United States Patent 10,766,935 (PLANT TRAITS CONFERRED BY ISOLATED POLYNUCLEOTIDES AND POLYPEPTIDES) - sequence listing, part 5

SEQ ID NO: 6402 - DNA, 622 bp, Daucus carota
tttaaaaccccgtcataaactccaagccccaatctgcgcttttggtttattttagggttccaaaaataccaaaacactctccgcagcagctgaatccatctttgcagcagcagccatggcgagcactaaagttcagaggattatgacccagcccatcaatctgattttcaggtttctccaaagcaaagcgcgcattcagatatggcttttcgagcagaaagatttgaggattgaaggcaggattatcgggtttgatgagtacatgaatttagtcctggatgatgctgaagaagtcagtatcaagaagaaaagcaggaaatcacttgggaggattttgctaaaaggagacaacattacattaatgatgaacacgggcaaatgataacctttggtgaattctatattgtcaccatagatgttttagctctacagacaattgtagtcctctgtcaacttatcggtttgtcattcagattttattgtgcatgaggtagaaacttgaattgtttcattattatggccttgtaatttaaacacaatgatgcactttctccaccctcccgtttactttctgtcggacatgtttgtgcacaccaccctctacttgttattaaaatttaaa

SEQ ID NO: 6403 - DNA, 654 bp, Daucus carota
tttcactttgattttttgctggcaacaacttttaccttgcagccatggcgagcaccaaagtccagaggattatgacccaacctattaatctgatttttaggtttctgcaaagcaaagcgcgcattcagatatggctttttgagcagaaggatttgaggatcgaaggcagaattatcgggtttgacgagtacatgaatttggtcctcgatgatgctgaagaagtgagtatcaagaagaaaagcagaaaatcgcttgggaggattttactcaaaggagacaacattacattgatgatgaacacgggtaaatgatgtcttttgatgaattctgttttgtcatcaaatgagatgtttcggctgtacgaaaggttgtcgccattcccctattagctatatgtttacatcattcagattttctaatacatgaggtagaaacacgaattactttgctattacgactttgtatttgaaagatatgttacttctgtattcttcttttctccctcccgccttacctgttggcatatatgtgcactatcctcaacaaattatgaaaaatatagttacctcttggagcctggactgctcttaccctttcatgattgtctttcctttttggcctagattcctcttcttactttctaagaaaacaaat

SEQ ID NO: 6404 - DNA, 704 bp, Daucus carota
accgagagcgagcccccttctaaaaccccgtcaaaaactccaagccccaatctgcgcttttggtttactttagggttccaaaaatcccaaaacactctcagcagcagctccagctgaatccatctctgcagcagcagccatggcgagcactaaagttcagaggattatgacccagcccatcaatctgattttcaggtttctccaaagcaaagcgcgcattcagatatggcttttcgagcagaaagatttgaggattgaaggcaggattatcggttttgatgagtacatgaatttagtcctggatgatgctgaagaagtcagtatcaagaagaaaagcaggaaatcacttgggaggattttgctaaaaggagacaacattacattaatgatgaacacgggcaaatgataacctttggtgaattctatatcgtcaccatagatgttttagctctacagacaattgtagtcctctgtcaacttatcggtttgtcattcagattttatttgtgcatgacgtagaaacttgaattgtttcaatattatggccttgtaatttaaacacaatgatgcactttctccaccctcccgtttactttctgtcggacatgtttgtgcacaccaccctctacttgctattaaaatttgaaaggtatgatggattttgaactgttgtccatgactaatatcattttatgatagttgcg

SEQ ID NO: 6405 - DNA, 810 bp, Manihot esculenta
gcaaattattcaaaacaaaatatctatttggttcagatttaaaaaaaaaaaaaaatctatttggttagaaaaataggacttattttgcctcttggctgaaatcgttctagggttttacttctctccaattcaactttctcttcgcccccggaatcctccagagctcatcaacatggctagtaccaaggtccagaggattatgacccaacccattaacctgattttcaggtttcttcaaagtaaagctcgcattcagatatggctttttgagcagaaggatcagagaattgaaggccgaatcattggctttgatgagtacatgaacttggttcttgatgatgctgaggaagtcaatgtcaagaagaaaaccagaaagtccttaggaaggattcttcttaaaggagacaatattactctgatgatgaacacagggaaatgatgtcacccggcaattatcgaggccgcgttgcgtttcaatctgggaggccttgttttgagctatgtagtgtgtagtgctacattaaacactaaaacatgcttttttggaccgactgtagggttaaatgtagttagatatgaatgttgaagttcaaatggtgatttgtctttttcaacttggcaatatccccaagtgttgcattaatattgcaatgcttggttggataagacatggacaatttgtacaatttgatgcatctttttggaggctggatgaaatatgctgctcctaattgctttgcataggtgctgtagatttcatgtgtgcatgcgtacgtgttgcagacttgtctatcatgtgaagatagattt

SEQ ID NO: 6406 - DNA, 413 bp, Castanea mollissima
gcagccatggcaagcaccaaagttcagaggattatgacccaacccattaacctgattttcaggtttcttcagagtaaagctcgcattcaaatatggctttttgagcagcgagacctgaggatcgagggccgtatcatcggctttgatgagtacatgaatttggtgctggatgatgctgaagaagtcaatgttaagaagaagagcagaaaatcattagggaggattcttcttaagggagacaacataactctgatgatgaactctggaaagtgatgatgattccaacaattgtgtaaattggcattatgatgcctgttcaatcacctggcagcgtagcatctctgtttactgacatgttagatacaatcttgaacatcaagaatgattgatgtaacatatgaatgattttctat

SEQ ID NO: 6407 - DNA, 739 bp, Citrus clementina
aagggttttgcagtaaacatctctgtgcacttgattttgcctcaacgtttctgaagggcaagcgtttgtcgaagcgaaggagcagcaccaagtaagcaagaagcaaccatggccagcaccaaagtccagaggattatgacacaacccattaatctgattttcaggtttcttcaaagtaaagctcgcattcaaatttggttgtttgagcagaaagatttgagaattgaaggccgtattatcgggtttgatgagtacatgaacttggttttggatgaggctgaagaagtttctgtaaagaagaagagcagaaaaccactaggtaggattttattgaaaggagacaatataactctgatgatgaatacgggaaaatgaggtggtgctggcttgtgcttgggttaccgtactgcttgcttgtgatttgggttaccatgctgcttatgtcaatgcatgttgctgggtccttccatttcaatgcctattgttattttgaattgtcctggggactaatgttactaaatggctatttgtattacagtttgtacaaatctattgtcaaatgtttgtggtaaatgattaactttacactagacagttatgttatccagaactaatatgaatgtttgttatgtacctgtatttcagattcttatatagtttgacagcggcttttgagacgaattttcgggtgtaagaagaacactcaattttaagaatttaaaacccattatgtcacatt

SEQ ID NO: 6408 - DNA, 489 bp, Cleome spinosa
ttcctcctcagttcgagctccagagaccctgaaagttcagcagccatggcgaccaccaaagttcaaaggatcatgacccagcccatcaacttgatttttaggtttcttcaaagtaaagctaggatccagatatggctctttgagcagaaagacttgaggatcgagggacgaattaccggttttgacgaatacatgaatttggtgctggatgatgcagaagaagtgaatgtcaagaagaagaccagtaaaacgctcgggaggattttacttaaaggagacaacataactctgatgatgaacacgggcaagtgaggactgtatcgacaaacctgcttgtattgccatcttggatgatggatgtgtagattcggcttccgggtttctgggaactctctagatgtttgatgttttcattcaccttaaacttgtgcttgacactgccagcatatcagattgtagtgacaactttgagattaaggaacctttgat

SEQ ID NO: 6409 - DNA, 515 bp, Cynodon dactylon
ccgggggtcttcgtcctgcagtcctgcctgccccccgagcgcggccgtccgagcttcaaacctcgccgcctccctcaactcaagctagggttttacccaacccatctcggtctcggcaggaccaagaccgtagagaggggaagccaagctagtcaaccatggcgtcgacgaaggtgcagaggatcatgacccagcccatcaacctcatcttccgtttcctccagagtaaagcgcgcatccagatctggctcttcgagcagaaggacctccggattgaaggcaggatcatcggctttgatgaatacatgaatttagtcttggatgatgctgaggagataaatgtcaagaaaaacaccaggaagactctgggtcggattctcttgaaaggagacaacattacactaatgatgaacacgggcaagtaacaacaacaacatttcattctgcatctggttgcacggactgctaccaagcttttgtgatatgagattttgagactgtagtagatatctttc

SEQ ID NO: 6410 - DNA, 680 bp, Solanum melongena
aaaatagtcccaaaattttaaaacagacgacactgcaagcccaaacccgaattcatctccggtaacgtaatacgagatttcaattcacaaataaagcagcaaggttttgctcgaactagggttttgcttgaggaaagagtaactcgtcggagaaacagcagcagcagcagcagcagccatggctagtaccaaagtacagaggattatgacccagcccatcaatctgatcttcagatttcttcagagtaaagctcgcattcagatatggctattcgagcagaaggatctgagggttgaagggcgtattattggtttcgatgagtacatgaatttggttctagatgatgccgaggaagtcaatgtgaagaagaatagcagaaagcagttagggcggattcttctgaaaggagataatatcacattgatgatgaacacggggaaatgatttcttgtcagctggatcttgggaagaagttcaatattttctagcaaaaatcaactattgtaacatttgtggacaaagagcagaatgttagacgaacatcgagtttgaacttccatttatgttttgctatatgtatatcagcattttatgctctgcactttttatacagtgaagaagagtgtagccgtttgacaccgtctctctctattgttggtagtatattttatattacagg

SEQ ID NO: 6411 - DNA, 844 bp, Eucalyptus grandis
agtgcatccagtttcagtttccctctttcaagtcagaatctctgcatcgccgtcgaatcgaagaaggggagaggcgaacagcagtccgcagccatggcgtcctcgaaagtgcagagaatcatgacccaacccattaatctgatcttcaggttccttcagagtaaagcgcggattcagatttggctgtttgaacagaaggatttgagaatcgaaggccgtataattggatttgatgaatacatgaatctggttttggatgatgccgaagaagtcaatgtaaaaaagaagaccagaaagactttagggaggatcttattgaaaggggataacataacgctgatgatgaacagcggcaaatgatcaataagaggggcagccacttcggtggagctgttgaggcggtggacccagaatatgtgggagttctatctttatatagtttcgatttcgatcatgtcgatctcctgaaaattaaacttgtattagtttgtacatgtatctgcatcggttactctttagtgctcttttgcggctgaaagtggttgctgaacttcagctcggattttgtagttaaatgggaagcaatgtctttgtcaagtaacaagcaagtctatctgtgcctgcctcacttaaatagttatgagtgaatagcattgcttcgccatgaatacaaggctagagttgtgtccaatgggtgtcgtcctcgttactaggaatttcattgttcattttgtagctattggcatttgacaactcaatagccattaggatgttggtgcatttcaaattgtatgtcttcttcatcagaccatttagatggaaggctcactcgtcacttagacat

SEQ ID NO: 6412 - DNA, 800 bp, Eucalyptus grandis
aaattttcccttcatgggctcggcccaaaaatcctcctaccgaccatccatccgctaggggttttcgcgttcctcctcttcttcttcttcttcttcttcagtgcatccagtttcagtttccctctttcaagtcagaatctctgcatcgccgtcgaatcgaagaaggggagaggcgaagagcagtccgcagccatggcgtcctcgaaagtgcagagaatcatgacccaacccattaatctgatcttcaggttccttcagagtaaagcgcggattcagatttggctgtttgaacagaaggatttgagaatcgaaggccgtataattggatttgatgaatacatgaatctggttttggatgatgccgaagaagtcaatgtaaaaaagaagaccagaaagactttagggaggatcttattgaaaggggataacataacactgatgatgaacagcggcaaatgatcaataagaggggcagccacttcggtggagctgttgtggcggtggacccagaatatgtgggagttctatctttatatagtttcgatttcgatcatgttgatctcctgaaaattaaacttgtattagtttgtacatgtatctgcatcggttactctttagtgctcttttgcggctgaaagtggttgctgaacttcagctcggattttgtagttaaatgggaagcaatgtctttgtcaagtaacaagcaagtctatctgtgcctgcctcacttaaatagttatgagtgaatagcattgcttcgccatgaatacaaggctagagttgtgtccaatgggtgtcgt

SEQ ID NO: 6413 - DNA, 541 bp, Euphorbia peplus
agcagcgtctttgttagggttctcgacgttcttcagttaaattctgatttcccccgagaatcttgagagctttacagccatggcgagcactaaggtccagcggattatgacccaacccattaacttgattttcaggtttcttcaaagtaaagctcggattcagatttggctgtttgaacagaaggattcacggattgaaggccgaatcattgggtttgatgagtatatgaatttggtactggacgatgctgaggaagtcaatgtgaagaagaagacgagaaaatctttaggaagaattttactcaaaggagacaatattacgctcatgatgaacacagggaagtgaagtcacctgggaactttatttggagctttcactgcttgtatttggaaatagaatttattcgtggtttgagcgggacttacttactttaggtggtaatataacaggatttgaatgaatttgcagctaatttagtgatgtatttttgtagctctacatttgcatactagattttatgcatataacatgtattagctt

SEQ ID NO: 6414 - DNA, 785 bp, Fagopyrum esculentum
aattcaagaggcggagaaaggataatccagacagccatggcgagcaccaaagtccagaggattatgacccagcccattaacctcatctttagatttctacaaagcaaagctcgtattcagatttggctgttcgagcagaaggatttgaggatcgagggtcgtatcattgggtttgatgagtacatgaatttaacactggatgatgccgaagaggtgaatgtaaagaagaaaacaaggaagtcactaggaaggatccttctgaaaggagacaatatcactctcatgatgaacacgggtaaatgataccttgatggtggaatggaatcgcactctgcttttgctcgtgtaacccaccggcaccaatttgctccttaatgtagttcagagcttccaccggtcgtagtctttattttcttatatgttcagtcttgcactcatctagctttcggctaccccaggactatgtcgttcggtttgcatatgcttcttcatgattggcactaggcctgggcgggtattggaagtttggaagtctatggccagtgattatgttcaagatggatattggttttcaaacaatcaatacaagtacatactcggcggtcgttgccctttgcgtgtgttggatgggataagccattatgttaggccaagtacattccaattgccaagtaaaatactagcaaatgctttacagtagttatatgtaaactctcacaatggctgccatacaggagaaaaagagagcataaaaccattcaattgaaagccataagcatcatagg

SEQ ID NO: 6415 - DNA, 558 bp, Fraxinus spp
tgtattgcaagaaaggagcagagcaaccaagttcagcagccatggcgagcacaaaagtccagaggatcatgacccaacccattaatctcatcttcaggttcctccagagcaaggctcgtattcagatttggcttttcgagcagaaggatacgaggatcgaaggccgcatcatcggcttcgatgaatacatgaatttggttctggatgatgctgaggaagtcaatgtgaagaagaatagcagaaagcaactcggtaggatccttctaaaaggggataatataacgttgatgatgaataccgggaaatgatgctaaaagattaaaaacgcaatagctgaatgctaaaggagactggccagtaatgggttcctcagatttctggaagcgagtttgtaggacaaggccttgtttagttagattccatcttaaacaactttatttggtattttatttgtatcacatcgttgtttcttgttttggtgccttctgtgtatacatttgtgtcttgttccaaggactgctggctagcacctgaaaatgggagtgaggtaaattgtta

SEQ ID NO: 6416 - DNA, 825 bp, Panax ginseng
gcagtggtatcaacgcagagtacatgggggagactagggttttctgtgagaagtaaataaggaagaaggaaaataatctgttgcagaggcgtagtcggagtcagccatggcgagcactaaagtacagaggatcatgactcaacccatcaatctcatattcaggtttcttcaaagtaaagctcgcatacagatatggctttttgagcagaaggatttaaggattgaaggacgcatcattgggtttgatgaatatatgaatctggttcttgatgatgccgaggaagtcagtataaagaagaagagcagaaagcaactgggtaggatcctactgaaaggcgacaacatcacactgatgatgaacacggggaaatagggacgatcagttgttatggttcatgtatggacattatatggtgtatttgcataagcaatggaaacagatttgtgtaatttctaatgtcacttattctgataatgatcttttaggcaaaattatcacttctgtattaattgctcgaacttggtagttgtgttcttgataagcctgtacctcaaccgacaaccagtgcctattggttgctcgtatatatgtttcctttttaccccttcccgctgtaaatgttggagtataacttatcaagcttgatgattaaggtggtgtttgattacattttcacaatctatttcttattcgctaagaggcattaagttgtttggttaaaaaaaaaaattccctttgaatgtttttaacgtataatcgataagatagaaaattaaatttaaactattaaaggtagagtgtgaacgaaattgactattatttgg

SEQ ID NO: 6417 - DNA, 712 bp, Actinidia deliciosa
ggattcggcgaacatggttcccgacaccgacagggcccaaatagagagcccaaactttccagtcgagtgggcgattattgtgtaaggtcgagtgtaccgttgcgttccgttacaaaacaaaacgcgatatctagggttttatcatacgtctgctgtcttttgctctgcaaggttttctgaaggagacgactctgcggccgacccagaaagcagccatggcgaccaccaaagtccagaggatcatgacacagcccatcaatcttatcttcaggttccttcaaagcaaagctcgcatccagatatggcttttcgagcagaaggactcgaggattgaagggcgcattattgggtttgatgagtacatgaatttggttctggatgatgctgaggaagtcaatgtaaagaagaagagcagaaaggctttggggaggatccttcttaaaggggacaacatcacgctgatgatgaacactgggaaatgatgatgtgattttaatgatgcatggagtgatggcttgttttgcttgcttagctatgaggcagatgtaataagatttcaggatatctcttctgatagttatatgtaacctggagactaaagtaggagttagatgcttaggctttgtattgctgttcaccttcctgctatgtcaagggtagtggaaaaaagaataggaaaattgcaactttcatattagtcgctaccgacata

SEQ ID NO: 6418 - DNA, 579 bp, Quercus alba
gatataaaaccgtccctaaagttattttacattagctttctctctttctctgtgagtgtcgaattttgcagaaccgcagccatggcaagcaccaaagttcagaggattatgacccaacccattaacctgattttcaggtttcttcagagtaaagctcgcattcagatatggctttttgagcagcgagacctgaggatcgagggccgtatcatcggctttgatgagtacatgaatttggtgctggatgatgctgaagaagtcaatgttaagaagaagagcagaaaatctttagggaggattcttcttaagggagacaacataactctgatgatgaactctggaaagtgatgatgattccagcaattgtgtaaattggcattatgatgcctttccaatcacctggcagcctagcatctctgtttactgacatcttagatacaatcttgaacatcaagaattgttaatgtaacataggaatgattttctatccatcgagtaagatacattggccctgttgctcttttacattgtctatcctgccttgtttctaataatttctgcttcatctgcattttttag

SEQ ID NO: 6419 - DNA, 630 bp, Olea europaea
gtgttgcattggaaggaaagaaattttttggcgccggagctcccaaattcagcagccatggcgagcacaaaagtccagaggattatgactcaaccaattaacctcatcttccggttcctccagagcaaagctcgtattcagatttggcttttcgagcagaaggacgcgaggatcgaaggccgcatcattggctttgatgaatacatgaatttggttctggatgatgctgaggaggtcaacgtcaagaagaatagcagaaagcaacttggtagaatccttctgaaaggagataatataacgttgatgatgaatacggggaaatgatgctaaaggattaaaaatgcaataggtgaaatccagaggcgactggctagtaatgtgtacctcagatttctggcagcgagtttgtatgagaatgccttgtttagttaaattctattttaaacaactttatccggtattttaattgtatctcatcactgtttctcagtcgagccttctctgtatacatttgtgtcttgttcaatgaactgctagctagcacttgaaaataggaatgaggtaaactgtttcttattttttacatgtctctacatgttgaaactaatcgtgagaggagttttttggttt

SEQ ID NO: 6420 - DNA, 518 bp, Olea europaea
gcacccaagttcagcagccatggcgagtacaaaagtccagaggatcatgacccagcctattaatctcatctttaggttcctccagagcaaaactcgtattcagatttggcttttcgagcagaaggatacgaggatcgaaggccgcatcataggcttcgatgaatacatgaatttggttctggatgatgctgaggaagtcaatgtcaagaagaagagcagaaaacaactcggtaggatacttctaaaaggggataatataacgttgatgatgaatacggggaaatgatgctaaaagattaaaaatgcaatagctgaatgctaaaggagactagccagtgatgggttcctcagatttatggcagcaagtttgtacgagaaggccttgtgtagtttgattcaatcttaaccaactttatttgctattttatttgtatctcgtaattgtttctcttcagagccttctgtgtttacatttgtgtcttattccaataactgctggctagcacctgaaaatggga

SEQ ID NO: 6421 - DNA, 738 bp, Citrus sinensis
aagggttttgcagtaaacatctctgtgcacttgattttgcctcaacgtttctgaagggcaagcgtttgtcgaagcgaaggagcagcaccaagtaagcaagaagcaaccatggccagcaccaaagtccagaggattatgacacaacccattaatctgattttcaggtttcttcaaagtaaagctcgcattcaaatttggttgtttgagcagaaagatttgagaattgaaggccgtattatcgggtttgatgagtacatgaacttggttttggatgaggctgaagaagtttctgtaaagaagaagagcagaaaaccactaggtaggattttattgaaaggagacaatataactctgatgatgaatacgggaaaatgaggtggtgctggcttgtgcttgggttaccgtactgcttgcttgtgatttgggttaccatgctgcttatgtcaatgcatgttgctgggtccttccatttcaatgcctattgttattttgaattgtcctggggactaatgttactaaatggctatttgtattacagtttgtacaaatctattgtcaaatgtttgtggtaaatgattaactttacactagacagttatgttatccagaactaatatgaatgttgttatgtacctgtatttcagattcttatatagtttgacagcggcttttgagacgaattttcgggtgtaagaagaacactcaattttaagaatttaaaacccatgatgtcacatt

SEQ ID NO: 6422 - DNA, 573 bp, Petroselinum crispum
cagccatggcgagcactaaagtccagaggattatgacccaacctattaatctgatttttaggtttctccaaagcaaagcgcgcatacagatatggctttttgagcagaaggatttgaggattgaaggccgaattatcgggtttgacgagtacatgaatttagtcctggatgatgctgaagaagtaagtatcaagaagaaaagcagaaagccacttgggaggatattgcttaaaggagacaacatcacattgatgatgaacacgggtaaatgatatattttggaaaattctaccttgtcatcaaatgagatgtttcgtctgtatgaacggttgtcatcgtccctccgttggcttatttgtttacatcatccagattttctcgtacatgaggtagaaacatgagggatttctgttatggccttgtatgttaatgatattttacctttttattctcctttcctcctgctctattcgtttggcatgtatgtgcactaccctcgaaatattgcgaaaattttaatgatctgctggaacttggaagggttgccctgacttcttcatgatagttgtgcct

SEQ ID NO: 6423 - DNA, 724 bp, Petroselinum crispum
ctgtagaaaagtgaagccccaagtcgaagccgcgctttttgttttgttagggtttatatacacacatacatatagcagcagcagctggaggaggctatcaatttggtccatcgcttggggtgagaaaaaggcagatcgatatttacagcatcagccatggcgagcaccaaagtccagaggattatgacccagcccattaacctaatttttaggtttcttcaaagcaaagcacgcattcagatatggcttttcgagcagaaggatttgaggattgaaggccgaattatcgggtttgatgagtacatgaatttagtcctggacgatgctgaagaagtcagtatcaagaagaaaagtagaaaaccacttgggaggatcttgcttaaaggagacaacattacattgatgatgaacacgggtaaatgatatattttggaaaattctaccttgtcatcaaatgagatgtttcgtctgtatgaacggttgtcatcgtccctccgttggcttatttgtttacatcatccagattttctcgtacatgaggtagaaacatgagggatttctgttatggccttgtatgttaatgatattttacctttttattctcctttcctcctgctctattcgtttggcatgtatgtgcactaccctcgaaatattgcgaaaattttaatgatctgctggaacttggaagggttgccctgacttcttcatgatagttgtgcct

SEQ ID NO: 6424 - DNA, 699 bp, Petroselinum crispum
ctgtagaaaagtgaagccccaagtcgaagccgcgctttttgttttgttagggtttatatacacacatacatatagcagcagcagctggaggaggctatcaatttggtccatcgcttggggtgagaaaaaggcagatcgatatttacagcatcagccatggcgagcaccaaagtccagaggattatgacccagcccattaacctaatttttaggtttcttcaaagcaaagcacgcattcagatatggcttttcgagcagaaggatttgaggattgaaggccgaattatcgggtttgatgagtacatgaatttagtcctggacgatgctgaagaagtcagtatcaagaagaaaagtagaaaaccacttgggaggatcttgcttaaaggagacaacattacattgatgatgaacacgggtaaatgatatctttggccaattctattttgtcatcggatctgttggttggctattcaaatgattgtcgtccgtctgttagcttatcagtttgcatcgttctgattttctcgtacatgagggagaaactcgatttagttgtttgttatggccttgtaatattaaatatatgttgcttatctctttcctttcttttcatcgtttgacaggcatgtatgcgcactacccttgacatattatgaaaagtttaatgatacattggaagtcggaaatgttgacctcgac

SEQ ID NO: 6425 - DNA, 720 bp, Lippia dulcis
agtaaagtcctaaaagcgctttcagcagtgagtaaaagacaatagaaacctccgaacccttgctagggtttctgcaggaggaggaagaaagacgagaagaaaaacagcgctagaattttttttgccgcagcgaccatacaagctgcagccatggcgagcactaaagtccagcggattatgacccaacccattaacctgatcttcaggtttcttcagagcaaagctcgcattcagatatggctttttgagcagaaggatctgaggattgaaggccggattattgggttcgacgagtacatgaatttggttttggatgacgccgaggaggtgaatatcaagaagaacagcaggaagcagcttggtaggattttgctgaaaggggataatatcactctgatgatgaacactgggaagtgaggctcgaaacaggctaaacgtgtaatgattaaatcctaacgaggctggctcttagaagttctgtattgctgctggcccaacttcatgtgaatccgactcttttaaacttactttctctaggtttatttttctatctcatgactgttatgtatccccttccttatcctactttttaatgtgttttaatctcgtgtaccaagaattgcaagtacttgaagttggatttcaggtaaagtagatttttttccccgcgtggctgtggccaacagttatatcacgggagatgaattcagcaaaaaagaa

SEQ ID NO: 6426 - DNA, 1122 bp, Populus trichocarpa
ctatcgttttgtcgtccagctctttgtaacaagccaatcgtaccaaacagtccccccctctctcgtgaacgctctctaaaggccgtgtggtttagggtttaaacgtctctacaattacactagtctgtgcccaaaaatcctcgagagcttcacagccatggcgagcaccaaagtgcagcgtattatgacccaacccattaacttgattttcaggtttcttcaaagtaaagctcgcattcagatttggctttttgagcagaaggacttgaggattgaaggccgaatcattgggtttgatgagtacatgaatttggttttggaagatgctgaagaagtcaatatcaagaaaaagagcagaaagtctttaggaaggattcttcttaaaggagacaacattactctgatgatgaacacgggaaagtaatggtcattcctggttctttaagtggaggttcagtggaacagctttgggtatcaaatattagtaggttattaatgaaaagaatgttcatgcaatgaatgtgtctttgcacttgacttggcaatgtatgcttgctttagatatttttcgtgcatgcatttttgtatctaatttgcaaacccctggcatgtcaattttcagccactttttagaaatcttgatgacatggcctccatgtgatgggtgtaggtagggtattcacaagcttaccccggtaaattgcgttgcttgcttgttatggttcacaggttcaggttgcagtggttgcgcttgcttcttttttggttttttggtcctcccttttgaatggcgtgctgttttttattggataccatgccactgtgagacctctcacagtttaatgtggattgttttggtcatcgctctttttttcttctcaattgaatctttttgtggttaaagtgatggtcaattgcttgttatttgccaagataggcaagaatgaaagataaaagaaccaaagtggacaaagcatggaaaataggtggcaatttaaaagtttatgcaaaaattttagtttggtcctactttttaatttctaaatatttggttcttttagttttttaaaattcaattttattttaaaattttatttattttattttttaatttctagtttg

SEQ ID NO: 6427 - DNA, 741 bp, Populus trichocarpa
actctcgaagttgtgtacgctcccccctccccccctgccggccttgtggtttagggttttaacgtctctacaatgttttacttgtctgtgccccaaaaaccctcgagagcttcacagccatggcgagcaccaaagtccagcgtattatgacccaacccattaacttgattttcaggtttcttcaaagtaaagctcgcattcagatttggctttttgagcagaaggatttgagaattgaaggccgaattattggctttgatgagtacatgaatttggttttggaggatgctgaggaagtcaatatcaagaaaaagagcagaaagtctttgggaaggattcttcttaagggagacaatattactctgatgatgaacacgggaaagtaatggtcattcctggttctttaagaggaggttgagtggaacagctttgggtaacaaacattagtaggttatgaatgaaaaaaatgttcttgtaatgaggtgtgtctttacatttgacttgacaatgtaacatctctatcgtaagaattgctattaattatcttggtgcttgtcagcgttaccaatattttatcagatgtactgatgtatgggaaccaagaaatgtattatgctctgcactgttttcttttcaagcctggtgaagtagcttcacagttcttgtgtgcatgcattttgtatttacaaaatctgggcatgtgatttttcagccatatttcagaacattgaaatcttgatg

SEQ ID NO: 6428 - DNA, 760 bp, Solanum tuberosum
tatcgaattccatcaggcagaggacgagacagaacgcagaaaaaggtttgagtctaactagggttttgcttgaagaagagtaactcgtcggagaaacagcaacagcagcagccatggctagcaccaaagtacagaggattatgacccagcccattaatctgatcttcagatttcttcagagtaaagcgcgcattcagatatggctatttgagcagaaggatcagaggattgaaggacgtattattggttttgatgagtacatgaatttggttctagatgatgccgaggaagtcaatgtgaagaagaatagcagaaagcagttagggcggattcttctgaaaggagataatatcacattgatgatgaacacggggaaatgatttcatgttagctggatcttgtgaagaagttcgattttttctggcaaaaatcaactattgaaacaacaagtctttgtggacaaggagcaggatgttagacgcaaatcattgagtttgaagttccatttatgttttgatatatgtatattcagaatggtatgctcagacctctttatacagtgaagaagagtagccttatgaccatttctctctatgttggtagtattgtagtcacaattatattgcaggtaaagaagtgtgttaacttgagaaattaagtattactatgggattttcatgtctaacatgccaagttatggcacttgtggtgcataactaaatttacatgtgattcattctcaatgttatcgttacaaatt

SEQ ID NO: 6429 - DNA, 710 bp, Primula obconica
ctctctctctgtgcgtgtcctgcaaccatggcgagcaccaaagtgcagcgtattatgacccaacccattaatctgatcttcaggtttctccaaagcaaagcgcgtatccagatatggttgtttgagcagaaagacttgaggattgaaggccgtatcattggcttcgatgagtacatgaatctggttttggacgaggctgaagaagtaaatgtcaagaagaaaaccagaaaagcacttgggaggatattgctcaaaggcgataatattactttaatgatgaatacgggcaagtgaggattagctgggcattcaattatggtcgctctcgtcacttgaaggctctttttgctgcttttttaatttatttattatggaatataaatgtgtcatgaacatctcttaagattttgttgactagtttcatacattttaacccttttgctgttcttgttttctgccttgtactactctgagatagtttctagctctaaacaagtcaaattctgtagcaaccccatttcatctcctgcaagggtcttcgtttctaacaaaaatcaagttatttatggtacgactttttctgtgagattttcattgttttaagtgataaactgagttattcggcctctcattatagttttattgatgtattctattttgttgatggggcatgaaacaatttctcaaagataagatgagttgtgttgagt

SEQ ID NO: 6430 - DNA, 716 bp, Chenopodium quinoa
gtcgaatatttccaccaattcaggcccttaacaattttagattccgaggttttaattatatcaactcaactcaccactctattgaagggttttcttcttcgtcgtcttctttctcaaattcgctaattagggttttagcagcaaaatcaattttcgcaaatctgcagcaaatttcaatttctaagcagcaacaatggcgagcaccaaagttcagaggattatgacccagcctatcaacttgattttcaggtttcttcaaagcaaagctcgtatccagatttggctgtttgagcagaaggatgcgaggattgaaggccgtataattggatttgatgagtacatgaatttggttctagacgatgcagaagaggtgaacgttaaaaagaagaccagaaaatcccttgggaggatcctgctgaaaggagacaatatcactctgatgatgaatacgggaaaatgagacccagctgatttgcatttgttcacaagtattaaaattccaaactgctcatccgccttagaagttttgtgcatattaatgtagtatgtacttcacgcattctcctctgttccgtatagttaatatgtgggttgatgaatatgaagtagtggatttgactaatgtgttcgtttgtgtttaatagaatttcttatagttgagttccttgtggtgcaatccaatctggggcaattttctatgctctaccagtttatgt

SEQ ID NO: 6431 - DNA, 704 bp, Chenopodium quinoa
tcgtcgtcttctttctcaaattcgctaattagggttttagcagcaaaatcaattttcgcaaatctgcagcaaatttcaatttctaagcagcaacaatggcgagcaccaaagttcagaggattatgacccagcctatcaacctgattttcaggtttcttcaaagcaaagctcgtatccagatttggctgtttgagcagaaggatgctaggattgaaggccgtatcattggatttgatgagtacatgaatttggttttagacgatgcagaagaggttaacgtcaaaaagaagaccagaaaatcacttgggaggatccttctgaaaggagacaatatcactctgatgatgaatacgggaaagtgaggaccagctgatatgcatttggtcaaaaatattaaatttgcaaactgctcacctgccttggaagttttgtgtattaatgtaggatgcccttctagcattcccttgtatagttgaatacttcgtatgaagtggatttgacggatgtctttgttcgtgtttaatagaatttcatatggttgagtttctagtggtagaatccaatttggggcaattttctctgctttaccagtttatgtatgtctatgatttattggagatgtctcgagtcataagctcatagcatgctcaaagtaatctgacactaggatttgataatttgaatctcttgaattctgtatactc

SEQ ID NO: 6432 - DNA, 711 bp, Chenopodium quinoa
gggttttcttcttcgtcgtcttcgttctcaaattcaattagggttttagcagcaaaaccaattttcgcaaatcagcagcaaattcaatttcgaagcagcaacaatggcgagcaccaaagtccagaggattatgacccaacctattaacctgattttcaggtttcttcaaagcaaagctcgtatccagatttggctgtttgagcagaaggatgcgaggattgaaggccgtataattggctttgatgaatacatgaatttagttttagacgacgcagaagaagtgaatgtcaaaaagaagaccagaaaatcacttgggaggatccttctgaaaggagacaatattactctgatgatgaatacgggaaaatgagacccagctgatttgcatttgttcaccagcattaaatattcaaactgctcatccgccttaaaagttttctgcttattaatgtaatatgtacttcaaggccttcccctctgttccgtatagttaatgtgtagtttgataaatatggagttgtgagttgtgactttgacgaatgtcttcgtttgtgtttagtagaagttcttttagttgaggtcctggtggtgtaatccaatatggggcaattttttatgctctaccagtttatgttacagaagagggctctttccagataactgtgttaatgattaatcaaaatgtggtgactgtgatttctgatagcaagc

SEQ ID NO: 6433 - DNA, 768 bp, Chenopodium quinoa
gggggggggccctatcccctcgtgtgcccttgcctcccacgactctcaaattcaattagggttttagcagcaaaaccaattttcgcaaatcagcagcaaattcaacttcgaagcagcaacaatggcgagcaccaaagttcagaggattatgacccagcctatcaacttgattttcaggtttcttcaaagcaaagctcgtatccagatttggctgtttgagcagaaggatgcgaggattgaaggccgtataattggatttgatgagtacatgaatttggttttagacgatgcagaagaggtgaatgtcaaaaagaagaccagaaaatcacttgggaggatccttttgaaaggagacaatatcactctgatgatgaatacgggaaaatgaggcccagttgatatgcgtttgttcagaactgttaaatttgcaaactgatcaccgtcttagaagttttgggtgtgtattaatgtaggcatgtccttcaagcattcacctgtatagttgaaatgtagtttgatgaatactttgtatgaagtagtggatttgatggatgtcttcgttcatgtttaatccaattagggacaattttctctgcgctacctgtttatgttacagaagagggttgtttccagaagactatgtttatgatttattggagatgtctgagagttataagctcatagcatgctcaaagtcattgacaccaggattttataatttaaatctcttgaattctgtatactcccctgtttcttaatatctaagcc

SEQ ID NO: 6434 - DNA, 798 bp, Solanum phureja
ccgaattcatatttgtatatgctacggcattaggcgccatttcgattcacggcttagggtatttgctagggtttagctgctttccttgagactgaaaaaggagcttagttgatcggagaaacaggaatttcagccatggctagcaccaaagttcaaaggattatgacccagcccattaacctgattttcaggtttcttcagagcaaagctcggattcaaatatggctttttgaacagaaggatctgaggattgaaggacgtatcattggttttgatgagtacatgaatttagttctggatgatgctgaggaagttaatgtgaagaagaaaaccagcaagcagttggggcggattcttctgaaaggcgataatattactctgatgatgaactcggggaaataatttcttgtctgttggagtaggaaagttggtggcatcttgtacgtgttcaccagatgcaaattgaaaccatgtgacctcatgaatgacagaattgcatggccctgactttcatttagtgtgtgtatgttgatgtaggtaaaatatttgacatggtttcattgaaccaaatgctttgattgttgtatgaatgtctattcatgacataagatccgggctcctctccattcctgtgttagttgatggcttgactactagcgccaaaggaagtgtatatttttccaagtttttgttggtcgagtataactccacattattatcatttgaaccatgcttgtcagctacctaccatgactgttgcgccacccactctcgtctctcaaactatactagttgtgc

SEQ ID NO: 6435 - DNA, 835 bp, Solanum phureja
aaatggttctacttacgcaaatagacccaaaatttaaactaacgacaacgcaagcccaaacccgaattcatctccggtaatgtaatgcgacatttcaattcacaaatagcaaggtttgagtctaactagggttttgcttgaagaagagtaactcgtcggagaaacagcaacagcagcagccatggctagcaccaaagtacagaggattatgacccagcccattaatctgatcttcagatttcttcagagtaaagcgcgcattcagatatggctatttgagcagaaggatcagaggattgaaggacgtattattggttttgatgagtacatgaatttggttctagatgatgccgaggaagtcaatgtgaagaagaatagcagaaagcagttagggcggattcttctgaaaggagataatatcacattgatgatgaacacggggaaatgatttcatgttagctggatcttgtgaagaagtttgattttttctggcaaaaatcaactattgaaacaacaagtctttgtggacaaggagcaggatgttagatgcaaatcattgagtttgaagttccatttatgttttgatatatgtatattcagaatggtatgctcaagacctctttatacagtgaagaagagttgccttatgaccatttctctctatgttggtagtattgtagttgcaattatactgcaggtaaagaagtgtgttaacttgagaaattaagtattactatgggattttcatgtctaacatgccaagttatggcacttgtggtgcatgactaaatttacatgtgattcattctcaatgttatcgttacaaattcatcag

SEQ ID NO: 6436 - DNA, 551 bp, Euphorbia esula
gaagccagatagcagcgtctttgttagggttctcgacgttcttcagttaaattctgatttcccccgagaatcttgagagctttacagccatggcgagcactaaggtccagcggattatgacccaacccattaacttgattttcaggtttcttcaaagtaaagctcggattcagatttggctgtttgaacagaaggattcacggattgaaggccgaatcattgggtttgatgagtatatgaatttggtactggacgatgctgaggaagtcaatgtgaagaagaagacgagaaaatctttaggaagaattttactcaaaggagacaatattacgctcatgatgaacacagggaagtgaagtcacctgggaactttatttggagctttcactgcttgtatttggaaatagaatttattcgtggtttgagcgggacttacttactttaggtggtaatataacaggatttgaatgaatttgcagctaatttagtgatgtatttttgtagctctacatttgcatactagattttatgcatataacatgtattagctt

SEQ ID NO: 6437 - DNA, 333 bp, Tabernaemontana elegans
gcaaccatggcgagcacgaaagtacagcggattatgacccaacccatcaatctgatcttcaggtttcttcagagcaaagcgcgcattcagatttggctttttgagcagaaggatctgaggattgaaggacgcatcatcggatttgatgagtacatgaatttggttttggatgatgctgaggaagtcaacattaagaagaagaccagaaagcaactgggaaggatacttctgaagggtgacaacatcaccttgatgatgaacactggaaaataatttctgcgtagaatatctatctatcttgatgatggtgtaaccatggaaaaatgattcttg

SEQ ID NO: 6438 - DNA, 554 bp, Tabernaemontana elegans
gggtagggttttagctgcatctctgcgtcgaagcttgaccaaaaggactcagacagcaatcgagcgagcaacagcagtcagcagccatggctagcacaaaggttcagaggattatgacccaacccattaatctcatcttcaggtttcttcaaagcaaagcacggattcagatttggctttttgagcagaaggatttgaggattgaaggacgcatcattggttttgatgagtacatgaatttggttctggatgatgctgaggaagtccacataaagaagaagagcagaaagcaattaggcaggatacttctcaagggggacaacatcaccttgatgatgaacactgggaagtaatgcccatgacctcgacttattgattgcggacggaaagtaaattttaacatcaagtggagttgcatatccaattgtcaagaacatccattgtattgatgatgtaacctgaggagtagccttctattaatgcacacttgtatgtgtgaaagtctttatgagtactgtagtccatgttataattttgggaagtgatgtgagttg

SEQ ID NO: 6439 - DNA, 453 bp, Tamarix hispida
ggggatagcagttgacgccattgtcagagggagggagcgagagacacagagaggcagagggcaaaatcagcgtgcgggaaactcagcaaaaatggcgagcaccaaagttcagaggatcatgacccaacctatcaatctaatatttaggtttcttcagagtaaagctcgaattcaaatttggcttttcgagcagaaggacttgaggatcgagggccgtatcattggtttcgacgagtacatgaacttggtgttggatgaggctgaagaggtcaacgtaaagaagaaaactagaaagtctcttggaaggattcttcttaaaggagataatatcactcttatgatgaacacggggaaatgatgagctaccttgtggttacagtaggaagtttttctcaagtttcttccgtgtaagtctgtctgtaatcgattgtcatggaagatcgaatatttctg

SEQ ID NO: 6440 - DNA, 734 bp, Solanum lycopersicum
caaaatttaaacttaacgacaacacgagcccaaacccgaattcatctccgggtaatgtaatgcgacatttcgattctcaaatagcaaggcttgagacttttgagtcaaactagggttttgcttgcagaagagtaactcgtcggagaaacagcagcagcagccatggctagcaccaaagtacagaggattatgacccagcccattaatctgatcttcagatttcttcagagtaaagctcgcattcagatatggctatttgagcagaaggatcagaggattgaaggacgtattattggttttgatgagtacatgaatttggttctagatgatgccgaggaagtcaatgtgaagaagaatagcagaaagcagttagggcggattcttctgaaaggagataatatcacattgatgatgaacacggggaaatgatttcctgttagctggatcttgagaagaagttcaattttctggcaaaaatcaactattggaatgtcgtctttgtggacaagaagctggatgttagatgcacatgattgagtttgaacttccatttatgttttgatatatgtatattcagcatggtatgctcagatctctttatacagtgaagaagagtagccttatgaccatttctctctatgttggtagtaacaattatatcgcaggtaaagaattgtgttaactcgagaaatcaagtgttactatggatttttcatgtctaatatgctttttta

SEQ ID NO: 6441 - DNA, 435 bp, Triphysaria pusilla
aaactctctgcagcggagcacagaagccgcagccatggctagcacgaaagtccagcggattatgacccagcccattaacctgatcttcaggtttcttcagagcaaagctcgcattcagatatggcttttcgagcagaaggatctgaggattgaaggccgaattattgggttcgatgagtacatgaacttggttttggatgaagctgaggaggtcaatgttaagaagaagagcaggaagcaactgggcaggattttgttgaaaggggataatataactctgatgatgaatactggaaattgatcttccaaaacaggctattattagtccaatgttcgaatcttgacgaggcttgctccgtatgaatcgagctcttttagaatctattttcccgcagactcttgttttctatcatgttattgctatttcttctcctt

SEQ ID NO: 6442 - DNA, 658 bp, Triphysaria pusilla
aattgttagggtttacttttttcagcaagagaaaaagagcactttgaaaaactctctgcaaggaagcacacaagccgcagccatggcgagcacgaaagtccagcggattatgacccaaccgatcaacctgatcttcaggtttcttcagagcaaagctcgcattcaaatatggcttttcgagcagaaggatctgaggattgaaggccgaataattgggttcgatgagtacatgaacttggttctggatgaagcggaggaggtcaatgtcaagaagaagagcaggaagcaactcggaaggattttgctgaaaggggataatataactctgatgatgaatactggcaattgatgctcagaaacaggctattattagcccaatgactgaatcttgaagagcctcgctactagtgacttgattccttcgtatgaattgttctcttagaatctatgccctattctatcctatcattgtcatttcttctccttatcctacttttatatgtatttagtgtcatcagtcatgtaagaatcgttactatttcaaacctgggtattggttaaaatagtaaaattgttcggtagagcttctgcagacagtttattgtattatcagattattgaatcgcgctgtttttattccgatgctatcattggtttc

SEQ ID NO: 6443 - DNA, 553 bp, Triphysaria pusilla
aaactctctgcagcgaagcacacaagccgcagccatggcgagcacgaaggtccagcggattatgacccaaccgatcaacctgatcttcaggtttcttcagagcaaagctcgcattcaaatatggcttttcgagcagaaggatctgaggattgaaggccgaataattgggttcgatgagtacatgaacttggttctggatgaagctgaggaggtcaatgtcaagaagaagagcaggaagcaactcgggaggattttgctgaaaggggataatataactctgatgatgaatactggcaattgatgctgagaaacaggctaatattagtccaatgactgaatcttgaagaggctcgctactagtgacttgattcctccatatgaatttttcttttataatctatgtcctgttctatcttatcattgttatcatgtatcaagaatcattactacttcaaactgggtattagttaaaataggaaatttgttcggtagagcttctgcaaacagtttattgtattatcagattattgtatcgcgtgaggttttattcaaa

SEQ ID NO: 6444 - DNA, 574 bp, Valeriana officinalis
tgtgcggaaggagacgatcaaacttagcaacaatggcgagcactaaagtccagaggattatgacccagccgatcaatctgatattcaggtttcttcagagtaaagctcgtattcagatttggcttttcgagcagaaggatctgagaatcgaaggacgaattattgggtttgacgagtatatgaatctggttcttgatgatgccgaggaagtgagcataaagaagaagagcagaaagcaacttgggaggatcttgttgaaaggggacaacatcacactgatgatgaacaccggcaagtagggatggaggcagtgggtttttcatccatcgacaatattttgttgtggagacgtgtttaagtgcaacagattacatatgtaatttctagacgtctaaactaggattttgtttgttaattttctcgcttcttaccttctatgcccatctcctttgatgccttttttgcgttgtttttaccttatgtgttgtattttcatttgatttactagtaaattttaccatctacagacagtttctcagtgagaggatcttttcaaatagagaattggttgttt

SEQ ID NO: 6445 - DNA, 625 bp, Valeriana officinalis
tgcggaaggagacgatcaaacttagcaacaatggcgagcactaaagtccagaggattatgacccagccgatcaatctgatattcaggtttcttcagagtaaagctcgtattcagatttggcttttcgagcagaaggatctgagaatcgaaggacgaattattgggtttgacgagtatatgaatctggttcttgatgatgccgaggaagtgagcataaagaagaagagcagaaagcaacttgggaggatcttgttgaaaggggacaacatcacactgatgatgaacaccggcaagtaggaatggaggcagtaagtttttcatccaccggctcttttgtggagacatttaagtgcaacagatcatatatgtaatttccagacgtcaaatctaggattttgtgtgctaattttcttattactcatcttctatgcgtatctcctttgacgccttgtttctgtccttgtttacttataagtgttgtattgcaattcgatttagcgctaaatttttactttctgcagatagttcctcaaacgacaggtgcttttctaatcgaaaattggctgtttagtgcaaaattgtatactccgtacttgattttgtctcgatataattcagaggttac

SEQ ID NO: 6446 - DNA, 426 bp, Oryza sativa
cgcagcctagggtttgcccccctctcctccttccagaagcttctagacgctcgtggggggagcatccgccgccgcagcagccatggcgtccaccaaggtccagcgtatcatgacccagcccatcaacctcatcttccggttcctccagagcaaagcgcgcatccagatctggctgttcgagcagaaggatctccggattgagggccggatcattggctttgatgagtacatgaatttggtccttgatgatgctgaggaaatcaacgttaagaaggatactaggaaatcattgggtaggatactattgaaaggcgataacataactctgatgatgaacactgggaagtgaattttctccccaaggttggcgtttgtgactttgtgtcgattagtcccgtgatactttgtactccatctagataatca

SEQ ID NO: 6447 - DNA, 803 bp, Spinacia oleracea
agttctttatttccagagggtactattcaggggttttagcagagcagagcaatttcgaaacagcaaccatggcgagcactaaagttcagcggattatgacccagcctatcaacctgatattcaggtttcttcaaagcaaagctcggattcagatttggctgtttgagcagaaagatgcgaggattgaaggccgcataattggctttgatgagtacatgaatttggttttagaagatgctgaagaggtgaacgtcaaaaagaagaccagaaaatcacttgggaggattcttctgaaaggagacaatattactctgatgatgaatacggggaaatgatacacatggctgatgtgcatttgttcagaagtattgaaattgttggcctggaagctatgacaaactgctgacccgacatagtagccttttatgcgtaaaacatactgattaatggtgtctgcgtcaagcattcccctcctctccgtattagctgaaatgtagttaaagtgaatattaagtagtggatttaattgatttcttcggtcatatgtaaaagtattaagtttcttatggttgaggctcctggtggtgctttccattttggggcttttctctctgttctattagcttatgttacagaagagggtatattcaagtgaaccctgtttgtgatttatcattttatccgattgtggagattatgatatctcgtaccaatctcaaagcagtcgagtagttgacccagcaggtgttaatcttcctatgattgtcctcttgatgaatgcattttgctttactagtaaaaaa

SEQ ID NO: 6448 - DNA, 462 bp, Amsonia hubrichtii
gaatcggagcaggatctgcaagcagcaaccatggcgagcacgaaagtacagcggattatgacccaaccgatcaacctgatcttcaggtttcttcagagtaaagcgcgcattcagatttggctttttgagcagaaggatctgcggattgaaggacgcatcatcgggtttgatgagtacatgaatttggttctggatgatgctgaggaagtcagcattaagaagaagaccagaaagcaattgggaaggatacttctcaagggcgacaacatcaccttgatgatgaacactggaaaataattgctttgttcgattagaatatctattctgacgatgggtgtaatggattttattctaattcattgcgttatgtaaacaatactttcaaattattctggtggcaatgtttgtgttagtgagaattctgttatgaattcaatgcatgccaaccctttcttggggaaa

SEQ ID NO: 6449 - DNA, 584 bp, Musa acuminata
ctcgacggagcctagggtttcaaaccagtcgagtcgggagaggaagcgaacaggggaaaggtagagagaggtccgactccgagggagaagcagcgatggcgtccaccaaagtccagcggattatgacccagcctatcaatctcatattcaggttcctccaaagcaaagctcgcatccagatatggctctttgagcagaaggatttgaggatcgaggggcgtatcataggctttgatgaatacatgaatttggtcctggaagaagctgaagaagttaatgttaagaagaaaacaagaaagccactggggaggattctgttgaagggagacaacataaccttgatgatgaatacgggtaaatgattatatgccattgttgggttatttggctggtgccagcatccctaggttagacttcagagaccatgtagcttcaacttttgtattggcaaattctgtatggcttttttaactgaatgtgtgagatggtaaatgtttctctaggatgttataagcattctaattaatgcaactgtaataggtcaaagatatgttgaatgtgaagtttgcaggctttgggagaat

SEQ ID NO: 6450 - DNA, 1388 bp, Ocimum basilicum
tctagggttttgctaggctagagaggtcgagggaaccggagcgcgacgaaattctctcagcactttagtcgaccccaagcagcagccatggcgagcacgaaagtccagcgtattatgacccaacccattaacctgatcttcaggtatcttcagagcaaagcgcgcattcagatttggctgtttgagcagaaggatctgaggattgagggcaggattattgggttcgacgagtacatgaatttggtgttggatgatgctgaggaggtcaacatcaagaagaacagcaggaagcagctcggtaggattttgttgaaaggggataacatcactctgatgatgaatactggcaagtgatgatgggatgcaggctcaacgacatgcaaatggactagcttctcatggttgtattggaatgacttggtctacattcatttctttaggatccccttttgcttatccggtttttctttcacccccaactccaatctctctaacctttcctactttttacatgtatgcaaatgtagtgtacttaagagttactagtatttggagttggatatcatgtaaagaagataatttgcttgaatatggatatatttcagagttggaagattcaccagaatttgattctttgatgtgatacagttggagttcactttaattgtagccttgttatgtatctatctagctgcagaagtaggaccaaactaatgagctgaattacatttgattatcctatccagagactgttaggtggcctttgaacacatattattctgtaatcacacacttgctgtctatagcaaatagcaggcattattatattgaggtggagcatgaaatgtttgtctatttactgatagcctacttaaatttgttgagaatcttttattatggtccagacatatcacactagtgcaagctaaattcatttcctacctcttctttttacctctttcatcacatgccatgttttcttcaatccgtgtatttcttgacaacaatgacgcacgcttcttttttaaaaaatcaggtttgacccgtttctgtattatgggaaaagggctcttgaaactcatgctgttttagtccattgcattcagttccatactagtgctttgtcagtgtgggggactgtttctaattattacgagtcatgaggggagaattgaaggaagagttgaggggagaattggagggcttcgaggagatgcgagcagacttcgaggccttccgttctcagtttatggctaactataggcctcctccgtcgtagtgacttatatttcatatttacaattcgtactggtgttgactacttgactgttagtttacgatattagactacttgtcttctagactttgtatgacttctatgtagtttg

SEQ ID NO: 6451 - DNA, 639 bp, Ocimum basilicum
gcagtttagtcgaccccaagcagcagccatggcgagcacgaaagtccagcgtattatgacccaacccattaacctgatcttcaggtatcttcagagcaaagcgcgcattcagatttggctgtttgagcagaaggatctgaggattgagggaaggattattgggttcgacgagtacatgaatttggtgttggatgatgctgaggaggtcaacatcaagaagaacagcaggaagcagctcggtaggattttgttgaaaggggataacatcactctgatgatgaatactggcaagtgatgatgggatgcaggctcaacgacatgcaaatggactagcttctcatggttgtattggaatgacttggtctacgttcatctccttagaatccacttttgcttagcgggtttttctttcaccttcaattccaatctctccaagttctcattttcctacttttacatgtatgtgaatgttgtgtactaagaattattagtatttggagttggatatcgtgtaaagaagagaatttgcttaaacctggttatattgcagagttggaagatcaaccagaatttgattcgtcacagttgttcactttgattggagccttgttatgtagctttctagctgcaaagtaggtc

SEQ ID NO: 6452 - DNA, 614 bp, Bupleurum chinense
atatacatacagctatctgttgctgttcataagttgggtgtgaaattgcagtaagcagtaagatctatcgagtttgcagccatggcgagcaccaaagtccagaggattatgacccagcccattaacctgatttttaggtttctgcaaagcaaagcgcgcattcagatatggctttttgagcagaaagatttgaggatagaaggcagaatcattggatttgatgagtacatgaatttagtcctagatgatgctgaagaagtgagtatcaagaagaaaaccagaaaatcacttgggaggattttgcttaaaggagataacattacactcatgatgaacacgggcaaatgatatctcttggcaaattctatctcgtcatcaaacgtgacaattcagctgtgtgaacgatttttcgttgtctctctgtcagattagttgtttacatcattcagataatcaattattctagtacaagaggtagaaacttcaactgttactttgttatggccttgtaatttcaatgatatgttgcttctttgtttttcattccctcactctatatcctttgtctggcgtatatgtgcactattctcgacttatcatcaaaaattttgagt

SEQ ID NO: 6453 - DNA, 644 bp, Catharanthus roseus
aaacaaagcactgttgctcttattccagctagggtttaggtttttctgctcctcttcgtgtcgaagctttgcgaacaacagcaaccatggcgagcaccaaagttcagaggattatgactcaacccattaatctcattttcaggtttcttcaaagcaaagctcggattcagatttggctttttgagcagaaggatttgaggattgaaggacgcatcattggttttgacgaatacatgaatttggttctggatgatgctgaggaagtccacatgaagaagaagaccagaaagcagctagggaggatacttctcaagggggataacatcaccttgatgatgaacactggaaaatagcgtcccggccttgctaatcacagattgagagtaaattttagcatatcaacaagtggagttggggatttgtaattttccatttaatgcacagctctatatgtgaaagtctttttgagtattgtagtagcccattctgtaattttaagaagcgatgtgaagtgaaaaacaaaaggatagctatcttggtaattttgcttcatagtacttgtggttggcttggatatgcatggttgataacaagcatctcaacttgatttggattgaagttaagggtgcatttggattggattt

SEQ ID NO: 6454 - DNA, 433 bp, Cyclamen graecum
catcatctgcaacaatggcgagcaccaaagtccagcgtattatgactcagcccatcaatctgatattcaggtttctccagagtaaagcacgtatccagatttggctgtttgagcagaaggacttgaggattgaaggccgtattatcggtttcgatgaatacatgaatttggttttggacgaggctgaagaagtcaacgttaagaagaaaactagaaaagcacttgggaggattttgctcaaaggggataacattactctcatgatgaatacggccaagtgaaggttaagctatgggcaatcatcatggtcgctctcgtcacttcaaggctctttttgctattgctatcatggaatataactgtcatgaatctgtcttatactttctattgttaatcttgtagcgccccgtaatctctagtatggacttactga

SEQ ID NO: 6455 - DNA, 431 bp, Cyclamen graecum
ctctggcgactgcagccatggcgagcaccaaagtacagcgtattatgactcaacccatcaatttgatcttccggtttcttcaaagtaaagcacgtatccagatttggctgtttgagcagaaggacttgaggattgaaggccgtattatcggtttcgatgaatacatgaatttggttttggacgaggctgaagaagtcaatgttaagaagaaaactagaaaagcacttgggaggattttgctcaaaggggataacattactctcatgatgaatacggccaagtgaaggttaagctatgggcaatcatcatggtcgctctcgtcacttcaaggctctttttgctattgctatcatggaatataactgtcatgaatctgtcttatactttctattgttaatcttgtagcgccccgtaatctctagtatggactt

SEQ ID NO: 6456 - DNA, 307 bp, Cyclamen graecum
atggcgagcaccaaagtacagcgtattatgacccaacccatcaatctgatattcaggtttctccaaagtaaagctcgtatccagatttggttgtttgagcagaaggacttgaggatcgaaggccgtatcatcggctttgatgaatatatgaatttggttttggacgaagctgaagaagtcaatgttaagaagaaaactagaaaagcactggggcggattttgctcaaaggggataacattactctgatgatgaatacgggcaactaattaatcagtgggcactcgtcatggtcgctctcatcacatg

SEQ ID NO: 6457 - DNA, 465 bp, Euonymus alatus
agactacagacggcagaagcactgagggacggcttcgctgactaggtttaaagcttcttcgcgttttcaacgtagtcggagaccgagaaacctagagattggcagccatggcgagcaccaaagttcagaggattatgacccaacccattaacctgattttcaggtttctccaaagtaaagctcgaatccagatttggctatttgagcagaaagatttgaggatcgaaggccgaataataggttttgacgagtacatgaatctggtcctggatgatgctgaagaagttagcattaagaagaaaagcagaaagcctttaggaaggattcttctcaaaggagacaacataactctgatgatgaacacgggagtgtaaattctctggccagctgcgaatatgttgccattctaatcacttggatgttgatgaatgttaatttgattataattcctggattcaatatacg

SEQ ID NO: 6458 - DNA, 597 bp, Fagopyrum esculentum
taaagttcaaagtttctactcattctctctcactccgcttcagccatttcaaagcacaggcatcagagagaagaacgagctttttgcagaattcgcagccatggcgagcactaaagtccagaggattatgacccagcctattaatctcatcttcagatttctgcaaagcaaagctcgtatccagatttggctgtttgagcagaaggacatgaggattgaaggtcgcattattggattcgatgagtacatgaacttggttcttgaggatgctgaagaagtgaatgtaaagaagaagaccaggaagacactagggaggattctattgaaaggagacaatattactctcatgatgaacacggctaaatgatctcctatgcattgctcgtggtagtaatctctttgtcgctgttgtgtagttcttaaatctcctttgaacttggacaatctgtccgaaagatattgtgaatgctccgagtgcgtgatatagttattgttcgatgagctttgtgtcaacagtactatcttgttgcttaacatcatgtaactcttaacacactgctgacttttgaagtgatagcttgagttatatcttctgtt

SEQ ID NO: 6459 - DNA, 678 bp, Fagopyrum esculentum
taaagttcaaagtttctactcattctctctcactccgcttcaaccatttcacagcacaggtatcagagagaagaacgagctttctgcagaattcgcagccatggcgagcactaaagtccagaggattatgacccagcctattaatctcatcttcagatttctgcaaagcaaagctcgtatccagatttggctgtttgagcagaaggacatgaggattgaaggtcgcattattggattcgatgagtacatgaacttggttcttgaggatgctgaagaagtgaatgtaaagaagaagaccaggaagacactagggaggattctattgaaaggtgacaatattactctcatgatgaacacggctaaatgatctcctatgcactgggcttttgctcgtggtagtaatcccttgtcgctgttgtgtagttcgtaaaactcctttgaacttagacaatttgtccgaaagatattgtgaatgctttgagtgcgggatatagttattgttcgacgagctttgtgtcaacattactattttgttgcttaacatcatgtaactcttaacgcactgctgacttttgaagtgatagctcgagttatatcatctggtttctacaaaaaaaaagaaaaacaaaaactaaactcgcgtgtatacacctgctcttgagacgcgcgacgacgaca

SEQ ID NO: 6460 - DNA, 601 bp, Fagopyrum esculentum
tttaaagttcaaagtttccactctttctctctcacttcgcttcaagcatttcaaagcacaagcatcagagagaagaaacgagctatttgcagaattcgcagccatggcgagcaccaaagtccagaggattatgacccagcctattaatctcatcttcagatttctgcaaagcaaagctcgtatccagatttggctgtttgagcagaaggatatgaggattgaaggtcgcattattggatttgatgagtacatgaacttggttctcgaggatgctgaagaagtgaatgtaaagaagaaaaccaggaagacactagggaggattcttttgaaaggagacaatattactctcatgatgaacacggctaaatgatctcctatgcattgggcttttgctcgtggtagtaatcccttgtcgctgttgtgtagttcttaaaactcctttgaacttagacaatctgtcggaaagatattgtgaatgctttgagtgcgggatatagttattgttcgatgagctttgtgtcaacagtgctattctgttgcttaatgtcatgtaactcttaacgcactgctgacttttaaagtgatagcttgagtaatatct

SEQ ID NO: 6461 - DNA, 630 bp, Setaria italica
cgcctccccccgctcgcagtcgcaggtctagctagggtttggtctccccgccccgccgcgcgcgctcctcacctccagaagcttccagacgctcgaaggaggagctcccgccgccgcatcagccatggcgtccactaaggtccagcgtatcatgacccagcccatcaacctcatcttccggttcctccagagcaaagcgcgcatccagatctggctgttcgagcagaaggacctccggattgagggtcgcatcattggctttgatgagtacatgaacttggtccttgatgatgctgaggaaatcaatgttaagaagaacattaggaaatcattgggtaggatactcctgaaaggtgacaacataactttgatgatgaacactggcaagtgaagggggtagatgtttggcgcctagtatccttgagacatttgtactccatcgaggctgaaatgtagcatgtcattgtgcgtgagacattgtacccttctatccagactgaaaatgtagcttgtcattatggaagtgagatagttgtccttgttgactacctggggttaactctgtgagctactgctagatgtgataatgagctgctcacttgtggtctgaatatcaacatgacttgtgtg

SEQ ID NO: 6462 - DNA, 909 bp, Panax ginseng
accgcctgcaaatatcataggaagcagtggtatcaacgcagagtacatggggaaacactacttcttagttcaagaatttttaagggttttagacaaaagagtaacaaaagctttccgcatctccttcaacttctgcccgtaaagtgaagcagagggagagagcacttgaagtttgcagccatggcgaccaccaaagttcagaggatcatgactcaacccattaatctgatcttcaggtttctccaaagcaaagcgcggattcagatatggcttttcgagcagaaagatttgaggattgaaggccgaattataggattcgacgagtacatgaatctggttttggatgatgcagaagaagtcagtattaagaagaaaagcagaaaatcacttggaaggattttacttaaaggagacaacattactttgatgatgaatacgggaaaatgatgatcttcagttctactctcatggttacatgtgtaataatgttacaattgtatgaaaggatgtcattatgatggctctatcagattatttaatggcttacatatttcagattttctagtacatcaagtagaaacttgaattgttactttacacttggcttaatttttgtgatacttggatttttttgggtgcactagcagtagtgataatttaaacacttcctggatgctgtccttggtgatagttttttctagtattgttaatagatcaacatgaagaattcgtggctgcagcttcttaaattaatcactattcgtgtagttcactaacgaaaaaaaaaaaaaaaaagaaaaaacaaaaaaaaagtagtacgtagggaggagaacggagaacacaagggaggtagagagggaggggtcagatacgtggaagcgggtaggaggggggggagctggggggggg

SEQ ID NO: 6463 - DNA, 611 bp, Panax ginseng
tcaacgcagagtacatggggaaacactacttagttcaagaatttataagggttttggacaacagagtaacaaaagctttccgcatctccttcaacttctgtccgtaaagtgaagcagagggagagagcacttgaagtttgaagccatggcgaccaccaaagttcagaggatcatgactcaacccattaatctgatcttcaggtttctccaaagcaaagcgcggattcagatatggctttttgagcagaaagatttgaggattgaaggccgaattataggattcgacgagtacatgaatctggttttggatgatgcagaagaagtcagtattaagaagaaaagcagaaaatcacttggaaggattttacttaaaggagacaacattactttgatgatgaatacgggaaaatgatgatcttcagttctactctcatggttacatgtgtaataatgttacaattgtatgaaaaggatgtcattatggctctatcagattatttaatggcttacgtatttcagattttctagtacattaagtagaaacttgaattgttactttacacttggcttaatttttgtgatacttggatttttttgggtgcactagcagt

SEQ ID NO: 6464 - DNA, 579 bp, Panax ginseng
tatcaacgcagagtacatggggagaagtaaataaggaagaaggaaaataatctgttgcagaggcgtagtccgagtcagccatggcgagcactaaagtacagaggatcatgacccaacccatcaatctcatattcaggtttcttcaaagtaaagctcgcatacagatatggctttttgagcagaaggatttaaggattgaaggacgcatcattgggtttgatgaatatatgaatctggttcttgaggatgctgaggaagtcagtataaagaagaagagcagaaagcaactgggtaggatcctactgaaaggcgataacatcacactgatgatgaatacggggaaatagtgacgagcagttgttatggttcatgtatggacataatatggtgtatttgcacaagcaatggaaacagatttgtgtaatttctaatgtcacttattctgataatatgattgttttaggcaaaattatcacttctgtattaattgctcgaacttggtagttgtgttcttgataagcttgtacctcaaccgacaaccagtgccaattggttgctcgtatatatgtttccttttta

SEQ ID NO: 6465 - DNA, 522 bp, Panax ginseng
agaggcgtagtccgagtcagccatggcgagcactaaagtacagaggatcatgacccaacccatcaatctcatattcaggtttcttcaaagtaaagctcgcatacagatatggctttttgagcagaaggatttaaggattgaaggacgcatcattgggtttgatgaatatatgaatctggttcttgaggatgctgaggaagtcagtataaagaagaagagcagaaagcaactgggtaggatcctactgaaaggcgataacatcacactgatgatgaatacggggaaatagtgacgagcagttgttatggttcatgtatggacataatatggtgtatttgcacaagcaatggaaacagatttgtgtaatttctaatgtcacttattctgataatatgattgttttaggtcaaaattatcacttctgtattaattgctcgaacttggtagttgtgttcttgataagcttgtacctcaaccgacaaccagtgccaattggttgctcgtatatatgtttccttttta

SEQ ID NO: 6466 - DNA, 671 bp, Heritiera littoralis
gcttctcagttccttcttaaaagcaagtgctctcaattgtaagctagggtttaagggctcacctactcaaacctttcgacaaacaggaaaaacgcggtcgagtttgtcacagccatggcgagcaccaaagtccagaggattatgacccaacctatcaacctgatcttcaggtttctccagagtaaagctcgcattgagatttggctgtttgagcagaaagatttgaggattgaaggccgaatcattggatttgatgagtacatgaatttggttctggatgatgctgaagaagttaacatcaagaaaaagagcagaaagtcattaggaaggattcttcttaaaggggacaatataactcttatgatgaatagtggaaagtgatgatcatcccagcggttatgtggactatcgttataagtcttctcagtttcctgtagatcaagtcacttgctctactgtgctacctttaaaacatccttcaactttcgtgtattatgtaagtcgtattaaagaagttgcttcctatgtttcagacagttactggtgcttgcttagtttattcaaatgattgatatgtacgattaagccctcggatctgcactaatgtttagatttttgattaagtcagcttcagaaaatctttattggcttttgtggcctgcttttcttag

SEQ ID NO: 6467 - DNA, 466 bp, Hevea brasiliensis
aattcggcacgagctctctttgcccccggaacccgcgagagctcatagccatggcgagcaccaaggtccagaggattatgacccaacccattaacctgattttcaggtttcttcaaagtaaagcccgcattcagatatggctatttgagcagaaggatatgaggattgaaggccgaatcattggctttgatgagtacatgaatttggttcttgatgatgctgaggaagtcaatatcaagaaaaaaaccagaaagtctttaggaaggattcttcttaagggagacaacattactttgatgatgaacacagggaagtgatgttcattgggcaattgagactgcattgtgtttcaatttcaaaggcttggaagttagagctatgtagcgtgtagtttctatattgaacattaaaacatgcttttttggactgagttcgggtcataaacgtgggtaggatatgaatgatg

SEQ ID NO: 6468 - DNA, 757 bp, Carpinus betulus
tacgttccttttaggtgacagaaaccctttctcattttctcctccttcagtcagtgccccgaaaacacgcacacacatcagaagaggaactggctaaagccctctcgtctccaacggctggtctctgaactacaattggatctgttcggtggaaaaagactctttggtttagggttctgcacttctttgactccaaatctgcgtaacaagtaaaaacaatcgaattctgcagccatggcaagcaccaaagttcaaaggataatgacccaacccatcaacctgattttcaggttccttcagagtaaagctcgcattcagatatggctttttgagcagcgagacctgcggattgagggccgaatcattggctttgatgagtacatgaatttggttctggatgatgctgaagaagtccacatcaagaaaaagagcagaaaaactttagggcggattcttcttaagggagacaacataactctgatgatgagcacgggaaaatgacgatgattccagcaattatgtatattggcattgtgttgccttttgaattatatggaggtcaatcatcttttctttactgtaatgtcagataggtatggacatcatgtatggttagtcaacttatgagaattttaggcagatgcacgatgagtatactttttagtcagtgagacctacttattcggtattggcttcggcactaaaatctttggtttgtgatgtactgacaaattacttgccaagaaatattaatttt

SEQ ID NO: 6469 - DNA, 679 bp, Jatropha curcas
gcgggggaaagagaagggagagaggaaacaaagaccctcatcttgcttcagtcgatccttgacggaatctttgctcagggtttaaggagtgcttgcgattgttgcagctatggcgagtactaaggtccagaggattatgacccaacctattaacctgattttcagatttctccaaagtaaagctcggatccagatttggctttttgagcagaaagatttaaggatcgaaggtcgaattataggttttgatgagtacatgaattcggttcttgacgatgctgaggaagtcaatgtcaagaaaaagaccagaaagtctttaggaaggattcttctcaaaggagacaatattactctgatgatgaactcaggaaagtgatggtccccttgggttgcagttgctttctgatggaaagtttgggacatgtagtgtattggacacagctttttttgggattactggagttaaatgtaggtgggttcgcatgtgaagttaaaatactttaagctgtaatgtgacttggtactcgacccggaaataccactaattgttgcaactaatacatgacattgttatgcttgtcgggatgatcttttgtgagatgtacaagtatcgtgaactatattgtatgtaattcatatttcctagtagaagtatactggtagctttgtttgtgtttgc

SEQ ID NO: 6470 - DNA, 646 bp, Nicotiana benthamiana
aactaggtttttgcttcattccgtgagatcagagaggaagagtgactcgtgagagaaacaggagtagcagccatgactagcaccaaagtacagaggattatgacccaacctattaacccgatcttcaggtttcttcagagtaaagctcgtattcagatatggctatttgagcaaaaggatctgaggattgaaggacgtattattggctttgatgagtacatgaacttggttttagatgatgctgaggaagtcaatataaagaagaaaagcagaaagcagttggggcggattcttctgaaaggagataatatcacattgatgatgaacacgggaaaatgatttcttgtcagccggatgttggaagaagtttgaattttttggtaaaatcaactattgaaacagttgggttgtggacaaggagcatgatgttggacgcataaacttgattttggactttcatttgctttttgctatttgtaaattcctcatggtttccttgagtctaaatgtctaatactccatgactgtcatggctctgacctctttatatagtgaggtctatttacgagtaattatatgaaagaagatgcttgatgccctagctatcggctcccaagtcagaagtgccttctgctgcactgttgtg

SEQ ID NO: 6471 - DNA, 426 bp, Ananas comosus
catcatctgcaacaatggcgagcaccaaagtccagcgtattatgactcagcccatcaatctgatattcaggtttctccagagtaaagcacgtatccagatttggctgtttgagcagaaggacttgaggattgaaggccgtattatcggtttcgatgaatacatgaatttggttttggacgaggctgaagaagtcaatgttaagaagaaaactagaaaagcactggggcggattttgctcaaaggggataacattactctcatgatgaatacggccaagtgaaggttaagctatgggcaatcatcatggtcgctctcgtcactttaaggctctttttgctattgctatcatggaatataactgtcatgaatctgtcttatactttctattgttaatcttgtagcgccccgtaatctctagtatggac

SEQ ID NO: 6472 - DNA, 723 bp, Oryza sativa
gagagccgcgtagcgagagacaaaaacccctctcgtcctcctcccgccgccgccgtctcgacctcgcagcctagggtttgcccccctctcctccttccagaagcttctagacgctcgtggggggagcatccgccgccgcagcagccatggcgtccaccaaggtccagcgtatcatgacccagcccatcaacctcatcttccggttcctccagagcaaagcgcgcatccagatctggctgttcgagcagaaggatctccggattgagggccggatcattggctttgatgagtacatgaatttggtccttgatgatgctgaggaaatcaacgttaagaaggatactaggaaatcattgggtaggatactattgaaaggcgataacataactctgatgatgaacactgggaagtgaattttctccccaaggttggcgtttgtgactttgtgtcgattagtcccgtgatactttgtactccatctagataatcagagaatgaaatgcatgtagcatgtcatcgtcatcgtcctcaattgaggatatgtaacggctgttagcaacctatgaactctgtgaactctaggcaaggttgttgagataatgagttgctcacttgtgtgtttaagattcctgatcccgtgaatcaatcctgctcacttataacacggacaattggagcaattcttgttgtacctcgtcttcttcccgtatctatgttatagat

SEQ ID NO: 6473 - DNA, 503 bp, Sorghum bicolor
gcgcgcctccagaagcttctagacgttccgaggaggaggaggggaggctcccgccgccgccgcagccatggcgtccaccaaggtccagcgtatcatgacccagcccatcaacctcatcttccgtttcctccagagcaaagcgcgcatccagatctggctcttcgagcagaaggacctccggattgagggtcgcatcatcggatttgatgagtacatgaacttggtcctcgatgatgctgaggaaatcaacgtcaagaaaaacactaggaaatcactgggccggatactcctcaaaggtgacaacataactttgatgatgaacactggcaagtgaagattcttatggcaggaatgatgtttggtgcacgcgttgagtatctgtgacacattgtactccatccatccagacttaaatgtatcatgtcattatggtttagtgagagttgtattggctgttaactacctgagtaacctcatgtgttagctatatgctacatgctgtg

SEQ ID NO: 6474 - DNA, 716 bp, Saccharum officinarum
atctcgccgaccgccgccctcggctctagcctgcccagggcgaaacaaaaccctcctccctcgttcgccgcctcgctcgcagacgcgtctagctaggttttggtctcgccgccccgccgcgcacgcctccagaagcttctagacgctccgaggaggaggaggggaggctcccgccgccgcagcagccatggcgtccaccaaggtccagcgtatcatgacccagcccatcaacctcatcttccgtttcctccagagcaaagcgcgcatccagatctggctgttcgagcagaaggacctccggattgagggtcgcatcatcggattcgatgagtacatgaacttggtcctcgatgatgctgaggaaatcaacgtcaagaaaaacactaggaaatcactgggccggatactcctcaaaggtgacaacataactttgatgatgaacactggcaagtgaagattattatggcaggaatgatgtttggtgcacgcgttgagtatctgtgacacattgtactccatccatccagacttaaatgtatcatgtcattgtggttaagtgagagttgtattggctgttgactacctgagtaaactcatgtgttagctatatgctagatgctgtgacaatgagctgctcagtgttcacttgtgttccaaagattagcccgacctgtgtgagccatgttgacatcttttcttgtttcatactcagcttt

SEQ ID NO: 6475 - DNA, 574 bp, Panicum virgatum
aaactgcaaactcaacgaagcactcttcccttccattgccgtctcgactcgcgacgagcttggcctccaaaccccgtcctgcctgagcctcccctccgctagggttttccccgccatctcgtgtggaccaagtagcgcgcggcgcaaggaggaggagcgcgcccgccatggcgtcgaccaaggtgcagcggattatgacccagcccatcaacctcatcttccgcttcctccagagcaaggcgcgcatccagatctggctcttcgagcagaaggacctgcggattgaaggcaggatcatcggatttgatgaatacatgaatttggtattggatgatgctgaggagatcaacgtcaagaaaagcaccaggaaatctctgggccgcattctcttaaaaggagacaatatcacgctaatgatgaacacggggaagtagcgtcagttcacagcgcatctgattgcaaggaccagtagttatcttggaatgtgaaatttgaggctgtagtggatttatcatccccctttgtgctcatctaaacctgattgcaatatatctccaggatggttcagtaaaac

SEQ ID NO: 6476 - DNA, 440 bp, Tripterygium wilfordii
tcaacgtcgttggagaccgagaaaccctagagagtagacattgacagccatggcgagcaccaaagttcagaggattatgacccaacctattaacctgattttcaggtttctccaaagtaaagctcgaatccagatttggctctttgaacagaaagatttgaggatcgaaggccgaatcattggttttgacgagtacatgaatctggtcctggatgatgctgaagaagttagcattaagaagaagagcagaaagcctttaggaaggattcttctcaaaggagacaacataactctgatgatgaacacgggagcgtaaattctcacgctaggtgtttagcaagctgcgaatatgttgccattccaatcccttggatgttgataaatgttaacttgatgtacttcctggatgtaatatactattttccattgaatatgttttc

SEQ ID NO: 6477 - DNA, 710 bp, Tripterygium wilfordii
ttctgaaattcctattcgacctagacatcgtcactgaccaaggtacacttcgaggcttcgacagccatggcgagcactaaagttcaaaggattatgacccaacccattaacctgattttcaggtttctacaaagcaaagctcgcatccagatttggctcttcgagcagaaagatttgagaattgagggccgaataattggttttgatgagtacatgaatctagtcctggatgaagctgaagaagtcagcattaagaaaaagagcagaaagactttaggaaggattcttctcaaaggagacaacataacgttgatgatgaacacgggaacataattgccatcatatccataagcagagtgccttgtgtcaatcacttggatatcgatgtatttttgctgctgctatattggtttgcttcccgaattctatatgctaattagtattggatgtgattatgtgtactcatgtattatataggaagtttatgcattctgatatctaagccaggggctgcccatggaaacttctccaagccaattagtgacaccactgttccaaattggatcttttgttccatattagctttgtgaaatgggctactatcaatttgctcaaacaataggatttcttcccctgattctcaaataccaacactttgtgagaggaggatatctctccacaactctgttatcatttagtgtagtcccgtt

SEQ ID NO: 6478 - DNA, 505 bp, Vaccinium corymbosum
gcacaagagagaagatttcccaaatctcaccagtcgcggcgtctagggtttttgctttcaaggtttttctgaaggagacgactctgtggccgacgatagcagcagccatggcgaccaccaaagtccagaggatcatgacacaacccatcaatctcatcttcaggttccttcaaagtaaagctcggatccagatatggctgtttgagcagaaggacttgaggattgaagggcgtattattgggtttgacgagtacatgaattggttctggaggatgctgaggaagtcaatgtaaagaagaaaagcagaaaaggctttggggaggatccttcttaaaaggggacaacatcacgctaatgatgaacacggggaaatgaagatggatttttcgatggtgcatggagtagcagcttgacgaagcagattattaagacagtcaacttttcttctaatgattgtgtacctaagactaaaatgtaaagaaagaacttaataatggatagcttt

SEQ ID NO: 6479 - DNA, 653 bp, Cucurbita pepo
cttttagttcgaagcatcggtctctggacgtgaagtggaagtgctctagggtttacatttcgtatcgaagattctcccactgccaaaacaaattcggtagccatggcgagcaccaaagttcagaggattatgactcaaccgattaacttgatattcagatttcttcaaagtaaagctcgtattcagatttggctatttgagcaaaaagccttaggatcgaaggccgaattattggatttgacgagtacatgaatttagtcttgatgatgctgaggaagttaatgttaagaaaagagtaaaaagcactcgggaggattcttctcaaaggagacaatataacgttaatgatgaatacgggaaatgatgatcatccagcaaccacattattgagatagttttcacttccatcgtatggcgttatagcttttacaatcatcttccttttggagttgtatctttcaacattttaatccatcgatgatcaactagttattatttggatgtataatgttatttcgtctgttggtagataatatcctttaattttattcgtccttataaccggttgtttattcatctaatccttgaaattaatggaactaagggcgtccttgaatcgtaaactaataaataggtggaggcatcgtttgtag

SEQ ID NO: 6480 - DNA, 481 bp, Scabiosa columbaria
ggcgagcagttagggtttcaatttcatcatacacaacaaaactcgcaagtctacggtagggtttttgatcgcaagctttgcaaggagacagacaaaaaagcagccatggcgagcactaaagttcagcggatcatgacccagcctatcaatctcatattccgattccttcaaagcaaagctcgcatccagatatggctttttgagcagaaggatctgaggattgaaggccgtattattgggttcgacgagtacatgaatctggttcttgatgatgctgaggaagtcagtataaagaagaagagcagaaagcaacttgggaggatcttattgaaaggggacaacatcacactgatgatgaacaccggaaaacaaggttagggtggagttgtgtttcagtgattgacagtacgtgacgaagacttgtagcggcagagattatgtatgtaattccgaatgaaaatttgcagatgtattgtggatg

SEQ ID NO: 6481 - DNA, 639 bp, Valeriana officinalis
ctccctctccctccgacgatcacgcagcttgtcgacttccatcccgactcgactgaggttttgttcttgctgctggaaggaaaaatggcgagcactaaagttcagaggattatgacccagcccatcaatctgatattcagatttcttcagagtaaagctcggatacagatatggctgtttgagcagaaggacctgaggatagaaggacgtattattggattcgacgagtatatgaacctggttcttgatgatgctgaggaagtcagcataaagaagaagagcaggaagcaacttggaaggatcttgctgaaaggggacaatatcacgctcatgatgaacactggaaagcaaggatgatccagtaaatttgagcaggaaagctacctggtttttatgtggactaaagaaacaattctgttaaaattgcctttagatgaatatatgcgcacttgtagtgcttgattaagttcgagcaggatcatgtcaaaattcaatgacactacaggcatattttccgtgtttaattgaatctgatatcgcaattgttgccaatctgggcagagttatgtgcagtgagttttaaaacttatgtaaccagttttcttttggaaccacattaaagtaaaatactgatcacta

SEQ ID NO: 6482 - DNA, 515 bp, Euphorbia peplus
gattccaactaatttctgtttccccccggaactgttacagcttcagccatggcgagtacaaggtccagaggattatgacccaacccattaacttgattttcaggtttcttcaaagtaaagctcggattcagatttggctgtttgagcagaaggatacgagaattgaaggccggattattggctttgatgagtatataaatttggtactagatgatgctgaggaagtcaatgtcaagaagaagaccagaaaatctttaggaagaattcttctcaaaggagacaatattactctgatgatgaacacagggaagtgaggtacgtgggaactgtatgctgcaatcctttcacaggcatggaagtttgagtgaagcagcgtttattgcatatgttaagaaatactggtacatgctttgactggggcttgtggtggtaatatagtcaggatattaatgaatttaaaatgcttgtaatgagatattcttaattgacatggcaatgtgatcaaagtttgcacc

SEQ ID NO: 6483 - DNA, 768 bp, Elaeis guineensis
gtctgtatgtagacatgggtgtttttttcgtgaaacaactattgtatttaaaactcgagtcacctccccttacagtcccttcaagccacctcccccgctacctagggttttatcaacgttcctatcgatctcccgccagagccaagagagaaggggaagagctcgcggaagccaaagaagaggcagccatggcgtccaccaaggtccagaggatcatgacccaaccgattaatcttatcttcaggtttcttcaaagcaaagcacgcatccagatctggctgtttgagcaaagggatttgaggatagaagggcggattataggttttgatgagtacatgaatttggtgctggatgatgctgatgaactcaacgtcaagaaaaatctagaaagccattggggaggattctcttgaaaggagacaacattactttgatgatgaacacgggaaaatgatagcttcttgtgctctggtagtttttacctcctctccaattggctttatctggaaggacatggtggtaacttttagcatttccaagtctttgtttgtgcgcctttccaactggctgtcatatgatttagaacagttgtctggttatttgagctctgtattacctaattttggattgaacagcagtagttgaaaaggtaatatattcaatgtatcttctgttgtgtttggtactccagtaaggaaaaaaaaaaagggcttgtagaaccatcatatgctcctgtattctgattgatctgaaagtcattatctgtgc

SEQ ID NO: 6484 - DNA, 780 bp, Chenopodium quinoa
cccggatctacaaactagttttaatatcagacggatgtaaaaataaaatgttactccgtactactattacgaaatagaagaaggatcaactcagtgactcacccatatctgcgtagcagccaaacaaattctcttcgagtgttttttttaggtttccctaattcaagtgtttagctagggttttagcaagaaaaccaattttcgaaaatcagcagcaaattcaatttggaagcagcaataatggcgagcaccaaagtccagaggattatgacccaacctattaacctgattttcaggtttcttcaaagcaaagctcgtattcagatttggttgtttgagcaaaaggatgcgaggattgaaggccgtataattggctttgatgaatacatgaatttagttttagacgacgcagaagaagtgaatgtcaaaaagagaccagaaaatcacttgggagatccttctgaaaggagacaatattactctgatgatgaatacgggaaaatgagacccagctgatttgctatttgttcaccagcattaaatattacaaactgctcatccgccttaaaagttttgtgcgtattaatgtaatatgtacttcaaggccttaccctctgttccgtatagttaatgtgtagtttgataaatatgaagttgtgagttgtgactttgacgaatgtcttcgtttgtgtttagtagaagttcttttagttgaggtcctggtggtgcaatccaatatggggcaatttattatgctctaccagtttatgttacagaaga

SEQ ID NO: 6485 - DNA, 395 bp, Camellia sinensis
ggggaggaaagctctctgtgttttgttcgctagggtttgtctcaaatctctccaacgtctctctacgtttctcaactctacagccatggcgagcaccaaagtccagcgtatcatgacccaacccattaatctgatcttcaggtttcttcaaagtaaagcacgaattcagatttggctatttgagcagaaagacttgaggattgaaggtcgaagttattggctttgatgaatatatgaatttggtttggaagatgcagaagaggtcaatgttaagaagaaaaccagaaagtcacttgggaggattctacttaaaggggacaacattactctgatgatgaacacgggaaaataatgagcagtctggcagtcgttatgatgatgtatctttcataata

SEQ ID NO: 6486 - DNA, 927 bp, Rosmarinus officinalis
agggttttgcagccatagagggactgagggaaccggagcgtgaagaattttttgcagcgattccaccgcaagcagcagccatggcgagcacgaaagttcagcgtattatgacccaacccattaacctgatcttcaggtatcttcaaagtaaagcgcgcattcagatttggctgtttgagcagaaggatctgaggatcgagggccgcataatcgggttcgacgagtacatgaacttggtgttggacgaagctgaggaggtcaacatcaaaaagaacagcaggaagcagctcggtaggattttgttgaagggagataacatcacgctgatgatgaacactggcaagtgacgctgagatagaggctcagagactaatgaagggactgccttgtagttctttcagaatgacttcatctacatttgtctctttaggatgtctgtctgcttagcttgtttttctctctccccaccatgtctattgtttctctctttatcctacttcttacatgtatgttactttgtttgtgtaccaagatttactagtatttgaagttggatatcatgtaaagaagtttgcttggatctggctattgcaagagttggaagtatcatttacttatttgatacttgtccaactttgtcgttttctctcatattgtcgttaccttcctgagatgagtcttcacattatgcttgtgtagttcctcgatgttaacagtttgtggtcaattggatttgagccataagcttgatatgttgagttgcaacctaagtgcaaaatttgactatgttcgattttcctatgaagtgcaactttcggtagcccttgaccaaaccccccttccctgaattatgcaatcacacttgctgcttttagcaaataccgttcatgattatatcaagatgagcatggaatgtttgtctgttta

SEQ ID NO: 6487 - DNA, 662 bp, Brachypodium distachyon
ccgccgtctctcctctcctcctcgtcgcttcttatctagggttttcggcgcctcctccctccggaagcttctagatacttccagccgtcgtcgtcgccgtcagaggaactccggccgcagcagccatggcgtccaccaaggtccagcgtatcatgacccagcccatcaatctcatcttccggttcctccagagcaaagcgcgcatccagatctggctgttcgagcagaaggacctccggattgagggtcgtatcatcgggtttgatgagtacatgaacttagttcttgaggatgctgaggaaatcaacgttaagaagaacaccaggaaatcattgggaaggatactcttgaaaggtgacaacataactctgatgatgaacactggcaagtgaagcttcttcccataggatggctggcattctggtgctttacgttgagcattcctttgataacttgctccatccaggctggaatgcaatatgtagctcgtcattgtgggtcactgaggatatgtaacggctatgagctacctatgaactcagtagtacattctgcgatttgagattttgtgcatgttgttgggataatgtggtgcgcacatgtgtgtaagattaacatgaacagactgccgtgctgacttgttagttgttggctctcagttc

SEQ ID NO: 6488 - DNA, 1807 bp, Citrus clementina
ttaggaccctaataactaatcaaaacctagaactctacgaggtcgtccgcttcttgcataagtcaaggtccttatactgaaaagcgctttcgctcccgctagggtttttcgtctcttgaattctcaagcgtatctctgtgaattcgatagcaatggcgagcaccaaagttcagaggattatgactcagcccattaatttgattttcaggttccttcaaagcaaagctcgcattcagatttggctttttgagcagaaggatttgaggattgaaggccgaattattggttttgatgagtacatgaacttggttttggatgatgctgaagaggttcacataaagaaaaataccagaaagccattaggaaggattcttctcaaaggagacaacataactcttatgatgaacacggggaagtgatgatggtcattctggaaatcttgtcgtctgtcattggttgagccatttagagtgtattgctatctttgatgtttgaatacttaactggatttctatatgataaggtgatattatattcagtccatttaatagtcactgtcattgcccttttagggtttataataccatttgcttatgtggttatactttttatttacaattgttcatctagtttattagcctaaactagtcaagaatttcttagcaattcatagtggatcggattttcttttcaaattttgtatgaaatgtctgatgcgactgcttgaatttgagaagagttgtgggtaattatagtggaaaataagtttttgtaatcttgtttaaaccaaactaatagctactaatagtgataattttactcactatttgcaattttgcatttacacgtaaattgtaaggattgtttaagtgcatgatggtaaactatttctgcaggttgaaagaacaaaaggttcacacaattgagctaagtaacttctcttgtttgtttcttttttcctttttcctttagatttttgcaaaacagagtaaatgcttatttgagttaaaatcacagtttttaatttaattaaaaaaagggaaaaatgaaagaaagggacattatctagtggttgggcatgagtgggtgagcttttgtgttgattgacgacacagatgaacaggccagggtgtaggagaaaatgacttgactcatggggttgtttctagtagtgtaggcggtgggggccagggccgtgagtgctggtcctgctgccctcctgtgtcccatgagtatcaatttgtctactcctagggaagcaaagtgccctcttcgataatcccatttttgttctccttttcacgtcactactcaccaggtcaattgaccactgactcagcctccacaacgtatcacgtcttggctaatggctacttacttttgacctcctttcttactacaatacaacatatgcctattcaccatttcttgtattttgcttcttggtttgtggctcgtattgcctaattgccttatcatgtattcttttgagttgggtcattggagattgcactagcattacttttgacgacttttgagaaagccagagagagagagcaacgtaaaattgtatatggagatgggttcaatttatataacagcgagcgtaaaatttttaaaatgaaactttaaacttataattttatatgaaaaaactttgctatatatgttgtaagtcttaagtttcatgtttcgatttttgcattctgagatgtgaaaagtatagactacatgtgtgatggtcgaacccccatgatataaaattataggattaaagacagggacatgataatcttgtcaaatcggg

SEQ ID NO: 6489 - DNA, 564 bp, Cleome spinosa
aatcaaaacgtagcaaaggagttgaggaaatagggttttaggttttcctccatagctagagctccagagaccttgaaacctcagcagccatggcgagcacgaaagttcaaaggattatgacgcaacccatcaacttgatttttaggtttctccaaagtaaagctaggatccagatatggctctttgagcagaaagacttgagaattgaggggcgaattactggttttgacgaatacatgaatttggtgctggatgatgctgaagaagtgagcatcaagaagaagaccagaaagtcactcgggaggatattacttaaaggagacaacatcactttgatgatgaacacgggcaagtgaggaactgtatcgaaaacccgcatgcgtgtattgctatcttggatgaatgtgtagattgaacttccgggtttctcggaactctcagatgattggattgctgttttctttcaccttagactggttcttgacactgtcgccttgtagtgtcgatgctgaggttaagaatccgatgatcagattcttttttcaatggcttgttctttgatct

SEQ ID NO: 6490 - DNA, 764 bp, Coffea canephora
aaaggaagtgtacaaaacacagcccaaacctgagtctattgatcggcatctttagtttaggaagtgaagaaagcgggggagccgtctgtggttagggttttcggggcgcagagggcaaaagctggttggttgaaaggcgactgagcgggaagaagcagcagcagcagccatggctagcaccaaagttcagaggattatgacccaacctatcaacctgatattcaggtttcttcaaagcaaagctcgaattcagatttggctctttgagcagaaggatttgaggattgaaggccgcatcattggttttgatgagtacatgaatttggtcctggaagatgctgaggaagtcaacataaagaagaagaccacgaagcaattggggaggatacttctgaagggggacaatatcacattgatgatgaactcgggtaaatgatgttcctggctttgatgcctagatgttcgtgaatgtttcagttactaccagcgcacttggatggtttattttcagtgatgatgtattctagatactcaatagcttttctcttattcatagctttatgtctcagctattaacttttagtatgagctggtaagccaaattgtatcttccagaattgttgtatgaattgggcaatggcttcaaattcaattgcctattatgttttctccttcgtcattagccaattagggataatctttaggctcattattattttcgtttaagtgttgtatttcctcttttgggatgctgggactacttg

SEQ ID NO: 6491 - DNA, 646 bp, Echinochloa colona
ccgctcgcactcgcaggtctagctagctagggtttggttggtctccccgccccgccggccgcgcgcgcccttcgcatccagaagcttccagacgctccgaggaggggaagctcaccgccgacgcagcagccatggcgtccaccaaggtccagcgtatcatgacccagcccatcaacctcatcttccggttcctccagagcaaagcgcgcatccagatctggctcttcgagcagaaggacctccggattgagggtcgcatcattggctttgatgagtacatgaacttggtccttgatgatgctgaggaaatcaatgttaagaagaacactaggaaatcattgggtaggatactcctgaaaggtgacaacattactttgatgatgaacagtggcaagtgaaggggggagatgtctggtgcctagtatttcctcaagacaattgtactccatccggactgaaatgtatcatgtcattgtgcgtgagacctgtactccatcccttttgaaaatgtagcatgccattattgaagtgagatagctgtcgctgttgactgggtttaactcttgtgtcttgtgtgctagatgtgataatgagctgctcatttgtgctccgaagattaacaatgttgttgacatcttttctggtt

SEQ ID NO: 6492 - DNA, 846 bp, Epimedium sagittatum
gtctcaggcaacaatatatgttcgttatcatctatcccgggcgagacatcgaccttcaccccccggccattccggccgggggcgtcgaagagtagcagctagggtttctctttgctttcacattcaattacagcgacgagtgagtcggaacagtgtaagctttgcagccatggcgacgacaagagttcaaaggataatgacacaacccattaatctcatttttaggttccttcaaagcaaagctcggatccagatatggctgtttgagcagaaagacctgaggattgaaggacgtatcattggttttgacgagtacatgaatttggtcctggatgacgctgaagaagttaatgtgaagaagcaaaccaagaaagctttggggaggatccttttgaaaggagacaacatcactctcatgcagaacacgggtaaatgatgataagcagcgacattccttaactgcttgtatgtttagttgggcagctgatttctttcaacacccttccatttgatattcgatacttgtgtaattctggtagctgtctttgacatatcatagatcagcccttgagctgagcttatggtgtaatttcggtctgtgttctttaccgtaaaatttactgttaggtggccatagacctcaaaatggatgttgtatcttaatagatctagtgtttcacatttttgactttaagcagcagttttatttttgttgagcctggtagaggtttcatgcttggacataagtttagccttcaagtttcaactgaacttgcaagaaattgaggttgtaggtcttcaaacatgtttatcatgttgtgttgtaggtcttcaaacatgtttaat

SEQ ID NO: 6493 - DNA, 606 bp, Euonymus alatus
ccttgcgcgtaggtttctaacgtcctttttcgacctcgacaccgtcaatccgtcactgaccaagctacacgcgagcttcacagccatggcgagtactaaagttcagaggattatgacccaacccattaacctgattttcaggtttctacaaagtaaagctcgcatccagatttggctcttcgaacagaaagatttaaggattgaaggccgcataataggttttgatgagtacatgaatctagtcctggaggatgccgaagaagtcagcattaagaaaaagagcagaaagtctttaggaaggattcttcttaaaggagacaacataacgttgatgatgaacactggaacataatcgcatcatatccgctacacagagtgccttgtttcaatcacttggatgttcatgtatttttgctgctgctattttggcttttcttgaatgctatgtagtatatactaattagtattggatgtgattgtgtgctcatctgttatataggcagtttatgcattctgataacttaagccagggggctgttcaatgttagctatgtgaaatgggcaactatcgatttgctcaaagaataggaattctaatccagattc

SEQ ID NO: 6494 - DNA, 708 bp, Euonymus alatus
gacaccgtcagtgaccaaggtaagctcgagcttcacagccatggcgagcactaaagttcaaaggattatgacccaacccattaacttgattttccggtttctacaaagtaaagctcgcatccagatttggctcttcgagcagaaagatttaagaattgaaggtcgaataattggttttgatgagtacatgaatatagtcctggatgatgcggaagaagtcagcattaagaaaaagagcagaaagtctttaggaaggattcttctcaaaggagacaacataacgttgatgatgaacacgggaacgtaattgccatcatatccgctacgcagagtgccttgtttcaatcgcttggatattgatatatttttgctgctgctattttggtttgcttcctcattgctttatactaattagtatttgatgtgattgtgtactcatctattatataggaagtttttgcattctgataacattagccgaggggctgcccatggaaacttctcctagccgattagtgacatcattgtgccatattagctatgtgaattgggcaactatgaatttgctcaaacaacaggaattctaccccagattctcaaataccaacacattgtgggaggaggatctctccacaactctgttaccatgtagtgtaggcccgttgagtattgaaaccttcagtaacataaacgattcaattgcctaac

SEQ ID NO: 6495 - DNA, 622 bp, Euonymus alatus
cgcttaggtttctaacgtcatttttcgacctcgacaccgtcagtccgtcgctgaccaagctacactcgagcttcacagccatggcgagtactaaagttcagaggattatgacccaacccattaacctgattttcaggtttctacaaagtaaagctcgcatccagatttggctcttcgaacagaaagatttaaggattgaaggccgcataataggttttgatgagtacatgaatctagtcctggaggatgctgaagaagtcagcattaagaaaaaaagcagaaagtctttaggaaggatacttcttaaaggagacaacataacgttgatgatgaacactggaacataattgcatcgtatccgctacacagagtgccttgtttcaatcacttggatgttgatgtatttttgctactgctattttggttttgcttcctgaatgctatgtagtatgtactaattagtattggatgtgattgtgtgctcatctgttatataggcagtttatgcattctgataacttgagccagggggctgttcaatgttagctatgtgaaatgggcaactattgacttgctcaaagaataggaattctaatccagattctcaaataccgtgactttg

SEQ ID NO: 6496 - DNA, 542 bp, Zea mays
gaaacaaaaccctcctccctcactgccccctcgcagacgagacgcgtggtagctagggttttggcctcgccgcgcacgcctcctgaagcttctagacgttcgaggaggaggaggggaggctcccgccgccgccgccgcagccatggcgtccaccaaggtgcagcgtatcatgacccagcccatcaacctcatcttccgtttcctccagagcaaagcgcgcatccagatctggctcttcgagcagaaggacctccggattgagggtcgcatcatcggattcgatgagtacatgaacttggtcctcgaagatgctgaggaaatcaacgtcaagaaaaacactaggaagacactgggccggatactcctcaaaggtgacaacataactttgatgatgaacagtggcaagtgaaagttcttatggcaggaacgatgtttggtgctcgcgttgagtatttctggcacgttgtactccatccattcagacttacatgtacctgctgttaatgacctgagtaaaattatgctagatgctggccacttgt

SEQ ID NO: 6497 - DNA, 912 bp, Mimulus guttatus
agggtttttgcagaagaaaaaacgagcgcaagaaataattctcagcaagcagagcccccatcaatcaaagcagcggcagccatggcgagcacgaaagtccagaggattatgacccaacccatcaacctgatcttcaggtttcttcagagcaaagcccgcattcagatatggcttttcgagcagaaggatgtcaggattgaaggccgaattattgggttcgacgagtacatgaatttggttttggacgaggcagaggaggtcaatgtcaagaagaacaccaggaaggaacttggccggattttgttgaaaggggataacatcactctcatgatgaatactggcaagtgatgcttgggattcaggctataattttgttgattgagtcaaggatgaggctggcttcatcgtggttcaatcagattactggcaagaattcgtataaattcaactcctttagaatctattctctcttagacagttgttttctattccgttaatgtaatgtctccccttatcctgcttttattatgtatgctaatgttgtgtatgaagaattccttctgcttgaaatcggatatcaggtaaattagaaatgtttttttctcatggtcgtttgagacagatgaacatgtcgggagatttgaatttctctttattatattagaaaaaaagtatcacggttatctccaattaatccgagaggaatttgctagggtttctgtgatgcatttctttcttcacgtttgcaggtacgaacgaaataacactagctcgtaagtttattgcatgaaatcattttagctgcctaactgaagagttaggatttacatcaatcattaattcaaaccaatcttttttcgcatgaagaattatgggatgtttgtctgtttactacataaattacgtagtaaa

SEQ ID NO: 6498 - DNA, 268 bp, Mimulus guttatus
agcagccatggctagtactaaagtccagaggattatgacccaacctattaatttgatttttaggtttcttcaaagtaaagctcgaattcagatatggcttttcgagcaaaaggatttacggatcgaaggccggattataggctttgacgaatacatgaatcttgtcctggacgatgccgaagaagtcaacgtgaagaagagcagcagaaagcaactcggaaggattcttttaaaaggggacaacatcacattgatgatgaattcgtaa

SEQ ID NO: 6499 - DNA, 564 bp, Allium cepa
gggaccgtaagatagtttttcaaacaaaaattaaaccactctgcgtttctgtaactagggttttgtacgctctcatattcgaaactcgtaattgctttcatcagcgtcatctgaatcacagcaacagccatggcgaccacaagagttcaaaggattatgacccaacccatcaatctcatcttcaggtttcttcaaagtaaagcacgcatacagatctggttgtttgagcagaaggatttgaggattgaaggccgcatcattgggtttgatgagtacatgaatttggttctggacgatgcagaggaactcaatgtcaagaagagcactagaaagactttagggaggattcttctgaaaggtgacaacataactttaatgatgaacactggaaagtgatgtgaattgagcttagttcgagttgtgatttgtagtcagttttcttcttggatgtaatgttatttttcatcttttaatgttatgctattgatatttgtcgaatgtaatgattctgatttggaaaggcaaaatatatgaatttgaagtttatttcaaaaacacacacac

SEQ ID NO: 6500 - DNA, 1807 bp, Citrus sinensis
ttaggaccctaataactaatcaaaacctagaactctacgaggtcgtccccttcttgcataagtcaaagtccttatactgaaaagcgctttcgctcccgctagggtttttcgtctcttgaattctcaagcgtatctctgtgaattcgatagcaatggcgagcaccaaagttcagaggattatgactcagcccattaatttgattttcaggttccttcaaagcaaagctcgcattcagatttggctttttgagcagaaggatttgaggattgaaggccgaattattggttttgatgagtacatgaacttggttttggatgatgctgaagaggttcacatcaagaaaaataccagaaagccattaggaaggattcttctcaaaggagacaacataactcttatgatgaacacggggaagtgatgatggtcattctggaaatcttgtcgtctgtcattggttgagccatttagagtgtattgctatctttgatgtttgaatacttaactggatttctatatgataaggtgatattatattcagtccatttaatagtcactgtcattgcccttttagggtttataataccatttgcttatgtggttatactttttatttacaattgttcatctagtttattagcctaaactagccaagaatttcttagcaattaatagtggattggttttcttttcaaattttgtatgaaatgtctgatgcgactacttgaatttgagaagagttgtgggtaattatagtggaaaataagtttttgtaatcttgtttaaaccaaactaatagctactaatagtgataattttactcactatttgcaattttgcatttacacgtaaatcgtaaggattgttgaagtgcatgatggtaaactatttctgcaggttgaaagaacaaaaggttcacacaattgagctaagtaacttctcttgtttgtttcttttttcctttttcctttagatttttgcaaaacagagtaaatgcttatttgagttaaaatcacagtttttaatttaattaaaaaaaaaggaaaaaatgaaagaaagggacattatctagtggttgggcatgagtgggtgagcttttgtgttgattgacgacacaggtgaacaggccagggtgtaggagaaaatgacttgacttgtggggttgtttctagtagtgtaggcggtgggggccagggccgtgagtgctggtcctgctgccctccgtgtcccttgagtatcaatttgtcttctcctagggaagcaaagtgccctcttcaataatcccatttttgttctccttttcatgtcactactcaccaggtcaattgaccactgactcagcctccacaacgtatcacgtcttggctaatggctacttacttttgacctcttttcttactacaatacaacatatgcctattcaccatttcttgtattttgcttgttggtttgtagctcgtattgcctaattgccttatcatgtattcttttgagttgggtcattggagattgcactagcattacttttgacgacttttgagaaagccagagagagagagcaacgtaaaattgtatatggagatgggttcaatttatataacagcaagcgtaaaatttttaaaatgaaactttaaacttataattttatatgaaaaaactttgctatatatgttgtaagtcttaagtttcatgtttcgatttaagcattctgagatgtgaaaagtatagactacatgtgtgatggttgaacccccatgatataaaattataggattaaagacagggacatgataatcttgtcaaatcggg

SEQ ID NO: 6501 - DNA, 655 bp, Ananas comosus
gtgtgcttttccccctctccctccccaaaatcctcactactatatttagggttttagcgagtcgtcgtcctcgtcgttgcgagagcgagagggagctagggccaaagggggcgagaagcggaggcggagctcgtagccatggcgtccaccaaggtccagaggattatgacccaacccatcaatctcatattcaggtttcttcaaagtaaagctcgtatccagatttggctgttcgagcagaaagatttgaggatcgaagggaggatcattggttttgatgagtacatgaacttggttctggatgaagccgatgaaatcaatgtcaagaagaagacaaaaaaaccactagggcggattctcttgaaaggagacaacattactttgatgatgagcacgggaaaatgatgagcagaccatatttccctgaaggctgtctaaagctcgatttggctaacttgcgaactatgctttctttgtgctatttagaccaggatgtcatatgttgtttaaaacctttttatagtacattgtagactgcaatgctttgattagtgttggtaacaacaaaagcttagatttgtttctgcactcgacatagtatagtggtgcttgttctatgtcaaattgcatcggaacattaaccaatttcccccca

SEQ ID NO: 6502 - DNA, 851 bp, Prunus mume
ctctctctctctctctctctctctcattctctgcgtctctactcttctccctcccaagccttctgcgtttattcttctctctctccctctccccctctcctctgcgtctcttctctgtaccacagagttttcattcgtattatagcaaaaagaaagacctgaggtcgctagggtttcttcaaagtctcttcgactaaaacctctttctgtaaccccaaaacccattgaatttcccagccatggcgagcaccaaagttcagaggattatgacccaacccattaacttgattttcaggttccttcaaagtaaagctcgcattcagatttggctctttgagcaaaaggacctcaggattgaaggccgaattattggttttgatgagtatatgaatttggttctggatgaggctgaagaagttagcatcaagaaaaaaaccagaaagtcgttgggacgcattcttctgaaaggagataacataactctgatgatgaacacggggaaatgacgaccaatctaataaatgcagaaacattggctacagtgtatctttaatgcgatggaggttgagctatttagatttactgcttttctaaaacaaatgtatgttggatgtcatttatgagtagtgagatatgtattgacaatcttaattgcaagcacgcagtgagatatacgttcactggtgttactgacactatttgttttgtgatgcagaattctttatactttgtgtttgcatttgatcgcccttgcccttgttaggctttctgtacaaaaccttgtatgttaatggtaattcggttcaaccatgattagatagattgctaaccctttttaatttggaaataaa

SEQ ID NO: 6503 - DNA, 679 bp, Prunus persica
ctactcttctccctcccaaacgttctgcgtttattcttctctctttccctcacccgctctcctctgcgtctcttctctgtaccaaagagttttcgttcgtattatagcaaaaagaaagacctggggtcgctagggtttcttcaaagtctcttcgactaaaacctctttctgtaaccccaaaacccattgaatttcgcagccatggcgagcaccaaagttcagaggattatgacccaacccattaacttgattttcaggttccttcaaagtaaagctcgcattcagatatggctctttgagcagaaggacctcaggattgaaggccgaattattggttttgatgagtatatgaatttggttctggatgaggccgaagaagttagcatcaagaaaaaaaccagaaagtcattgggacgcattcttctgaaaggagataacataactctgatgatgaacacggggaaatgacgaccaatctagcaaatgcagaaactttggctacagtgtatctttaatgtgacggaggttgagctatttagatttactgcttttctaaaacaaaagtatgttggatgtcatttatgagtagtgagatatgtattgacaatcttaattgcaagcggatatacgttcactggtattactgacactatcttgttttgtgatgcagaattcttta

SEQ ID NO: 6504 - DNA, 346 bp, Rosa hybrid cultivar
acccctttctgcaactcatcgtactccgcagccatggcgagcaccaaagtccagcggattatgacacagcctattaacttgattttcaggttcctccaaagtaaagctcggattcagatttggctctttgagcagaaagatgtcaggattgaaggccgcattattggatttgatgagtacatgaatctggttctggatgatgcagaagaagtcagcatcaagaaaaacaccaggaagacattaggaaggattcttcttaaaggtgacaacataactctgatgatgaacacggggaaatgatattgctacagtaaatgcaaaaatcaagatccttgtggcggaattt

SEQ ID NO: 6505 - DNA, 605 bp, Silene vulgaris
aagacgaagaagcagcaaccatggcgagcgcaaaagttcaacgtattatgacccaacctatcaatctgatattcagatttcttcaaagcaaagctcggattcaaatatggttgtttgaacagaaggatttgcgaattgaaggccgtattattggctttgatgagtacatgaacttgactttggacgatgctgaagaagttaacattaaaaagaagaccagaaagtcactggggaggatccttctgaaaggagacaatattactctgatgatgaacacggggaaatgaacctattgggaacaaattctttcagtagccgcaattcttaagcaacaacaattttcgtgctcattgtagagagtttctgtgtgaaaacttgctcagcattgtactttgtagatcgtagtgtatttagctccaacgttaaagtctatttcgtgactcgtgtgtagtaattggaagtatcgtccttggtcaagatctctgtcatttgagttccggtcagcaatttcgttctctattatgaaatatgtagctgtcttaacatggctactacggaacccttgtcatatgaaatccctcttttccttgtcatatgagtttgga

SEQ ID NO: 6506 - DNA, 677 bp, Fragaria vesca
ccgtcttcctctttctcgattcatatcactctcgactcttgtttcggaattcgctgaaaccctaaaccctatccgcccgacccagagagcagccatggcgagcaccaaagttcagaggatcatgacccagcccattaacctgattttcaggtttctccagagtaaagctcgaattcagatttggctctttgaacagaaagacgtcaggattgaaggccgtatcattggttttgatgagtacatgaatttggttctagatgatgctgaagaggtgagtatcaagaagaataccagaaagacactaggaaggattcttctcaaaggagataacataactctcatgatgaacacggggaaatgatgaccgatctgagaagtgtttatccaacattctgaatttggtggacatcaagctattcagactctattctgtagtgacatgtattatggataccaatcatctgtagtagtgattgtattcttgaccttaatgggtgactgatttttcatgcagagtttcttttatataatatgactcttcggtaggtgggtgtttgcataaaaaaaaccccgagtatgttgattgttcaagtaaatatctgaatcattctcaaacgtatgatattgtttggatcaagccataaaggttcttgttgatcctcgtatgagttgcgtaa

SEQ ID NO: 6507 - DNA, 694 bp, Utricularia gibba
gcgggggaggaaaacaggcgtcgatcgaagaagcaagcagcaatggcgagcacgaaggttcagcgtatcatgacccagccgatcaacctgatcttcaggttcctccagagcaaggctaagattcagatctggctgttcgagaagaaggatctgcggatcgagggcaggatcatcggattcgacgagtacatgaacctcgttttagacgacgccgaggaagttagcgtcaagaaaaacagtaggaagcaactcgggcggattctgctcaagggcgataatatcaccctcatgatgaacaccggcaagtaatcgcttccttcgtcttctgctagtgtattaggcttaatcctacgaacctcgttctgctttctgattcgtggtgcctgagcttcaattgctgtaatgttgatcctttgtcaatcgactgttttggaagtatggtgtgaaaaagatctgttcttggcttgttttctatggccagcgggagatcagtcagtcagtatacatgggattgattctaagagcggaagagtatttttatgacatgaacttttctttgtatttcatgcaacttcaatgtctgccggcattgtgttgtcttcaacgtatttagttttcggctttccgatcctcgacggccttactgagttccctgtggatttcggggagatgtggacttgaccttcttcgttcg

SEQ ID NO: 6508 - DNA, 546 bp, Carpinus betulus
ctccttcagccagtgcccccgaaaacacgcacacacattagaagaggaactggctaaagccctctcgtctccaacggttcggtggaaaaaaagctctttggtttagggttctgcacttctttgactccaactcttcgtaagaagtaaaaacatcgaattctgcagccatggcaagcaccaaagttcaaaggataatgacccaacccatcaacctgattttcaggttccttcagagtaaagctcgcattcagatatggctttttgagcagcgagacctgcggattgagggccgaatcattggctttgatgggtacatgaatttggttctggatgatgctgaagaagtccacattaagaaaagagcagaaaaactttagggcggattcttcttaagggagacaacataactctgatgatgagcacgggaaaatgacgatgattccagcaattatgtatattggcattgtgttgccttttgaattatatggaggtcaatcatcttttcttttactgtaatgtcagatgggtatggacatcatgtatggt

SEQ ID NO: 6509 - DNA, 655 bp, Elaeis guineensis
tatcaacgttcctatcgatctcccgccagagccaagagagaaggggaagagctcgcggaagccaaagaagaggcagccatggcgtccaccaaggtccagaggatcatgacccaaccgattaatcttatcttcaggtttcttcaaagcaaagcacgcatccaggatctggctgtttgagcaaagggatttgaggatagaagggcggattataggttttgatgagtacatgaatttggtgctggatgatgctgatgaactcaacgtcaagaaaaatactagaaagccattggggaggattctcttgaaaggagacaacattaactttgatgatgaacacgggaaaatgatagcttcttgtgctctggtagtttttacctcctctccaattggctttatctggaaggacatggtgggtaactttttagcatttccaagctttgtttgtgcgcctttccaaccggctgtcatatgatttagaacagttgtctggttatttgagctctgtattacctaattttggattgaacagcagtagttgaaaaggtaatatattcaatgtatcttctgttgtgtttagtactccagtagaaaaaaaaaagggcttgagaaccatcatatgctcctatattctgattgatctgaaatcattatctgt

SEQ ID NO: 6510 - DNA, 485 bp, Arachis hypogaea
acgactacagaagcagtggtatcaacgcagagtcgggggaattcctcctcagagactctcaggcacttagtcgcaaaccctagcagtagggttttagttcgagctccctcgctgcaaaatacagttttgttcctgcaactgtttgatccagtttccaaaccatggcaagcactaaagttcagagggttatgacccaacccattaacttgattttcaggttccttcaaagtaaagctcgcattcagatttggctctttgagcaaaaggatttgaggattgaaggccgtatcattggttttgatgaatacatgaatttgggtctggatgatgctgagaagtgaatgtcaagagaacaccagaaagacattagggaggatccttcttaaaggagacaacataactttaatgatgaacacggaaaatgatgaagaagatgaacaccaaggtgtattgtaaaccatacattccattcagcaaggagacag

SEQ ID NO: 6511 - DNA, 716 bp, Silene vulgaris
aaaataaaattagggtttttgctagactctcaaactcagtgtcctccataacaaaaacgcagcaagtctacagcaacagcaaggtcagcaacaatggcgagcgccaaagttcagcggattatgactcagcctatcaacttgattttcaggttcttcagagtaaagctaagattcagatctggttgtttgagcagaaggatttgaggattgaaggccgtattattggatttgatgagtacatgaacttggttttggacgatgctgaagaagtcaatgtcaaaaagaagacccgaaaatcactagggaggatccttctgaaaggagacaacattactctgatgatgaacacgagtaaatgagcctcaggggatggacttcaacaggtcgaactctcaaagcagcatcaaatttcgtgcttattgtagagaatttatgtgaaaacttgcggattaatttagtatcaactcaagtgtctctgtttccctcctaatacgttggacactgttattgactattattataatgcaatagtattagctttaatggctggtgtttttggatgcatcaatccagagactaccaaccttgaactaatgaatttatagtcatgtttgtgtcgaattcatttttaaaggatgtacatcttttggaatttcgattggtgctgcactgctccccatcagacaattatgcatgcatctttcgcttatgtaaag

SEQ ID NO: 6512 - DNA, 526 bp, Oryza sativa
gctcgccgagggcaggaaggagagcgcgcgaggtcgaggagaagcgaactccgccgccatggcgtccaccaaggtgcagaggattatgacccagcccatcaacctcatcttccgcttcctccagagtaaagcgcgcatccagatctggctcttcgagcagaaggacctccggattgagggcagaatcatcggctttgacgaatacatgaatttggtcttggatgaagctgaggagatcaacataaagaaggacactagaaaatctctgggccggattctcttaaaaggagacaacattacattaatgatgaacacgggaaagtgataacagctcgccgtgccctccattgcaagaattactgataacctatctatcccaaccttctatgaagttagaatttgagcctgtagtagtctttttttgtttgttcatctaaatcgattgtaatatacagtatcagcgagagatgatgagttctgtgaaagcaagtgtttaaccaggacatgagtttggttactatatcag

SEQ ID NO: 6513 - DNA, 713 bp, Rosmarinus officinalis
cggccgggggatttacaaggaggacagagagagcgagtatcttatactcttctagctagggtttttgcagcaagagagattgagggaaccggagcgcgactattttttggttttgcaacgatttcacctcaagcagcagccatgacgagcacaaaagttcaacgtattatgacccaacctattaacctgatcttcaggtatcttcagagcaaagcgcgcattcagatttggttgtttgagcagaaggatctgaggatcgagggccgaattatcgggttcgacgagtacatgaatttggtgttggacgaagctgaggaggtcaacattaagaagaacagcaggaagcagctcggtaggattttattgaagggggataacatcacgctgatgatgaatactggcaagtgatgctcagatacaggctcaaagactaacaaaggggttgccttcttgttgttctttcagaatgacttcgtctacattttaggatgtccatttgcttagctcttttactctcgccccactctactccatccattgtttctctcattatcctacttcttacatgtatgttactgtgtttgtgtaccaagatttactagtattcgaagttggatgtcatgtaaagaagagaatttgcttcaatctggctattgcaagagttggtagtattcattcacatatttgatccttgtccaatttgtcgttttctt

SEQ ID NO: 6514 - DNA, 705 bp, Musa acuminata
gtcttttagagctcaagctagggttttctttatcgcgttcatcgggaggggcttctgccggaaccgagagaggagaaaaggaaaccggctacaagggagaagcagcaatggcgtcgaccaaagtccaacggattatgacccaaccgatcaatctaattttcaggttcctccaaagcaaagctcgcatccagatatggctctttgagcagaaggatttgaggatcgaggggcgtattattggttttgatgaatacatgaatttggtcctggaagaagctgaggaactaaatgtgaagaagaaaaccagaaagccattggggaggattctgttgaaaggagacaacataacgctgatgatgagcacgggtaaatgatatcctgaagttacttggcttcggctgcatccagcagtactaacttctccttttcgcggccgttgtagctgttgtgacatttgtattggcaaattgtctgtcgtttgaacctgagtgttcaagatgagaagaagtttctctaggattgtctgtgttttaatttgtgcaactacagttcaacaaggatatgtgttaaatgcctgtgtcatcaaggcataaattagcatcagtagtcagtttgaagtgtcccagggttaaaccatgcaggcttgaaaaggatcactgtttcttatgagattgcatcatagcattcttatccaatatccttcac

SEQ ID NO: 6515 - DNA, 368 bp, Catharanthus roseus
agcacgaaagtacagcggattatgacccaacccatcaacctgatcttcaggtttcttcaaagcaaagcgcgaatacagatttggctatttgagcaaaaggatctgaggattgaaggacgcatcatcggatttgatgaatacatgaatttggttcttgacgatgccgaggaagtcagcattaagaagaagactagaaagcaattgggaagaatacttttgaagggcgataacatcaccttgatgatgaatactggcaaatagttttttttttttcttggttggaagatagatcctcttctaatgtactgtttttatgtaaacaatctcttccttaatatgttcagtgacagtgttggtggttctgatca

SEQ ID NO: 6516 - DNA, 431 bp, Echinochloa colona
accgcaaaccccctcgcctccctccgctagggttttgcccccaacatctcgtagcgcgcggcgcgaggaggagaagcgcatcagccatggcgtcgaccaaggtgcagaggattatgacccagcccatcaacctcatcttccgtttcctccagagcaaggcgcgcatccagatctggctcttcgagcagaaggacctgcggattgaaggcaggatcatcggatttgatgaatacatgaatttggtcttggatgatgctgaggagatcaatgtcaagaaaaacaccaggaaatctttgggccgcatcctcttaaaaggagacaacatcacgcttatgatgaacacataagtgaaaaggggaagtaacttctgatgtgtgaatttgaggctgtaatggaatcatgtttctcctatgtgctcatctaaacctgac

SEQ ID NO: 6517 - DNA, 546 bp, Gnetum gnemon
agctcagatacgagggcatcaacggaggaagaagagtagcgctcaagattcaaaatcctacgatttttatcaactcaactcagctcgacctaagcaaaccagtaaacaatggcttccaccaaggttcagaggattatgacccaacctattaatctcatatttcgatttttacagagcaaagcccgtatacagatctggctgtttgaacagaaagatttgaggattgaaggccgtatcattggatttgatgaatatatgaatctggttctggatgatgctgaggagatatctgtgaagaggaaaacacgaaaaccattaggtcgaattttactgaaaggtgataatatcacattgatgatgaatacgaataagtgatcgtattacatgacgtaggaacatttcagtgagcttaatgtactagtaattcaagtggacactttccctagttgtagacaatccctttatggaattggttattcgtaaaagtgctattgcttttgtggttttactatgatacgatggaggaatgtaacggtactcgtattt

SEQ ID NO: 6518 - DNA, 657 bp, Zea mays
acaaaactctcgctccctctcgcagacgcgcctaggtctagctagggtctggtctcgctgccccgccgcgcgcgcattcacaagcttctagacgttccgaggaggaggggaggtacccgccgccgcagccatggcgtcgactaaggtccagcgtatcatgacccagcccatcaacctcatcttccggttcctacagagcaaagcgcgcatccagatctggctcttcgagcagaaggacctccggattgagggtcgcattatcggattcgatgagtacatgaacttggtcctcgaagacgctgaggaaatcaacgtcaagaaaaacactaggaaatcactgggccggatactcctcaaaggtgacaatataactttgatgatgaacagtggcaagtgaagattcttatggcaggaacgatgtttggtgctcgcttcgattatctgtgacacaatgtactccatccatccgtccagacttaaatgatgtatcatgtcattgtggtttagtgagagttgtataactacctgaggaaactcacgtgttactatatgctaagatgctgtgacggtgagctattcagtgctcacttgtgttccaaagattagcccgacttgtgtgtgccatgctgacatcttttctggtttcatactcagctt

SEQ ID NO: 6519 - DNA, 597 bp, Nuphar advena
attttttttggggtttcgatcgagagagaagcagagagcagcagcgatggcgaccacgaaggttcagaggatcatgacacaacccatcaatctcatcttcagatttcttcagagcaaagcgaggatccagatctggctgtttgagcaaaaggatctgaggatcgaaggtcgaattatcggttttgatgagtacatgaatttggtgctggatgatgctgaagaagtcaaccttaagaagcacacaaggaagtctttagggaacatccttttgaaaggagacaacattactttgatgatgaatacgggaaaatgatggacgctatccaaaccctttgaggcaaaccagctggagtgtagtactcctaaacaacatgatgtgatgtctacatgtattgttggacctgcttttttctttcctttgtttttttagattgtacatttttgttactgcttttttggccttaggaccacatatgcatcgcaacctttccagtctttccccctggcggctacggtctgttttcctcttttgtatgaatacggacaatttagtttcgtatgcatgcatacttatcatgtcttacatgactttgaggt

SEQ ID NO: 6520 - DNA, 690 bp, Elaeis guineensis
cccccgctacctagggttttatcaacgttcctatcgatctcccgccagagccaagagagaaggggaagagctcgcggaagccaaagaagaggcagccatggcgtccaccaaggtccagaggatcatgacccaaccgattaatcttatcttcaggtttcttcaaagcaaagcacgcatccagatctggctgtttgagcaaagggatttgaggatagaagggcggattataggttttgatgagtacatgaatttggtgctggatgatgctgatgaactcaacgtcaagaaaaatactagaaagccattggggaggattctcttgaaaggagacaacattactttgatgatgaacacgggaaaatgatagcttcttgtgctctggtagtttttacctcctctccaattggctttatctggaaggacatggtgggtaactttttagcatttccaagctttgtttgtgcgcctttccaactggctgtcatatgatttagaacagttgtctggttatttgagctctgtattacctaattttggattgaacagcagtagttgaaaaggtaatatattcaatgtatcttctgttgtgtttggtactccagtgaaaaaaaaaaagggcttgtagaaccatcatatgctcctgtattctgattgatctgaaagtcattatctgtgcaatcacacttgttt

SEQ ID NO: 6521 - DNA, 673 bp, Elaeis guineensis
cgctacctagggttttatcaacgttcctatcgatctcccgccagagccaagagagaaggggaagagctcgcggaagccaaagaagaggcagccatggcgtccaccaaggtccagaggatcatgacccaaccgattaatcttatcttcaggtttcttcaaagcaaagcacgcatccagatctggctgtttgagcaaagggatttgaggatagaagggcggattataggttttgatgagtacatgaatttggtgctggatgatgctgatgaactcaacgtcaagaaaaatactagaaagccattggggaggattctcttgaaaggagacaacattactttgatgatgaacacgggaaaatgatagcttcttgtgctctggtagtttttacctcctctccaattggctttatctggaaggacatggtgggtaactttttagcatttccaagctttgtttgtgcgcctttccaaccggctgtcatatgatttagaacagttgtctggttatttgagctctgtattacctaattttggattgaacagcagtagttgaaaaggtaatatattcaatgtatcttctgttgtgtttagtactccagtgaaaaaaaaaaggggcttgtagaaccatcatatgctcctgtattctgattgatctgaaagtcattatctgtgcc

SEQ ID NO: 6522 - DNA, 673 bp, Elaeis guineensis
tatcaacgttcctatcgatctcccgccagagccaagagagaaggggaagagctcgcggaagccaaagaagaggcagccatggcgtccaccaaggtccagaggatcatgacccaaccgattaatcttatcttcaggtttcttcaaagcaaagcacgcatccagatctggctgtttgagcaaagggatttgaggatagaagggcggattataggttttgatgagtacatgaatttggtgctggatgatgctgatgaactcaacgtcaagaaaaatactagaaagccattggggaggattctcttgaaaggagacaacattactttgatgatgaacacgggaaaatgatagcttcttgtgctctggtagtttttacctcctctccaattggctttatctggaaggacatggtgggtaactttttagcatttccaagctttgtttgtgcgcctttccaactggctgtcatatgatttagaacagttgtctggttatttgagctctgtattacctaattttggattgaacagcagtagttgaaaaggtaatatattcaatgtatcttctgttgtgtttggtactccagtgaaaaaaaaaaaaagggcttgtagaaccatcatatgctcctgtattctgattgatctgaaagtcattatctgtgcaatcacacttgttt

SEQ ID NO: 6523 - DNA, 597 bp, Elaeis guineensis
aacgttcctatcgatctcccgccagagccaagagagaaggggaagagctcgcggaagccaaagaagaggcagccatggcgtccaccaaggtccagaggatcatgacccaaccgattaatcttatcttcaggtttcttcaaagcaaagcacgcatccagatctggctgtttgagcaaagggatttgaggatagaagggcggattataggttttgatgagtacatgaatttggtgctggatgatgctgatgaactcaacgtcaagaaaaatactagaaagccattggggaggattctcttgaaaggagacaacattactttgatgatgaacacgggaaaatgatagcttcttgtgctctggtagtttttacctcctctccaattggctttatctggaaggacatggtgggtaactttttagcatttccaagctttgtttgtgcgcctttccaactggctgtcatatgatttagaacagttgtctggttatttgagctctgtattacctaattttggattgaacagcagtagttgaaaaggtaatatattcaatgtatcttctgttgtgtttggtactccagtagaaaaaaaaaggactt

SEQ ID NO: 6524 - DNA, 508 bp, Elaeis guineensis
cgctacctagggttttatcaacgttcctatcgatctcccgccagagccaagagagaaggggaagagctcgcggaagccaaagaagaggcagccatggcgtccaccaaggtccagaggatcatgacccaaccgattaatcttatcttcaggtttcttcaaagcaaagcacgcatccagatctggctgtttgagcaaagggatttgaggatagaagggcggattataggttttgatgagtacatgaatttggtgctggatgatgctgatgaactcaacgtcaagaaaaatactagaaagccattggggaggattctcttgaaaggagacaacattactttgatgatgaacacgggaaaatgatagcttcttgtgctctggtagttttacctcctctccaattggctttatctggaaggacatggtgggtaactttttagcatttccaagtctttgtttgtgcgcctttcaactcggctgtcatatgatttagaacagttgtctggttatt

SEQ ID NO: 6525 - DNA, 478 bp, Allium cepa
ggctaacgtctggattgtacacggcatgacttaagtaaagaagaggataaatgtatttcagagctgtattttaatggagtgctccttaagtcttggttccaagccaacggtgttttgtcagcatcatctgaatcagagcagcgccatggcgaccacaagagttcaaaggattatgacccagcccatcaatctcatcttcaggtttcttcaaagtaaagctcgcatacagatctggttgtttgagcagaaggatttgaggattgaaggccgcattattgggttcgatgaatacatgaatttggttctggatgatgcagaggaactcaatgttaagaagaacactagaaagactctagggaggattcttctgaaaggcgacaacataactttaatgatgaactctgggaaatgatgcaaattgtgcgtagttggaattatgatttggtagtcggttttcttatttgatgtacttttcccc

SEQ ID NO: 6526 - DNA, 337 bp, Allium cepa
cagccatggcgaccacaagagttcaaaggattatgacccaacccatcaatctcatcttcaggtttcttcaaagtaaagctcgcatacagatctggttgtttgagcagaaggatttgaggattgaaggccgcattattgggttcgatgaatacatgaatttggttctggatgatgcagaggaactcaatgtcaagaagaacactagaaagactctagggaggattcttctgaaaggcgacaacataactttaatgatgaactctgggaaatgatgtgaattgcgcctagttggaattatgatttggtagtcggttttcttatttgatgtacttttccc

SEQ ID NO: 6527 - DNA, 507 bp, Primula obconica
gcaccaaagtccagcgtattatgacccagcccatcaatctgatcttcaggtttctacaaagcaaagcgcgtatccagatttggttgtttgagcagaaggacttgcggatcgaaggccgtatcatcggctttgatgaatacatgaatttggttctggacgaggctgaagaagttaatgttaagaagaaaactagaaaagcgcttgggaggattttgctcaaaggggataacattactctgatgatgaatactggcaagtaaagattaagctgtgggcgctttggcatggttgctgtcacttgaaggctctttctagcactaccatgaaatataattgtgtcatgaatttctttatctttagacaatactttggtggctagttttatgtattgtaatttgtaaacccttttttattatattcggctaccgtatttttttgaaagatcctagtgacgtaactatgttgtgacaatagggtgccacggtacccccataattataatttttt

SEQ ID NO: 6528 - DNA, 871 bp, Prunus mume
tttttgacaaaaaaaataaaaataaaaggcgggtttgtctttcaatttcagcaaatagaaagaaaaaaacactgagctcgctaggttttcaaagtctcttcgactagaacttccgtctgtgacgcgaaacccattgaatttcgcagccatggcgagcaccaaagttcagaggattatgacccaacccattaacttgattttcaggttccttcaaagtaaagcccgcattcagatttggctctttgagcaaaaggacctgaggattgaaggccgaatcattggttttgatgagtacatgaatttggttctggatgaggccgaagaagtcagcatcaagaaaaacaccagaaaggcattgggaaggattcttctaaaaggagacaacataactctgatgatgaacacgggaaaatgatggccaatctagcaaatgcatgaactaaggctacagtgtgttttcattgtgatggaggttgagctctttagatttactgcttttctaaaacaagtatacgttggatgtcatttatgagtagtgatatgtattgacaaccttaattgcaagtggatatactttcactggtagtacttacactgtatcttgttttgtcatgcagaattctttatactttgtgtttatatttgatccctgttgttaggctttctacaaaaaaaactagtgtggatttcttggtggtttgtgtaatgcttgtaagtttttgtagttcagttcaaccatgtcagattgccaaccatttttaatttggaaacaaaccgtttgtcatccctgcttaacccaaatcaaggtttgttagacaaagaaaatcagagattccttttgaatgaatcatttgatttcgttctcaatgtt

SEQ ID NO: 6529 - DNA, 614 bp, Prunus persica
agcaaataggaagaaaaaaaaaaactgagctcgctaggttttcaaagtctcttcgacaagaacttctgtctgtgacgcgaaacccattgaatttcgcagccatggcgagcaccaaagttcagaggattatgacccaacccattaacttgattttcaggttccttcaaagtaaagcccgcattcagatttggctctttgagcaaaaggacctgaggattgaaggccgaatcattggttttgatgagtacatgaatttggttctggatgaggccgaagaagtcagcatcaagaaaaacaccagaaagtcattgggaaggattcttctaaaaggagacaacataactctgatgatgaacacgggaaaatgatggccaatctagcaaatgcatgaactaaggctacagtgtgttttcattgtgatggaggttgagctctttagatttactgcttttctaaaacaaacataggttggatgtcatttatgagtagtgatatgtattgacaaccttaattgcaagtggatttactttcactggtagtacttacactgtatcttgttttgtcatgcagaattctttatactttgtgtttatatttgatccccgttgttagac

SEQ ID NO: 6530 - DNA, 708 bp, Oryza sativa
cacccagctgctgcaaaagcccctctcgcaaacaaactagggtttttaggcgtcagctcgccgagggcaggaaggagagcgcgcgaggtcgaggagaagcgaactccgccgccatggcgtccaccaaggtgcagaggattatgacccagcccatcaacctcatcttccgcttcctccagagtaaagcgcgcatccagatctggctcttcgagcagaaggacctccggattgagggcagaatcatcggctttgacgaatacatgaatttggtcttggatgaagctgaggagatcaacataaagaaggacactagaaaatctctgggccggattctcttaaaaggagacaacattacattaatgatgaacacgggaaagtgataacagctcgccgtgccctccattgcaagaattactgataacctatctatcccaaccttctatgaagttagaatttgagcctgtagtagtctttttttgtttgttcatctaaatcgattgtaatatacagtatcagcgagagatgatgagttctgtgaaagcaagtgtttaaccaggacatgagtttggttactatatcaggtctggttttgctctatagttgagcaaggtatcaatgttctgccgctgttctgtgactttaccctttcattgtcatgcacatgttggccaaatattcctcttttgggggactgatgatttattcctc

SEQ ID NO: 6531 - DNA, 852 bp, Sequoia sempervirens
ttgaagattatcatttgtggcatcgattattttgaagagaaggatcagatttttattgaagaatatctgaagctaaatctgaagcaaacagggacgccatttggagacacatttgaattcattcgagctctattgaatgcactccaagctctcacggataagccagtctctcataacccaaaatcataaaagagcatttgggtttagatattgagtttctgcagaggcgggtgaagatcacctgaaataaggaaaatcacagataaaccagaaaacaaagcaatcatggcgactaccagagtgcaaaggattatgacccaacctatcaacttgatatttcggttccttcaaagcaaggcacgcattcaaatttggctattcgagcagaaggatttgagaatcgagggccgcatcatcggatttgatgagtatatgaaccttgttctggacgatgctgaagaggtttctattaagaaaaagacacgtaaagtattaggacgtattcttttgaaaggagacaatatcacactaatgatgaatacggggaaataaattttagccaagccatcctctgtattgtaatccagagtttcaacttgttaaattggtacaactaccatggattttgcagttttctagtcacaatatattttatagatttgttcgaacattccaaacatacattgggaatttgggggtaagttgtgagaatgtttctctatactgaccactgttattatcatgtgtgaaatgtatctgattttggaggtatcaccagtattttaagaaatctgaagctctgaacaaggccatagtttttcttatgtacacttttctgagccaatgtttagc

SEQ ID NO: 6532 - DNA, 494 bp, Tripterygium wilfordii
actctagagattaacagccatggctagcaccaaagttcagaggattatgacccaacccattaacctgattttcaggtttctccaaagtaaagctcgaatccagatttggctctttgagcagaaagatttgaggatcgaaggtcgaatcatcggttttgacgagtacatgaatcttgtcctggatgaggctgaagaagttagcattaagaagaagagcaggaagcctttaggaaggattcttctcaaaggagacaacataactctgatgatgaacgcgggaacgtaaattctcatactagcagtaactgtttgctgtttagcaagctgagaatactttgccattccaatcacttggatgttgatgaatgttaaactcgatttacttcctggatgcaatgtactatttccattgaattattttttttgttcctatttattacgtatctagtttctgcattctgatgtactcaagtgtttctggcatcagtcttctc

SEQ ID NO: 6533 - DNA, 445 bp, Vinca minor
ctagtataccgaaaccggagaagaatcggcgtcggcgaagatcggaaacagcagcaatggcgaccacgaaagtacagaggattatgacccaaccaatcaacctgatcttcaggtttcttcagagcaaagctcgaattcagatttggctgttcgaacaaaaggatctgaggattgaaggacgaatcatcggattcgatgagtacatgaatttggttctcgatgatgccgaggaagttagtattaagaagaaaactagaaagcaattgggaaggattcttcttaagggcgataatatcactttgatgatgaataccgccaaataattttcaattatttattttgattattgttgtgcttctctggatgatagattttcttctatttctactgctttctgtaaaacaatcttttttctagtatattaagttgataatgtttatgtttg

SEQ ID NO: 6534 - DNA, 274 bp, Cyclamen graecum
atggcgagcaccaaagtccagcgtattatgactcagcccatcaatctgatattcaggtttctccaaagtaaagctcgtatccagatttggttgtttgagcagaaggacttgaggatcgaaggccgtatcattggctttgatgaatacatgaatttggtcttggacgaggctgaagaagtcaacgttaagaagaaaactagaaaagcactcgggaggattttgctcaaaggagataatattaccctgatgatgaatacagcaagtagggattagc

SEQ ID NO: 6535 - DNA, 1261 bp, Ambrosia trifida
acttccagtgtagctctactactactactacaactagggttttctcttcgactgcgttattattaatcaataataatcgatcaaaggagatacaacaacagtagcagcagcagccatggctaccaaagtccagaggatcatgacccaaccaatcaatctcatctttaggtttctccagagtaaagctcgtattcagatatggctctttgaacagaaggatttgaggatcgaaggccgtattattgggtttgatgagtacatgaatttggttcttgatgaggctgaggaagtcagcataaagaagaagaccagaaaggctctaggcaggattttgctaaaaggggacaatattaccctcatgatgaacgcgggaaagtaaggaggagcatttgcataaggatgatcggtgttggttgctgaatagaagattgcaacttatgttaagacattgttttaatgaatgttaattagggacctctatgagaaatcttctagattacattgatgatttttaggttgtaagcacccaacttttggatatgagcaaattttattggaaagctgcacttttttcttttttggattgttaataatcgaggtccttaactttttttttaatcacagttacataacatataaccaattaccacatttgtgagctcagaaacattaaaccaaagccttacaacatgaactacatcgtccaatccaaaagcttcgaaagtttcgacttgtttttccacattttaatctttgaagcatcgcaattaaagttgcagtcgcactttggtgactcctcaaacgtgttgacatcgaatcccgccttcaacaacccgatcgagaatttcatctcactttcatcccgagtagcctcaacaatatccacccaaaaaaacataagtcttacacttacacctttcaacttcgtcaccttgtcttttctaatcacgccactaatcgttggtttgtacctcactacgtacccatcgttaaaaaaggtacaattatgacctatattaacatggaactccccggtgcttgggtttagagtgtacgatgttacatttgttggaagcactcctatgggtaaatcatatttttgtagcacttcgtacacagtcggttcctgagctacgatggcacaagtgaggacgaggaggaggaggagagggggtattgtggcccgataagtcattatatgagagttggaagatggtggatttagagatgataatataggatatgaatgaggaaatgataa

SEQ ID NO: 6536 - DNA, 617 bp, Ambrosia trifida
cacaccaaaaactacttctagggttggtttctgcgactgcgttatcaatacaacaaaaacaaaagaagaaacatcaataacacacacacacacacacacaaacacacagtagcagcaaccatggctaccaaagtccagagaatcatgacccaacctatcaatctcatctttaggttccttcagagcaaagctcgtattcagatatggttgtttgagcagaaagatttgaggattgaaggccgcattattgggtttgatgagtacatgaatttggttcttgatgaagctgaggaagtcagcataaagaaaaagacccgaaaggctctaggccggattctgctgaaaggagacaacatcacgctcatgatgaacgcgggaaagtaaaaaagaagcatttgcatgaagaggatatctgctgaatagactatttgcagcagcttatgttgatttttgtttcgacatgttaattagggatttatatgagatttgatccggcttatgttaatgtttttaggtttgtaagcactaaacttttggatatattttttgctactgttgctagatgcatcaactacatggtatcgttgtgctgtatttgagctcaatatattatataa

SEQ ID NO: 6537 - DNA, 656 bp, Malus domestica
gcaaatactcggcactcgctagggtttcaatttcataagtcccccgtcgactaaaactctctctcaaccctaagcccatcgaatttcgcagccatggcgagcgctaaagtccagaggattatgacccaacccattaacttgattttcaggttccttcaaagtaaagctcgcattcagatttggctatttgagcagaaggacctcaggattgaaggccgaattattggttttgatgagtacatgaatttggttctggatgaagccgaagaagtcagcatcaagaaaaagaccagaaagtcgttaggaaggattcttctcaaaggagataacattactctgatgatgagcacggggaaatgatggccaatgctgcaagggcttaaaatgaaggttacagtgctttttgaatggatgggggccgagtgatttagatttactgctgttgtaagacgtgtatttggatcagtagtggtatgtattagtatttgcaagtggtatcattaaaccttgtgcattgattgctgacctctatttttaccatgcagaattgtttatgcttaagagcttacatttgattgcacttgttagcctattttcattaaaccttgtgtattgattgcttgggggatatgggtaatgcctacatctttgagcaa

SEQ ID NO: 6538 - DNA, 540 bp, Arabidopsis lyrata
aaaatcgaattagaaattgatattgcaagttttagggttttagaaaatcttcttcactgagttttcgagctccgaagaacacttgcaacttcagcaaccatggcgagcaccaaagttcagaggattatgacccaacccattaatctgattttcagatttctccaaagtaaagctcggattcagatttggctttttgagcagaaagatttgaggattgagggacgaatcactggttttgatgagtacatgaatttggtgctggatgaggctgaggaagtgagcatcaagaagaaaaccagaaaaccacttggaaggattttgcttaaaggagacaacataactctgatgatgaacgcgggcaagtgatgtctgttgcagtggaaggaatgatctaactataagggatggtttaagagttcttgttcccttcttgtttcttctgttgggggaaaacttgtctttctgttgtttacttactgtcaaattgagatatttcactttgcaatttttttttatgagaaaaaagtttcttcaaaaaag

SEQ ID NO: 6539 - DNA, 610 bp, Arabidopsis lyrata
gaaaaatattgaaaagagcgtattattattagcagagagacaaatttagtgaagtctctgtctttttttttttctagggttttagattttctcccagagagaaattttgaaagcttcagagagatttccagctccggcagccatggcgagcaccaaagttcaaaggattatgacccaacctatcaacttgatttttaggtttcttcaaagtaaagctaggatccagatttggctgttcgagcagaaagatttgaggattgaaggaagaatcactggttttgacgaatacatgaatctggtgttggatgaggccgaagaagtgagcatcaagaagaacactaggaaaccacttggaaggattttacttaaaggagacaacataactctgatgatgaacacgggaaagtgatgtctgtctcaataagctctgtcgtggattcgtagatctcgattcttcgatgaccttcaagcttatgttaaatatctgttgagttcttcctcagtttaattggtacttgacgataccttcttttcttcaatgtcgtataatatgcaatgtagtaacaactttgagaaattaaggagcttgatcgaatctagtggattggtt

SEQ ID NO: 6540 - DNA, 495 bp, Arabidopsis thaliana
gttttagatttcctctgagagagaattttcgaaagcttgagagagatttccaactacgttagccatggcgagcaccaaagttcaaaggattatgacccaacctatcaacttgatttttaggtttcttcaaagtaaagctaggatccagatttggctatttgagcagaaagatttgaggattgaaggaagaatcactggttttgacgaatacatgaatctagttttggatgaggctgaagaagtgagcatcaagaagaacaccaggaaaccacttggaaggattttactcaaaggagacaacataactctgatgatgaacacgggaaagtgatgtctgtctcaaacaactctcttcgatgaccttcaagcttatgttaaatatctgttgagttcttcctcagcttaattggtacttgacgataccttcttttcttcaatgtcgtataatatattgcaatgtagtgagtgacaaaggagcttgatcgaatctagtgg

SEQ ID NO: 6541 - DNA, 498 bp, Arabidopsis thaliana
gaattagaaattgcaagttttagggttttagaaaatctatcttcttcactgagttttccagctccgaagaacacttgcaacttcaggcaattatggcgagcaccaaagttcagaggattatgactcaacccattaatctgattttcagatttctccaaagtaaagctcggattcagatttggctttttgagcagaaagatttgaggattgagggacgaattactggttttgatgagtacatgaatttggtgctggatgaggcagaggaagtgagcatcaagaagaaaaccagaaaaccacttggtcggattttgcttaaaggagacaacataactctcatgatgaacgcgggcaagtgatgtctgttgcagtgcaaggaatgatctaattatatggaatggtttaagagttcctgctcccctctcgtttctctgttgggtaaaagttgtctttttgctgtttacttctgtcaacttgagaaatttcaactttgcaaac

SEQ ID NO: 6542 - DNA, 1294 bp, Aristolochia fimbriata
gagtgcaattcgcgggaaaagggaaacccttttcagtcttgcgctactagttatttccgtgcttcttcgtttgattctgacgatcgcgaagttttatctagggttttggttttctctgagcctctgcgagcgaaagggcgggaaagaagccagatcaccagccatggcgaccaccagagttcagaggattatgactcaacccatcaatcttattttccgctttctccaaagtaaagctcgcattcagatttggcttttcgagcagaaggatatgaggatcgaaggtcgcatcatcggatttgatgagtacatgaatttggtcttagatgatgctgaagagcttaacgtcaagaagaatactaaaaagtccttggggaggattcttttaaagggagataacatcactttgatgatgaactcgggaaagtgaaattaattgtacactcagcgatatgtaaactttaagggtattgaatacttccagttctccctgagtatattgtagccaatgtataaatttcattggtacataaccaagacttggatatttgttaaacttgatattgtggtctcttgtcgtcttttgcttaatctaacccgtatagatattctgatttgcactcagctcatgctatttcagtttttttatttgggaatgacaagaagtgttatttgaggaaggaaaagatgatatacacaaattggtgaagtatttcttgttgatagctcttcgcttgaaatatgttctatgctgctagcatttgtcaatcgccttgcatgttgcagaacagtatgcagttggtgatggtagcttataaccgtaacattgttgctgatgatgatattttggcgccagggagcctatttgccgaggagcgggtttccgtcttgtaatggacctgctgaaaagcctgacatctttgattatgtggcttgtaactgtctcaatttcgcccttttgttcccggccgaaagcttcttcctccctgctgcttcagcaaatccatctcttccatttcagcagacgcttctaatgttcctgcgaatggattgcaaacataacctgtaaagtggtgccggcggatgggctgcgggcatgtgatctgatatataatgcaagacgaacgggttccttccctgcaactctgtccgagtacacccgctaaaggtaaagtacaggcaattgtattgttgtagtacacgtgccagtactatcaatagcgtcacttcgaagaaatcattgactcgtactaccatttccgaaggcaactgcgaacacaaggtaaatcggtaa

SEQ ID NO: 6543 - DNA, 486 bp, Arnica chamissonis
gtttttttcttctgcgactgcgtttttaaccaatcgaagaagaagacgataacaacaacagcagccatggctactaaagtccagaggatcatgacccaaccaatcaatctcatcttcaggttcctccagagtaaagctcgtatacagatatggctgtttgagcagaaggatttgaggatcgaaggccgcattatcgggtttgatgaatacatgaatttggttcttgatgaggctgaggaagtcagcataaagaagaagaccagaaaggctctaggcaggattctgctaaaaggggacaatatcaccctcatgatgaatgcggggaagtaacaagcagcatttgcacgaggatgataggtgctcaaaagaattgcagcaacttatgttaagacattgttttgttgaatgtcaattagggacttatttgagaaatgttctagattgcattgatgttttaaggtttgtaagcatacaactattggacat

SEQ ID NO: 6544 - DNA, 492 bp, Arnica chamissonis
ctgcgttatcaatcaaccaaagaagaagatcgataacatcaacagctgcagcaatcatggctaccaaagtccagaggatcatgactcagccaatcaatctcatctttaggttcctccagagtaaagctcgtatacagatatggctgtttgagcagaaagacttgaggattgaaggacgcataattgggtttgatgagtacatgaatttggttcttgatgaggctgaggaagtcagcataaagaaaaagaccagaaaggctctaggcaggattctgctgaaaggggacaacattaccctcatgatgaatgcgggaaagtaaaaaagaagcatttgtatgaggaggataggtgctgaaaagaagatttgcaacttatgctggtctttgttttgatgaatgttagttagggatttctttgagaattgatccagcttatgttgatgtttttttaggtttgtaagcaccaaactttcaatatgtgttacgttactat

SEQ ID NO: 6545 - DNA, 520 bp, Brassica juncea
tgagggtttaacttgatctttttcccccgaagcgtcgagagagagaaatcaaacgtcggcaggcagcgatggcgagcaccaaagttcagaggattatgacccaacctatcaacttgatttttaggtttcttcaaagtaaagctaggatccagatttggctatttgagcagaaagatctgaggattgaaggaaggattactggttttgacgagtacatgaacctagtgctggatgaagctgaagaagtgagcatcaagaagaacaccaggaaaccacttggaaggattctactcaaaggagacaacataactctgatgatgaacacgggaaagtaatgtctgttctcaacaaactatctcgaggattagtggatcggtttttactatctccaaatcttttgctaaatatatgttgagttaagttcttcttcagttaactgataatgccttcttctcttcatgatcgtgtaatattgcaatgtagtgacaagtttgaaaaattatggaacttggttgaatct

SEQ ID NO: 6546 - DNA, 513 bp, Brassica oleracea
gtccaccgaagcttgggagagggagagagaggagagagagagagagagagagaattgaaacgtcgggagcaatggcgagcaccaaagttcaaaggattatgactcaacctatcaacttgatttttaggtttcttcaaagcaaagctaggatccagatttggctttttgagcagaaagatttgaggattgaaggaagaatcactgggtttgacgaatacatgaacctagtgttggatgaagctgaagaagtgagcatcaagaagaacaccagaaaacaacttggaaggattcttcttaaaggagacaacataacgctgatgatgaacacgggaaagtgatgactattctctcaagaaaaactctcaaggattagtatatccaaagcttttgctaagtatatgttgagttgagctcttcttcttcttcagttaactgacaatgccttcttcgttatcgtgtaatattgcaatttagtaagctagtaacaaggtttgagaaattatggagtttggt

SEQ ID NO: 6547 - DNA, 623 bp, Brassica oleracea
aaacgtcggcaggcagcgatggcgagcaccaaagttcagaggattatgacccaacctatcaacttgatttttaggtttcttcaaagtaaagctaggatccagatttggctatttgagcagaaagatctgaggattgaaggaaggattactggttttgacgagtacatgaacctagtgttggatgaagctgaagaagtgagcatcaagaagaacaccaggaaaccacttggaaggattctactcaaaggagacaacataactctgatgatgaacacgggaaagtaatgtctgttctccacaaactctctctagatgattagtggattcgactatctccaaagcttttgctaaatatatgttgagttgagttcttcttcagttaactgataatgccttcttctcttcatgatcgtgtaatattgcaatgtagtgacaagtttgaaaaattatggaacttggttgaatcttatggatggtattgtaccttttggtttgatgtaatgtggagtcctcgtaggttttcaaaaacaaaagtggagtttttatattacaatttgataaaaaacgatatttgttgcaacttttttttcagatgaaaaatttaaccagtttgatttagatta

SEQ ID NO: 6548 - DNA, 642 bp, Brassica rapa
aaagagcgtatctctcctctccgtcagtctctctagggtttaacttgatctttttcccccgaagcgtcgagagagagaaatcaaacgtcggcaggcagcgatggcgagcaccaaagttcagaggattatgacccaacctatcaacttgatttttaggtttcttcaaagtaaagctaggatccagatttggctatttgagcagaaagatctgaggattgaaggaaggattactggttttgacgagtacatgaacctagtgttggatgaagctgaagaagtgagcatcaagaagaacaccaggaaaccacttggaaggattctactcaaaggagacaacataactctgatgatgaacacgggaaagtaatgtctgttctcaacaaactatctcgaggattagtggatcggtttttactatctccaaatcttttgctaaatatatgttgagttaagttcttcttcagttaactgataatgccttcttctcttcatgatcgtgtaatattgcaatgtagtgacaagtttgaaaaattatggaacttggttgaatcttatggacgtaatattgtcataggttttcaaaaaaaaactggagtttttatattacagtttattgaaaacgatatttgttgcaactttttt

SEQ ID NO: 6549 - DNA, 756 bp, Brassica rapa
cagcgactctttctctctcgtcgtgatttagggtttttcttcttcttgtccaccgaagcttgagggagagagagaattgaaacgtcgggagcaatggcgagcaccaaagttcaaaggattatgacccaacctatcaacttgatttttaggtttcttcaaagcaaagctaggatccagatttggctttttgagcagaaagatttgaggattgaaggaagaatcactgggtttgacgaatacatgaacctagtgttggatgaagctgaagaagtgagcatcaagaagaacaccagaaaacaacttggaaggattcttcttaaaggagacaacataacgctgatgatgaacacgggaaagtgatgactattctctcaagaaaaactctcaaggattagtacatgggcttttcgattatatccaaagcttttgccaagtatatgttgagttgagctcctcttcttcttcagttaactgacaatgccttcttctcttcgttatcgtgtaatattgcaatttagtaagttagtagcaaggtttgagaaattatggagtttggtggaatcttaaggatggtattgcctctttttggttaatggaaattactattttcgggaagattgaaattaaccatctcaatagaccaagcagaataatatgttagaagcagacatggttgttaatttgaaatgtgtaattgttaacatagaaataaagatatatgtaccatctatattatgaaaactgaaatactgtttg

SEQ ID NO: 6550 - DNA, 565 bp, Brachypodium distachyon
gacaccctccgagccgcgagcaaaagctagggtttatccacccctactcctcccctaaccccgcccaagctcgacgacgggtccgcagccatggcgtccaccaaggtgcagcggatcatgacccagcccatcaacctcatcttccgcttcctccagagcaaggcgcgcatccagatctggctcttcgagcagaaggacatgcggatcgagggaaggatcatcggctttgacgaatacatgaatttggtcttggaggatgctgaggagatcaacatcaagaaaaacactagaaaatctctgggtcggatcctcctgaaaggagataacattacactaatgatgaatacgggaaagtaacaacagctcactttctctattgcaaggataactaacaatctatgatcttgggctctatgattatgaatatgaggctgtcgtagacatgtgttctcattgatcttttaagacttgtattgtaatgtgccatatttgcacagataacaggctctctgaagttaaagtgtctttatcccgaacgtgatctgatcttaatatcgaccttgga

SEQ ID NO: 6551 - DNA, 570 bp, Brassica napus
tcttcttgtccaccgaagcttgagagagagagagagagaattgaaacgtcgggagcaatggcgagcaccaaagttcaaaggattatgactcaacctatcaacttgatttttaggtttcttcaaagcaaagctaggatccagatttggctttttgagcagaaagatttgaggattgaaggaagaatcactgggtttgacgaatacatgaacctagtgttggatgaagctgaagaagtgagcatcaagaagaacaccagaaaacaacttggaaggattcttcttaaaggagacaacataacgctgatgatgaacacgggaaagtgatagacttttctctcaagaaaaactctcaaggattagtacatgggcttttcgattatatccaaagcttttgctaagtacatgttgagttgagctcctcttcttcttcagttaactgacaatgccttcttctcttcgttatcgtgtaatattgcaatgtagtaagttagtaacaaggtttgagaaattattgagtttgttggaatcttaaggatggtattgcctctttttggttaatggaaattacta

SEQ ID NO: 6552 - DNA, 584 bp, Brassica napus
tctttttcccccgaagcgtcgagagagagagaaatcaaacgtcggcaggcagcgatggcgagcaccaaagttcagaggattatgacccaacctatcaacttgatttttaggtttctgcaaagtaaagctaggatccagatttggctatttgagcagaaagatctgaggattgaaggaaggattactggttttgacgagtacatgaacctagtgttggatgaagctgaagaagtgagcatcaagaagaacaccaggaaaccacttggaaggattctactcaaaggagacaacataactctgatgatgaacacgggaaagtaatgtctgttctcaacaaactatctcgaggattagtggatcggtttttactatctccaaatcttttgctaaatatatgttgagttaagttcttcttcagttaactgataatgccttcttctcttcatgatcgtgtaatattgcaatgtagtgacaagtttgaaaaattatggaacttggttgaatcttatggacgtaatattgtcataggttttcaaaaaaaagtggagtttttatatgggaaattgcaccctatatacatgaaa

SEQ ID NO: 6553 - DNA, 618 bp, Brassica napus
gagagagagagagaattcaaacatcggcaggcagcaatggcgagcaccaaagttcagaggattatgacccaacctatcaacttgatttttaggtttcttcaaagtaaagctaggatccagatttggctatttgagcagaaagatctgaggattgaaggaaggattactggttttgacgagtacatgaaccttgtgttggatgaagctgaagaagtgagcatcaagaagaacaccaggaaaccacttggaaggattctactcaaaggagacaacataactctgatgatgaacacgggaaagtaatgtctgttctccacaaactctctctagatgattagtggattcgactatctccaaagcttttgctaaatatatgttgagttgagttcttcttcagttaactgataatgccttcttctcttcatgatcgtgtaatattgcattgtagtgacaagtttgaaaaattatggaacttggttgaagaatcttatggatggtattgtcccttttggtttgttgtaatgtgagcgtcctcgtaggttttcaaaaacaaaagtggagtttttatattacaatttgataaaaaacgatatttgttgcaacttttttcttagatgt

SEQ ID NO: 6554 - DNA, 625 bp, Brassica napus
ttttcttcttcttgtcaccgaagcttgagggagagagagaattgaaacgtcgggagcaatggcgagcaccaaagttcaaaggattatgacccaacctatcaacttgatttttaggtttcttcaaagcaaagctaggatccagatttggctttttgagcagaaagatttgaggattgaaggaagaatcactgggtttgacgaatacatgaacctagtgttggatgaagctgaagaagtgagcatcaagaagaacaccagaaaacaacttggaaggattcttcttaaaggagacaacataacgctgatgatgaacacgggaaagtgatgactattctctcaagaaaaactctcaaggattagtacatgggcttttcgattatatccaaagcttttgccaagtatatgttgagttgagctcctcttcttcttcagttaactgacaatgccttcttctcttcgttatcgtgtaatattgcaatttagtaagttagtcgcaaggtttgagaaattatggagtttggtggaatcttaaggatggtattgcctctttttggttaatggaaattactattttcgggaagattgaaattaaccatctcaatagaccaagcacaataatatgtta

SEQ ID NO: 6555 - DNA, 572 bp, Centaurea maculosa
ctcttcttctcttttcagggttctttctgcgatttcagggttttttctgcaacttcgttgccaaactaaaggagaaaagctctaatcgccagccgtaacaacagcagccatggctaccaaagtccagaggattatgacccaaccgatcaatttgatctttcggtttcttcagagtaaagctcgtatccagatatggctgtttgagcagaaggatttgaggattgaaggccgtataattgggtttgatgagtacatgaatttggttcttgatgaggctgaggaagtcagcataaagaagaaaaccagaaagcctctaggcaggattttgctgaaaggggacaacattaccctgatgatgaattcgggaaagtaatatggagcattttcttgagggtagcatccatatatgtgctggattatgtttgatgaatgttgttaattagggacatgggttctgtttgcgtttttagatatattcgtttatgtaaggcaccaaactgcaggaaatttgaggagtatgctttatcgatttatgcacagtcgtcaacaaaagacacaatgctattatatca

SEQ ID NO: 6556 - DNA, 1062 bp, Cephalotaxus harringtonia
ttactcatcattgaagtccactggtaagactgaagaaggagaagcacaggaaacccagaaaggaaagcagccatggcgaccaccagagtgcagaggattatgacccaacccatcaacctgatatttcggttccttcaaagcaaagcacgcattcagatttggcttttcgagcagaaggatttaaggattgaggggcgcatcattgggtttgatgagtatatgaaccttgtgctggaagatgctgaagaggtttctattaaaaagaagacacgtaaagtattaggtcgaattcttttgaaaggagataacatcacgctaatgatgaacacggggaaatgaatcttgcaaactgtaaagccattctctgtattataatccagagaaccagcagctgctatattaccttcaacttgccacatggtatatctactgtggattttgcaattttctgttcataatatattccttaaaatttgctcaaacattccaaaggtttggattagatggaggaaagttgtcagaatgtttctttatattgaacattgcttttattatgcttggaatctatcttcttattgaggcattaatggaatcttatgaaatctgaagttctgaacatgacttgaatttttgatgtagactgttctgagtcaatggctaatcatcccatttgtctagttacaagttgaagtgcaggttttgtaacacacaaggatattatttattgttgattaaatgtcttttaatttacactgatttgagtcgaaggttatttgtcctatttgcctagttacaagtctgaagtgcaggatttgtaacacagaaggattgtatgtattgctaaacaaaggtctcctgcgtgatacatggttttagaagttttgtttagtctctggacaatgatcttggatgttttagaactctgattaaagtcatggtactggcagacgacttaagttctgcttttcttgtaatgctattctgcctatttacaaagtttgaacatacatcgacactcttttgcggttcggcactgatgataatttggcgagaatctttaac

SEQ ID NO: 6557 - DNA, 631 bp, Chelidonium majus
ggttttagctcacttttgtattttcttgtcgtctggaattttagggatttagggtttgccgaggaagagaaaaacacaaaccttgcagccatggcgacgagggttcagaggattatgacccagcctatcaatctcatcttcagatttcttcagagtaaagctcgtatacagatctggctttttgagcagaaggatttgaggattgaaggccgcatcatcggttttgatgagtacatgaatttggttcttgatgacgctgaagaagtcaacgtcaagaagaatacaaggaagtcattagggaagattcttttgaaaggagacaacattacgttaatgcagaatacgggcaaatgatgatggcctggtgacatctggtgaaattatgtgggctctgaagtcgagtgcgtagtgcatattatatagttcatgtatcaggagtgaagcccatattctctgattttggatattatctttctttgatttctaggtaactcatgtaaccatggaatctttaaatgattataggatatgattccatgtttctgtacatggttatgaacttgtattttgcagatttcttggttgtgtaccattgcgctgttgcttagataattaaagaatatgtgcttta

SEQ ID NO: 6558 - DNA, 534 bp, Chrysanthemum coronarium
ttctaaattagggttttgtgtgtgcgactgcaaactcttttcctaccacaagatccttcattctcatcagcagccatggcgaccaaagtccagagaatcatgacacagccaatcaatctcatctttaggttccttcagagtaaagctaggattcagatatggcttttcgaacagaaggacttgcgcatcgaagggcgtattattggctttgacgagtacatgaacttggttcttgacgaagctgaggaggtcagcataaagaagaagaccagaaaggcactagggaggattttgctgaagggtgacaacataaccctcatgatgaattcggggaagtgagtaggagcttggacgaggataggtgctgaaacaaattgcaattcatgttggacattgttttgatgaatgtttattagagatttgtatgagaattgatccgtagtatgttgatgttttatgttcttattttgtaaaacccgactgcaggatatatgctaccttatgagcaaatcttattaaaatgttgctttttta

SEQ ID NO: 6559 - DNA, 572 bp, Chrysanthemum coronarium
agcagcaacaacactcttttctaaattagggttttgtgtgtgcgactgcaataatcaattaaaccacaagatccttcattctcatcagcagcagcagccatggcgaccaaagtccagagaatcatgacacaacccatcaatctcatctttaggttccttcagagtaaagccaggattcagatatggcttttcgaacagaaggacttgcgcatcgaagggcgtattattggctttgacgagtacatgaacttggttcttgacgaagctgaggaggtcagcataaagaagaagaccagaaaggcactagggaggattttgctgaagggtgacaacataaccctcatgatgaattcggggaagtgagaaggagcttggatgaggacatgtgctgaaactaattacaacttatgttgggcattgtttgatgaatgttagtcagggatttgtatgagaattgatctatcgtatgttgatgctttatgttcttattttgtaaacaccagactgcaggatatgtcttgtcttatgagcaaatcatattaaaatgttgctttttgtatgggtgttggtca

SEQ ID NO: 6560 - DNA, 564 bp, Chrysanthemum coronarium
cagcaacaacacactcttctaaattagggttttgtgtgtgcgactgcaaacccttctcctaaaaatcaatcaaaccacaagatccttcattctcatcagcagcagcagcagccatggcgaccaaagtccagagaatcatgacacaacccatcaatctcatctttaggttccttcagagtaaagccaggattcagatatggcttttcgaacagaaggacttgcgcatcgaagggcgtattattggctttgacgagtacatgaacttggttcttgacgaagctgaggaggtcagcataaagaagaagaccagaaaggcactagggaggattttgctgaagggtgacaacataaccctcatgatgaattcggggaagtgagtaggagcttggacgaggataggtgctgaaacaaattgcaattcatgttgaacattgttttgatgaatgtttattagagatttgtatgagaattgatccgtagtatgttgatgttttatgttcttattttgtaaaacccgactgcaggatatatgctaccttatgagcaaatcttattaaaatgttg

SEQ ID NO: 6561 - DNA, 713 bp, Cichorium intybus
gaccagaattcagaaaggcggaaacaagggctcacttcactcttctccgcaagagctctctagggttgtctctgcgactgcgttttcaaccaaaggaggtcagccatcacaacagcagccatggcgactaaagtccagaggatcatgacccaaccgatcaatctgatctttcggttcctccaaagtaaagctcgtattcagatatggctatttgagcagaaggacttgaggattgaaggccgcataatcgggtttgatgaatacatgaatttggttcttgatgaggctgaagaagtcagcataaagaagaagaccagaaagcctctaggaaggattctgctgaaaggggacaacattaccctgatgatgaattcgggaaagtaatgaggagcatttgcatttgtgtaggctgaaaacagatttgcaacttatgtttggccttgttttgatgaaatgaattgtgtgagaatagatccgggatatttttagatttttattatgtaagtggggtatttgtcaacttggctttatgatttggtaggttgtattttatatgggagctaagctaatctatcattttgcataaattcctttacttgacaagctacaaaacagtttttatgtatgctttctgcacaaattgtgggaaatagcaacgtactttgccttttatcaatttaagcaatatgcacaccaggaatctgataatgcag

SEQ ID NO: 6562 - DNA, 582 bp, Cirsium arvense
ccttcactcttctctctttcaccactgcggcttgcttctagggttccatctgcgatttctagggttccatctgcaacttcgttaccaaactaaagaagaaaaacctctaatcgcaacaacagcagccatggctaccaaagtccagaggattatgacccaaccgatcaatttgatctttcggtttcttcagagtaaagctcgtatccagatatggctgtttgagcagaaggacttgaggattgaaggccgtataattgggtttgatgagtacatgaatttggttcttgatgaggctgaggaagtcagcataaagaagaaaaccagaaagcctttaggcaggattttgctgaaaggggacaacattaccctgatgatgaattcgggaaagtaatatggagcattttcttgagggtagcatccatatatgtgctggattatgtttgatgaatgttgttaattagggacaagggttctgtttgcgttttgagatatattcgtttatgtaagcaccaaactgcaggaaatttgaggagtatgctttatcgatttatgcacagtcgtcaacaaaagacacaatgctat

SEQ ID NO: 6563 - DNA, 513 bp, Cirsium arvense
tctgcgacttcgttaccaaactaaagaagaaaaaagctctacgtaacaacagcagccatggctaccaaagtccagaggattatgacccaaccgatcaatttgatctttcggtttctccagagtaaagctcgtatccagatatggctgtttgagcagaaggatttgaggattgaaggccgtataattgggtttgatgaatacatgaatttggttcttgatgaggctgaggaagtcagcataaagaagaaaaccagaaagcctctaggcaggattttgctgaaaggggacaacattaccttgatgatgaattcgggaaagtaatatggagcattttcatgagggtagcatccatagatgtgctggattacgtttgatgaatgttgttaattagggacatgggttctgtttgcgtttttagatatattcggtcatgtaagcaccaaactgcaggaaatttgaggaagtatgctttatcgatttatgcacagtcgtcaacaaaagacacaatgctat

SEQ ID NO: 6564 - DNA, 500 bp, Distylium racemosum
aaaatattgaaggcagccatggcaactaccagagtgcagaggattatgacccagcccattaacctgatatttcggttccttcagagcaaagcgcggattcagatttggctttttgagcagaaggatttaagaatcgaggggcgtatcattggatttgacgaatatatgaaccttgtacttgatgatgctgaagaaatttctctcaagaaaaagacgcataaaccattaggccgaatccttttgaaaggagataacatcacactaatgatgaacacgggcaaatgaattgtgtgcagtatgtcaagtatgtcaagatgttctttgtatcatccaagacaaaagactgctgctaaagattagcttttgtaacttttcccttactgccatgcttttttttgatgtgttaaaaagtgcagggtgttttagtccaaagtttcagctgaatgttttgggttgaacattcttattcagttgtttttcaagttcaaatttatacgccc

SEQ ID NO: 6565 - DNA, 611 bp, Echinacea purpurea
gggggatcgagtagaaagaaaggtttcctcatacgagctgtgctaatactagggtttttcttttgcgactgcgttatcaatcgaacataggagaaaagcaggaacaacaacagcagcagcaacaatggctaccaaagtccagaggatcatgacccaaccaatcaatctcatcttcaggttccttcagagtaaagctcgtatacaaatatggttgtttgagcagaaggatttgaggattgaaggccgcattattgggtttgatgagtacatgaatttggttcttgatgaggctgaggaaatcagcgtaaagaagaagaccagaaaggctctaggcaggattctgctaaaaggggacaatattaccctcatgatgaatgcgggaaagtaacaaggaacatttgcgtgaggatgataggtgctgatatgaaagttgcaacttatgtttaagaaattgctttgttgaaatgctaattagggacttctgtgagaaatgttctagattgcatttatgtttttaggtttgtaagcttacaactttgaatgagccaatttgattggaaagctgcatttttcggtattttttataaccttgagaatatttttattcggcc

SEQ ID NO: 6566 - DNA, 756 bp, Adiantum capillus-veneris
ggaggggcgtatactcctcgaccgtcctcgactcctcgttacattccttgactctgtgcgtagccttaggtcttatagctcgagcgtcgaaattcttggcgagcgcaaccatggcgacaacgaaagtgcagcgtattatgacacagcccatcaatctcatattcaggttcctgcaaagtaaatctcgcattcagttctggctctttgagcagaaggacctgagaattgaaggccgcatcatcggttttgatgagtacatgaacctagtgctagatgatgcagaggaggtgtctatcaagaagaaaactcgcaaacccttaggtcgaatattgttgaaaggggacaacatcactttgatgatgaacacggggaagtagtgataggatttttggtagagaccttcttttcatgcttgtggtggccaacgttctgcttttgtttccatggcatccttgcaagtggattagaccatttgactcatcaatggtttagtgtaccctcctttactgaatagctcggtcatatattttctgctgtaaatttttgcatcatggggacatactggcgtatgctgatgcaggggtagggattttcgttgttctgatttttgcgttcaaggtccaagcgcttcgagtggtacctcattcctgcgcattggctccgaaaattgtaatatcaaatcttctggactggtccttgattgtgcttgttttttcatgaacaatggcaaaaatataaatggtcaggttattttgt

SEQ ID NO: 6567 - DNA, 582 bp, Festuca arundinacea
agtggtatcaacgcagagtacggggggcgtatctagggttctttacctctccgctccgctcgccccgcacgccccgcacgcacgcgcttccttccagaagcttctagatacgtccagtcggaggacgagctcccgccgccgcagcagccatggcgtccaccaaggtccagcgtatcatgacccagcccatcaatctcatcttccgattcctccagagcaaagcgcgcatccagatctggctgttcgagcagaaggatatgcggattgagggccgtatcatcggctttgatgagtacatgaacttggttcttgaggatgctgaggaaatcaacattaagaaggacaccaggaagtcgttgggaaggatactcttgaaaggtgacaacataactctgatgatgaacactggaaagtgaagcccctcttcctaggatggctggtgttctcattcctgcgctgagagttcctgtgatactctgtactccatctagactgatatgcatgtagcttgtgattgtggtcactatatgtaatgtctgtcatctacgagtacctatgaactcggtaatccattctgtgaaa

SEQ ID NO: 6568 - DNA, 573 bp, Festuca arundinacea
agtggtatcaacgcagagtacgggggggcgtatctagggttctttacctctccgctccgctcgccccgcacgcacgcgtttccttccagaagcttctagatacttccagtcggaggacgagctcccgccgccgcagcagccatggcgtccacaaaggtccagcgtatcatgacccagcccatcaatctcatcttcaggttcctccagagcaaagcgcgcatccagatctggctgttcgagcagaaggatatgcggattgagggtcgtatcatcggctttgatgagtacatgaacttggttctcgaggatgctgaggaaatcaacattaagaaggacaccaggaagtctttgggaaggatactcttgaaaggtgacaacataactctgatgatgaacactggaaagtgaagcttctctccctaggatgtctggcattctcgttccgtgttgagcattcttgtgatactttgtattccatccaggctgatatgcatgtagcttgtgattgtggtcactgaggatatgtaatgttggttatctaccctatgaactcagtaaaatccattctgtgaa

SEQ ID NO: 6569 - DNA, 575 bp, Festuca arundinacea
agtggtatcaacgcagagtacggggggggcgtatctagggttctttacctctccgctcctctcgccccgcacgcacgcacgcacgcgtttccttccagaagcttctagatacttccagtcggaggacgagctcccgccgccgcagcagccatggcgtccacaaaggtccagcgtatcatgacccagcccatcaatctcatcttcaggttcctccagagcaaagcgcgcatccagatctggctgttcgagcagaaggatatgcgtattgagggccgtatcatcggctttgatgagtacatgaacttggttctcgaggatgctgaggaaatcaacattaagaaggacaccaggaagtctttgggaaggatactcttgaaaggtgacaacataactctgatgatgaacactggaaagtaaagcttctctccctaggatgtttggcattctcgttcctatgttgagcactcctgtgatactttgtaactccatccaggctgatatacatgtagcttgtgattgtggtcactgaggatatgtaatgtttttatctaccctatgaactcagtaaaatccat

SEQ ID NO: 6570 - DNA, 517 bp, Gerbera hybrid cultivar
ggtttagggctgactctgcgactgcgttaccaacaaaacgcgaagagctctactcgccaacagcagccatggccactaaagtccagaggatcatgacccaacccatcaatctgatctttaggttcctccagagtaaagctcgtatacagatatggctgtttgagcagaaggacttgaggattgaaggccgcataattgggttcgatgagtacatgaatttggttcttgacgaggccgaggaagtgagtataaagaagaagacccgaaaggctctagggaggattctgctgaaaggggacaacattaccctcatgatgaattcgggaaagtaacaaggagcgtttgaatcagtataggcgctgaaaagaaagatttgaaatttgtgttgggcattgttttgatgaatgttaatcaggaacttgtgtaagaattggtttgatttcagtaagctggaaatttatcaagacagcatgtcatgtttttctgtttatttgacaaaagcaagtttgaataaaaa

SEQ ID NO: 6571 - DNA, 340 bp, Panax ginseng
aagactgagactagggttttctgtgagaagtaaataaggaagaaggaaaataatctgttgcagaggcgtagtcggagtcagccatggcgagcactaaagtacagaggatcatgactcaacccatcaatctcatattcaggtttcttcaaagtaaagctcgcatacagatatggctttttgagcagaaggatttaaggattgaaggacgcatcattgggtttgatgaatatatgaatctggttcttgatggtgccgaggaagtcagtataaagaagaagagcagaaagcaactgggtaggatcctactgaaaggcgacaacatcacactgatgatgaacac

SEQ ID NO: 6572 - DNA, 734 bp, Lactuca sativa
ggaaactgtaaatgttgaccagaaacaagggctcacttcagtcttctctcccgtaagagctctctagggttgtctctgcggctgcgttatcaatcaaaggagaggacatccacaacaacagcagccatggcgaccaaagtccagaggatcatgacccaaccgatcaatctgatctttaggttcctccagagtaaagctcgtattcagatatggctatttgagcagaaggacttgaggattgaaggccgcataatcgggtttgatgagtacatgaatttggttcttgatgaggctgaagaagtcagcattaagaagaagaccagaaagccactaggaaggattctactaaaaggggacaacattacgctgatgatgaattcgggaaagtgatgaggagcatttgcatcagtgtaggcttaaaacaagatttgcaagttatgttaggcattgttatgatgaagggaattgtgtgtgaattgatccgggatcttgttacatttttattttcatgtaactgagctttatgaactgtaatgttgcattttatatggtatctaagctgatctatcattttgcataaatttctttactttacttgacaaaccacaaaaatctgcacaaattgcgggaaatagcattgtacattgccttttatactggcataggcagtttactgtaagtttgactagcatcgtacatgtagactaaatcagctgcaaattatatgcattttt

SEQ ID NO: 6573 - DNA, 540 bp, Liriodendron tulipifera
aagatcttcttcctgctttctctagggttttggcagacagcgaaatcgcagccatggcgaccaccagagttcaacggattatgacccagcccatcaatcttatctttcgatttcttcagagtaaagctcgcattcagatctggcttttcgagcagaaggatttgaggatcgaagggcgtatcatcggttttgatgagtacatgaacctggttcttgatgatgctgatgaattcaatgttaagaaaaacatcagaaagccattggggaggattcttttgaaaggagataacatcacactgatgatgaacacggggaagtgataatttcacttggaggaaatgtctattctgaggtgtgcgcactctagctttcggtaaaaatcacatggcagcaaacattttcaaatatctgtctaatcgaactggatattttgcgatgactgtgactgcctcttagtgctacttatactgctccgtgtatgcattttattgctagctgtcagcttgtttaaatatcatcagtaggaaatttggctcaaaa

SEQ ID NO: 6574 - DNA, 784 bp, Lolium multiflorum
acaagaaggtccatgggctagacccctagcccaagatctcttgacctcaggtttgacgaaccgcaaagggaaagcccccgcctagctcgcgccaagcaagctagggtttttccgccgccgtgaaagctcgtcgacggcgcgccagaggaggggggcgagaggagcgcagcctagcccgccgccatggcgtccaccaaggtgcagcggatcatgacccagcccatcaacctcatcttcagattcctccagagcaaggcgcgcatccagatctggctcttcgagcagaaggacatgcggatcgagggcaggatcatcggctttgatgaatacatgaatttggtcctggaggatgccgaggagatcaacatcaagaaagacactaggaaatctctgggtcggatcctcttgaaaggagataacattacgctaatgatgaacacgggaaagtaacaatagctctatgtctgctttattgcaaggataagtatcaacctatatatcctgagctcgaatgaaggcgaaattgaggctgtagtagacttcatctccgtcttgtccaaatttgattgtaatataccatattggccaggcatagtaggggccctgtgaagttgaagtgtgttatccagaccatgaatttcgtgcttgggctagcttcattattatgcagtggtgttgatgctctggtggtttgttatttcattgaaatatgaacttggtcagatggtcatggaattggtttgaattttcgagaccctcgtaatatgaaagggtccttacctgc

SEQ ID NO: 6575 - DNA, 632 bp, Lolium multiflorum
ggcggcctatctagggtttctttgcctctccgttcctctcgctccacacgcgcttccttccagaagcttctagatacgcccagtcggaggaggagctcccgccgcagcagcagcagccatggcgtccaccaaggtccagcgtatcatgacccagcccatcaatctcatcttccgattcctccagagcaaagcgcgcatccagatctggctgttcgagcagaaggatatgcggattgagggccgtatcatcggctttgatgagtacatgaacttggttcttgaggatgctgaggaaatcaacattaagaaggacaccaggaagtcgttgggaaggatactcttgaaaggtgacaacataactctgatgatgaacactggaaagtgaagcccctcttcctaggatggctggtgttctcattcctgggctgagcgttcctgtgatactttgtactccatctagactgatatgcatgtagcttgcgattgtgtcactatatgtaatgtttgtcatctacgagtacctatgtactcagtaacccattctgtgaaccatgtgcatgatgtctgagataatgagcttatctcttgtgcttaagattaacatgaacagactgctatgttgacttgtttgc

SEQ ID NO: 6576 - DNA, 546 bp, Lolium multiflorum
cgccgccgcagcagcagccatggcgtccaccaaggtccagcgtatcatgacccagcccatcaatctcatcttccgattcctccagagcaaagcgcgcatccagatctggctgttcgagcagaaggatatgcggattgagggccgtatcatcggctttgatgagtacatgaacttggttctcgaggatgctgaggaaatcaacattaagaaggacaccaggaagtcgttgggaaggatactcttgaaaggtgacaacataactctgatgatgaacactggaaagtgaagcccctcttcctaggatggctggtgttctcattcctgggctgagcgttcctgtgatactttgtactccatctcgactgatatgcatgtagcttgtgattgtggtcactatatgtaatgtctgtcatctatgggtacctatgagctcagtaatccattctgagataatgagcttatctcttgtgcttaagattaacatgaacagactgctatgttgacttgtttgctggctctcagttatcactatcttctgttttataa

SEQ ID NO: 6577 - DNA, 594 bp, Lolium multiflorum
ggcggcctatctagggtttctttgcctctctccgttcctctcgctccacacgcgcttccttccagaagcttctagatacgcccagtcggaggaggagctcccgccgcagcagcagcagccatggcgtccaccaaggtccagcgtatcatgacccagcccatcaacctcatcttccgattcctccagagcaaagcgcgcatccagatctggctgttcgagcagaaggatatgcggattgagggccgtatcatcggctttgatgagtacatgaacttggttctcgaggatgctgaggaaatcaacattaagaaggacaccaggaagtcgttgggaaggatactcttgaaaggtgacaacataactctgatgatgaacactggaaagtgaagcccctcttcctaggatggctggtgttctcattcctgggctgagcgttcctgtgatactttgtactccatctcgactgatatgcatgtagcttgtgattgtggtcactatatgtaatgtctgtcatctacgagtatctatgaactcagtaacccattctgtgaaccaagtgcatgatgtctgagataatgagcttatctcttgtgc

SEQ ID NO: 6578 - DNA, 751 bp, Marchantia polymorpha
ctgcgttcggatttggaaatttctctcgacacctcgagcgaagtaaaaaacgcgcgcaaccatggcgaccaccaaagtgcagcggattatgacacagccgatcaacttaatctttcgatttttgcaaagtaaatcgaggattcaaatttggttgttcgaacagaaggacctccgaattgagggccgtattattggttttgatgagtacatgaatcttgtactcgaggatgccgaggagatctctctaaagaagaaaaccaagaagcccctgggaagaattcttctgaaaggtgacaacatcacgttgatgatgaatacgggcaaatgatacaacgatgttaactacactgggaagtagtgaactatgcagcactttgaagatgcactggttatcaaccttttagataccacttgcactggaggttattccacttttgacactcgctcactttggaaactccaacgaccatcttgatgttttttacaaggtgtcaaggtcacacgtagtatctgaacagcagttggaaatagcggcgcattgctaaacgcctgctaagacttgcagggagttttgtcgtggtgaagctgaacaccaagtctggtggcttcatcatctgccctgtgaggtgtacattgtatagcgcatgtttgaccggtcaagtacaaaagatgatattatttccaattacatacagatttgttcctctgttactcgcctggcagagcagtaacaatttttttaaaaaaaaaa

SEQ ID NO: 6579 - DNA, 690 bp, Pennisetum glaucum
ctcctcccttcctcccttcctctccgcctccccagctcgcagtcgcaggtcttgctagggtttcgtctccccgccgcgcgcgcgcctcgcctcgcctccggaagcttccagacgctcgttagaggagctcccgccgccgcatcagccatggcgtccaccaaggtccagcgtatcatgacccagcccatcaacctcatcttcaggttcctccagagcaaagcgcgtatccagatctggctgttcgagcagaaggatctccggattgagggtcgcatcattggctttgatgagtacatgaacttggtccttgaggatgctgaggaaatcaacattaagaagaacactaggaaatcattgggtaggatactcctgaaaggtgacaacataactttgatgatgaactctggcaagtgatgaaggggggagatgtgagatgtttggcacctagtattaccttgagaaatttgtactccatccagactgaaatgtagcgtgtcattgtgcgctgagtcgttgtactccatccagaccgaaaatgtagcatgtcattgtggaagtgagaatgtgagatagttgccgctgttgactaccaggggttaactttgtgtgatctgatgctagatttgataatgagctgctctctgctgctctgtagatcaacatgacttgtgtgctttattgtcatctttt

SEQ ID NO: 6580 - DNA, 749 bp, Avena sativa
aaacaaaacccggccgtctccctcctcccccgcggcgtatctagggttttttccctctcccctccgctcgccccacacgcgcttccttccagaagcttctagatacttccagtcggaggacgagctcccgccctcgcgtcagccatggcgtccaccaaggtccagcgtatcatgacccagcccatcaatctcatcttccggttcctccagagcaaagcgcgcatccagatctggctgttcgagcagaaggatatgcgtattgagggtcgtatcattggctttgatgagtacatgaacttggtcctcgaggatgctgaggagatcaacattaagaagaacaccaggaagtcgttgggaagaatactcttgaaaggagacaacataactctgatgatgaacactggaaagtgaagcttctctccctagtatggctgccattctcgttcctgtgttgagcaccatgcgatactttgtactccatccaggctggtatgcatgtagcttgacattttggtcgctgaggatatgtaactgtctacctatgaactcagtaatccattctgtgaaccctgagcatgatgtttgagatatcgtgcttatcgcttgtgtttaagattaacgcgaacagactgccatgttgacttgtttgttggcttcagttatcagcatatgttctataattatatgtatactatgatgtaaccggctgaacatattgaccatgtatttgtattggctgcgttatttgt

SEQ ID NO: 6581 - DNA, 667 bp, Avena sativa
agcctgcctagcccgccgccatggcgtccaccaaggtgcagcggatcatgacccagcccatcaacctcatcttccggttcctccagagcaaggcgcgcatccagatctggctcttcgagcagaaggacatgcggatcgagggcaggatcatcggctttgacgagtacatgaatttggtcttggaggatgccgaggagatcaacatcaagaagaacactaggaaatctctgggtcggatcctcttgaaaggagataacattacactaatgatgaacacgggaaagtagcaatagctctactctactgcaaggataactaacaacgcatatatcccgagcttgtatgatgattgtgaaactgaagctgtggtagacttttctctccgccttctcgtcctatgtttgattgtaagatactaccatgttggccgcagattattactctgaaattgaagtgtgttatccagaccatgaatttcgtgcttgggctagcttaattatattacttaaaaggtattcaggctctggtggtttgtgctctcagtgaaacatgtactcggtcagatggtctgcttggaattggtctgaattttgaagggcttgtaagaatccttctcggaagaaaaagagagataataggaaaaccctctgttgaagttctgatgatt

SEQ ID NO: 6582 - DNA, 629 bp, Avena sativa
caagcaagctagggtttttccgccgccgtgcaagctcgtcgacggcgcgcgagaggagaggagcgcgcagcctgcctagcccgccgccatggcgtccaccaaggtgcagcggatcatgacccagcccatcaacctcatcttccggttcctccagagcaaggcgcgcatccagatctggctcttcgagcagaaggacatgcggatcgagggcaggatcatcggatttgacgagtacatgaatttggtcttggaggatgccgaggagatcaacatcaagaagaacactaggaaatctctgggtcggatcctcttgaaaggagataacattacactaatgatgaacacgggaaagtagcaatagctcactgcctactctactgcaaggataactaacaacgcatatatcccgagctcgtatgatgattgtgaaactgaagctgtggtagactttcctctccgccttctcgtcctatgtttgattgtaaaatactaccatgttggtcgcagattattactccgaaattgaagtgtgttatccagaccatgaatttcgtgcttgggctagcttaattatattattagaaggtattgaggctctggtggtttgtgctctcagttgaacatgtact

SEQ ID NO: 6583 - DNA, 523 bp, Parthenium argentatum
gggcgttcctacaagctctacatatactagggttttctctgcgactgcgttattaatcgatcaaagaacaacaacatcaacagctaaacaacagcagcagcagtcatggctaccaaagtacagaggatcatgacccaaccaatcaatctcatctttaggttcctccagagtaaagctcgtatacagatatggctgtttgagcagaaggatttgaggatcgaaggccgcattattgggtttgatgagtacatgaatttggttcttgatgaggctgaggaagtcagcataaagaagaagaccagaaaggctctaggcaggattttgctaaaaggggacaatatcaccctcatgatgaacgcgggtaagtaacaaggagcatttgtatggggatgatagatgctgattgctgaagagaagatttgcaacttatgttaagacattgttttgatgaatgttaattagggactagtgtgagaaatgttctagattacattgatgtttctaggtttgtaaactttcggat

SEQ ID NO: 6584 - DNA, 1083 bp, Physcomitrella patens
cactgttccataagctttctcgccccgttactctagggttttggcgactcacaagcgcagcggagagtgtgagagagcttcgtctgcttcttctagctcgtggttgtagcgctcgttttcctcttgtttgccggtggcagggtagttggaaagccggacaccatggcgaccaaggtgcagcggattatgacccagcccatcaaccttattttccgttttcttcagagtaagtccaggattcagatatggctcttcgagcagaaagatctgcgcatcgagggtcgtatcattgggttcgatgagtacatgaacctggttctcgatgaggcagaggaggtttcactcaagaagaagacgcggaagccgttgggtcggatattgctgaagggtgacaacatcacgcttatgatgaataccgggaagtgagatcctggagggaggatgcgacattgtcgtaaacgctgcatgtagcatgaccagaagagaatccatcgaaatatggtttgctgccggagatcatgaaattactgatagtcagccgcatgtatcttgtggagcatgccttgatgtttttattctagcggtctcaagtctgcttgtcctgcaaggaattttagtatgttgaagacaatgagcaaattagaaggcttgaaaggtttgaaggagctcatacttgtatggattttgtatttgaaatatctaggtttatttccttctccctccctccatttgcgtatccttgcagtcaaacagtacattcttctagccctaagcattacaggcatctcaaatgtatgagactttttcaagtgttgcaatcttttcatgaaatctgtcacgttttatctcgaatattgccagcagcactaattcattaacgaagtatatttgaaatgcaaggtagatcaagatgatgaaattttgttaaggaaattgatacgtattattgagtagtgttatgaggaagggatatctgaattccatttagggcctgacacaccaaaaagtgcttggatttggagcacatttttgtattcacatgctgaaatgtagaggcaagtgatccaagtttatggagtcgtt

SEQ ID NO: 6585 - DNA, 1341 bp, Physcomitrella patens
ctttgtttcacggactggaggttttgttagggtttagcacaaggtgattgagtcgtagtcttggatcacgctcgtctgtgagcttgtgtccctttgaaagatttttccggtggcagggtggttgaaagctcggacgccatggcgaccaaggtgcagcggattatgacacagcccatcaatcttattttccgtttcttgcagagtaagtcgaggatccagatatggttgttcgagcagaaggacttgcgcatcgagggtcgtatcatcgggttcgacgagtatatgaacctcgtgctcgatgaggcggaagaggtttccttgaagaagaaaacgcgcaagccgttgggccgaatattgctcaagggggataatatcacacttatgatgaataccggaaagtaaagttcggaagggatggcgacgcaccagataatgtatcgaaaaatgtacgtcgtcgggttggattcgtttattttagattattttagattagggcttcttcctagtttgttttatgaggcctgtcactcctacgcacggagtagtcaaggtgtttttttctacctctgcgtcgacaccgaaatgcagggtttgacattctgcgatacgcagtgtgcacatgagcttttgtacatatagctcagggagtcgattattgagaaaagctgaatgtcgcatctgggcggggttggagctttttgcctccgttgagcatcttcaaagtaaactctattatttgcaaaagtcacgaaattgtgtatgcttgtcgggcgatcacatgttcaagttctctctttttagagtcattggagaggccagagtattatttgatggtattcgataagaacgcgtcgatcacgtcataaacgaccttcctatatgcccaccctatctaaatattgaaatacttattttccatcattttaaataccgctgtgtgctaagcggatctgatggattcttgaactgcttgtgggtcgtattattgttcgaggaagggaagataaaagctgctgcaaccacgcaatcaccaagccatagttatcctatcttcaagatggggttgtatctaacgtattctgggatgagagattgatttccattacagtgattgaagcagtgatcatcaaactacaaatacctagcaggctgctagcaacggcatgctgtctacgctctacacactacaaacggtagcgctcctacttcccacattttgactactattatctaaagtggattatcctgggcagtgcatcggtgatccgaaggcatgataggtggatacagcagtatagttagaacgtttacacaatatcaacaaaacaaagtgcttgacat

SEQ ID NO: 6586 - DNA, 585 bp, Platanus occidentalis
ttagcatctcttgaacgtcttcggtgagaggaaaaactgagcttacagccatggcgactaccagagttcagaggatcatgacccagcccatcaatctcattttcaggtttcttcaaagcaaagctcgcattcaaatttggctttttgagcagaaggatttgaggattgaagggcgtataattgggtttgatgagtacatgaatttggttttggatgaggctgaagaagtccatgtcaagaaaaacaccagaaagccgttagggaggattcttcttaagggagacaacatcactctgatgatgaacacgggcaaatgatgatcattctggggacattgtcgaactctgtcatccccaatgtgcctttttcagactacatggtagccaatgttacttcagatattttggttgtgtgggatactatatgtcgttttctaagattgccaattaggtcaggtgtttgagaagttgaacattgctttagaaatttccttcaaacaactttttgtatcaagctaatttattgagctaccgcataaaaaagaatttcaggtttatcatttttctttatatgggcgtggtcaaa

SEQ ID NO: 6587 - DNA, 572 bp, Raphanus sativus
gggtctttggtgttgatttagggtttaaagagttgggaagattgagagagaattgagagagtcgggagcaatggcgagcaccaaagttcaaaggattatgacccaacctatcaacttgatttttaggtttcttcaaagcaaagcgaggatccagatttggctctttgagcagaaagatttgaggattgaaggaagaatcactgggttcgacgaatacatgaacctagtgttggatgaagctgaagaagtgagcatcaagaagaacaccagaaaacaacttggaaggattctacttaaaggagacaacataacgctgatgatgaacacgggaaagtaatcacactattctctcaagtctcaagaaacactctcgtggtggagcagtagatggtgtcttttcgattatctcccaagcatttgcttaattgagctcttcttcttcttctgttaactgacaatggtttcttctcttctttatcgtgtaattgcaatgtagtaaaaaggtttgagaaattatggagtttcgtggaatctaaaggatgctatttgcctaaagcttactattgcattct

SEQ ID NO: 6588 - DNA, 532 bp, Raphanus sativus
gagagagagaattcaaacgccggcagcgatggcgagcaccaaagttcagaggattatgacccaacctatcaacttgatttttaggtttcttcaaagtaaagctaggatccagatttggctttttgagcagaaagatctcaggattgaaggaaggattactggttttgacgagtacatgaacctagtgttggatgaagctgaagaagttagcatcaagaagaacaccaggaaaccacttggaaggattctactcaaaggagacaacatcactctgatgatgaacacgggaaagtaatgtctgctctcaacaaactctctcgtggattagtagatttgcttttcgactatctccaaagcttttactaaatgtatgttgagtttagttcttcaattatctgataatgccttcttctcttcatgatcgtctaatgctgcaatgtagtgacaagtttgagaaattatggaacttggttgaatcttatggatggtattgtccttttagtttcatgtatgctactaacactgtttttcc

SEQ ID NO: 6589 - DNA, 914 bp, Raphanus sativus
gctttagcaacgcgtatacatatgtaatcttggagatataaatgtagatcgatgaatcaatactctcgaagaacaagtgcagtgaatacttaagtattagactaatagtctttgaacaaatccatacgaagagatgtgattcagaatcttgaatgaaagaagaaataaaaatatataatggcagatctttgaattttcttgacaagcgtgtgcccatctatacctaaactaagcacatgatttttataaaaagatccaaaaggaccacccaaaaagaaaataagttttcaagaccaataatttaccactggggattaacggccctacaactaagggagagagagagagaattcaaacgtcggcagcgatggcgagcaccaaagttcagaggattatgacccaacctatcaacttgatttttaggtttcttcaaagtaaagctaggatccagatttggctttttgagcagaaagatctcaggattgaaggaaggattactggttttgacgagtacatgaacctagtgttggatgaagctgaagaagttagcatcaagaagaacaccaggaaaccacttggaaggattctgcttaaaggagacaacatcactctgatgatgaacacgggaaagtaatgtctgttctcaacactctctcgaggattagtggatctgcgtttcgactatctccaaagcttttgctaaatatatgttgagttaagttcttcttcagttgactgataataccttcttctcttcatgatcgtgtaatattgcaatgtagtgacaagtttgagaaattatggaacttggtggttgaatcttattagtaacactgtttttcttttgtttggagtattgtattacaaaagagtcgaattgtttcacaatttattaaaaatcgatatttgctgca

SEQ ID NO: 6590 - DNA, 908 bp, Secale cereale
aaacaaaaccctgccgtctcccccttcccctgcggcgtatctagggtttttttacctccccgctccgcccgcccacacgcgcttcccaagaaggttctagacacttccagtcggaggaggagctcacgccgcagcagcagccatggcgtccaccaaggtccagcgtatcatgacccagcccatcaatctcatctttcggttcctacagagcaaagcgcgcatccagatctggcttttcgagcagaaggatatgcggattgagggtcgtatcatcggctttgatgagtacatgaacctggttctcgaggatgctgaggaaatcaacattaagaagaacaccaggaaatcgttgggaaggatactcttgaaaggcgacaacataactctgatgatgaacactggaaagtgaagcttctctctctaggatggctagcgttgtcgttcctgtgtcgagcattcctgtgatactttgtactccacccaggcctatatgcatgtagcttgtcgttgtggtcactgaggatatgtaacttctgttgtctatctatgaacccagacccagtaaacccattctgcccactccgtgcaagttgtttgatcaagatgatgtgcttatcggttgtgtttaagattgacatgaacagaccttgttggcttgtttgttgagtttattagttacgactgtacgttatgttttttcaactgcttatgagtggaaacttgatttcccttgcgctgaaggactgctagctgaaactgaatttgctaccagatgactcggcaaagttaattatcaacatgtatttatttgtataaattttattctagggtacaaagttcattataaacatagatttatctgtatattatgatgggaaagaacagaatcggttttaaattctttaacc

SEQ ID NO: 6591 - DNA, 607 bp, Salvia sclarea
ctactagaccttggctgtcactcaagagagagagagacgaattatttgcagcaattccaccagaagcagaagcagcagcagctatggcgagcacgaaagttcagcgtattatgacccaacctattaacctgatcttcaggtatctgcagagcaaagcgcgcattcagatttggctgtttgagcagaaggatctgaggatcgagggccgaataatcgggttcgacgagtacatgaatttggtgttggacgaagctgaggaggtcaacatcaagaagaacaccaggaagcagctcggtaggattttgttgaagggagataacatcacgctcatgatgaacactgccaagtgatgctcagataccaggcttaaagactaacgaaggggctgtcttcttgtacttctttcagaatgacttggtctacttttgtctctttaggatctctccatttgcttagcctgtttcactctcaccccaccccgtccattgtttctctcgttatcctacttctttatacatgtatgttactgtgtttgtgaacaaagatttgctagtattcgaagttggatatcatgtaaagaagagaatttgcttgaatctggctactg

SEQ ID NO: 6592 - DNA, 648 bp, Senecio madagascariensis
aagcagtggtatcaacgcagagtacgcggggaagcagaacgaaaaaaagggcttcttcacactctctcgtaagctagggtttactctgcaactgcgtccctttatcaatcaatcaatcaatcgtaaatcaaacaacaaattcagcagccatggcgactaaagttcaaaggattatgactcaaccaatcaatctcatcttcagatttctccagagtaaagctcggattcagatttggttgtttgaacagaaggatttgaggattgaaggtcgtattattgggtttgatgagtacatgaatttggtgctcgacgaggctgaggaagtcagcatcaaaaagaagactagaaagccactaggcaggattttgctgaaaggagacaacattaccctgatgatgaactcgggaaagtaacgaggaggaacatttgcatgaggataggtgcggaaaagaagaaacgtggcttatgttaggcattgttttgatgaatgttaattagtgacttgtgtgagaattgtgttgaaatttctaggctttaatgtttgtaagcacccaactgcagtaaaattttatatgttcaccttatgagcaaatcttattaaaaagttgcatttagcgtaaaattctgtacctcggccgcgaccacgct

SEQ ID NO: 6593 - DNA, 515 bp, Helianthus annuus
cacaccaccaactctgctctagggttttctcttcaatcaacaaagaagaagaagaagatcgataacatcaacaccagcagcagccatggctaccaaagtccagaggattatgacccaacctatcaatctcatctttaggttcctccagagcaaagctcgtattcagatatggttgtttgagcagaaagatttgaggattgaaggtcgcataattgggtttgatgagtacatgaatttggttcttgatgaggctgaggaagtcagcataaagaaaaagacacgaaaggctctaggccggattctgctgaaaggagacaacattaccctcatgatgaacgcgggaaagtaaaaagaagcatttgcatgaagaggatatgtgctgaatagatgatttgcagcatcttatgttatttttgtttcgatgattgttaactaggcacttctgtgagaattgattgtcttatgttgatgttttttagtttgtaagcacccaacttttggatatatgttactat

SEQ ID NO: 6594 - DNA, 518 bp, Helianthus annuus
agggttttctctgcgactactgcgttatcaatcaatcgatcaaagtagaaacagctacaacatcagcagcagcagccatggctaccaaagtccagaggatcatgacccaaccaattaatctcatctttaggttcctccagagtaaagctcgcatacagatatggctgtttgagcagaaggatttgagaatcgaaggtcgcattattgggtttgatgagtacatgaatttggttcttgatgaggctgaggaagtcagcataaagaagaagaccagaaaggctctaggcaggattctgctaaaaggggacaatattaccctcatgatgaacgcgggaaagtaacaaggagcacttgcatgaggatgataggtgctgaaaagaagatttgcaacttatgttgagatattgttttaatgaatgttaattagggacttttgtgagaaatgttctagattacattgatgctttttaggtttgtaagcacccaacttttggattgagcaaattttattggaaagc

SEQ ID NO: 6595 - DNA, 438 bp, Helianthus annuus
cagcagccatggctaccaaagtccagaggatcatgacccaaccaattaatctcatctttaggttcctccagagtaaagctcgcatacagatatggctgtttgagcagaaagatttgagaatcgaaggtcgcataattgggtttgatgagtacatgaatttggttcttgatgaggctgaggaagtcagcataaagaaaaagacacgaaaggctctaggccggattctgctgaaaggagacaacattaccctcatgatgaacgcgggaaagtaaaaagaagcatttgcatgaagaggatatgtgctgaatagatgatttgcagcatcttatgttatttttgttttgacgattgttaactaggcacttctgtgagaattgatcgtcttatgtcgatgtttttaagtttgtaagcacccaacttttggatatatgttactat

SEQ ID NO: 6596 - DNA, 510 bp, Helianthus annuus
ctagggttttctctgcgactactgcgttatcaaatcaatcgatcaaagtagaaacagctacaacatcaacagcagccatggctaccaaagtccagaggatcatgacccaaccaattaatctcatctttaggttcctccagagtaaagctcgcatacagatatggctgtttgagcagaaggatttgagaatcgaaggtcgcattattgggtttgatgagtacatgaatttggttcttgatgaggctgaggaagtcagcataaagaagaagaccagaaaggctctaggcaggattctgctaaaaggggacaatattaccctcatgatgaacgcgggaaagtaacaaggagcacttgcatgaggatgataggtgctgaaaagaagatttgcaacttatattgtttaattgaatgttaattagggacttttgtgagaaatgttctagattacattgatgctttttaggtttgtaagcacccaacttttggattgaccaaattttattggaaagc

SEQ ID NO: 6597 - DNA, 482 bp, Helianthus annuus
aatcgatcaaagtagaaacagctacaacatcagcagcagccatggctaccaaagtccagaggatcatgacccaaccaattaatctcatctttaggttcctccagagtaaagctcgcatacagatatggctgtttgagcagaaggatttgagaatcgaaggtcgcattattgggtttgatgagtacatgaatttggttcttgatgaggctgaggaagtcagcataaagaagaagaccagaaaggctctaggcaggattctgctaaaaggggataatattaccctcatgatgaacgcgggaaagtaacaaggagcacttgcatgaggatgataggcgctgaaaagaagatttgcaacttatgttgagatattgttttaatgaatgttaattagggacttttgtgagaaatgttctagattacattgatgccttttaggcttgtaagcacccaacttttggattgagcaaatttcattggaaagc

SEQ ID NO: 6598 - DNA, 763 bp, Taxus baccata
aagaaggcttttgtcatatttcaagattcttccccggcgaagcgcgctaataataattcgaggaggagaagcccaggaaaaccagagagcaaagcaaccatggcgaccaccagagtgcaaaggattatgacccaacccatcaacctgatatttcggtttcttcaaagcaaagcacgcattcagatttggcttttcgagcagaaagatttgaggattgagggacgcatcattggatttgatgagtatatgaaccttgtgttggaagatgctgaagaggtttctataaaaaaaaagacacgcaaagtattagggcgaattcttttgaaaggagataacatcacactaatgatgaacacggggaaatgaattgtatgcactgtcaaacaattctctgtattataatccagagaaccagttgctttattgacgtcaacttgccacacggtatatctactgtggattttgcaagtttctgttcataatatattttatgaatttgtccaagcattttaaaagtttggattggatggagggaggttgtcagaatgtttctctatactaagcatttcttttattatatgtggattgtagcttgttattgaggcatcaatgaaatcttacaaaatctgaagttttgaacatgacgtgaactttcaacgtagactgttctgagtcaatgactaattcattgtatttgtttagttacaagtgcaggtttgtaacacaaaaggataatgtttagtgccgatcaaatgtctttaat

SEQ ID NO: 6599 - DNA, 502 bp, Eutrema halophilum
gatttagggttttagagttgagttcctctcagagaaatttttttcctccgaagcttcagagagatttcaaacgtcggcaacaatggcgagcacgaaagtacaacgcatcatgacccaaccgatcaacttgatttttaggtttcttcaaagtaaagctaggatccagatttggctatttgagcagaaagatctgaggattgaaggaagaattactggttttgacgaatacatgaatctagtgttagatgaagctgaagaagtgagcatcaagaagaacacaaggaaaccacttggaaggattctactaaaaggagacaacataactctgatgatgaacacgggaaagtgatgtctgtctcaacaaacaaactctgtggtggatttgtagatccgatattaaaattaaccttttggtttgatgtaatgttgagttttcattacttaagaggataaaggttgaattgtttcatagttcattaagatgattgatttttgctgcaac

SEQ ID NO: 6600 - DNA, 515 bp, Vinca minor
cgtcgtcttcttcctctcgctagggtttattaactcaaaaagttcagagagcaacaatcaaagccatggctaccaccaaagttcagaggattatgacccaacccatcaatctcatcttcaggtttcttcaaagcaaagcacggattcagatttggctttttgagcagaaggatttgaggattgaaggacgcatcattggttttgatgagtatatgaatttgactttggatgatgctgaggaagtctccataaagaagaagaccagaaagcaactaggcaggatacttctcaagggggacaacatcaccttgatgatgaatactgcaaaataatgtcccagacatcctgattgaagatgaagagtaaatttaagcatcgacaagtggagttggatgtttagaattctcgaaaacatcgactgtagtgattatgtaagcctgatgagtggattacctattttaatgcacagttgtgtgtgagaaagtcttttatgattagctatgctgtaactttcg

SEQ ID NO: 6601 - DNA, 473 bp, Vinca minor
agccatggccaccaccaaagttcagaggattatgacccaacccatcaatctcatcttcaggtttcttcaaagcaaagctaagattcagatttggctttttgagcagaaggatttgaggattgaaggacgcatcattggttttgatgagtacatgaatttggttctggatgatgctgaggaagtccatataaagaagaagaccagaaagcaactaggcaggatacttctcaagggggacaacatcaccttgatgatgaatactgcaaagtaatgtcccggaattcctgatcacagatgaagagtaaattttagcaacaagcagtggaattcgatatttagaaatttcaagaatgattatgtaacttgatgagtagatttcctatttgatgcacagccttatgtgagaattttttatgaatatcgtagcctatgttgtaaacttcagaagtggtatgaagtgaatgctttcaaat

SEQ ID NO: 6602 - DNA, 787 bp, Triticum aestivum
cctcctggaactggaagcaagcaaagcacgctagggtttcccttccgccggggaccctgcaggcccagggctcgtcggcgagggggagcgcggacggcggcagccatggcgtccaccaaggtgcagcggatcatgacccagcccatcaacctcatcttccgcttcctccagagcaaggcgcgcatccagatctggctcttcgagcagaaggacgcgcggatcgagggcaggatcatcggctttgatgaatacatgaatctggtcttggaggatgctgaggagatcaacatcaagaaaaacactaggaagtctctcggtcggatcctcttgaaaggggataacattacactaatgatgaacacgggaaagtaacaacagcccagtgactgttctattgcaaggataactaacaacctacgtatcctgagctcctaggattgcaaacttggggccgtaacagacattcctctctgtgttctcgtctaaatttgattgtaatagaatatgttttgccagagagaataggctctgtgaggtaaaagtgtgttatccagatcatgagcttagcacttgtactagcttaattcagaggcattgatgttctggtggtttgtgctctcattgaaatattaacgtggtggtctgattgttcttttggaattttttaggcccctgtgtaagataaaagtatcattctgtgaaagttcttgtcacgaaattacttctcctcggtttgcatttcagctgcctgtatgctatgttttcacggtgatatttctttcttaag

SEQ ID NO: 6603 - DNA, 930 bp, Triticum aestivum
gcctagcccaaacagctcctctgatccggacccttcatcggacttgaggcacccccgctgccgcctcttctcgctcgccgtgcgaaacaaagccctgccgtctccctcttcccctgcgacgtatctagggtttttacctccccgctccgcctgcccacacgcgcttccctccagaagcttctagacacttccagtcggaggaggagctcacgccgcagcagcagccatggcgtccaccaaggtccagcgtatcatgacccagcccatcaacctcatctttcggttcctccagagcaaagcgcgcatccagatctggcttttcgagcagaaggatatgcggatcgagggtcgtatcatcggctttgatgagtacatgaacctggttctcgaggatgctgaggaaatcaacattaagaagaacaccaggaaatcgttgggaaggatactcttgaaaggcgacaacataactctgatgatgaacactggaaagtgaagcttctctctctaggatggctggcgttgtcgttcctgtgttgagcattcctgtgatactttgtactccacccaggctgatatgcatgtagcttgtcgttgtggtcactgaggatatgtaacgtctgttgtctatctatgaacccagacccagtaaatccattctgtcgactccgtgcaagatgtttgatcaagatgatgagcttatcggttgtgtttaagattgacatgaacagaccttgttgacttgtttgttgagcttattagttacgactgcatgttatgtttttttcactgcttatgagtgaaacgcttgatttccctcgtgctgaaggactgctagctgaaactgaatttgctaccagatgactcggcaaagttaattatcaacatagatttgtacatatcttattctagggtacaaagttcattataaac

SEQ ID NO: 6604 - DNA, 563 bp, Taraxacum officinale
ctcacttcactcttctctaccgtaaagctttctagggttgtctctgcgactgcgttatcaaccaaaggaggacatccagatcaacagcagccatggctaccaaagtccagaggatcatgacccaaccgatcaatctgatctttaggttcctccagagtaaagctcgtattcagatatggctatttgagcagaaggacttgaggattgaaggccgcataatcgggtttgatgagtacatgaacttggttcttgatgaggctgaggaagtcagcataaagaagaagaccagaaagccactaggaaggattctgctaaaaggagacaacatcaccctgatgatgaattcgggaaaacaatgaggggcatttgcatcagtgtaaatgcagcatatgttaggcatcttttgattaggggagttttgtgagaattgtgaaaggcatgtgctataatttctagatttctattcatgtaagaaggaaaatttgtaaacttggatttatgaacttgaaagttgcatttcatatgtgtgctaaactactcttttatcaattttggagttctcc

SEQ ID NO: 6605 - DNA, 2731 bp, Cichorium intybus
attggactaaagttgtcttaaagaaattatatttgcaaattagtccattaagagatactccaaggactagttttgtaattatgttattaattattgacatttacatacgaatgattgttggcgcttataaaaacaccgacgattcccccgcaaaaatcacttcgatcacccaaagaaaaaggaagaaaccagattgaaaattctgttgatttccgccatgatcgcctcaaccgctccttcttcttcttcttcaaaatctgtaatcaacctcccaacctacgccactccttttaaatcttcattcctctcttcctccttttcaattcccccaagattttctccttcagctcttcaatttccatctctaattatcaaaaatgttcttaaaaccgccgattccccaaatctatcttcaaccgccccaaatcttgattcccttttcgccaattccaaaccgaccatccttgtctcagaaaaacttggagatgcaggtctcgaccttctaaaaagcttcgccaacgttgattgctcctacaatctctctcctgaagacttatgttccaagatctccatgtgcgatgccttgatcgtcaggagtggtacaaaggtcaaccgtcaggtcttcgaagctgccaaaggccgattgaaggttgtcgggagggctggggtaggtatcgacaatgtagatctacaagccgccactgaatttggatgccttgttgtcaatgcacctaccgccaacactattgctgctgccgagcacgctatcgctttgttgtctgccatggctcgtaatgtcgcacaagctgatgcctccatgaaagctggcaaatggcagcgaagcaagtacgtcggagtctccatggtgggaaagacattagccatcatggggttcggaaaagtaggatccgaagttgctagacgcgcaaaaggtctcggcatgcatgttgtggcacacgatccatacgcaccagcagacagagctcgtgccattggtgtcgaactaatctccttcgatcaagctatctcaacagctgatttcatctcactccatatgccactcactcccacaacttccaaagtattcaacgatgaaaccttttcaaaaatgaaaaaaggagtccgcatcatcaacgtcgcaagaggtggagtcatcgatgaagacgccttactgaaagccctagattccggagtcgttgcacaggcagcattagacgtgttcactgaagagccacccaaagacagcaaattagtccaccatgaaaacgtcaccgccacacctcatcttggagctagcacaaaagaggcacaagaaggtgtagctgtggaaatagcagaggcggtagtcggagctttacaaggtgaactatctgcaaccgcggttaacgctccaatggtccctcctgaagttttatctgagctggcgccttacgtggcactagctgagaaactagggagactagctgtacagttggtggccggaggaagcgggatcaagtcggtaaaggtggtgtacaggtcagcacgagatcccgatgacctggacactagacttttacgggctatgatcacaaaaggaatcatagaaccgatctctgattccataatcaatcttgttaacgctgattttatcgctaaacaaaaagggttacggatctccgaagaacgggtgttcgccaactcatcgccagggtgtccgcttgattccattacagtacagataagcaacgtaaaatcgaaattcgcaagtgctttgagtgataacgatgagattagtgtggaagggagagtgaaatacgggatgcctcatttgacacgtgtcgggtcgtttggtgtggatgtgagtcttgaagggaatttgatattgtgtcgccaggtggaccaaccagggatgattgggatggttggagggattttgggggaaaataatgtgaatgtgagtttcatgagcgttggaagaacttttagaggtaaaaaagcgattatggcgattggtgttgatgaagaaccggacaagaatactctcaagaaaataggcgatgtgccggctgttgaagagtttgtgttccttggattatagtaacgattttacggtgtcataataagatatgattgtttcgtgtggtgttaaaattattgacatttaaactattttccgagtgtatggttgttttataaagtgaagcccacaatttgatactaatatactgcagtcaaatggtaatgattacataatcaaaatacaaaacgtgcaaagaaattgactaattctctacacaggcattgcataaaaagagagctcgcccaaaatctcctctccagctcttgtaaatgctccgaattatttacccgtgttcatcatcagggtaatgttgtctcctttcaacagaatccttcctagagcctttctggttttcttctttatactcacttcctctgcatcctcaagaaccaaattcatgtactcgtcaaaaccaattatgcgaccttcgatcctcaaatccttctgttcaaacagccatatctggatacgcgctttactttgaagaaatctgaatatcagattgatgggttgggtcatgatcctctgaactttagttgccatggctgcgtgttgaatatgagacagagagctctctggtgagtcttcggttcttggctgggctgaaacaaaaccactgatattcatgttacgactttgctcctctaagaaattcgtatctaattgatg

SEQ ID NO: 6606 - DNA, 2699 bp, Cichorium intybus
gctcaaaggactagttctgtaattatgttattaattattgacatttacatacgaatgattattggcgcttataaagacaccgacggttcccccgcaaaaatcacttcgatcacccaaagaaaaaggaagaaacctgattgaaaaattctgttgatttccgccatgatcgcctcaaccgctccttcttcttcttcttcaaaatctgtaatcaatctcccaacctacgccactcctttcaaatcttcattcctctcttcctccttttcaattcccccaagattttctccttcagctcttcaatttccatctctaattatcaaaaatgttcttaaaaccgccgattccccaaatctatcttcaaccgccccaaatcttgattcccttttcgccaattccaaaccgaccatccttgtctcagaaaaacttggagatgcaggtctcgagcttctcaaaagcttcgccaacgttgattgctcctacaatctctcacctgaagacttatgttccaagatctccatgtgcgatgccttgatcgtcaggagtggtacaaaggtcaaccgtcaggtcttcgaagccgccaaaggccgattgaaggttgtcggaagggctggggtaggtatcgacaatgtagatctacaagccgctactgaatttggatgccttgttgtcaatgctcctaccgccaacactattgctgctgccgagcacgccatcgctttgttgtctgccatggctcgtaatgtcgcacaagctgatgcctccatgaaagctggcaaatggcagcgaaacaagtacgtcggagtctccatggtgggaaagacattagcgatcatggggtttggaaaagtaggatctgaagttgctagacgcgcaaaaggtctcggcatgcatgttgtagcacacgatccatacgcaccagcagacagagctcgtgccattggtgtcgaactaatctccttcgatcaagctatctcaacagccgatttcatctcactccatatgccactcactcccacaacttccaaagtattcaacgatgaaaccttttcaaaaatgaaaaaaggagtccgcatcatcaacgtcgcaagaggtggagtcatcgatgaagacgccttactgaaagccctagattccggagtcgttgcacaggcagcattagacgtgttcactgaagagccacccaaagacagcaaattagtccaccatgaaaacgtcaccgccacacctcacctcggagctagcacaaaagaggcacaagaaggtgtagctgtggaaatagcagaggcggtagttggagctttacaaggtgaactatctgcaaccgcggttaacgctccaatggtccctcctgaagttttatctgagctggcgccttacgtggcactagctgagaaactcgggagactagctgtacagttggtggccggaggaagcgggatcaagtccgtaaaggtggtgtacaggtcagcacgagatcctgatgacctggacactagacttttacgggctatgatcacaaaaggaatcatagaaccgatctctgattccataatcaatcttgttaacgctgattttatcgctaaacaaaaagggttacggatctccgaagaacgggtgttcgccaactcatcgccagggtgtccgcttgattccattacagtacagataagcaacgtaaaatcgaaattcgcaagtgctttgagtgataacgatgagattagtgtggaagggagagtgaaatacgggatgcctcatctgacacgtgtcggttcgtttggtgtggatgtgagtcttgaagggaatttgatattgtgtcgccaggtggaccaaccagggatgattgggatggttggagggattttgggggaaaataatgtgaatgtgagtttcatgagcgttggaaggacttttagaggtaaaaaagcgattatggcgattggtgttgatgaagaaccggacaagaatactctcaagaaaataggcgatgtgccagctgttgaagagtttgtgttccttggattatagtaacgattttacggtgtcataataagatatgattgtttcgtgtggtgataaaattattgacatttaaactattttccgagtgtatggttgttttataaagtgaagcccacaattgttatgctatttgatactaataccttttaatgcacttgttgacgaatattctgtagtcatatggtaatgattacataatcaaaatacaaaacgtgcaaagaaagtgaatatttctacacaagcattgcatcaaaagagagttcgcccaaaatctcctctcgagctcttgtaaatgctccgaattatttacccgtgttcatcatcagggtaatgttgtctcctttcaacagaatccttcctagagcctttctggttttcttctttatactcacttcctctgcatcctcaagaaccaaattcatgtactcgtcaaaaccaattatgcgaccttcgatcctcaaatccttctgttcaaacagccatatctggatacgcgctttactttgaagaaatctgaatatcagattgatgggttgggtcatgatcctctgaactttagttgccatggctgcgtgttgaatatgagacgaagagctcttctggtgagtcttcggttcttggctgggctgaaacaaaaccctagagagaagtaaacccccttttctattcaaaattatgcg

SEQ ID NO: 6607 - DNA, 720 bp, Abies balsamea
aactcaagttcagagaaactgcagcgattatacttataattccggtcaaggagatgaaggcgacgacagagtgcattggtgggaattgtgggaagttggaatggcaatgggaactgcgattgggtttggaagtgtgatcggtgtgttagctctgagcagggagattgaggaagaaggtactacccaaagaagagcagccatggcgaccacccgagtgcagaggattatgacacagcccatcaatttgattttccggttcctgcaaagtaaagctcgcattcagatttggctgtttgaacagaaggatttgagaatcgaaggtcgtatcatcggatttgatgagtacatgaaccttgtattggaagatgcagaagaaatttctgtcaagagaaagacacataaaccattaggacggattcttttgaaaggagataacatcacgttaatgatgaacactgggaaataaatcatgtgcacaatcttgtctggcagatctgagcacattctaaaatagtttctacattggaactgttagatggttctgctaggtgttgctaatgctcttgatgtgtttaaattttgtacgaccgctccagtgaggaagttttcagaaccttttttgtttgtcaagtcataaattggtctaacttccaacttgtatttgtgagagagttgtcttggcattatgttttaatggaattctagttacagttcccattg

SEQ ID NO: 6608 - DNA, 1351 bp, Cocos nucifera
cattgaactctcatacatatttgcatacatttacatagatacatacgtatttatgtatgtatgtagacataaacaactactgtatttaaaactcgagtcacctcccctaataggcccttcgagccacctcccccaatacctagggttttatcaacgtgcctatcgatctcccgccagagccaagagagaaggggaagagctcgcggaagccgaaggagaggtagccatggcgtccaccaaggtccagaggatcatgacccaaccgatcaatcttatcttcaggtttcttcaaagcaaagcgcgcatccagatctggctctttgagcaaagggatttgaggatagaagggcggattataggatttgatgagtacatgaatttggtgctggatgatgcggatgaactcaacatcaagaaaaatactagaaagccattggggaggattctcttgaaaggagacaacataactttgatgatgagcacgggaaaatgataactccttgaagtaggtttatctggaagtacatggtggccgactttttagcattttcgaagctttgttagagcgccctttcaacgtgctttcgtatgtggttttagaaaccttctgtatggatatttgagctgtgtgatggttacctgttttggattaaactgcagtatttgaagagagactgtacccgaggtatcttcaggtgtgcttagtgctcctatcaaaaggcttggttgtggaggtttaggtagaaccttcgtatgctcctgtattctgattgctaatcttaaagtcattatctgtgagatcccattaatttcttacgcaattcaacagatggtgcttccagaatcgtgcatgctcagatgtctgcgactggactggatacccgaaatgtgatctttattggcactttgggttcttctgacagactatgacaaccttaaaggagatgccttgaactattttgtcctcaatgtcctcgctattgttgctgcttctgcttcaagtctttacgggatatttgttttatcccaccattcaactttgccggaaggatgtgatatatggagcgaaagtggttgaagccacactgagctaaagtagatggagagttgaggctgtcaggctttcttggatgtggatttggttcctcaactttttgtcatcaactgctcttatcctgaagctggaccgtggttgtagaatagagtttttgtcacatcggttctctcgtcagtaataggatatacccaatttgttaagtaatgatgatggttaaccaaaccactcatgattaaagcttatacttctatacttttgtgagggagacggccactcagcgcaccgttttgttaa

SEQ ID NO: 6609 - DNA, 820 bp, Cryptomeria japonica
gagctgcggcctttaaaaaaacctacccatattccttgcggaatcacctaaattatactggaaacgtacatgaactctcagtttctcataatcctaaatcactaaaagcttttttattagattttcgtgtttctgcacaggcgggtgaagattacctgaaataaggagaataacagtaaaccagaaagcaaagcagccatggcaaccactagagtgcagaggattatgacccaaccgattaacttgatatttcgattccttcaaagcaaagcgcgcattcaaatttggctattcgagcagaaggatatgagaatcgagggccgcatcatcggatttgatgaatatatgaaccttgtactggatgatgctgaagaggtttctattaagaaaaatacacgtaaagtattaggacgtattcttttgaaaggagacaatatcacactaatgatgaacacggggaaataaatattagccaagtctgtattgtatcgagagatctaacttgtcatattggtaatctaccatggattttgcagttttctattcacaatatatattatagatttgttcaatcattccaaacatgcattgggggtcagttgcgagaatgtttttctgtaccaaacactgctattatcatgtgtgaaatgtatctgattgagggggtatcatcagcattttgtgaaatctgaattaacgccttaatttttcgtatgtactctgttctgagccaatgcttgcttgtcctatttgtctagttgtaagttttaaaacacatggatcgataatatgcaccgtcgaacaaatttactttatgtac

SEQ ID NO: 6610 - DNA, 568 bp, Eschscholzia californica
atcgtctgctactacactccgccggaattcatagtcgtcgccgccgtcttcgtatctttcagagctcgaatctttgcatatttgcagccatggcgaccacaagagttcagaggattatgactcagccgatcaacctcatctttaggtttcttcagagtaaagctcgtattcagatatggctttttgagcagaaagatatgaggattgagggccgtattattgggttcgatgagtacatgaatttggttcttgatgacgctgaagaagtgaatgtcaagaagaacacaaggaagtcattagggaagattcttctgaaaggggacaacatcaccctaatgcagaatacgggcaaatgatgatcaagatggtgatattatggaacctgtagctaagcacattgtgcatattagatcgttttgcagtagaagagtgaacccatgttttctgatttcggatgatctttccttgttcgagatacttcatgtaaaatcataaactatttcatttggcgttgccggatatggtattagtactccctgaaatggtttgattccatgttacttgacat

SEQ ID NO: 6611 - DNA, 462 bp, Flaveria ramosissima
acttcactgtaaagagctcaactaaaacctagggtttttgttattatcggcgactccatttctaatcaatcgaagaagaagaagagcgataacaacaccagcagcaacaatggctaccaaagttcagaggatcatgacccaaccaatcaatctcatcttcaggttcctccagagtaaagctcgtatacagatttggttgtttgagcagaaggatttgaggatcgaaggccgtattatcggatttgatgagtacatgaatttggttcttgacgaggctgaggaaatcagcataaagaagaagaccagaaaggctctaggcaggatcctgctaaaaggggacaatattaccctcatgatgaacgcgggaaagtaagaaggagcatttgcatgaggatgataggtgctagaaaagaagatctgcaacttatgttaagacttcttttgatgattgttggttaggga

SEQ ID NO: 6612 - DNA, 604 bp, Flaveria ramosissima
aacaactctgccctagggttatccctgcgactgcttttatcaatcaatcaaacaagaagaagatcgatcacattaacagcatcagcaatggctacaaaggtccagaggatcatgacccaaccaatcaatctcatctttaggttcctacagagcaaagctcgtatacagatatggttgtttgagcagaaagatttgaggattgaaggccgcataattgggtttgatgagtacatgaatttggttcttgatgaggctgaggaaatcagcataaagaaaaagacccgaaaggctttaggcaggattctgcttaaaggggacaacattaccctcatgatgaatgcgggaaagtaaaacaaaggatttgaatgaggataggggttgaaaagaacatttgcagcttatgttggtctttgttttgatgaatgttagctagggatttctgtgagaattgatccagcttatgttgatgtttttaggtttgtaagcacgcaactatggatatgtgttactatatgagcaaatcttattaaaaagttgcattttgtatgggggctggctaagctaagctaagctattattgttgcataattacttacaatgtgtg

SEQ ID NO: 6613 - DNA, 577 bp, Flaveria ramosissima
agaaacaaggggtcgatgactttactgtaaagagctctactaaaacctagggtttttatcggcgactgcagtactaatcaatcaaagaagaagaagaagagcgataacaacaccagcagcagccatggctaccaaagttcagaggatcatgacccaaccaatcaatctcatcttcaggttcctccagagtaaagctcgtatacagatttggctgtttgagcagaaggatttgaggatcgaaggccgtattatcggatttgatgagtacatgaatttggttcttgatgaggctgaggaaatcagcataaagaagaagaccagaaaggctctaggcaggatcctgctaaaaggggacaatattaccctcatgatgaacgcgggaaagtaagaaggagcatttgcatgaggatgataggtgctgaaaagatctgcaacttatgttaagactacttttgatgattgttggttagggacttatgtgagacatgatctagattgcattgatgtttttaggtttgtaagcacactaactttggatatgagtaaattttatacgaaaaattactattttgcgtac

SEQ ID NO: 6614 - DNA, 490 bp, Flaveria ramosissima
taaagagctctactaaaacctagggtttttatcggcgactgcagtactaatcaatcgaagaagaagaagaccgataacaacaccagcagcagccatggctaccaaagttcagaggatcatgacccaaccaatcaatctcatattcaggttcctccagagtaaagctcgtatacagatttggctgtttgagcagaaggatttgaggatcgaaggccgcattatcggttttgatgagtacatgaatttggttcttgacgaggctgaagaaatcagcataaagaagaagaccagaaaggctctaggcaggatcctgctaaaaggggacaatattaccctcatgatgaacgcgggaaagtaaggaggagcatttgcatgtggatgataggtgctgaaaagaagatctgcaacttatgttaagacttgttttgatgattgttggttagggacttatgtgagacatgttctagattgcattgatgtttttaggttt

SEQ ID NO: 6615 - DNA, 441 bp, Flaveria ramosissima
tttcactttgacgacttcacactaacaaatctgctagggttgtccctgcgactgcgttatcaatatcaatcaaccaaacaagaagaagatcaatcacattaacaaaaacagcagcagcaatggctacaaaggtccagaggatcatgacccaaccaatcaatctcatcttcaggttcctacagagcaaagctcgtatacagatatggttgtttgagcagaaagacttgaggattgaaggccgcataattgggtttgatgagtacatgaatttggttcttgatgaagctgaggaaatcagcataaagaaaaagacccgaaaggctttaggcaggattctgctgaaaggggacaacattaccctcatgatgaacgcgggaaagtaaaacaaagcatttgaataaggataggggttgaaaagatttgcagcatatgttggtttat

SEQ ID NO: 6616 - DNA, 541 bp, Flaveria ramosissima
gggtatcgagtagaaagaagggctcgacgacttccactgtaaagagctctcctaaaactaggggttttttttttcttattaatatcggcgactgcatttctaatcaatcgaagaagaagaagaagaagaagaagaagagcgattgcaaacaccagcagcaacaatggcaaccaaagttcagaggatcatgacccaaccaatcaatctcatcttcaggtttctccagagtaaagctcgtatacagatttggctgtttgagcagaaggatttgaggatcgaaggccgcattatcggttttgatgagtacatgaatttggttcttgacgaggctgaggaaatcagcattaagaagaagaccagaaaggccctaggcaggatcctgctaaagggggacaatattaccctcatgatgaacgcgggaaagtaaggaggagcatttgcatgaggatgatagatgctgaaaagaagatctgcaacttatgttaagacttgttttgatgattgttggttagggacttatgtgagtcatgctctagattgc

SEQ ID NO: 6617 - DNA, 667 bp, Phalaenopsis aphrodite
ctgcagtatcgttcaattatacaaataaagccttttagggttttatcgaggtgcctctcgtcacatttcttgctccctcggtagacggaaagctagcggcggagaatcagaggcagaggaagcagccatggcgaccaccaaagtccagaggattatgacacaacctatcaatctgatctttaggttcctccagagcaaagcgcgaattcagatctggctttttgagcagaaggatcttagaattgaggggcgcattattggctttgatgagtacatgaatttggttttggaggatgccgatgaactaaacatcaagaaaaatacaagaaaacctttagggagaattctcttgaaaggagacaacataaccttgatgatgaacactggaaaatgatttccgaagctgattctagacataatatttttctgtgagaattgtgatcggatgaacctctgttatgaacctgaactttttggtatatactgctagaccattaggaggtaggaaatggcttaaaggtgtctttcttctcttatctttgctcatgctcaacaaagctgccatctgctggtattgtattgtattttatctttttgtttattacaatccatctttttacattaatgatattttgcattctatagtctattaaataacgtaattttt

SEQ ID NO: 6618 - DNA, 902 bp, Pseudotsuga menziesii
gaaagcccaagtgagttggaggacgacgaagaaaacccaggccgagtaggagggcgaacttaattggtctgtttaagttgtcatcactgcaagcaaataagtgggcgaggaaaaccctcaggcatagcagccatggcgaccacccgtgtgcagaggattatgacccagcccattaatttgattttccgcttcctgcaaagcaaagctcgcattcagatttggctgtttgaacagaaggatttgagaatcgaaggtcgcatcatcggatttgacgagtacatgaaccttgtattggaagatgcagaagaaatctctgtcaaaagaaagacacacaaaccattaggacggattcttttgaaaggagataacatcacgttaatgatgaacactgggaaataaatcacgtgcacgatatggtctggcaggtctgagcacattctaaaatagtttgtacttgctacttttagattgttctgctagaattgctaatgttcgtgatgcacactaattttgtatgagtgctttaggtgaagctccagtttggaagtttcgagaatgtttttggtagtcaagctgatgaattggtctaacttccaacttgtatttgtgaggaagttattttgatattaactttagtagaattttagttacagcttccattgaaaataccagttaatcagttaattgaactactgacttgtgtttggatttttctagctattgcttgttagggtataatttttttactactttccctgtcagctcctagtataatttttcagaagaacagtatgtttttagattgcaatttacttattgaacaatttgccatggtgcgagtgtcgttttaagtaattttccacccgtgaatatttcttaaatatatctatttgaaatttgag

SEQ ID NO: 6619 - DNA, 1080 bp, Picea glauca
attgcttcagcaacattaaaatattacccgtctacacaatgtcacatttattggtctcacatttatcacttcttcataaatgtaagctttaggaaagccaacaataaaaggttttcaattttatgagaaagtttattagaatccaatacctggaagagcgagaagaaaacgcaagcaagtaggagggcgagaaagaaaaccccaagcaagtaagaggggcgagagagaaagaaaacccaagcaagtaggagggcgaagttattgctctgtttaaattatcacagcaaactagagggcggtgttaattggtctgtttaagctatcatcactgcgagcaaacaagagggcgaagaaaaccccaaagcagagcagccatggcgaccacccgagtgcagaggattatgacccagcccatcaatctgatttttcgcttcctgcaaagcaaagctcgcattcagatttggctgtttgagcagaaggatttgagaatcgaaggccgaatcatcggatttgatgagtacatgaaccttgtattggaagatgcagaagaaatctccgtcaagagaaagacacataaaccattaggacggattcttttgaagggggacaacatcacgttaatgatgaacactgggaagtaaatcacgtgcatgatatggtctggaagatctgagcacattctaaagtagtttctacattgcaactgttagatgcttctgctaggtattgctaatgttgttgatgcactttaattttgtacaagtgcttaaggtaaagctccagttgggaaattttcagagccttttttggtagacaaactcatgaattggtctaatttccaacttgtatttgtgagggaatcatcttcttgttatttttaatggaattctagttacagttcccattgaaaatactaattaatcagttaattgaacttccaacttgtatttggatttttgcaactagtggttttcagggtgattttttgatacttttcctgacaaggccctagtataaatttccaaaagaacaacttggtttttagattgcaatgaacttattgaactattgccatgtttt

SEQ ID NO: 6620 - DNA, 921 bp, Picea glauca
aatacctcgaagagcgagaagaaaacccaagcaagtaggagggcgagaaagaaaacctcaagcaagtaagaggggcgagcgagaaagaaaacccaagcaagtaggagggcgaagttatcgctctgtttaaattatcacagcaaactagagggcggtgttaattggtctgtttaagctatcatcactgcgagcaaacaagagggcgaagaaaaccccaaagcagagcagccatggcgaccacccgagtgcagaggattatgacccagcccatcaatctgatttttcgcttcctgcaaagcaaagctcgcattcagatttggctgtttgagcagaaggatttgagaatcgaaggccgaatcatcggatttgatgagtacatgaaccttgtattggaagatgcagaagaaatctccgtcaagagaaagacacataaaccattaggacggattcttttgaagggggacaacatcacgttaatgatgaacactgggaagtaaatcacgtgcatgatatggtctggaagatctgagcacattctaaagtagtttctacattgcaactgttagatgcttctgctaggtattgctaatgttgttgatgcactttaattttgtacaagtgcttaaggtaaagctccagttgggaaattttcagagccttttttggtagacaaactcatgaattggtctaatttccaacttgtatttgtgagggaatcatcttcttgttatttttaatggaattctagttacagttcccattgaaaatactaattaatcagttaattgaacttccaacttgtatttggatttttgcaactagtggttttcagggtgattttttgatacttttcctgacaaggccctagtataaatttccaaaagaacaacttggtttttagattgcaatgaacttattgaa

SEQ ID NO: 6621 - DNA, 760 bp, Picea glauca
tttaaattttatgagaaagtttattagaatccaatacctggaagagcgagaagaaaacgcaagcaagtaggagggcgagaaagaaaaccccaagcaagttaagaggggcgagcgagaaagaaaacccaagcaagtaggagggcgaagttattgctctgtttaaattatcacagcaaactagagggcggtgttaattggtctgtttaagctatcatcactgcgagcaaactagagggcggtgttaattggtctgtttaagctatcatcactgcgagcaaacaagagggcgaagaaaaccccaaagcagagcagccatggcgaccacccgagtgcagaggattatgacccagcccatcaatctgatttttcgcttcctgcaaagcaaagctcgcattcagatttggctgtttgagcagaaggatttgagaatcgaaggccgaatcatcggatttgatgagtacatgaaccttgtattggaagatgcagaagaaatctccgtcaagagaaagacacataaaccattaggacggattcttttgaagggggacaacatcacgttaatgatgaacactgggaagtaaatcacgtgcatgatatggtctggaagatctgagcacattctaaagtagtttctacattgcaactgttagatgcttctgctaggtattgctaatgttgttgatgcactttaattttgtacaagtgcttaaggtaaagctccagttgggaaattttcagagcctttttgggtagacaaact

SEQ ID NO: 6622 - DNA, 554 bp, Helianthus annuus
tttctctgcgactactgcgttatcaatcaatcgatcaaagtagaaaccgctacaacatcagcagcagcagccatggctaccaaagtccagaggatcatgacccaaccaattaatctcatcttcaggttcctccagagtaaagcacgcatacagatatggctgtttgagcagaaggatttgagaatcgaaggtcgcattattgggtttgatgagtacatgaatttggttcttgatgaggctgaggaagtcagcataaagaagaagaccagaaaggctctaggcaagattctgctaaaaggggacaatattaccctcatgatgaacgcaggaaagtaacaaggagcacttgcatgaggatgataggtgctgaaaagaagatttgcaacttatgttgagatattgttttaatggatgttaattagggactttcgtgagaaatgttctagattacattgatgctttttaggtttgtaagcacccaacttttggattgagcaaattttattggaaagcagtctactgctagattttttcataatgacaaaaacaaagag

SEQ ID NO: 6623 - DNA, 677 bp, Elaeis guineensis
ctagggttttatcaacgttcctatcgatctcccgccagagccaagagagaaggggaagagctcgcggaagccaaagaagaggcagccatggcgtccaccaaggtccagaggatcatgacccaaccgattaatcttatcttcaggtttcttcaaagcaaagcacgcatccagatctggctgtttgagcaaagggatttgaggatagaagggcggattataggttttgatgagtacatgaatttggtgctggatgatgctgatgaactcaacgtcaagaaaaataactagaaagccattggggtagggattctcttgaaaaggagacaacattactttgatgatgaacacgggaaaatagatagcttcttgtgctctggtagtttttacctcctctccaattggctttatctggaaggacatggtgggtaacttttagtcatttcctaagctttgtttgttgcgcctttcctaacctggctgtcatatgatttagaacagttgtctggttatttgagctctgtattacctaattttggtattgaacagcagtagttgaaaggtaatatattcaatgtatcttctgttgtgtttggtactccagtgaaaaaaaagggaacgttgtagaaccatcatatgctcctgtattctgattgatctgaaagtcattatctgtgcaa

SEQ ID NO: 6624 - DNA, 895 bp, Cycas rumphii
cgcgtctctgctcttgttggatttagggtgaaaacgtaaaggatctccaagccatgcgaccgtcggcttaactttctcggtctacatcgatcccagccgttgcaatagaagggctggaaacagcctataaacgggtcttttgcccttctcctatctttcgaagtgagtagcgcaggaaagaagttttacggtgcagaattgtcttcttactcggagagggagagccggagcaaagggagcgcacaagcagccatggcgaccacgagagtgcagaggattatgacgcaacctatcaatctcattttccgattcttacaaagcaaagcccgcattcagatatggctttttgagcagaaggatctgagaatcgagggtcgcatcatcggatttgatgagtatatgaatcttgtactcgatgatgctgaagagatttctctcaagagaaagacacggaaatcattaggacgcattcttctgaaaggtgataacatcacactaatgatgagcacgggaaaataagcattttttagcacttgcaatcaaatattcttagcctgtatttgttttgcacttatgaatgcattgattttgtggttccaacttttttcatgcattgaaatggatacaacaccaagatgaatctgcagctgcatgttcccacctggggatattttgtaattgatttgtttgtatcaagctatatttgaaatcactggttgggctttccaaataatatatgtgggaacgtcttccttaatggttttttccctatggaattctgttttgtggacttagaatctaaatattgtttttgaaagtactgtatattggtcaactcttttcactgttgtttgtggggaacgtaaatattaaacatggcggtacttaaatttgc

SEQ ID NO: 6625 - DNA, 626 bp, Artemisia annua
caacttcactctcttctaaattttagggttttgtgtgtgtttccttcattctcatcatcatcagcagcagcagccatggcgaccaaagtccagaggatcatgacccagccaatcaacctcatctttaggttccttcagagtaaagctagaattcagatatggcttttcgaacagaaggatttgcgtatcgaagggcgtattatcggattcgacgagtacatgaaccttgttcttgacgaggccgaggaggtcagcatcaagaagaagaccagaaagccgctagggaggattttgcttgacaacattaccctcatgatgaattctggaaagtgaggagcagttgcacgagggataggtgttgacaaaaagaattgcaacttatgttggggattgttttgaggaatgttatttagggacttgtatgagaattgatccggcttatgttaatgtttttatgttcttattttgtaaacacccgactgcggatatgtgttaccttatgagcaaatcttattaaaatagttgcattttgtatgggtgttggttatctgagctactcctgtacacgaaggcaatgcacaaaaagatggcgtctgtgttttacctgcccaatgaaactagaaatt

SEQ ID NO: 6626 - DNA, 647 bp, Artemisia annua
aaaaaaggagaaacaaaagaacagaaggagagggagggttctcacttccggcatcaacaacagtcgaagttagggttttctgtgttgttttttttataacaaattaacaatcaatcagtgaatcagtagccatggcgacgaaggtccagaggatcatgacccaacccatcaatctcatctttaggttccttcaaagtaaagctcgtattcagatttggctatttgagcagaaggacttgcgtatcgaaggccgtattattggttttgatgagtacatgaatttggttctagacgaagctgaggaggtcagtatcaagaagaagaccagaaagccactagggaggattttgcttgacaacattaccctcatgatgaattcgggaaagtgaggaggagctctgaacgaattgcaatttctgttggacattgttttgatgaatgttaattagggatttgtatgagaaatgatccatcgtatgtaggtgttttatgttcttattttgtaaaacccgacggcaggatatgtgctaccttatgagcaaatcttattaaaatgttgccttttgtatgggtgttggtcaatctcagctatctttttgcatatattcatctgaatttaagcgttgaaaacatgaattggcgctttg

SEQ ID NO: 6627 - DNA, 649 bp, Persea americana
ctggtcatttctactagggtttagggttttcgcagttcccagcagaagccgaatcgaagaggaagtaaagatctttcaaccctatttttgcagccatggcgaccaccagagtccagaggattatgacccaacccatcaatcttattttccggtttcttcagagcaaagctcggattcagatttggctgtttgagcagaaggatacgaggatcgaaggccgtatcattgggtttgatgagtacatgaatctggttctggatgatgctgatgaactgaacatcaagaaaaatactagaaagccattagggcggattcttttgaaaggagacaatatcactctgatgatgaacacggggaagtgataattttaatccgaggtatttgtagtccatgaaggtgagtgtgctgtagcttgttacaaaagcatggtggctaacattttcacttacctagtagaggcgaactatgttgaatcaacctaggttatatatgatggttgtaaacacttactcaaagtagctttattgcctttccgttcctcaagaacctattcacatagttgctattaagctttgagcaaatgctttgtgttgagcaagttggttttatgtatcatttcagcagccttcattcatagccagtttgacct

SEQ ID NO: 6628 - DNA, 287 bp, Brassica juncea
gagagagagaattcgaacgtcggcaacgatggcgagcactaaagttcaacggattatgacccaacctatcaacttgatttttaggtttcttcaaagcaaagctaggatccagatttggctgtttgagcagaaagatttgaggattgaaggaagaatcactgggtttgacgaatacatgaacctagtattggatgaagctgaagaagtgagcatcaagaagaacaccagaaaacaacttggaaggattctactcaagggcgacaacattacgctgatgatgaacacgg

SEQ ID NO: 6629 - DNA, 924 bp, Ceratodon purpureus
gcacagtgcgaagtcgaagctccacgccatagccagggagggtttcaaggaggggtcgtgtttccttctttcttgtgttctcgcctcgcctgtccgattattgtatccgtttctttagttttgccggtggcagggggtttgcgaagtcgggcgccatggcgaccaaggtgcagcggattatgacccagcccatcaacctcatcttccgatttctgcagagcaagtcgcgcattcagatatggctcttcgagcagaaggacatgcgcatcgagggtcgcatcatcggcttcgacgagtacatgaacctcgtgctggacgaggcggaggaggtgtcgctcaagaagaacacgcgcaagccgttgggccggatattactcaagggcgataacatcacgctcatgatgaacaccgggaagtgagcatgcggaggagtgagtcaatgccactgatgtaccatgaccagaaggaaagacatcccgatgaggtctgctggagatcttgtaaccatttctcaaaaaggcagacgcaaaaaaaagtagttgatgtcttgatgttctttagtcgtctctgtctgcttagcttggaaggagttctattctgtgccttctgtcacgaacaatgagtaacttagaatttccttcagaggcttacactttttggtgagagcttcgaagcttatatggattctgtatttgaagtaaccagattttcttttcggatttgcattcccttgatttacacagtggagatgatgtcgtgagatggatttctatttgaggttggaaagttttgcacgttattgacgaattctgctaaactagagtacttcacatttttctaatgattaccaatcgtgtttgaagcagttaggtttgtcatttaccttatatccaatctgtagtttctcatgacatcataaatcaa

SEQ ID NO: 6630 - DNA, 577 bp, Pinus pinaster
ttttttttgtaataagaaagttcagaatccaatcccgcgaagagaagaaaacccaaaccgagcgaaattctctctgtttatctcagcaaactagagggggaagttaatcggtatttttaagttatcctcactgcaagcaaacagtagatccaccccaaagcagagcagtcatggcgactacccgagtgcagaggattatgacccagcccatcaatctgatttttcgcttcctgcaaagcaaagctcgcattcagatttggctatttgaacaaaaggatttgagaatcgaaggccgcatcatcggatttgatgagtacatgaaccttgtattggaagatgcagaagaaatctctgttaagagaaagacacataaaccattaggacgaattcttttgaaaggggacaacattacgttaatgatgagcactgggaaataattcatgtgcacgatatagtctggcagatctgaggacgttgtgaaatagtttctacatttcaactgttagatggttctgttaagtattggtaatgttgttgacgtgctctaattttatttgagtgttcgaggtgaagttcc

SEQ ID NO: 6631 - DNA, 910 bp, Pinus pinaster
tgggccacatttccttttccatttctctgtcagcaccttttaatattatgggcttatttgatcaatatttttcaacctggttaatgtgattaccggagtgaagtttagaactattttcgtgagcttgctcaaggaaaccggtatcacacccttcaaaatttatgagaattgtcatttgatttctgtagggagtaagttattattcgtctgtgtaaggtaatttcagtgggactaagaggccgaaaaaacaccacagcatagcaaccatggcgaccaccagagtacagaggattatgacccagcccattaatctcattttccgcttcctgcaaagtaaagctcgcattcagatttggctgtttgaacagaaagatatgaggatcgaaggtcgcatcattggatttgatgagtacatgaatcttgtactggaagatgcagaagaaatttctgtcaagagaaagacgtgtaaaccattaggacggattcttttgaaaggagataacatcactttaatgatgaacactgggaaataaattgcatgcatgaaatggtcaagaagatctgagcgtattctaaaatagtttctacattgcaactgctagattgttctacttaggtattgccaatgttcttgatgcgttctaattttgtagaagtgctttaggtaaagctctagttgggaagttttcagagcctttttttggtagccaaagccatgctttggtctaattttcaagttgtatttgtgggggagtcatctcgatgtcatttttcaatggatgtctaggcacagttcccatcgaaaatattagttaatcagttaattggacttccaacttgtatttggagttttgcaactgtttcttctcaagatattttttaattacttttcatgacaggaccttttgaa

SEQ ID NO: 6632 - DNA, 513 bp, Elaeis guineensis
gccagagctaacagagaaggaaaggaactcgcggaagccgaaggaaaggcagccatggcttccaccaaagtccagaggatcatgacccaacctatcaatcttatcttcaggtttcttcagagcaaagctcgcatccagatctggctcttcgagcagagggatttgacgatcgaagggcggattataggttttgacgagtacatgaatttggtgctggatgatgccgatgaacttaacattaagaaaaagaccagaaagccactggggaggattctcttgaaaggagacaacataactttgatgatgaacactatttgaaaagatactgtacccgaggtatctttaggtgtgctcagtgctcaaatcaaaaagcttggttgtggaggtttaggtagaaccgtcatatgcccctgtattctgattgctaatcttgaagtcattatctgtgagatcccattcgtttcgcacgctattcaacagacggtgcttctggaatcgtgcatgctcagatgt

SEQ ID NO: 6633 - DNA, 1254 bp, Pinus taeda
gagagagcagtatcgagttttttcgacatttccttttccatttctctgtcagcaccttttaatattatgggtttatttgatcaatattttcaacctggttaatgtgattaccggagtgaagtttagaacgattttcgtgaggttactcaaggaaaccgccatcacacccttcaacatttatgagaattgtcatttgatttcaacagcattataacgttctgtagggagtaaattattattcgtctgtgtaaggtaatttcagtaggactaagaggccggaaaaacaccacagcatagcaaccatggcgaccaccagagtacagaggattatgacccagcccattaatctcattttccgcttcctgcaaagtaaagctcgcattcagatttggctgtttgaacagaaagatatgagaatcgaaggtcgcatcattggatttgatgagtacatgaaccttgtactggaagatgcagaagaaatttctgtcaagagaaagacgtgtaaaccattaggacggattcttttgaaaggagataacatcactttaatgatgaacactgggaaataaattgcatgcatgaaatggtcaagaagatctgagcgtattctaaaatagtttctacattgcaactgctagatggttctactaggcattgccaatgttcttgatgcgttctaattttgtagaagtggtttaggtaaagctctagttgggaagttttcagagcttttttttggtagccaaagccatgctttggtctaattttcaacttgtatttgtgagggagtcatctcgatgtcatttttcaatggatgtctaggcacagttcccatcggaaatattagttaatcagttaattgggcttccaacttgtatttggagttttgcaactgtttcttctcaggacatttttttaatacttttcatgatagtaccagattggtagcagtttcttctcatcttcttctttattctgcaatatattggcttccttttgtcattgtttgtttagtccaccgcatagccatgcattttcgtgttcttttcctattagcggttgatctgttgttcttgattttatgtgtttgtggttgatctgctattcttgatttatgtttttgtgtgcatctgcattgtttctcagccgattttattttgttgctgtatttaaagaagaagatgaacgggatggaaatgaaactcaggatttcatatttttcttggaagaatggtcactgaaggtagaagaagg

SEQ ID NO: 6634 - DNA, 800 bp, Podocarpus macrophillus
gcagaacaatttcctcttcagcaaaatccccgcctgcatcttagggcgcttaccaacatagagatctataaatactgtagcccctattgaaactaccattagctcccgttgtatttacaagcaacgtctgaggaggctattacagttacagcagaaggaaaacctaaagccctggccatggcgaccaccagagtgcagaggattatgacccaacctattaatctgatatttcggtttcttcagagcaaagcccgcattcagatttggctttttgagcagaaggatatgcggatagaaggccgcatcataggatttgacgagtatatgaaccttgtcctggaggatgctgaggaagtttcgatcaagagaaagacacgcaaaccattaggacgaattcttttgaaaggagataacattacattaatgatgaacacgggaaaatgagtgatgggcatgcctttctctgtattatggaagatgagactgctttgcttcattagcattgtgtgaattttactttcatgccatgcttcctagtgcattttaatacatggtatgcaaaaagcacaagttgaactccatgatttagaaagtctcttcaatctattttctagtctacttagtacaccaaattacttgtttcaagtttgaagacaacctgaatttttttggataggaactcaatcattgtactatatatctaaccatgtgggctacttttgttttggttttatgtagaaattcaatatacttgaataatattaattaattaacttaagatggcattaattaaactcatt

SEQ ID NO: 6635 - DNA, 631 bp, Pseudotsuga menziesii
gtttggaccgaaattgggaaaaaacgtcggaacaaaggggcgccgctccctatacaacgcgcttttcgtgagcttgctcgatgaaacccctataaatttataatatccttcaaaattttgaattcattagcaataaaacgttttgcagggaataccttaagccatatatttttcagtgcgattaagaggtcgggaaaaactttagagcagagcagccatggcgaccaccagagttcagaggattatgacccagcccattaatctcatttttcgctttctgcaaagcaaagctcgcattcagatttggctgtttgaacagaaggatttgaggatcgaaggtcgcatcattggattcgatgagtacatgaaccttgtactggaagatgcagaagaaatttcagtcaagagaaagacgcataaaccgttaggacggattcttttgaaaggagataacatcacgttaatgatgagcactgggaaataaattgcagtgtgcaaaatattcaagcagatctgagcatattctaagatattttctacattgtaactgctagatggtcctcctagatattgccattgttctttatgcgttctaattttgtacaagtgatttaggtgaagctctagttgg

SEQ ID NO: 6636 - DNA, 680 bp, Sciadopitys verticillata
ggacaagcctctatttaacctagagtttcctaataaaaataaaatagtgcttggtattttgattttctgcaaagaccagccaagacctgctaaattctaggaagaacagaaaatacttgcgaagcagaacagccatggcgactaccagagtgcagaggattatgacccaacccattaatctcatttttcggtttctacaaagcaaagcgcgcattcagatatggcttttcgagcagaaagatttgaggattgaagggcgtatcattggatttgatgagtatatgaaccttgtgctggatgaagcggaagaaatttctatgaagaaaaagacacgtaaacaattaggacgaatccttttgaaaggagataatatcacattaatgatgagcacggggaaataattggtgcacatgtgaattaaccctctttaggtttctgatctgttgtattttataggtttagtaaaacattccaaaggcttgcatgagcgtgcagttttcggaatgtttttatatgtcgaacattaattttatatgaggcgtctatcttacatgatgagatatcacaactttttatgaaatttgaacaactctaaacttttgaggtagacagtttaaaatttcaaggtaggcagttttgagaatgtttattagttcaatgtattgaaaatgttttaatct

SEQ ID NO: 6637 - DNA, 924 bp, Picea glauca
gttttcgacctcgtgagtgaagtttggaactttcttcgcgaggttgctcgaggaaaccgatataatacctacctttcaaagtttatggcaattctcatttgaattcaatagcatcaagacattttacaagagtaagttattatccgtctgtgtaaggtatttttcagtgcaactacgaggccgataaaaactccagagcagagcaaccatggcgaccaccagagtacagaggattatgacccagcccatcaatctcattttccgcttcctgcaaagcaaagctcgcattcagatttggctgtttgaacagaaagatctaaggatcgaaggtcgcatcattggatttgatgagtacatgaatcttgtactggaagatgcagaagaaatttctgtcaagagaaagacgcataaaccattaggacggattcttttgaaaggagataacatcacattaatgatgagcactgggaaataaatcgtatccatgaaatggtcaagcagatctgagcatattctaaaatagtttctacattgcgaactgctagatggttctactagctattgccaatgttcttgacgtgttctaattttgtacaaatgctttaggtgaagctctagttgggaagttttcagagacttttttggtagccaaagccatgcattggtctaatttccaacttgtatttgtgagggagtcatcttgatgtcgttttttattggaattctagttacagttcccattgaaaatattagttaatcagttaactttttacttgtatttggagttttgcaactgttgcttctcaggataatttttaatacttttcatgacagtgtctgttgaaatcgttaaatcttacctgtcttatggaaacaatgtgtgatacttatttttatacgagtgggttatggtttgttaaaaaa

SEQ ID NO: 6638 - DNA, 774 bp, Picea glauca
aattggtctgtttaagctatcatcactgcgagcaaacaagaggcgaagaaacccaaagcagagcagccatggcgaccacccgagtgcagaggattatgacccagcccatcaatctgatttttcgcttcctgcaaggcaaagctcgcattcagatttggctgtttgagcagaaggatttgagaatcgaaggccgaatcatcggatttgatgagtacatgaaccttgtattggaagatgcagaagaaatttccgtcaagagaaagacgcataaaccattaggacggattcttttgaaaggagataacatcacattaatgatgaacactgggaaataaatcgtatccatgaaatggtcaagcagatctgagcatattctaaaatagtttctacattgcgaactgctagatggttctactagctattgccaatgttcttgacgtgttctaattttgtacaaatgctttaggtgaagctctagttgggaagttttcagagacttttttggtagccaaagccatgcattggtctaatttccaacttgtatttgtgagggagtcatcttgatgtcgttttttattggaattctagttacagttcccattgaaaatattagttaatcagttaactttttacttgtatttggagttttgcaactgttgcttctcaggataatttttaatacttttcacgacagtgtctgttgaaatcgttaaatcttacctgtcttatggaaacaatgtgtgatacttattttatacgagtgggttatggttt

SEQ ID NO: 6639 - DNA, 324 bp, Eutrema halophilum
tttagggtttattgaagaaatcttcttcaccgtttcgagctccgaagaacacttgcaaccatggcgagcaccaaagttcagaggattatgacccagcctattaatctgattttcaggtttctccaaagtaaagctcggatccagatttggctttttgagcagaaagacttgaggatcgagggaagaattactggttttgatgagtacatgaatttggtgctggatgaggctgaggaagtgagcatcaaaaagaatactagaaaacaacttggaaggattttgcttaaaggagacaacataactctgatgatgaacacgtaagtg

SEQ ID NO: 6640 - DNA, 2068 bp, Cirsium arvense
ctctctaccacaattcgaaatttctcagcacaaaattgcataatttactggattccatttgcactagtcgtctttcaattcgcatctccgtctaaatcggcggcagaacaggtgcctcctggctatattacaaggatataagaagtccaaattggtaacgatttctggctacatattgatatctcatcctgtagtttcatgggggctggcgaacagagctcacctgccaagcattccaaacctactacaactcaggaaacacctccgccctcatattctgattggtcaagctctatgcaggcttattatggctctggagctgctccacctttctttgcctcaactgttgcttctccgactccccatccatatatgtggggaggccagcatcctatgatgccaccatatgggacgccggttccataccctgctctatatcctccagcaggagtttatggtcatcctagtatgcctatgactgccagcactgcacagccaaatgcagaaatggaagccaagacccctaatgggaaggattgggttccaaacaaaaagtcaaagggtatttcaggaaattccaatgccattggtgttaggactggcgagagtgggaaggcagcatcgagttcagggaatgatggtgccacccaaagtgccgaaagtggaaatgatggttcatcagatgcaagtgatgaggatgaccaacatgaacaacattctggaggcaagaagggaagcttccatcagatgcttgcagatgcaaatgcacgtaatagcaattctggatccagtattcagacatcagtgcctgggaatcctgtagtttctatgcctactactaatcttaatatggggatggatctttggaacccatcagctggaactggatctatgaaaatgcaaccaaatcattccggtggctcacaaacagtagttccaccaccaatgatggctgatcagtgggttcagcaggatgagcgagaactgaagaggcagaagaggaagcaatctaatagagagtctgctagaagatcacgactgcgcaagcaggcggagtgtgaagagctacaggcgagagtagaggtactaagcaacgagaatcactcacttagggacgagctacaaaagctttccgaggaatgcgggaagcttacatctgaaaataattcaataaaggatgagttaactaggttttttggacccgaggccgtgttgaaactcgatgcacatcttcaatctcaaatagatgaaggtgagagttgacaacatagttgcttattgtacaattaggtcaacaaccattttcgagtcttgaaaaggaatcgactttaggattgatcaacccacatcttttatggtttcatacaaccataaccttttttaaccaacataattgtaacatgttcaccaaaaactttcatatatagaatatttggtcctcatgtttgttgttgtagaagttgaaagtttatccgaaaaaagaaaaaagtaccgactgtagatagaattgtgactagatgataaaaacttaaagacatcatggtctgatatatagcattgtgtcttgtgaatttcctgcagtttggtgcttacataaacaaatatctaaaaaaaccaacagaacccatgtccctaattaacattcatcaaacataatccagcacctccatggatgctaccctcatgcaaatgctcctactgcattactttcccgaattcatcatcagggtaatgttatcccctttcagcaaaatcctgcctagaggctttctggttttcttctttatgctgacttcctcagcctcatcaagaaccaaattcatgtactcatcaaacccgataatgcggccttcaatcctcaaatccttctgctcaaacagccatatctgtatacgagctttactctggaggaaccgaaagatcaaattgatcggttgggtcatgatcctctggactttagtagccatggctgctgttgttacggctggcgagcaggactcttcttctcttcttgttgatgttcgcagatacaaccctaggagaagccgcagtggtcaagagaaagagt

SEQ ID NO: 6641 - DNA, 1188 bp, Selaginella moellendorffii
acccgcgagagatggccaaggtccgcgaagaactcgacgcggcggtgggcgttgaccggcccgttgacgagtcggacgtggtcaacctcaactatctcaaggcggtggtgaaggagatcttccggctccacccggtgggcgcgttccttatcccgcatttctccactgaggacacgcggatcggcggctacgacatccccaagaacacgcgcatcctcgtcaacacgtactcgcttgggaggagccgatcggtgtggggcgacgacgtgcatctcttccgccccgatcgcttcctcgcctcgccgggcgatctctcgtcccagatcgtggagctcatggactcggagtgccgggtggtgccgtttggggccgggcggaggagctgccccggcgcgtcgctggggtcgtgcatggtggtgatggggctggcgagattgatccagaggttcgattggagcgcaccgccaggggaggagattgatgtgagcgagcgagtgggattcacggtgctggacaagccgctggagctcgtcgccaagccgagggagtgcgtaaatttctagctcaactcaaggtggatcgatctttgatttcttgccgcaagggcgatcgtggattctttcatttcgtcatgtaggatcaattctctcattgtttgcagaggctttgcttttatctagtccaaggccgtgaatgaaagaagaccccagtcaacgtctttgactgggcgggactagaaagtcaactcaactagaatgcgtgaaacctctttgagctgctagagccatggtaaacgagatacaaagacactcgccaagaacaagagcgaaaaataaagcccatcttggaacttctctcagagattttttttctgctactacttgccggtgttcatcatgagcgtgatgttatcgcccttgaggaggatccggcccagcggcttgcgggacttcttcttgagcgagatctcgtaggcgtcgtccagtaccagattcatgtactcgtcaaaccctatgatccggccctcgattctcaaatccttctgctcaaacagccacacctggatcgtcgccttgctctgcaggaaccggaagatgagattgatgggctgggtcatgatccgctggactttggaggtcgccatggctgccgcgcgcgcttctcctccgccttgccgagagccctaaa

SEQ ID NO: 6642 - DNA, 438 bp, Panax ginseng
aagcagtggtatcaacgcagagtacatggggaagactgagactagggttttctgtgagaagtaaataaggaagaaggaaaataatctgttgcagaggcgtagtcggagtcagccatggcgagcactaaagtacagaggatcatgacccaacccatcgtttcttcaaagtaaagctcgcatacagatatggctttttgagcagaaggatttaaggattgaaggacgcatcattgggtttgatgaatatatgaatctggttcttgatgatgccgaggaagtcagtataaagaagaagagcagaaagcaactgggtaggatcctactgaaaggcgacaacatcacactgatgatgaacacggggaaatagtgacgaacagttgttatggttcatgtatggacattatatggtgtatttgcataagcaatggaaacagattt

SEQ ID NO: 6643 - DNA, 1096 bp, Conyza canadensis
cacaaatcaaaaacttttttgagtcgttcaagtttttacatatacatctaaaagggggcgggacttaaaaaagccctttctacatctcctagggttttgtctctgtcgactactactgtcttcttcttagtccaattaatccacacacgcatacccacaccagcagcaacaatggcggctaaagtccagaggattatgactcaacccatcaatctgatctttcggttccttcagagtaaagctcgaattcagatttggttgtttgaacagaaggacttgaggattgaaggccgtataattgggtttgacgagtacatgaatttggtacttgacgaggctgaagaagtcagcataaaaaagaagaccagaaagtctctaggcaggattctgctgaaaggagacaacatcaccctcatgatgaatttgaatgcgggaaagtaacgagaagtagcaatctgcacgagggatgctgaaaagaaagtttatggttaagcattgtgtcgagtaattctaagtagggacttgtattagaactgatccagtttggatgttgatgtttttagaatttgtatttttgtatgcaccaaactgcaagaaatatgtcaagaagtatgttttcactttatgagtgaatcttattggaaagttgcattttgcgtaaatttctctattaattttagcaactgcataagttcctatatttgtcaaggtacaaaaacaggttctcgtgacagcttaaattgattttttaggaaagcagttatactcttttaattcttggtggatgatttatgcaagtgtcactcctatcccaaaattgctctttaagttggaacctgtgatttgctgtcggtgcaaatatgaaggccttgtgtctgactttaatttagtcaaagcaccaaacttgctgaagtaacaaatatagttgcagaaaacccccttgtcgtgatggtgtttttattttcaagctccccataacaccagtttgcgttgtgatgtgcttcctacattacagttcttaccatacatcaggtttgcatggatgtttcacttgtagatcttgattttaaattgcctgtacgcacctatatctagg

SEQ ID NO: 6644 - DNA, 438 bp, Fraxinus spp
ccggggattgctttctgtgttgcattagaagaaagaattattttggcgccggagctcccaaattcagcagccatggcgagcacaaaagtccagaggattatgactcaacccattaacctcatcttcaggttcctccagagcaaagctcgtattcagatttggctttttgagcagaaggatacgaggatcgaaggccgaatcatcggctttgatgaatacatgaatttggtactggatgatgctgaggaagtcaatgtcaagaagaagagcagaaagcaacttggtaggatccttctgaaaggagataatataacgttgatgatgaataccgggaatgatgcaaaaggatcatttgaaagctagaggagactggctagtaatgggttcctcagatttctggcagcaagtttgtacgagaatgccttgttttagtaaact

SEQ ID NO: 6645 - DNA, 779 bp, Amborella trichopoda
agagtacgaggggtttctcttctctcaggcgtccaccgaagagtttagggcaagatttcaggcgaggttccagtgacttccgggcagtttacggccaagagtttacaccagccacggttcggttgccggtccagtcttgacaacataactcccaatttctagggtttcttgggtcttagggtttagcagccatggcgactacaagagttcaacgtattatgacccagcctattaatctcattttccggttcctccagagtaaagctcggatccagatttggctttttgagcagaaggatttgcgaattgaagggcgcataattgggtttgatgagtatatgaatctggtcctggatgatgctgatgaactcaacatcaagagaaacaccaggaagccccttggcaggattcttttaaaaggtgacaatattactctcatgatgagcacgggaaaatgattggaggatctggagcactcatacccgatcgcgtttggatcgtattatcatgtgtctccatccttgcacttgaattttaaaatcttagaacactcacaaatcctcatttacaatcagagccttctttgtacctatgttgtattcgctttccattttgaagtaaaatagttgtttctcatttactttgtgcactacacttgagcaatggctgattaaaatcctatgtaagagtttcatgccaatgtgtagcccattggtatgaacaggtgacttcgaagtattatcctctctcgactttcgagtgcaaaaactggatctgtc

SEQ ID NO: 6646 - DNA, 366 bp, Artemisia annua
caccaaaacaacttcactctcttctaaattttagggttttgtgtgtgtttccttataaatcaatcaaaccacaagatccttcattctcatcatcatcagcagccatggcgaccaaagtccagagaatcatgacccagccaatcaatctaatctttaggttcctccagagcaaagctagaattcagatatggcttttcgaacagaaggatttgcgtatcgaagggcgtattatcggattcgacgagtacatgaaccttgttcttgacgaggccgaggaggttagcatcaagaagaagaccagaaagccgctagggaggattttgcttgacaacattaccctcatgatgaattctggaaggtgaggag

SEQ ID NO: 6647 - DNA, 662 bp, Phalaenopsis aphrodite
cttgcggcggagaatcagaggcagaggaagcagccatggcgaccactaaagtccagaggattatgacacaacccatcaatctgatctttaggttcctccaaagcaaagcgcgaattcagatctggcttttcgagcagaaagatctcagaattgaggggcgcattattggctttgatgagtacatgaatttggttttggaggatgccgatgaactcaacatcaagaaaaatacaagaaaacctttagggagaattctcttgaaaggagacaacataaccttgatgatgaacacgtaagtaaatctttaacttctttacttgcacatcaattctctgcttttatctgcccctgcaacgcgtttctacttaatgctcttattttacagtggaaaatgatttccgaagctgattctagacataatatttttctgtgagaattgtgatcggatgaacctctgttatgaacctgaactttttggatatactgctagaccattaggaggtaggaaatggcttaaaggtgtcttttcttctcttatctttgctcatgctcaacaaagctgccatctgctggtattgtattgtattttatctttttgttattacaatccatcttttttacattaatgatatttgcattctatagtctattaaataacgtaa

SEQ ID NO: 6648 - DNA, 1549 bp, Physcomitrella patens
caaagaataattttctcaccttctaaatgatattctgagtatgttactagagttgcaatgtacaaggcgtgcccaaaaagcatgccctattccactcatcaagttggatatacttcgttgtttcgtaaaccctaaaatagttatttttgctgtaatggcattgaatttccacgaaacagaccaacgtgtcgagttttgaccaataaggctgaccaacattacgtgcaaaaccctaataaggtttacttatttttcgctactttgcttggcctcggtacagccattggattttgcagacgctacaacagtggaaagcttccttttgcaacttctcatttgtcagcttacccgttatttttctttcctagtaaaaggtatctttggaaagtctgacgcaatggcgaccaaggtgcagcggattatgacccagcccatcaatcttatatttcgttttctgcagagtaagtccaggattcagatatggctctttgagcagaaggatatgcgcattgagggccgcatcattgggttcgatgagtacatgaacttggtgctcgaggaggctgaggaagtctcgctcaagaagaacacgcggaagccattaggtcggatattgctcaagggggacaacattacgcttatgatgaatactgggaagtaaggtcagaagggaagatgcgacagctttctgttgtaaacgtacgtgtttgggcctgggtttggttctttctttccttgaatagctgatgttttcctcccaaagatgatttggcaacggcatgtaggagtttttgttgtagcataaatgaagttggacgacatgtatgaggtggtccaagagttcgattaccgacagatagagtcccaatgacatttccaagcatgttcacggttttggtcgttagtaacgtttgattggtctttgtttcttgtatggtcgttagagtaacaaatacatggcatgatcacttggggcgttcataattgctcatggagcgctggagagctggagagccatcgtttctattatctcagaacacattgccaacagtaggcagtttcacgttcaggatgggatcttatgagcactgtagtttgcgagatatccgaagttgatttagcggagagttggagctgtccctgcgatgggttttcactaggagactgcagacgaagcagtagacattggtttccaaattgaagaaatacatttggctttaaggtccagcaatttccggaagataatcttgagtcttttggagtattttcggatgccttctaattggtgttgaagtgtgcagggtacatgcaacactgagcagaagagaaggcatccaaatgcatactgcagctgccgttcttgcagccaaccaccagcattcagttgcattgatagattttttctgaaattaaaattagaaagtgtcaggatattttttcaaggtatgcataattagtaaattgtaacttactgaaaaggcatgagggcctgcgcaatctaggcctttgtggctcggccttgcgaggatgtacagatcctgtatttgat

SEQ ID NO: 6649 - DNA, 808 bp, Papaver somniferum
ggagcttaaaccctaaaccgagagaaactgaacccccgctcacaaaatcactgtagcagccccaaaagcggcaccacaaacccttcctcctcctccttcatcgaagcagtaactagggtttctgtctgggttttcgttcaacattgtttgaggttgaaacagagaattagcagccatggcgaccaccaaagttcagaggattatgacccaacctattaatcttatctttcggtttctgcaaagtaaagctaagattcaaatctggttgtttgagcagaaggatataaggatcgagggacgaattattggatttgatgagtacatgaatttggttcttgatgatgctgaagaagtcaacatcaagaaaaacaccagaaagtcattggggaaaattctcttgaaaggtgacaacattacactgatgcagaacgcgggcaaatgatgattgaatctggttataatttgtgaactttggcttgttgagtccgaaaaacaattcgtctggtaccttgtgtaaccttacaatagagatatcgtagtactactacctgtgggggagaaacttgaatccatatatgtttctccacatgccgaaatattctatttcgaataattagttattcggcttgcttaacttgatatggctagaacctcttgttatgtgtttatccatgtgtaaattttttttcttctttcgatttcctggttatcttgttttgcttaccctagcatatgaattaaaaagtctctgtccatatcttggactgagtaataagaaatgttgactgttataaaaaaaaaaaaaaaa

SEQ ID NO: 6650 - DNA, 758 bp, Papaver somniferum
tcccaaaggagcttaaaccctaaaccgagagaaactgaaccctcgctcacaaaatcactgtagcagccccaaaagcggcaccattcctcctccttcatcgaagcagtaactagggtttctgtctgggttttcgttcaacattgtttgtggtagaatttgcagccatggcgaccaccaaagttcagaggattatgacccaacctattaatcttatctttcggtttctgcaaagtaaagctaagattcaaatctggttgtttgagcagaaggatataaggatcgagggacgaattataggatttgatgagtacatgaatttggttcttgatgatgctgaagaagtcaacatcaagaaaaacaccagaaagtcattggggaaaattctcttgaaaggtgacaacattacactgatgcagaatgcgggcaaatgatgattggatctggttataatatgtgaactttggcttgttgagtctgaaaaacaattcgtctggtgccttgtgtaaccttacaatagagatatcgtagtactactacttgtgggggagaaacttgaatccatatatgtttctccacatgccgaaatattctattttcgaattattggttattgggcttgcttaacttgatatgactagaacttcttgttatgtgtttatccatgtgttaaaaagtttttttttgtatttcctggttattttgttttgcttaccctaacatatgaattaaaaagtctgtgtccatatcttggactgagt

SEQ ID NO: 6651 - DNA, 889 bp, Papaver somniferum
tgcggcctcttctctccgctaatagtaaactcgttctatatattcattcttcgtcctctccttcccgctaatagtaaactcatccgactcttcaacgccacaacagctgcatcctcactcacatgtttctctctccttatttttcaatttaacgaacctcagtttctgggtttcataaaggataaagagaattttgcagcaatggcgactactagagttcagaggattatgacccagcctatcaacctcatttttcggtttctccaaagtaaagcaaggattcagatttggctttttgagcagaaagacaggaggattgaaggcagaattattgggtttgatgagtacatgaatttggttcttgatgaagccgaagaagtcaacatcaagaaaaataccaggaagtcattggggaagattcttttgaaaggagacaacataacattgatgcagaatacgggtaaatgatgattttggcctagcgaggatatagaacatgagtagcagagttgaatcttgcatattatactgtctgaaaatgcaagcgcaacaatcgaattttctgcaattggataattgtcaactgtttgttctagatatctcatttaacctaaaacctcatacaaatgagtgtagaatatggtgctgccacctggtagtgcagtaatttggtaacatgttcttttaatgcttaaaatttggtgctagcacatgcttggcttgcttacgtagttagatattacttggaattaatcgacatgttgtaatgccctaatacccttgcacacacatttgtcttgggcgatttaccactgacgattcttatgtgggaacaccttttttacattttattattaaacaaggtgtgcttacgatacttaaaaaaaaa

SEQ ID NO: 6652 - DNA, 649 bp, Papaver somniferum
gaacccccgctcacaaaatcactgtagcagccccaaaagcggcaccacaaacccttcctcgtcctccttcgtcactagggtttctgtctgggttatcgttcaacattgtttgagcttgaaacagagaatttgcagccatggcgaccaccaaagttcagaggattatgacccaacctattaatcttatctttcggtttctgcaaagtaaagctaagattcaaatctggttgtttgagcagaaggatataaggattgagggacgaattattggatttgacgagtacatgaatttggttcttgatgatgctgaagaagtcaacatcaagaaaaacaccagaaagtcattggggaaaattctcttgaaaggtgacaacattacactgatgcagaatgcgggcaaatgatgattggatctggttataatatgtaaactttggcttgttgagtccgaaaaacaattcgtctggtaccttgtgtaaccttacaatagagatatcgtagtactactacttgtggggggagaaacttgaatccatatatgtttctccacatgccgaaatattctattttcgaattattggttattcggcttgcttaacttgatatgactagaacttctggttatgtgtttatccatgtgtaaaaagtt

SEQ ID NO: 6653 - DNA, 835 bp, Zamia vazquezii
gctaccggtgactatttatcgcggggtattggcggaatcaacagccataagcccatgagcccagtgatgagctctgcgtagtgctgaagtcgattttcaatcaatcaatcagaggagaggcagaggtgaaggaaggcaataaaacgaacagccatggcgaccacaagggttcagaggattatgacgcaccctattaatctcatttttcgttttctacaaagcaaagctcgcattcagatatggctatttgagcagaaagatatgaggatcgaaggtcgcatcattggatttgatgagtatatgaatcttgtactagatgatgctgaagaaatctctgtcaagagaaagacacggaagtcattaggccgtattcttctgaaaggcgataacattacattaatgatgagcacgggaaaatgatttttctgactccatggtcaacacttttagcctgaatgattgagtaattgtgtttggcacttctgactggattgttttttcccttgcactttcggattcattatggatacaccaccaaggtgaagatgcggttgcatgttcccacttgaggagagtctgtaattgagttgtttgtagcatgttgtatttgaaatcattggtggatattccttgatgcttttttctttgagattctgatttgtcaacttgcattgtttttgaaaagtattgcatatttgaataatctttattcacatctgtttgtctggaaatgtaagcatgtatgggctgtatctctggcatgttaacctactaccagaataatatagcggcaagattgcttgatgatatagattatgtatttgcaatgttagca

SEQ ID NO: 6654 - DNA, 1304 bp, Chrysanthemum coronarium
acactactcgtgcccaagcaaaccacaagaaatgctatattaataacttagtttctttgggcaggtagctcagattaaccaacacccatacaaaatgcaagttttttaataagatctgctcataaggtaacacatatcctacggtcggatgtttacaaaataacataaaaacattaaaatgaacccggatcaattcccataaagtaacacatatcctacagataaacattaaaataagcccggatcaattctcatacaagtccctaaataacattcatcaaaacaatccccaagttgaaattcttttttctcaacacctatccctcagtgcaaatgctcctcactttccagagttcatcataagggtaatgttgtcacccttgagtaatatcctccctagcggctttctggtcttcttcttgatgctgacttcctcagcttcatcaaggactatattcatgtactcatcaaacccgattatacggccttcaatacgcaaatccttctgctcaaacagccatatctgaatcctagccttgctttgcaagaatctgaagatgagattgatgggttgggtcatgatcctctggactttggtcgccatggctgctgctgctgagaatgaaggattcgattgattgtttatgaaagagtatgcagtcgaaaaacacacacaaaaccctagttttatcaaatccactcggtttttgagaatgaagggagctaaaggagcgaagaaagctgatgctaagctgaatgtgaagaagactgctaagggaaaggctgcaaaggacccaaacaagcccaagaggcctgctagtgccttctttgttttcatggagggtttcaggaagcagttcaaggaagagaaccccactgtcaattctgttgctgctgttggcaaggccggtggagctaaatggaaggcaatgtctgatgctgagaaggcaccttttgttgccaaagctgaacaaagaaagaaggattacgacaaaacccttgctgcatacaacaagaaacaggctgctggtcctaaagacgaggacaatgattctgacaaatccaagtcagaggtaaatgatgatgatgatgaggagggcagtgatgaggaggatgatgatgaataaagcgggatttcatcgagtgatgcagaataaatctgctgcgttgtagctttttaatactattagcaaagactaggttttgtttcagtaatggatatgttatgttggatcgctgatcatggaatagtatttggttagatgtttagttgttatggtgcatagagataacaagttagattt

SEQ ID NO: 6655 - DNA, 1652 bp, Echinacea purpurea
gcctgtaaaacatgcatttatgtaatattaatatatgcaagaaaaagtagatacacgaccttaattctccgaattgcacggctatagatgtggtttttgtttcacaggattatagaaagatagaaagatactacgttcaattacacgcacatatatacagagacagagagacaaaaagagaagagaagcagggtttggtgccttgttctcatggtaaggaatttatgcaaacataatatcttagattggccgggtaccgtacaaaatgcaactttccagtatgatttgctcatatagtaacacaaccgaaagttgggtgcttacaaacctaaaaacatcaacataagctagatcaattctcatagaagtccctaattaacactcatcaaaataaaaaccaacaaaagctgctgcataccatcttttcaacgcatcctcctcatgcaaatgcttctctttactttcccgcattcatcatgagagtaatgttgtcccctttcagcaaaatcctgcctagagcctttcgggtctttttctttatgctgatttcctcagcctcgtcaagaaccagattcatatactcatcaaacccaattatgcgaccttcaatcctcaaatctttctgctcaaacaaccatatctgaatacgagctttgctttggaggaacctaaagatgagattgattggttgggtcatgatcctctggactttggtagccattgttgctgctgctgtgttcctgcttttctcctatgttcgattgataacgcagtcacaaaagaaagtgaaagcgaaattgggtaattgtggaaaagtttacgtttcgtatgatgaatttgttgagatgtgtgtggaaggatgtgggaacagggatctagggttagatctggtcaaaattttggatgattcgggttcggttatcgtgttaggagacgttgtgttcctcaagcctgatcaggtggtgaaagccatatacggcttgctgcccccaaattctccggtgacccaaaaaccagaggtgaaagaattagaagagatggagcggtggaaggccgccattgacacgaaggcgaaaaagatggttcaaagagagctatggggtggtctggcgtatctgatggtccagaccgctgggttcatgaggctcacattctgggaactctcatgggacgtgatggagcccatttgcttttatgtcacgtcgatctatttcatgggtggatacgcgtttttcttgagaacttcgaaagagccttcgtttgaagggttctttcagagcaggtttagttcgaaacagaagttgttgatgaaacgtgaagggtttgatatggggaaatataaagagttgagggaggcttgttatccaaatcatgaggcttggccaagtgaaacttcggggctaaaaagtcaatttacttgaacataaagttctattataagtcaatttacctgaaaaaatccctatttatttcttgagccctttagattgaaaagcggctttttgtaaactttacatggatgacaagttgtgttcatgttttctgaccgttttcttatgattgaaaaccgatgaattaaaggagagagcagggcggaggttgaatttactgggtttagatgaacataaataaaataataatttacatatgct

SEQ ID NO: 6656 - DNA, 327 bp, Secale cereale
gtccaccaaggtccagcgtatcatgacccagcccatcaatctcatctttcggttcctacagagcaaagcgcgcatccagatctggcttttcgagcagaaggatatgcggattgagggtcgtatcatcggctttgatgagtacatgaacctggttctcgaggatgctgaggaaatcaacattaagaagaacaccaggaaatcgttgggaaggatactcttgaaaggcgacaacataactctgatgatgaacactaggaaagtgaagtcttctctctctaggatggctagcgttgtcgttcctgtgtcgagctattcctgtgattactt

SEQ ID NO: 6657 - DNA, 393 bp, Ambrosia trifida
ctgaaggagacgactctgtggccgacgatagcagcagccatggcgaccaccaaagtccagaggatcatgacacaacccatcaatctcatcttcaggttccttcaaagtaaagctcggatccagatatggctgtttgagcagaaggacttgaggattgaagggcgtattattgggtttgacgagtacatgaatttggttctggagatgctgaggaagtcaatagtaaagaagaaaagcaagaaaggtcgtttaggggaggtatccttagttaaaaggggacaacatcacgctgatagatagaacgaacggggaaataggaagagtaggtattttacgagttggtgcgagtgggaagtagacgagtcgttagataggaagccgagtattatcgta

SEQ ID NO: 6658 - DNA, 833 bp, Pinus taeda
tccttcgatcaaaataaaaatagaaagatgtacccaagaaccctccaaaacctttgtccatatgcgcaagcgtgaggaaaccagttttttttgtaataagaaagttcagaatccaataacacgcagagaagaaaacccaaaccgagcgaaattctttctctgttaatcggtctttttaagttatcctcactgcaagcaaacagtagatccaccccaaagcagagcagccatggcgactacccgagtgcagaggattatgacccagcccatcaatctgatttttcgcttcctgcaaagcaaagctcgcattcagatttggctgtttgaacaaaaggatatgagaatcgaaggccgcatcatcggatttgatgagtacatgaaccttgtattggaagatgcagaagaaaagacacataaaccattaggacgaattcttttgaaaggggacaacattaccttaatgatgagcactgggaaataaatcatgtgcacgatatagtctggcagatctgaggacattgtgaaatagtttctacatttcagctgttaggtggttctgctaagtattggtaatgttgttgacgtgctctaattttatttgagtgttcgaggtgaagttccggttgggaatttttcagggctttttttggtagtaaattccatgaattggtctaactgccaactatttctgaaggaatcatgttgatgttatatttaatgaaattctcgttatagtttccattgaaaatacttattaatcatctatttgaacttccaacttgtatttgacagtcttatgacgtgttccttcaaaacatatttgcagttgaagc

SEQ ID NO: 6659 - DNA, 2009 bp, Oryza sativa
atggcgtccaccaaggtccagcgtatcatgacccagcccatcaaagcgcgcatccagatctggctgttcgagcagaaggatctccggattgagggccggatcattggctttgatgagtacatgaatttggtccttgatgatgctgaggaaatcaacgttaagaaggatactaggaaatcattgggtaggatactattgaaaggcgataacataactctgatgatgaacactgggaagtgaattttctccccaaggttggcgtttgtgactttgtgtcgattagtcccgtgatactttgtactccatctagataatcagagaatgaaatgcatgtagcatgtcatcgtcatcgtcctcaattgaggatatgtaacggctgttagcaacctatgaactctgtgaactctaggcaaggttgttgagataatgagttgctcacttgtgtgtttaagattcctgatcccgtgaatcaatcctgctcacttataacacggacaattggagcaattcttgttgtacctcgtcttcttcccgtatctatgttatagatagtcttgagcatgaatgcatgatcgtgaattactaaaatgcaggatgaacacatgataaacatatgttatgcacagttctattagggacatggcattactgccatattgcttgaaaaggaaatctcatggagatcttgttgatgtcttctgtttatatactgtgttgctagagatatggtgagttgttaagggaataatccatatcgtttaccccctaaagctcaataaaaaccaataaaaaccttatggtgtgggttgatatttcggatctgtgaaataatcaaagtttttctctcacactctctacatgactacacaaattagtgaattaccgtggatctaccattgtgaacttgaactgtgttagataaacatcacgatcatcatctattattgaatataaatctaaattcgcacgaattttgaaatcagagctcaaaaacgtaccctaaacatgtgtacaaaatcacaattgtatatcacatggtaaaaaacattcagaacgccagagtacaaacaagctaggatcaaaagagggagaaccacttggttttagacttgttcttgctcatcatctccttcctcttcctctccctctccttctcaagtttttcttcttcttcctcctcctcgtcctcgctactgacgctgctgctcgtctgatccttctcttcctcctcctcgtcgtcatccttcttggtggatttcgccttgccggcgccggccgtggcgacgtcgagccgcgcggcgtccatcgcccaccgcatcaccttgtccacctcgtcgtcctcgtcctcgtccgactccccgcccagatcctccagcctcaccctcgtctccttctccggccccgccgcccccttcagcgctgcgaaacgcgcctccagctcgtccatcccgccggcggctgcggcggagggagcatcgggttgcttcggcttcggatccggcgggcggtgagacctgagcgcgtcgaagcggcgggcgaggtcggcgtcgaggggatctgcggcggcggcggcggcggggtggtcgagcgagggaggaagattcggagcggtggccgaggacgacgaggagacgaggtgggagttcgcctgcagcttgagcatcaccgcgtcctgcgccgcgcggaggagcgcttccacctccgcctcttcgccgccggtgacggccgccttccggccgccgccgccgccgctcatcgtggtggactcgtgggtgggggacttttttctaatttttctccactttgtttgctgctttaatgacagtatggtgggcccaaaaattgtactaggccaacatgagtagagcccaatttagtgatcaatgggccgggccgattttacggcccacgatgccaagctattattaatcccagcctaattctaatccctaccttaattaaaccatttttccccacagaaaaaaaatattattaactaaacaaaaacc

SEQ ID NO: 6660 - DNA, 589 bp, Panax ginseng
gagaagtaaataaggaagaaggaaaataatctgttgcagaggcgtagtccgagtcagccatggcgagcactaaagtacagaggatcatgacccaacccatcaaagctcgcatacagatatggctttttgagcagaaggatttaaggattgaaggacgcatcattgggtttgatgaatatatgaatctggttcttgaggatgctgaggaagtcagtataaagaagaagagcagaaagcaactgggtaggatcctactgaaaggcgataacatcacactgatgatgaatacggggaaatagtgacgagcagttgttatggttcatgtatggacataatatggtgtatttgcacaagcaatggaaacagatttgtgtaatttctaatgtcacttattctgataatatgattgttttaggcaaaattatcacttctgtattaattgcttgaacttggtagttgtgttcttgataagcctgtacctcaaccgacaaccagtgcctattggttgctcgtatatatgtttcctttttaccccttcccgctgtaaatgttggagtataacttatcaagcttgatgattaaggtggtg

SEQ ID NO: 6661 - DNA, 657 bp, Mesostigma viride
atagcttttgttgtttagcaacccattttgcgcttctaactcttttgccttgtgcagtatatcgacacccgaaggcaatcatggcgaccaaagtgcagcgtattatgacccagcccatcaacctgattttcaggtttctacaaagtaaatcgaggatccagatctggctgtacgagcagacggacatgcggatcgagggccagatcatcgggtttgacgagtacatgaacctggtgctgaatgacgcggaggaggtgtcgatgaagaagaagacacgcaagtccctaggccacatcttgctaaaaggggacaccatcacgctcatgatgaacacggggaagtaagatgcatttcatgcctgtgcaccgtgcgaaggtcaaccagcatggcctggcctgtgtttctttttcctcgtggaatgggtcggagcatccatcatcactgcacccatggactgtgcacagcaaagtcacgcggtcctgcgcacagcaaagtcatgcggtcgttttatgtgggaggaaacgctgcgtgtcaccgggtccgagtggggagtcatttctgggatgtgacccacgacgaggttcggcagcagcattggtgttcgctaccgcccgccctatttcagcatctagacttttatttattcgaacattcgtt

SEQ ID NO: 6662 - DNA, 732 bp, Oryza sativa
atggcgtccaccaaggtccagcgtatcatgacccagcccatcaaagcgcgcatccagatctggctgttcgagcagaaggatctccggattgagggccggatcattggctttgatgagtacatgaatttggtccttgatgatgctgaggaaatcaacgttaagaaggatactaggaaatcattgggtaggatactattgaaaggcgataacataactctgatgatgaacactgggaagtgaattttctccccaaggttggcgtttgtgactttgtgtcgattagtcccgtgatactttgtactccatctagataatcagagaatgaaatgcatgtagcatgtcatcgtcatcgtcctcaattgaggatatgtaacggctgttagcaacctatgaactctgtgaactctaggcaaggttgttgagataatgagttgctcacttgtgtgtttaagattcctgatcccgtgaatcaatcctgctcacttataacacggacaattggagcaattcttgttgtacctcgtcttcttcccgtatctatgttatagatagtcttgagcatgaatgcatgatcgtgaattactaaaatgcaggatgaacacatgataaacatatgttatgcacagttctattagggacatggcattactgccatattgcttgaaaaggaaatctcatggagatcttgttgatgtcttctgtttatatactgtgttgctagagatatggtga

SEQ ID NO: 6663 - DNA, 597 bp, Pteridium aquilinum
agccatgtcgacaccaaggtgcaacgtattatgacacagcccattaactcatttcaggttacttcaaagcaaatctcgcatacagatccggctctcgagcagaaggacctgagaatcgaaggccgcatcattggttttgacgaatacatgaacctggtattggatgaggctgaggaagtatctatcaagaagaagacccgcaaacctttaggacgaatattgttgaagggtgataacatcactttgatgatgaacacggggaagtgaggacgatttgtctcttcgagatctagtttgcgagttagaacccttcccatggtgacaaacactctgcttttgtcagttctcaaggctaagcaattttgactgtgcgaattgctaatggtttagtgtactactattgtccatctttacaagatcagagcacagaattgggttgcctttgttttcctcaagtcccgtcatgcacgggtcttatggtacataacaaacttaagagcaatttcggcagtaccaatttccgccaacttctgtaagtgccgagttagctacttgtgcctatgctggctccatactcatgatgcgttcttagcatta

SEQ ID NO: 6664 - DNA, 576 bp, Platanus occidentalis
tttgacatatctcaacttttgggtgagagggaaagaagtgagctaacagccatggcgaccaccagagttcagaggattatgacccagcccatcaatctcatcttcaggtttcttcaaagtaaagctcgcattcaaatttggctttttgagcagaagtatttgaggattgaagggcgtataattggcttcgatgagtacatgaatttggtttggatgatgctgaagaagtccacatcaaagaaaaacagcagaaagccgctggggaggattctacttaaaggagacaacatcactttgatgatgaacacgggaaaatgatgattagtctggcaacatcgtctgtcatctccaatgtacctttttcaaattacatggatgccaatgttttccgactttctatggttgtcttattgaacatgaatttctcatgtgtcactaaggttgcttataaatgattttagatctctctctctctctctctctctcatgtatatcaattccttttccctagctaacaacgtttcctttcgatattccagggaaaatgatgactagtctgggaacatagtctgtcat

SEQ ID NO: 6665 - DNA, 362 bp, Scabiosa columbaria
cgagcagttagggtttgaatttcatcatacacaacaaaactcgcaagtctacggtagggtttttgatcgcaaggagacagacaaaaaagcagccatggcgagcactaaagttcagcggatcatgacccagcctatcaatctcattttccgattccttcaaagcaaagctcggattcagatatggctttttgagcagaaggatctgaggattgaaggccgtattattgggttcgacgagtacatgaatctggttcttgatgatgctgaggaagtcagtataaagaagaagagcagaaagcaacttgggaggatcttattgaaagggacaacatcacactgatgatgaacaccggaaaaacaag

SEQ ID NO: 6666 - DNA, 405 bp, Utricularia gibba
agccgattaacctgattttcaggttcctccagagcaaggcgaggattcagatatggcttttcgagcagaaggatctgcgaatcgagggcagaatcatcggattcgacgagtacatgaacctcgttttggacgacgccgaggaggttagcgtcaagaaaaacagcaggaagcagctcggccggattctgctcaagggcgataacatcactctcatgatgaacaccggcaagtagccaagtacttcaccgctatgcggagcgtatgcattgccgtgtttttaggtactaggttttgtctggttcatcctctcccaatttcatgtattgcagtgtgttgatggcgaacttttctgttaatctgaaatcttcgaattacgtagaaaaaaaaaaaaaaatacacattaac

SEQ ID NO: 6667 - DNA, 269 bp, Brassica juncea
gagagagagaactcagacgtcggcagccatggcgagcaccaaagttcaaaggattatgacccaacctatcaacttgatttttaggtttcttcaaagcaaagctaggatccagatttggctgttcgagcagaaagatttgaggattgaaggaagaatcactgggtttgacgaatacatgaacctagtgttggatgaagctgaggaagtgagtattaagaagaacaccaggaaaccacttggaaggattttacttaaaggagacaacataa

SEQ ID NO: 6668 - DNA, 573 bp, Tragopogon dubius
catacgtcttctttcacccgcctccatcttccagattcatcacgtcgcctccattccaacctgcagaatccttcagcttcattccttcagccgctcgtttacagaaacaagggattgcttcactcttctctcccgtgagctttctggggttgtctctgcgactgcgttatcaaccaaaggagaacagcaaccacaacagcagccatggcgactaaagtccagaggattatgacccaaccgatcaatctgatctttaggttcctccaaagtaaagctcgtatacagatatggctgtttgagcagaaggatctgaggattgaaggccgtataatcggttttgatgagtacatgaatttggttcttgatgaggctgaagaagtcagcattaagaagaagaccagaaagcctctaggcaggattttgctaaaaggggacaacattaccctcatgatgaattcgggaaagtatgaggagcatttgcatcagtgtagttgctgaaaccaagagttacaatgtttttatgaatgttaattagggaattatgttcttgtattgaactttaggcttttattc

SEQ ID NO: 6669 - DNA, 504 bp, Guizotia abyssinica
aaactagggttttatctgctatcaatcaaaggagacgagcgattccaacaacagcagccatggctactaaagtccagagggtcatgacccaaccaatcaatctcatcttcaggttcctccagagtaaagctcgtatacagatatggctgtttgagcagaaggatttgaggatcgaaggtcgcattatcgggtttgatgagtacatgaatttggttcttgatgaggctgaggaagtcagcataaagaagaaggccagagaggctctagttgcaaacttttgaatagggataggcaggatcctgctaaaaggggacaacattactctcatgatgaatgcaggaaagtaacaaggagcatttgcacaaggatgataaaacaagatttgcaacttatgttaagacattgttttgatgaatgttaattagggatttatgatgtttttaggtttgtaagcacacaacttttgaatatgagccaagttctaatcgaaaatcgcattctact

SEQ ID NO: 6670 - DNA, 809 bp, Trigonella foenum-graecum
cacacgcgctattcggattatataatcgtctcttcacatttgtgagtagctagggtttctatcaaacacacaagaggcgcagccgtagaagaagcttgtgaattcaacaatggcaaggatcaaggttcacgagttgaggcagaaagccaaagctgatctgttggctcagctgaaagacctcaaggctgaactcgctttgctccgtgttgctaaggtcactggtggtgcacccaacaagctctccaagatcaaggtggttaggttgtcgattgctcaggttttgacggtgatttctcagaaacagaaggctgcattgagggaagtttacaagaacaagaagtatttgcctcttgatcttcgtccaaagaagaccagggccattcgcagaaggcttaccaagcaccagtcatcattgaagaccgagagggagaagaaaaaggagacatacttcccaatgaggaaatatgctatcaaagcataggactgtagtagagcaatcatatctatcaactggagatttacatcttcataattgacaagttttgatatttctactcttgtattttcattatggtgttattaagtttttcttcatcgggtctcttgaggtttccctccttaagttactaggatttctgcacttggttaatttttgccttttaaggaatcagactcgacaatgttcaaaattgatgaatgtttaagttttgctatttatcaacagttttgctatttatcaacagtttctaatttgtttgtggtttaaattatatggtagatttcactccgaaaaaaaagaaaaaaacaaa

SEQ ID NO: 6671 - DNA, 738 bp, Fagopyrum esculentum
ggagaggagataggagacgcggacaccaccagattccagcaatggcaaggattaaggttcatgaactcaggcagaagaacaagaccgatcttctcgctcaattgaaagatctcaaggccgagctttcactccttcgcgttgctaaagtcaccggcggtgctcccaacaagctttccaagattaaagttgtgagacttcagatcgcacaggttttgactgtgatttcgcagaagcagaaggctgctttgagagaagtgtacaagaacaagaagtacttgccacttgaccttcgtcctaagaaaaccagggccatcagacgtcgtcttaccaaacaccaggcttccctgaaaacagaacgtgaaaagaagaaggaaatttacttccccatgaggaaatatgctatcaaggtgtaaagctcttgatctggcatcaatccttttacattccgtgttagttcctgattctatttgtcaaagttttgtttgtgttgagactgccaatttctactagcatgaggattgtttccatttgaaggatcgttttcttagtggctgaaattttggagatcatattttgtcatttagaaaatactcttgtttctcgatgcagctagctttaaaaaaaacttgagtctgggtgtacttgcgtcagtttatgttgtctgctgcaggaattcttcatgtgatggtacggtagcttgtaggttgattttgcatcactatgggttcttctaacttg

SEQ ID NO: 6672 - DNA, 620 bp, Pisum sativum
caaggttcacgaattgaggcagaaagccaaagctgatctcttgagtcagctcaaggacctcaaggccgaactcgccttgctccgtgttgctaaggtcaccggtggtgcacccaacaagctctccaagatcaaggtggtgaggctgtcgattgctcaggttttgacagtgatttctcagaagcagaaggctgcattgagggaagtttacaagaacaagaagtatttgccacttgatcttcgccctaagaagaccagggctattcgccgaaggctcaccaagcaccaggcttctcttaagaccgagagggagaagaagaaagagacatacttcccattgaggaagtatgccatcaaagcataaaactgtagaacaaccatatctatctattggagatttacatctttcatagttgacaagttttgattattctacttttgtatttgcatgcttgtgttatctagtttttcttcatcagacatgttaccttttgctgaagttattagaatttctcgattttgttagtttctgccttcaaggaactaggattatgacggattgtttaaaattgatgaatactctgttttgttcttttatttatcaacattttccatttatattg

SEQ ID NO: 6673 - DNA, 892 bp, Cicer arietinum
tgcaatcttcatccctccccattttggagtagctagggtttgtatcgaagacagaagagtaggcgcagcttcgtgaattcaacaatggcaaggatcaaggttcacgagctgaggcagaagacaaaggctgatcttttgagtcagttgaaagacctcaaggctgaactctccttgctccgtgttgctaaggtcactggtggtgcacccaacaagctctccaagattaaggtggtgaggttgtccattgctcaggtgttgacagtgatttctcagaaacagaaggctgcattgagggaagtttacaagaataagaagtatttgccacttgatcttcgcccaaagaagaccagggctattcgcagaaggctcaccaagcatcaggcatcattgaagaccgagagggagaagaaaaaggagacatatttcccattgaggaagtatgctatcaaagcataggacagtagaccaatcttctctatcgattggagatttacatcctttatagttacaagttttgatatttctactcctgtaatttcatgttggttttattaagtttttctttaatagacatggagtttccctcctgaacctactagaatttgtgtgcttgatagtttttgtctctaaagaaccagactcttggtattgttagtttcagtgttcaaaattgatgaatgctttgagttttgccagttttatctacattttctaatttgtttggcactttgatgtggtcaatttcagttagcgtaagtgctgaaacttttttttcctaacataattctaaccttttgaacaaaatacaaaggataaggtatgaaggaagttggtcaaacacgagtgcacctatatatttgtttatgtacaaaaatgcagcactatactcaaa

SEQ ID NO: 6674 - DNA, 700 bp, Trifolium pratense
atttcgaagtaacttagggtttgcagagaggcgcagccgtagaagaaacctcttgaattcagcaatggcaaggatcaaggttcatgagttgaggcagaaagccaaaactgatcttatggctcagcttaaagacctcaaggctgaactcgccttgctccgtgttgctaaggtcaccggtggtgcacctaacaagctctccaagattaaggtggtgaggctttctattgctcaggttttgaccgtgatttctcagaagcagaaggctgcattgagggaggtgtacaagaacaagaagtatttgccacttgatcttcgcccaaagaagaccagagccattcgcaggaggctcaccaaacaccaggcttcattgaagactgagagggagaagaaaaaggagacatatttcccattgaggaaatatgctattaaagcttaggagtgtagagcaattgtctcttttgatttgaaatttgcatcctacctattaaacaagttttgatatttcttgttgttaagtttttcttcatcagacctgattttgagtttttcctccttaaactactaggtattctgaactttgttagtttgtgtctttgtgaaacaaaaagctcattgcggatctttattttctacaatgtttaaaattattgaattctaagttttctagtcatttgtttatcaatattttttagttaaaaaa

SEQ ID NO: 6675 - DNA, 686 bp, Trifolium pratense
tagggtttgcagagaggcgcagccgtagaagaaacctcttgaaattcagcaatggcaaggatcaaggttcatgagttgaggcagaaagccaaagctgatcttttggctcagcttaaagacctcaaggctgaactcgccttgctccgtgttgctaaggtcaccggtggtgcacctaacaagctctccaagattaaggtggtgaggctttctattgctcaggttttgaccgtgatttctcagaagcagaaggctgcattgagggaggtgtacaagaacaagaagtatttgccacttgatcttcgcccaaagaagaccagagccattcggagaaggctcaccaagcaccaggcttcattgaagaccgagagggagaagaaaaaggagacatatttcccattaaggaaatatgctattaaagcataggagtgtagagcaattgtctcttttatttgaaatttgcatcctacctattaaacaagttttgatatttcttggtgttaagtttttcttcatcagacctaattttgagttttccctccttaagctactaggttttctgaactttgttaatttgtgtctttgtgaaacaaaaagctcattgcggattgttagtttctacaatgtttaaaattattgaattctaagttttctagtcatttgtttatcaatattttttagttaaaaaa

SEQ ID NO: 6676 - DNA, 1297 bp, Vaccinium corymbosum
cgtgttcgattcgtctcgcgggcgattgagaattagggtttcttatttagagcagataaaaccgccgaggacggctagggtttcatttcttatcaggctatcataggcatacagagagacagacgccatggcaaggatcaaggttcatgagctcaggcagaagtccaagacagatctattggcccagttgaaggatctgaaagcagagcttgctcttcttcgggttgccaaggtcactggtggtgcccccaacaagctctccaagattaaggtggtgcggttgtcgatagcacaggtgttgactgtgatctcacagaagcagaaggcggccctgagggaggtttacaagaacaagaagtacctgccccttgatctgcgtcccaagaagacgagagccattaggagacgcctcaccaagcaccaggcgtcattgaagacagaaagggagaaaaagaaggagatgtactacccaatgaggaagtatgccatcaaggtttagcattcaaattgcttttgaaggcttttgtttctctctacattatgatgtactacttcctattgaggaactatgccctccaggtttaggatctatattgccttttaaggcctttgtttcttttctctatatccttgcgctgaaatcattttactattatttgtttcttccctttttggccaaacttaagatgaatgagaacacaaggatgagttttttaagtatcattttttcatggagtattgtggcctgctcaatttgtctaatttgagtgtttccacacactgaattgtatgctttgttgtgcttgggtattacaagaacaactattaactgtagtcaggtacgatcagattgtctgggctttaaaggtgatggtagaagctttttattcagtgaagccatgatggaaatgctcaaccttatgtttaatattcccaacccttttaatttctacttctctggaaatgctctctgtactcctacattagcagatagcatattttgcttcctaagcaattatcctttacattacccagttggcttcgtacgttatgtgaattgcaaacaaataatgtggatagctgcttgttggaattgctttgaaagctgttatggtttactgtatgcccagttgtgatggcaaatgtgatcctattttaggtgtttccaattgtttccatctgacgtgttctggagtacttctcttgatctgcaatgagtttttggaaaacaaatagtttacaaagtgaaccattgggttgttatagactatatgacaattggacatctagacactaa

SEQ ID NO: 6677 - DNA, 710 bp, Glycyrrhiza uralensis
atttcggactactactagggtttgtagcagggaagggaagaggcgcagccgtagcagaagctcgtgaattcagcaatggcaaggatcaaggtgcacgagctgaggcagaagaacaaggcagagctgttgaatcagctgaaagacctcaaggccgagctcgccttgctccgcgtcgccaaggtcactggtggtgcccccaacaagctctccaagataaaggtggtgaggttgtccattgcccaggttttgactgtgatctctcagaagcagaaggctgcgttgagggaagcttacaagaataagaagtatctgccactggatctccgccctaagaagaccagggctattcgaagaaggctcaccaagcaccaggcatcattgaagactgagcgggagaagaagaaagagacatatttcccaatgaggaaatatgctatcaaggcgtagggctgtagagcaatctcatctgttgatcggcagtttacctgttttattatagttgacaagttttgatatatctactcttgtagtttcatgttggtgttattattggttatgttaaatttcacttaatcagacctggggtttctctcttgaagctactaggatttctgcgcattgttagtttctgtcttcaagtgattatctgttcaaaattgatgaatgcattatgtttttgccctttaatttataaacgttttcttttctta

SEQ ID NO: 6678 - DNA, 806 bp, Vicia sativa
aggttttctagggtttgtagcaaggagaggaggagcagcagccgtcgtgaaattcaacaatggccagaatcaaggttcatgagttgaggcagaaagccaaagctgatctcttgagtcagctcaaagacctcaaggcggaactcgctctgctccgtgttgctaaggtcactgggggtgcacccaacaagctctccaagatcaaggtagtgaggttgtcgattgctcaggttttgacagtgatttcccagaagcagaaggctgcattgagggaagtttacaagaacaagaagtacttgcctcttgatctccgccctaagaagaccagagctattcgccgcaggctcaccaagcatcaggcatctttgaagaccgagagggagaagaaaaaggagacatactttccattgaggaagtatgccatcaaagcttaaaactgtagaacaaccatatctatctgttggagatttacttcatagttgacaagttttgataattctacttttgtatttgcatgtttgtgttatctagttttttctttatcagacctgaggtttccttgctcaagttattagaatttctctattttgttagtttctttctctaaggaactaggcttattgcgtattgttttaaattgttgaatactctgttgctgagtaagtttgagattcatattttcttcattaaaaaaaaaaaaaaaaagtagaatcaaagcatagacacagaaagaatatataaaccaccctctcaattttcactgcaacaatcctttgtaattcacgatgaggctgttgaaggtagctact

SEQ ID NO: 6679 - DNA, 595 bp, Primula obconica
agagtgagcggcttggtgcattttcgatcactgcaatggcgaggattaaggtacatgaattgagacagaagacgaaggctgatttgttggcacagctcaaggatctcaaagctgagctgtcactcctccgtgtcgccaaagtcaccggcggcgctgcttaacaagctctccaaaataaaggtagtgaggttgtcgattgctcaggttttgacagttatctcacagaaacaaaaggctgctcttagagaagtgtacaagaacaaaaagtacctgccccttgatctacgtccaaagaaaactagagccattcgcaagcgtctaaccaagcatcagcaatcgttgaagaccgaaagggagaagaagagagaaatgtactttcccatgaggaagtatgctatcaaggtctagaatttatcatgctttggagtagatttacgatgcacttggagcctactcgagttttgtttgacaatttttttttggatctaagactggttattgttccttatttctgtcgaaccaaatattttgctcttatttatccaacttgtggaaacttgagttcccctgtttgtaggtctttggttttatcaaa

SEQ ID NO: 6680 - DNA, 853 bp, Trifolium pratense
attcccatttcgtagtaactagggtttgcagagaggcgcagcagccgtagaagaaacctcctgaattcagcaatggcaaggatcaaggttcatgagttgaggcagaaaaccaaagctgatcttttggctcagcttaaagacctcaaggctgaactcgctttgctccgtgttgctaaggtcaccggtggtgcacctaacaagctctccaagattaaggtggtgaggctttcaattgctcaggttttgacagtgatttctcagaagcaaaaggcagcattgagggaggtgtacaagaacaagaaatacttgccacttgatcttcgcccaaagaagaccagagctattcgcagaaggctcaccaagcaccaggcctcattgaagacccagagggagcagaaaaaggagacatatttcccattgaggaaatatgctattaaagcataggttttctgcactctttgtatcctagatttgcatctgccccgttagacaagttttgatatttctattgtattttcttggtgttatcaacgttttcgtcattttcttggtgttatcaacgttttcttcatcagacctgggtttacagtttcccctcttgaagctattaggttttccgcactttgttattttgtgtctttatggaacaaagctcattgcagatcaatagttctacaatgtttaaaattgatgaatattaagttttgttatttatttattatcattttctaatttgattggggtataattatgttgatttcaccttgtaggatgcagaaatttttacttaaaacaatgtatttctaacattgagacataacaaaagaaatttgcctagttagtggttcctatt

SEQ ID NO: 6681 - DNA, 824 bp, Trifolium pratense
attcccatttcgtagtaactagggtttgcagagaggcgcagcagccgtagaagaaacctcctgaattcagcaatggcaaggatcaaggttcatgagttgaggcagaaaaccaaagctgatcttttggctcagcttaaagacctcaaggctgaactcgctttgctccgtgttgctaaggtcaccggtggtgcacctaacaagctctccaagattaaggtggtgagactttccattgctcaggttttgacagtgatttctcagaaacagaaggcagcattgagagaggtgtacaagaacaagaaatacttgccacttgatcttcgcccaaagaagaccagagctattcgcagaaggctcaccaagcaccaggcctcattgaagacccagagggagcagaaaaaggagacatatttcccattgaggaaatatgctattaaagcataggttttctgcactctttgtatcctagatttgcatctgccccgttagacaagttttgatatttctattgtattttcttggtgttatcaacgttttcgtcatcagacctgggtttaaagttttccctcttgaagctattaggttttccgcactttgttattttgtgtctttatggaacaaagctcattgcagatcaatagttctacaatgtttaaaattgatgaatattaagttttgttatttatttattatcattttctaatttgattggggtataattatgttgatttcaccttgtaggatgcagaaatttttacttaaaacaatgtatttctaacattgagacataacaaaagaaatttgcctagttagtggttcctatt

SEQ ID NO: 6682 - DNA, 422 bp, Cyclamen graecum
ctgcacaaacttctcccccgccgagagagagaaagacagagaacgacgccatggcgaggataaaggtacacgagcttaggcagaagacgaaggctgatctgttggctcagctgaaggatctcaaggccgagctctccctcctccgcgtcgctaaggtcaccggcggcgcaccaaacaagctctccaagataaaggtggtgcggctgtcgattgcgcaggtgctgacggttatatcccagaagcagaaggcggcgctgagggaggtgtacaagaacaagaagtatctgccgctcgatctccgcccgaagaagacacgggccattcgcaggcgcctcaccaagcaccaggcgtcattgaagacagaaagggagaagaagagggatatgtactttccaatgaggaagtatgccatcaaggtgtag

SEQ ID NO: 6683 - DNA, 657 bp, Lotus japonicus
atccctttcattgagcactagggtttgtagcgaagaggcgcagccatagcaagagcttctgaattcagcaatggcgaggatcaaggttcatgagttgaggcagaagaacaaggctgatctgttgagtcagctgaaggacctcaaggccgagctcgctttgctccgtgttgctaaggtcaccggcggtgcccccaacaagctctccaagatcaaggtggtgaggttgaacattgctcaggttctgactgtgatttctcagaagcagaaagctgctttgagggaagtttacaagaacaagaagtacttgccccttgatctgcgcccaaagaagaccagggctattcgcaggaggcttaccaagcatcaggcatcattgaagactgagcgggagaagaagaaagagacatatttccccatgaggaagtttgctatcaaggtgtaggactttagagcaatcacatttctctactggacatttacaccatttctagttttcaagttttgagatatcttatttgtagtttcaacttctctatcaagttgttggctatgttaaatttcttgtcatcagacccgggctttctcccttgaatttactaggatttctgcatatttctgtctttaaagcagtaaattttcttctcattgttagtctgc

SEQ ID NO: 6684 - DNA, 657 bp, Sesamum indicum
caaacactcccccacccccacttaggaaccgagaggaggaagaacgacgagatggcgaggattaaggtgcacgagttgaggcagaagaacaagacggagctgctggctcagctcaaggatttgaaggcggagttggcgcttttgagggtggccaaagtgaccggaggcgcccccaacaagctttcgaagatcaaggtggtgaggctctctattgcccaggtgctgactgtcatttcgcaaaagcagaaatccgctctcagagaagcctacaagaacaagaaatacttgccacttgatctccgcccgaagaagacccgtgctatccgccgccgcctcactaaacaccaggcatctttgaagacagaaagggagaagaagaaagagatgtacttcccaatgagaaagtatgccattaaagtttaagttaattccttccttttgcagttttgcttgtgttgatttctgatcttggaggatattcatattttgtgccagtgaatttttagttttaatgaatttgtagttttctgattaattaaaattaaaagtgatatgtagactcttgaagtaccattttccatcttatataatgatcccacatctttttataagatggaaaatggtactttaagagtctacatatcagaaagaagtcca

SEQ ID NO: 6685 - DNA, 389 bp, Primula obconica
gtgtttctcagtcactgcgatggcgaggattaaggtacatgagttgagacaaaggaaaggtggatttgttgggtcaattgaaggatttgaaagctgagctctcacttctccgtgtcgctaaggtcaccggcggcgcacctaacaagctctccaagataaaggtggtgaggctgtcgattgcccaggttttgacggtaatttcacagaagcaaaaggctgcattgagagaagtctacaaaaacaagaagtatttgccgcttgatttacgtcccaagaaaacccgagccattcgcaagcgtctgaccaagcatcagcaatcattgaaaaccgaaagagagaagaagagggagatgtactttcccatgaggaagtatgctatcaaggtctag

SEQ ID NO: 6686 - DNA, 407 bp, Ananas comosus
tagtacacgagctgaggcagaagtcgaaggccgatctgttggcccagttgaaggatctcaagacggagctctccctcctccgtgtcgccaaggtcaccggcggcgccccgaacaagctctccaagataaaggtggtgcggctgtcgattgcgcaggtgctgacggttatatcccagaagcagaaggcggcgctgagggaggtgtacaagaacaagaagtatctgccgctcgatctccgcccgaagaagacacgggccattcgcaggcgcctcaccaagcaccaggcgtctttgaagacagaaagggagaagaagagggatatgtactttccaatgaggaagtatgccatcaaggtgtagtgtttaatgccctgtaggctagttccttattgttactttgtgtcgagg

SEQ ID NO: 6687 - DNA, 568 bp, Antirrhinum majus
ctcctcccccaaccctagcctccctgcagaagaaaatggctcgcattaaggtgcacgaattgaggcagaagaacaagaccgatctcctcgctcagctgaaggatctgaaggccgaattggcgctgctgagggttgctaaagtgacaggtggagcaccgaacaagctctcgaagatcaaagtggtgaggctctcgatcgctcaggtgctcactgtcatttcacagaagcaaaaatctgcactcagagaagtgtacaagaacaagaagtacttgcctcttgatctccgccctaagaagactcgcgcaattcgtcgccgtcttacgaaacatcaggcttctttgaagactgagaagcagaagaagaaggagatgtactttccattgagaaagtatgccattaaggtctaatttaggcttgtatcaggatcaattttgtggttttccgtctcactttctaagatatttgttttttgctactagatttgcacccaattattagatgcattttcaagacttatatagggaaatacttgtcgttcgagtttgatgaaattctcttgttcctttag

SEQ ID NO: 6688 - DNA, 807 bp, Vaccinium corymbosum
ccctacctccctcgttgtcgtcgttcggcgatctcagagaccgtgtctacacacagaggtcggctaattaccgggacgggacgaccggttggttatacacgacgagaggtcgctatacggcggggtcgatttctagggtttagtcgtatactctgagcctccctcaggttctagcacagagcagtcgttcttcctttttgcagtcgattcaatggcgagggtgaaggttcatgagctgaggcagaagtcgaaggcggagttgttgagccagttgaaggatctcaaagctgagcttgcgcttctccgtgtcgccaaggtcaccggcggtgcccccaacaagctctccaagataaaagttgtgaggttgtcaattgcccaggtgttgacggtgatttcacagaaacagaaagctgctctgagggaagtctacaagaacaagaagtacttgccacttgatctgcgtcccaagaaaaccagggccatccgtaggcgtctcaccaagcatcagttgtccctgaagactgaaagagagaagaagaaggagatgtattatcccatgaggaagtatgctattaaagtgtagggttgagctattgcggagtagatttctgttgccgggcatccatacatcttgtttcaagcgtgaactatttagttttgttgtgcctttcatcataagtttggtggattattgatgagttctattgttttttaagaagcagactttgaagttccgaatcttttatgggtgcggtggtaaggtttttggttagataactgatatatgcaaggttttaggtattctaa

SEQ ID NO: 6689 - DNA, 822 bp, Chelidonium majus
acagaggaggaaggagagccgatagtcgtttaggaagtcacagcagcaatggcgaggatcaaggttcatgaactcaggggtaagtcgaagaccgacttattgaaccagttgaaggatctgaaagcagagctagctcttctccgtgtcgctaaggtcaccggtggagctccaaacaagctctccaagattaaggtggttaggttgtcgattgcacaagttttgactgtgatttctcagaagcagaaggctgctttgagggaagtttacaagaacaagaagctcttgcctcttgaccttcgacctaagaagactagggccatcaggagacgtcttaccaagcaccagctatctttgaaaacagaacgtgagaagaagaaggagatgtacttcccaatgaggaaatatgcaatcaaggtgtagtttaggagatcagttaactgagaattttgtttctcttcctaaaatattgttgttagatcgacatctattgcttgttcatttgaagttttttttgccccttagatggaggtgcacacctcctccattttatttagatttggacaaatatgaatgagtacctgaatttgagtttatgtagggttgcagttacttttctttttaatcctcgacttctattggtgattaatttcatgcttaaaactttaatgaatggtatgcactcttaacattgcttagcagacttcgtatcaccttctttcgtaattttgttgtagccaaagctacagattatatctgaacacccaagtgcaatttgtaaattgtgttatacccgagctacggattatctagctacggattatc

SEQ ID NO: 6690 - DNA, 493 bp, Chelidonium majus
gagatggcaaggattaaggttcatgaactcagaggtaagtccaagactgacttgttaagccagttgaaggatctgaaagcagagctcgctctgctccgtgttgctaaggtcactggtggagctcctaacaagctctccaagatcaaagtggtgaggttgtcgattgcccaggttttgactgttatctctcagaagcagaaggcagctcttagggaagtctacaagaacaagaaactccttccccttgatctccgcccaaagaaaaccagagccatccgtagacgccttaccaagcatcagctatcactgaagaccgaacgtgagaagaaaaaggaaatgtacttcccaatgaggaagtatgccattaaggtgtaagctaggttttactcaagaagacatttttgatgattctaattcctgtgtttttgtgaaagttgtttctttctgcactccaaagttgcacattttaagatatttggagttgattttgcaa

SEQ ID NO: 6691 - DNA, 797 bp, Coffea canephora
cggccgggggaaagtcagtcacatagctgagggatatcatcatcacagaactagggtttttccgccttgctcatatctgctgtctctctgtcacacacacacacacacagaggtgagggatacgagacggcgccatggcccggatcaaggttcatgagctgaggcagaaaaacaaagccgagcttttggctcagttgaaggatctaaaagccgaattggctctcctccgagtcgctaaagtcaccggcggcgccgccaacaagctttccaagataaaggtagttaggttgtcaatagcgcaggtgctgacggtgatttctcagaagcagaaggcagcattgagggaggtttacaagaacaagaagtatttgcctcttgacctccgccctaagaagaccagagctatccgccgtcgcctcaccaaacaccaggcttctttgaagacagaaagacagaagaagaaagagacgtactttcccctgaggaaatatgcaattaaggtttagatcgaccatgtttggatttgattttggtgtttgaacctgtctgaacacgaagaaaaatcatattttgcttcatttctgttgctagcctaaggaatatatggatcgctgtgaacaaagctttaagcatgttggtagcccattgtttatttagtcacacattttctcatagttttcttagtcacattttctcatagttttcttgggggcacggctgaagagccatgtttatgtgggtggtgtggtgatgggtaaggagccgtttggtgattatgcggaagattgaaatttcac

SEQ ID NO: 6692 - DNA, 630 bp, Cyclamen graecum
tgggttcgccacttgtctcaaaatctagagagagagatttccatggcgaggattaaggtacacgagcttcggcagaaatcgaaagctgatttgatggcgcagctgaaggatctgaaggctgagctgtcactcctccgtgtcgctaaggtcaccggcggcgcaccgaacaagctctccaagataaaggtggtgaggttgtcaattgcccaggttttgacagtgatctcgcagaagcaaaaatctgctctgagagaagtgtacaagaataagaagtacttgccccttgatttgcgtcccaagaaaaccagagccattcgcaggcgtctaaccaagcatcagcaatcattgaagactgaaagagagaagaaaagggagatgtactttcccatgaggaagtacgccatcaaggtctagattttgttatgctcttgagtagacttcttatgctctccgaaccgattcgaattttgttacaagtatttcttttggtcgaaacctggttattgttctttttgtcctgtgaaccaaggatgttactcctgtttgattagcacattgaaacgcaatattttgtaccgtgttagtttatgtcctgtgaacctccagcttcgttaatgatgtgattgttcg

SEQ ID NO: 6693 - DNA, 536 bp, Cyclamen graecum
agagagagggaggggcacagagcgacgccatggctaggatcaaggtacacgagctgaggcagaagtcgaaggccgatctgttggcccagttgaaggatctcaagacggagctctccctcctccgtgtcgccaaggtcaccggcggcgccccgaacaagctctccaagataaaggtggtgcggctgtcgattgcgcaggtgctgacggttatatcccagaagcagaaggcggcgctgagggaggtgtacaagaacaagaagtatctgccgctcgatctccgcccgaagaagacacgggccattcgcaggcgcctcaccaagcaccaggcgtcattgaagacagaaagggagaagaagagggatatgtactttccaatgaggaagtatgccatcaaggtgtagtgtttaatgccctgtaggctagttccctattgttactttgtgtcgaggattcagaagatcttttcgtctttttggtgacctatttctctcgttttttcatgcatatcacagattattacaatttagacttggatt

SEQ ID NO: 6694 - DNA, 628 bp, Solanum melongena
acgtagggtttcagaatcagtaatcacgagaagccgcctctgtagaaacctccagcagcagcaacaatggcgagaatcaaggttcatgagctgaggaacaagtcgaagactgatctactggctcagttgaaggatttgaaggctgagcttgctcttcttcgtgtggcgaaggttactggtggtgctcctaataagctctctaaaatcaaggtggtgaggttgtctattgcacaggttctgactgtaatttcacagaaacaaaaggctgctcttcgggaagtttacaagaacaagaaatacctgcctcttgacctgcgcccaaagaaaactagggccatccgcaaacgtttgactaagcaccaggcatccttgaagacggagagagagaagaagaaggagatgtacttccctttgagaaagtatgccataaaagtgtaggataggatctaatttggcagaaattttggtgtttgaatcaggatatattggtttaaactatttatcatgcaaattttgttttagctttctttcatttggcttttatgacgttaggaacaagactgttatggagcttcatttgttccaaaatatcaagtgttttcctattttatgttaaagagtactttgt

SEQ ID NO: 6695 - DNA, 710 bp, Fagopyrum esculentum
gtgagaaagtgagaggcagttcgccgttaagccgcagatagcaggagatttcagcaatggcgaggattaaggttcacgagcttaggcaaaagaacaagactgatcttctcgcacagttgaaggatctcaaggctgagctctctcttctccgcgtcgctaaggtcaccggcggtgctcccaacaaactttcgaagattaaggttgtgaggttgcaaatcgcccaggttttgacggtgatttcacagaagcagaaatcagcattgagagaagcttacaagaacaaaaagtaccttcctctcgatcttcgccccaagaagactagagccatccgccgtcgtctcaccaagcaccaggccaatttgaaaaccgaacgtgagaagaagaaagagatttacttcccattgaggaaatatgccattaaggtgtaatgactgatccttgatttcgtgttagtttacaaacacagcattttgtgcaagttttgtttgtttccggaactatgaactagtatggagattgctcttctatttgaattctttatctttctctcctcgtctaaatcttttatgttagtattgtatcccatcaactgcattctgaatctcatcttttcaacatatccatatgggaaagcaaatgggaatgttctcattgtatcgatcagcatattctcatcagcaagcctgataatttctactcccaatatcttg

SEQ ID NO: 6696 - DNA, 664 bp, Fagopyrum esculentum
agaaagtgagagacagtcgccgttaagccgcagatagcaggagatctcagcaatggcgaggattaaggtacacgaactcaggcaaaagaacaagactgatcttctcgcacagttgaaggatctcaaggccgaactctctcttctccgtgtcgctaaggtcaccggcggtgctcctaacaaactctcgaaaattaaggttgtgaggttgcaaatcgcccaggttttgacggtgatttcacagaaacagaaatcagcattgagagaagcgtacaagaacaaaaagtatcttcctctcgaccttcgccctaagaagactagagccatccgccgccgtctcaccaagcaccaggccaatttgaaaaccgaacgtgagaagaagaaagagatttacttcccattgaggaaatatgccatcaaggtgtaaggaatattgacccttaatttcgtgttagttttacaaacacagcattttgtgcaagttttgtttgtttcagaactatgaattattatggatactgctcttccatttgaattctttgtctttttctcctcggctaaatcttttgctttagtattgtatcccatcaactgcattggagatgatgaatatcttgcaagtatactatccatatgagaaagtaatgggaatgcccacgttgtattg

SEQ ID NO: 6697 - DNA, 620 bp, Linum usitatissimum
ccagccagaagaggtgaactcaacgaagcagctgccgctgtcgcagattgaaacgaagacatggccagaatcaaggtccacgagctgaggcagaagaacaaatccgaccttttgaaccagttgaaggatctcaaggctgagctcgccctcctccgcgtcgctaaggtcactggcggcgctcctaacaaactctccaagattaaggtggtgcgcttgtccattgcccaagtcttgactgtgatttcacagaagcagaaagctgctttgcgagaagtctacaagaacaagaagctcttgcctcttgatcttcgtcctaagaaaactagggccattagaagaaggcttacaaagcaccagcaatcattgaagacggagagggagaagaagagagaaatgtacttcccaatgagaaagtatgcaatcaaggtttaagattagcgtggacccttttaaagtatgctatttcataatcttgatggatatgaagaaagcatattctcgtacaacgaacattgtggaaattgtgtaattttagatttgagtgatagtgtgaactatgcatcacttcacttcttggaacctttgaaaatgacatgaattcttattataaactcgaaggt

SEQ ID NO: 6698 - DNA, 640 bp, Linum usitatissimum
gacagatagcagctgccgccatcgccagagtgaaacgaagcaatggccagaatcaaggtccacgagctgaggcagaagaacaagttggatcttttgaatcagctcaaggatctcaaggctgagctttctcttctccgcgtcgccaaggtcacaggcggcgctcctaacaagctctccaagatcaaggtggtgcggctgtctattgcccaagtgcagactgtcatctcacagaagcagaaagctgcacttcgtgaagtgtacaagaacaagaagctgttgcctcttgacctccgtcccaagaagaccagagccatcagaaggaggcttaccaagcaccagcaatctcttaagacggagagggagaagaagagggaaatgtacttccccatgaggaagtatgcaatcaaggtgtaggaaaagctagcaacttttctgtcttcaagggttattaagatttaaggaggtgcgttttattattaggagcaattttgagtctttttgtaatttcatattcgaagatagacatgtgaactcgagcatcaacttttgaacaagttttggaatgatatgtatcgacttttctcacacccttgttgaatcagagttcatgttttgtggaagtgtctgaaaatctgaattc

SEQ ID NO: 6699 - DNA, 729 bp, Linum usitatissimum
ggtttagtcatctgcacagagacagatagctgctgccgccatcgccagagtgaaacgaagcaatggccagaatcaaggtccacgagctgaggcagaagaacaagtcggaccttttgaatcagctgaaggatctcaaggctgagcttgctcttctacgcgtcgccaaggtcaccggcggcgctcctaacaagctctccaagatcaaggtggtgcgattgtcgattgcacaagtgctgactgtgatatcacagaagcagaaagctgcacttcgtgaggtgtacaagaacaagaagctgttgcctcttgaccttcgccccaagaagactagagccatcagaaggaggcttaccaagcaccagcaatctcttaagactgagagggagaagaagagagaaatgtacttccccatgaggaagtatgcaatcaaggtgtaggaaaagctagcaactttccgtctcgcaggttattaaggtgtgttttagtacaaggagcaatttcgactctttttgtgatttcatatttgagggtagacatgtgaactcgagcatcaactgttgaagaagtttttggaatgatatgtacataattttcttacacctttgttgaatcagttcatgttttgtggaagtgtctgaaaatctgagttcatttcttcctcatgtttttacaagtagatacatggcaccagtatctcatatcaatacagtgcttgtcatctgtcgttgattt

SEQ ID NO: 6700 - DNA, 717 bp, Tropaeolum majus
cggccgggggttgtgcttcattatcgtcaagtagcggaagcaggaggctgagaaggtagtcgttgcaaaactttagcgacaccatcaatagcaatggctaggattaaggttcatgagttgaggcagaagtccaaggacgatcttttgagtcaattgaaggatctaaaggctgagctcgctctccttcgcgttgctaaggtcactggtggtgcccctaacaagctttccaagatcaaggtggttcgcttgtctattgcacaggtgttgactgttatttcacagaaacaaaaatctgccctgagggaggtatacaagaacaagaagtatttgcctcttgatcttcgccccaagaagactagagccatcaggagaaggcttacaaagcaccaggtttcattgaagaccgaacgtgagaagaagaaggagatgtactttcccatgaggaagtatgccattaaagtataagttagtaatggccgttagcatactccagtaatctttcagtttttagcttcagattttgtttgctgcactcttttctcgatttgttattttgaactataagctcaattaggtcctggaaatgattcatcactacaggcaaatgtgctgtaacaacttcatactattttgtttcctaagggattttgttctttgtttattattttcacattctgtccgttaagtttcgtgttggctaattacaagcttatatgt

SEQ ID NO: 6701 - DNA, 612 bp, Petunia hybrida
tcttagcagtaaattagggtttctgaggtttaacatcacctttggcttcatagagcttgagaaatagagagacgcaatggcaagaatcaaagttcatgagctgaggcaaaaatcaaagacagagcttttagctcaattgaaagatctgaaagctgaactttctctcctccgtgttgctaaagtcactggcggtgcccctaacaagctctccaaaattaaggtggtgaggttgtcgatagcacaagtgttgacagtgatatcacagaaacagaagacagcactgagagaagtatacaagaacaagaagtacttgcctcttgacctccgtccaaagaagaccagagccattcgtaaacgtcttactaagcaccaggcatctttgaagacagaaagggagaagaagaaagagatgtacttcccaattagaaagtatgcgattaaggtttaaattgatccaacttagatagttttttatgtcagtacttgcagaacaaagcagagatgttttgccattttgcgttgttttctgttatttactattgttgcattatgaagttggacctctggttattttatttgtctttttgctcattcaacaattgaacacttctt

SEQ ID NO: 6702 - DNA, 594 bp, Primula obconica
agagagagcggcttggtgcattttcgatcactgcaatggcgagaattaaggttcatgagcttcgacagaagatgaaggccgatttgttggcacagctcaaagatctcaaagctgagctctcactcctccgtgtcgctaaggtcaccggcggcgccgctaacaagctctccaagataaaggtggtgaggttgtcgattgctcaggttttgacagttatctcacagaaacaaaaggctgctcttagagaagtgtacaagaacaaaaagtacttgccccttgatctgcgtccgaagaaaactagagccattcgcaagcgtctaaccaagcatcagcaatcgttgaagaccgaaagggagaagaagagagaaatgtactttcccatgaggaagtatgctatcaaggtctagagtttatcatgctttggagtaggtttttgatgcacttggagcctactcgagttttgtttgacaatttttttttggatctaagactggttattgttcgttatttctgtcgaaccaaatattttgctcttatttatccaacttgtggaaactgcagttctcctgtttgtgggtctttggttttatcaaa

SEQ ID NO: 6703 - DNA, 662 bp, Sarracenia psittacina
tcgttgttcagtcgcaggcggagatttgaaacagcgactctggtagaattcttccgtcactgccgccatggctagggttaaggttcatgagcttaggcagaagacgaaggcggatttgttgagccagttgaaggatctcaaagctgaactcgctcttctccgcgtcgccaaggtcaccggtggtgccccgaacaagctctccaagataaaagtggtgaggttgtccattgctcaggtgttgacagtgatttcacagaagcaaaaggctgctctaagggaagcgtacaagaacaagaagtacttgccacttgatttacgtcccaagaaaaccagagccatccgcagacgtctcaccaagcatcaggcatcactgaagaccgaaagggagaagaagagggagatgtactttcccatgaggaaatatgctattaaggtgtaggctagggagtgggttttggtccacggcacccatgaatgattgtgattttggagttttatttatgtctggctatttttgtaggacttattattaattttttgattttgtactggtttaatttgtgaccattaagctttataagtccccctctttatgaaacaatgttgttttttcccaatgttaatgcactggtaatctgaggatctgggtccgaatttgatgg

SEQ ID NO: 6704 - DNA, 640 bp, Sesamum indicum
cattccagcagctcttcactttgctcatccgccaattcgactacctacctgcccacagaaagcaaagagggagaagaaactcgaaatggcgaggattaaggttcatgagttgaggcagaagaacaagacggagctgctggcacagctgaaggatctgaaggcggagctagcgctgctgcgggtggcgaaggtgaccggtggcgctccgaacaaactttccaagatcaaggtggttaggctgtccattgcccaggtgctgaccgtgatttctcagaagcaaaaagccgctctcagggaagcgtacaagaacaagaagtacttgcctcttgatctccgccctaagaagactcgtgctatccgccgccgccttacgaagcaccaggcatctctaaagacagagaagcagaaaaagaaggagatgtattttcctatgaggaagtatgccattaaggtttaaatttacttgtgcttgaagcaattttggtacttcatattttctgatcttgaagggcactgatactgtgtcatgatgattgtagacttgcaattagttaagctgtgccgactagacttgaaattcaagtgccattattccgttttacagactatatctattttatatcatatctcatgccagaag

SEQ ID NO: 6705 - DNA, 644 bp, Solanum lycopersicum
gaaaaaaccctaatctccatcgccgtctgagcagtaacctcaaaggagcagcagccatggcgagaataaaggttcatgagttgaggaacaagtcgaagacagaccttttggctcagttgaaggatctgaaggcggagcttgctcttctccgtgttgcaaaggtcaccggtggtgctcctaacaagctatccaaaatcaaggtggtaaggttgtcaattgcacaggttttgactgtcatctcacagaagcaaaagtcagctcttagggaagtttacaagaacaagaagtacttgcctcttgatcttcgccccaagaaaaccagagcaatccgtaaacgtttgactaagcaccagtcatccttgaagacagagagagagaagaagaaggaaatgtacttccccattaggaaatatgctatcaaagtgtagggataggatctactttggctgagatttttgctttggatcaaaattatttgttgaacttatcagcaatacaagttttgttttgctttgtttcgtcgatgacatttgatacatgatcaatgtgttgggaatatgactcttatgttgaatgtcttatttgttgttagtaatctctatgcttactgtgtaccaaatctgtgtactttttgtcgtcttagc

SEQ ID NO: 6706 - DNA, 498 bp, Pisum sativum
gaggattaaggtgtacgagttgaggaacaaaaccaaaccggatttgctgaaccagctgaaggatctgaaggcggagcttgctttgctccgagtggcgaaagtcaccggcggcgcaccgaataagctatccaaaattaaagttgttaggctttcgatagcacaagtgttgacagtgatttcacagaagcagaaagctgcacttagagaagtatacaagaataagaagtatttgccactcgatcttcgtcccaagaagacccgtgccattcgaagacggcttaccaaaaatcaggcatcgttgaagacagagcgagagaagaagaaggagatatactttccattaagaaagtatgcaatcaaagcttaggctaggattgttttctagttgcatttgtagaccttttatttgaattattggaactttaaggttgcctaatttgtttgttactgtatctgcaatccaatttttgttctagttgattttctggttttcattat

SEQ ID NO: 6707 - DNA, 494 bp, Euphorbia peplus
ggttcatgaacttagggaaaaatcaaagcctgatttattggcgcaactcaaggatcttaaggccgagttagctcttcttcgtgttgctaaggtcactggtggtgctcctaacaagctttccaagattaaggtggtaagatttggggattgcacaagtcttgacagtgatatctcaaaagcagaaggcagcattgagggaggcttacaagaacaagaagtatttgccccttgacctccgtcccaagaaaacccgtgccattcgccgtcgtctcaccaagcaccaggcatcattgaagaccgagagggagaagaaaaaggagatgtactttcccatgaggaagtatgccatcaaggtgtagggtagattaagtttgaatgtgtagaatatttggtacatttcaagtttctacactgtttcgaacttttgtcagtagcaagtttagcagcagccttttttcgactgagtttttatcctatggtattcatcactttat

SEQ ID NO: 6708 - DNA, 778 bp, Arachis hypogaea
ccccccccccccccccctatcccctgtgtgccttggcagtctcagaagcagtggtatcaacgcagagtacgggggggtccctcccatttgaaactagggtttgtaaaggaagaggcgcagcagccacatcaggagaagaaagaagctcgagaattcagaaatggcgaggatcaaggtttacgagctgaggcagaagaacaagactgagttgttgaaccagctcaaggatctgaaagccgagcttgctttgctccgtgtcgccaaggtcactggtggtgccccaacaagctctccaagatcaaggttgtgaggttgtccattgcacaagtcttgactgtgatttctcagaagcagaaggctattttgagggaagtttataagaagaagaagtacacacctcttgatctccgtcctaagaagaccagagccattcgcagaaggctcaccaagcaccaggcatctttgaagaccgagagggagaagaagaaggaaacatatttcccaatgaggaaatatgccatcaaggtgtaggagtctattgcatatttaattttatattgcgcatttaccagttatagttggcaaattttgaggtagtttcatgttggagttatttgttgtcttcaaattttacctatttggacctttggtttctctttgaaatggatttatgatcaaaattgaggattacattgagttaaaaaaaaagaaaaaaaaacaaaagtactctgcgttgataccactgcttctgagactgccaaggcacacaggggatagg

SEQ ID NO: 6709 - DNA, 594 bp, Primula obconica
agattcctttaaacctgccgccaaactcccttctctagagagagagagagagagagagaagaaaagaccatggctaggattaaggtacacgagctgaggcagaaatcggaaaggggatcttttgggtcagctgaaggatttgaaggcggagctctctctcctccgcgtcgccaaggtcaccggcggcgcccccaataagctctccaagataaaggttgtgcgattgtcaatagcgcaagtgctgacggtgatatcacagaagcagaaggcagcgctgagggaggtgtacaagaacaagaaatatctgccgctggatcttcgcccaaagaagacccgtgccattcgcaagcgcctcactagccaccaagcatcattgaagacagaaagggagaaaaagagggacatgtacttcccattgagaaagtatgccattaaggcgtagggtttaatgcactctagcctaattctatattgcgtactttttttttgaggatccgaaggttttcgtcttttttgtttacttatttctcttgtttatgctatatcacaagttcgaatttaaacatgaaattttgctgtgttgcattctcacag

SEQ ID NO: 6710 - DNA, 646 bp, Amsonia hubrichtii
tacagctagggtttcacttaaactatcccctcccccattccccatacgcacaccgcaaaggagaagacgccatggcaaggatcaaggtgcacgagctgaggcagaagacaaagcaggatcttttggctcagcttaaagatctcaaagctgagcttgctcttctccgcgttgctaaagtcactggtggtgctcccaacaagctctccaagataaaagtggtgaggttgtcaattgcgcaggtgctgacagtgatttctcagaagcagaaggcagcgttgagagaggcttacaaaaataagaagtatttgccactcgacctccgccctaagaagaccagagccatccgcaggcgcctcacaaaacaccaggcatctctgaagacagaaaaacagaagaagaaagaaatgtacttcccaatgaggaagtatgcaattaaggtttaagttgatcaagtattcaaaatggtattctacctcttgtctaaacatcaagcagaattattgcttgaattattttgttctatcaagatgttagactcttctaccagggcaaaaggatttccgaatgatgagatagttctgagaattttgttagtcccatgttgttagtatgatgagatagtttgttgattacatacaaggttctc

SEQ ID NO: 6711 - DNA, 665 bp, Amsonia hubrichtii
ttctactatttggtgatgccgcataggtgaccagcttctgttgcagctctcagtcgaagcgaagcgatggcaagaatcaaggttcatgaattgaggaacaagaataagcaagagttgcttgctcagctgaaggatctgaaggcggagcttgctcttctccgtgtcgccaaagttactggtggtgctcctaacaagctttccaagatcaaagtggtgagattgtccattgcccaggtgttgacagttatttcacaaaaacagaaggctgctctgagagaagcctacaagaacaagaagtacttgcccctggacctgcgccccaagaaaaccagagctattcgtagacgtctgaccaagcaccaggcctctttgaagactgagcgacagaagaagaaggagatgtactttcccatgaggaagtatgccattaaagtttagagcaggacccttttgttaaagttttggtgtttactttagaaaatatcgcatttgagttaaatataattttgttattggatatgatttgatattattgacttgtgatgaattttggattttcagttttcatgtttctggtttctagtgtgtatcaactttagaaaagagacattgtttgattcaggtttaggtactgcagtgcaactacttttacgattctctggtag

SEQ ID NO: 6712 - DNA, 652 bp, Antirrhinum majus
ctaattccttcctcacccgcaacttgaatcacagaaggaagaacaaccccaaaatggctcgcattaaggtgcacgagttgaggcagaagaacaagcccgatctcttggcccagctcaaggatctcaaggccgagctcgctctgctcagggttgctaaagtcacaggcggtgcacctaacaagctgtccaaaattaaggttgttaggctgtcaattgcgcaggttttgaccgttatttcacagaagcagaaattggcgttgagggaagtttacaagaacaagaaatatttgccgcttgatctacgtcccaagaagacacgtgccattcgtcgtcgcctcacaaaacaccaggcatctttgaagactgagaagcagaagaagaaagagatgtacttccctctgagaaagtatgctattaaggtttaagtggaaaaatgtgctagagacaaacttttttgtgtttttgctctcttcattctgaattgctattgagattttgtgctgctcaaatgttatatttgcatttcgttaaaagaagctatgttttgagacctccaagtccggatctttgttccttgccgtaatgtttgtttcgtttggatcgtcgctatattcgcttctgtcgtattgagaaggatctgcactgcatgatg

SEQ ID NO: 6713 - DNA, 605 bp, Theobroma cacao
gccgttgcagtcccagcagaagaacagcgaaaggagcaatggcgagaatcaaggtccatgagttgagacagaaatcaaaaactgagcttttggctcagttgaaagatctcaaggctgaacttgctcttcttcgcgttgctaaagttaccggtggcgcacctaacaagctttccaagataaaggtggtgaggctgtcaattgctcaggtgttgacagtaatctcacagaagcagaaggccgcactgagggaggcatataagaataagaagttcttgccccttgatctgcgtcctaagaagaccagagccattaggagaaggcttaccaagcaccaggcatcattgaagactgaacgggagaagaagagggagatgtacttcccaatgaggaagtatgccattaaggtgtaggctaggatctttcagataggattctatttacaaatccatttaccgttctactttctagtgtcatatttgtgaaacctgagttttgattttgttcaatttcttgtttatcaacttttccttttgtgcaaaaccaagatgcctatcttttagatgggagtagtaattaaatgagggatttttggttttgttgatggg

SEQ ID NO: 6714 - DNA, 1415 bp, Cicer arietinum
tactccaataatttgcggtaagaaattgtgttctatttttggttaacactcaacatcactagactagagttggtcttgattgggccggttatcgataagtgaggcccaaaagagaaaatagtgtcttgagcccattaacccaataggatggttaattctggcccaacccgattaacgtatataacaccgtcgttgaaacggtgctggcgattttgattttagggtttctgcaggagttgttaattatcacttcctaacagcgcgtggatcaacgaaatggcgaggattaaggtgtatgagctgaggaacaaaaccaaggcggatttgttgaaccagttgaaagatctgaaggcggaactcgctttgctacgagtggcgaaagtcaccggcggtgcgcctaacaagctctccaaaataaaagttgtgaggctttcaatagcacaagtgttgacagtgatttcacagaagcagaaagctgcactcagagaggtttataagaataagaagtatttgccacttgacctacgtcctaagaagacccgtgccattcgaagacgccttaccaaacaccaggcatcattgaagacagaacgagagaagaagaaggagatatactttccattaagaaagtatgcaatcaaagcttaggctaggattgctttctagcttccggttgtagaccagttatttgaattattgaaacttaaatgttgcttaatttgtttgtctctatatctgcatgccaatttttgtactagcaacttttcttgtttttattatagtttctgtatacacctaatctatcttaagagcttccaaggtttatgacaaaatttgattttggagaatttctagttgataatgagttatcaatgatgtcatccttttatcactacctaaagaagctgccacaatttagtttaggatgatggctgctgtatctctgcaatcttatttacactcgtgctagcagttaatcacatacttcaatagctcttgtcactaccatttatactcgtgatggcatgtttttttcactgtttcctcgatagtgtttttgttaaacattggttcatgtagctaactttctgaatattttgctgcaaaattattatttctatatgttcatgttagtcccttattttattgtttataataaagtggaacgttatgcattaattttttgtaaatctcaattaaggttgttgcttctctgactttgtttttggtctcctaatctaattttttatttatcgaaaactgaagttgtacatcacttttatttagtttttttatgatacgatggagattttctgtattctttaggattttttggcttcttgtattttctaaccaaaaattaaaaataaataagtattaacttgtacacatttaatgatggcgatacaactccc

SEQ ID NO: 6715 - DNA, 845 bp, Cicer arietinum
gtaatgcggcccagatccatctaaacgttcgttgatctgtcttttctctcaggttagggttttacgaagaaaacatatcaaagcaaccagagttagacactctgtcgagtattttcgcggcgattcaagagcttcgcaatggctagaatcaaggtttacgagctcaggcaaaaaacaaaagcagaccttctgaatcaattgaaggatctgaaagcagaactttcgctccttcgcgtcgccaaggtcactggtggtgccccaaataagctctccaagataaaagttgttaggctttcgatagcgcaggttttgactgtgatttcacagaagcaaaagtcagcattgagggaagcttataagaataagaaatatctgcctttggatctccgccctaagaagacaagagctattagaagacgcctcactaagcaccagcaatctttgaagacagagcgtgagaagaagaaggaaatctacttcccaatgagaaaatatgcaattaaggtgtaatgttgggcccttattgcatgacttctgatttgttatttgacataattattaaaaatatttgatcttgggttctatttttgtctccttttgagttgaactaatcactgaaatggaattttaagtaaaattgttatctctgttttttactcgttccagtttcagattccttaccaaacattacccatctgtttgatttataaaatgagtttggaatctgttaaattcattacgaacatgtttaccgatgcataataacatccccaattaggacccttgtagacctgtactataaattattaacaagttatgattcatcatggatacttggctttttc

SEQ ID NO: 6716 - DNA, 684 bp, Citrus clementina
acttaaaaaccgcacacaactgggctagggtttcgatgacataagtcttcttcttcttcacacactgacagaaagagtcgaataaccagcagccatggcaagagtcaaggttcatgaactgcggaccaaatccaagacggatttattgagccagttaaaagatctgaaggcggagctcgctcttctgcgggtcgccaaagtcaccggtggcgcgccaaataagctttccaaaattaaagtggtgaggctatcgattgcccaagtgttgactgtgatatcgcagaagcagaaggcggctttgagagaagcatacaagaacaagaagtttttgccacttgatcttcgtcccaagaagaccagagctatccgaaggcgcctcaccaagcatcaggcatctttgaagactgaacgtgagaagaagagggaaatgtactttccaatgaggaaatacgccattaaggtgtgagatcaaattgaattgggaaggagacaatgattttaaacttgtcaaatgctatcaaagatttttttgttctgttgaattttaagtttagtttttcttatcttccatttgtgttactagtatggattttggacttcgatgagagtattcaggttttaattctatatacttgaaggtttggtctcatttcatcaaagcatggttcaagcggttttctgttc

SEQ ID NO: 6717 - DNA, 1023 bp, Gossypium hirsutum
agaaagaggccgccgttgtcgtccctgcagcagaacagcaaaagaagcaaagcaatggcaaggatcaaggttcatgagttgcgacagaaatcaaaaaccgatcttttggctcagttgaaagatctcaaagctgaacttgctcttcttcgcgttgctaaagttaccggtggtgcacctaacaagctttctaagataaaggtggtgaggctgtccattgctcaagttctgactgtaatctcacagaagcagaagtctgcattgagggaggcatacaagaagaagaaattcttgcctctcgatctccgtcccaagaagacccgagctatccgcagaaggcttaccaagcaccaggcatctttgaagaccgaaagggagaagaagaaggaaatgtacttcccaatgaggaagtatgccattaaggtgtagggtaggatctctcacattctatttacatatcgattcgctctttactttctagcatcgtcttccgtaaaacccgagttgtgattttgtttcaatcttcatgtttggaaactcttttttgtccccttgttaaaaaccaagattctggtctttttgattgaatggtaatttatggattttttgcatttcttgatgagtgaaattaaaatccaattagtttgagaagttttaattcgatattattgaaacctcgtttgcttcccatttgataaaaaatatttgctcatcttgtataaagaatggaatatttggttggtattaaaatggtttcaaaaagtatactttcttgatgataacatattttgaagattaaattgagtaatttggtttttgttagcatgatatatacgcggtattttatgtatcactatctggttatatcattaatcacgttaatttttaacagtacaaatgcataaacttttatcagaaaaagatcaatatgctttttgaatggagagcaaaaatataatttattttctaatacaggatttccatagccttttaccctcgttagctatttaaaacacataaattaga

SEQ ID NO: 6718 - DNA, 666 bp, Gossypium hirsutum
tttatccctgaaaacagagagaggccgccgttgtcgttcagcagcagaacagcaaaagaagcaaagcaatggcaaggatcaaggttcatgagttgcgacagaaatcaaaaaccgagcttttagctcagttgaaagatctcaaagctgaacttgctcttcttcgcgttgctaaagttaccggtggtgcacctaacaagctttctaagataaaggtggtgaggctgtccattgctcaagttctgactgtaatctcacagaagcagaagtctgcattgagggaggcatacaagaataagaaattcttgcctcttgatctccgtcccaagaagacccgagccatccgcagaaggcttaccaagcaccaggcatctttgaagaccgaaagggagaagaagaaggaaatgtacttcccaatgaggaagtatgccattaaggtgtagggcaggatctcacattctatttaaaccgagttgtgattttgtttcgattttcatgtttggaaactcttttttgccccctgttaaaaaccaagattctggtctttttgattgaatggtaatttatggatattttgcatttcttgatgaggagtgattgaaattcaattagtttgagaagttttaattcgatattattgaaacctcgtttgcttcctatttgataaaa

SEQ ID NO: 6719 - DNA, 645 bp, Gossypium hirsutum
tactttgagaaagacggagcgaagccggattgcacccacttctgaagagcagcggaagaagcaatggcgagaatcaaggtccatgagttgagacagaaatcaaaaactgagcttttggctcagttgaaagatctcaaagctgagctcgctcttcttcgtgttgccaaagttaccggtggtgcacctaacaagctttccaagataaaggtggtgaggttgtcaattgctcaggtgttgacagtgatctcacagaagcagaaggctgcactgagggaggcatataagaagaagaagttcttgccccttgatctccgtccaaagaagaccagagccatcaggagaaggcttaccaagcatcaggcatcgctgaagacagaacgtgaaaagaagaaggaaatgtacttccccatgaggaagtatgccattaaggtgtaggataagatatttgagattctattttgaaatccgtttgtgtttacttatttgtgaaaacccgagctgtgattttgtttggtttttatgtttttgaacattttcccatatgtcaaatctagattttaatctttttgatggaagtggtaattaaatgagggacattctgcttaagaatgaaatttagatggaggttagaaatgaaatccattt

SEQ ID NO: 6720 - DNA, 1169 bp, Gossypium hirsutum
accctagtctccttttaatattagggtttcgtcatactttaagaaagacagagcgaagccggcattgcactcacttctgaagagcagcggaagaagcaatggcgagaatcaaggtccatgagttgagacagaaatcaaaaactgagcttttggctcagttgaaagatctcaaagctgagctcgctcttcttcgtgttgccaaagttaccggtggtgcacctaacaagctttcgaagataaaggtggtgaggttatcaattgctcaggtgttgacggtgatctcacagaagcagaaggctgcactgagggaggcatataagaagaagaagttcttgccccttgatctccgtccaaagaagaccagagccatccggagaaggcttaccaagcatcaggcatcgctgaagacagaacgtgaaaagaagaaggaaatgtacttcccaatgaggaagtatgccattaaggtgtaggataagatatttgagattctattttcaaatccgtttgtgtttacttatttgtgaaaacccgaactgtgattttgtttggtttttatgtttttgaacattttcccatatgtcaaatctagattttaatctttttgatggaagtggtaaattaaatgagggactttctgcttaagaatgaaatttagatggaggttagaaatgaaatccatttatctttgttttgaaacatctcactagtgtcatgctgggatctttggtggtcaatgccatatgtgggaacttctcctcggcattccctgaggtggcttcagtcatgattttatacccctcctaattgatgtcaacgctgaagatggcaatgtcaattcttattaaggcgaatcttgagtgagaatttaaatggcgatgagaatactttgtttatgtttcgagatggtattagatttgattggtagtggcgtttttggggtggaaaaagaagatgatatatatcgtggattgatgttgtttttgtctttttattcttttctcgccgtgatttaacagtcacgaatctcttgctatttgcctaggaaaaaaagtaaggttttggcgattagatttagtgtctgatttcacggctttctagctgagaccccctttcttaccgggtccggccataccctcggccgactgggtttcaccttctatgtatgattc

SEQ ID NO: 6721 - DNA, 563 bp, Solanum melongena
gagagagagagagagagagagagagagagagagagagagagagagagagaaagagaagcaatggcaagaatcaaagttcatgagctgagacagaaatccaagactgagcttttagctcaattgaaggatcttaaagcagaacttgctctcctccgcgtcgccaaagtcactggcggtgcccctaacaagctctccaagattaaggtggtgaggctatcaatagcacaagtgttgactgtgatatcacagaagcagaagtcagcactgagagaagtgtataagaataagaagtatttgccccttgacctccgtcccaagaagactagagccattcgtaaacgtctcacgaagcaccaggcatctttgaagacagaaagggagaagaagaaagagatgtactttcctattagaaagtatgccattaaagtttaaattgatccaagttagataatttgtgatgttatgacttgcagaccatgttttactgttttgcgtttttatattttgtatccctactacgtgttatgaagttggaactttgttcgtcttcttttttacactaa

SEQ ID NO: 6722 - DNA, 861 bp, Solanum melongena
aaattataattaccaagaaagaaaaaacctaaacttctcttccacttgtttggtaattttaaaaaaccctaatctccttcggcgtctgaagcagtaaagcgtaaggagcagccatggctagaataaaggttcatgagctgaggaacaagtcgaagacagagcttttggctcagttgaaggatctgaaggcggagcttgctcttctccgtgttgcaaaggtcaccggtggtgctcctaacaagctatccaaaattaaagtggtaaggttgtcgattgcacaggttttgactgtcatctcacagaagcaaaaggcagctcttcgggaagtttacaagaacaagaaatacttgcctcttgaccttcgtcccaagaaaaccagggcaatccgcaaacgtttgactaagcatcaggcatccttgaagacagagagagagaagaagaaggagatgtacttcccaccaaggaaatatgccatcaaagtgtagaataggatctactttagctgggagtttttttttctggatcaaaattatttctttaacttatcaccaatataaattttgttggtgcttgtgacattttgatacatgatcaatgtgttgggattatgtctttaatgttgaatgcctgttcgatgttaaaaaaaaaaaacaacttgtttggtaattttcccctcctgcaccatcaatttcctgctcctgctcttcttcttcttcatcaaattccatattaatttcacttcccaactaccctccacccacctaacacactttttctttttctattatatatattatgattttttttttgaaatttgactattcaaaaaatagaaaataaaaatccacatcatctcaaccg

SEQ ID NO: 6723 - DNA, 655 bp, Solanum melongena
aaaaaccctaatctccttcggcgtctgaagcagtaaaacgtaaggagcagccatggctagaataaaggttcatgagctgaggaacaagtcgaagacagagcttttggctcagttgaaggatctgaaggcggagcttgctcttctccgtgttgcaaaggtcaccggtggtgctcctaacaagctatccaaaattaaggtggtaaggttgtcgattgcacaggttttgactgtcatctcacagaagcaaaaggcagctcttcgggaagtttacaagaacaagaaatacttgcctcttgaccttcgccccaagaaaaccagggcaatccgcaaacgtttgactaagcaccaggcatccttaaagaccgagagagagaagaagaaggagatgtactttcccctaaggaaatatgctatcaaagtgtagaatggaatctactttagctgagagttttattttctggatcacaattatttcttgaactcatcaccaatataaattttgttttgcgttgtttcgtctggtgcttgtgacatttgatacatgatcagtgttgggattatgtcttttatgttgaatgtttgttcgatgttagtggtttccatgccatgtacaaatgtacgtcgaaaatggcgtttgaatatcattcaattttgg

SEQ ID NO: 6724 - DNA, 737 bp, Linum usitatissimum
gggagggtttagtcatctgcacagagacagatagcagctgccgccatcgccagagtgaaacgaagcaatggccagaatcaaggtccacgagctgaggcagaagaacaagttggatcttttgaatcagctcaaggatctcaaggctgagttttctcttctccgcgttgccaaggtcaccggcggcgctcctaacaagctctccaagatcaaggtggtgcggctgtctattgcccaagtgcagactgtgatctcacagaagcagaaagctgcacttcgtgaagtgtacaagaacaagaagctgttgcctcttgacctccgtcccaagaagaccagagccatcagaaggaggcttaccaagcaccagcaatctcttaagacggagagggagaagaagagggaaatgtacttccccatgaggaagtatgcaatcaaggtgtaggaaaagctagcaacttttctgtcttcaagggttattaagatttaaggaggtgcgttttattattaggagcaattttgagtctttttgtaattattcgaagatagacatgtgaactcgagcatcaacttttgaacaagttttggaatgatatgtatcgacttttctcacacccttgttgaatcagagttcatgttttatggaagtgtctgaaaatctgaattcatttctgcatgtttctacaagtagattcatggcaccagtatttaaatacagttcttgtcatctgtcgttgattttc

SEQ ID NO: 6725 - DNA, 595 bp, Fraxinus spp
tcgtggagagaagtctttgaagggagaaggcaaaatggctcggatcaaggtgcatgagttgaggcagaagaacaaggcggagcttttggcgcagctgaaagatctgaaggcagagctggcgttgcttagggtcgccaaggcgactgctggggcagccaacaagctgtcaaagatcaaggtggttaggctttccatagcccaggtgctgactgtaatttcccagaaacagaaggccgctctcagggaagtatacaagaacaagaagtatttgcctcttgatctccgtcccaagaagactcgtgccattcgcaggcgcctgaccaagcaccaggcatctttgaagacagaaagggagaagaagaaagagatgtacttcccaatgaggaagtatgcaatcaaagtttaagtagatctacggtggaagttatttcagtactgtccctgcttaatctccgaggataattatatatcttttggtaagttgttagctgaaaattgttatgattttgagaacttgagtttttgagtgtcattatttgttattatctaatgactagagacgaaagattttgattcaagttatgcattttatttc

SEQ ID NO: 6726 - DNA, 665 bp, Gossypium raimondii
atttatccctgaaaacagaaagaggccgccgttgtcgtcccagcagcagaacagcaaaagaagaaaagcaatggcaaggatcaaggttcatgagttgcgacagaaatcaaaaaccgatcttttggctcagttgaaagatctcaaagctgaacttgctcttcttcgcgttgctaaagttaccggtggtgcacctaacaagctttctaagataaaggtggtgaggctgtccattgctcaagttctgactgtaatctcacagaagcagaagtctgcattgagggaggcatacaagaagaagaaattcttgcctctcgatctccgtcccaagaagacccgagctatccgcagaaggcttaccaagcaccaggcatctttgaagaccgaaagggagaagaagaaggaaatgtacttcccaatgaggaagtatgccattaaggtgtagggtaggatctctcacattctatttacatatcgattcgctctttactttctagcatcgtcttccgtaaaacccgagttgtgattttgtttcgatcttcatgtttggaaactcttttttgcccccttgttaaaaaccaagattctggtctttttgattgaatggtaatttatggattttttgcatttcttgatgaggagtgaaattaaaatccaattagtttgag

SEQ ID NO: 6727 - DNA, 627 bp, Gossypium raimondii
cgatattaaagccttcatcgctgcacttttcacaccttcttcacttcacagagaaaacagaggcaggcagccatggcaaggatcaaggtgcacgagttaaggaacaaatcaaagacagagctgttgactcagctcaaggatttaaaagccgaactttctctccttcgtgttgccaaggtcactggtggtgcccccaataagctctccaagattaaggtggtgaggctatccattgctcaagtattgacggtgatatcccaaaaacagaaggctgctttgagggaagcttataagaacaagaagtttttgcctcttgatctccgtcccaagaagaccagagctattcgccgccgccttaccaagcaccagcaatctttgaaaaccgagcgggagaaaaagaaggagatgtactttccgatgaggaagtatgccattaaggtataagcttgaaatttgacttaggatggatacctttatgttagtttcaaagtgactactcgaggttattgttgaagttttgtgttgttgaattttcgttttcttcataacattccctattatgtttaagtttcttacaattctgaattatggagtataaagagtgttggttaggcctttcttttataa

SEQ ID NO: 6728 - DNA, 771 bp, Gossypium raimondii
gtttcgtcatactttgagaaagacggagcgaagccggattgcacccacttctgaagagcagcggaagaagcaatggcgagaatcaaggtccatgagttgagacagaaatcaaaaactgagcttttggctcagttgaaagatctcaaagctgagctcgctcttcttcgtgttgccaaagttaccggtggtgcacctaacaagctttccaagataaaggtggtgaggttatcaattgctcaggtgttgacagtgatctcacagaagcagaaggctgcactgagggaggcatataagaagaagaagttcttgccccttgatctccgtccgaagaagaccagagccatcaggagaaggcttaccaagcatcaggcatcgctgaagacagaacgtgaaaagaagaaggaaatgtacttcccaatgaggaagtatgccattaaggtgtaggataagatatttgagattctattttcaaatccgtttgtgtttacttatttgtgaaaacccgagctgtgattttgtttggtttttatgtttttgaacattttcccatatgtcaaatctagattttaatctttttgatggaagtggtaaattaaatgagggacattctgcttaagaatgaaatttagatggaggttagaaatgaaatccatttatctttgttttgaaacatctcactagtgtcatgctgggatctttggtggtcaatgccatatgtgggaacttctcctcggcattccctgaggtggcttcagtcatgattttataccc

SEQ ID NO: 6729 - DNA, 1006 bp, Humulus lupulus
cccctctcatcgctagggtttcatttcctgtgagagagtcagagaggcgccgtttggaagctcggaaaacacagcaatggcgagaatcaaggttcacgagttgaggcagaagaacaaggcagaccttttgacacagcttaaggatctcaaggccgagctcgctctccttcgagtggccaaggtcaccggcggtgcacccaacaagctctccaagattaaggtggtgaggctatcgatcgctcaggtattgacggtcatatcccagaagcagaaggctgctctaagagaagtttacaagaacaagaagttcttgccactcgatctccgtaccaagaagaccagggctattcgcagaaggcttacaaagcatcagttgtctttgaagactgaaagggaaaagaagagggaagtctacttccccatgaggaagtacgccatcaaggtgtagggttggttttattactatttaggtcatggtatcttttgtttacagaccttatttggttgacaagttttgtcttttcttcactcttcgatagttttgttactagacctgaatttgcgttaaattttattctgtaacttggggaggacttgtctcaagctaaactgagttatatatttttttttaaattggtagttaatatttgtttttccttaatgtttgatgaatgcgtaagttgcttctatgatgtgatatggtatgtcagaatcgtttatgatatacctgtttagccttccggccgaaatttggaagcctaattatgtgctgatattggtttgaatgcactccctctctggctatttccacccaccagtttaaagtcctgcacccgtgcaccgtttaaaatgtgatgcttcccagcgaagttgtctttaaatggtctgtttgtccagtgtgtattgtagataaagaacttttagttgtcatactttaacacaccacagtatcaaatgtagaataattgaccttcgattttattgaattcattgctttgttcgaccg

SEQ ID NO: 6730 - DNA, 622 bp, Actinidia deliciosa
gttcgttgagaggagagagagattttgtcagtcattgccatggctagggttaaggttcacgagttgaggcagaagacgaaggtggagttgctgagccagttgaaggatctcaaggctgagctcgccctcctccgtgtcgccaaggtcaccggcggcgcccccaacaagctctccaagataaaagtggtgaggttgtccattgcccaggtgctgacagtgatttcacagaagcagaaggctgctctgagggaagcctacaagaacaagaagtacttgccacttgatctgcgtcccaagaaaaccagagctatccgtaggcgtctcaccaaacaccaggcatcactgaagaccgaaagggagaagaagagggagatgtacttccccatgaggaagtatgccattaaggtgtagggtagagtatccattaaagagtagattttggttcacagccataaatctccattccggtcctgaagttttgaattttgtttacatttttattcatatttggaggacttgaacaaagtttaattttgtgccgagtaatctagaggtcgtatccctcctgatgaaacaactctagttttcttttctttttttcgagcttaatacatttataatt

SEQ ID NO: 6731 - DNA, 933 bp, Actinidia deliciosa
cttcttacatccatggcgaggatcaaggttcatgagctgagacagaagtcgaaggcggatttgttgagccagctcaaggatctgaaagctgagctcgctcttctccgagtcgccaaggtgaccggcggtgcccccaacaagctctccaagataaaagtggtgaggctgtcaattgcccaggttttgaccgtgatttcgcagaaacagaaggctgttctgagagaagcctacaagaacaagaagtacttgccgcttgacctgcgtcccaagaaaaccagggccatccgtaggcgtctcaccaagcatcaggcgtccttgaagacagaaagggaaaaaaagaaggagatgtactttcccatgaggaagtacgctattaaggtgtagggataggatttattatggccttcggtatccatatatcttgttccaactatggattttggagatttattacatttttatccaaatttcagtgaactggagagtttgagtttttgtttgtttaattttgagaagtaaacttcagacacttggcttgtcttctgatgctgcaatggtgcaatgctagggtttcctttgttggtgccaatagttacaaggttgttgatcttctcctctcgatgccgtgtttatcttctcttctaattatttttatacggtagtcaaccgacaagggtggaagggaccgatcatgcacagttcctttacgttttgatatgctgcaaaggagcagccgaactaggggatttacttgcatttgcatctaattaaaatcacattactcatttgttgcatgctttagaagttcattgctgagtatccagattcccagaatcaccattgtagcaatttcccacagtttgatcaatcctgctaatatttgttaagcatttggcaaaggaagtttgattgaagattcagtttgatgctcat

SEQ ID NO: 6732 - DNA, 880 bp, Mimulus guttatus
agggttttcactgacgagcagcggcatttctcccaccgtcagcgagcttgaaatcctgcctcccaccgcccaaaacagggaaggaagcagcacaaggaattcgaaatggcgaggattaaggtgcacgagctgaggcagaagaacaaggtggatctgcaggcgcagcttaatgatttgaaggcggagcttgcgttgctgcgcgtggccaaagtgaccggcggcgctccgaacaagctgtcgaaaatcaaggttgtcaggctctccattgcccaggtgctgaccgtgatttctcagaagcaaaaagctgccctgagggaagtgtacaagaacaagaagtacttgccacttgatctccgccctaaaaagacacgcgccatccgtcgccgcctcaccaagcaccagtcatctttgaagacactaaaagagaagaagaaagatatgtatttccccatgaggaagtatgccattaaggtgtaagtgagcttgtgcttcggcttggaggtattatttttgtactcagttttctgatctcgaacagatttttcgatgctttgtcccgatcaaattttaaacttgcagttaatttagtttctgttgtcttagacatgaaattgagtttcgttttcccttttttacttactgatttgcatttcttagtattatatatgctgtttttggtctggttaatgtttttagagctttacaataagttctttatttgcctccagaactgtctgaggatatcaatatcttatgataatgacttcaaattcaaattcttttgacaaaatttgccaaaacgagtaaagccgataatgtggttggcagttgtgaacttcataaattatcgatttcattaataataaattacttttcaatt

SEQ ID NO: 6733 - DNA, 788 bp, Nicotiana benthamiana
acaggcctataatcctctatcaacgagtggtttccggtaacatcttgggttttcagaattctcttcagtggtgagagagagtgagactgtgagagaaacgccatggcaaggatcaaagtgcacgaactgaggcagaaatcaaagactgagcttttggctcagttgaaggatttaaaagcagaactcgctctccttcgtgtcgctaaagtcaccggtggtgctcctaacaagctctctaaaataaaggtggtgaggctgtcgatagcacaggttttgactgtgatatcacagaagcaaaaaacggcactaagggaagcatacaagaacaagaagtacttgccgctggaccttcgtcccaagaagaccagagccatccgtagacgtcttacaaagcaccaggcatctttgaagacagaaagggagaagaagaaagagatgtactttccattgagaaagtatgccattaaggtttaagtatccaaatccaacttagatagtcattgtgatgttagaactggcagcgcaaagccgtgtaacattgttccgcactaggtggttatattttttgtgattgctgttattgcattatgaagtgaaatttttggtttgtttcgtttttttctaatgtttttggtcagagaaggttcaatatttagtagtaagttcaagccaagttatctgtcttcatgcatgtgatatgttttacaagatttaattcgccactttgccgagcttttgttcagcatcaaggtgttgaggcgtgcatctcatcaccagtgagctctgtg

SEQ ID NO: 6734 - DNA, 686 bp, Citrus sinensis
gacattaaaaaccgcacacaactgggctagggtttcaatgacataagtcttcttcttcttcacacactgacagaaagagtcgaataaccagcagccatggcaagagtcaaggttcatgaactgcggaccaaatccaagacggatttattgaaccagttgaaagatctgaaagcggagctcgctcttctgcgggtcgccaaagtcaccggtggcgcgcccaataagctttccaaaattaaagtggtgaggctgtcgattgcccaagtgttgactgtgatatcgcagaagcagaaggcggctttgagagaagcatataagaacaagaagtttttgccacttgatcttcgtcccaagaagaccagagctatccgaaggcgcctcaccaagcatcaggcatctttgaagactgaacgtgagaagaagagggaaatgtactttccaatgaggaaatacgccattaaggtgtaagatcaaattgaattgggaaggagacaatgatgttaaacttgtcaaatgctatcaaagatttttttgttctgttgaattttaagtttagtttttcttatcttccatttgtgttactagtatggattttggatttcgatgagagtattcaggttttaattctatatacttgaaggtttggtctcatttcatcaaagcatgggtcaagcggttttctgttc

SEQ ID NO: 6735 - DNA, 713 bp, Orobanche aegyptiaca
gtaacccatacatgaagagacaagggttttctcgtttcaactgaggcatttttcctactcgctcatacgcccatcaaaccctacctccccccccagacaaaacacagaagatattttgaaatggctaggattaaggtgcacgagctgaggcagaagacgaagacggagctgctagcacagctgaaagacctgaagggggagctgtctttgctacgcgtggcgaaagtgactggcggtgcgccgaacaagctgtcgaagattaaggtggtgaggctctcaatcgcccaggtgctgacagtgatatctcagaagcaaaaggccgctctcagggaagcttacaagaacaagaagtacttgccgcttgatctccgccccaagaagactcgtgctatccgccgtcgtctcaccaagcaccaggcatctttgaagacagaaaagcagaagaaaaaagagatgtattttcccatgaggaagtatgccattaaggtttaagttagagcttgtgctgaaagcaattctgggacactccttttttcaattttggaccattattaatattgagttcttgaatttttttttttaaatttactttcagttatttggtgctgtctccacagcattcaagtacttgatgacctgcatttgcatttatataagctacggtatatgcattagcgtttaatgccagtttccactgctgcattgttttaccc

SEQ ID NO: 6736 - DNA, 665 bp, Carica papaya
accgcagctacatatataaataaagttacggtaaacggaaccctaagtctttcctcattttttagggttttgcgaaacagagacaggaaccggccgacgacaatggcgaggatcaaggttcacgagcttaggcagaagtcgaaggctgatctgttgaaccagctgaaggatctgaaggccgagctcgcactcctgcgcgtcgctaaagtcacaggcggtgctcctaataagctatccaagatcaaggtggtgaggttgtcgattgcccaggtgttgactgttatttctcaaaagcagaaggctgcactgagggaggcatacaagaagaagaagtacttgccacttgatctgcgccccaagaagacaagagccatcaggagaaggctaaccaagcaccaggcatcgctgaagacggaacgtgagaagaagaaggaaatgtattttcccatgaggaagtatgccattaaggtttagggtagataggtcagatatgatattttagaatctcgcaaatttttttatgtttgtcttcctgaatgtggagtttgacttagtgttaaattgttttctcatattaaatgaaagcgtctacctttttgatgtgtgtggtagttaagaggagaatttctattccattataatgaattcctttctggcttttattg

SEQ ID NO: 6737 - DNA, 709 bp, Arachis hypogaea
aacagtggtatcaacgcagagtacgggggagcctttgtccctcccatttgaaactagggtttgtaaaggaagaggcgcagcagccacatcaggtgaagagagaagctcgagaattcagaaatggcgaggatcaaggtttacgagctgaggcagaagaacaagactgagttgttgaaccagctcaaggatctgaaagccgagcttgctttgctccgtgtcgccaaggtcactggtggtgcccccaacaagctctccaagatcaaggttgtgaggttgtccattgcacaagtcttgactgtgatttctcagaagcagaaggctattttgagggaagtttataagaagaagaagtacacacctcttgatctccgtcctaagaagaccagagccattcgcagaaggctcaccaagcaccaggcatctttgaagaccgagagggagaagaagaaggaaacatatttcccaatgaggaaatatgccatcaaggtgtaggagtctatgcatatttaattttatattgcgcatttaccagttatagttggcaaattttgaggtagtttcatgttggagttatttgttgtcttcaaattttacctatttggaccttttgtttctctttgaaatggatttatgatcaaaattgaggattacattgagttttgtcaaaaaaaaagaaaaaaaaacaaaagtactctgcgttgataccact

SEQ ID NO: 6738 - DNA, 685 bp, Arachis hypogaea
tcaacgcagagtacggggggccttgtccctcccatttgaaactagggtttgtaaaggaagaggcgcagcagccacatcaggagaagaaagaagctcgagaattcagaaatggcgaggatcaaggtttacgagctgaggcagaagaacaagactgagttgttgaaccagctcaaggatctgaaagccgagcttgctttgctccgtgtcgccaaggtcactggtggtgcccccaacaagctctccaagatcaaggttgtgaggttgtccattgcacaagtcttgactgtgatttctcagaagcagaaggctattttgagggaagtttataagaagaagaagtacacacctcttgatctccgtcctaagaagaccagagccattcgcagaaggctcaccaagcaccaggcatctttgaagaccgagagggagaagaagaaggaaacatatttcccaatgaggaaatatgccatcaaggtgtaggagtctattgcatatttaattttatattgcgcatttaccagttatagttggcaaattttgaggtagtttcatgttggagttatttgttgtcttcaaattttacctatttggaccttttgtttctctttgaaatggatttatgatcaaaattgaggattaaaaaaaaagaaaaaaaacaaaagtactctgcgttgataccactgct

SEQ ID NO: 6739 - DNA, 579 bp, Petunia hybrida
tacgcggggaagttagggtttcagaatcaaggagcagcctctcagcactcacttccactagcagcaatggcaaggattaaggttcatgagctgaggaacaagtccaagactgagctattggctcagttgaaggatttgaaggctgaactttcccttcttcgtgtcgctaaggtcaccggtggcgctcctaacaagctctccaaaattaaggtggtaaggctgtcaattgcacaggttctgactgtaatttcacagaagcaaaagacagctcttcgggaagtttacaagaacaagaaatacctgcctcttgacctgcgccccaagaaaactagggccattcgcaaacgtttgaccaaacaccaggcgtccttgaagaccgagagggagaagaagaaggagatgtacttccccatccgaaagtatgccatcaaagtgtaggatagtatttactttgcaagagattttgatgtttttgaatcagaatatattggttgaaactattgagcatgcaaattttggttagttttgttttttggcacttgtgacattagatacttgaccaatatggtgcttcatttt

SEQ ID NO: 6740 - DNA, 683 bp, Plantago ovata
cggccgggggtagaagccatttcaaccctacgccggccagaggaagaaaaaacccaaagaggaagaggaagaagaaatggctcggatcaaggtgcacgagctccgacagaagaacaagactgacctattggctcagctgaaggatctgaaagctgagcttgctctgctccgcgtggccaaggtcaccggtggtgctccgaacaagctgtccaaaatcaaggtcgtgaggctctccattgctcaggttctgaccgtcatctcccagaagcagaaggctgcccttagggaagtgtacaagaacaagaagtacttgcccctcgatctccgccctaagaagacccgtgctattcgccgccgtctcaccaagcatcaggcctctttgaagacagagaaacaaaagaagaaggatatgtacttccctttgaggaagtatgctatcgcggtttaagttcattgatagggttttcgtgttttagtcgatgacattttgagggtactttaattttgtcaaaattggagttgtgcttcagattttgtattactcctatcatggatttatgagtattattgtctacatatttgtctagtagcatttgttcctgctgaatgatctcaagtttaatcagtttaacctctatgagcttaagttttacctctaccaaataaaaatgatatctttgtgt

SEQ ID NO: 6741 - DNA, 776 bp, Populus trichocarpa
taaaagactccaaaaccctgccacctatttagggtttgcacaacacaggagagccgcgcagccgttgcaagagagtgtgtgtgtgagagagagagagagacagaagcgaagcaatggcaagaatcaaggtccatgagttgagacagaaatcaaagacagatcttttggctcagttgaaggatctcaaagctgagcttgctctccttcgcgttgctaaggtcaccggtggtgctcctaacaagctctccaagatcaaggttgtgaggttgtcgattgcacaggtcttgactgtgatttcgcagaagcagaaggctgtattgagggaggcttacaagaacaagaagtttttgcctcttgatctgcgtcccaagaagaccagagctatccgccggaggcttaccaagcatcaacaatcactgaagactgagcgcgaaaagaagagagaaatatacttcccaatgagaaagtatgctattaaggtctagggtggcaccaatcacataggctattttgatatctttcctgaacctgttttgttgacaagttttgactttgatcgtctttgtgtcttgtttgtgaactattaatttatgtttaaaaactttgggaaagggtgtatctcactctaaccaagatgctagatttatattggaatagtagctgaagagtatttttgttttatattggaatagtagctgaagagtatttttgttcatgtgtcttttaatcgttgctgtttgtatttaggatgtggtctcgcacttttttctcctcta

SEQ ID NO: 6742 - DNA, 754 bp, Silene vulgaris
ctctcactgacggtaagtcccattcatttctagggtttccacttctctcacctccgccgcacgcagaaatggcaagaatcaaggtgcatgaactgagggaaaaatcaaagcctgatttattggcgcaactcaaggatcttaaggccgaattagctcttcttcgtgttgctaaggtcactggtggtgctcctaacaagctttccaagattaaggtggtaagattggggattgcacaagtcttgacagtgatatctcaaaagcagaaggcagcattgagggaggcttacaagaacaagaagtatttgccccttgacctccgtcccaagaaaacccgtgccattcgccgtcgtctcaccaagcaccaggcatcattgaagaccgagagggagaagaaaaaggagatgtactttcccatgaggaagtatgccatcaaggtgtagggtagattaagttcgaatgtgtagaatatttggtacatttcaagtttctacactgtttcgaactgttgtcagtagcaagtttagcagcagccttttttcgactgagtttttatcctatggtattcatcactttatcatcaaccaatgtgacatgtaaacttattttgttgaaacaagttttgtgttaaaatttgagacctaatcttcttgtcagtaattcaggcttggctaaattgtgttctttgttggctttgacgcatcggctgacctgttgaaacgatattttgtattttgttctctattgtcaaggtgtt

SEQ ID NO: 6743 - DNA, 671 bp, Solanum phureja
ttgaaaaaaccctaatctccatcgccgtctgagcagtaacctcaaaggagcagtagccatggcgagaataaaggttcatgagctgaggaacaagtcgaagacagagcttttggctcagttgaaggatctgaaggcggagcttgctcttctccgtgttgcaaaggtcaccggtggtgctcctaacaagctatccaaaattaaggtggtaaggttgtcgattgcacaagttttgactgtcatctcacagaagcaaaagtcagctcttagggaagtttacaagaacaagaagtacttgcctcttgatcttcgccccaagaaaaccagagcaattcgtaaacgtttgactaagcaccagtcatccttgaagacagagagagagaagaagaaggagatgtacttccccattaggaaatatgctatcaaagtgtaggataggatctactttggctgagatttttgtttttggatcaaaattatttgttgaacttatcagcaatacaagttttgttttgctttgtttcgtctgtggcatttgatacatgaccaatgtgttgggggaatatgactttatgttgaatgtcttatttgttgttagtggtttcaacgctaccgtgtaccaaatctcttcatctttatgttttagcgtttgaatatcattcaatttgtcagtg

SEQ ID NO: 6744 - DNA, 590 bp, Tabernaemontana elegans
gaacccgtccccatcgcctgcggacacagagacagaaggagaaggcgccatggcaaggatcaaggtgcacgagctgaggcagaaaacaaagcaggagcttttggctcagcttaaggatctcaaagctgagcttgctctcctccgcgttgcgaaagttactggtggcgctccgaacaagctctccaagataaaagtggtgaggttgtcaattgctcaggtgctcacggtgatttctcagaagcagaaggcagcgttgagagaggcttacaagaacaagaagtatttgccactcgacctccgccctaagaagaccagagccatccgcaggcgcctcacaaaacaccaggcatcattgaagacagaaaggcagaagaagaaagaaatgtacttcccaatgaggaaatacgcaattaaggtttaagttgatcaagtatgaaattaaaattggtactgtacttgtctaaacatcaagcagaatcaagatgctaaacttttctactatgacatgagatagttccaagtattttgttagtgatgcgttttttttttccccccttcccctctcctccatgatggttccaggacaaact

SEQ ID NO: 6745 - DNA, 602 bp, Tabernaemontana elegans
ttgaacttaaactagggtttctgcgcgaaggagagcagcctctgttgtagttctcagtcgaagcgaagcgatggcaaggattaaggttcatgagttgaggaacaagacaaagcaagagttgcttgctcagttgaaggatctgaaggcggagctcgcccttctccgtgtcgccaaggtcactggtggtgctcctaacaaactctccaagatcaaagtggtgaggttgtccattgcccaggtgttgacagttatttcacaaaaacaaaaggctgctctgagggaagcctacaagaacaagaagtacctgcccctggacttgcgccctaagaaaaccagagccatccgtagacgtttgaccaagcaccaggcatctttgaagacagagagagagaagaagaaggagatgtacttccccatgaggaagtatgccattaaagtttagggtaggacccttttgttgctgaagttttggtgtttacgttaaaatatattgcatccatcctcgagttgagagaatttttttattggatatgatttgatgttaatgactagtgatgaattttggaatttcaattttcatgcttccagtttatagtgtgtat

SEQ ID NO: 6746 - DNA, 746 bp, Camellia sinensis
gcggggcgcgagttgagaattagggttttgtatcagagatattagaaccgccgccgaggtctagggttctctcctcattcattcaagctagagaagagagagagagagacacacacacacacacagagacgccatggcgaggatcaaggttcacgagctgaggcagaagtccaaggcagagctattggctcaactgaaggatctcaaggcagagctttctctcctccgcgttgccaaggtcactggcggtgcccctaacaagctctccaagataaaggtggtgaggttgtcgatagcacaggtgttgacggtgatctcgcagaagcagaagtcggttctgagggaggcttacaagaacaagaagtacctgcctcttgatcttcgtcccaagaagaccagagctatccgtagacgcctcaccaagcaccaggcatcattgaagacagaaagggagaaaaagaaggagatgtacttcccaatgaggaagtatgcgatcaaggtttaggtttttagcatcttttatgtttctactatctatatgccgtggatagtgagatatttttccgattaaattgtttttcttttcggtttgcccaaacatatgctgaatgagaacttgaaacatgagtttttgttatatttttctttttacaatattgttctactttagtttaatgttttcatgggagtggggaatgtgtagttgtggctttgctcattttgtccaataataattgtttccaccc

SEQ ID NO: 6747 - DNA, 710 bp, Valeriana officinalis
tttaagataaagcggcacttcttctaggtctttgatcgcaataatggctaggattaaggttcatgagctgaggaccaaaaacaagggagatctgctaagccaattgaaggatctgaaagctgaactcgctcttcttcgagttgccaaagtcaccggcggtgcccctaacaaactctccaaaatcaaggtggtgaggttgtcaattgctcaggtattgactgtgattcaacagaagcaaaaggctgctcttagggaagtgtacaagaacaagaaattgcttcctcttgatttgcgccccaagaaaactcgagccattcgccgacgtcttaccaaacaccaggcgtctttgaagaccgaaagggagaagaaaaaagagatgtacttcccaatgcgaaaatatgccattaaggtgtagtgagttataaatttcttctagtgactagttgattttgctaccagaaaatcaataccatttacttctttcggcaaatttgtggatttattaagttttttcttgtcttggtattacattgtttgctttaagtgtttctcaaaatccgacttttttcgcgtgagttggtgatatatgctctgaaaaggaacttgatcatgcaaaaggttaaaaccgtgtatatatgttttcgcctttattcaaagaatgccttcacttttgaaaattagtcctttgttaaattctaaaacaagttagc

SEQ ID NO: 6748 - DNA, 513 bp, Flaveria ramosissima
ccgaatcaaggttcatgagcttaggaacaaatcgaaggctgatttgtttgctcagttgaaggatctcaaggcggaacttgctcttcttcgtgttgcgaaagtcaccggtggtgctcccaacaagctttccaaaataaaagttgtgaggacctcaattgctcaggtgctgactgtgatctcacagacccagaaggctgctctcagggaagcatacaagaacaagaagtacttgccacttgatttgcgcccaaagaaaaccagagccatccgcagacgtcttaccaagcatcaggcttcgttgaagaccgaaagagagaagaagaaagagaagtacttcccattaaggaagtatgctattaaggcataaggtgaaaaccaccaaggaggagatttaggtgttcaaatcactttctaagttttggacttaaattcatcagaaatgtgtttgttagtttgtttgcaatgagttataagacattctacattggatcgtgtcttttttttgtttgactt

SEQ ID NO: 6749 - DNA, 519 bp, Flaveria ramosissima
cgaatcaaggttcatgagcttaggaacaaatcgaaggctgatttgttcgctcagttgaaggatctcaaggcggagcttgctcttcttcgtgttgcgaaagtcaccggtggtgctcccaacaagctttccaagataaaagtggtgaggacatcaattgcccaggtgctgactgtgatttcacagactcagaaggctgctcttagggaagcttacaagaacaagaagtacttgccgcttgatttgcgcccaaagaaaaccagagccatccgcagacgtcttaccaagcatcaggcttctttgaagaccgaaagagagaagaagaaagagaagtactttccattaaggaagtatgctatcaaggcataaggtgaaaaccattatggaggatatttaggtgtttggtcactttccagttttggacttaaattcatcagaaatatgtgtttgttagtttgcttgcaatgagttataagacattctacattggatcttgctcttttattgtctcacttgtttttt

SEQ ID NO: 6750 - DNA, 491 bp, Flaveria ramosissima
cgaatcaaggttcatgagcttaggaacaaatcgaaggctgatttgttcgctcagttgaaggatctcaaggcggaacttgctcttcttcgtgttgcgaaagtcaccggtggtgctcccaacaagctttccaaaataaaagttgtaaggacctcaattgctcaggtgctgactgtgatttcacagacccagaaggctgctcttagggaagcctacaagaacaaaaagtacttgccactcgacttgcgtccaaagaaaaccagagccatccgcagacgtcttaccaagcatcaggcttcgttgaagaccgaaagagagaagaagaaagagaagtacttcccattaaggaagtatgctatcaaggcataaggtaaaacccatcgaggaaaagatttaggtgttcaaatcactttcaagttttggacttaaattcatcagaaatgtgtttgttagtttgtttgcaatgagttacaagacattctacattggatctt

SEQ ID NO: 6751 - DNA, 586 bp, Medicago truncatula
cactatcactccatagccgttcgtgaatcaagaaaaaatggcaattaagatgttcgagttgaggagcaaaaccaaagctgatttgctgagccagctgaaggatctgaaggcggagctcgctttgctccgagtcgccaaagtcaccggcggtgcacctaacaagctctctaaaatcaaagttgtgaggctttcaattgcacaagtgttgactgtgatttcacagaagcagaaagctgcgctgagagaggtttataagaataaaaagtatttaccacttgaccttcgtcccaagaagactcgtgctattagaagacgccttaccaaacaccaggcatcattgaagacagaacgagagaagaagaaggagatatactttccactaagaaagtatgcaatcaaagcttaggctaggattgctttctagttgcattgtagaccagttatttgaaatattgaactttaaggttgcctaatttgtttgtctggcagtgtagcctatgcgttccaatttttgtgtagttacatttctgatttccattatagcttctgtatgcaactaatctatctctcttgagagttcccaaag

SEQ ID NO: 6752 - DNA, 518 bp, Lippia dulcis
gctcggatcaaggtgcacgagctccggcagaagagcaaggcggagcttttggcgcagctgaaggatctcaaggcggagctctcgttgctgcgtgtggccaaggtcaccggcggcgctcccaacaagctctccaaaatcaaggtcgtcaggctatcgattgcccaggttcttaccgtgatttcgcagaagcaaaaggctgctctacgagaagcatacaagaacaaaaagtatttgccgctcgatctccgccctaagaagactcgttccatccgtcgccgcctcaccaagcaccaggcttctttgaagacggaaaaggagagaaagaaggaaatgtacttccctatgagaaagtatgctattaaagtttgagttgttttttttgttggaaactgttttggatatttttgttgtcctctctcggagaaatttgaaattttatgtgaaattttattgttaaatttgcagttagtttgatgatttgtgccgaagttagtaagtcttctgtaacccttagttac

SEQ ID NO: 6753 - DNA, 672 bp, Epimedium sagittatum
ttctctgtccatttagggtctcagaaggcgaagacacaggaaaagaagaaggagagccgacgccatggccaggatcaaggttcacgaactcagaggcaagccgaaagccgacctcttggcccaattgaaagatctgaaagcagagctcgctttgctccgtgtcgccaaggtcactggtggcgcccccaaccaagctctccaagattaaggtggtgaggttgtcaattgctcaagttctgaccgtgatttcgcagaagcagaaagcggctttgagggaggtttacaagaacaagaagcttatgcctcttgatcttcgtcccaagaaaaccagagctatcaggaggcgtctcaccaagcatcagttgtctttgaagacagagcgtgagaagaaaaggagatgtattaccctttgagaaagtatgcaatcaaggcgtagtgtggaaagtttgctgtgagataattgttggttttgtccatcttcgctgttattgggatttgttacattagactgttggcatttgaatattttctcagagcttcaccttgcagttcttttttcaggatttgtgaaatttagtttatgcatttacctatctttagtttatttaaaattgagtttttattctattgtacaaacaagaacaaagagacgttagagaccaggctacccta

SEQ ID NO: 6754 - DNA, 638 bp, Tropaeolum majus
cggccgggggtagctagggttccatataggaagcaaagaacaggcgcagtcgatccagtgatctcataatggccaggattaaggttcacgagctgaggaacaagtccaaatcggaccttttgagccagttaaaggaccttaaagcagagcttgcccttcttcgcgtcgctaaggtcactggaggtgcccccaacaaactctctaagataaaggtggttagattgtcgatagcgcaggtgttgacggtgatttcacagaccgagaaggcggccttaagggaagtatacaagaacaagaagttttgcctctcgatctccgcccaaagaaaacccgtgccatacgcagacgccttaccaagcatcaggcatctttgaagacagaacgtgagaagaagaaagaaatgtatttcccattgaggaaatatgctatcaaagcgtaacagtatcgatacccatcaggaatgagtgtattttgtttctttggggtgtgtgttttacatgagttcctaacctcgtttagggtgaaatttgtttttgatacagttttctatggctagtttatatgagctcttgagtattttaatttaactaacccagttatgtctttaatttaaccagcaaaataaattgaaaacaatt

SEQ ID NO: 6755 - DNA, 704 bp, Cannabis sativa
gtgtttgaccgttttaattttttgtgtttgttaaagcgaggattaaggttcacgagcttaggaccaagaacaaggccgatttgcagagccagttgaaggatctgaaggctgagcttgctcttctccgggtcgctaaggtcactggcggtgcacctaacaagctctccaagataaaggtggtgaggctttcgattgcacaggttttgactgtgatttcgcagaagcaaaaggctgctttgagagaagtatataagaataagaagcttttgccgctcgatctgcgtacaaagaagaccagggctatcaggaggcgtctcaccaagcaccagttgtcattgaagaccgaaagagaaaagaagagagaaatctactttccaatgaggaagtacgctatcaaggtgtaatgttggatcttcttgggaagttcttaacatgttttcatccatttctaggatatacttttaaaatgtttgtttagctgcttttcaaatttaatcattggggacagtatcaccattgagtttttggtttttcctttgttcagttatatgcatcctatgtagtactactactacttcaattattggttttagtctcaacaaattcttaatgtgttacttttgggaactacgctgttcttccttcctccttttatagcatcacatctaatcatcaattaatttgatcgaagctcagtttgtcca

SEQ ID NO: 6756 - DNA, 698 bp, Rosmarinus officinalis
cggccggggggctctcgtgttgggattttgagtcaccatgtttcactctttggtcgttagctagggtttcactgaagccatcccccatctcctgctcacgcacagacagacagaacgagaaggcgccatggcaaggatcaaggtgcacgagctgagacagaaggcaaagcaggagcttttggcccagcttaaggatctcaaagctgagctagctcttctccgcgttgccaaggtcaccggtggcgctccgaacaagctttccaagataaaagtagtgaggttgtcaattgcacaggtgctgacggtggtatctcagaagcagaaggcagcgttgagagaggcttacaagaacaagaagtatttaccactcgacctccgccctaagaagaccagagccatccgcaggcgcctcacaaaacaccaggcatctttgaagactgaaagacagaagaagaaagaaatgtacttcccaatgaggaagtatgcaattaaggtttaagttgattaaatatgagactcatttgggtttttcctactagtctacacatcaagtggaattattgcttgaatagtattgttcaatcaaagatgttaagactcttcagctaggcaaatgagaactcttgaggatgatgagatagctccgagaattttgttttgtcccttttattctttatatgataagatggatatgcatc

SEQ ID NO: 6757 - DNA, 817 bp, Rosmarinus officinalis
ggccggggggaagctgaaccacacatcgcttgtcacttccgccgcagctttcctgccgaaacagagaacgaaggagaagaaatggctcggatcaaggtgcacgagcttcggcagaagaacaagacagagctgctagcccagctgaaggatctgaaggcggagcttgcgctgctgcgtgtggccaaagtcaccggcggcgctcccaacaagctctccaaaatcaaggtggtgagactgtcgattgcgcaggtgctcaccgttatctcgcagaagcagaagtccgctctgcgcgaagcctacaaaaacaagaagtatttgcccctcgatctccgccccaagaagacgcgcgccatccgccgccgcctaactaagcaccaggcttctttgaagacggaaaagcagaagaagaaagaaatgtacttccctttgaggaagtacgccatcaaagtctaaactctttttcgcagtagaaagcccaccattggagtattatcaaaatttatgtgcaattgaatttggaattttcttttgggcattacttcaaagacctcgtggtgtgtgaactagaagcctggattgcctcattttgatgagataccgaattgctgttttgtatccctgctataaattttgtgatcgagcaacacatttatttccccagttttgcttcatcctttgtcttttcgtttgaggttagtgcgtgttatgtctttatcaatttatgctagtgtcggaacaaataatatctgatatctaaacttcaaagaacatcttttaagatgtgtaggaacttctaagtttccttgtgttcatcggc

SEQ ID NO: 6758 - DNA, 655 bp, Rosmarinus officinalis
acatcagggttttacggtttggccgctttctccttgccccgtcgcccactctctgccacccgcaaaccctaaaccccaatccctcgagagacgaacgcgaaatggcgaggattaaggtgcacgagttgaggcagaagaacaaggtggatctcctggcgcagctgaaggatttgaaggcggagcttgcgctgctgcgagtggcgaaggtgaccggcggtgcccccaacaagctgtcgaagatcaaagttgtgaggctgtcgattgcccaggtactcaccgtcatttcgcagaagcagaaaaccgctctcagagaagcttacaagaacaagaagtatttgccactcgatctccgccctaagaagactcgcgccatccgccgccgtttaacgaaacaccaggcatctttgaagacagaaaagcagaaaaagaaagagatgtatttccccttgagaaagtatgcaattaaagtttaacttatctggttctgtaagagcattcttgttactgtgtggaggaccttttatactgcttcgatagttcgatttattgttagaatttgcgatttagttataagtagtttgcggatgtctaggcatgaaattgaagtactattgtcttttctatacaatgataccctgtgtttccatcataaaac

SEQ ID NO: 6759 - DNA, 674 bp, Rosmarinus officinalis
cggccgggggacatcagggttttacggtttggccgctttctccttgccccgtcgcccactctctgccacccgcaaaccctaaaccccaatccctcgagagacgaacgcgaaatggcgaggattaaggtgcacgagttgaggcagaagaacaaggtggatctcctggcgcagctgaaggatttgaaggcggaacttgcgctgctgcgagtggccaaggtgaccggcggtgcccccaacaagctgtcgaagatcaaagttgtgaggctgtcgattgcccaggtactcaccgtcatttcgcagaagcagaaaaccgctctcagagaagcttacaagaacaagaagtatttgccacttgatctccgccctaagaagactcgcgccatccgtcgccgtttaaccaaacaccaagcatctttgaagacagaaaagcagaaaaagaaagagatgtatttccccttgagaaagtatgcaattaaagtttaacttatctggttctggaagagcattcttgttactgtgtggaggagctttgatactgcttcgatttattgttagaatttgcgatttagttataagtagtttgcggatgtctagacatgaaattgaagtactattgtcttttctatacaatgataccctgtgtttccatcataaaaccaaaaaatttacttgtc

SEQ ID NO: 6760 - DNA, 507 bp, Arnica chamissonis
gcagtccacccaaacttctatcaatggctagaatcaaggtccatgagcttaggaacaaatcgaaggttgatttgtttgctcagttgaaggatctcaaggctgaacttgctcttcttcgtgtcgcgaaagttaccggcggtgctccgaacaagctttcaaagataaaagtggtgaggacatccatcgctcaggtgctgacagtgatttcacaaacccagaaggctgctcttagggaagtctacaagaacaagaagtacttgccgcttgatttgcgtccaaagaaaaccagagccatccgtagacgtctaaccaagcatcaggtttccttgaaaactgaaagagagaaaaagaaagagaagtactttccattgaggaagtatgctatcaaagcataaggtgaaaactaccaaggaggatatttaggtgttcaaatcactttccagttttttgcttgaattcatcagaaatatgtatttgttagtttggttgcattgagttgcaagacta

SEQ ID NO: 6761 - DNA, 599 bp, Persea americana
tttctgggaagtccgaagaggagagaaagcaagcgaagaagcatccatggcgaggatcaaggtccacgagctgcgggggaagtcgaaggccgaccttctgactcaactgaaggatctgaaagccgaacttgctctactgcgtgtcgccaaagtcacgggcggtgcctccaacaagctttctaagataaaggtggtgaggttgtcgattgcgcaggtgctgacggtgatttcgcagaagcagaaggcggcgctgcgggaagtgtacaagaataagaagtacttgccactcgatctgcgcccgaagaaaacccgagccatcaggcgtcgtctcaccaaacaccaggcatctttgaagacagaacgggagaagaaaagggaaatttattttccaatgaggaagtatgctatcaaggtgtagggtagcagtgttagttataggccagtttgttgttttgtttgaaaatggatcttgtcatctcttttgaatccacatttgtccacatgctatgtgtctttcctgttcaactgcgaggaaccggctggaactgggttggaatgagttctctacaatttgttacttaaatgaagtttcgtggaag

SEQ ID NO: 6762 - DNA, 610 bp, Ocimum basilicum
ggttcctgccgaatcagagaaaggaggaccagaaatggctcggatcaaggtgcacgagattcggcagaagaacaaggcggagctgctggcgcagctgaaggatctgaaggcggagcttgcgttgctgcgggtggcgaaagtcaccggcggcgctccgaataaactctccaaaatcaaagtggtgaggttgtcgatcgcgcaggtgctcaccgttatttcgcagaagcaaaaaaccgctctgcgtgaagcctacaaaaataaaaagtatttgccccttgatctccgccccaagaagacccgcgccatccgtcgccgtctcacaaagcaccaggcttctttgaaaacagaaaaggagaagaagaaagaaatgtacttcccattgagaaagtacgccatcaaagcttagcttggatctctacgcacgtccaccattggagtattatcaaaaatttttgtttgcaactgaatatccaatatttttggcatttacttcaaagattcaaaactagaagcctgggttcacttcatttacaggatatatcaaggtgttacgatgttgttcttcttcatcttttattgtttatttggatggatgtgtacagctttcttc

SEQ ID NO: 6763 - DNA, 627 bp, Phaseolus vulgaris
gtctcttttatttaacactagggtttgcaacgaagagtcgcagccgtatcagaagctcgcggaagtgtagcaatggcgaggattaaggtttacgagctgaggcagaagacgaaagctgatctcttgaatcagctgaaggacctcaaggccgagttagccttgcttcgtgttgccaaggtcaccggaggtgcccctaacaagctctccaagataaaagtggtgaggttgtccattgcccaggttttgacggtgatttctcagaagcaaaagtctgcgttgagggatgcctacaagaacaaaaagtacttgcctcttgatcttcgccccaagaagaccagggctattcgcaggaggcttactaagcaccaggcatcattgaagaccgagagggagaagaagaaagagacttatttcccaatgaggaagtatgctatcaaggtgtaatatttaagcaaatcttagtgatcaatttaacgtttacctccttcatacttgaccagttttgatacatctcagatttgtagtttcatgttggagtttctatttattattgcctatcttaaaattcttgttgggtttcttgaagctactagcatttttgcgcattgttagttttcgttcaaaatt

SEQ ID NO: 6764 - DNA, 578 bp, Theobroma cacao
cttcgcttcagagagagaaaaacagaggcaggcagccatggcaaggatcaaggtacacgagttaaggaacaaatcaaagacagagctgttgagccagcttaaggacttaaaggctgagctttctctccttcgtgtagccaaggtcactggtggtgcccccaacaagctttccaagattaaggttgtgaggctatcgattgctcaagtattgacggtgatatcccagaagcagaaggccgcattgagggaagcctataagaacaagaagtttttgcctcttgatctccgtcccaaaaagaccagagctattcgccgccgccttaccaaacaccagcaatctttgaaaacagagcgggagaagaagagggagatgtactttccaatgaggaagtatgccattaaggtgtaagcttgagattaatttaggaagggatacctttgtgttagattcgatgtgcctattggaggatattatttaaatttgttgttgttgaattttcattttttttataatttttccatttccctcccatctttctcactattatgaattattggaacttaatgagtgttggtcg

SEQ ID NO: 6765 - DNA, 624 bp, Manihot esculenta
agggcttcataggagcggagtagcagggagcagtcgccgttgtccaatctcgtagaaagatatggctagaatcaaggtccatgagctgagacagaagtcgaagactgagctactggaccagttgaaggatctaaaggctgagcttgctctccttcgggtcgccaaggtcaccggcggtgctcctaacaagctcagcaagatcaaggtggtgagattatcaattgcacaagttttgactgtcatctcgcagaaacagaaggctgctcttagggaggcatataagaacaagaaatttttacctcttgatctgcgtcctaagaagaccagagccatccgcaggaggcttaccaagcaccagcaatctctgaagacagagcgtgagaagaagagagaaatgtactttcccatgagaaaatatgctattaaggtgtaggatggtgtcttcgggatagggttatttgaattttgcaattgtaaacctgtttggtcgacaagttttcacaatggattatctttttgttgtgactttatctcttctagtttaatattatgtctgtaagcttgaaagggtgtatctcactcttaagttattctttctgaagtttttgaggccttattgaatgt

SEQ ID NO: 6766 - DNA, 613 bp, Catharanthus roseus
taaccttatttgactctttggtcctcagctagggtttcactgaactccccttaccccttcccctgcttccacagagactgcacgagaaggcgccatggcaaggatcaaggtgcacgaattgaggcagaaaacgaagcaggagcttttggctcagcttaaggatctcaaagctgagctagctctccttcgcgttgctaaagttactggtggcgctcccaacaagctctccaagataaaggtggtgagattgtctatcgcacaggtgctgactgtaatttcgcagaagcagaagtcagcattgagagatgcttacaagaacaagaagtatttgcctctcgaccttcgtccgaagaagaccagagccatccgcaggcgcctcacgaagcaccaggcatctttgaagacagaaagggaaaagaagaaagaaatgtacttcccaatgaggaagtatgctattaaggtttaattttgactagagcgtctagagagacatgaaacaaaattgttgccttaattttttgttgttggatcaaacttgttgttagcctttgtttactaggcaggccacaacaacttttgagaatgaatgatcaggtgtttgttagttcctttt

SEQ ID NO: 6767 - DNA, 692 bp, Catharanthus roseus
ttagaactcattagtagggtttcagagctaaggtaggcagttcccaatcgaagcgagaggcgatggcaagaattaaggttcatgagttgaggaacaagacaaagcaggaattgcttgctcagctgaaggatctcaaggcggaactcgctcttctccgtgtcgccaaggtcaccggtggtgctccgaacaagctctccaagatcaaagtagtgaggttgtctattgcccaggtgttgactgttatttcacaaaaacaaaaatctgctttgagggaggcctacaagaacaagaagtacttgccgctggacttgcgtcctaagaaaaccagggccattcgtagacgtctgaccaagcaccaggcctctttgaagactgagagagagaagaagaaagagatgtacttccccatgaggaaatatgccattaaagtttagggcagggtccttttgttgttgaagttttggtgtttacgttaagatatatggcatcaaaccttgagttgatagaattttgttattggatatgatttgatattaatgaccagtaatgaattttggaatttcagtttttatgtttccagtttctagtgtgtatcaactttagcaagggacaatttcaatatagttttaggtactgcaatgcaacatactgttgttggttactttcatatttgataagcttctctgattgcc

SEQ ID NO: 6768 - DNA, 1516 bp, Cirsium arvense
tcaatcacccccttcactctctacactctcaaaccttgtgttttttcagaggcggcggcgatctcttcactcaatcggagagccatggcaaggatcaaagttcatgagctaaggaacaaaaacagaggagatttattaggtcaattgaaggatttgaaagctgagctctctcttcttcgtgttgccaaggtcaccggtggtgctcctaacaaattatccaaaataaaggttgttagaacatcgattgcccaggttttgaccgtgatgtcacagaaacaaaaggcggcactgagagaagtgtacaagaacaaaaagtacctgcctcttgatttacgtcccaagaaaacccgggccatccgaagacgtctaacaaagcaccaggcctcgttgaaaaccgaaagagagaagaagaaagagaagtatttcccattgaggaagtatgccatcaaggtttagaggtgcattacggtcttttttgagtatttgagttccatcaatttcgctagtatttgtaaacccggtttcactgtttttctgctttaatgatgatcgaaagatgcttaaatacgattgtttttttgttcaaagccatcgtaatctgtatattattaaacaatatttccaaaaatacatacaaaatttcttattaccgtgtttacaacttttatcaagagcctaataaaagcgtatcacttttatacacaaaggccttctcactttttgcgggcatctttgcctcatcaagataatgcacattgacaaccatttaaaagatttggagaaagacacttaaaatatatgttcttaattacaaattatttcaacaaataacacaagcatttgggttctcctctatgctttggtgatggggtggttgataattatagtaggtatgcattggagggtaatatggtaatttatagggcataagcatccctacaacttgctcttgtggttgtggctgtggttgaggttgagattgtggggtactcttcttttcgccctcttctttaggctcctctttcttggcttcttcttttggggcttcttctttcggaggttcttctgttttaggctcatctttctttggttcttctttggtttcctctttctttggctcctctttcttctcttcttctttcttgggttcttctttcttttcaggctccttagcgggccccactgatactaaatacgttggccaaagttttcgaagcttgctaacggcgcttattggatcaacggctccaacaattgtcatgttcttctctttcatgtttatcgtgattgaatcaatccctgcaaatgctgctactgttttcatggcctttctcttgtctttttcatcattcaattccaacttcaatataaatttcttcatgtgggtgtttttgaatccaagcctttgtataactgcaattggaattagaactcagaaaggaatcaaaatgtagagagagaaagagagtgagatgagagagagtgagtgagagttatatgatgtgtataaataatg

SEQ ID NO: 6769 - DNA, 603 bp, Cirsium arvense
cttcagaggcggctatctcttcactcaatcgaaaccatggcgaggatcaaagttcatgagctcaggaacaaaaacagatcagatttattgggtcaattgaaggatcttaaggctgagctcgctcttcttcgtgtagccaaagttaccggtggagctcctaacaagctatccaaaataaaggtcgttaggacatccattgcgcaggttttgactgtgatgtcacagaaacagaaggcggcattaagggaagtatacaagaacaaaaagtatttgcctcttgatttgcgtcccaagaaaactagggccatccgtagacgtctaacaaagcaccaggcatcgttgaaaaccgaaagagagaagaagaaagagaagtatttcccattgaggaaatatgccattaaggcttagaagggcatcatttgtctttttgagtttttcagtttcagtggtatttgtaaacccagctttcactgcttttcttctttaatgataattgaaagatgcttaaatacgttggtcattctttccgactctgtgttgcacgaggacttaatttgttcacaaacgagtttactgtttaaaaagaaaaagtaaccgactgcg

SEQ ID NO: 6770 - DNA, 696 bp, Trifolium pratense
aatggctggaatcaaggtttatgagctccggcaaaaaacaaaagcagaacttttgagtcagttgaaggatctgaaagcagaacttgctcttcttcgcgtcgctaaggtcactggtggtgctccaaataagctctccaaaatcaaagttgtccggctttcaatagcacaagttttgactgtgatttcacagaaacaaaagacagcattgagggaagtgtataagaataagaaatacttgcctttggatctgcgtcccaaaaagacaagagccattagaagacgacttactaagcatcagcaatcattgaagacagagcgtgagaagaagaaggaaatctacttcccattgagaaaatatgcaatcaaggcgtaatgcggggctctttttacatgacttgggatatgttatttgtcatattttgcaaaatatttggtcttggattttgtttttgtttccttgtgagtttaactaatcattataaaacagaattaagttaactttttctcgtctttgtttttcttctcattccagattcagatttttcactgcttaaattacattatctggttgtttgcttaataaactagtttttggaaaacaaacacattataatatgataagcaacacaacataatatttatttagttagtaattacattgagttgcctacaccagatatacattattgcatcatg

SEQ ID NO: 6771 - DNA, 687 bp, Coffea canephora
cggccggggaatccccttgcatttggaccactagggtttctgagcagcctctgaaggaagtctccctcgaaccgaagccatggctagaatcaaggtacacgagcttcgtaacaagtcgaagacggaattgctagcgcagttgaaggatctcaaggcggagctcgcccttctccgcgtcgccaaggtcaccggcggtgcccctaacaaactctccaaaatcaaggtagtgaggttgtccatcgcccaggtgttgactgtaatttcccaaaagcagaaggctgctcttagggaggcttacaagaacaagaaatacttgcccctcgacctgcgccccaagaaaacaagggctatccgcagacgtcttaccaagcatcaggcctctttgaagacagagcgacagaagaagaaggagatgtacttccctgtgcggaagtatgccattaaggtttagggaaggactgcttgtgagaggttttggtgttttacatgaaagcagacaacattttgttaaaatcagattttgcaaatttttgttactattagtgccctcttgctggacttggacttgagattagtggttcatgttgaattttggtatttcagtttcacctattctagataattctgtacctttatctgttcggagaaatagcttgcgcttcattctgaaaagatcgactttgtgcc

SEQ ID NO: 6772 - DNA, 655 bp, Gossypium hirsutum
gggatgcaaattagggttttctgggaagccgatattaaagccttcatcgctgcactttcacaccttcttcacttcacagagaaaacagaggcaggcagccatggcaaggatcaaggtgcacgagttaaggaacaaatcaaagacagagctgttgagtcagctcaaggatttaaaagccgaactttctctccttcgtgttgccaaggtcactggtggtgcccccaataagctctccaagattaaggtggtgaggctatccattgctcaagtattgacggtgatatcccaaaaacagaaggctgctttgagggaagcttataagaagaagaagtttttgcctcttgatctccgtcccaagaagaccagagctattcgccgccgccttaccaagcaccagcaatctttgaaaaccgagcgggagaaaaagaaggagatgtactttccgatgaggaagtatgccattaaggtataagcttgaaatttgacttaggatggatacctttatgttagtttcaaagtgactactcgaggttattgttgaagttttgtgttgttgaattttcgttttcttcataacattccctattatgtttaagtttcttacaattctgaattatggagtataaagagtgttggttaggcctttcttttataa

SEQ ID NO: 6773 - DNA, 603 bp, Vigna unguiculata
ctcttttatttaacactagggtttacaacgtagagtcgcagccgaagcggaagctcgtggaattgtagcaatggcgaggattaaggtttacgagctgagacagaagacgaaagctgaactcttgaatcagctgaaggacctcaaggccgagctagcattgcttcgtgttgctaaggtcaccggaggtgcccctaacaagctctccaagataaaagtggtgaggttgtcgattgcccaggttttgactgtgatttctcagaagcaaaaggctgcgttgagggatgcctacaagaacaaaaagtacctgccccttgatctccgccccaagaagaccagggctattcgcaggaggcttactaagcaccaggcttcgttgaagactgagagggagaagaagaaggagacttatttcccaatgaggaagtatgctatcaaggtgtaatattagagcaaatcttattgatcaatttgacgtttactcctttaatacttgaccagttttgatacatcacagatttgtagtttcatgtcggagttaccatttgttattgcctatgttaaaattcgtgtttggttttttgaagctattagaatttatgcgca

SEQ ID NO: 6774 - DNA, 579 bp, Vigna unguiculata
gggtctcttttatttaacactagggtttacaacgtagagtcgcagccgaagcagaagctcgtggaattgtagcaatggcgaggattaaggtttacgagctgaggcagaagacgaaagctgagctcttgaatcagctgaaggacctcaaggccgagctagccttgcttcgtgttgctaaggtcaccggaggtgcccctaacaagctctccaagataaaagtggtgaggttgtcgattgcccaggttttgactgtgatttctcagaagcaaaaggctgcgttgagggatgcctacaagaacaaaaagtacttgccccttgatctccgccccaagaagaccagggctattcgcaggaggcttactaagcaccaggcttcgttgaagactgagagggagaagaagaaagagacttatttcccaatgaggaagtatgctatcaaggtgtaatattagagcaaatcttattgatcaatttgacgtttactcctttaatacttgaccagttttgatacatctcagatttgtagtttcatgaccatttgttattgcctatgttaaaattcatgttgggttttttgaa

SEQ ID NO: 6775 - DNA, 455 bp, Cyclamen graecum
cagcgaaagagagagaaagatattctccgcgatggcaaggattaaggttcatgagcttcgccagaagtcgaaggcggatttactgggccagctgaaggatctgaaggctgagctggcactcctccgtgttgccaaggtcaccggtggtgccccgaacaagctctccaagataaaagtggtgcggttgtcaattgcgcaggttttgaccgttatctcacagaaacaaaagtccgctctgagggaagtttacaagaacaagaagtacttgccccttgatctgcgtcccaagaaaaccagagccattcgtaggcgtctaaccaagcatcagcaattgttgaagaccgagagggagaagaagagggagatgtacttccccatgaggaagtatgctatcaaggtctaggattggttatgctttggagtgaaattcgggtgcaccttgagcctactcaaaa

SEQ ID NO: 6776 - DNA, 368 bp, Cyclamen graecum
ccatggcgaggattaaggtacacgagcttcggcagaaatcgaaagctgatttgatggcgcagctgaaggatctgaaggctgagctgtcactcctccgtgtcgctaaggtcaccggcggcgcaccgaacaagctctccaagataaaggtggtgaggttgtcaattgcccaggttttgacagtgatctcgcagaagcaaaaatctgctctgagagaagtgtacaagaataagaagtacttgccccttgatttgcgtcccaagaaaaccagagccattcgcaggcgtctaaccaagcatcagcaattgttgaagaccgagagggagaagaagagggagatgtacttccccatgaggaagtatgctatcagg

SEQ ID NO: 6777 - DNA, 503 bp, Eschscholzia californica
cagaggaagagcaggaggagcggcatcaacaccaatggcgaggattaaagttcatgagcttagaggtaagtctaagacagatttattgaaccagttgaaggatttgaaggcagagttagctcttcttcgtgttgctaaggtcactggtggagcaccaaacaagctctccaaaattaaggtggtgagattgtcgattgctcaagtattgactgtgatttcacaaaagcagaaagctgctttaagagaagcttacaagaacaagaagtttttgcctcttgatcttcgacctaagaagactagggctatcagaagacgccttaccaagcatcagttatctttgaaaacagaacgagagaagaaaaaggagctatactacccaatgaggaagtacgcaatcaaggtgtagtctaggaatcaagttaattgcgaattttgtgttttcgcccttttttcccattttgctctttaggatttgacctcaactattatgtttttctcttatg

SEQ ID NO: 6778 - DNA, 521 bp, Eschscholzia californica
gccacagcaatggcaaggattaaggttcatgaactcagaggtaagtcgaagactgatttgttgaaccagttgaaggatttgaaggcagagctagctcttctccgtgttgctaaggttactggtggagccccaaacaagctctccaagattaagatagtgaggttgtcgattgctcaggttttgactgtgatttcacagaagcagaaagctgctttaagagaagcatacaagaacaagaagttcttgcctcttgatcttcgtcctaagaagactagggccatcaggagacgccttaccaagcaccagttgtctctgaaaaccgaacgagagaagaaaaaggagttgtacttcccaatgaggaagtatgcaatcaaggtgtagtttagaagatctgcttaactgataattttgtttcttcatctttatgttgttagtagattcgacttcttatttacttatttcagtatgaagtttctttgcctgtttatgggaacaccaactcttgaccgagtttgcttttt

SEQ ID NO: 6779 - DNA, 693 bp, Euphorbia peplus
tttttttttttttttagaaaaaacataacttctggattttcttatccaggcgggcaggagcataaaagagactagccgccgtctttgagagccggaagaaaacgaaatggcaagaatcaaagtccacgagctgagacagaaaacaaaggcagatctgttgaatcagttgaaggatctcaaggctgagcttgctcttcttcgggtcgctaaggttacaggcggtgccccaaacaaactctccaagatcaaggtggttaggttgtccattgcacaagtcttgactgttatttcacaaaagcagaaggctgcattgagggaagcatacaagaacaagaagttcttgcctcttgatctgcgtccaaagaagaccagagccatccgcaggaggcttacaaagcaccagcaatctttgaagactgaacgtgaaaagaagagagaaatgtacttccccatgagaaagtatgctattaaggtgtaggtcgtgatttgctaagtaggcttttttcacatccttcaattataaaccctatttgataggccaagttttgatgtggatcaacttttgcttcttgttatgaacaatatatttttttgtgctaaatcttatgtttgtgaacttctaagggtgttcctcactctaacccggtccagatttatgttggaaaagtagatgcagaagttatgtttttatct

SEQ ID NO: 6780 - DNA, 588 bp, Fagopyrum esculentum
tcgccattaggtttaagtgaagacacgccgttctctcgttgacacacaaaggcagcaatggcgagaatcaaggttcatgagcttaggcagaagcccaaggcggatctgttgagccaactcaaggagttgaaggctgagctttctctccttcgcgtcgctaaggtcaccggtggcgctcccaacaagctatccaagatcaaggtggtgagattgtcgattgcgcaagtgttgactgtgatttctcagaagcagaaattggcgttaagagaggtgtacaagaacaagaagtacttacctcttgatctccgccctaagaagaccagagctattcgccgccgtctcaccaagcaccaggcttcgttgaagacagaaaggcaaaagaagaaagaggtgtatttccccttgagaaagtatgcaatcaaggtctaaggttggagtttttgattattagagaaagtgttgggtggtttagtagtatcaatgcttgttaaccgtcttcttaattcagcaattgttttcattatactggatgtttgtttgaatgttgtcatctttgatagagctatctttagtgaaatctctttcttt

SEQ ID NO: 6781 - DNA, 612 bp, Linum usitatissimum
gttctaggatttgtcatccggccagaagaaagcagctgccgccgtcgccagactagaacgaagacatggccagaatcaaggtccacgagctgaggcagaagaacaagtcggaccttttgaaccagttgaaggatctcaaggctgagctcgccctcctccgcgtcgctaaggtcactggaggcgctcctaacaaactctccaagattaaggtggtgcgcttgtccattgcccaagtcttgactgtgatttcacagaagcagaaagctgctttacgagaagtctacaagcacaagaagctcttgcctcttgatcttcgtcctaagaagactagagccattagaagaaggcttacaaagcaccagcaatcattgaagacggagagggagcagaagagagaaatgtacttcccaatgagaaagtatgcaatcaaggtttaagagtagcgctgaccctttcgtagtatgctatttcataatcttcatggttatgaagaaagcatactctagtacagcgaacattgtggaattgtgtaatgttagatttgagtgatagtgtgaactgagcatcatcttggaagttttgaaaataacttgactcgaaggtaatccgttt

SEQ ID NO: 6782 - DNA, 791 bp, Linum usitatissimum
tttagtcatctgcacagagacagatagcagctgccgccatcgccagagtgaaacgaagcaatggccagaatcaaggtccacgagctgaggctgaagaacaagttggaacttttgaatcagctcaaggatctcaaggctgagcttgctcttctccgcgtcgccaaggtcaccggcggcgctcctaacaagctgtccaagatcaaggtggtgcggttgtctattgcccaagtgttgacagtgatctcacagaagcagaaagctgcacttcgtgaagtgtacaagaacaagaagctgttgcctcttgacctccgtcccaagaagaccagagccatcagaaggaggcttaccaagcaccagcaatctcttaagacggagagggagaagaagagggaaatgtacttccccatgaggaagtatgcgatcaaggtgtaggaaaagctagcaacttttctgtcttcaagggttattaagatttaaggagcaatctcttaagacggagagggagaagaagagggaaatgtacttccccatgaggaagtatgcgatcaaggtgtaggaaaagctagcaacttttctgtcttcaagggttattaagatttaaggaggtgcgttttagtataaggagcaatttagagtctttttgtaatttcatatttgaagggtagacaagtgaactcgagcatcaacttttgaacaagttttggaatgatatgtatcgacttttcttacacctttgttgaatcagttcatgttttgtggtaagtgtctgaaaatctgaattcatttcttct

SEQ ID NO: 6783 - DNA, 556 bp, Heritiera littoralis
gagggtttcatttatttataagaaaaaaggcgaagccgccgttgcagtcccacccgaagaacagcaaaagaagcaatggcgagaatcaaggtccatgagttgagacagaaatcaaaaactgaacttttagctcagttgaaagatctcaaagctgaacttgctcttcttcgcgttgccaaagttaccggtggtgcacctaacaagctttccaagataaaggtggtgaggctgtcaattgctcaggtgttgacggtaatctcacagaagcagaaggctgcgttgagggaggcatataagaagaagaagttcttgccccttgatctgcgtcccaagaaaaccagagctatcaggagaaggcttaccaagcaccagggatcattgaagaccgaacgggagaagaagagggaaatgtacttcccaatgaggaagtatgccattaaggtgtagggtaggatctttcagatagggttctattttcaaatccacttgtactttacttactagtgtcttatttttgtaaacctgagttacgatattgttctgttgttatgtttct

SEQ ID NO: 6784 - DNA, 765 bp, Actinidia deliciosa
tttggagatagagctaataaaaccgccgctgagtagggtttctatcgactctctaaagccatcagagagagagagagagagagggtgaaagactgacagacgccatggcgaggatcaaggttcacgagctgaggcagaagtcgaaggctgagctattggcccagttgaaggatctgaaagcagagcttgctctccttcgcgtcgccaaggtcactggtggcgcccccaacaagctttctaagataaaggtggtgaggttgtcgatagcacaagtgttgaccgtgatatcacagaagcagaaggcggttctgagggaggcttacaagaacaagaagtacatgccacttgatctgcgtcccaagaagaccagagccatccgcagacgcctcaccaaacaccaggcatcattgaagacagaaagggagaaaaagaaggagatgtacttccctatgaggaagtatgccatcaaggtttagggttcatttcgcttttttctcagttatgtttctgctctgtctgtgctgaggatggtgaaagcttcttcctatggaattcttttcctttcactttcctgtttgcgaaatatttgatggatgagaattagaatgtgtttgttatgtcttcctatacccgacttcagtttaatgcttccgttgaaatggcatcgaccaagtgtatgagccatgttatgtagtttttttgcccagtagtgagcatgactgttatttctagtaaagccagtgtgctccatttgttgataaaaaa

SEQ ID NO: 6785 - DNA, 533 bp, Medicago truncatula
caaagcttccacattctaccaagttttctcgcggcgattcaagaccttcgaaatggctggagtcaaggtatatgagctgagacaaaaaacaaaacaagatcttctgaatcaattgaaggatctgaaagccgaacttgctctccttcgcgtcgcgaaggtcaccggaggtgccccaaataagctctccaagatcaaagttgttcggctcaacatcgcacaggtcttgactgtgatttcacagaagcaaaagacagcattaagggaagcttataagtccaagaagtacttgccgttggatctccgtcccaagaagacaagagctattagaagacgcctcactaagcatcagagctccttgaagacagagcgtgagaagaagaaggaaatctacttcccagtgagaaagtatgccattaaggcgtaatgttggaccctttcttttgcatgaatttcgatttgttgttggatattgttctagatatttggtgttgtgttctacttttgtttccttttgagtttaacttatcttcatg

SEQ ID NO: 6786 - DNA, 822 bp, Mimulus guttatus
ctagggtttctctattcaccattttctctctgttacactcactcttcgtcgtcaaccgcaaaccctaaaccccaaattcggcggcaaacgagaaaatggcgaggattaaggtgcacgaattgaggcagaagaacaaggcagatctattggcgcagctgaacgatctgaaggcggagctagcgttgctcagggtggcgaaggtcaccggcggcgcccccaacaagctctccaaaattaaggttgtgcgtctctcgattgcgcaagttctgactgtcatttctcagaagcagaaagcagctctcagagaagtgtacaagaacaaaaagtacattccgctcgatctccgccctaagaaaacccgcgccatccgccgccgccttactaagcaccaggcatctttgaagactgaaaagcaaaagaagaaagagatgtacttccccctgaggaagtatgctattaaagtttaagttatttggtaacatttttgctgtctaccgctgaatattaatactttgtgccgatcgttatttaattcgcagtttctttagtagttgtaccgttggatattaatacatttcttgtttaatctagactcgaattacgtttgagtcacatcttttcctttatattatgatccccaatgtgtttcatcatgttaaatcttattttgcacctggtgatttagggttttggcaatttggagtgtcccttttgacttggtcaacttatttgaaaagtatttcgttttcttgctaaaactaattataaattttattagaaatgtaacgttgactttgatgatcatttttcatttcattagtc

SEQ ID NO: 6787 - DNA, 530 bp, Tropaeolum majus
tctccgactcagcggccgggggaagacttcagttgtgttgcagaagttcagttacactatcgatagcaatggcgagaatcaaggtgcatgagctgagacagaaatccaaggaggatctgttaagtcaattgaaggatttgaaggccgagctcgctctccttcgcgtagctaaagtaaccggcggtgctcctaacaagctctcgaaaatcaaggtggtcaggttgtcaattgcacaggtgctgacagtgatttcacagaaacagaaatctgcccttagggacgcatacaaaaacaagaagtatttaccccttgatttgcgtcccaagaagacaagagccatcagaagaaggcttacaaagcaccagatatcattgaagactgaacgagagaagaagaaagagatgtattttcccatgaggaagtatgccattaaggtgtagggtgagatatatgccaacgatctctctttttgtagtttcagaaattttgacttggggaatttattatgccttgtgactttgaagtaaaaa

SEQ ID NO: 6788 - DNA, 759 bp, Nicotiana benthamiana
aaaccctaaatcttcttcagcttctaagcagtaacctcaaaggagcagccatggcgagaataaaggttcatgagctgaggggcaagtcgaaaactgatttgttggctcagttgaaggatctgaaggctgaacttgcccttctccgtgttgctaaagtcaccggtggtgcccctaacaagctatccaaaataaaggtggtaaggttgtcgattgcacaggttttgactgtgatctcacaaaagcaaaagtcagttcttcgggaagcttacaagaacaagaagtacttgcctcttgaccttcgccccaagaaaacaagggcaatccgcagacgtctgaccaaacaccaggcatccttgaagacagagagagagaagaagaaggagatgtatttccccataagaaaatatgctatcaaagtttaggataggatctacttccgagatttttgttttttggatcaaaattacttgtcgaacttatcagcaaatacaaagtttgttttgctttgtttcatctggtgctttgacatttgatacatgaccaatgtgtagcttcatttgttctgaatgttggtagtattgactattttagcctgtttgttattagtggttcaatgcattgaaaatttcttatcatatgtgttgctggttttagaacattgttcagtttgtccgtcactcctttaaaagaagtaattgttgggtttacaaagtgaatactttttctggaattctagaaatttgcaattaatttattgaa

SEQ ID NO: 6789 - DNA, 860 bp, Elaeis guineensis
gagggcgagggagaagagaatggctcggatcaaggtgcacgagttacgggggaagtcgaagacagagctgctgagccagctgaaggacctgaaggcggagctgtcgcttctccgggtggcgaaggtcaccggcggcgcccccaacaagctgtcgaagatcaaggtggtccggctgtccatcgctcgggtgctcaccgtcatctcgcagaagcagaaggctgcgctcagggaggcctacaagaacaagaagtacatccccctcgacctccgccccaagaagacccgcgccatccgccgccgcctcaccaagcaccaggcatcattgaagacagaacgacaaaagaagaaggagatgtattttccaatgagaaagtatgcaatcaaggcatagagtaggaatatggccggactgcttttttgttgttcttatgcatgctttctatgtttttaatgatgatgttaggcttgctgaatggtgtgtccatgtcttatccaatgcaatagcatggatttttttttttttttttggactcttaaacgctttgcaaagcagtttagacattatattattacttcttgcaccatttacttggtggtatattactcagtctgttacagtagcaaaacagcttggacagtatagctgatgccaattcggctggattagcttttgcttcatgtttagggtggagtgcttaactgctgatgcgaacttttttcttcttactccgcctagttctgatattactgaactaccggattgcttccattttgatgcatgtttttgacagatatgcatgtttttgacgtatctgtgtcctcagtggtggtgttgcaccggcgcccaccaacaagttgcg

SEQ ID NO: 6790 - DNA, 807 bp, Olea europaea
tgcaactcctggagagaagtcgttgtagggaaaagacgaaatggctcggatcaaggtgcatgagttgaggcagaagaacaaggcggagcttttggcgcagctgaaggatctgaaggcagagctggcgttgcttagggtcgccaaggcgactgctggggctgccaacaagctgtcaaagatcaaggtggttaggctttccatagcccaggtgctgactgtaatttcccagaaacagaaggccgctctcagggaagtatacaagaacaagaagtatttgcctcttgatctccgtcccaagaagactcgtgccattcgcaggcgcctgactaagcaccaggcatctttgaagtccgaaagggagaagaagaaagagatgtacttcccaatgaggaagtatgcaattaaagtttaagttgatcaacggtggaagttatttcagtaccatccctgcttaatctcgaaggataattacattttgtttggtaagttgttagctgaaaattgttatgattttgagaactttgagtttttgagtgtcattatatgttattatcttatgactagagacgaaagattttgattgaagttatgcattttacttctatttggcttggtttgatttggtttctcatagcccatgcacttttcatgctttataagtactgatggttactactggtgcaccgaatagcaagaatgctatgatgtgcaatgtatttttatggtcctaatcattcgcctaggatggcagtcatgtcggtggaattggacgaagtgacctagatttggatcaaattaatgtaattg

SEQ ID NO: 6791 - DNA, 1323 bp, Solanum tuberosum
gagaagagtgacatttatagctttggaatacttatcatggagataattactgggagaactcctgttgattatggtagaccaaaaggcgagactaatttggtggagtggttaaaaatgatggttgggaatcgaaaatctgaggaagtggttgatcctaagttgcctgaaatgccttcgtcaaaaggactcaagcgtgctcttttggttgctcttcggtgtgttgatcctgatgctcaaaagaggcctaaaatgggacacattatccacatgctagaggcggatgacctgctggttcgtgatgaacgtcgtattggtagagaaagagaatcgtctaattcccaccgtgactacaaacaagacaaccaagctggtcccaagttatccagaaaacaatatggtgatggagcaccagaaactagtgaaggagatagtagtagaaaccataatttgccatctagttggagatagataaaattataaatgatcatccatatttatatatctaaatgcttatcctgttctttatgtaattctttttcactaaccttgttaatgatttctatactatcactcacgagccgccgccgccgcctctgtagctatctccaccaacatcaacaatggccagaatcaaggttcatgagctgaggaacaagtcgaagcctgatctactgactcagttgaaggatttgaaggcagagcttgctcttcttcgtgttgccaaggtcactggtggtgctcctaacaagctctccaaaatcaaggtggtaaggttgtctattgcccaggttctgactgtaatttcacagaagcaaaaggctgctcttagggaagtttacaagaacaagaaatacctgcctcttgacctgcgcccaaagaaaactagggccatccgcaaacgtttgaccaagcaccaggcgtctttgaagacggagagggagaagaagaaggagatgtacttccctttgagaaagtatgctatcaaagtgtaggctaggatctaatttcgcagaaattttggtgtttgaatcaggatatatattggtttaaaccatttatcatgcaaattttgtttagtttgctttcgtttggcgcttatgacattagaaacatgactgatatggagctttatttgttcctagtatcaagtgcttgcctattttatgttattaaaagtacccttttcattaggtatttcatgccatgttgagatttttatttgatcctagtgggttttagaagtccattcgacttggttagacaaatgattgcttgatcaagtggggacatgttgctattagcaccttgaaaagaattcaatta

SEQ ID NO: 6792 - DNA, 701 bp, Solanum tuberosum
atcaggcagaggacgagacagaacgcagaaagctgcgaattagggtttctgagtttcaacattgccaggactcaggagagagtgacacgttatggcaaggatcaaagttcacgagctgaggaacaagtccaagactgagcttttggctcagctgaaggacctgaaagcagaactgtctcttctccgcgttgccaaagtcactggcggtgcccccaacaagctctcaaagataaaggtagttagattgtcaatagcacaggtgttgacggttatatcgcagaagcagaagttggcacttagggaagcatacaagaacaagaagtatttgcctctggatcttcgtcccaagaaaaccagagctattcgtaaacgtcttactaagcaccaggcatctttgaagaccgaaagagagaagaaaaaagaaatgtactttccacttagaaagtatgccattaaggtttgaattcatccaacttattgttactatgatattagcactttctccatgcaattgtcatgtagcaggttggatggatgagttcatgaattaggtgtataatcttttccttttcattgaaattggaatgaagattatgatgtaacatctcactcatgaagagttttgaaacaactggcttttatcagatgctgaaaagaatgggtcaaaaataaacaattgcttcgaaatgtatcatgttttt

SEQ ID NO: 6793 - DNA, 644 bp, Rosa hybrid cultivar
ggcagccgcgtttctgggttcactctctccttcatccccttcttctttcaaagagaaacagacaccacagccatggcgaggatcaaggtccacgagctcaggaacaagtccaaggcagatcttttgggtcagctcaaggatctgaaggcggagctcgctcttctccgagtcgccaaggtcactggtggagcccccaacaagctctccaaaatcaaggtggtgaggctttcaatagctcaggtgctgacagtgatttcccagaagcaaaaggcggctcttagggaagtttacaagaacaagaagcttcttcctcttgatttgcgtccaaagaagaccagggctatcaggagacgtctgactaagcaccaggcatctttaaagacagagagggagaagaagagagagatgtacttcccactaaggaagtacgcaatcaaggcataatgttggatccacttatgaaggacatcaggacttttacctactatatgatattcccaggacatgtgtttaaagtatttagccattttcgtaattgtatcggcgtaggcagtacccccaatatgacttcactggtccagaattataatgctgattgtgtttccattttgtgcttaatgatttgcaatcggattttttttatt

SEQ ID NO: 6794 - DNA, 541 bp, Salvia sclarea
ctactagaccttggctgtcactcagaaatggcgagaattaaggtgcacgagttgaggcagaagaacaaggttgatctgctggcgcagctgaaggatttgaaggcggagcttgcactgttgcgggtggcgaaggtgactggcggtgcccccaacaagctgtcgaagatcaaggttgtgaggctgtcgattgcgcaggtgctcactgtcatttcgcagaagcagaaatccgctcttagagaggcatacaagaacaagaagtatttgccgctcgatctccgccctaagaagacccgcgccatccgacgccgtctaacaaaacaccaggcttctttgaagacggagaagcagaaaaagaaagagatgtatttccccttgagaaagtacgccattaaagtttaacttacctagtttcggaagagcatttttgttactgattggaagatatttgctgctgctttatcaattgttagaatttgtggtttagtttacaagtagtttgtgatgtttaaacatgaatttgaagtactattattttcctata

SEQ ID NO: 6795 - DNA, 743 bp, Sarracenia psittacina
tcgtcgtatagtctcaagcagacgcactgatcgaagagctgccctgaaccgtttctttcggtcattgctatggcgagggttaaggttcatgagctgaggcagaagtcgaaggcagagttgttggcccaattgaaggatctgaaggcggagctcgcccttctccgtgtcgccaaggtcaccggcggtgcccccaacaagctctccaagataaaagtggtgaggttgtcaattgcccaggttttgacagtgatttcacagaaacagaaatctgctctgagagaagcctacaagaacaagaagtacttgccacttgatctgcgtcccaagaaaaccagggccatacgtagacgtctcaccaagcatcaggcatcattaaagactgaaagggagaagaaaagggagatgtactttccattgaggaagtatgctattaaggtgtagggtaagatttattatggagtagattttggtgctcaatatccataatattgttccaaggataaaccttttttgagttgtgttgcatgttatcttaatttcgctgaaccaatggttccgtgttttttttttaatttgagaagttttgcttcatgatcgccggattttttgatactgtgatggtggggtttgtgcttgtttgttaatgcacagatggtttacaggggtgttttcatttctctgcccggtctctcgctatctttgctatttgaattaacacttccacaactactactatgacatta

SEQ ID NO: 6796 - DNA, 680 bp, Sarracenia psittacina
gtatagtctcaagcagacgcactgatcgaagagctgccctgaactgtttctttcggtcattgctatggcgagggttaaggttcatgagctgaggcagaagtcgaaggcagagttgttggcccaattgaaggatctgaaggcggagctcgcccttctccgtgtcgctaaggtcaccggcggtgcccccaacaagctctccaagataaaagtggtgaggttgtcaattgcccaggttttgacagtgatttcacagaaacagaaatctgctctgagagaagcctacaagaacaagaagtacttgccacttgatctgcgtcccaagaaaaccagggccatccgtagacgtctcaccaagcatcaggcatcattaaagactgaaagggagaagaaaagggagatgtactttccactgaggaagtatgctattaaggtgtagggtaagatttattatggagtagattttggtgctcaatatccataatattgttccaaggataaaccttttttgagttgtgttgcatgttatcttaatttcgccgaaccgatggttccgtgtttttttttttaatttgagaagttttgcttcatgatcgccggattttttgatactgtgatggtggggtttgtgctttgtttgttaatgcacagatggtttacaggggtgtttttcattttctctg

SEQ ID NO: 6797 - DNA, 478 bp, Scabiosa columbaria
ctactagaccttggctgtcactcaagtagagtttttccttgcatttttcagagttgaagcggagagcgagaaactcagacgccatggcaaggattaaggttcatgagctgaggcagaaatcaaagtctgatcttttagctcagttgaaggatctgaaagcagaacttgctctgctccgtgtcgctaaggtcaccggcggtgctcctaacaagctctccaagataaaggtagtgaggttgtcaattgctcaggttcttaccgttattcagcagacgcaaaaggcagcattgagagaagtgtacaagaacaagaagtacatgcctcttgatcttcgtcctaagaagacccgtgcaatccgcaagcgccttaccaagcaccaggcatctttgaagactgaaagagagaagaagaaagagatgtactttccaatgaggaagtatgctattaaggtttaagttctattgttgtcaattttatg

SEQ ID NO: 6798 - DNA, 610 bp, Scabiosa columbaria
tttagggtttgcgaagctctctaataagaacgagtgaaccactagggtttcttcctccgcattttttcagagtttgagcagagcgcgagagagagagagagagaaagagagacgccatggcaaggattaaggttcatgagttgaggcagaaatcaaagtccgatctcttagctcagttgaaggatctgaaagcagaacttgctcttctccgtgtcgctaaggtcaccggcggtgctccgaacaagctctcaaagatcaaggttgtgaggttgtccattgcacaggtgctaaccgttattcagcagacacagaaggcagcattgagggaagtttacaagaacaagaagtatatgcctcttgatcttcgtcctaagaagacccgtgccatccgtaagcgccttaccaagcaccaggcctctttgaagacagagagggagaagaaaaaggagatgtactttccaatgaggaagtatgctattaaggtttaatggtatgagctttgttcagtttattgtttttggtattagtttgattcaacttcaaatggtttttggctttagactgtttctgaattatattattagtaagcactgctatatgtatgatcaaa

SEQ ID NO: 6799 - DNA, 694 bp, Silene vulgaris
ttcccatctctccaatctccgccgatcgcacccctttccgcagaaatggcaagaatcaaggttcatgagctaagggagaaatcaaagccagatttattggatcagcttaaggatcttaaggctgaattagctcttcttcgtgttgctaaggttactggtggtgcacccaacaaactctccaaaatcaaggtggtgagattgggaattgctcaagtattgacagtcatatcacagaagcaaaaggctgctttgagggaggcttacaagaacaagaagtacttgccccttgaccttcgccccaagaagactcgtgccattcgccgccgtctcaccaagcaccaggcatcattgaagaccgagagggaaaagaagaaagaaaggtactttcccatgaggaagtacgcgattaaggtttaagttagatcaagtcttgtgctttgaagattttgtatgtttcagtttcgaaatactattaaggtttagctccaagttgtggaccaatttagaagctttttctggttgcgagttttagaatatggatgatgagaatttaaggatttttgttcgaaatctatgattataatttcatggtggatttgtcttaacttgtttgtatcgagttatctacatgatggtaggcatcacaaatctttttacataaagattaaagcaaaagactccatataataaccat

SEQ ID NO: 6800 - DNA, 650 bp, Solanum phureja
atattccatttagggtttcagaatcaacactcacgagccgccgccgccgcctctgtagctatctccaccaacatcaacaatggccagaatcaaggttcatgagctgaggaacaagtcgaagcctgatctactgactcagttgaaggatttgaaggcagagcttgctcttcttcgtgttgccaaggtcactggtggtgctcctaacaagctctccaaaatcaaggtggtaaggttgtctattgcccaggttctgactgtaatttcacagaagcaaaaggctgctcttagggaagtttacaagaacaagaaatacctgcctcttgacctgcgcccaaagaaaactagggccatccgcaaacgtttgaccaagcaccaggcgtctttgaagacggagagggagaagaagaaggagatgtacttccctttgagaaagtatgctatcaaagtgtaggctaggatctaatttcgcagaaattttggtgtttgaatcaggatatatattggtttaaaccatttatcatgcaaattttgtttagtttgcttttgtttggcacttgtgacattagaaacatgactaatatggagctttatttgttcctagtatcaagtgcttgcctattttatgttattaaaagtacctttttcattag

SEQ ID NO: 6801 - DNA, 699 bp, Solanum phureja
tgccgcgaattagggtttctgagtttcaacattgccaggagagagtgagacgccatggcaaggatcaaagttcacgagctgaggaacaagtccaagactgagcttttggctcagctgaaggacctgaaagcagagctgtctcttctccgcgttgccaaagtcactggcggtgcccccaacaagctctcaaagataaaggtagttagattgtcaatagcacaggtgttgacggttatttcgcagaagcaaaagttggcactgagggaagcatacaagaacaagaaatatttgcctctcgatctccgtcccaaaaaaaccagagctattcgcaaacgtcttactaagcaccaggcatctttgaagaccgaaagagagaagaaaaaagaaatgtactttccacttagaaagtatgccattaaggtttgaattcatccaacttattgttactatgatattagcactttctccatgcaattgtcatgtagcaggttggatggatgagttcatgaattaggtgtataatcttttccttttcattgaaattggaatgaagattatgatgtaacatctcactcatgaagagttttgaaacaactggcttttatcagatgttgaaaagaattggtcaaaaataaacaattgcttccgaaatgtatcatgtttttctcattttgtttttgtgtaagaaattcacatacc

SEQ ID NO: 6802 - DNA, 1001 bp, Fragaria vesca
ccaggtgctgtttctttatctcgatcaggtaccgaaattctgattgataatttagggaggcgaaggtcgtgagagattttaatctagaaacctcaagagcgagcggaaaaaatctggcatcagcattttatatcagtcattcggttcaaatgggccatatccccaaagcccaaatcagcccaggacttgaactctcactcgccacgtgtattataacccaaatcccagattagggttttagcagaaaggagatattaaaaccgcagccgagagcgcttcagagagacactgataaccgcaggctgcgatggcgaggatcaaggtgcacgagctgaggaacaagtccaaggcagatcttttgggccagctcaaggatctcaaggcggagctcgctcttctccgagtcgccaaggtcactggtggagcccccaacaagctctccaaaatcaaggttgtgaggctttcaattgctcaggtgttgacagtgatttcccagaagcagaaggcggctcttagggaagtttacaagaacaagaagcttcttcctcttgatttgcgtccgaagaagaccagggccatcaggaggcgtctgactaagcaccaggcatctttaaagaccgagagggagaagaaaagagagatgtacttcccactaaggaagtacgcaatcaaggcatgatgtcggatccacgtatgaaaagcatcagaactttcacctactatatgatattgccaggatctgagtttacagtttttagccattttcataattttaacagtgtaaacagtatccccaatatgaccttactattcgagaattgtaatgctgattttgattccatttcttgtttattgatccgattttgtttattcagttgtcgaatcatcaccgttctcctgtctttgtgtgagaattgtgtctcatattactgcttaacacaacagtaagagctataaagccaaactcggtgttagaaaacagacatggcttgttttctgtc

SEQ ID NO: 6803 - DNA, 1038 bp, Nicotiana tabacum
ttgaacatctagggttttcagaattctcttcggtggggagaaagagtgagactcggagagaaacgccatggcaaggatcaaagttcacgaactgaggcagaaatcaaagactgagctttcggctcagttgaaggatttaaaagcagaactcgctctactccgtgtcgctaaagtcaccggtggtgctcccaacaagctctctaaaataaaggtggtgaggctgtcgatagcgcaggttttgactgtgatatcacagaagcagaaaacggcactacgggaagcatacaagaacaagaagtacttgccactggaccttcgtcccaagaagaccagagccatccgtagacgtcttacaaagcaccaggcatccttgaagacagaaagggagaagaagaaagagatgtactttccattgagaaagtatgccatcaaggtttaagtatccaaatccaacttagatagtcattgtgatgttagaactggcagagcacagccgtgtaacattgttccgcactgggtggttatattttttttcattcccgttattgcattatgacgcgaaatttttcgtttgtttcgtttttcctaatgtgttcctggtcagagaaggttcaatttttagtagtaaccttcaagcctagttatctgtcttcatgcatgtgatatgttttaccagatttaattcaccactttgccgagcttttgttcagcatcaaggtgatgaggcgtgcatctcaccaccacttagggctgtgcaaggatcggatcggatttagcacatttcgggttcggatttcggattctagaaaatgcaatccgaatccgatccgaattatatcagatcggattttaaagtttggctcgcatcggatctcggaccgtcttattatgtctcaaagttaaactaatatgtatattttctttgtaaaagaggcaatacattaagaaaaattcatgtttatgcaaaaaaaaaataatctaacccatgttgcttattgatggaatttagtgaaggaacttacattaattctgtacatg

SEQ ID NO: 6804 - DNA, 693 bp, Solanum lycopersicum
ctctttattccatttagggtttcagaatccacattcacgagccgccgccgccgcctcagtagtactctccgccaacatcaacaatggccagaatcaaggttcatgaactgaggaacaagtcgaagcctgatctattgactcagttgaaggatttgaaggcagagcttgctcttcttcgtgttgcgaaggtcactggtggtgctcctaacaagctctccaaaatcaaggtggtaaggttgtctattgcccaggttctgactgttatttcacagaagcaaaaggctgctcttagggaagtttacaagaacaagaaatacctgcctcttgacctgcgcccaaagaaaactagggccatccgcaagcgtttgaccaagcaccaggcttccttgaagacggagagagagaagaagaaggagatgtacttccctttgagaaagtatgctatcaaagtgtaggctaggatctaatttcgcagaaattttggtgtttgaatcaggatatatattggtttaaaccatttatcatgcaaattttgtttagtttgctttcgtttggcgcttatgacattagaaacatgactgatatggagctttatttgttcctagtatcaagtgtttgcctattttatgttatttaaagtacctttttcattaggtatcttgtgccatgtttgaggtttttatttgatcctag

SEQ ID NO: 6805 - DNA, 566 bp, Trigonella foenum-graecum
gaaacaaaccataacaaagttacactctccttcgtgttttctcgcggcgattcaagttcttcgaaatggctagaatcaaggtgtatgagctcaggcaaaaaacaaaagcagatcttctcaatcaattgaaggatctgaaagctgaacttgctctccttcgcgttgcgaaggtcaccggcggtgccccaaataagctctctaagatcaaagttgttcggcttaacatagcgcaggttttgaccgtgatttcacagaagcaaaagacagcattgagggaagcttataagaacaagaaataccttcctttggatctgcgtccaaaaaagacaagagctattaggagacgcctcactaagcatcagtcttctttgaagacagagcgtgagaagaagaaggaaatctacttcccactgagaaaatatgcaattaaggcgtaatgttgtaccctttgtgcatgacttcgatttgttgttcgacaattttaaaaaaatattcggtgttgggttctgtttttgtttcctttgaagtttaactaatcgtgaaatggaattataagtacactgttc

SEQ ID NO: 6806 - DNA, 620 bp, Cichorium intybus
acgggagtctgggacacgtaaaaactccataaaccctattggttatcgttctcttagcttgtggttgcagaggcggctatctcttcactcgatcggatccatggcgaggatcaaagttcatgagcttaggaacaaaggcaaaccagagttgttggctcaattgaaggacctcaaagccgagctcgctcttcttcgtgtagccaaagttaccggcggtgctcctaacaaactatccaaaataaaggttgtacggacatccattgcacaggttttaacagtgatgtcacagaaacaaaagtcagctttaagggaagtgtacaagaacaaaaaatacttgcctcttgatttgcgtcccaaaaaactagggctattcgcaggcgtctaactaagcaccaggtatcattgaaaacggaaagagagaaaaagaaagagaagtatttcccattgaggaagtatgctataaaggcttagaggggaaaatattataaaagttgttattatcttcttgattattgcagttgatcaattaggtgggattttgtaagctcaatgataattgaaagatgcttaaattggtattacgaaatattatacggtttaaataatttgtcgttttcaag

SEQ ID NO: 6807 - DNA, 2026 bp, Cocos nucifera
aaaacaagcagcccagtccatacccctgcgctatgccttgattgcatactttcgcattggaaaatacatctccttcttcttttgtcgttctgtcttcaacgatgcctggtgcttggtgaggcggcggcggatggcgcgggtcttcttggggcggaggtcgagggggatgtacttcttgttcttgtaggcctccctgagcgcagccttctgcttctgcgagatgacggtgagcaccctagcgatcgacagccgaaccaccttgatcttcgacagcttgttgggggcgccgccggtgaccttcgccacccggagaagcgacagctccgccttcaggtccttcagctggttcagcagctctgccttcgactccccccgcaactcgtgcaccttgatgcgagccattctcgtctccttctcccgtcgccctcgccctcgccctcgccctcgcccgtgccaaaccctatgagtattctcatcggtgctgctaccacccctagccgccttccgccgcccaacagtttccctataattagcagcgcaggcacaacatcccagccacggtcccagcaccccccggtccacccgtataaattattctcaccgctcgctctccttaaaaccccctatctcaggtcccgactggaaacttccgaacggacttggtggaagacaagaaacggaagtaagaagccctccttctttttaacccggcctcctctgttatcgaaaatggcggagggaaaggagaagggaagggacatggaggaggccggcggcgccggcgaggggtggattaggatggggggaatggtggtggaggaactgcgggagctgtgggggttggcgctgccgatcaccgccatgaactgcgtggtgtacctccgggccatggtctccgttctctgccttggccgactcggccgcctcgagctcgccggcggcgccctctccatcgggttcaccaacataaccggctactccgtcctcgtgggcctcgcctcctgtctggagcccctctgctcccaggcctacggttcccgcaactgggactttctgtctctctcgctgcagcgcgccatcctgctcctcctcctcgcggccgtccccatctccttcctctggatccatctcgggcccatcatggtaactctgggccaggacccggccatcaccgccgtcgcctcgtcgtactgcctctactcactcccggacctcgtcaccaacgccttcctgcagccgctccgcgtgttcctacggtcgcagggggtgacgcggccgatggcggcgtgctcggcgctggcggtggcgctccacgtgccgctgagcgcgttgctggcgttcgggctggggctgggggtccccggggtggcgctggcggcggcgacgacgaacctgaacatggcggtgttcttgctggtgtatctccggaggcggcgggtctgcgagctgacctggcgggggtggtcgcgggaagcgctgaggggactgtcgccggtgctccgcctggcgctgccgagctgcgcgggggtctgcctcgagtggtggtggtacgagatcatgaccgtgctcgccggctacctgccggaccccacctccgccgtcggcgccaccgcagtcctcatccagaccaccagcctcatgtacaccgtccccatggcactcgccggctgcgtctccactcgggtgcgtcaaaagtcgtgcctccctccttccctcccgcagcatacggtgctcccgcgggggcatctcaccgtccaacggcatcgtgtcatcacacaccatgtccatacatattatagcatgcgtcccccccccccccccccccccccccccccccccccccccccccccccccccaatattaagcctcctcaagcctcctcctagccttcgtggcccacccagtcgcatcatgccacgtagtcattgtaccatccctagctaactagcagatctcatcatcacctccaacttcacactcactgttccattggcatcgattcccaccttcatctttagcattcca

SEQ ID NO: 6808 - DNA, 2193 bp, Echinacea purpurea
cggccgggggcagcaacaaacaaacgacaagtgattttaacagcccagtatgaaatagcgtgggttcacaccatagagcgggatgagcggttgtaacgttttacaacgacccgtgaaatcttaaaacaatctctgtcttctttctcgccggcgacgatcggccaccatggcgacaaggttaccatacgccgatgtcgattcaagcttgcgagccatggccaacggggctgagggattcggccgttgtgctatcggcggctttaatggtcctgtgcatcacgtcacttctttagccgatgaagggccaggatcacttcgtgaagcatgtcgtaggacagaaccattgtggatagtgtttgaaacatccggcacaattcatctatcgtcctacttgaatgtttcatcaaataaaacgattgatggccgaggtcaacgtataaaacttactggaaaaggtttaaggttgaaagaatgtcaacatataattatatgcaatctggagtttgaaggtggtagaggacatgatgttgacggtattcagattaaaccgaactcacaacacatttggattgatcgttgcagcctgcgcgactacgatgatggacttatagatataactagacaaagcacagatatcacaatttccagatgctacttttcggggcatgataagacgatgcttattggagctgatccgacccatattggtgatagatgtattagagtgaccattcatcattgttttttcgatgggacgagacaaagacatcctcgtcttcggtttgggaaagttcatctttataataactacactagaaactggggagtgtatgctatatgcgctagcgttgaagcacagatatactctcaatgtaacatctatgaagcaggacacaagaaaaaggctttcgagttttataccgaaaaggcagcagataaggaagaagctagatcaggcttgatagtatccgaaggcgacttgctcttaaacgaagctcaaccgtgtccattgaaagaaaccgttggcgaagacatgtttcatccttgtgagttttacccgaagtggacaatagaacccgcttcagattcgctaaaacagattctgcaggtctgcactggttggcagtctgttgcgagaccagctgatatgtctgcaagatctgattcataaattatgttttgctttctgtagttattatttgttgatgataaatatgaattcatttataaaatttctgcaagttcaataaaaaataagtatccatctttctgtgaaactagtgaatgtatgtattataactgtgagatacatattgcttctacttcttttcgtgtgtcaagctacaatcactatcggcacgcactataaaacccatatgcataatcgtcgtgtgcagctatagatcgtgttgaatttgaaaatcatggacttcaacgatttagcagaactcattaaaaaaccaaacaatgccaaatagcaaatgtttgtattattgtgtctatgcatcagcgtgagcaagacatattaaacgacggaaaagtgcacttcgagaaagtgtgattcggtaaacgccaagcagcctactcatcaaagttcaaaactgtaaaattatcttcgaacaatcaaatcaaacataaaagagcaacggtttagcgtcaaatgtcttgcaattcatgaaaccaaactaacaaacacatatttctgataaaaatttgaagtccaaaactggaaagcgatttgaaaacctagatttcgtacttgttcaacttatgccttgatagcatacttccttaatggaaagtacttctctttcttcttctctctttcggtcttcaacgaagcctgatgcttggttagacgtcttcggatggctctggttttcttcggacgcaaatcaaggggcaagtacttcttattcttgtaagcttccctaagagcagccttctgagtctgtgaaatcacagtcaacacttgagcaatccctgttctcaccacttttatcttcgaaagcttgttcggagcaccaccggtaactttcgcgacacgaagaagagcaagctcagccttcagatctttcaactgagcaaacaaatcagccttcgtcttgttcctgagctcatgaaccttgatacgagccattgattcaagctggatgaactgcgatgaaggtcggcttgaaagtttgaaaccct

SEQ ID NO: 6809 - DNA, 669 bp, Panax ginseng
gtcgtctcatttctatttagggtttcagaagcaattgcaagcagcccctccgtggtttttgcttcagtcaaaggacagcaatggcgaggattaaggttcatgagctgaggggtaaatcaaagacggatttgttgacccagctgaaggaactaaaggctgagctcgctctcctccgtgttgccaaggtcaccggcggcgctcctaacaagctctccaaaataaagttgtgaggctgtcaattgcgcaggtgttgactgtcatgcaacagaaacagaaagctgctttgagggaagtgtacaagaacaagaaactactgccgcttgatttgcgtcccaagaaaactagagctatccgcaggcgtcttaccaagcaccaggcttcattgaagactgaacgtgagaagaagaaagagaagtacttcccaatgagaaagtatgctattaaggtgtagggtagaatctactgtggaggagatttgttactttgtgactacaaacctcattccaattttgaattctgaaattttgttttccattgtcctgtattgctgatcctagttcaagtgttactttattgtggttgtttactctttgtttcatgtgctagaaactattcatatcaagccctagttcaggtttactttatggtggtgtttactcttgttttaat

SEQ ID NO: 6810 - DNA, 469 bp, Panax ginseng
agggtttcagaagcaagtgcaagcagcccctccgtggtttttgcttcagtcaaaggacagcaatggcgaggattaaggttcatgagctgaggggtaaatcaaagacggatttgttgacccagctgaaggaactaaaggctgagctcgctctcctccgtgttgccaaggtcaccggcggcgctcctaacaagctctccaaaataaagttgtgaggctgtcaattgcgcaggtgttgactgtcatgcaacagaaacagaaagctgctttgagggaagtgtacaagaacaagaaactactgccgcttgatttgcgtcccaagaaaactagagctatccgcaggcgtcttaccaagcaccaggcttcattgaagactgaacgtgagaagaagaaagagaagtacttcccaatgagaaagtatgctattaaggtgtagggtagaatctactgtggaggagatttgttactttgt

SEQ ID NO: 6811 - DNA, 493 bp, Avena sativa
ctagaccagctcgccagcagcaatggcccggatcaaggtgcacgagctgaggggaagaacaaggcggatctgcagggccagctcaaggacctcaaggcggagctgtccctcctccgcgtcgccaaggtcaccggcggcgcccccaataagctctccaagatcaaggtggtgcgcacctcaattgcgagggtgctcacggtgatctcgcagaagcagaaggcggcgttgagggaggcgtacaagaacaagcgtctcccgctcgacctgcgccccaagaagacccgcgccatccgcaggcgtctcaccaagcaccagctctctttgaagacggagagggagaagaagcgcgagaagtacttccccatgaggaagtatgctatcaaggcctaggttaggaggacatgtttaccggccgagttttgctcagaagttgcatgaattttatgttctgtgtggacaccgctgctatctaagtactatgtattcgatatcc

SEQ ID NO: 6812 - DNA, 801 bp, Secale cereale
ccgccagcagaccagctcgccagccgcaatggcccggatcaaggtgcacgagctgagggggaagagcaagacggacctgcagggccagctcaaggacctcaaggcggagctgtccctcctccgcgtcgccaaggtcaccggcggcgcccccaacaagctctccaagatcaaggtggtgcgcacctcgattgcgagggtgctcacggttaatctcgcagaagcagaagtcggcgctgagggaggcgtacaagaacaagaagctgctcccgcttgacctccgccccaagaagacccgcgccatccgcaggcgtctcaccaagcaccagctctctttgaagaccgagagggagaagaagcgtgagaagtacttccccatgaggaagtatgctatcaaggcctaggttaggagcacatgttttaccggtcgagttttgcccagaagttgcatgaattttatgttctgtgtggacaccgctgctatctaagtacaatgtattggatctcctgcattaagtaccagcttttgcttattgtcactattatctggttacagctgcttgttggtgttgcaatggatggttatcgtaccttgtcagtttacagtttatctgattgtgagtttccatcggtgaaggatgcttgttgttctgcatgttagtttgttttcagatagtggtcttcgtaactcccatctgctttccatatatcacaaatttgtaattgtttgcgttaaaactatggaaaatatataagcaagtttagaaaaaaaaacaaaaaaaaaaaaacaaaaaaaaaaaaaaa

SEQ ID NO: 6813 - DNA, 512 bp, Flaveria ramosissima
gcgaatcaaggttcatgagcttaggaacaaatcgaaggctgatttgttcgctcagttgaaggatctcaaggcggaacttgctcttcttcgtgttgcgaaagtcaccggtggtgctcccaacaagctttccaaaataaagttgtgaggacctcaattgctcaggtgctgactgtgatttcacagactcagaaggctgctcttagggaagcttacaagaacaagaagtacttgccactcgacttgcgcccaaagaaaaccagagccatccgaagacgtcttaccaagcatcaggcttcgttgaagaccgaaagagagaagaagaaagagaagtacttcccattaaggaagtatgctattaaggcataaggtagaaaaccatcaaggaggagatttaggtgttcgaatcactttcaagtttggacttaaattcatcagaaatgtgtttgttagtttgtttgcaatgagttataagacattctacattggatcttgctcttttttgttcgacttgt

SEQ ID NO: 6814 - DNA, 518 bp, Flaveria ramosissima
cgaatcaaggttcatgagcttaggaacaaatcgaaggctgatttgttcgctcagttgaaggatctcaaggcggaacttgctcttcttcgtgttgcgaaagtcaccggtggtgctcccaacaagctttccaaaataaagttgtgaggacctcaattgctcaggtgctgactgtgatttcgcagacccagaaggctgctcttagggaagcctacaagaacaagaagtacttgccactcgacttgcgcccaaagaaaaccagagccatccgaagacgtcttaccaagcatcaggcttcgttgaagaccgaaagagagaagaagaaagagaagtacttcccattaaggaagtatgctattaaggcataaggtgaaaaccaacaaggaggagatttaggtgtttaaatcactttcaagttttggacttaaattcatcagaaatgtgtttgttagtttgtttgcaatgagttataaagacattctacattggaatcttgctcttttttgttcgacttgtttttt

SEQ ID NO: 6815 - DNA, 861 bp, Hordeum vulgare
gcccgccgccgccgccgcagcagatcagcccgccaacagcaatggcccggatcaaggtgcacgagctgagggggaagaacaagacggagctgcagggccagctcaaggacctcaaggcggagctttccctcctccgcgtcgccaaggtcaccggcggagcccccaacaagctctccaagatcaaggtggtgcgcacttcgattgcgagggtgctcacggtgatctcacagaagcagaaggcggcgctgagggaggcgtacaagaacaagaagcttctaccgctcgacctccgccccaagaagacccgcgccatccgcaggcgtctcaccaagcatcagctctcattgaagaccgagagggagaagaagcgtgagaagtacttccccatgaggaagtatgctatcaaggcctaggttattaggagcacatgttttaccggccgagttttgcccagaagttgcatgaattttatgtttgtgtggactcccctgctatctaagtacaatgtattcagtatcctgcttgaaattcgaacttttgcttattgacactatgttctggttatagctgcttgttggtgttgcagtatgatggttattgtactttgttagtttccagtacatctgattgtggaagtagatgcttgttgatgttgcagtgatggttatggtgctggtttgcagttccatctgattgtggaagtaagccatttagtgttcatcgttgctggatgctttatgttcttcattagttttctgatagtggttctaggtagtttaaatcttctctggccatcagcttgctatataacgaaggtttgtgttagggaagaactagtggcataagtgcttctggagatat

SEQ ID NO: 6816 - DNA, 554 bp, Rosmarinus officinalis
cggccgggggaatcctcttgaactttaactagggtttcagagcaaaggtcggcagctcccaatcgaagcgaagcgatggcgagaattaaggttcatgagttgaggaacaagacaaagcaagatttgcttgctcagctaaaggatctgaaggcggagctcgcccttctccgtgtcgccaaggtcaccggtggcgctcctaacaagctctccaagatcaaggtagtgaggttgtccattgcccaggttttgactgttatctcacaaaagcagaagtctgctttgagggaagcctacaagaacaagaagcttttgcccctagacctgcgccctaagaaaaccagagccatccgtagacgtctgactaagcaccaggcttctttgaagactgagcgacagaagaagaaggagatgtacttccccatgaggaagtatgctattaaagtttagggtaggacccttttgttgttgaagttttggtgtttaaatcaaaatatatggcatcaaaccttgagttaatagaattttgttattggatatgatttgatattaatgac

SEQ ID NO: 6817 - DNA, 660 bp, Rosmarinus officinalis
cggccgggggaggcgcatttcagtcctttctgctcatcccgcaaaccctacattccaacaggaggaagacgaaattcgagatggcgaggattaaggttcacgagctgaggcagaagaacaaggtggaactgctggcgcagctgaaggatctgaaggcggagctggctttgctacgggttgcaaaggttactggaggagctcccaacaagctgtcgaagatcaaggtggttaggctgtcgattgcgcaggtgctgaccgtgatttctcagaagcagaagtcggcgctgcgagaagcgtacaagaacaagaagtacttgccgctcgatctccgccctaagaagactcgcgccatccgccgccgcctcaccaaacaccaggcatctttgaagacagaaaagcagaagaagaaagagatgtatttccctctaagaaaatatgctatcaaagtttaaattagcttttgatttaagcaattttgtttctgttgcctgagcttaaggataacaatattttctttaatgaactctttagatttgcaattcagtggtgttgttgagacatgaaatccgagtaccatcatcccatttttacgcatttgacattattatcttgtttgtgtgttggaatgggcaatagcctttctagatatgcgtttgtaag

SEQ ID NO: 6818 - DNA, 616 bp, Malus domestica
ttctagggtgacacttcccgtctccaccttcttcgtccaaagcgagcaacaccgactgcagcagcaatggcgaggattaaggtccatgaacttaggcacaaaaccaaggcagatcttttggctcagctgaaggatctgaaggcagagctcgctcttctccgggtcgccaaggtcaccggtggagcccccaacaaactctccaaaatcaaggtggtgaggctttcgatcgctcaggtgttgacagtgatgtcccagaagcaaaaggcggctcttagagaagtctacaggaacaagaagctccttcccctcgatttgcgtcccaagaagaccagggccatcaggaggcgtctcaccaagcaccaggcatctttgaagacagaaagggagaagaaaaaggagatgtactacccatcgaggaagtacgcaatcaaggcatgattatggatccagatttgaagggaattgagagtttcacccgttatatggtattccaaggacatcagtttaaaatgttgaactctttccgtaattttatctacgtacgtaggcgccatcccaaagatgattttgttgatccagaattttaatgctgattttcatttcgtttattgtttga

SEQ ID NO: 6819 - DNA, 650 bp, Malus domestica
caaattagggttttagaattaaaaccgaacccaagttctagggttacactctcgtctcaacctccttcttccaaagcgagcaacacagaccgcagcaatggcgagaatcaaggtccatgagctcaggcacaaaaccaaggctgatcttttggctcagctgaaggatctgaaggcagagctcgctcttctccgagtcgccaaggtcaccggcggagcccccaacaagctctccaaaatcaaggtggtgaggctgtcaatcgcccaggtgttgacggtgatgtctcagaagcagaaggctgctctcagagaagtgtacaggaataagaagcttttgcctcttgatctccgtcccaagaagaccagggccatccgccggaggctcaccaagcaccaggcatctttgaagacagaaagagagaagaaaaaggagatctactacccattgaggaagtacgcaatcaaggcataattacggatccagatttggagggaattaagcgtttcacccgttatatgatattccaaggacatcagtttaaaatgttgaaccctttccgtaatttatctatgtagacacttcccaaatatgattttgttaatccagaattttaacgctgattttgatttggtttatagtttgatttgctcta

SEQ ID NO: 6820 - DNA, 1098 bp, Hordeum vulgare
taggcccagaggccccaaagtccataatatcctagggtttcccctgtctcaggggtttcatcttgcgcatcccccgtatatataaccctcacgcagccggccccgtctctcctcagcgcctcattttcatctccgcccgccgccgccgccgcagcagatcagcccgccaacagcaatggcccggatcaaggtgcacgagctgagggggaagaacaagacggagctgcagggccagctcaaggacctcaaggcggagctttccctcctccgcgtcgccaaggtcaccggcggagcccccaacaagctctccaagatcaaggtggtgcgcacttcgattgcgagggtgctcacggtgatctcacagaagcagaaggcggcgctgagggaggcgtacaagaacaagaagcttctaccgctcgacctccgccccaagaagacccgcgccatccgcaggcgtctcaccaagcatcagctctcattgaagaccgagagggagaagaagcgtgagaagtacttccccatgaggaagtatgctatcaaggcctaggttattaggagcacatgttttaccggccgagttttgcccagaagttgcatgaattttatgtttgtgtggactcccctgctatctaagtacaatgtattcagtatcctgcttgaaattcgaacttttgcttattgacactatgttctggttatagctgcttgttggtgttgcagtatgatggttattgtactttgttagtttccagtacatctgattgtggaagtagatgcttgttgatgttgcagtgatggttatggtgctggtttgcagttccatctgattgtggaagtaagccatttagtgttcatcgttgctggatgctttatgttcttcattagttttctgatagtggttctaggtagtttaaatcttctctggccatcagcttgctatataacgaaggtttgtgttagggaagaactagtggcataagtgcttctggagatattcttgctacataacttcttttgttgaataaaatgtggttggcttaaacttcggaagatattctcgaagcccgtctggtattgcatttgcaaaacaaagttcca

SEQ ID NO: 6821 - DNA, 512 bp, Catharanthus roseus
tttcagaagcaagtgcaagcagcccctccgtggtttttgctttagtcaaaggacagcaatggcgaggattaaggttcatgagctgaggggtaaatcaaagacggatttgttgacccagctgaaggaactaaaggctgagctcgctctcctccgtgttgccaaggtcaccggcggcgctcctaacaagctctccaaaataaaagttgtgaggctgtcaattgcgcaggtgttgactgtcatgcaacagaaacagaaggctgctttgagggaagtgtacaagaacaagaaactactgccgcttgatttgcgtcccaagaaaactagagctatccgcaggcgtcttaccaagcaccaggcttcattgaagactgaacgtgagaagaagaaagagaagtacttcccaatgagaaagtatgctattaaggtgtagggtagaatctactgtggaggagatttgttacttggtgactacaaacctcattccaatcttgaattctgaaatttgttttcca

SEQ ID NO: 6822 - DNA, 611 bp, Centaurea maculosa
gcgatctcttcactcaatcggaagccatggcgaggatcaaagttcacgagctaaggaacaaaaacagaggagatttattaggtcaattgaaggatctcaaagctgagctcgctcttcttcgtgtagccaaggtcaccggtggtgctcctaacaaattatccaaaataaaggttgttagaacatcgatcgcccaggttttgaccgtgatgtcacaaaaacaaaaggcggcattaagagaagtttacaagaacaaaaagtacctgcctctcgatttacgtcccaagaaaacccgagccatccgaagacgtctaacaaagcaccaggcatcgttgaaaaccgaaagagagaagaagaaagagaagtatttcccattgaggaagtatgccatcaaggtttagaggtgcattattctctttttgagtatttgagttccatcaatttcgctagtatttgtaaacccgggattcactgtttttctgctttaatgatgatcgaaagatgcttaaatcgatggttgtgttttttttgaaccgtgttattaggctcgacccgttccgttcacaaatgagtttacgttgccactgatgtagttaaaacggtgtcttggtttg

SEQ ID NO: 6823 - DNA, 553 bp, Centaurea maculosa
ccctaatcacccctttactagacactctcaaaccttgtgatttttcagaggcggcgatctcttcactcaatcggaagccatggcgaggatcaaagttcatgagctaaggaacaaaaacagaggagatttattaggtcaattgaaggatttgaaagctgagctcgctcttcttcgtgttgccaaggtcaccggtggtgctcctaacaaattatccaaaataaaggttgttagaacatcgatcgcccaggttttgaccgtgatgtcacaaaaacaaaaggctgcactaagggaagtttacaagaacaaaaagtacttgcctctcgatttgcgtcccaagaaaacccgagccatccgaagacgtctgacaaagcaccaggcatcattgaaaaccgaaagagagaagaagaaagagaagtatttccctttgaggaagtatgccatcaaggtttagaggtgcattattatcttttttgagtatttgagttccatcaatttcgctaggatttgtaaacccggattcactgtttttctgctttaatgatgatcgaaagat

SEQ ID NO: 6824 - DNA, 883 bp, Citrus clementina
aattttagggttttcataaccatacgcataagcagaggaagccgccgttgcaggagcagagacaccaaacgtagcaatggctaggatcaaggtgcatgagctgaggcagaaatcgaaggtggatcttttgaaccagttgaaggaactcaaggctgagctcgccctccttcgcgttgctaaggtcaccggcggtgcccctaacaagctatccaagatcaaggtggtgaggttatcgatcgcacaagtgttgactgtcatttcacaaaagcagaaggctgcattgagggaggcatacaagaataagaagttcttgccccttgatctgcgtcccaagaagacccgggctatcaggagaaggcttaccaagcaccaggcttcactgaagaccgagcgggagaagaagagggagatgtactttcccatgaggaagtacgccattaaggtgtaggctagaatctttttctaggagtatcttggtatcttgcagttacgaacctattttgttgacaaatttttacttttgttaccttttcaaatatcatttttgttcacttaaatttgcttttgttcaatcttatgtgtgtaaaacttgaagggtgcatctcaacctaaacaagatgtgctagattgtgatggaatagcagtcaagataggatttctgttcttgagtgttcttatttatctacatttgttggtaaattctttgttttatttcttgctgggtaatgtagtgcattgcctttagaatgtcagtgattgtggaaaggatccctagtctgaaactcatctgtagtgcgattaggttttcatatttggtcaatttcttagcatgcttggtaattaattcccataaaatacaaccagataagccatctagttttca

SEQ ID NO: 6825 - DNA, 643 bp, Cucumis sativus
cttccatctcttctagggttccgccgactcgaagaccgcacgatacgaaatggcgaggatcaaggttcatgagttgaggcagaaatcgaaggcagatctcttgttgcagcttaaggatcttaaggctgagctttctctccttcgtgtcgccaaagttaccggcggtgctccgaacaagctatccaaaatcaaggtagtgagattgtcgatagctcaagtattgacagtaatttctcagaagcagaaggcggcgttgagggaagcttacaagaagaagaagcttttacctcttgatctgcgcccaaagaagaccagggccattcgtagaaggctcaccaagcaccaggcgtctttgaaaactgagagacagaagaagaaagaaatgtactttccattgaggaaatatgctattaaggtgtagtggtcagtattatatttggtagtccatttttatatgcaacatcaaaccagttttgttggcaagttttgtctcgtaatcttatgtcgaatactcttgaggtatttctccctaaaccaagatgtttcgttttcattgacgattatataattttgacagttaatagcctttttttcttgtttattgacttattctttttctgtccaaaaaaaacttgttccttta

SEQ ID NO: 6826 - DNA, 689 bp, Cucurbita pepo
tgtgctagttgcagacctccgccaaatcccaaaacaccacagccggtctctgcttatcagattctaatggcgagaattaaggttcacgagcttagacagaagtctaaggcggatcttttgacccagcttaaggaccttaaggcggagctttctctgctccgtgtagctaaggtcactggtggtgctcctaacaagctctccaaaattaaggttgtgaggttatcaatcgctcaggtgttgacagtgatttctcagaaacaaaaggcagctcttagggaagcttacaagaagaagaagcttttgcctcttgatttacgtcccaagaagaccagggccattcgtagaaggcttaccaagcaccaagcatctctaaagacagagcgagagaagaagaaagaaatgtattacccattgaggaagtacgctattaaggtgtaggcttagagggaattgatcgctcatccatggtaccatgcatcttctactcttttagcttttgatttatctataactttattgggacttgagtgcctattttcaatcttattgttagatctccgaactttgatgaagtctttccattttccatgtaatacttttgtttcccaagttctaatgaaatggttttggtaaatgtctttaggcagcctaatcttgaacatatctctttttgtgttcgtcgtttatat

SEQ ID NO: 6827 - DNA, 957 bp, Eucalyptus grandis
gaacgttcctatataaatgccctaacccccattacggccggagggtttcgcagtcgcaggagcaggaagcagagccgtcgccgatctgcgagaggatcacctccgatcacagcaatggcgaggatcaaggtgcacgagctgaggcagaaaacgaaggtcgaccttctgacccagctgaaggaactcaaggccgagctcgccctcctccgcgtcgccaaggtcaccggtggtgccccgaacaagctctccaagataaaggtggtgaggctgtcgattgcacaagtcttgactgtgatttcccagaaacaaaagtctgctttgagggaggtttacaagaagaagaagtacttgccccttgatctccgtcccaagaagaccagagctattcggagaaggcttacaaaataccaggtatctttgaagacagagcgtgagaaaaagaaagagatgtactttcccctgaggaagtatgccattaaggcgtagtagggataccgttcatgttgtgttggagcttcgcctcttacgaatcttttggtttgtcaaattttcgggttatcttgatcccgcatcatagtttggacgacaagaaatctagcttcggcgccttatttttttccccccatcgaggacaattgtcatttttcttgagtatgaattataactaggtttgaatccttaacaagtgatcttgatttgagaaggcgcgcgacatatatgaatttatgtgatggttttgtctgtcttacatctagacttacacaacacagtacacacatgatagaaaatgtccgtgtgatgttgggttatttcctcaacaaagaataggatgtaacgaaaccataggcaccacggccgtgattctggagatggtaagggtgtcgcctgttagttcagtgcgacacagctgttaatttaatgggctgtaaatctatggctttgctagtaaggtgtgca

SEQ ID NO: 6828 - DNA, 558 bp, Euphorbia peplus
gaaagcccgccgccgttgaaggatcggaaggaagaaatggctagaatcaaggtccacgagctgagacagaaaactaaggcggagttgttgaaccaattgaaggatctcaaggctgagttggctcttcttcgcgtggctaaggtcaccggaggagcccctaacaaactctccaagatcaaggtggtgaggttgtccattgcccaggtcttgacagttatctcacagaagcaaaagcttgcactgagggaagcatacaagaacaagaagttcttgcctcttgatcttcgtcctaagaagaccagagccatccgcaggaggcttactaaacaccagcaatcgttgaagaccgaacgtgagaagaagaaagagatgtacttcccaatgaggaagtatgcaattaaggtctaggttgtgatttccagagtaggctgttttaatgtccttcaattttaaacttattttgtttgacaagtttttgacatggattggggtttttctttttgtcatgaacatgaattttttatgtgggaaatgtatgctgcaagaatttacgttttt

SEQ ID NO: 6829 - DNA, 589 bp, Euphorbia peplus
agaacatcaatcagcagccgccgtcgagggatccggaggaaagaaatggcaagaatcaaagtgcacgagctccgacagaaaacgaaggcagaactgttgaaccagttgaaggatctcaaagctgagttagctcttctccgtgtcgccaaggtcaccggtggcgcccctaacaaactctccaagatcaaggtggtgaggttgtccatagctcaagtcttgacagttatctcacagaaacagaagctcgcattgagggaagcgtacaagaacaagaagttcttgccacttgatttgcgtcctaagaagaccagagccatccgccggaggcttacaaagcaccagcaatcattgaaaactgaacgtgagaagaagaaagaaatgtactttcccatgagaaagtatgcaatcaaggtctaggttattatttgcagagtagactttttttaatgtccttcaattatagaacctattttgttggcaagttttgacatggattatgttttttattgttgtggacaagatatttacgtgggaaatgtagctgcgaaatttatatttgtatctttttaaagctttgttatgatatcta

SEQ ID NO: 6830 - DNA, 648 bp, Euphorbia peplus
ggagatcccgccgccgtagaagatcggaatcagagaaatggctagaatcaaggtgcatgagctcaggcagaaaactaaggcagagcttttgaatcagctgaaggatctcaaggctgagctagctctccttagggtagctaaggtcaccggcggtgccccgaacaagctctccaagatcaaggtggtgaggttgtccattgcacaagtgttgacagttatctcacagaagcagaagcttgcattgagagaagcatacaagaacaagaagttcttgcctcttgatttgcgtcctaagaagaccagagccatccgcaggaggcttactaaacaccagcaatcattgaagaccgaacgcgagaagaagaaagaaatgtacttccccatgaggaagtatgcaattaaggtctaggcttttatttccagagtaggcttttttgatgtccttcagttataaacctattttgttgacaagttttgacatggatcatgtttttcttattatcgtgatcaagatttttatgtgggaaatgtagctgcaagagttgcgtttgtatctttttaaagctttattgtgttacctacctttttaacttgagcattggtctgtcacttatggtgatatctatggtaggacaatcattcggtttg

SEQ ID NO: 6831 - DNA, 553 bp, Flaveria ramosissima
tagtagctagggtttcaatctctcaagccgaccttcatcgcagttctcttcagcttcaatcaatggcgcgaatcaaggttcatgagcttaggaacaaatcgaaggctgatttgttcgctcagttgaaggatctcaaggcggaacttgctcttcttcgtgttgcgaaagtcaccggtggtgctcccaacaagctttccaaaataaaagttgtgaggacctcaattgctcaggtgctgactgtgatctcacagacccagaaggctgctctcagggaagcctacaagaacaagaagtacttgccacttgatttgcgcccaaagaaaaccagagccatccgcagacgtcttaccaagcatcaggcatcgttgaagaccgaaagagagaagaagaaagagaagtacttcccgttaaggaagtatgctattaaggcataaggcgaaaaccatcaaggaggagatttaggtgttcaaatcactttcaagttttggacttaaattcatcagaaatgtgtttgttagtttgtttgcaatgagttataagacattctacattg

SEQ ID NO: 6832 - DNA, 609 bp, Flaveria ramosissima
atagtacctagggtttcaatctctcaagccgaccttcatcgcagttctcttcagcttcaatcaatggcgcgaatcaaggttcatgagcttaggaacaaatcgaaggttgatttgttcgctcagttgaaggatctcaaggcggaacttgctcttcttcgtgttgcgaaagtcaccggtggtgctcccaacaagctttccaaaataaaagttgtgaggacctcaattgctcaggtgctgactgtgatttcacagacccagaaggctgctcttagggaagcctacaagaacaagaagtacttgccacttgacttgcgtccaaagaaaaccagagccatccgcagacgtcttaccaagcatcaggcttcgttgaagactgaaagagagaagaagaaagagaagtacttcccattaaggaagtatgctatcaaggcataaggtgaaaaccatcaaggaggagatttaggtgttcaaatcactttcaagttttggacttcaattcatcagaaatgtgtttgttagtttgtttgcaatgagttataagacattctacattggatcttgctcttttttgttgacttgtttttttgaatgcattttacagcttataac

SEQ ID NO: 6833 - DNA, 660 bp, Flaveria ramosissima
gtaaactctgcgttgtataccacctagcttaacgtacattggttagttcaaccgaccgagagtacgccgggggaccggttcctatcgcagttctctccagcttcaatcaatggcgcgaatcaaggttcatgagcttaggaacaaatcgaaggctgatttgttcgctcagttgaaggatctcaaggcggaacttgctcttctccgtgtcgcgaaagtcaccggcggtgctccgaacaagctttccaagataaaagtggtgaggacatcaattgctcaggtgctgactgtgatttcacagactcagaaggctgctcttagggaagcctacaagaacaagaagtacttgcctcttgatctgcgcccaaagaaaaccagagccatccgcagacgtcttaccaagcatcaggcttcattgaagaccgaaagagagaagaagaaagagaagtactttcctttaaggaagtatgctatcaaggcataaggtgaaaaccatcaaggaggatatttaggtgttcggtcacttccagttttggacttaaattcatcagaaatatgtgtttgttagtttgtttgcaatgagttataagacattctacattggatcttgctctttttgtttgacctgttttttcgaatgcattttacagcttataactttgg

SEQ ID NO: 6834 - DNA, 493 bp, Fraxinus spp
gaaagaagagagacaagatggcgagaatcaaggtgcacgaattgaggcagaagaacaaggcggagctgctggcgcaactgaaggatctgaaggccgagttggccttgctaagggtggccaaggcgacagctggcgccgccaacaagctgtcaaagatcaaagtagtgaggctttccatagcccaagtgcttaccgtgatttcccaaaagcagaaggcagctctcagggaagcttacaagaataagaagtacttgcctctcgatctccgtcctaagaagacccgcgctattcgcaggcgcctaacaaagcaccaggcatctttgaagaccgaaagagagaaaaagaaagagatgtacttcccattgagaaagtatgccatcaaagtttaagctgatttatgctggaagagattctggtactcatactctataatcttggaggacttttcatgttggatggaattctactagctagcatgaaatgctatggattg

SEQ ID NO: 6835 - DNA, 805 bp, Panax ginseng
aagcagtggtatcaacgcagagtacatgggggtctcatttctatttagggttccagaagcaagtgcaagcagcccctccgtggtttttgcttcagtcaaaggacagcaatggcgaggattaaggttcatgagctgaggggtaagtcaaagacggatttgttgacccagctgaaggaactaaaggctgagctcgctctcctccgtgttgccaaggtcaccggcggcgctcctaacaagctctccaaaataaaagtggtgaggctgtcaattgcgcaggtgttgactgtcatgcaacagaaacagaaggctgctctgagggaggtgtacaagaacaagaaactactgccgcttgatttgcgtcccaagaaaactagagctatccgcaggcgtcttaccaagcaccaggcttcattgaagactgaacgtgagaagaagaaagagaagtacttcccaatgagaaagtatgctattaaggtgtagggtagaatctactgtggaggagatttgttactttgtgactacaaacctcattccaattttgaattctgaaatttgttctccattatcctgtattgctgatcctagttcaagtgttactttattgtggtgtttactcttgtttcatgtgctgaaactattcatatcaagccctagttcaagtttactttatagtgatgtttactcttgttttaatgtgggtctaaaactaggtctgaacataggtggtatgagatgctgctgtttgcaaatttctcacttttctagtcatagcacatgaaataaaaattatactaaattttcagct

SEQ ID NO: 6836 - DNA, 796 bp, Panax ginseng
cagtggtatcaacgcagagtacgcgggggtctcatttctatttagggttccagaagcaagtgcaagcagctcctccgtggtttttgcttcagtcaaaggacagcaatggcgaggattaaggttcatgagctgaggggtaagtcaaagacggatttgttgacccagctgaaggaactaaaggctgagctcgctctcctccgtgttgccaaggtcaccggcggcgctcctaacaagctctccaaaataaaagtggtgaggctgtcaattgcgcaggtgttgactgtcatgcaacagaaacagaaggctgctctgagggaggtgtacaagaacaagaaactactgccgcttgatttgcgtcccaagaaaactagagctatccgcaggcgtcttaccaagcaccaggcttcattgaagactgaacgtgagaagaagaaagagaagtacttcccaatgagaaagtatgctattaaggtgtagggtagaatctactgtggaggagatttgttactttgtgactacaaacctcattccaattttgaattctgaaatttgttctccattatcctgtattgctgatcctagttcaagtgttactttattgtggtgtttactcttgtttcatgtgctgaaactattcatatcaagccctagttcaagtttactttatagtgatgtttactcttgttttaatgtgggtctaaaactaggtctgaacataggtggtatgagatgctgctgtttgcaaatttctcacttctctagtcatagcacatgaaataaaaatgatactaaattt

SEQ ID NO: 6837 - DNA, 804 bp, Panax ginseng
agtggtatcaacgcagagtacatgggggtctcatttctatttagggtttcagaagcaagtgcaagcagcccctccgtggtttttgctttagtcaaaggacagcaatggcgaggattaaggttcatgagctgaggggtaaatcaaagacggatttgttgacccagctgaaggaactaaaggctgagctcgctctcctccgtgttgccaaggtcaccggcggcgctcctaacaagctctccaaaataaaagttgtgaggctgtcaattgcgcaggtgttgactgtcatgcaacagaaacagaaggctgctttgagggaagtgtacaagaacaagaaactactgccgcttgatttgcgtcccaagaaaactagagctatccgcaggcgtcttaccaagcaccaggcttcattgaagactgaacgtgagaagaagaaagagaagtacttcccaatgagaaagtatgctattaaggtgtagggtagaatctactgtggaggagatttgttactttgtgactacaaacctcattccaattttgaattctgaaatttgttttccattatcctgtattgctgatcctagttctagtgttactttattgtgatgtttactcttgtttcatgtgctgaaactattcatatcaagccctagttcaggtttactttatggtggtgtttactcttgttttaatgtgggtctaaaactaggtctgaacataggtggtatgagatgctgctgtttgcaaatttctcacttctctagtcatagcacatgaaataaaaatgatgctaaattttcagctcta

SEQ ID NO: 6838 - DNA, 572 bp, Panax ginseng
gtggtttttgctttagtcaaaggacagcaatggcgaggattaaggttcatgagctgaggggtaaatcaaagacggatttgttgacccagctgaaggaactaaaggctgagctcgctctcctccgtgttgccaaggtcaccggcggcgctcctaacaagctctccaaaataaaagttgtgaggctgtcaattgcgcaggtgttgactgtcatgcaacagaaacagaaagctgctttgagggaagtgtacaagaacaagaaactactgccgcttgatttgcgtcccaagaaaactagagctatccgcaggcgtcttaccaagcaccaggcttcattgaagactgaacgtgagaagaagaaagagaagtacttcccaatgagaaagtatgctattaaggtgtagggtagaatctactgtggaggagatttgttactttgtgactacaaacctcattccaattttgaattctgaaatttgttttccattgtcctgtattgctgatcctagttcaagtgttactttattgtggtgtttactcttgtttcatgtgctgaaactattcatatcaagccc

SEQ ID NO: 6839 - DNA, 607 bp, Panax ginseng
agggtttcagaagcaattgcaagcagcccctccgtggtttttgcttcagtcaaaggacagcaatggcgaggattaaggttcatgagctgaggggtaaatcaaagacggatttgttgacccagctgaaggaactaaaggctgagctcgctctcctccgtgttgccaaggtcaccggcggcgctcctaacaagctctccaaaataaaagttgtgaggctgtcaattgcgcaggtgttgactgtcatgcaacagaaacagaaagctgctttgagggaagtgtacaagaacaagaaactactgccgcttgatttgcgtcccaagaaaactagagctatccgcaggcgtcttaccaagcaccaggcttcattgaagactgaacgtgagaagaagaaagagaagtacttcccaatgagaaagtatgctattaaggtgtagggtagaatctactgtggaggagatttgttactttgtgactacaaacctcattccaattttgaattctgaaatttgttttccattgtcctgtattgctgatcctagttcaagtgttactttattgtggtgtttactcttgtttcatgtgctgaaactattcatatcaagcccta

SEQ ID NO: 6840 - DNA, 744 bp, Panax ginseng
gcaagtgcaagcagcccctccgtggtttttgcttcagtcaaaggacagcaatggcgaggattaaggttcatgagctgaggggtaagtcaaagacggatttgttgacccagctgaaggaactaaaggctgagctcgctctcctccgtgttgccaaggtcaccggcggcgctcctaacaagctctccaaaataaaagtggtgaggctgtcaattgcgcaggtgttgactgtcatgcaacagaaacagaaggctgctctgagggaggtgtacaagaacaagaaactactgccgcttgatttgcgtcccaagaaaactagagctatccgcaggcgtcttaccaagcaccaggcttcattgaagactgaacgtgagaagaagaaagagaagtacttcccaatgagaaagtatgctattaaggtgtagggtagaatctactgtggaggagatttgttactttgtgactacaaacctcattccaattttgaattctgaaatttgttctccattatcctgtattgctgatcctagttcaagtgttactttattgtggtgtttactcttgtttcatgtgctgaaactattcatatcaagccctagttcaggtttactttatggtggtgtttactcttgttttaatgtgggtctaaaactaggtctgaacataggtggtatgagatgctgctgtttgcaaatttctcacttctctagtcatagcacatgaaataaaaatgatactaaattttca

SEQ ID NO: 6841 - DNA, 681 bp, Hevea brasiliensis
acgtcagagaaagaaatggcgagaatcaaggtccacgagcttagacagaaatcaaagacggagctgttgaatcaattgaaggatctcaaggctgagcttgctctccttcgcgtcgccaaggtcactggtggtgctcctaacaagctctccaagattaaggtggtgaggttgtctattgcacaagtcttgactgtcatttcccagaaccagaaggctgctcttagggaggcatacaagaacaagaagttcttgccccttgatctgcgtcccaagaagaccagagctatccgcaggaggcttactaagcaccagcaatctttgaagacggaacgtgagaagaagagagaaatgtacttccccatgagaaagtatgctattaaggtgtaaggtgatatcttcaggagaggctgcttttatattttgcaattataaacccatttggtttactagcttttatttgaattatctcttggtcttgtgtctgtaaacttggaagggtgcatctcaccattaccaggagcaagattgatgttgacgtatgatttctttccatgtttcttgaatccttagcaatagcttgcctttaccttttgacctatgttttgtttgattttaacattgagtctctactttttacgttccattcgcaataacattataccttttgatgcattgtgtttc

SEQ ID NO: 6842 - DNA, 606 bp, Ipomoea batatas
aatgaacccacatatgaactagggtttcggtggaagaagagcggcatctgcagtacctatccgaagggcaccaatggctagaatcaaggttcacgagctgaggaacaagagtaaaaccgagcttctggctcagttgaaggatctcaaggccgagcttgccctcctccgtgtcgccaaagtcaccggcggtgcccccaacaaactttcgaagatcaaggttgtcaggttgtcaattgcacaggtgttgactgtgatatctcagaagcagaaggctgtgctaagagaagcatacaaaaataagaagtatttgcctcttgatctccgcccgaagaagaccagagccatccgccgccgtcttacaaagcaccaggcctcattgaagacagagagacagaagaagaaagaaatgtacttcccattgaggaagtatgctattaaagtgtaggataatacctactgttaagtcattttgagcttcaaatcaaatatgttggttagaactatgaatttacaaattttgttttctatagtctgcttttgtctggcttgatggaatattgttctagttttgactatttatatttcagcgtttgttgatttaaaaaa

SEQ ID NO: 6843 - DNA, 643 bp, Jatropha curcas
attcggaagagagagcagccgccgttgctgaagctcagaggaagaaagcgaaatggcgagaatcaaggtccacgagcttagacagaaatccaagacggagcttttgaatcaattgaaggatctcaaagctgagctcgctctcctacgcgtcgctaaggtcaccggcggtgctcctaacaagctttccaagatcaaggtggtgaggttgtcaattgcacaggtcttgactgtgatttcacagaagcagaaggctgcattgagggacgcatacaagaacaagaagttcttgccacttgatctgcgtccgaagaagacaagagccatccgcaggaggcttaccaaacaccagcaatcgttgaagacagaacgtgagaagaagagagaaatgtacttccccatgagaaagtatgctatcaaggtgtagggcaatttttgctaaatagattggttttggtatcttgcaattataaacccatttggttgtcaagttttgtcttggattatctttttgatgtgcttgtgaactagagttggctttgttgaatcttatgtctgtaatcttggaagggtgtatctcactctaaccgggtgctagatttacttggaattatagctgcagaaacttcttttcatttttcttcac

SEQ ID NO: 6844 - DNA, 626 bp, Actinidia deliciosa
tctcagtcagagttgcaaacagcggcttcggtaccttcttctcacatccatggcgaggatcaaggttcatgagctgagacagaagtcgaaggcggatttgttgagccagctcaaggatctgaaagctgagctcgcccttctccgagtcgccaaggtgaccggcggtgcccccaacaagctctccaagataaaagtggtgaggttgtcaattgcccaggttttgacagtgatttcgcagaaacagaaggcttttttgagagaagcctacaagaacaagaagtacttgccacttgatctgcgtcccaagaaaaccagggccattcgtaggtgtctcaccaagcatcaggtgtcgttgaagacggaaagggaaaagaagaaggagatgtactttcccacgaggaagtacgctattaaggtgtagggataggatttattatggccttccgtatccatatatcctgttccaacgatggaattttgagatttgtcacatttttatctaaatttcggtgacctgagggttttgagtttttgtttgtttaattttgagaattagacttcagagattgccttatcttctgatgctgcaatagtgcaattctaaggctttgctttgttgtgccaat

SEQ ID NO: 6845 - DNA, 629 bp, Actinidia deliciosa
agagagtgaaagacttgacaaacgccatggcgaggatcaaggttcacgagctgaggcagaaatcgaaggctgagctattggcccagttgaaggatctgaaagcagagcttgctctccttcgcgtcgccaaggtcactggaggcgcccccaacaagctctctaagataaaggtggtgaggttgtcgatagcacaagtgttgaccgtgatatcgcagaagcagaaggcggttctgagggaggcttacaagaacaagaagtacatgccacttgatctgcgtcccaagaagaccagagccatacgcagacgcctcaccaagcaccagacatcattgaagacagaaagggagaaaaagagggagatgtacttccctatgagaaagtatgcaatcaaggtttagggttcatttcacctttgcttattcagttgtgctttcaaggaaagtgaaatcttcttcagttgtgctttcaaggaaagtgaaatcttcttcctaccatattgttttcctttcctgtttccaaaatatttgatgaatgaggaattagaatgtgttttgttacgtccttctattccccgacttcagtttattgatttggttgtaatggatcgactaagtgcatgagccatgtta

SEQ ID NO: 6846 - DNA, 637 bp, Liriodendron tulipifera
ctttctcgctcgcttctcctcctcgtcccgaaggcgcagccaacctctacgctctcagaccttcccgccatggccaggattaaagtccacgagctgagaggaaaatcgaaggtcgatcttctaaaccagctgaaagatctgaaagcagagctctctctgctacgtgtcgccaaagtcactggaggagcgccaaacaagctctctaagataaaggtcgtgaggttgtcgatagcgcaggtgttgactgtgatttctcagaagcagaaagcggcattgagggaagtatacaagaagaagaagttcctgccgctcgatctgcggccaaagaagacacgagccatcaggcggcgactgaccaaacaccaggcatctttgaaaacagagcgtgagaagaagagggaaatgtattttccattgaggaagtatgccatcaaggtgtagggtaagcacctaatctacttatcttttcatccctttcagaacagtgactactggatgatgagttttgacatttggtatctttgaatctgtgatcagatgcagtggctttctttttactattttattctaagtttacaaataggtgaatgggcagtaactgttgaacctgtagatgttggttggatatctgtttggc

SEQ ID NO: 6847 - DNA, 708 bp, Nicotiana benthamiana
aagtagggtttaagaatctaggagcagcctctgcaccaaaaacagcttccagtagcagcaatggcaagaatcaaggttcatgagctgaggaacaaaacaaagactgagctactggctcagttgaaggatctgaaggccgagcttgccctacttcgtgtcgctaaggtcaccggtggtgctcctaacaagctctccaaaatcaaggtggtaaggttgtcgatcgcacaggttctgactgtaatttcgcagaagcaaaaaactgctcttcgggaagcttacaagaacaagaaatacctgccccttgacctacgccctaagaaaactagggccatccgcaaacgtttgaccaagcaccaggtgtcactgaagaccgagagggagaagaagaaggagatgtacttccccatccggaagtatgccatcaaggtgtaggataggatctacttaggcagagccttttgtattttgaatcagaatatattggtgaaactattgagcatgcaaattttgtttagctttatttcgtttggcgcttgtgacattagacacatgactgatgtggagcttcattcgttccaagtttcaagtttattccaattttatgtttagcaccctgttatctttgatcttaagggttttaaggctcattcacacttaattggatgagtgattgcttgatcacgttgcagtccgcaagttgctctcgca

SEQ ID NO: 6848 - DNA, 642 bp, Nicotiana benthamiana
aagtagggtttcagaatctaggagcagcctctgcaccaaaaacagcttcaagtagcagcaatgtcaagaatcaaggttcatgagctgaggaacaaaacaaagactgagctactggctcagttgaaggatctgaaggccgagcttgccctacttcgtgtcgctaaggtcaccggtggtgctcctaacaagctctccaaaatcaaggtggtaaggttgtcgatcgcacaggttctgactgtaatttcgcagaagcaaaaatctgctcttcgggaagcttacaagaacaagaaatacctgcctcttgacctgcgccctaagaaaactagggccatccgcaaacgtttgactaagcaccaggcgtcactgaagacggagagagagaagaagaaggagatgtacttccccatccgaaagtatgccatcaaggtgtaggataggatctattttggcagagccttttgtgttttgaatcagaatatattggtgaaactattgagcatgcaaattttgtttagctttgtttcgtttggatcttatgacattggacacgactgatatggaggttaatttgttccaagtttcaagtttattcctattttatgttgagcaccctgttatcttttgatcttaagggttttaaag

SEQ ID NO: 6849 - DNA, 684 bp, Avena sativa
tccgtctcacggacaaacataacccgcacgccgccgcctccctgcccccagcgcctcattttcttctctccgctcgccaccgccgccgctagaccagctcgccgaaagcaatggcccggatcaaggtgcacgagctgcggggtaagaacaaggcggacctgcagggtcagctcaaggacctcaaggcggagctctccctcctccgcgtcgccaaggtcaccggtggcgcccccaacaagctctccaagatcaaggtggtccgcacctcgatcgccagggtgctcacggtgatctcgcagaagcagaagtctgccctgcgggaggcgtacaagaacaagaagctgctcccgctcgacctccgccccaagaagacccgtgcaatccgcaggcgccttaccaagcaccagagctctttgaagaccgagagggagaagaagcgtgagaagtacttccccatgaggaagtatgctatcaaggcctaggttaggagtgcgtgttttaccggtcaagttttgcccagaagttgcctggattatgttgtgtgtggactccatgagatgtacaatgtatttgatctactccatgagatggtcatcttttgcttaactttatgaggtatctggttatagctgcttgctgatgttggaatgtgatggttatcgtaatttgtttgattcctgtcca

SEQ ID NO: 6850 - DNA, 692 bp, Olea europaea
atggcgaggatcaaggtacacgaattgaggcagaagaacaaggcggagctgctggcgcaactgaaggatctgaaggcggagttagccttgctaagggtggccaaggcgacagctggcgccgccaataagctgtcaaagatcaaggtagtgaggctctccatagcccaagtgcttaccgtgatttctcagaagcagaaggccgctctcagggaagcttacaagaataagaagtacttacctctggatctccgccctaagaagacccgcgccattcgcaggcgcctcacaaagcaccaggcatctttgaagactgaaagggagaaaaagaaagagatgtacttcccattgagaaagtacgccatcaaagtttaagctgatttatgctggaagagattttggtacttcatctttgttatcttggaggatttttcatgttggatggactactagttaggctgaaatgttatggattgagatcattttttcgagtatcattatttctcctcaactaatgattagtgaagtccttatttcacatatgacatggaatgtgaatggtttcttccttttatctcgcttcatttgtaggcattcccactatccaatagcgatgagtggaatgtatttaatgtatccacgtgtaggttcttttgcacaaggtttttggccagtagtggaattgtgccagaacc

SEQ ID NO: 6851 - DNA, 600 bp, Olea europaea
acgtagaagggaaaacgcgaaatggctcggatgaaggtgcatgagttgagacagaagaacaaggcggagcttttggcgcagttgaaggatctgaaggcggagctggcgttgcttagggtcgcaaaggccactgctggtgccgctaacaagctgtcgaagattaaggtggtcagactctctatagctcaggtgctgaccgtcatttctcagaagcagaaggcagctctcagggaagcgtacaagaataagaagtatttacctcttgatctccgccccaagaagacccgtgctattcgcaggcggctaaccaaacaccaggcatctttgaagagtgaaagggagaaaaagaaagagatgtacttcccaatgagaaaatatgcaattaaagtttgagttgatctattatcaaaattaggtattatccctgtttaatctaggaggatactatattttgttttcgtattttagctgaaaatagttttgattttgagaaactattgagtttgggtggcattatttcttattatctaatgactactagcttacaacactgaagttcttttaagttttgcgctttatttatgttcttttaataagcct

SEQ ID NO: 6852 - DNA, 862 bp, Citrus sinensis
aattctagggttttcataaccatacgcataagcagaggaagccgccgttgcaggagcagagacaccaaacgtagcaatggctaggatcaaggtgcatgagctgaggcagaaatcgaaggtggatcttttgaaccagttgaaggaactcaaggctgagctcgccctccttcgcgttgctaaggtcaccggcggtgcccctaacaagctatccaagatcaaggtggtgaggttgtcgatcgcacaagtgttgactgtcatttcacaaaagcagaaggctgcattgagggaggcatacaagaataagaagttcttgccccttgatctgcgtcccaagaagacccgggctatcaggagaaggcttaccaagcaccaggcttcactgaagaccgagcgggagaagaagagggagatgtactttcccatgaggaagtacgctattaaggtgtaggctagaatctttttctaggagtatcttggtatcttgcagtgacgaacctattttgttgacaaatttttactttgttaccttttcaaatatcatttttgttcaatcttatgtgtgtaaaacttgaagggtgcatctcaacctaaacaagatgtgctagattgtgatggaatagcagtcaagataggatttctgttcttgagtgttcttatttatcgacatttgttggtaaattctttgttttatttcttgctgggtaatgtagtgcattgcctttagaatgtcagtgattgtggaaaggatccctagtctgaaactcgactgtagtgcgattaggttttcatatttggtcaatttcttagcatgcttggtaattaattcccataaaatacaaccagataagccatctaattttca

SEQ ID NO: 6853 - DNA, 580 bp, Carica papaya
ctttcctcatttttaagggtttgtgaagcagatatcggaaccggcagtcgacaatggcgaggatcaaggttcacgagcttaggcagaagtcgaaagccgatctgttgaaccagctgaaggatctgaaggccgagctcgcgctcctgcgcgtcgcgaaggtcacagggggcgctcctaataagctatccaagatcaaggtagtgaggctgtcgattgcccaggtgttgactgtgatttctcagaagcagaaggctgcactgagggaggcatacaagaagaagaagtacttgccacttgatctgcgccccaagaagacaagagccattaggagaaggctaaccaagcaccaggcatcattgaagacagtacgtgagacgaagaaggaaatatattttcccatgaggaagtatgccattaaggtgtagggtagatctgtcggatatgatgttttgtaggacctcgcaaattataaacctatttgatccgcaaattttgagtatttgtctttctgaatgttgagtttgagctagtttgtaatggttttcccatattaattgaaggtgcttagttttttgatgaa

SEQ ID NO: 6854 - DNA, 520 bp, Capsicum annuum
gagtttcagcattgcctgtagacaaacacaccatggcaagaatcaaagttcacgaactgagacaaaagtccaagactgagcttttagctcagctaaaggacctaaaagcagaacttgctcttctccgtgttgctaaagtcactggtggtgcaccaaacaagctctcaaagataaaggtagtgaggttgtcaatagctcaggtgttgacggttatatcgcagaagcagaagtcggcactgagggaagcgtataagaataaaaagtatttgcctcttgatcttcgtcctaagaaaactagagctattcgtaaacgtcttactaagcaccaggcatctttgaggacagaaagagagaagaagaaagaaatgtactttccacttagaaagtatgccattaaagtttgaattcatccaacttagttactgtggtattagcacttcccaagcagaacaatggatctatgtaaactgatttgttttacttcataaaacagtgcgttatgaagcctaaactttgttta

SEQ ID NO: 6855 - DNA, 812 bp, Papaver somniferum
aggagctacatttgccattaacgatttctctcaatggcaaggattaaagttcatgagctccgaactaagaacaagactgagcttttgggacagctcaaggatctgaaagctgagcttgctttgcttcgtgttgctaaggtcaccggtggtgcacctaacaaactctctaagatcaaggtggtgaggctatcaattgcacaagtgcttactgtgatttctcagaagcaaaagtctgctcttagagatgcatacaagaacaagaagtttttgcctttggatcttaggccaaagaagacccgtgctatcaggagacgcctgactaaacatcagttgtcattgaagactgaaagggagaagaagaaggagatgtacttccccatgaggaaatatgctatcaaggtctagagtgaagaatctgagaggataaaatacttggaagaatgaatttatgttttagatactatgtaaggttttaagtttacttctcaaatgaccattctgtagtttaggtttcatatatgcatgaatattatatcaatttgcttgcttaagaaccctgaaactctgtgcacatctacttccaccattgttcatcggtacttaattccctgatctctttttaaagccacttctgtctagtataatgttgttgctattgttggctgtctttgacttccttacctgtttatgctgatttatcctctgcaatttagagatgtgtatttgcatacggaagctaacctctagagaccggatttctctcaagtaagcattaccatatcttttatttatctaaattggaaaaaaaggca

SEQ ID NO: 6856 - DNA, 817 bp, Prunus mume
ccgcagccgtgttttagggttcactctcttctccgccttgagtttcatccagagagagcaacagagtctgcagcaatggcgaggatcaaggtccacgagctcagaaacaagacaaaggcagagcttttgggtcaactgaaggatctgaaggcagagcttgccctcctccgagtcgccaaggtcaccggtggagcccccaacaagctctccaaaatcaaggtggtcagactttcaatagcacaagtgttgacagtgatttcccagaagcaaaaagcggctttaagggaagtctacaagaacaagaagtttcttcctctggatttgcgcccaaagaagaccagggctatcagaaggcgtctgaccaagcatcaggcatctttaaagacagaacgggagaagaagaaggagatgtacttcccattgaggaagtttgcaatcaaagcataatgttggattcaattatgaaggaaatcgggtgtttctcccattataagatattccaaggacaccattttaaagtgtttagctcttcccgtaatttcatcattgtagacgctatcccaaatatgattttgttggtccaggattttaatgctgattttgatttctattattgtttgagcatttgcaatgggattaacttggccggttatcctattcactctttgttttcttaattgaaggcgtagcatttcagtaatcaacatcactgggtacattcaactttgtttgccctagaaagttgataacatccagccccttcttcctagccaaaccattttattaccttaagtgagtgcaaagcgtagatcataac

SEQ ID NO: 6857 - DNA, 897 bp, Prunus mume
cactcatagttagggtttcattttcccgtgaagctaagagagggccgccgttgcagaactcacagaacacagcaatggcgagaatcaaggtacacgagttgaggcagaaaacaaaggctgagcttttgaaccagctcaaggatctcaaggcagagcttgctcttcttcgcgttgccaaggtcactggtggagcacccaacaagctctccaagatcaaggttgtcaggctatcgattgcccaagtgttgactgtgatatcacagaagcaaaagtctgccctgagagaagtgtacaagaacaagaagttcttgcctcttgatctgcgtcccaagaagaccagagctatccgccgaaggctcaccaagcaccaggcatctttgaagaccgagagggagaagaagaaggaaatgtattatcccttgaggaagtatgccattaaggcatagagtgttggatcaattacgttagatcatcttggtaccttgctgtaatagaatccttttgttcacaagttttggatttacttttgattaagaaattagacctgagattttgatgtttaattacttgtctaggtttggggaggcatgtcttcttgcccaaatcaacttaattttctttgggtacaatgatagttaagattctgttcgtgtttgataaatgacttgagctcattattccctgcttatattggctgatttactgaaagcatttggccatctttatttttacatttcattcggtttagttaatctgttttgggagacatttggctggctgctttggcttaaggctttgtttggcatcggggtgtgtctatgtgatgtctcattcccattcttcggcctgaactaggtttattctgaaaatcatccaattgaaagcatttccagtgct

SEQ ID NO: 6858 - DNA, 621 bp, Prunus persica
atgtttgtgcaaaatcaggttgagccctctacccttgctgagtttcatccagagagagcaacacagtctgcagcaatggcgaggatcaaggtccacgagctcagaaacaagacaaaggcagagcttttgggtcaactgaaggatctgaaggcagagcttgccctcctccgagtcgccaaggtcaccggtggagcccccaacaagctctccaaaatcaaggtggtgaggctttcaatagcacaggtgttgacagtgatttcccagaagcaaaaagcggctctaagggaagtctacaagaacaagaagtttcttcctctggatttgcgcccaaagaagaccagggccatcagaaggcgtctgaccaagcatcaggcatctttgaagacagaacgggagaagaagaaggagatgtacttcccattgaggaagtttgcaatcaaagcataatgttggattcaattatgaaggaaatcgggtgttttgcccattataagatattccaaggacaccattttaaagtgtttagctcttcccgtaatttcgtcattgtagacactattccaaatatgattttgttggtccaggattttaatgctgattttgatttctattattgtttga

SEQ ID NO: 6859 - DNA, 704 bp, Prunus persica
gctcgtagttagggtttcattttcccgtgaagctaagagagagccgccgttgcagaactcacagaacacagcaatggcgagaatcaaggtacacgagctgaggcagaaaacaaaggctgagcttttgaaccagctcaaggatctcaaggcagagcttgcccttcttcgcgtggccaaggtcactggtggagcacccaataagctctccaagatcaaggttgtgaggctatcgatcgcccaagtgttgactgtgatatcacagaagcaaaagtctgccctgagagaagtgtacaagaacaagaagttcttgcctcttgatctgcgtcccaagaagaccagagctatccgccgaaggctcaccaagcaccaggcatctttgaagaccgagagggagaagaagaaggaaatgtattatcccttgaggaagtatgccattaaggcatagagtgttggatcaattacgttagatcatcttggtaccttgctgtaatagaatccttttgttcacaagttttggatttacttttgattaagaaattagacctgagattttgatgtttaatttttcttgtctgggttttggggaggcatgtcttgcccaaatcaacttaattttcttcgggtgcaatgatagttaagattctgttcatgtttgataaatgaattgagctcattattccctgcttatattggctgatttactg

SEQ ID NO: 6860 - DNA, 442 bp, Salvia sclarea
gaaattcgagatggcgaggattaaggttcacgagctgaggcagaagaacaaggtggagctgctggcgcagctgaaggatctgaaggcggagctggcgctgctgcgggtggcgaaggtgaccggcggcgctccgaacaagctgtcgaagatcaaggtggttcggctctcgattgcgcaggtgctgaccgtgatttctcagaagcagaagtcggcgctgagagaagcgtacaagaataagaagtacttgccgctcgacctccgccctaagaagactcgagccatccgccgccgcctcaccaagcaccaggcttctttgaagacagagaagcagaagaaaaaggagatgtatttccctctaagaaagtatgctatcaaagtttaagttaactacttttgattgaagcaattttgtgtctgttgcccgatcttaaggatgacaata

SEQ ID NO: 6861 - DNA, 781 bp, Fragaria vesca
atagttttagggtttcattttagagtgaaagcagagaagagccgccgaacttcacacacagtctctcaatggccagaatcaaggttcacgagctgaggcagaagtcaaaggccgatcttttggcccagctcaaggatctcaaggcggagctcgccctcctccgcgtcgccaaggtcaccggtggcgcacccaacaagctctccaagatcaaggttgtgaggcttgggattgctcaggtgttgacagtgatctcgcagaagcagaaggctgctctgagggaagtgtacaagaacaagaagctcttgcctcttgatcttcgtcccaagaagaccagggccattcgccgaaggcttaccaagcaccaggcatctttgaagactgaacgtgagaagaagagggagatgtactaccccttgaggaagtttgccatcaaggcatagagtgttggtctgctttatttaggtcatctatcttttgtaatagaaacttctgttcacaagttttgattttgaattgatatgttgaacatgagatattggtgttttatttgacttctctagtttgggtatcacccaaaccgattatgttcttctcttctgtgatgatagtctagatttccttcagatttttatcaatgcttctcgggttatcatttggttatagttttcttttatatgatatggtttggttcatgtcgttattctctggtacattgttgtggacctgaattatgtttggtagtgtaccggttattaattattaagtaaactgtttttatgct

SEQ ID NO: 6862 - DNA, 554 bp, Helianthus annuus
aaccctaatttctcccccttttacgaacgagggttctgcggcagcctccattgcagctcatttttctccgatcacaatcaatcaatggctcggatcaaagttcacgaacttagaggcaaatcgaaggtcgatttgttcgctcaattgaaggatttgaaagccgaacttgctcttcttcgtgtcgcaaaagtcaccggtggtgctccgaacaagctctctaagataaaagtagtaagaacctcgatcgcgcaggtgctgacagtgatttcacagacccagaaagccgcgcttagggaggcttacaagaataagaagtaccttcctttggatcttcgtcccaagaaaaccagagccattcgcaggcgtctcaccaaacatcaggcttcattgaagacggagcgtgaaaagaagaaagagaagtattttccgttgaggaagtatgcaatcaaggcttaggtggttttaggttcaattttgaatttgaatttaagctttgtgtatgttttcgtcaagttttgttggatttgaatggttatatgaacatttggattttt

SEQ ID NO: 6863 - DNA, 697 bp, Camellia sinensis
tccctctcgtttttagggttcgttcttctgatagtctcaggcacagagagagagagagagagagagagactgccatggcgaggatcaaggttcatgagttgagacagaaatcaaaggcagagttgcagagccaattaaaggatctcaaagctgagctctcccttcttcgtgtcgccaaggtcactggcggtgctcccaacaagctctccaagataaaagtggtgaggttgtccattgcccaggtgttgaccgtgatttcacagaaacagaagtctgttctgagggaagcctacaagaacaagaagtacttgccacttgatctacgtcccaagaaaaccagagccatccgtagacgcctcaccaagcatcaggcatcactgaagactgaaagggagaagaagaaggagatgtactttcctatgaggaagtatgctattaaggtgtagggtaggatctactatacggtggatttttgtgcttatgcatccatatatctactccaaacatgaattttagaattttgtttacatttatgctacttttggaggacttgaaagtttgattttgtatttgcttaaaatttgtgactagtaagctttggtgctcacatctctcctgttgctaggaatttttttgtctcatttaatagttgatgagggttttggttcaattacgatggtggatgcttgaccagacg

SEQ ID NO: 6864 - DNA, 737 bp, Nicotiana tabacum
ccctaaatcctcttcagcttctaagcagtaacctcaaaggagcagccatggcgagaataaaggttcatgagctgaggggcaagtcgaagacagagctgttggctcagttgaaggatctgaaggctgaacttgcccttctccgtgttgctaaagtcaccggtggtgcccctaacaagctatccaaaataaaggtggtaaggttgtcgattgcacaggttttgactgtgatctcacaaaagcaaaagtcagttcttcgggaagcttacaagaacaagaagtacttgcctcttgaccttcgccccaagaaaacaagggcaatccgcagacgtttgactaagcaccaggcatccttgaagacagagagagagaagaagaaggagatgtatttccccataagaaaatatgctatcaaagtttaggataggatctacttctgctgagatttttgttttttggatcaaaattacttgtcgaacttgtcagcaatacaaattttgttttgctttgtttcatctggtgcttttgacatttgatacatttcatctggtgcctttatgttgaataggctgtttgttattagtggttcaatgcattgaaaatttcttatcatatagtatgttttactggtgttagaatattgttcagtttgtccgtcactcctttaaaagaagtaattgttgggtttacaaagtgaagactttttgtggaattcttgaaatttgcaaataaatttttga

SEQ ID NO: 6865 - DNA, 559 bp, Nicotiana tabacum
ggtctcataattaacatcgccgtttagtacttcacagagagagagagagagagagagtgtgtgatagaaatggcaagaatcaaagttcatgagctgaggggaaaatcaaagactgagcttttggctcagttaaaggatctgaaagcagaacttgctctcctccgtgttgctaaggtcactggcggtgcccctaacaaactctccaaaattaaggtggtgaggttgtcaatagcacaagtattgacagtgatatcacagaagcagaagacagcattgagagaagcttataagaacaagaagtacttgcctcttgacctccgtcccaagaagactagggccattcgtaaacgtcttaccaaacatcaggcatctttgaagactgaaagggagaagaagaaagagatgtactttccaattagaaagtatgccattaaggtttgaattgatccaacttagatagtttgtgatgttagagcaaagctgaggatcattatttttgccattttgcaatgttatattttgtattactactattattgcattatgaagttggagtttt

SEQ ID NO: 6866 - DNA, 522 bp, Nicotiana tabacum
gaaatggcaagaatcaaagttcatgagctgaggggaaaatcaaagactgagcttttggctcagttaaaggatctgaaagcagaactcgctcttctccgtgttgctaaggtcactggcggtgcccctaacaaactctccaaaattaaggtggtgaggttgtcaatagcacaagtattgactgtgatatcacagaagcagaagacagcactgagagaagcttataagaacaagaagtacttgccgcttgaccttcgtcccaaaaagaccagggccattcgtaaacgtcttaccaaacatcaggcatctttgaagacagaaagggagaagaagaaagagatgtactttccaattagaaagtatgccattaaggtttaaattgatccaatttagatagtttgtgatgttagcatttgcagagcaaagctgaggatcgtatttttaccattttgcaatgttatattttgtattactactattattgcattatgaagttggagttttattaaaaaagcggccgcatga

SEQ ID NO: 6867 - DNA, 614 bp, Nicotiana tabacum
gggtttcagaatctaggagcagcctctgcaccaaaaacagcttccagtagcagcaatggcaagaatcaaggttcatgagctgaggaacaagacaaagactgagctactggctcagttgaaggatctgaaggccgagcttgccctacttcgtgttgctaaggtcaccggtggtgctcctaacaagctctccaaaatcaaggtggtaaggttgtcgatcgcacaggttctgactgtaatttcgcagaagcaaaaaactgctcttcgggaagcttacaagaacaagaagtacctacctcttgacctgcgccctaagaaaactagggccatccgcaaacgtttgaccaagcaccaggtgtcattgaagactgagagagagaagaagaaggagatgtacttccccatccgaaagtatgccatcaaggtgtaggataggatctactttggcagagccttttgtgttttgaatcagaatatattggtgaaactattgagcatgcaaattttgtttagctttatttcgtttggcgcttgtgacaacacatgactgatatggagcttagttcgttccaagtttcaagtttattcttattttatgttgagcaccctgttatctc

SEQ ID NO: 6868 - DNA, 715 bp, Solanum lycopersicum
acgttcgaaacacagacagccaacaggcgtcttctttctgccgctaattagggtttctgagtctcaacattgccaggagagagtgatacgccatggcaaggatcaaagttcacgagctgaggaacaagtccaagactgagcttttggctcagctgaaggacctgaaagcagagcttgctcttctccgtgttgccaaagtcactggaggtgcccccaataagctctcaaagataaaggtagttagattgtcaatagcacaggtgttgacggttatatcgcagaagcagaagttggcactgagggaagcatacaagaacaagaaatatttgcctctcgatcttcgtcccaaaaaaaccagagctattcgaaaacgtcttactaagcaccaggcatctttgaagacagaaagagagaagaaaaaagaactgtactttccacttagaaagtatgccatcaaggtttgaattcatccaactatgatatgagcactttgtccatgcaattgtcatgtagctggttggatggatgagtccatgaattaggttatagttaatccaagtttcaactcttttccttttcattgaaattggaatgcagattattatgtaacatctcactgatgaagagttttgaaacttttggcttttatcagatgttgaaaagaattggtcaaaattaaacagtggcttgcgaaacatatatcatgtttttctca

SEQ ID NO: 6869 - DNA, 547 bp, Tragopogon dubius
aacccgcgtgttttcattccgagagcttgtggtttcagaggcggctatctcatcactcaatcggagccatggcgagggtcaaagttcatgagctgaggaacaaaggcagatcagatttgttggctcagttgaaggatctcaaggccgagctcgctcttcttcgtgtagcaaaggttaccggcggtgctcctaacaagctagccaaaataaaggttgtacggacatccattgcccaggttttgactgtgatgtcacagaaacagaagtcggcgttgagggaagtttacaagaacaaaaaatatctgccacttgacttgcgtcccaagaaaactagggccattcgcagacgtctaaccaagcaccaggtgtcattgaaaactgaaagagagaagaagaaagagaagtatttcccattgaggaagtatgctatcaaggcttagaccactattttagtttttattcattttgtaagctcagatttactgtttttttctgatttaatgataattaaaaaaatgcttgagttttataattggtactgcaaatt

SEQ ID NO: 6870 - DNA, 572 bp, Tripterygium wilfordii
gccgttcccaagcagcatcaatggcgaggattaaggttcacgagctgagacagaaatcgaaggcggatctcttgaaccagctcaaggatctcaaggctgagcttgctctcctccgtgtcgctaaggtcaccggtggcgcacctaacaagctctctaaaatcaaggtggtgagattgtcgattgcccaggtgttgactgtgatttcccagacccaaaaggctgcactgagagaggcttacaaaaataagaagttcatgccccttgatctgcgtccgaagaagaccagagccattcggagaaggctaacaaagcatcaggcatcattgaagacagaaagggagaagaagaaagagatgtattttcccatgaggaagtatgctattaaggtgtaatgcagctttttattacgaaggataatttggtatcttgcagttataaaacttttggctatgaaattttgatgttatttactcttattgtcttgttcccgaacaatattgtctttgttttcacactgaatttgaatggtttgtgctggactagtttgtgatagaattgtggacaagacttgg

SEQ ID NO: 6871 - DNA, 678 bp, Citrullus lanatus
gtacacgaaaaccctagttttctcagtagcagctcttccaccagcttccatcttctcttctagggtttcgccgagggcggcgcagagtcgaagagcacgcgagaagaaatggcgaggatcaaggttcatgagttgaggcagaaatcgaaggcggatctgttgttgcagcttaaggatcttaaggcggagcttgctctccttcgagtcgccaaagtcaccggtggtgccccgaacaagctgtccaaaatcaaggtagtgagattgtcgatcgctcaagttttgacagtaatttctcagaagcagaaggcggcgttgagggaagcttacaagaagaagaagcttttgcctctcgatcttcgccccaagaagaccagggccattcgtagaaggctcaccaagcaccaggcttctttgaagaccgagagagagaagaagaaagaaatgtactttccattgaggaaatatgctattaaggtgtagtattttccggtagtcgaattttatatgcaacggcagaccaattttgttgacaagttttgtctcgtattcttgataatcttatgtcggatactctactcttgaggttttcctccctaaaccaaggtgtttcatttccatctgacaattatatatttttgacagtgtagcgtttttattgattgttgaacttgtttcttt

SEQ ID NO: 6872 - DNA, 559 bp, Flaveria ramosissima
aaggttcatgagcttaggaacaaatcgaaggctgatctgtttgctcagttgaaggatctcaaggccgaattagctcttctccgtgtcgccaaagtcaccggcggtgctcccaacaagctctccaagataaaagtggtgaggacgtcaattgcgcaggtgctgactgtgatttcacagactcagaaagctgctcttagggacgcctacaagaagaagaagtatttgcctcttgatttacgtccaaagaaaaccagagccatccgtagacgtctaaccaagcatcaggcttcattgaagactgaaagagagaagaagaaagagaagtacttcccgttgaggaagtatgctatcaaggcgtaaggtcaaaacttttgaggagatttaggtgtgtaaatctctttccagttttcgactttgtgttcaattcattagaaatatgtattcgttcgtttggttgcaatgagttgcaagacagttgactttggacctttcctctttatgttaagtatctgttcgacttggtttttgggaggcagtttacggttgtttctcaattgac

SEQ ID NO: 6873 - DNA, 666 bp, Centaurea maculosa
ttttctttcatttttcatcaaattagggtttccagccagccttcgttgcagcctactccaccttcttcaatcaatggctacgaatacaaagttcatgagcttaggaccaaatcgaaggtcgatttgtttgctcagttgaaagatctcaaggcggaacttgctcttcttcgagtcgctaaagttaccggtggtgcccctaacaagctctccaagataaaggtggtgaggacatcaattgcacaggtgctgactgtgatttcacagactcagaagtctgctctcagggaagcctacaagaacaagaagtacttgcctcttgatttgcgcccaaagaaaaccagagccatccgcagacgtcttaccaagcatcaggtttcattgaagactgaaagagagaagaagaaggagaagtacttccctttgaggaagtatgctatcaaggtgtaaggtgggaaactatggaggaggagatttaagtagttgttgtgtaaatctctttccagttttgaagtctgagtttgtgttctatttgatcagagatcatgtatttcatagtttttttctactgcaatgaggtaaaagacaattaacattggaagcttgttgcataccagtttacttgttttttttttggaagacagtgtattgttgattgcattatgcatt

SEQ ID NO: 6874 - DNA, 557 bp, Euphorbia peplus
caagaatcaaggtccacgagctgcgactgaagactaaggcagggctattgaaccagttgaaggatctcaaggctgagttagctcttcttcgcgtcgccaaggtcaccggtggtgcccctaacaaactctccaagatcaaggtggtgaggttgtccattgcccaggtcttgacggtcatctcacagaagcaaaagcttgcattgagggaagcatacaagaacaagaagttattgcctcttgatcttcgtcctaagaagaccagagccattcgcaggaggcttacaaagcaccagcaatcactcaagactgaacgtgagaagtagaaagaaatgtacttccccatgagaaagtatgcaattaaggtctaggttatgatttccagagtaggctttttcaatgtccttcaattatatacctgttttgttgggaagttttgacatgggttatgttctttttattgttgtgaacaagatatttatgttggagttttagctacaagagtcgtgtttgtatcttttcaaagctttattttgatatctatccattttaacttgagc

SEQ ID NO: 6875 - DNA, 542 bp, Flaveria ramosissima
catcgttgccaaattagggtttcagaacaccattgcagcagcggcttctgcaacaaactcataatccatggctcggatcaaagttcatgaattgagggaaaaatcaaaggctgatttgtttactcagttgaaggatctcaaggctgaactttcacttcttcgtgttgctaaagtcaccggtggtgcccccaacaaactctccaaaataaaagtggtgaggacgtctatcgcgcaggtgttgactgttatttcacagacgcagaaggcgaagcttagggaagcttacaagaataagaagtatttgcctcttgatttgcgtcctaagaaaactagagccatccgtaggcgtttgaccaagcatcaggcctcgttgaagactgaacgagagaagaaaaggagaagtactttccattgaggaagtatgctattaaggcttagggtagatgaacatgtatgtatgttcttctcacttgaattttggatctggtctatatttattacattaatatggctgctttatgtttaagatcatttgtagcttg

SEQ ID NO: 6876 - DNA, 570 bp, Lippia dulcis
ctacattccaaagcaagaaggaagaagacattcgagatggcgaggattaaggttcacgagcttaggctgaagaacaaggtggagctgctagcgcagctgaaggatctgaagcaggaacttgggctgctgcgtgtggcgaaggtcaccggaggcgctcctaacaagctttcgaaaatcaaggttgttagactgtcgattgcgcaggtgctgaccgtgatttctcagaagcagaagtctgcgctgcgagaagcgtataagaacaaaaagtaccttcctcttgatctccgtccgaagaaaactcgcgctatccgccgccgcctcaccaagcaccaggcatctttgaagacagaaaaagcagaagaagaaagagatgtacttccctctaagaaagtatgccatcaaagtttaagtttttattgatttaagcgattttgtttctgttgctcaattttaaggaatgacaattttttgtttgagcttaactcttatatttgcaattagttcaattgtgttattgagacttgaaatccaagtatccatcatctcaatttttatgtattgacataatca

SEQ ID NO: 6877 - DNA, 569 bp, Secale cereale
atttggggtcctcattttcatctcccagcccgtccgccgccgccagcagaccagctcgacagacgcaatggcccggatcaaggtgcacgagctgaggggaagagcaagacggacctgcagggccagctcaaggacctcaaggcggagctgtccctcctccgcgtcgccaaggtcaccggcggcgccccaacaagctctccaagatcaaggtggtgcgcacctcgattgcgagggtgctcacggttatctcgcagaagcagaagtcggcgctgagggaggcgtacaagaacaagaagctgctcccgcttgacctccgccccaagaagacccgcgccatccgcaggcgtctcaccaagcaccagctctctttgaagaccgagagggagaagaagcgtgagaagtacttccccatgaggaagtatgctatcaaggcctaggttaggagcacatgttttaccggtcgagttttgcccagaagttgcatgaattttatgttctgtgtggacaccgctgctatctaagtacaatgtattggatctcctgcattaagtaccagcttttgcttattg

SEQ ID NO: 6878 - DNA, 579 bp, Euphorbia peplus
gagatccggagaaaagaaatggcaagaatcaaggtccacgagctgcgactgaagactaaggcagagctattgaaccagttgaaggatctctaggctgagttagctcttcttcgagtcgccaaggtcaccggtggtgcccctaacaaactctccaagatcaaggtggtgaggttgtccattgcccaggtcttgacagtcatctcacagaagcaaaagcttgcattgagggaagcatacaagaacaagaagttcttgcctcttgatcttcgtcctaagaagaccagagccattcgcaggaggcttacaaagcaccagcaatcactcaagactgaacgtgagaagaagaaagaaatgtacttccccatgagaaagtatgcaattaaggtctaggttatgatttccagagtaggcttttgcaatgtccttcaattatatacctgttttgttgggaagttttgacatggattatgttctttttattgttgtgaacaagatatttatgttggagatttagctacaagagtcatgtttgtatcttttcaaagctttattttgatatctatccattttaacttgagc

SEQ ID NO: 6879 - DNA, 828 bp, Utricularia gibba
tggtgattccgtctgattgttttgtttgttttgtcagctcggatcaaggtccacgagctccggcagaagaacaaggcggagcttctgacgcagctgaaagatctgaaggcggagttatctcttctccgggtggcgaaagtcactggcggcgcgcctaacaagctcgcgaaaatcaaggtggttaggctgtcgattgctcaggtgctcaccgtgatttcgcagaagcagaaaggcgctctcagggaagcgtacaggaacaaaaagtacttgcctctggatctccgccctaagaaaacgcgagccattcgccgccgtctcaccaagcatcaggcatctttgaagacggagaagcagaaaaagaaggaaatgtatttccctgtgagaaagtacgctatcaaggtttgagttgttgtcatatgctgatacaacctttgcttcattcagcattgtctcagacagatgttttgtcacaaaggaatctagcttgagaactctagcgccgtaactccatccttcatatttgtgcttggactccgtagtttgtaaaaactagaagcacagacaggcacttcttgtgtagttgacagttcaaggtcaggtatcctgatgtgtaccaagcttcagtagatagatagatgcaaatggattttgcgtaccaagcttcaatagattagattttctgatgggtgctgcatccatagctccatcctaatccaacacagccgctccctccctgctgcttttggcgaatacggtaagaagggttattctactacccaaattcgataaacttttgtatttctgattctttttcgaaatgaaatcttt

SEQ ID NO: 6880 - DNA, 930 bp, Glycine max
gtccctcttactaacactagggtttacagagaagcgaagaggcgcagccgtagcagtaactcgtggaattgctagcaatggcgaggatcaaggtttacgagctgaggcagaagacgaaggctgatctgttgaatcagctgaaggacctcaaggccgagcttgccttgcttcgtgttgctaaggtcaccggcggtgcacctaacaagctctctaagatcaaggtggtgaggttgaacattgcccaggttttgacggtgatttctcagaagcagaaggccgcgttgagggatgcctacaagaacaagaagtacttgcctctcgatctccgccctaagaagaccagggccattcgcaggaggcttactaagcaccaggcatcattgaagacagagagggagaagaagaaagagttatatttcccactgaggaaatatgctatcaaggtgtaactttagagcaatcttatctgttaattggacatttacctcctttatactcgccaagttttgataaatctcgttttgtagtttaatgttggagttattgctgattggctgtgttaaatttcatgtcttttatatacctggggtttcttgaagctaccaggatttatttatgggtatcgttagtttccgttcaatattgatgaatgcgttacatttttgccatttgttttttttatcaacatttccatctgcatatattttggtacaatgtctccacatgtgcccttttacaatactaacaaatcgtgccgtaccaggcagcttcatatacttattttcaggaatctttattcggttaattgaagcaaaaatggagttcgaagtaggaagtctccttttcctatttttctttaatacgcctattctctttagtatttactgtctacgagtctgttgatgattaactaacgcaatagttcaggta

SEQ ID NO: 6881 - DNA, 531 bp, Glycine max
ctagggtttacagagaagctaagaggcgcagccgtagcaaaagctcgtggaattgctagcaatggcgaggatcaaggtttacgagctgaggcagaagacgaaggctgatctgctgaatcaactgaaggacctgaaggcggagcttgccttgcttcgtgttgctaaggtcaccggtggtgcccctaacaagctttccaagataaaggtggtgaggttgaacattgcccaggttttgacggtgatttctcagaagcagaaggctgcgttgagggatgcctacaagaataagaagtacttgcctctcgatctccgccctaagaagaccagggctattcgcaggaggcttactaagcaccaggcatcattgaagacagagagggagaagaagaaagagttatatttcccactaaggaaatatgctatcaaggtgtaactttagagcaatcttatcggttaattggacatttacctcctttatactcgacaagttttgatatatctcgttttgtagtttcatgtttattgcttatt

SEQ ID NO: 6882 - DNA, 637 bp, Acacia harpophylla
gctggtagttttagggtttcaactttcaagtgttgggagtagcataactgcggagaaaatggcgaggataaaggtgcacgagctgaggaataaatcaaagccagagctacttaaccagttgaaggaactcaaggcagagctcgctttactccgagtcgccaaggtcaccggtggtgcccctaacaagctctctaagattaaggttgtgaggctgtcaatagcgcaggtgttgactgttatttcccagaagcagaaagcggctttgagagaggtttacaaaaacaagaagtatctgcctcttgatctccgtcccaagaagacccgagccattcgcaggcgtctcaccaaacaccaggcttcattgaagacacagcgtgaaaagaagaaggagatgtactttcccttgaggaagtatgccatcaaagtgtagggtaatcgttattgcttctaagtttgtattctccagaccagcgaatttgatatactgaatattagttctggtcttctggatgcttccattcgatcggcacttaaatttttccagccggctattttactttgatgtccttgtatgccactacttcacattattatttcccaaagttatcaaattataaagatcttgcttagaatttaa

SEQ ID NO: 6883 - DNA, 564 bp, Arnica chamissonis
cagttcacttctgcttcaatcaatggctcgcatcaaggttcatgagcttaggaacaaatcgaagggcgatttgtttgcccagttgaaggatctgaaggctgagttagctcttctccgtgtcgctaaagttaccggcggtgctccgaacaagctctcgaagataaaagtggtgaggacatcgattgctcaggtgctgactgtgatttcacagacccagaaggctgctcttagggacgcctacaagaacaagaagtacctgcctcttgatttgcgtccaaagaaaaccagagctattcgtagacgtctaaccaaacatcaggtttcattgaagaccgaaagggagaagaagaaggagaaatacttcccgctgaggaaatatgctatcaaggcgtaaggtcaaaacaatagcagggatttaggtatgaaagtctctttctagtttttgatttgcgtttgtgtacgattcatcagaaatatgtattcgtcagttttgttgcaatgagttacaagacagttggcatcaggccttgcacctttatgttaaagtgcctatttaacttgttt

SEQ ID NO: 6884 - DNA, 625 bp, Artemisia annua
atcaacgcagtactccgacggggagggtttcatatctatcagcagagagccacccacccacctttctttctttcgtcggcaggagactctaaaccaaacaatcaatcaaatggctaggattaaggttcatgagttgaggagcaaatcaaaggtggatttgtttgcacagttgaaggatttgaaagctgaactagctcttcttcgtgttgctaaggttactggtggtgctcccaacaagctctccaagatcaaggtggtgaggacatcaattgctcaggtgctgactgtgatttcacagacccagaagtctgctcttagggaagcatacaagaacaagaagtacttgcctcttgatttacgtccaaagaaaaccagagccatccgcagacgtctcaccaagcatcaggcttctttgaagaccgaaagggagaagaagaaggagaagtacttcccattgaggaagtatgctatcaaggcataagttggaagctatgaaggaggagatttaggtacttatgtgtgtaaatctctttccagttttgagttttagtttgtgaacgattggtcagaaatctatgtattcgatagttttattgcaatgacttacaagacagttgatgttgga

SEQ ID NO: 6885 - DNA, 713 bp, Fagus grandifolia
cttaaaaacactaataaagctctctgcctctctcgctccatttcagatttctagggttttcacaaaccaaccaggagccgaagccgccgcgttacttcagaatggcgaggatcaaggttcacgagttgaggaacaagtcaaaggcagatttacagagccagttgaaggacctgaaagccgagcttgctctcctccgtgtcgctaaggtcactggtggtgcgcccaacaagctctccaagataaaggtagtgaggctaggaatagcgcaagtgttgacagtgatatcgcagaaacagaaagcggcgcttagggaggtctacaagggaaagaaatacctgcctctcgatcttcgtcccaagaaaacccgtgccatccgtagacgcctcaccaagcaccaggcatctttgaagacagaacgtgagaagaagaaagagctgtactttccattgaggaagtatgctatcaaagtgtaggctaggccactagggtctcgtgttacattatggacatgttgcatttttactgaaattaccattagttgcagccatgcaggcagcctttttgtttatcttttattggggttgaaccatctagcttgaagttttaaacataagattattttcacatcttttggaaattatgttgttgatgtttgctttaggtttttatgttttgattcgatgagatctgattggagacgaaccctcagatct

SEQ ID NO: 6886 - DNA, 572 bp, Brachypodium distachyon
ccttcccttggcaccgcctacctgtaatcttcgctcccccgccgccgccgccgcttcgtcgccaccgtcgccatggcccggatcaaggtgcacgaactccgtgggaagaacaaggcggagctccagggccagctcaaggacctcaaggccgagctctccctcctccgcgtcgccaaggtcaccggcggggcacccaacaagctctccaagatcaaggttgtgcgcacgtcgatagcgcgcgtcctgacggtgatctcgcagaagcagaaggcggctcttcgtgaggcgtacaagaacaagaagctactccccctcgacctccgccccaagaagacccgcgctatccgccgccgcctcaccaaacatcagctttctctgaagacagagagggaaaagaagcgtgagaagtatttccccatgaggaagtatgccatcaaggcgtaggtctgcaacatgagttacgtttagagtttcttgaactagtatgttatcatgtatggacgcctgttgtgttctaagtacaatgtgatgctccattttgtcgaatctttcgttcaagtacttccttgtgc

SEQ ID NO: 6887 - DNA, 555 bp, Brachypodium distachyon
gctcagcccctcatttttcgtatcgccgccgccgtttgcccagtgcgccgatagccatggcccggatcaaggtgcacgagctgcgggggaagaacaagacggagctgcagggccagctcaaggacctcaaggcggagctctccctcctccgtgtcgccaaggtcaccggcggtgcccccaacaagctctccaagatcaaggtggttcgtacctcgatcgcgcgggtcctcacggtgatctcgcagaagcagaaggcggcgctgagggaggcgtacaagaacaagaagctgctcccgctcgaccttcgccctaagaagacccgtgccatccgcaggcgtcttaccaagcaccagctctctttgaagactgagagggagaagaagcgcgagaagtacttccccacaaggaagtatgctatcaaggcctaggttaggagcaaatgttttacctgtcaagttttgcccaaaagttacctgaatttgaagttccatgcggactgtcacctaagtacaatgaatttgatctactgcgtaaaatgtcctacttttgtttctt

SEQ ID NO: 6888 - DNA, 593 bp, Bruguiera gymnorhiza
aaatgtgagattctagggtttcgaggacagaggcaggcagccgttggcgcaacagctcggagatagaaggaaagcaatggcgagaatcaaggtccacgagctcaggcagaaaacgaaggcagagcttttgaaccagctgaaggaccttaaggctgagcttgctcttctccgcgtcgctaaggtcaccggcggtgctcctaacaagctctccaagatcaaggtcgtgaggttatccattgcacgggtattgactgtgatttcacagaagcagaaggctgcattgagagaggcatacaagaacaagaagttcttgccacttgatctgcgccccaagaagaccagagccattcgcaggagacttaccaagcatcagcaatcattgaagaccgagcgggagaagaagagagaaatgtacttccctatgagaaaatatgccattaaggtgtaaggcactatctaccacatagacacacttcagtatcttgaaaatcctatttgattgaccagacaagttttggctttgatcatcttcatgtcgtgaattagcaatatgttttcgtctactaagttttaaagttggattttgattgagt

SEQ ID NO: 6889 - DNA, 621 bp, Daucus carota
gccagcagaaagaacaaagcagccgccgccgctcacttgaaacatttttagcatcaatggcgaggattaaggtacatgagctgaggacaaagtccaaggcggatttgttggcgcagcttcaggaattgaaggctgagctttcgcttcttcgggttgcgaaagtcaccggtggagctcctaataagctctccaagataaaagtggttcgattgtcgattgcacaggtgttgacggttatgcaacagaagcagaaggctgctcttagggaagtctataagaacaagaaacttatgccacttgatctgcgtcccaagaagaccagagccatcaggaggcgtcttacaaagcaccaggcatcgttgaagactgagcgagagaagaaaaaggagaagtacttccccatgagaaaatatgccatcaaggtttagggtagttaactttcagggaggagaatttggaattgagatctgtttgcaatttatcttttgattctctgtatgtacttgtacttggttgaccgattcggagtgatgtgtactttgaggttgcttatgcttttttcatgcaaacaaaaactatttctgttatattgctttaagctaaggccaagaaattttagta

SEQ ID NO: 6890 - DNA, 807 bp, Daucus carota
ctctactatataaaaccctaacaagctcatccccatcatcttattctagggtttcaagcctcacagcctatccgtacagtccccgcagcaatggcgagaatcaaggttcatgaattgaggacgaaaccgaaggctgatttgctggcacagctcaaggatctcaaagctgagctcgctcttctccgtgtcgctaaagtcactggtggcgctcctaacaagctctctaagattaaggtggtcaggacatccattgctcaggtattgactgttatgcaacaaaaacaaaaagctgctctgagggaagtgtacaagaacaagaagcttatgcctctggatttgcgtcccaagaaaacaagagccattcgtaggcgtctgaccaagcaccaggcttcattgaagaccgagcgtgaaaagaagaaagagaagtactttccaatgaggaagtatgcaattaaagtgtaggcaagaatcagcaagggtcgagtttttggtatcgtgtctataaatctcgattccaattttgagttcagagaactgtttaccatttctctatattggtggatctttatttaagtgtattgttgtccctttacatcgctaaactaatgaagttgtcttatattttcactaaactaatgaggttctcttataattttagacaataatagttattcttaaggtgagtgttgtcctgttgctccactgccaggtggtggcttcaccatattttgtgtctgggttcattggaatgtttctctttagttaatgtattggtttgtcggtgtgggttcattccccacgcaggga

SEQ ID NO: 6891 - DNA, 694 bp, Manihot esculenta
agggtttcgtatccaataagagtagcagagcagctgtggttgtcttgcatcagagaaaaatggcgagaatcaaggtccacgagctgagacagaaatcgaagacggagctgttgaatcaattgaaggatctcaaggctgagcttgctctacttcgcgttgccaaggtcaccggcggtgctcctaacaaactctccaagattaaggtggtgaggttatctatcgcccaggtcttgactgtgatttcccagaagcagaaggctgctcttagggaggcatacaagaacaagaagttcttgccccttgatctgcgtcccaagaagaccagatctatccgcaggaagctaactaagcaccagcaatctttgaagacagaacgtgagaagaagagagaaatgtacttccccatgagaaagtatgcaattaaggtgtaaggtggtagtcttcacgatagactgtttttattatttgcaattataaacctattggtttactagattttatttgaatttatgttttggtcttatgtttgtaaactgggaaccgtgcacctcactattaccaggagcaagatttatgttgacatttgatttcttttcatgtttagtgaatccttgtagcactatctctggccttcacctttttaacctatgtttttgtttgattttagtgtttaatctctacttttttaatcttc

SEQ ID NO: 6892 - DNA, 889 bp, Ricinus communis
cagtctcattcttctttagagcgaggaagaaaacaaagaagagacagggccatggcaagaatcaaggttcacgagctaagaaacaaatcaaaaacagagttattgagccagttgaaagatctaaaagcagagctagctcttctccgtgttgctaaagtcactggtggtgcacccaacaagctttccaagattaaggtagtgaggctatcgatagcacaggtattgactgtgatatcacagaagcagaaggctgctttaagggaagcctacaagaataagaagttgttgcctcttgatttgcgtcccaagaagactagagctatccgcagacgtctcactaagcaccaggcatcattgaagactgagcgagagaagaagagggaaatgtactttccagtgaggaagtatgccattaaggtgtaaggttggattcatagcgaaagatggtcttttgtattacctcacaaaacgccatgacaattgatgtgtttttacattttttgaactttaatttttgccccaattaatattatgaatcacctagctttattactaactttctttacggaggttccaagttattgtcgtaacttttagctcatcattttcctaaaagctttctgaatattgttgttggtcattctcgagcagaattttgttgttatcaagtgtcgcctgttaaccatctcaaatgccatagttaaaaggaagcatccactgtctccattctggagacgccaccaaaggcatgaattgagatgtaaatgttgggagtttccaaagtcattatcttttaccatagtgaatttgtgacacctgacatggcattttcccgtttaccttttactaagacgttttgatccgaagcaaaacgcactatccattccag

SEQ ID NO: 6893 - DNA, 759 bp, Castanea mollissima
attagtagtgaaaaagcatccgccgcagcgtgtagctcaaagacgcaatggcgagaatcaaggtccacgagttgcgtcaaaagacaaaggcggagctgctcaaccagctgaaggatctcaaggccgagcttgccctcctccgcgtcgccaaggtcaccggcggcgcacccaacaagctctccaagataaaggttgtgaggctgtcgatcgcgcaggttttgactgtgatttcacagaagcaaaagggggctctgagagaagcttacaagaaaaagaagtacttgccactcgatctgcgtcccaagaagactagggccattaggagaaggcttaccaagcgccaggcatctttgaagactgaacgggagaagaagaaggagatgtatttccccatgaggaagtatgctatcaaggtgtagggtgtagggcctttagtttatgagatcttgctaccttgctaccataaatccatttggtttgcaaattttgccatttgtttacttaatcttaatttcatattggtgggacttgatcttatgtttttgttttgacattgtaaaacttaaaaatgagattttaggttatttggtgtgtgagttaaaagtatgcatttatatccttctttcgtgaatgtcatagtattattttaatgctatttttaacgccttatcaattctgccttcattttgttgtaaatttgtaatgcttattgtaccatttcatgtaatgaggaatgtccagccatggacatacgagtgt

SEQ ID NO: 6894 - DNA, 625 bp, Chrysanthemum coronarium
gataactatcagagccaccattcttcatcagcagcagcaggagactcaaaaccaaccaaatggctaggattaaggttcatgagctcaggagcaaatcaaaggcggatttgtttgcacagttgaaggatttgaaagctgaacttgctcttcttcgtgttgctaaggttactggtggtgctcccaataagctctccaagatcaaagtggtgaggacatcaattgctcaggtgctgactgtgatttcacagacccagaagtctgctcttagggaagcttacaagaacaagaagtacttgcctcttgatttacgtccaaagaaaaccagagccatccgcagacgtctcaccaagcaccaggcttctttgaagaccgaaagggagaagaagaaggaaaagtacttcccattgaggaagtatgctatcaaggcgtaagtttgaagctatgaaggatgagatttacgtacttatgtgtgtaaatctctttcccgttttgagttttagtttgtgaacggttggtcagaaatttatctattcgatagctttattgcaatgacttacaagacggtttatgttggagcttgtttcttggtgtcacatacctattcgacttgtattttgaaacgcaa

SEQ ID NO: 6895 - DNA, 740 bp, Chrysanthemum coronarium
cctcttttacgttctctaccagcagcagcaggagaagataactatcagagccacctttcttgatcagcagcagcaggagactcaaaaccaaccaaatggctaggattaaggttcatgagttgaggagcaaatcaaaggcggatttgtttgcacagttgaaggatttgaaagctgaacttgctcttcttcgtgttgctaaggttactggtggtgctcccaataagctctccaagatcaaagtggtgaggacatcaattgctcaggttctgactgtgatttcacagacccagaagtctgcacttagggaagcttacaagaacaagaagtacttgcctcttgatttacgtcccaagaaaaccagagccatccgtagacgtctcaccaagcaccaggcttctttgaagaccgaaagggagaagaagaaggaaaagtacttcccattgaggaagtatgctatcaaggcgtaagtttgaagctatgaaggatgagatttaggtacttatgtgtgtaaatctctttccagttttgagttttagtttgtgaacggttgatcagaaatctatgtattcgatagttttattgcaatgacttacaagacggtttatgttggagcttgtttcttggtgtcacatacctattcgacttgtattttgaaacgcaatttagagctgttttgctgcttgctttacacttgtggcaactcgtaatgtcttatttagtatttgttttataggcttcat

SEQ ID NO: 6896 - DNA, 737 bp, Chrysanthemum coronarium
gctaggatcaaggttcatgagttgaggagagcttctagggtttgataagtatcagcagggagccacctttctttcatcggcaggagactcaaaaccaaccaaccaatcaaatggctaggatcaaggttcatgagttgaggagcaaaacaaaggtggatttgtttgcacagttgaaggatttgaaagctgaactagctcttcttcgtgttgctaaggttactggtggtgctcccaacaagctctccaagatcaaggtggtgaggacatcaattgctcaggtgttgactgtgatttcacagacccagaagtctgctctcagggaagcatacaagaacaagaagtacttgcctcttgatttacgtccaaagaaaaccagagccatccgcagacgtctcaccaagcatcaggtttctttgaagaccgaaagggagaagaagaaggagaagtacttcccattgaggaagtatgctatcaaggcgtaagttggaagctatgaaggaggagatttaggtacttatgtgtgtaaatctctatccagttttgagttttagtttgtgaacgattggtcagatatctatgtattcgatagttttatttcaatgacttactagacagtttggtgttggagcttgtttcttggtgttgcatacctatttgacttgtttctttaaaggcaatttacagctgttttgctgcttgctttacacatttggggcaactattattagtatttgttt

SEQ ID NO: 6897 - DNA, 692 bp, Cichorium intybus
gatttcgtctattttccggaagtagggtttcagaggcggcctccattgcaacttgattctccgtcgattatcaaatggctcggatcaaagttcatgagctcaggggcaaatcgaaggctgatttgtttgcgcagttgaaggatcttaaagctgaacttgctcttctccgtgtcgccaaggtcaccggtggtgcccccaacaagctctccaagattaaggtggtgaggacatcgattgcacaagtactgactgttatctcacaaacccaaaaagccatgcttagggaagcttacaagaacaagaagtacctccctcttgatcttcgtcccaagaaaaccagagccattcgcagacgtctcaccaagcatcaggtttcattgaagacagagcgagagaagaagaaagagaagtacttccctttgaggaagtatgcaattaaggcttaggtaaaacaattgagaagggagatatatgtgaaacctcttttccaattttgaatttgggtttttgtaccgacatttttctttatcagagctggatgtattctaaaggttgtttgtaccgacacattgttcatcactctttcttgagctttcttacaaatacaaaacacccatgatagatctcattgacaagataatgcctgcactggtgcaatgttctatgcattcaaataaaaatatgttgtagtt

SEQ ID NO: 6898 - DNA, 822 bp, Cichorium intybus
gatttcgtctattttccggaagtagggtttcagaggccgcctccattgcagcttgattctccatcgattacattcaatcaaatggctcggatcaaagttcatgagctgaggggcaaatcgaaggctgatttgtttgctcagttgaaggatcttaaagctgaacttgctcttctccgtgtcgccaaagtcaccggtggcgcccccaacaagctctccaagattaaggtggtgaggacatcgattgctcaagtgttgactgttatctcacaaacccaaaaagccatgcttagggaagcttacaagaacaagaagtacctccctcttgatcttcgtcccaagaaaaccagagccattcgcagacgtctcaccaagcatcaggtttcattgaagacagaacgagagaagaagaaagagaagtatttcccattgaggaagtatgcaattaaggcttagtaggtaacacaattgagaagggagatatatgtgaaacctcttttccaattttgaatttgggtttttgtaaggaccttttttttatcaagagctggatgtattctaaaggttgtttgcattcaattggattttggatcttttttgaaattgtggcagccttcaattttcttgttagtttgattttgcaattggtaatgtctttgtcaactggtcctcaaatcagcaagcagtcctacttttagtttaaggaccgaatagaaagcaattcaaaacctaaatcagttttagttctaactcgattaaagactggagaggtttaaaactgtgttcaaatcggtcttcaatagaataaaaagcattcatctcatc

SEQ ID NO: 6899 - DNA, 476 bp, Cirsium arvense
caaactttcacgccgaatttcatccagtttgattcaatggctcgaatcaaggttcatgagctcagaaacaaatcgaaggctgatttgtttgctcaattgaaagatctgaaggctgaacttgctcttcttcgtgttgccaaagttaccggtggtgctccgaacaagctttccaagatcaaggtggtgagaaccggaatcgctcaagtgttgaccgtgatttcacagacccagaaggctgctcttagggaagcttacaagaacaagaagtacttgcctcttgatttacgtccaaagaaaacccgagccattcgtagacgtctaaccaagcatcaggcttcgttgaagacagaaagagagaagaagaaagagaagtactttccattgagaaagtatgctatcaaggcataagatgaaagctttttaaggagagttttcagttttggactttaatttttatcagaaatatgtatttgtta

SEQ ID NO: 6900 - DNA, 632 bp, Cleome gynandra
acttcttggagccaactcgagcagcagcgtcaacagcagttcaaccccaggaaggtcactatggcgaggattaaggttcacgagctcagagacaagtcgaagacggacttgctgaaccagcttaaggatcttaaggcggagcttgcacttctccgtgtcgccaaagtcactggcggtgctcctaacaagctctccaaaatcaaggtggtaaggaagtccattgctcaggtattgacagtgatttcccagaagcaaaaatctgctctgagagaagcttacaagaacaagaagcttcttcctcttgatcttcgtcccaagaaaacacgtgccattaggaggcgccttacaaaacaccaggcgtctttgaagacggagcgggaaaagaagaaagatatgtactttccgatgaggaagtacgctatcaaagtgtaatgcacttagctaaatccttagttttgatggaaacatgttattgtgttgtcattcccatatgtttcatcactatcttcacagacttggccgtagttgctttgggtttgcaatatattctatttttgacattgaacagtcatatcttactcaattgtttcgattctgaaatgaactcaatgacttaccaattaaaaaaaaaa

SEQ ID NO: 6901 - DNA, 612 bp, Trifolium pratense
acaaactacagttacattaattccaagttttttcgcggcgattgaagagcttcgaaatggctagaatcaaggtttatgagctcaggcaaaaaacaaaagcagatcttttgaatcaattgaaggatctgaaagcagaacttgctcttcttcgcgtcgctaaggtcactggtggtgccccaaataagctctccaaaataaaagtcgtccggctttcaatagcacaggttttgactgtgatttcacagaaacaaaagacagcattgagggaagcttataagaagaagaaatacttgcctttggatctgcgtcccaaaaagacaagagctattagaagacgtctcactaagcatcagcaatcattgaagacagagcgtgagaagaagaaggaaatctacttcccattgagaaaatatgctatcaaggtgtaatgttgggccttttttacatgactttggatatgttatttgacatgttttgcaaaatatttggtcttgggttttgtttttgtttccttatgagtttaactaatcattatgatacagaattttaagttaactttttctcgcctttgttttacttctcattccagattctgatttttcactgcttaaa

SEQ ID NO: 6902 - DNA, 772 bp, Cucumis sativus
aggtttgatcttcctcagtttcttcaacctagggttttgcagaccaccgccgaatcccaaaactcaactcccggtctctgcttaacagattctaatggcgagaattaaggttcatgagcttagacaaaagtcgaagggggatcttttggcccagcttaaggaccttaaggcggagcttgctctcctccgtgttgctaaggtcactggtggtgctcctaacaagctttccaaaattaaggtagtgaggttgtctatcgctcaggtattgacagtgatttcccagaagcagaaggctgctcttagggaagcttacaagaagaagaagcttttacctcttgatctgcgcccaaagaagaccagggccattcgtagaaggctcaccaaacaccaagcatctctaaagacggagagacagaagaagaaagagatgtactacccattgaggaagtatgccattaaggtgtaggcttagagggaattgattgatgatcctccgtggtatcatgcatcttctactcattttggcttttgatttatctataacattattcagacttgagtgcctattttcaatcttattgttagatctttgaactttgaaatctttcctttctttccatgtaatactttagtttcccaagttataatgaaattgttttggttaatgaccttaggcagctctatcttttgctaagttgaatgtgctctgattttaaaccataggcagctctatatttccatttgattctttagtttcctaagcaataaatct

SEQ ID NO: 6903 - DNA, 541 bp, Cucurbita pepo
aggcggcgtggagtagaagagcactcgagaagaaatggcgaggatcaaggttcatgagttgaggcagaaatcgaaggtggatctgttgacgcagcttaaggatcttaaggcggagctttctctccttcgagtcgccaaagtcaccggcggtgccccgaacaagttatccaaaatcaaggtagtgagattgtcgattgctcaagtcctgacagtgatttcccagaagcagaaggcggcattgagggaagcttacaagaagaagaagctcctgcctctggatctgcgcccaaagaagacgagggccattcgtaggaagctcaccaagcaccaagcttctttgaaaacagagagagagaagaagaaggagatgtactatccattgaggaaatatgctattaaggtgtagtaatattcggtagtcattttattatgcaacggcagaccaattttgttgacaagttttgtctcgtattcttgataagcttatgtctgattctcttggggctttcccctctaaaccaagctgttctattttcattga

SEQ ID NO: 6904 - DNA, 653 bp, Cyamopsis tetragonoloba
gcgaagaggcgcagccataaccagagctcgtgaattcagcattcagcaatggcgaggatcaaggttcacgagctgaggcagaagaacaaggcagagctgttgaatcagctcaaggacctcaaggccgagcttgccttacttcgggtcgctaaggtcactggaggtgccccaaacaagctctccaagatcaaggtggtgagattgtccattgcccaggttttgacggtgatttctcagaagcagaagtctgctttgagggaagcttacaagaagaagaagtacttgcctcttgatctccgcccaaaaaagaccagggctattcgcagaagactcaccaagcaccaggctacgttgaagactgagcgcgagaagaagaaagagacatatttccctctgaggaaatttgctatcaaggtgtaggccattagttcaatgttatcatttatttggacatttacttcttttacagttaacaagttttgatacatctcatcttgtagtttcaaatttaatctttgatgttattggctgtgtttaatttcatgtattcggactctggctttcttccatgaattcatctactgatttctgcgtattgttagttttaatcttgaaatcagagatttatctggatttatagtttgcaaaaaacg

SEQ ID NO: 6905 - DNA, 580 bp, Cyamopsis tetragonoloba
cccgatcgagaaaatggcgaggattaaggtgcacgagctgaggaacaaaaccaaggtggagttgctgaatcagctgaaggatctgaaggcggagctcgcgcttctccgagtggccaaggttaccggcggtgcccccaacaagctctccaaaatcaaggtggtgcggctttcgattgcacaggtgttgactgtgatttcccagaagcagaaagcggcacttagggaggcttacaagaagaagaagtatttacctcttgaccttcgtcccaagaagactcgcgccattcgcagacgcctcaccaaacaccaggcatctttaaagacagaacgggagaagaagaaggagctgtacttcccactaagaaagtatgcaatcaaagtttaggctagaattacttttgacttgcattttgtaagagtaatctgacttgtattgaaaatttaagcttttgatgactgccactgtggcaaaatttcaattttttgtgcgagctacttctgagttttcaacgtggtctctgtatacagctagcctgatttcagagtttctatggtttatgttaaaattggagttgtttca

SEQ ID NO: 6906 - DNA, 543 bp, Cynara scolymus
cgggggtaagcttgtgttttcagaggcggctatctcttcactcaaatcggggccatggcgaggattaaagttcatgagctgaggaacaaaaacagagcagatttgttgggtcaattgaaggatctcaaggctgagctggctcttcttcgtgtagccaaagttaccggcggtgctcctaataaactatctaaaataaaggttgttaggacatccattgctcaggttttgactgtgatgtcacagaaacagaaagcggcactgagggaagtgtacaagaacaaaaagtacacgcctcttgatttgcgtcccaagaaaaccagggccatccgtagacgtctaacaaagcaccaggcatcgttgaaaaccgaaagagagaagaagaaagagaagtatttcccattgaggaaatacgccatcaaggtttagaggtgcattattgtctttttgagttttgcagttcatcaatttcagtggtttttgtaaacccagattcgctgcttttctgctttaatgataattgaaagatgcttaaatccggcaaat

SEQ ID NO: 6907 - DNA, 1009 bp, Echinacea purpurea
cggccgggggagactggactggactgaacgtagctccagctatacgtatatatcagccctaaccttcccttcatttctcgcagctagggtttcaagctttcacggcagccttcatcgcggttgctcaacaatggctcgaatcaaggttcatgagcttaggaacaaatcaaaggctgatttgttcgctcagttgaaggatctcaaggctgaattagctcttctccgtgtcgccaaagttaccggcggtgctccgaacaagctctccaagataaaagtggtgaggacatcaatcgcgcaagtgctgactgtgatttcccagactcagaaggctgctcttagggatgcctacaagaacaagaagtacttgccccttgatttgcgtcccaagaaaaccagagccatccgtagacgtctaactaagcatcaggtttcattgaagaccgaaagagagaagaagaaagagaagtactttccattgaggaagtatgctatcaaggcgtaaggtcaaaactatcaaagaggatatctaggtgtgtctctttctagtttttgatttgtacgatttatcacaaatatgtattcgttagtttggttgcgacgagttacagttaatgtcggacttcgctcttttatgttcaagtacctgtttgagttgttttttgaaggcagtctaaagatgtttctttggttcattatgcactatatttcatcaggagcaagtaacatatttcattgattaacaaaagtatttggtagtgaatgcacaataacttgtaaattttaacagatggggtatttacagacagaagtcctaggtaatagttgttttgggtataatatgttaattcttgattcttgtggaatcaaatgcaccagcaaaacctgaattatcatgtgtacattcgtttttaaaatatcgactataacggtcgcgcatcatcagttcattttcaagattcaaacccgaccagttacacaagctcaaacatactccttgaattgaagggtg

SEQ ID NO: 6908 - DNA, 679 bp, Euonymus alatus
attagggttttggagagacccatattaagaccttagaacagtggaaaactaaccaacagagaggcagcaatggcgaggatcaaggtgcacgagctaaggaacaaatcgaagacggagctgttgaaccaattgaaggatttgaaagcagagcttgccctcctacgcgtggctaaggttaccggcggcgcccccaacaagctatccaagattaaggtcgtgaggctgtcgatagcgcaggtgttgacggtgatttcgcagacacagaaggccgcattgagggaagcttacaaaaataagaagtatttgcctctcgatctccgccccaagaaaaccagagccatccgcagacgcctcactaagcaccaggcgtctctaaagactgagcgacaaaagaagagggagatgtatttcccaatgaggaaatatgccatcaaggtgtaagattaaagaaggaagccgttccatcaagttccatcggaaggatgtcttttacaacaaaaattttggaagtaatgcatttccttaattatagaattgctcgggaaagacttcattcctgttttggttcatgtaacttatgtttagttctcaagttctaaggtcggataaggtttgagtcgctgtgatttttaggacaatggcattccttcaagaaaaaaaggggttactttttaccgaa

SEQ ID NO: 6909 - DNA, 603 bp, Euphorbia peplus
tccatcttctcttctagggtttcgccgagggccccgcagagtcgaagagcacgcgagaagaaatggcgaggatcaaggttcatgagttgaggcagaaatcgaaggcggatctgttgttgcagcttaaggatcttaaggcggagcttgctctccttcgagtcgccatagtcaccggtggtgccccgaacaagctgtccaaaatcaaggtagttagattgtcgatcgctcaagttttgacagtaatttctcagaagcagaaggcggcgttgagggaagcttacaagaagaagaagcttttgcctctcgatcttcgccccaagaagaccagggccattcgtagaaggctcaccaagcaccaggcttctttgaagaccgagagagagaagaagaaagaaatgtactttccattgaggaaatatgctattaaggtgtagtattttccggtagtcgaattttatatgcaacggcagaccaattttgttgacaagttttgtctcgtattcttgataatcttatgtcggatactctactcttgaggttttcctccctaaaccaaggtgtttcatttccatctgacaattatatatttttgacagtgtagcg

SEQ ID NO: 6910 - DNA, 589 bp, Fagopyrum esculentum
taggttttagtgaagacacgccgttctctcgtcgagacacaaaggcagcaatggcgagaatcaaggttcatgagctgaggcagaagcccaaggccgatctgttgagccaactcaaggagttgaaggctgagctttctctccttcgcgtcgctaaggtcaccggtggtgctcccaacaagctctccaagatcaaggtcgtgagattgtcgattgcgcaagtgttgactgtgatttctcagaagcagaaattggcgttaagagaggcgtacaagaacaagaagtacttgcctcttgatctccgccctaagaagacgagagctattcgccggcgtctgactaagcaccaggcttcgttgaagacagaaaggcaaaagaagaaagaggtgtatttccccttgagaaagtttgcaatcaaggtgtaaggctggagtttttgattagtagagaggcttagtagtattaaggttggagttgttgattcagcaattgttttcattatatgggatgtttgtttgaatcttttcttattcacaaagatgatcggatccttgtcagttggttcttggtctacattttatgacaaatcttt

SEQ ID NO: 6911 - DNA, 790 bp, Panax ginseng
aacgcagagtacatgggggtctcatttctatttagggtttcagaagcaagtgcaagcagcccctccgtggtttttgctttagtcaaaggacagcaatggcgaggattaaggttcatgagctgaggggtaaatcaaagacggatttgttgacccagctgaaggaactaaaggctgagctcgctctcctccgtgttgccaaggtcaccggcgccgctcctaacaagctctccaaaataaaagttgtgaggctgtcaattgcgcaggtgttgactgtcatgcaacagaaacagaaagctgctttgagggaagtgtacaagaacaagaaactactgccgcttgatttgcgtcccaagaaaactagagctatccgcaggcgtcttaccaagcaccaggcttcattgaagactgaacgtgagaagaagaaagagaagtacttcccaatgagaaagtatgctattaaggtgtagggtagaatctactgtggaggagatttgttactttgtgactacaaacctcattccaattttgaattctgaaatttgttttccattgtcctgtattgctgatcctagttcaagtgttactttattgtggtgtttactcttgtttcatgtgctgaaactattcatatcaagccctagttcaggtttactttatggtggtgtttactcttgttttaatgtgggtctaaaactaggtctgaacataggtggtatgagatgctgctgtttgcaaatttctcacttctctagtcatagcacatgaaataaaaatgatgctaaattttcag

SEQ ID NO: 6912 - DNA, 597 bp, Vitis vinifera
agtcgcagccatggcgagaatcaaggttcatgagttgaggggaaaaacaaaggcggacttgttggtgcagttgaaggagttgaaggccgaacttgctcttctccgagttgccaaggtcaccggtggtgcaccaaacaagctctccaagataaaggtggtgagattgtcgattgcacaggtattgacagttatttcacagaagcagaaggctgctctgagggaagcctacaagaacaagaagtacttgccacttgatctgcgccccaagaagaccagagccattcgcaagcgactcaccaagcatcaggtgtcattaaagacagaaagggaaaagaagagggagatgtacttccccatgaggaagtatgctattaaggtgtaggtcaggatcaattatgtttgtcattttggtattctgaatccataaatcttattaagttgacaaattttgaatattgtttactttcatctcatgttggactcaagtttggggttaaatttgttggattttgtgtttgtaagttctggtgggtgtatctcacctgataccaggatgctaggctttttctgcaatgatagctattaagaggtgtttct

SEQ ID NO: 6913 - DNA, 654 bp, Guizotia abyssinica
gcagctagggtttcaaactttcaagccagccttcatcgcaggtcgctccagcttcaatcaatggcccgaatcaaggttcacgagcttaggaacaaatcgaaggctgatttgttcgctcagttgaaggatctgaaggctgagctagctcttctccgtgtcgcgaaagtcaccggcggtgctccgaacaagctctcgaagataaaggtagtgaggacatccattgctcaggtgttgactgtgatttcacagactcagaaggctgctcttagggatgcctacaagaacaagaagtacttgcctcttgatttacgtccaaagaaaaccagagccatccgcagacgtctaaccaagcatcaggcttctttgaagaccgaaagagagaagaagaaggagaagtacttccctttaaggaagtatgctatcaaggcgtaaggtgaaaacgatcagtccatcaactatcaaggagatttaggtgtgtaaatctctatcttgtttttgacttttgtttgtttccaattcatcagaaatttgtatttgttagtttggttccaatgagttacaagacggttaagattttatgtacttccttttatgttaagtacctatttggcttggttttggaaggtagtttacagttatgtttgttgccaaaat

SEQ ID NO: 6914 - DNA, 772 bp, Mesembryanthemum crystallinum
cccgggctgcagggtttttgtacactgctgagtcgccgttgcaggtctcaccaccgaggaagaagaagatggcgaggatcaaggttcatgagttgaggcagaaatcgaaggcggatttgttgaaccagttgaaggatctcaaggctgagcttgctcttcttcgtgttgctaaggtcaccggtggtgcacccaacaagctctccaagattaaggtggtgaggttgggtattgcacaagtgttgacagtgatatcacagaagcagaaatcagcattgagggaagcttacaagaacaagaagtacttgcctcttgacctccgccccaagaagaccagagctattcgccgtcgcctcaccaagcaccaggcatctctgaagaccgagagggagaagaagaaggagatgtactatcccatgaggaagtttgccatcaaggtgtaaggtagataattgcctgtaggacgagtgctatttttttgactttctaccttttatggaaatgaaatctcttaaattttgagtttcttcaatgatgaggatttaggtctttccccctttcgtctattcctcctctactttattttcccctttttattcttagttttttctccttttccttttttaccattctcctattttctcctccatttatgtttacctttctttgcttacttttttttcaccctcccttatcctccccccttttctcttcattttttctatattatctcccttcattttttttcttctttttttcctatattttacaccct

SEQ ID NO: 6915 - DNA, 625 bp, Mesembryanthemum crystallinum
cactagtcctagaccgatcggcacgagctcactgctactctctctctctctcctccgaaacaagacgatggcgagaatcaaggttcatgagttgaggcagaaatcgaaggcggatttgttgaaccagttgaaggatctcaaggctgagctcgctcttcttcgtgttgctaaggtcaccggtggtgcacccaacaagctctccaagattaaggtggtgaggttgggtattgcacaagtgttgacagtgatttcacagaagcagaagtcagcattgagggaagcttacaagaacaagaagtatctgcctcttgaccttcgtcccaagaagaccagagccattcgccgtcgcctcaccaagcaccaggcatccttgaagactgagagggagaagaagaaggagatgtactatcccatgaggaagtttgccatcaaggtgtagggtagataatcatctgtaggaggatgtttggtatttttcgactttctactctatatggaaatgaaatctctgaaattattttgagtttcttcaatgatgaggacatttgcaagtctatgactactcaattttgtgtactaaatgtcgaaatgttagcttctctattattgacaacaattttgcgtg

SEQ ID NO: 6916 - DNA, 608 bp, Ipomoea batatas
aaagaggacgagagcatcagttgcaggaacacgaagcagcagcgatggcgagaatcaaggttcacgagctgaggaacaaaaacaagtcggagctgcttgctcagttgaaggatctcaaggcggagcttgccctcctccgtgtcgctaaggtcaccggaggtgctcctaacaagctctccaaaatcaaggtggtaaggctgtcaattgcacaggttttgactgtgatctcacagaagcagaaggctgtgctaagggaagcatacaagaacaagaagtacttgccgcttggcctccgccccaagaagaccagagctattcgccgacgtctaactaagcaccaggcctctttgaagactgagagacaaaagaagaaggagatgtacttcccattgcgaaagtatgctattaaagtgtaggatacaacctactaggattccatgtctcttctcaatatcaaaattttcaggtagagctgagttttgtcagtttgttttgttgggtttgatgaggaaaatgttcactttagcttgttatttttaacttctatgcactgcaatcttcagtacattttattattgaatcatacgaaaatgcataaacctttcact

SEQ ID NO: 6917 - DNA, 773 bp, Lactuca sativa
aagagatccgggttaagcccattttgtatcgtgtggactgtggaccctttcgtataaatggaagccgtcataactaaaccctaagatttcgaccattttccgtatctagggtttcagacgcagcctccaccctccattgcagcttgcatctgctttgattacacttaatcaaatggctcggatcaaagttcatgagttgaggggcaaaaccaaggctgacttgtttgctcagttgaaggatcttaaagccgaacttgctcttctccgtgtcgctaaggtcaccggtggtgcgcccaacaagctctccaagataaaagttgtgaggacatcgattgcacaggtgctgactgttatctcacagacccaaaaagccatgcttagggaagcttacaagaacaagaagtatcttcctcttgaccttcgtcccaagaaaaccagagctattcgcaggcgtctcaccaaacatcaggtttctttgaagacagagagggagaagaagaaagagaagtactttcctttgaggaagtatgcaatcaaggcatagatagtgaaaccctttttttcttcagttttgaatttggatttgtgtacgttttttgtttaattattatcagagttttgatattatttgaaggttgttagcattcaattaaatattggattttgctttgaagttgaggcagagttgtcttgttgatttgattttatattggtctataaatcgttgctgctatatccatatatatgaacctgaataattcatttaactcctt

SEQ ID NO: 6918 - DNA, 751 bp, Cucumis melo
gaacctagggttttgaagaccaccgccgaatcccaaaactcaactcccggtctctgcttaacagattctaatggcgagaattaaggttcatgagcttagacaaaagtcgaagggggatcttttagcccagcttaaggaccttaaggcggagcttgctctcctccgtgtcgctaaggtcactggtggtgctcctaacaagctttccaaaattaaggtagtgaggttgtctatcgctcaggtgttgacagtgatttctcagaagcagaaggctgctcttagggaagcttacaagaagaagaaacttttgcctcttgatttgcgcccaaagaagaccagggccattcgtagaaggctcaccaaacaccaagaatctctaaagacggagcgacagaagaagaaagagatgtactacccactgaggaagtatgccattaaggtgtaggctcagagagaattgattgatgatcctccgtggtatcatgcatcttctactcattttggcttttgatttatctataactttattcagacttgagtgcctattttcaatcttattgttagatctttgaactttgaagtctttcctttctttccatgtaatactttagtttctcaagttataatgaaatggttttggttaatgaccttaggcagctctatcttttgctaagttgaatgtgctctgattttaaaccataggcagctctatatttccatgtaatactttagtttcctcagccataagtcttca

SEQ ID NO: 6919 - DNA, 625 bp, Momordica charantia
gagtcttcccagtagcagctctttcaccaggttccatctcctcttctagggtttcgtcgagggcggcgcagagtttcgaagagcacgcgagaagcaatggcgaggatcaaggttcacgagttgaggcagaaatcaaaggcggatctgttgacgcagcttaaggatcttaaggcggagcttgctctccttcgtgtcgccaaagtcaccggcggtgccccgaacaagctatccaaaatcaaggtggtgagattgtcgatcgctcaggtcttgacggtgatttcgcagaagcagaaggcggcattgagagaagcgtacaagaagaagaaacttttgcctctcgatctgcgtccaaagaagaccagggccattcgtagaaggctcaccaagcaccaggcctccttgaaaactgagagacagaagaagaaagagatgtactttccattgaggaaatatgctattaaggtgtagtgttatctgatagacattttcttatgcaacggcagaccaattttgttgacaaattttgtctcgtattcttgataattttactttggatactctctgagatttttcctcaaccaagatgttttatttttgttgacttttatttatcttgacagttagt

SEQ ID NO: 6920 - DNA, 657 bp, Mimulus guttatus
taaaaaggttattagggtttcggacttgcactatttcatcagcacccaacatttttgctgcgggaagaaaaatccaacgaagagaaatggcacggatcaaggtgcacgagctccggcagaagaacaaggcggagctgttggcgcagctgaacgatctgaaggcggagctgtcgttgctgcgggtggcgaaggtgaccggcggcgctccgaacaagctatcgaagatcaaggtggttagactatcgattgcgcaggtgctgaccgtgatttcgcagaagcagaaatccgctctgcgtgaagtgtacaagaataagaagtatgtgccgcttgatctccgccctaagaagaccagagctatccgccgccgcctcacaaagcaccaggcatctttgaagacggagaagcagaagaagaaagacatgtacttccccttgaggaaatatgctattaaagtttaagttgtttttgtactgaaggccaaattttgaagacgatctaaatcttgtgctcaatcgaatttttagttttctggattttttttcaaagatattgtgatattaagtacgaagttgagtgatgtttggttattttatatccatgattttacttaatataatcgtgcatactgaatttgaaattcggatcattataaaagtt

SEQ ID NO: 6921 - DNA, 646 bp, Quercus alba
gtagctcagagacgcaatggcgagaatcaaggtccacgagttgcgtcaaaagacaaaggcggagctgctcaaccagctgaaggatctcaaggccgagcttgccctcctccgcgtcgccaaggtcaccggtggcgcacccaacaagctctccaagataaaggttgtgaggctgtctattgcgcaggttttgactgtgatttcacagaagcaaaagggggctctgagagaagcttacaagaagaagaagtacttgccactcgatctgcgtcccaagaagactagggccattaggagaaggcttaccaagcgccaggcatcattgaagactgaacgggagaagaagaaggagatgtatttccccatgaggaagtatgctatcaaggtgtagggtgtagggcctttagtttatgagatcttgctaccttgctaccataaatccatttggtttgcaaattttgccatttgtttacttaatcttaatttcatattggtgggacttgatcttatgtttttggtttgacattgtaaaacttaaaagtgagattttaggctatttggtgtgtgagttaaaagtatgcatttatatccttctttcgtgaatgtcatagtattattttaatgctatttttaacgccttatcaattac

SEQ ID NO: 6922 - DNA, 615 bp, Orobanche aegyptiaca
ctctcctgcagaaccaagaagatggctcggatcaaggtgcacgagcttcggcagaagagcaaggcggatctgttgtcgcagttgcaggaactgaagggggagctttcgctgctgcgcgtggccaaggtcaccggcggcgcgccaaacaagctctccaaaatcaaggtggtcaggctgtcgattgcacaggttttgaccgtcatttcgcagaagcagaaggccgctctacgagaagtatacaagaacaagaagtatttaccgcttgatcttcgccctaagaagacgcgagccatccgccgtcgtctcaccaagcatcaggcatctttgaagacagagaagcagaagaagaaagaaatgtacttcccattgaggaaatatgccatcaaagtttaagttgtgtttttgtttcggaactctgatcttgaatgattttgaaattgtttggaattaagtatttacatttggaatttaattccgagattatgagataatttttcgttgtgttagactgttgtatagcttgtgaacctttgttcatttgcataattgaatttgtcatcaaattcataaatattagcattgaatagaatcaaacctagtggagattgccaatct

SEQ ID NO: 6923 - DNA, 758 bp, Petroselinum crispum
aaaaccctaacaacctcgtccccatcattttattctagggtttgaagcctcacagcacaaccgtacagtctccgcagcaatggcgagaatcaaggttcatgagttgaggacaaaatcaaagccagatttgttagcacagcttaaggatctgaaagctgagctctctcttctccgtgtcgctaaagtcactggtggcgctcctaataagctctcgaagattaaggtggtgaggacatcaattgcgcaggttttgactgttatgcaacagaaacaaaaggctgctctgagggaagtgtacaagaacaagaagctcatgcctctggatttgcgtcccaagaaaactagagccatccgtaggcgtcttaccaagcaccaggcatcactgacgaccgagcgtgaaaagaagaaagagaagtacttcccaatgagaaagtatgcaattaaggtttaggctagaatctgcaagggacgtgattttggtatcgtgtctataaatctcacttccagttttgagttcagagaacggtttaccatatctatgttggtggatcttaatttaagtgtattgttgttcctttacatcagtaaactcaaagttctataattttagactatgttagttatgtgaactaaaaatcttgttgctcgaccgccttctcctataattttagaccatgttagttgtatgaatgaagaatcttgttgctccacttccaggtgttggcttgacctgtttcatgtctgggtttgttggattg

SEQ ID NO: 6924 - DNA, 526 bp, Lippia dulcis
tttcggactgctcatctcccacaaccttctccattccatcacaaggaaagggatggcgaggattaaggttcacgagcttagattgaagaacaaggtggagctgctggcgcagctaaaggatctgaaggcggagctggcgctgctgcgggtagcgaaggtgaccggaggcgctcccaacaagttgtcgaagatcaaggtggttaggctgtcgattgcgcaggtgctgaccgtgatttctcagaagcagaagtccgcgctacgagaagcgtacaagaacaagaagtacttgccgcttgatctccgccccaagaagactcgcgctatccgccgccgcctcaccaagcaccaggcatctttgaagacagaaaagcaaaagaagaaagagatgtatttccctctaagaaagtatgccatcaaagtttaagttagtttttaattcaaccgatttttgcttctgtttcccaatcttaaggaatgacatatttgttaaaatgaacttatttgcaattagttcaatgtgttgttg

SEQ ID NO: 6925 - DNA, 723 bp, Cajanus cajan
gcgagcttgtccctcccatttaaaattagggtttacggcgaagaggcgcagccatagcagaagctcctgaaattgctagcaatggcgaggatcaaggtttacgaactgaggcagaagacgaaggctgagctgttgaatcagctgaaggacctaaaggcggagcttgccttgcttcgtgtcgctaaggtcaccggaggtgcccctaacaagctctccaagataaaggtggtgaggttgtcgattgcgcaggttttgacggtgatttctcagaagcagaaggctgcgttgagggatgcctataagaacaagaagtacttgcctcttgatctgcgccctaagaagactagggctattcgcagaaggcttaccaagcaccaggcatcattgaagacagagaagcagaagaagaaagagacatatttcccaatgaggaaatatgctatcaaggtgtaacactagagcaatcttatctattaattggacatttacctcctttatacttgacaagttttgatacatctcgttttgtagtttcatgttggaatcgttgcttatcattgccttttaattattatgtctttagaccggtgtttcttgaagctaccagtattcatgcgaattgttagtttcttttgttattttcagttcaaaattgaaaaaatgcattacatttttgtcatttatttttatcaacattttcatctgtggcttttttcatgattg

SEQ ID NO: 6926 - DNA, 755 bp, Cajanus cajan
gtttaacattgtgcctccgattttagggtttcggagtcgttgcagcgctgcgcatcaatccgaacaatggcgaggataaaggtgtacgagctgaggaacaagactaaggcggagctgctgaaccagctgaaggatctcaaggcggagctcgctctcctccgagtcgccaaagtcaccggcggcgcccccaacaagctctccaaaatcaaggtggtgaggctctcgatagcgcaggttttgacggttatttcgcaaaagcagaaagcggcgctcagagaggcgtacaagaataagaagtatttgccccttgacctccgtcccaagaagactcgcgccattcgcagacgcctcaccaaacaccaggcatcattgaagacagaacgggagaagaagaaggagttgtactttcccctaaggaagtatgcgatcaaagtttaggtcagaatcggtttcaagttacatttgtagaacagttatttgtattgaaattttaattttaatgttttgatgcctgcatatgctagcattccaatttttattaccagagttgtgtcggtgcctgcctttagagtttctgagttctgtgttaaaactagagttgtttcgagaatttatggttgcttttggccttttgttttatggcgtatcacccgatgaatgatcaatggcagtaatagtatcatttttgagttctgatttatgcacatttcaacagtgaatatcaatttacacttcgtttccctcgatttttggag

SEQ ID NO: 6927 - DNA, 666 bp, Papaver somniferum
ctcctagcaagaagtctagggtttcaaaatcgcagcgaggagaagttcagtggaataggaaggaggcaaagcaatggcgaggattaaggttcatgaactcagagataagtctaagactgatttattgaaccagttgaaggatctgaaagctgaactagctttactccgtgttgctaaggttactggtggagctccaaacaagctctctaagatcaaggtggtaaggttgtcgattgcacaagttttgaccgtgatttctcaaaaacagaagtctgctttgagggatgcttacaagggtaagaagtttttgccacttgatcttcgtcctaagaagactagagctatcaggagacgtcttaccaaacatcagctgtcactgaaaactgaaagagagaagaagaaggagatgtacttcccaatgagaaagtatgcaatcaaggtgtaggtttagcaaatctgctggcggagaattttgtgttatctcttttatctccttccctagatatttgactccatggcttgttatgtttggaagtattttgtacttgtccatctattttggttttaggcaccgtatacaatgaataccagggtatttgaatctttatggctcttttaaggctcccttttttaaactttattctttaattccattgtatgttagat

SEQ ID NO: 6928 - DNA, 606 bp, Papaver somniferum
caaaatcgcagcgaggagaagttcagtggaataggaaggaggcaaagcaatggcgaggattaaggttcatgaactcagagataagtctaagactgatttattgaaccagttgaaggatctgaaagctgaactagctttactccgtgttgctaaggttactggtggagctccaaacaagctctctaagatcaaggtggtaaggttgtcgattgcacaagttttgaccgtgatttctcaaaaacagaagtctgctttgagggatgcttacaagggtaagaagtttttgccacttgatcttcgtcctaagaagactagagctatcaggagacgtcttaccaaacatcagctgtcactgaaaactgaaagagagaagaagaaggagatgtacttcccaatgagaaagtatgcaatcaaggtgtaggtttagcaaatctgctggcggaaatttctgtgttatctcttttatcttcttccctggatattgttcgtagatttgactccatggtgtgttatgttttgaagtattttgtacttgtccatctattttggtattaggcactgtatacaatgaataccaaggtatttgaatctttatggctcttttaa

SEQ ID NO: 6929 - DNA, 712 bp, Papaver somniferum
agctgcttctaggtttagtagagaagcaaatttagctgcgcagaaatggcaagaattaaggttcatgaactcagggccaagtccaaggcagatttattaaaccagttgaaagatctgaaagctgaacttgctttacttcgtgttgctaaggtcaccggtggtgctcctaacaagctctccaagattaaagtggtgaggttatcgattgcgcaagtattgacagttatatctcagaagcagaaattagcacttagggatgcttacaagaacaagaagtttttgcctcttgatcttcgtcctaagaaaactagagctattcgtaggcgtcttactaagcaccagttatcattgaagacagaacgcgagaagaagaaggaaatgtactttcctatgaggaagtatgccatcaaggtgtaggaatcttggatatcttttactgcagaagagtagtttgtcgatttttgattgcattaccattcccatcgacttgttttgttctaagcacatttgtagtagacaatctgcaattacgttgaatgtttcgacaaatttcacttaaaacttcaagtttaagtactattgttgctttagttgcagtttaatcgacttgttaacggaagttgatgacatatattgctttagttgctacatatgattgcgggtgctcttggctctactcgcatgaaatttaattttgcttctcctttcgtgt

SEQ ID NO: 6930 - DNA, 679 bp, Rosa hybrid cultivar
gtgttagggtttcattttttcagtgaagctaaagagagagccgccgttgcagaacctcacccacacagcgcaatggccagaatcaaggtacacgagctgaggcagaagtcgaaggccgatcttttggcccagctcaaggatctcaaggcggagctggccctcctccgcgtcgccaaggtcaccggtggagcacccaacaagctctccaagattaaggttgtgaggcttgggattgctcaggtgttgacagtgatctcgcagaagcagaaggctgcgttgagggaggtgtacaagaacaagaagctcttgcctcttgatcttcgtcccaagaagaccagggccattcgccgaaagctcaccaagcaccaggcatctttgaagactgaacgtgagaagaagagggagatgtactaccccttgaggaagtttgccatcaaggcatagagtgttggtttgcttaagttagaaaatctatcttctgtaatagaaacttctggtcacaagttttgattttgaattaatatgttgaacatgagattttggtgtttaatttgacttctctaggttgggtatcacccgaaccgattatgtgttcttctccggtgcaatggtagtttaaatttcttttagatttctattaatgcctctgggtttatccttttattcttctggttgaata

SEQ ID NO: 6931 - DNA, 767 bp, Secale cereale
cgccgccgccagcagaccagctcgacagacgcaatggcccggatcaaggtgcacgagctgagggggaagagcaagacggacctgcagggccagctcaaggacctcaaggcggagctgtccctcctccgcgtcgccaaggtcaccggcggcgcccccaacaagctctccaagatcaaggtggtgcgcacctcgattgcgagggtgctcacggttatctcgcagaagcagaagtcggcgctgagggaggcgtacaagaacaagaagctgctcccgctcgacctccgccccaagaagacccgcgccatccgcaggcgtctcaccaagcaccagctctctttgaagaccgagagggagaagaagcgtgagaagtacttccccatgaggaagtatgctatcaaggcctaggttaggagcacatgttttaccggtcgagttttgcccagaagttgcatgaattttatgttctgtgtggacaccgccgctatctaagtacaatgtattggatctcctgcattaagtaccagcttttgcttattgacactattatctggttacagctgcttgttgatgttgcaatggatggttatcgtaccttgttaatttacagtttatctgattgtgagtttccatcggtgaaggatgcttgttgttctgcatgttagtttgttttcagatagtggtcttcgtaactcccatctgctttccatatatcacaaatttgtaattgtttgcgttaaaactatggaaaatatataagcaagtttaga

SEQ ID NO: 6932 - DNA, 722 bp, Sciadopitys verticillata
ttttaccggaattagccgtttaaaccctagtgcctcccgaaaccctaaaagcgtatgcgagctgccagcaatagcttgtttgtgctgcagggacagtataggggaggggagggaagtgaaggccagtaaagggaagcgtaggttttttttcactatctgtcagggttgcgtaagcaatggcgaggattaaggttcacgagttgcggacgaagggtaaatcagatctgttgaaccagctgaaagacctgaaggcggagcttgccctgctgagagtggcgaaagtgacaggaggagctcctaacaagctctctaaaataaaagtcgtacggaagtcgatagcacaagtgttgacagtgatatctcagaaccagaaggcggctctgagggaggcgtacaagaagaagaagtatctccctcttgatttgcgccctaagaagacccgtgccatcagacgtcgccttaccaagcaccaggcttcattgaagaccgagagagagaagaagaaggagatgtacttcccaatgagaaagtatgccattaaggtctaatgaccgttgtttttgtgagcaggaatatttataggaaatagaagcatttcatattaattgtgtacttacatttatttggaaagctgtgactgaattccatttttattgatatgcctaccttttttcttgtggagatttacaaactcatttttacaattcattgggataatcaaa

SEQ ID NO: 6933 - DNA, 932 bp, Glycine max
tcgtccctcttactaacactagggtttacagagaagcgaagaggcgcagccgtagcagtaactcgtggaattgctagcaatggcgaggatcaaggtttacgagctgaggcagaagacgaaggctgatctgttgaatcagctgaaggacctcaaggccgagcttgccttgcttcgtgttgctaaggtcaccggcggtgcacctaacaagctctctaagatcaaggtggtgaggttgaacattgcccaggttttgacggtgatttctcagaagcagaaggccgcgttgagggatgcctacaagaacaagaagtacttgcctctcgatctccgccctaagaagaccagggccattcgcaggaggcttactaagcaccaggcatcattgaagacagagagggagaagaagaaagagttatatttcccactgaggaaatatgctatcaaggtgtaactttagagcaatcttatctgttaattggacatttacctcctttatactcgccaagttttgataaatctcgttttgtagtttaatgttggagttattgctgattggctgtgttaaatttcatgtcttttatatacctggggtttcttgaagctaccaggatttatttatgggtatcgttagtttccgttcaatattgatgaatgcgttacatttttgccatttgttttttttatcaacatttccatctgcatatattttggtacaatgtctccacatgtgcccttttacaatactaacaaatcgtgccgtaccaggcagcttcatatacttattttcaggaatctttattcggttaattgaagcaaaaatggagttcgaagtaggaagtctccttttcctatttttctttaatacgcctattctctttagtatttactgtctacgagtctgttgatgattaactaacgcaatagttcaggta

SEQ ID NO: 6934 - DNA, 631 bp, Glycine max
atttaactctagggtttacagagaagctaagaggcgcagccgtagcaaaagctcgtggaattgctagcaatggcgaggatcaaggtttacgagctgaggcagaagacgaaggctgatctgctgaatcaactgaaggacctgaaggcggagcttgccttgcttcgtgttgctaaggtcaccggtggtgcccctaacaagctttccaagataaaggtggtgaggttgaacattgcccaggttttgacggtgatttctcagaagcagaaggctgcgttgagggatgcctacaagaataagaagtacttgcctctcgatctccgccctaagaagaccagggctattcgcaggaggcttactaagcaccaggcatcattgaagacagagagggagaagaagaaagagttatatttcccactaaggaaatatgctatcaaggtgtaactttagagcaatcttatcggttaattggacatttacctcctttatactcgacaagttttgatatatctcgttttgtagtttcatgtttattgcttattggctgtgttaaacttcatgtcttctttagacctggggtttcttgaagctaccaggatttatgggtatcgttagtttccgtttaatattgatg

SEQ ID NO: 6935 - DNA, 566 bp, Euphorbia esula
aagaaatggcaagaatcaaggtccacgagctgcgactgaagactaaggcagcgctattgaaccagttgaaggatctcaaggctgagttagctcttcttcgcgtcgccaaggtcaccggtggtgcccctaacaaactctccaagatcaaggtggtgaggttgtccattgcccaggtcttgacagtcatctcacagaagcaaaagcttgcattgagggaagcatacaagaacaagaagttcttgcctcttgatcttcgtcctaagaagaccagagccattcgcaggaggcttacaaagcaccagcaatcactcaagactgaacgtgagaagaagaaagaaatgtacttccccatgagaaagtatgcaattaaggtctaggttatgatttccagagtaggctttttcaatgtccttcaattatatacctgttttgttgggaagttttgacatggattatgttctttttattgttgtgaacaagatatttatgttggagatttagctacaagagtcatgtttgtatcttttcaaagctttattttgatatctatccattttaacttgagc

SEQ ID NO: 6936 - DNA, 611 bp, Euphorbia esula
tccatcttctcttctagggtttcgccgagggccccgcagagtcgaagagcacgcgagaagaaatggcgaggatcaaggttcatgagttgaggcagaaatcgaaggcggatctgttgttgcagcttaaggatcttaaggcggagcttgctctccttcgagtcgccatagtcaccggtggtgccccgaacaagctgtccaaaatcaaggtagttagattgtcgatcgctcaagttttgacagtaatttctcagaagcagaaggcggcgttgagggaagcttacaagaagaagaagcttttgcctctcgatcttcgccccaagaagaccagggccattcgtagaaggctcaccaagcaccaggcttctttgaagaccgagagagagaagaagaaagaaatgtactttccattgaggaaatatgctattaaggtgtagtattttccggtagtcgaattttatatgcaacggcagaccaattttgttgacaagttttgtctcgtattcttgataatcttatgtcggatactctactcttgaggttttcctccctaaaccaaggtgtttcatttccatctgacaattatatatttttgacagtgtagcgtttttatt

SEQ ID NO: 6937 - DNA, 543 bp, Helianthus annuus
aaactttcacgccgaatttcatccagtttgattcaatggctcgaatcaaggttcatgagctcagaaacaaatcgaaggctgatttgttcgctcaattgaaagatctgaaggctgaacttgctcttcttcgtgttgcgaaagttaccggtggtgctccgaacaagctttccaagatcaaggtggtgagaaccggaatcgctcaagtgttgaccgtgatttcacagacccagaaggctgctcttagggaagcttacaagaacaagaagtacttgcctcttgatttacgtccaaagaaaacccgagccattcgtagacgtctaaccaagcatcaggcttcgttgaagacagaaagagagaagaagaaagagaagtactttccattgagaaagtatgctatcaaggcataagatgaaagctttttaaggagagttttcagttttggacttaaatttttatcagaaatatgtatttgttagtttggttgcactgatttacaagacttttgcccattcaacttttgcttttttatgtttgactggtttt

SEQ ID NO: 6938 - DNA, 564 bp, Helianthus annuus
actggttcttcgttttattctagggtttcagaacactacagcggcggcatttgcaacaaactcgtaatccatggctagaatcaaagttcatgagttgagggagaaatcaaaaaccgatttgtttgctcagttgaaggatctcaaaactgaactcgcactcctccgtgttgctaaagtcaccggtggtgctcctaacaagctctccaaaataaaagtggtgaggacttcaattgcacaggtgttgactgttatttcacagacacagaaggcaaagctcagggaagcttacaagaacaagaagtacttgcctcttgatttgcgccctaagaagaccagagccattcgtaggcgtttgaccaaacatcaggtgtcgttgaagacggaacgagagaagaaaaaggagaagtactttccattgaggaagtatgctattaaggcttagttatatcgagtattaagggtcttctcacttaattttgagcttttatctttacacactttgatgtttttggtctaagttcattctgtatctcttgatcttcatattgaaattacatgtttttg

SEQ ID NO: 6939 - DNA, 477 bp, Tamarix hispida
gggggatattatagcggtgttccataacccgcgtcttctcggcctcagtagggtttcagtctgtgtatcgccgttcaagccttagcaatggcaagaattaaggttcacgaattgaggcagaaatccaaacaggagcttttgaatcagctcaaggatctcaaggctgagctttctctccttcgtgttgctaaagtcactggtggtgctcctaataagctttccaagatcaaggttgtaaggttgtccattgctcaagttttgacggtgatctcacagaagcagaaaacagcgcttagagaagcttacaagaacaagaagtacttgccacttgatctccgtcccaagaagaccagagccattcgtcgtcgcctcacgaaacaccaggcatccttgaagacagaaaagcagaagaagaaggaaatgtacttccctatgagaaagtttgctatcaaggtgtagcaagactccatattcatt

SEQ ID NO: 6940 - DNA, 606 bp, Triphysaria pusilla
aaacagacctaaacagacgacagaaatggctcggatcaaggtccacgagctccggcagaagagcaagtcagatctgttggcgcagttgaaggacctgaagacggagctttcgttgcttcgtgtggctaaggtgactggcggcgcacccaacaagctctccaaaatcaaggtggttaggttgtcaattgctcaggtgctcaccgtcatctcgcagacgcagaagtccgctctgagagaagcgtacaagaacaagaagtatttgcctctagatctccgtcctaagaagacccgtgccattcgccgtcgtctcaccaagcaccaagcatctttgaagaccgaaaagcagaagaagaaagaaatgtacttccctttgaggaagtatgctattaaagtttaagttctgtattggaagtcttatcttgaatggtattgaaattttgtgttcaattcagtttttaaatttggagttcagttcaggtgtcaaaactagaagactgggagttaagttcatttgagttcagttgagttaagttcagtttttaaatttgtacttgagttcagtcgaatctttgaagaaccattgatctatttgtatgatcagatgaa

SEQ ID NO: 6941 - DNA, 579 bp, Tripterygium wilfordii
ctgttccgaagcagcatcaatggcgaggattaaggtccacgagctgagacagaaacccaaggcagagctcttgaaccagctcaaggatctcaaggccgagctcgctctcctccgtgtcgctaaagtcactggtggcgcacctaacaagctctctaaaatcaaggtggtgagattgtcgattgcccaggtgttgactgtgatttctcagacccaaaaggccgcactgagagaggtttacaagaataagaagttcatgccccttgatttgcgtcctaagaagaccagagccattcgcagaaggctaacaaagcatcaggcttccttgaagacagaaaggcagaagaagaaggagatgtattttcccatgaggaagtatgctattaaggtgtaatgcagttttattacctaggatattttggtatcttgcagttatgaaacgtttggatatgaaattttgatgttatttactcctaatggtcttgttcgtgaacaatagtgtcattgttttcatgccaaatttggatggtttatattggcaaagttggatgactaggtttgtgatagaattgtggaccagac

SEQ ID NO: 6942 - DNA, 659 bp, Valeriana officinalis
atcgccgtcccagcgtaatcatagattttaccatcacaaatcttccggagctcagtcagagaagagagagagagagaggccatggcgagaattaaggttcatgagttgaggcagaaatccaaggctgatctcctagctcagttgaaggatctgaaggcagaacttgctctgctacgtgtcgctaaagtcaccggcggtgcaccgaacaagctttcaaaaattaaggttgtaaggctgtcaattgcgcaagtgttgactgtcattcagcagacccagaaagcagctttgagagatgtgtacaagaacaagaagtacatgcctcttgatcttcggcctaagaagactcgggctattcgtaagcgtctcaccaagcatcaggcttccttgaagactgagagggaaaagaaaaaggagatgtattttccattgaggaaatatgctattaaggtttgataatcgtttgtgtcgaattttgtttcgttaaacttcagtcttttttagactaaacttgtcatgaattttcttgtttgttttttccagtagtactgccatatgtattatgcaattttggcttaatataaaatttggtgggtgtgttgtgcctgtttttgttttttataaattgatttgtgcttttagcactacaggtcataaaacta

SEQ ID NO: 6943 - DNA, 964 bp, Vinca minor
ccactcgaagaagaataagcaatggcgagaattaaggttcatgaattgaggaacaagacaaagcaagagttgcttgctcagctgaaggatctgaaggcggaactcgctactctacgtgtcgctaaggtcaccggcggtgctcctaacaagctctccaagatcaaggtagtgaggttgtccattgcccaagtgttgactgttatttcacaaaaacagaagtctgctttgagggaagcctacaagaacaagaagtacttacccctggacctacgcccaaagaagaccagagccatccgtagacgtctgaccaagcaccaggcctctttgaagactgagagagagaagaagaaggagatgtactatcccatgaggaagtatgccattaaggtttagggcagtagccttgtgttgaagttttgatgtttacgttaaaatataataggtcaatccttaagttaatggattttgttattggatatcatttgtcactattgacttgtgatgaattttggaatttcaattttcatgtttctagtttctagtgtgtatcatttttagaattggttaagctttattatattttgtgtacttcctactttagtttaggtacactccaacagcttggctggtttgtatctggttgaatatttttgactttgttttagaatatgaatttgatggccgccaaagtattggttgcaagaaaattggtgccctccgtatagggaattatactatacaaatctgacaacattcagctgcagaaaggaacgtggaaatgttggtgagatttttcacataattttggtgattacttgtcagatttactttactgaactgatgttcgggggattgatcaacaccatcaaactcttgagcatcttagtgtcgtccctatgttgtcaagtgtaatagataatattctatctcgttgtctatttttcaataattgtaaatcagtagc

SEQ ID NO: 6944 - DNA, 530 bp, Utricularia gibba
gctcggatcaaggttcacgagcttcggcagaagaacaaggcggagctgttggcgcagctgaaagacctgaaggcggagttatcgcttctccgggtggcaaaagtcaccggcggcgcccctaacaagctcgccaagatcaaggtagttaggctctcgattgctcaggtgctcaccgtgatttcgcagaagcagaaaggggctctcagggaagcgtacaagaacaaaaagtatctgcctttggatctccgcccaaagaagacgcgtgccatccgccgccgtcttaccaagcatcaggcatcactgaagactgaaaaacagaagaagaaggatatgtatttccctttgagaaagtatgctgtcaaggtttgagcttttttgtcatatgttaaaggcagccttcgttaccctttcttttgcttacaactatgatgttatttcgattcagcattgtttcagtcggatgttttgttgtcaatgaactagtcttgagcgaattttaataccacatttctctacaaaaaaactgagac

SEQ ID NO: 6945 - DNA, 531 bp, Thalictrum flavum
aatcaaggttcatgaactccgagacaaatcaaagactgatcttttgagccagctcaatgagcttaaggctgagcttgctttgctccgtgttgccaaggtcactggtggagcacctaacaagctttctaagattaaggttgtaaggctgtcaattgctcgcgtgcttactgtcatctcacaaactcagaaagctgctttgagaaatgcatacaagaacaagaagctcttgcctttggatcttaggccaaagaagacccgtgctatcaggaggcgtctcaccaaacaccaggaatcactgaagacagaaagggagaagaagaaggagatgtattttcctatgaggaaatacgctatcaaggtgtaagcaatatgagcaatgggtgtagtggtaatattgagttttgttgttcacttttaaatttgaattatgtttacattgggatcattaatctgatgtcttctacagactttattacagtcagaattggtcatattttggttactggtttaaagtttgtgaactgattttcg

SEQ ID NO: 6946 - DNA, 633 bp, Cichorium intybus
agtctgggacatgtaaaaactccataaaccctattgcttatcggtctcatagcttgtggttgcagaggcggctatctattcactcgatcggagccatggcgaggatcaaagttcatgagcttaggaacaaaggcaaaccagagttgttggctcaattgacggacctcaaggccgagctcgctcttcttcgtgtagccaaagttaccggcggtgctcctaacaaactatccaaaataaaggttgtacggacatcaattgcccaggttttaacagtgatgtcacagaaacaaaagtcagctttacgggaagtgtacaagaacaaaaaatacttgcctcttgatttgcgtcccaaaaaactagggctattcgcaggcgtctaactaagcaccaggtatcattgaaaacagaaagagagaagaaggaagagaagtatttcccattgaggaagtatgctataaaggcttagaggggaaaatattataaaagttgttatttatcttcttgattattgcagttgatcaattaggggggattttgtaagctcaatgataattgaaagatgcttaaattggtattacgaaatattatacggtttaaataatttgtcgttttcaagaaatcaactttttgcgg

SEQ ID NO: 6947 - DNA, 619 bp, Cichorium intybus
agtctgggacatgtaaaaactccataaaccctattggttatcgttctcttagcttgtggttgcagaggcggctatctattcactcgatcggagccatggcgaggatcaaagttcatgagcttaggaacaaaggcaaaccagagttgttggctcaattgaaggacctcaaagccgagctcgctcttcttcgtgtagccaaagttaccggcggtgctcctaacaaactatccaaaataaaggttgtacggacatccattgcacaggttttaacagtgatgtcacagaaacaaaagtcagctttacgggaagtgtacaagaacaaaaaatacttgcctcttgatttgcgtcccaaaaaactagggctattcgcaggcgtctaactaagcaccaggtatcattgaaaacagaaagagagaagaagaaagtgaagtatttcccattaaggaagtatgctgttaaggcttagagggaaaatattataatacttgttatttatcttcttgattattgcagttgatcaattaggggggattttgtaagctcaatgataattgaaagatgcttaaattggtattacgaaatagtatatggtttaaataatttgtcgttttcaataaag

SEQ ID NO: 6948 - DNA, 453 bp, Echinochloa colona
aggaagcccggctcgccgctcgcatggcccggatcaaggtgcacgagctgcggggaagaacaaggcggacctgcaggcgcagctcaaggagctcaaatcggagctctccctcctccgcgtcgccaaggtcaccggcggtgcccccaacaagctctccaagatcaaggtggtgcgcacctccatcgcgcgcgtgctcaccgtgatctcgcagaagcagaagtcggctctgcgggaggcgtacaagaagaagaagctgctcccgctcgacctccgccccaagaagacccgcgccatccgcaggcgcctgaccaagcaccagctttctttgaagaccgagagggagaagaagcgtgagaagtatttccccatgaggaagtatgccatcaaggcctagattagtgaaaaagaaatgttttactaccctgtcaagttttgcccagaagttaccagaat

SEQ ID NO: 6949 - DNA, 494 bp, Fraxinus spp
gtgtgcataataatcaggtttttccttgtattaataattcgttatttttattatttacttttgtagcgaggattaaggtgcatgaattgaggcagaagagcaaggcggatttactggcccagctgaaggatttgaaggcggagctggcactgttgcgggtagcgaaggcgaccggcggcgccgccaacaagctttcaaaaatcaaggtggtgaggctttccattgcccaggtgctgaccgtgatttctcaaacgcaaaaggccgcactcagacaagcttacaagaataagaagtacttgccgcttgatctccgcccgaagaagacccgcgccattcgtaggcgcctcaccaagcaccaggcatctttgaagacggaaaggcagaaagcgaaagaaatgtatttcccagtgagaaagtacgcaattaaggtttgagttgtttgtgctggattcgagttttttgaaggataatgatactttgttacattgattttt

SEQ ID NO: 6950 - DNA, 842 bp, Panax ginseng
agcaagtgcaagcagcccctccgtggtttttgcttcagtcaaaggacagcaatggcgaggattaaggttcatgagctgaggggtaagtcaaagacggatttgttgacccagctgaaggaactaaaggctgagctcgctctcctccgtgttgccaaggtcaccggcggcgctcctaacaagctctccaaaataaagtggtgaggctgtcaattgcgcaggtgttgactgtcatgcaacagaaacagaaggctgctctgagggaggtgtacaagaacaagaaactactgccgcttgatttgcgtcccaagaaaactagagctatccgcaggcgtcttaccaagcaccaggcttcattgaagactgaacgtgagaagaagaagagaagtacttccaatgagaaagtatgctattaaggtgtagggtagaatctactgtggaggagatttgttactttgtgtactacaaacctcattccaattttgaattctgaaatttgttttccattgtcctgtattgctgatcctagttcaagtgttactttattgtggtgtttactcttgtttcatgtgctgaaactattcatatcaagccctagttcaggtttactttatggtggtgtttactcttgttttaatgtgggtctaaaactaggtctgaacataggtggtatgagatgctgctgtttgcaaatttctcacttctctagtcatagcacatgaaataaaaatgatgctaaattttcagctactaaaaaaaaaaaaaaaaaaaaaaaaaaaaaaaaaaaaaaaaaaaaaaaaaaaaaaaaaaaaaaaaaaaaaaaaaaaaacaaaaaaaaaaaaaaa

SEQ ID NO: 6951 - DNA, 560 bp, Elaeis guineensis
tctacctttgggaaccctgccgccatttcgtctcgcccgagccgagggagagtagggcagaagagatctcgatccgcttccaatggcgaggattaaggtccacgagctacgggggaagtctaaggcggatctgttgaaccagctgaaggacctcaaggcggagctcgccctcctccgcgtcgccaaggtcaccggcggcgcccccaacaagctatccaagatcaaagtggtgaggctctcgatcgcgcgggtgctgacggtgatctctcagaagcagaaggaggtgctgcgggaggcgtacaagaagaagaagtaccagccgctcgatctccgccccaaaaagactcgcgccattcgccgccgactcaccaagcaccaggcttcattgaagactgagcgcgagaagaaaaggagatgtacttcccaatgaggaagtatgcaatcaaggcctagattaggttattctgtttaagtgactcatttgggatccaattttgcatttgctttatggattagctattcctgtttagtaccatgattgggttatggcataacaaata

SEQ ID NO: 6952 - DNA, 611 bp, Hordeum vulgare
ggcacgagccggcattgcactcacttctgaagagcagcggaagaagcaatggcgagaatcaaggtccatgagttgagacagaaatcataaactgagcttttggctcagttgaaagatctcaaagctgagctcgctcttcttcgtgttgccaaagttaccggtggtgcacctaacaagctttccaagataaaggtggtgaggttgtcaattgctcaggtgttgacagtgatctcacagaagcagaaggctgcactgagggaggcatataagaagaagaagttcttgccccttgatctccgtccaaagaagaccagagccatcaggagaaggcttaccaagcatcaggcatcggtgaagacagaacgtgaaaagaagaaggaaatgtacttactcatgacgaagtatgccattaaggagtacgataagatatatgagattctattgtgaaatccgcttgtgtttacttatttgcgaaaacccgagccgtgattttgttagcatcttatgtttatgaacattctcccatatgtcaaaactagattttaatctttttgatggaaagcgggattaaatgagggacattctgcttaagaatgaaaaaaaaaaagaat

SEQ ID NO: 6953 - DNA, 612 bp, Cirsium arvense
caatggctcgaatcaaagttcatgagcttaggaccaatcgaaggtcgatttgtttgctcagttgaaagatctcaaggcggaacttgctcttcttcgagttgctaaggttaccggtggagcccctaacaagctttccaagataaaggtggtgaggacatcaattgcacaggtgctgactgtgatttcacagactcagaagtccgctctcagggaagcctacaagaacaagaagtacttgcctcttgatttgcgcccaaagaaaaccagggccatccgcagacgtcttaccaagcatcaggtttcattgaagactgaaagagagaagaagaaggagaagtacttccctttgaggaagtatgctatcaaggtgtaaggtgggaaactatggaggaggagatttaagtagttgttgtgtaaatctctttccagttttgaagtctgagtctgtgttctatttgatcagagatcatgtatttcatagttttttttttctgcaatgaggtaaaagacaattaacattggaagcttgttgcataccagtttacttgttttttttggaagacagtgtattgttgattgcattatgcatttgtggttaatctctattgcatc

SEQ ID NO: 6954 - DNA, 669 bp, Flaveria ramosissima
aacctggccttcacagcagttcacaccagcttcaatcaatgggtaaactttcaatttgatgcgttaatgttatcatcgttctctatgaatttcaattacgctgattgatttgttcatcaaaattcattgtaaaacatcatagcccgaatcaaggttcatgagcttaggaacaaatcgaaggctgatctgtttgctcagctgaaggatctcaaggctgaattggctcttcttcgtgtcgccaaagtcaccggcggtgctccaaacaagctctccaagataaaagtggtgaggacatcaattgcgcaggtgttgactgtgatttcacagactcagaaagctgctcttagggacgcctacaagaagaagaagtacttgcctcttgatttgcgtccaaagaaaccagagccatccgtagacgtctaaccaagcatcaggcttcattgaagaccgaaagagagaagaagaaagagaagtacttcccgttgaggaagtatgctatcaaggcgtaaggtcaaaactgttgaggagatttaggtgtgtaaatactctttccagttttcgtactttgtgttcaattcaatagaaatatgtattcgttcgtttggttgcaatgagttgcaagacagttgactttggacctttcctctttatgttaagtatctgttcgac

SEQ ID NO: 6955 - DNA, 1299 bp, Conyza canadensis
cagcaactaggttttcagaggcagcctccctccttccatttgcactcggatttcacttaagctaatcaaatggcaagaatcaaggtgcacgagctaagaagcaaaacaaaggcagatttgttcgctcaattgaaggacttgaaagctgaacttgcccttcttcgtgttgctaaggtcactggtggggcccccaacaaactctccaagattaaggtggtgaggacatcgattgcccaggtgctgactgtgatttcacagactcaaaagtctgctcttagggaagcttacaagaacaagaaataccttcctcttgatctgcgtcccaagaaaaccagagctattcgcaggcgtcttaccaagcatcaggcttctttgaagacagcgcgtgagaagaagaaagagaagtacttcccactgaggaagtatgcaatcaaggcataggtaattgagaaggatatttagtttcaattttgagtttggactttgtgtaagatcttatgaaaagcttgtttgattcgaaatattggatcttgttttgaaatgttgaaggttgtttatgttatgcattctgcactttgattagataccaaatctttgtcatggctaatgtgcagcaacccatcaagtagttttcgtcttttatggttgatttattctgaaagcttcttgtccaatttttattgtaatggacctcatctggatgaaaccatatcaatttgctcctaaacaggggagatgtcaattttcaatacaagcttgaaagcactgttaaatgtaaaattatacccagttttgcgaccccaatctttttatatatatactagcatagagcattagctattaaaattgcaatatgtttgcttcctcactatacctgtttacctatgtttaactatctaatacctttgacctgtttaagttaatgaactagcggtgtcatattggattgtttgatacccatctctaacttgaatccgagatggataaataccaataactaatcttcgttgagtaattaaggaatcagctgtattgggttataacttataaagcctaaacttgtgtctataatggagtactatgcaattcgagaatgaaacacttgcgggaactcttaaatccctcaacaaaaacagaagactaagaaaaataaaaggatacagtaagaattaagaagtctcatgccttcttttgaaattttggtcaagcaaaataactatgtagataaattttaatttttgaatcaaaatactctgtagataaaatcatagattctgaatcaagatactttttagtcgg

SEQ ID NO: 6956 - DNA, 880 bp, Glycine max
gtttcggagtcgttgcagagctgcgcgtcgatctagaaaatggcgaggataaaggtttacgagcttaggaacaagacgaaggcggagctgctgaaccagctgaaggatctcaaggcggagcttgccctgctccgcgtcgccaaggtcaccggcggcgcccccaacaagctctccaaaatcaaggtggtgaggctttcgatagcgcaggttttgacggttatttcccaaaagcagaaagcggcgctgagagaggcttacaagaagaagaagtatttgccccttgacctacgtcccaaaaagacccgcgccattcggagacgccttaccaaacaccaggcgtctttgaagacggaacgtgagaaaaagaaggagctgtactttccactaagaaagtatgcgatcaaagtttaggttagaattggtttcaagttgcattttttagggcagttacttgtattgaaattttaaggttttgatggcagccactgtggcagcattccaatttttagtaccagagttgtttccatacctgcattcagtttccaaggtctatctatatgttaaaaccagagttgtttcgagaaattatggttgctgtcggcttttttgctttatagcgtatcacctattgaatgatcaaatggccgtatcctttttgagttgtgatttatgcactaaggcacgacccaataagcccaacagagacacgtcacagacgacgttgtacgtattcaacaggtgcttcattcataagaatcataacattaatcacaacccagtacaatttccaaccatgcatcatccaaatcaaataaaaacagtcaagaaagactacagttgcatggacccataggttgtgcaaaatgaacccaaataggga

SEQ ID NO: 6957 - DNA, 435 bp, Glycine max
cggagtcgttgcagagctgcgcgttgatctagaaaaatggcgaggataaaggtgtacgagttgaggaataagacgaaggcggagctactgaaccagctcaaggatctcaaggcggagctagccctgctccgcgtcgccaaggttaccggcggcgccccaaacaagctctccaaaattaaggtggtgaggctatcgatagcgcaggttttgacggttatttcccagaagcagaaagcggcgctgagagaggcttacaagaagaagaagtatttgccccttgacctccgtcccaagaagacccgcgccattcgcagacgccttaccaaacaccaggtgtctttgaagacggaacgtgagaagaagaaggagctgtactttccactaagaaagtatgcgatcaaagtttaggttagaattggtttcaagttgcatttt

SEQ ID NO: 6958 - DNA, 523 bp, Glycine max
taaccaggtggtagggtttctaattcttttcatcctcttcgcagagcctcagtagcttcgcattagcaatggcgagaatcaaggtgtacgagctgaggaacaagacaaaagcagagcttctgaaccaactgaaggatctcaaagcagaactcgctctcctccgcgtcgccaaggtcaccggcggagccccgaacaagctttccaaaatcaaagtggttaggctttcgatagcgcaggtgctgacggtgatttcccagaagcaaaaagcagcgctgagagaggcttacaagaagaagaaataccttcctttggatctgcgtcccaagaagaccagagccatccgaaggcgcttaactaagcaccaggcttcattgaagacagagcgtgagaagaagaaggaattgtattttccactgcgaaaatatgcaattaaagtgtaatgttagatcccaatacggatgataattttggcgtttgttagttgacacagttttgatgccgttttgtcctagttttcttttaa

SEQ ID NO: 6959 - DNA, 746 bp, Amaranthus tuberculatus
ctctcaaggtaagccatttcatttctagggtttcagagcatccatagtcgccgttcatctccaccgcagaaatggctcggatcaaggttcatgagttgaggcagaaaacaaaggcagagttgttgaatcaactcaaggatctcaaggctgaattggctctccttcgtgtcgctaaggtcaccggtggtgcaccgaacaagctctccaaaattaaggtggtgagattgggaattgcacaagttttgacggtgatgtcacagaagcagaaattggcattgagggaagcttacaagaacaagaagtatttgcctcttgatcttcgtcctaagaagacccgtgccattcgtcgtcgcctcaccaagcaccaggcatctttgaagaccgaaagggagaagaagaaggagatgtactatccaatgaggaagtatgccatcaaggtgtaggctaggctattcccatctaggaaggtttttacaatccaaggaaattttgttcagacgttttgttaatcatcttcttctatagttgctttttgacaacaattgtttctgccattttattcaatgtatggagtttttcatcttcaggagtagcattgtggccgtgaattgttccctatttcggtttttcgatgagaaaactgaactacgagatagatattcggtgaagttgattacttattccgtgtttaacatccacaaggtccaaaaaattgactcgatacatcacttcatacatttattttt

SEQ ID NO: 6960 - DNA, 717 bp, Amaranthus tuberculatus
accaggtaagccagtttatttctagggtttcaaaaaatcgcaagtcgccgttgcagccaaaacctcagcaccagaaatggctcggatcaaggttcatgaattgaggcagaaaacaaaggtagaattgttgaatcagcttaaggatctcaaagctgaattggctcttcttcgtgttgcgaaggttaccggtggtgcacctaacaagctttccaagattaaggtagtgagattggggattgcgcaagtgttgactgtgatgtcacagaagcaaaagtcggcattgagggaagcttacaagaacaagaagtatttgccgcttgatcttcgtcctaagaagacccgcgctattcgtcgtcgcctcactaagcaccaggcatccttgaagactgagagggaaaagaaaaaggagatgtactatccaatgaggaagtatgccatcaaggtgtaggctagggattcttatctaggaacatcctctttaaaaaagacagaaattttgttgagaagtttattattaagattctaaaagtggtttatgtcaacagttgtttctcttcctttttggtttaatttgtgggagcttttatatattcgtaactcgtaagtactaagtagcattgtggttaatgtgatctatgacaatttttcaatggagaatggatggtcgatgtttactgaatctctgtgtgtgttggcaatgaaaccatatagaagtac

SEQ ID NO: 6961 - DNA, 550 bp, Artemisia annua
ccaacggggagggtttgagaaatacagccgcacagcagcagcacaacttcaacattttctcaatggcaaggattaaggtgcatgagttgagggagaagacaaagactgatttgttcagtcagttgaaggaattgaaagctgaacttgctcttcttcgtgttgctaaagtcactggtggtgctcccaacaagctctccaaaatcaaagttgtgaggacatctattgcacaagtgttgactgtcatttcacagacacaaaaggcaaagctcagggaagcttacaagaacaagaagtacttgcctcttgatttgcgtcccaagaaaaccagagccatccgtaggcgtttgaccaagcatcaggtttccttgaagactgaacgtgagaagaagaaagagaagtactttccattgaggaagtatgctatcaaggcttagggtagataaagtattcatgctcatgtcacttgaattttgaactatgttttatctacattatattaatgttttggactaagttgagtttgtagcttgatcttatatggaatcatatt

SEQ ID NO: 6962 - DNA, 789 bp, Musa acuminata
atgaactataatatcatgaactgccttgggtttgcgcgcggcggaagcggaaggggaagaaagcgacgaggggggagaggcgattctataccgatggcgaggattaaggttcacgagcttcgggggaagcccaaggcggagctccaggcccagctgaaggacctcaagaacgagctttccctcctccgcgtcgccaaagtcaccggtggcgcacccaacaagctctccaagattaaggtggttagggtgtcgatcgcgcgggtgctgaccgtgatctcgcagaagcagaaggcggcgctgagggaggcctacaagaacaagaagttcatcccgctcgatctccgtcccaagaagactcgtgccatccgccgccgtctcaccaagcatcaggattcattgaagacagaacgggagaagaaaaaggagatgtacttcccgatgagaaagtatgccatcaaagcttagattagaatgcttatgaatccactcttgctttataatgagtactgtatgttttgacttgtgctttatcgattaattaattttgcaacactatggttggattttgtactttaaaatggctgaggaagacgatatattgtgtgatcaacttgttattacatggcagcattggtctgatttctcgattgtgtttcacaagatcacaggttataaataggttggtcggcattgccaaggaaaacaaaatgctcccagtattacttgagataaacatgaaccgaaagaactttgtgttgcatgctctccctctcgctgctgctttttgac

SEQ ID NO: 6963 - DNA, 949 bp, Musa acuminata
gattcgatttgaaatatgaatcattggaccgagtcggttgttgttccgacgcctctttgcagtattaggatttctgtgcggcggtgaagcgggagagtcgattcgttgacaatggcgaggatcaaggtgcacgagcttcgcgggaagactaaggtggaactccagagccaactgaaggacctgaagaatgagctttctctccttcgcgtcgctaaagtcaccggcggcgcccccaacaagctctccaagataaaggtggtgaggctgtcgatcgcccgggtgttgaccgtgatctcgcagaagcagaaggcggcactgagggaggtctacaagaagaagaaactcatgcctctggatctccgccccaagaagacacgggctattcgccgtcggcttaccaaacatcaggagtctttgaagacggaacgtgagaagaaaaaggagatgtatttcccaatgaggaagtacgcaatcaaagcttaaaattacaacatcggatgattctcttattgctctttaattttcattatttgtttccaagttttggctgttaatttgcagaataagttgcatcacgatggccatgattttgtggtagcaaattgatagcagcttcttttcgatttctgaatcacctacttgatctagcattccatttatcattatgtttctccctcatagtttacctggcagcagtcctgatggtgtataaatccttcagggtattaattctggaaggtattttagtctgttcttgaatgcaataatgtgcatttgtctgtgtttctatgtacatctggatttccacgaaacacacctgataaaaatgaaaaagttcctcctcttctgcttccgtcaacgatgtttggccgccacacgtgcaaaatggtcgcgccggaaggtcctccttccagcgcgcgtttcctcctttggaagtcaacccagacac

SEQ ID NO: 6964 - DNA, 690 bp, Phaseolus vulgaris
gggtttagaaagacaaagaagcagagcaagcaagtaggtagggtttctctctctttcgatcctcttcgcagcgccacacgaccttcgaattcgcaatggcgagaatcaaggtttacgagctgaggagcaaaacgaaagcagagcttctgagccaattgaaggatctcaaagcagaactcgctctcctccgcgtcgctaaggtcaccggcggagccccaaacaagctttccaaaatcaaagtggttaggctttcgatagcgcaggtgctgacggtgatttcccagaagcaaaaatcagcgttgagggaggcttacaagaacaagaagtaccttcctttggatctgcgtcccaagaagaccagggccatcagaaggcgcttaacaaaacatcaggcttcattgaagacagagcgtgagaagaagaatgaattgtattttccaatgcgaaagtatgctattaaggtgtaatgttagatccaagtaaggataataattttggagacactttattttgtacgattattttttctggtcgctcagtttttatgccatttattccgattttcattttaatcatcgttaaactgaactaaaagttagcttgtctttccattaggttggttttttttgtcatctatggtggcagactttcaattttgtgtatgcacgtaattgatctatattcttttta

SEQ ID NO: 6965 - DNA, 687 bp, Phaseolus vulgaris
gtatataaaaatcatcgttaacattgtgcctccgactttagggtttaggagtgtgtttgcagagctgcgcgtcgatctacgaaatggcgaggataaaggtgtacgagctgaggaacaagaacaaggtggagctgctgaaccagttgaaggacttgaaggcggaactcgctctgcttcgagtggccaaggtcaccggcggcgcccctaataagctctccaaaatcaaggttgtgaggctttcgatagcccaggtgttgacggtcatctcccaaaagcagaaggcggcgctcagagaggcatacaagacgaagaagtatttgccccttgacctacgtcccaaaaagacccgcgccattcgcagacgcctaaccaaaaaccaggcatcattgaagacagaacgggagaagaagaaggagctgtactttccactaagaaagtatgccatcaaagtttaggttagaattgattatttgtattgaaattttaaggtgttgttgatgcctgccactgaggctgcattccaatttttagtaccagtgtcattttgatgcctgcctttatagttttcaagatatttgttaaagctagagttgttttgagaattatggttgtttttggccttttggttggagtatcactgaatgaatgatcattgacactcttcatttttctcctttttgttgaact

SEQ ID NO: 6966 - DNA, 516 bp, Bruguiera gymnorhiza
gggggtttcatataatatccgcagaggagagcggggggcaaagaagaagccgcagccagagacgttgcaatggcgagaatcaaggtccacgagctcagacagaaaacgaaggcagagcttttgaatcagctgaaggacctcaaagctgagctcgctctccttcgcgtcgctaaggtcaccggcggtgctcctaacaagctctccaagattaaggtggtgaggttgtctattgcacgagttttgactgtgatttcacagaagcagaaggctgccttgagggaagcatacgagaacaagaagttcctgccacttgatctgcgtcccaagaagaccagagctattcgtaggaggcttaccaagcatcagcaatcgttgaagacagagcgggagaagaagagagaaatgtacttccccatgagaaagtatgctattaaggtgtagggcattatctattgcgcaggccatttcactatcttgaagttattaatcctgtttgattggcaagttttggtttca

SEQ ID NO: 6967 - DNA, 667 bp, Daucus carota
cccgtgtattttttagggttaaaaaaatcaaagcagcctcctctcatttcacacaaacacatcaatggcgaggatcaaggttcatgagctgaggactaaaccaaaggctgatttgcaggctcaggttaaggaactcaaggccgagctttcgcttcttcgggttgcgaaagtcaccggtggagctcctaacaagctctccaagataaaagttgtgaggttgtcaattgcccaggtgctgactgttatgcaacagaagcagaaggctgctctgagggaagtctacaagaacaagaagctcatgcctcttgatttgcgtcccaagaagaccagagccatccgtaggcgtcttaccaagcaccaggcatctttgaagactgagcgtgagaagaaaaaggagaaatacttccccatgagaaagtatgccatcaaggtgtagggtagaattctcttagaggagattttcaaattgatatttgtttgcaattatcttataaaatacttggttaatggattctgaagttagtgtactttgtggttctttagtctacttttgttcccatgcaaaacaagaacgtttttttgttatcttgccttaagttaatattctatgctcaagttttctgtctcggaatattttaaagcgaaaattgctaatgaaattggtgcc

SEQ ID NO: 6968 - DNA, 479 bp, Centaurea maculosa
cctccattgcagctgcggcgagcattacttactcataatctatggctcggatcaaagttcatgagctaagggacaaatcgaaggctgatttgtttgctcagctgaaggatcttaaggctgaacttgctcttctacgagtcgccaaagtcaccggcggtgctcccaataagctctccaaaatcaaggtggtgagaacatccatcgcccaggtgctgactgttatttcgcagacacaaaaggccaagctcagggaagcttacaagaataagaaataccttcctcttgatttgcgtcctaagaaaaccagagccatccgcagacggttgaccaagcaccaggtttccctaaagacagaaagagagaagaaaaaggagaagtactttccattgaggaagtatgctattaaggtttagggtagataaaccaaccatctaggttaggtggaaagagagcacttgatttttggatttggtttaatt

SEQ ID NO: 6969 - DNA, 542 bp, Centaurea maculosa
cctccattgcagctgcggctcgtattactcactcataatccatggctcggatcaaagttcatgagctaagggacaaatcgaaggctgatttgtttgctcagctgaaggatcttaaggctgaacttgctcttctacgagtcgccaaagtcaccggcggtgctcccaataagctctccaaaatcaaagtggtgagaacatctatcgcccaggtgctgactgttatttcacagacacagaaggccaagctgagggaagcttacaagaataagaaatatctgcctcttgatctgcgtcctaagaaaaccagagccatccgcaggcgtttgaccaagcaccaggtttccttgaagacagaaagagagaagaaaaaggagaagtacttcccattgagaaagtatgccattaaggtttaaggtagataaccatctaggttaggtggaagaagagttcttgagttttgatttggttttatttaaaattatattgatgttttggaacaagttgaattttggggaatgaaattataccgtcatttggttttc

SEQ ID NO: 6970 - DNA, 941 bp, Chelidonium majus
tccttcctttctgtgagacgcttgtagacggagctgcatttgccctaaccaagttccatcaatggcgagaatcaaagttcatgagctccgagcaaaatccaaaacagaccttttgaatcagctcaaggagttcaaggcagagcttgccttgctccgagttgccaaggtcactggaggtgcacctaacaagctctcaaagattaaggtggttaggctttcaattgcacaagtgcttactgtaatttctcagaaacagaaggctgctcttagagaagcttacaagaacaagaagcttttgcctctggatcttaggccaaagaagacccgtgccatcaggaggcgtcttaccaaacatcaggagtcattgaagactgaaagggagaagaagaaagagatgtacttcccaatgaggaaatatgccaattaaagtctagagagatcgttcgagttaagagagaaatagagagaggataaggtattcttagttatggaagttttgtttcatcgtgtagtttggagtcttgacgtcattcaaacattgttaaactaggttttcagtatccacaacttttatctagacatgtatcccttatgtttacctgttttattacagttacattttattttcgctacatagcttgcccccttttgataatgaaagtcaaaattggttgggaatgatcctctcaaaccgcatgactagaaggtttccctttccttgaatcagtttgttgtctctatttccacataattctcaggtttctatccacactgcctactcaccatccattcaatagaacccccacagatgatgttggctgcctaggtctcctatgtgagaagatgagtaaaagaaccaccaaccaattcattaacacttttgaacatgaaattgtaatatcatgagcattaacatatattacataacccaaacgtctgag

SEQ ID NO: 6971 - DNA, 625 bp, Castanea mollissima
ttttcattcacagagcaacaaggaaccgaagccgccgcgttatttcacaatggcgaggattaaggtacacgagttgaggaacaagacaaaggcagaactgctggctcagttgaaggacctcaaagctgagctcgctcttctccgagtcgctaaggtcactggtggtgcacccaacaagctctccaagataaaggtagtgaggcttggaatagcgcaagtgttgacagtgatatctcagaagcagaaatcagctcttagggaggtctacaagaacaagaaatacattcctctcgatcttcgtcccaagaaaacccgtgctatccgcagacgcctcaccaagaaacaggcatctttgaagacagagcgtgagaagaagaaggagatgtactttccattgaggaagtatgctatcaaagtgtaggcgaggcctcgagggtctacttttcctaattttcattatggacatgttacattttttctttctttctgaatttgccgttagttgcagccatgcaggcagcatttttgtttatcttgtatcgggtttgaaccatctagcttgaagttttaaacatgagattatttttcacaaaaatgctgcctgcatggctgcactgagacacgc

SEQ ID NO: 6972 - DNA, 661 bp, Chrysanthemum coronarium
taacaatcagaagagagccacctttctttctttcatcggcaggagactcaaaaccaatcaatcaatcaaatggctaggatcaaggtttttgagttgaggagcaaatcaaaggtggatttgtttgcgcagttgaaggatttgaaagctgaactagctctgcttcgtgttgctaaggttactggtggcgctcccaacaagctctccaagatcaaggtggtgaggacatcaattgctcaggtgttgactgtgatttcacagacccagaagtctgctctcagggaagcatacaagaacaagaagtacttgcctcttgatttacgtccaaagaaaaccagagccatccgcagacgtctcactaagcatcaggtttctttgaagaccgaaagggagaagaagaaggagaagtacttcccattgaggaagtatgctatcaaggcgtaagttggaagctatgaaggaggagatttaggtacttatgtgtgtaaatctctttccagttttgagttttagtttgtgaacgattggtcagaaatctatgtatttgatagttttattgcaatgacttacaagacagttaatgttggagtttgtttcttggtgttgcatacctatttgacttgttttttggaaggcgacttacagctgttttgctgcttgcttt

SEQ ID NO: 6973 - DNA, 834 bp, Cichorium intybus
ccgcgtgtataaagaacgtacatgaagtctaattggtctggaatgggtaatgactgggccgggcttacaaatttttaatggctgggtcttttcttatatacaaaagcctccttaaacaaaccctcgtcttcgtctgttttcgatattagggtttcagaagaccctccattgcagctgcggcttcttcaaccaacgcataatccatggctcggatcaaagttcacgagttgagagacaaatcgaaggctgatttgtttgctcaattaaaggatcttaaggctgaactcgctcttcttcgcgtcgccaaggtcaccggcggtgcccccaacaagctctccaaaataaaggtggtgaggacatctattgcacaagtgctgactgtaatttcacagacacaaaaggcaaaactcagggaagcctacaagaacaagaaatacctgcctcttgacttgcgtcccaagaaaaccagagccattcgcaggcgattgaccaagcatcaggtatcattgaagaccgaaagggagaagaaaaaggagaagtacttcccattgaggaagtatgctattaaggtttaagggtagataggtaaactatctaggaaggagattttgtgttttgaacttggatttatttgcattaatttgatgttttgggaggtgttgaattttggagtttgatcttgatattgaaagttatattggtcctttctcgctttaaaatacttggtttttattctattactagtctttgaaaatatgcttgcaagatcttgttactgtagtatccgttataaatatgatgtgaccattctcaaaaattaccacaatttttggt

SEQ ID NO: 6974 - DNA, 754 bp, Cichorium intybus
ccgcgtgtataaagaacgtacatgaagtctaattggtctggaatgggtaatgactgggccgggcttacaaatttttaatggctgggtcttttcttatatacaaaagcctccttaaacaaaccctcgtcttcgtctcttttcgatattagggtttcagaagaccatccattgcagctgcggcttcttcaaccaacgcataatccatggctcggatcaaagttcacgagttgagagacaaatcgaaggctgatttgtttgctcaattaaaggatcttaaggctgaactcgctcttcttcgcgtcgccaaggtcaccggcggtgcccccaacaagctctccaaaatcaaagtggtgaggacatctattgcacaagtgctgactgtaatttcacagacacaaaaggcaaaactcagggaagcctacaagaacaagaagtacttgcctcttgacttgcgtcccaagaaaaccagagccattcgcaggcgattgaccaagcatcaggtatcattgaagaccgaaagggagaagaaaaaggagaagtacttcccattgaggaagtatgctattaaggtttaagggtagataggtaaactatctaggaaggagattttgagtcttgaacttggatttatttgcattaatttgatgttttgggaggtgttgaattttggagtttgatcttgatattgaaattatattgttcctttcttgctttaaaatacttggtttttcttttattactagcctttgaaaat

SEQ ID NO: 6975 - DNA, 732 bp, Cichorium intybus
ggcggggggggcataagttttattggcttgatattttcttatatacaaaactacaaaagcctccttacacaaaccctcttcttcgtctgttttcgatattagggtttcggataccctccattgcagctgcggcttcttcaaccaacgcataatccatggctcggatcaaagttcacgagttgagagacaaatcgaaggctgatttgtttgctcaattaaaggatcttaaggctgaactcgctcttcttcgcgtcgccaaggtcaccggcggtgcccccaacaagctctccaaaataaaggtggtgaggacatctattgcacaagtgctgactgtaatttcacagacacaaaaggcaaaactcagggaagcctacaagaacaagaaatacctgcctcttgacttgcgtcccaagaaaaccagagccattcgcaggcgattgaccaagcaccaggtatcattgaagaccgaaagggagaagaaaaaggagaagtacttcccattgaggaagtatgctattaaggtttaagggtagataggtaaactatctaggaaggagattttgtgttttgaacttggatttatttgcattaatttgatgttttgggaggtgttgaattttggagtttgatcttgatattgaaagttatattggtcctttctcgctttaaaatacttggtttttattctattactagtctttgaaaatatgcttgcaagatcttgttactgta

SEQ ID NO: 6976 - DNA, 602 bp, Cirsium arvense
caatcaatggctcgaatcaaagttcatgagcttaggaccaaatcgaaggtcgatttgtttgctcagttgaaagatcttaaggcggaacttgctcttcttcgagtcgctaaagttaccggtggtgcgccaaacaagctctccaagataaaggtggtgaggacatcaattgcacaggtgctgactgttatttcacagactcagaagtccgctctcagggaagcctacaagaacaagaagtacttgcctcttgatttgcgcccaaagaaaaccagggccatccgcagacgccttaccaagcatcaggcttctttgaagaccgaaagagagaagaagaaggagaagtacttccctttgaggaagtatgctatcaaggtgtaaggtgggaaactatggaggaggagatttaagtagttgttgtgtaaatctctttccagttttgaagtctgagtttgtgttctatttgatcagagatcatgtatttcatagttttttttcctgcaatgaggtaaaagacaattaacattggaagcttgttgcataccagtttacttgcttttttttggaagacaatgtattgtttattgcattatgcatttgtggtt

SEQ ID NO: 6977 - DNA, 398 bp, Cirsium arvense
gctgcggctcgtattactcacacataatctatggctcggatcaaagttcatgagctaagggacaaatcgaaggctgatttgtttgctcagctgaaggatcttaaggctgaacttgctcttctacgagtcgccaaagtcaccggcggtgctcccaataagctctccaaaatcaaagtggtgagaacgtctatcgcccaggtgctgactgttatttcacagacacagaaggccaagctgagggaagcttacaagaataagaagtatctgcctcttgatttgcgtcctaagaaaaccagagccatccgcaggcgtttgaccaagcaccaggtttccttgaagacagaaagagagaagaaaaaggagaagtacttcccattgagaaagtatgccattaaggt

SEQ ID NO: 6978 - DNA, 513 bp, Cirsium arvense
aatcaatggctcgaatcaaagttcatgagcttaggaccaaatcgaaggttgatttgtttgctcagttgaaagatctcaaggctgaacttgctcttctccgggtcgccaaagttaccggtggtgccccgaacaagctctccaagataaaggtggtgaggacatcaattgcacaggtgctgactgtgatatcacagactcagaagtctgctctcagggaagcctacaagaacaagaagtacttgcctcttgatttgcgtccaaagaaaaccagagccatccgcaggcgtctaaccaagcatcaggcttctttgaagactgaaagagagaagaagaaggagaagtattttcctttgaggaagtatgctatcaaggtgtaaggtgggaactatgaaggagatttaagttctctttccagttttgaactcatagtttgtgtacgattaatcagtgttttgatagtttgtctgctttgagttaaaagacgcataacattggagcttgctcttaatgtta

SEQ ID NO: 6979 - DNA, 704 bp, Cirsium arvense
cctccatccagaaacccttgccttcgtccaatcttaatattagggtttcagagcaactctgcattgccgctgcggctcgtcatactcactcataatccatggctcggatcaaagttcatgaattgagggacaaatcgaaggctgatttgtttgctcagttgaaggatcttaaggctgaacttgctcttcttcgagttgccaaagtcaccggcggtgctcccaacaaactctccaaaatcaaagtggtgagaacatctattgcccaggtgcttactgttatttcacagacacagaaggccaaacttagggaggcttacaagaataagaagtacttgcctcttgatttgcgtcctaagaaaaccagagccatccgcaggcgtttgaccaaacaccaggtttctctgaagacagaacgagagaagaagaaggagaagtactttccattgaggaagtatgctattaaggtttaggtggtggaggatgagtagttgattttatttaaatcatattttgatgttttggaacaagttgaattttgggggttgaaattatactgttattcgtttttctcctagctttacagtggttaaatgaatggtagacaatctttgttgcatgagttaagttattacaactgtcatttgcattttaattcattatcgaaattggaggcaagtggaggacttgagagattggaaaaattc

SEQ ID NO: 6980 - DNA, 629 bp, Cirsium arvense
catttcgtgtgcatttttcggaactgggtttcagaggcagcctccgtcgcagtttgcttccgctccgatcgcacgttaatcaatggctcggatcaaagttcatgagctcaggggcaaatcgaaggccgatttgtttgctcagttgaaggatcttaaagctgaacttgctcttctccgtgtcgccaaggtcaccggtggtgcgcctaacaagctctccaagattaaagtggtgaggacatcgatagcacaggtgctgactgtgatatcacagactcagaagtcgatgcttagggaagcttacaagaataagaagtacctacctcttgatctgcgtcccaagaaaactagagccattcgtaggcgtcttaccaagcatcaggtttcattgaagacagagcgagagaagaagaaagagaagtacttcccattgaggaagtatgcaattaaggcgtaggtagatgaaaccaattgagattggaattttgaatttggatttggatttggatttgtatcagaatttcatgtttttaaaagagttgccagcatttaagttaaaaaagaaaatatatagtatagtaggattagagtatgtcttagaaccacaagcaaatcatatgcactaatatatg

SEQ ID NO: 6981 - DNA, 662 bp, Cleome spinosa
attcgtcggagccaacacgagcagcagcggcgacaacagcagttcgacatcagggagttcacgatggcgaggattaaggttcacgagctcagggacaagtcgaagacggatctgctaaatcagcttaaggatctcaaggcggagctcgcgctcctccgtgtcgccaaagttactggcggtgctccgaacaagctctccaaaatcaaggtggtgaggaaatccattgcacaggtgctgactgtgatatctcagaagcaaaaatctgccctgagagaagcgtacaagaacaagaagtatctgcctctcgatcttcgtcccaagaaaacccgtgctatcaggagacgcctcaccaaacaccagaaatcactgaagacggagcgagagaagaaaagagatatgtactttcccgtgaggaagtacgcaatcaaggtgtaaaatccacttcggcggctctgtttcatttgtgaacaaatgatcgtcaccagctctggtttagtttctctttatcagttttgttttggaaaccaccgtgtactcgtttatctttcgatgccattggaacttcaaatcattttgtcctcgacgacccaaaactgcttcggttcttgttaggatgaaccaactcattattgtaacttttagtgtccgttgcacatgttgaa

SEQ ID NO: 6982 - DNA, 861 bp, Cocos nucifera
aatttagtgccgaggggccggcccactatatttaataatatttctgatgcctccttgcggctagggttgagagctctcattccgctcatctgggcctcctctgtcgccgtttgtaggcattcgtctcgtccgggcagcgagaggcagaactcgacgaggaggaaagaagaagggatcgcgaaccatttccaatggcgaggattaaggtccacgagctccgggggaagtccaagacggagctcctgacccagctgaaggacctcaaggcggagctcgccctcctccgcgttgcgaaggtcaccggcggtgcccctaacaagctctccaagatcaaggtggtgaggctgtcgatcgcgcgggtgctgacggttatctctcagaagcagaagcaggtgctgagggaggcgtacaagaataagaagtaccagcctctcgatctccggcccaagaagactcgcgccatccgccgccgcctcaccaagcaccaggcttcattgaagaccgaacgtgagaagaaaaaggagatgtacttcccactgagaaagtatgccattaaggcatagatcgggatattatctagactttcctcccttttgtttcaagtgactgcctctggcatccaaattttgtcatatgttttatttttgacattttatggcaatacgaaatgctagtctgttctgaaatccacataaattggatgtttgactctggcttcatcttcctttgcttgccttaattttgtgggtggtagcacactcacttggtttgaatgtcggatatacatttctgctcgatgctaacttcaaatacccgagatattttcactgcagttgctgcatgaagcagtattatctcatc

SEQ ID NO: 6983 - DNA, 633 bp, Vigna unguiculata
ctttagggtttcggaagagctgcgcgtcgatctacgaaatggcgaggataaaggtgtacgagctgaggaacaagacgaaggcggagctgctgaaccagttgaaggatctgaaggcggagctcgctctacttcgagtggctaaggtcaccggtggcgcccctaacaagctctccaaaatcaaggtggtaaggctttcgatagcgcaggtgttgacggttatttcccaaaagcagaaggcggcgctcagagaggcgtacaagacgaagaagtatttgcctcttgacctccgtcccaagaaaacccgcgccattcgcagacgccttaccaaacaccaggcatcattgaagacagaacgggagaagaagaaagagctttactttccactaagaaagtatgctatcaaagtttaggttagaattgattacgtgtattgaaattttaaggtgttgatgcttgccattgaggctgcattccaatttagtaccagagttgttttgatgcctgccttcatagtttccagggtatttgttaaaactatagttgcttcgagaaattatggttgtttttggccttttgttttatggagtatcactggatgaatgatcaatgacagtcttcatttttctcttttta

SEQ ID NO: 6984 - DNA, 696 bp, Vigna unguiculata
gagtgcaaccaagtaggtagggtttctctctcttttgatcctcttcgcagcgccacgcgaccttcgaattagcaatggcgagaatcaaggtgtacgagctgaggaacaaaacgaaagcagagcttctgaaccaattgaaggatctcaaagcagaactcgctctcctccgcgtcgctaaggtcaccggcggggcgccaaacaagctttccaaaatcaaagtggttcggctttcgatagcgcaggtgctgacggtgatttcccagaagcaaaaagcagcgttgagggaggcttacaagaacaagaagtacattcctttggatctgcgccccaagaagaccagggctatcagaaggcgcttaacaaaacatcaggcttcattgaagacagagcgggagacaaagaaggaattgtactttccgatgcgaaagtatgctattaaggtgtaatgctagatctatgtaaggtttataattttggagacactttcttttgttatttgaagtacgattattttttgcagtcgctcagtttttatgtcatttctctccggttttcattttaatcatcgttaaattggactaaaaattagtttgttttacattaagtctgtttttttgtcatgtatgacgaactttcaattttgtgtatgctcgtaagtaaacctatattctttctatacacaattcgccatttaat

SEQ ID NO: 6985 - DNA, 605 bp, Cynara scolymus
cggggcttcttcattcttcatattagggtttcagagcaaccctacattgcacctgcggctcgtactactcacgcataatccatggctcggatcaaggttcatgagttgagggacaaatcgaaggctgatttgtttgctcagttgaaggatcttaaggctgaactcgctcttcttcgagttgccaaagtcaccggtggtgctcccaacaaactctccaaaataaaagtggtgagaacatctattgcccaggtgctgactgtcatttcacagacacagaaggccaagctcagggaagcttacaagaacaagaagtacttgcctcttgatttacgtcctaagaaaaccagagccatccgcaggcgtttgaccaagcaccaggtatctctgaagactgaacgagagaagaaaaaggagaagtactttccattgaggaagtatgctattaaggtttagggtagcttaggtagtacttgatttttgaactgggttttatttaaattatattttcatgttttggatcaagttgaattttgggagttgaaattatagtgttctgttttctcctagttttacagtggttaaatgaatggtagacaatctttgtt

SEQ ID NO: 6986 - DNA, 757 bp, Cynara scolymus
cggggtctagggtttcactttcgagcgagccttcgttgcagtttactccggcttccatcaatggctcgaatcaaagttcatgagcttaggaacaaatcgaaggttgatttgtttgctcagttgaaagatctcaaggctgaacttgctcttctccgggtcgccaaagttaccggtggtgccccgaacaagctctccaagataaaggtggtgaggacatcaattgcacaagtgctgactgtgatttcacagactcagaagtcagctctcagggaagcctacaaaaacaagaagtacctgcctcttgatttgcgtccaaagaaaaccagagccatccgcagacgtctaaccaagcatcaggcttcattgaagactgaaagagagaagaagaaggagaagtactttcctttgaggaagtatgctatcaaggtgtaaggtgggaactatgaaggaggagatttaagttgtggtgtgtaaatctctttccagttttgaactcatagtttgtgtacgattaatcagagatcatgcgttcgatagtttgtctgcattgagttaaaagacagttaacatcggagcttgctcttgatgtttgcatacctatttgacttgtttcatcttttttaaaaaggcatctacatttgtggtgttgatttgcattatctgttgtatcgattcgtttcttatgaaagcaaagactttgctctgacaatgttttgcatcgaccttttgtactaaaggtactagatatcggggttac

SEQ ID NO: 6987 - DNA, 608 bp, Taraxacum officinale
ttttcgaattagggtttgagatttcagctgcggctcattcaactatcgcataatccatggctcggatcaaagttcatgagttgagggacaaatccaaggttgatttgtttgctcagttgaaggatcttaaggctgaactcgctcttctccgtgtcgccaaagtcaccggcggtgctcccaacaagctctccaaaataaaagtggtgaggacatcaattgcacaggtgctcactgttatttcacaaacacaaaaagcaaaactcagggaagcctacaagaacaagaagtacttacctcttgatttgcgtccaaagaaaactagagccattcgcaggcgtttaaccaagcaccaggtatcattgaagactgaaagggagaagaaaaaggagaagtacttccctttgaggaagtatgctattaaggtgtaaggacagatgatgaatccatgtacgatgagatttcaatttttgaatttaatagttaatttacttcatattatgttttggaaggaatttaattttggagcttgttcttggtattgacattataatgttgcctttctgttttacttgatttttcatttattgttattatgatggttagaatcc

SEQ ID NO: 6988 - DNA, 580 bp, Taraxacum officinale
cggggtccgtggtatagggtttcagaagacactccgttgcagctgcggctcatacaattaacggcgtaatccatggctcggatcaaagttcatgagttgagggacaaatcgaaggtcgatttgtttgctcaattgaaggatcttaaagctgagctcgctcttctccgtgtcgctaaagtcaccggcggtgctcccaacaagctctccaaaattaaagtggtgaggacatcaattgcgcaggtgttgactgttatttcacagacacagaaagcaaaactcagggaagcttacaagaacaagaagtacttacctcttgacttgcgtcccaagaagaccagagccattcgcaggcgtttaaccaaacaccaggtatctttgaagactgaaagagagaagaagaaggagaagtactttccattgaggaagtatgctattaaggtgtaaggctagattaataaacaatgtaggatgagattttaagatctgaaccttaaacttaatttttgttaatctgatgttttggaaggagttgaattttggagcttgttcttgatattgagattataatgttgctttcttg

SEQ ID NO: 6989 - DNA, 559 bp, Taraxacum officinale
aagactctccgttgcaggtgaggctcatacagttatcgccgtaatccatggctcggatcaaagttcatgagttgagggacaaatcgaaggtcgatttgtttgctcaattgaaggatcttaaagctgagctcgctcttctccgtgtcgctaaagtcaccggcggtgctcctaacaagctctccaaaattaaagtggtgaggacatcaattgcacaggtgttgactgttatttcacagacacagaaagcaaaactcagggaagcctacaagaacaagaagtacttacctcttgatttgcgtcccaagaaaaccagagccattcgcaggcgtttaaccaagcatcaggtgtccttgaagactgaaagagagaagaagaaggagaagtactttccattgaggaagtatgctatcaaggtgtaagggtagatgattaaaaccatgtagaatgagattttaagatcttaaccttaaacttgatttttgttcatctgatgttttggaaggagttgaattttggagcttgttcttgatattgaaattataatgttgctttcctgtca

SEQ ID NO: 6990 - DNA, 664 bp, Echinacea purpurea
tctcgccagaattcttcatcgtgaagaaatctacatgctagaagtgatttactcgcccatcccatcccatccacaaaccatggttcgtcgtttttattattttagggtttcagaacgtcacagctgcggctcctgcaacaaactcataatccatggctcggatcaaagttcacgagttgagggagaaatcaaaaactgatttgtttgctcaattaaaggatctgaaaactgaactcgcacttcttcgtgttgctaaagtcaccggtggtgctcccaacaagctctccaaaataaaagtggtgaggacatctattgcacaggtgttgactgttgtttcacagactcaaaaggcaaagctcagggaagcttacaaaaataagaagtatttgcctcttgatctgcgtcctaagaaaaccagagccatccgtaggcgtttgaccaaacatcaggtgtccttgaagacagaacgggagaagaaaaaagagaagtactttccgttgaggaagtatgctattaaggcttaggatagataatcaaataccaatgttcttctcacttgaatcttgaacttagttatttttacacattatatgttgatgtttttggtctaaggtcattctgtatcttgatcttgatattggaagcacagtgcttttgttttacg

SEQ ID NO: 6991 - DNA, 638 bp, Euonymus alatus
attttagggttttcagtctcgtcctcgtagcaggagcagtgccgcctttcccaagcagcatcaatggcgaggattaaggtccacgagctgagacagaaatcgaaggcggagctcttgaaccagcttaaggatctcaaggccgagctcgctctcctccgtgtcgctaaggtcaccggtggcgcacctaacaagctctcgaaaatcaaggtggtgagattgtcgattgcccaggtgttgactgtgatttcgcagacccaaaaggctgcactgagagaggcatacaagaataagaagttcatgcctcttgatctgcgtcctaagaagactagagccattcggagaaggctaacaaagcatcaggcatccttgaaaacagaaaggcagaagaagaaggagatgtattttcccatgaggaagtatgctattaaggtgtaatgtggttttttattacataggatattttgatatcttggagttaaagacgtttggctatgaaattttgatgttatttactcatgttgtcttgtttgtgaacgatattgtctttgttttaacatcaaatttggttggtttgtgctggatgtaaaacatggcatgtgttgctttcctgttcatgactatatcacaaatgcgtcttt

SEQ ID NO: 6992 - DNA, 767 bp, Euonymus alatus
cggccgggggacgtccgtcctctgttttttagggttttcattctcgcagcagcaggagcagagccgcctttcccaagcagcatcaatggcgaggattaaggtccacgagctgaggcagaaatcgaaggcggagctcttgaaccagctcaaggatctcaaggccgagctcgctctcctccgtgtcgctaaggtcaccggtggcgcacctaacaagctctctaaaatcaaggtggtgagattgtcaattgcccaggtgttgactgtcatttcccagacccaaaaggctgcactgagagaggcttacaagaataagaagttcatgccccttgatctgcgtcctaagaagaccagggccattcgcagaaggctaacaaagcatcaggcttccttgaagacagaaaggcagaagaagaaggagatgtattttccgatgaggaagtacgcgattaaggtttaatccagttttactacgtaggatattttggtatcttagagttataaaacgtttggctatggaattttgatgttatttattcctactggtcttgttcgtgaacaatattgtccttgttttcactctaaattcggatggtttatgtttgcaaagttgaatctgattaggtttgtgatagaattgtggacgagaaagctatttattttcatatgtttgatctctctcctccctattttatttttcagtcaagctccataatatgtttgattgtcatcattgaaatgcatttcataagttatctggtgttgactga

SEQ ID NO: 6993 - DNA, 655 bp, Euonymus alatus
ccgggggacgtgttccctctcattttagggttttcagtctcgtcctcgtagcaggagcagtgccgcctttcccaagcagcatcaatggcgaggattaaggtccacgagctgagacagaaatcgaaggcggagctcttgaaccagcttaaggatctcaaggccgagctcgctctcctccgtgtcgctaaggtcaccggtggcgcccctaacaagctctcgaaaatcaaggtggtgagattgtcgattgcccaggtgttgactgtgatttcgcagacccaaaaggctgcactgagagaggcatacaagaataagaagttcatgcctcttgatctgcgtcctaagaagactagagccattcggagaaggctaacaaagcatcaggcatccttgaaaacagaaaggcagaagaagaaggagatgtattttcccatgaggaagtatgctattaaggtgtaatgtggttttttattacatagatatcttggagttaaaaacgtttggcaatgaaattttgatgttatttactcatgttgtcttgttcgtgaatgatattgtctttgtttttaacatcaaatttggatggtttgtgctggatggaaaacatggcatgtgttgcttgcctgttcatgactatattacaaatgcgtcttttagt

SEQ ID NO: 6994 - DNA, 774 bp, Euonymus alatus
gcggccgggattacggccgggggtccgtcctctgttttttagggttttcattctcgcagcagcaggagcagagccgcctttcccaagcagcatcaatggcgaggattaaggtccacgagctgaggcagaaatcgaaggcggagctcttgaaccagctcaaggatctcaaggccgagctcgctctcctccgtgtcgctaaggtcaccggtggcgcacctaacaagctctctaaaatcaaggtggtgagattgtcaattgcccaggtgttgactgtcatttcccagacccaaaaggctgcactgagagaggcttacaagaataagaagttcatgccccttgatctgcgtcctaagaagaccagggccattcgcagaaggctaacaaagcatcaggcttccttgaagacagaaaggcagaagaagaaggagatgtattttccgatgaggaagtatgcgattaaggtttaatccagttttactacgtaggatattttggtatcttaagagttataaaacgtttggctatgaaattttgatgttatttattccgactggtcttgttcgtgaacaatattgtctttgttttcactctaaattcggatggtttatgtttgcaatgttcgatccgattgggtttgtgatagaattgtggacgagaaagctatttattttcatatgtttgagtagacctgtcctggtgctgttatgtgtccatacgtgctaagtatatcttagctaatgttttccatatgatgatttgttagtgagacgcttc

SEQ ID NO: 6995 - DNA, 705 bp, Festuca arundinacea
agtggtatcaacgcagagtacggggggcctcattttcttctctccgcccgccgccgccgctagacaagcacgccgaccgcaatggcccgcatcaaggttcacgagctgcgggggaagaacaaggcggagctcctgggtcagctcaaggacctcaaggcggagctctccctcctccgcgtcgccaaggtcaccggtggcgcccccaacaagctctccaagatcaaggtggtccgcacctcgatcgcgagggtgctcacggtgatctcgcagaagcagaagtctgcgttgcgtgaggcgtacaagaacaagcggctcccgctcgacctccgccccaagaagacccgcgccatccgcaggcgtctcaccaagcaccagctctctttgaagaccgagagggagaagaagcgtgagaagtacttccccatgaggaagtatgctatcaaggcctaggttaggagcccatgtttcagcggttaagttttgcccagaagttgcctgaattctatgttctgtgtggactcccctgtcacctaagtactatgtatttggtctactccatgagatgtcaacgtttgcttattaaaactatattgatctaggtaaaaaaaaaaaaaaaaaaacaaaaaaaaaaaacaaaaaaaaaaaaaaaacaaaaaaaaaaaaaaaaaaaaaacaaaaaaaaaacaaaaaaacaaaaaacaaaac

SEQ ID NO: 6996 - DNA, 590 bp, Flaveria ramosissima
ctagggtttcaaactttcacgccggccttcacagcagttcacaccagcttcaatcaatggcccgaatcaaggttcatgagcttaggaacaaatcgaaggctgatctgtttgctcagctgaaggatctcaaggctgaattggctcttcttcgtgtcgccaaagtcaccggcggtgctccaaacaagctctccaagataaaagtggtgaggacatcaattgcgcaggtgttgactgtgatttcacagactcagaaagctgctcttagggacgcctacaagaagaagaagtacttgcctcttgatttgcgtccaaagaaaaccagagccatccgtagacgtctaaccaagcatcaggcttcattgaagaccgaaagagagaagaagaaagagaagtacttcccgttgaggaagtatgctatcaaggcgtaaggtcaaaactgttgaggagatttaggtgtgtaaaaatctctttccagttttcgactttgtgttcaattgatcagaaatatgtatttgttagtttggttgcagtgagttgcaagacattagacatcggacctttcttctttatgttaagtatctgttcgactt

SEQ ID NO: 6997 - DNA, 590 bp, Flaveria ramosissima
catcgtttccaaattagggtttcaaaacaccattgcagcagcggcttctgcaacaaactcataatccatggctcgaatcaaagttcatgaattgagggagaaatcaaaggctgatttgtttactcaattgaaggatctcaaggctgaactcgctcttcttcgtgttgctaaagtcaccggtggtgcccccaacaagctctccaaaataaaggtggtgaggacatcaatcgcgcaggtgttgactgttatttcacagacacagaaggcaaagcttagggaagcttacaagaataagaagtatttgcctcttgatttgcgtcctaagaaaactagagccatccgtaggcgtttgaccaaacatcaggcctcattgaagactgaacgagagaagaaaaaggagaagtacttcccattgaggaagtatgctattaaggcttagggtagatgaacaagtatgtatgttcttctcacttgaattttgaacctggtttatatttattacattaatatggctgcttttgttttaagttcatttgtagcttgattttgataattgatatcgaaattgtcaaatgacattgtttttgtat

SEQ ID NO: 6998 - DNA, 479 bp, Flaveria ramosissima
cgcgggggcagctagggtttcaaactttcaagccagccttcacagcagttaacaccatcttcaatcaatggcccgaatcaaggttcatgagcttaggaacaaatcgaaggctgatctgtttgctcagttgaaggatctcaaggctgaattagctcttcttcgtgtcgctaaagtcaccggcggtgctcccaacaagctctcgaagataaaagtggtgaggacgtcgattgcccaggtgctgactgtgatttcacaaactcagaaagctgctcttagggacgcctacaagaagaagaagtacttgcctcttgatttgcgtccaaagaaaaccagagccattcgtagacgtctaaccaagcatcaggcttcgttgaagacggaaagagagaagaagaaggagaagtatttcccgttgaggaagtatgctattaaggcttaaggtcaaaactatcgaggagatttaagtttgtaaatctctt

SEQ ID NO: 6999 - DNA, 571 bp, Flaveria ramosissima
caatcaatggcacgaatcaaggttcatgagcttaggaacaaatcgaaggctgatctgtttgctcagttgaaggatctcaaggctgaattagctcttcttcgtgtcgccaaagtcactggaggtgctcccaacaagctctccaagataaaagtggtgaggacatcaattgcgcaggtgttgactgtgatttcacagactcagaaagctgctcttagggacgcctacaagaagaagaagtacttgcctcttgatttgcgtccaaagaaaaccagagccatccgtagacgtctaaccaagcatcaggcttcattgaagaccgaaagagagaagaagaaagagaagtacttcccgttgaggaagtatgctatcaaggcgtaaggtcaaaactattgaggagatttaggtgtgtaaaaatctctttccagttttcgactttatgttcaattcatcagaaatatgtattcgttagtttgattgcaatgagttgcaagacagttgacatcggacctttcttttttatgttaagtatctgttcgactttggttttgggaggctagtttacagtttgttt

SEQ ID NO: 7000 - DNA, 560 bp, Flaveria ramosissima
acagcagttcacaccagcttcaatcaatggcacgaatcaaggttcatgagcttaggaacaaatcgaaggctgatctgtttgctcagttgaaggatctcaaggctgaattggctcttcttcgtgtcgccaaagtcactggaggtgctcccaacaagctctccaagataaaagtggtgaggacatcaattgcgcaggtgttgactgtgatttcacagactcagaaagctgctcttagggacgcctacaagaagaagaagtacttgcctcttgatttgcgtccaaagaaaaccagagccatccgtagacgtctaaccaagcatcaggcttcattgaagaccgaaagagagaagaagaaagagaagtacttcccactgaggaagtatgctatcaaggcgtaaggtcaaaactattgaggagatttagttgtgtaaaaatctctttccagttttcgactttgtgttcaattcatcagaaatatgtattcgttagtttgattgcaatgagctgcaagacagttgacatcggacctctctttcttatgttaagtatctgttcgactt

SEQ ID NO: 7001 - DNA, 639 bp, Linum usitatissimum
gacagatagcagctgccgccatcgccagagtgaaacgaagcaatggccagaatcaaggtccacgagctgaggcagaagaacaagttggatcttttgaatcagctcaaggatctcaaggctgagttttctcttctccgcgttgccaaggtcaccggcggcgctcctaacaagctctccaagatcaaggtggtgcggctgtctattgcccaagtgcagactgtgatctcacagaagcagaaagctgcactttgtgaagtgtacaagaacaagaagctgttgcctcttgacctccgtcccaagaagaccagagccatcagaaggaggcttaccaagccccagcaattttttaagacggagagggagaagaagagggaaatgtacttccccatgaggaagtatgcaatcaaggggtaggaaaagctagcaacttttctgttttcaagggttattaagatttaaggaggtgcgttttattattaggagcaattttgagtttttttgtaatttcatatttgaagatagacatgtgaactcgagcatcaacttttgaacaagttttggaatgatatgtatcgacttttttcccccccttgttgaatcagagttcatgttttatggaagggtttgaaaatttgaatt

SEQ ID NO: 7002 - DNA, 631 bp, Gossypium raimondii
gcactctccggaccttcatcaccacaaagggagaaagaggcagccactcatggcaaggattaaggtacacgagctaagggacaaatcaaagacggagctgttgagccagctcaaggaattaaaagctgaactttctctacttcgtgtagcgaaggtcactggtggtgctcccaacaagctctccaagattaaggttgtgaggctatcgattgcacaagtgttgacagtgatatcccagaagcagaaggctgcattgagggaagcatataagaagaaaaagtttttgcctcttgatctccgtcccaagaagaccagagctattcgccgccgcctcaccaaacaccagcaatctctgaagacggagagggagaagaagagggagatgtactttccacagaggaagtatgccattaaggtgtaagcttttcaaatttatattacgagggatatacccctttttcttcattagattttaaatgactacacaatgatatgttgttgtttaattttcatttcttcgtatttccttttattaccttcatctttctcactactatgaactgttggaacctagaaagtgtttttgtgcagttttttcttttataatttctggattgaaggcttgcttccc

SEQ ID NO: 7003 - DNA, 595 bp, Guizotia abyssinica
tagggtttcaaactttcacgccggccttcatcgcagttaaattcagcttcaatcaatggctcgcatcacggttcatgagcttaggaccaaatcgaaggttgatttgtttgctcagttgaaggatctcaaggcggagctctctcttctccgtgtcgcgaaagttaccggcggtgctcagaacaagctttcgaagataaaagtggtgaggactcaaattgctcaggtgctgactgtgatttcacagactcagaaggctgcacttagggaagcctacaagaacaagaagtacttgcctcttgatttgcgtccaaagaaaactagagccatccgtagacgtctaactaagcatcaggcttcattgaagacagaaagggagaagaagaaagagaagtactttccattgaggaaatatgctatcaaggcataaggtgaaaactatgaaggatatttaggtgttgaaatcactttccagttttggacttaaatttatcagagatatgtgtttgtagtttggttgcaatgagttacaagaccttgacgatgctgctgtggcgtttgtgaatcgcgtaaatttgaggccgcctcgaccctagat

SEQ ID NO: 7004 - DNA, 621 bp, Mesembryanthemum crystallinum
tccccgggctgcaggaattcggcacgaggtttttactagtcgccattggagctcaccttccaaccagaaatggcgagaatcaaagtccacgagctcaggcaacaacccaaagccgagctgttaaatcaactcaaggccctcaaggatgaactctctctcctcagagtcgctaaggtcactggcggtgctcccaacaagctctcgaagatcaaggtggtgagattgggaattgcacaagtgttgactgtgatatcacagaaacagaaggcggcacttagggaggtttacaagaacaagaagtacttgcctcttgaccttcgtcccaagaagacccgggccattcgtcgtcgccttacaaagcaccaggcatccttgaagacggagagggagatgaagaaggagaggtactatcccatgaggaagtacgccatcaaggtgtagtttagtgtaggcattccagatatctagcagagttggtacatttcaactattttacaccaacaagaacttttgtaacgatagcttgttgagatccttgcttgtgctctctagtctttgataattaacgattttgtttccgacaagttttgagcagagaaaaaatggttatagacttttagt

SEQ ID NO: 7005 - DNA, 673 bp, Ipomoea nil
tcatcgctgtctggaacagcgatactcggagaaccgattcaaggctagggttttcggaattctaaggaagcagcagccatggcgagaatcaaggttcacgagctgaggaacaagagcaaagcggagctgctggctcaattggctgatctcaaggccgagctcgccctccttcgcgtcgccaaggttactggtggtgctccaaataagctgtcaaaaatcaaggtagtaaggctgtcaattgcacaggtattgaccgtgatttctcagactcagaaggctgcacttagaaatgcttataagaacaagaagtatttgcctcttgatctccgccccaagaagaccagagccatccgccggcgtctgaccaagcaccaggcttctttgaagacagaaagggaaaagaagaaggagatgtatttccccttgaggaaatatgctatcaaagtgtagagtaggactatgctctctctgttttgaactgagtatatcagttagaacattgaattcaagaattttgtttactgtgttaatgtgttcatgttaactttgattggaagattaatcagtttgcaacataccattaatttcaatttgtgtgaagtaatcttgtatgatagattgccatcaattctgtaacactttgcaaggctgcaattgccaagttccaagtagt

SEQ ID NO: 7006 - DNA, 992 bp, Lactuca sativa
aacaaatgaggtttatggtagggatagggatagcaatcgctatcttagcccaaagcccaattgtaagatactcttagtgggctaacaaggtctattgcactatcggatatttggaactggatctagcaaataatagactggactgggctacaaatagcttgagccttatatatcaaccccaaccttccgttcatatctcgtaattagggtttcaaactttcagaaggagccttccctgcagttcacttcggcttcgatcaatggctcgaatcaaagttcatgagcttaggaacaaatcgaaggctgatttgtttgccgagttgaaggatctcaaggctgaacttgctcttctccgtgtcgccaaagttactggtggtgctccgaacaagctatccaagataaaagtggtgaggacatcaattgctcaggttctgactgtgatttcacaaactcagaagtctgctcttagggaagcttacaagaacaagaaatacttgcctcttgatttgcgcccaaagaaaaccagagccatccgcagacgtttaaccaagcatcaggtttcattgaagactgaaagagagaagaagaaggagaagtacttcccattgaggaagtatgctatcaaggcgtaaggtgggaattatccaggatgatatttaggtattaatgtgtttaaaacttgttccaattttgaagtctgattctctgtacgaatgatcagaaatcatgtatttgatagtttgtttgcaatgagttacaagatgatcaacatttgtgtttgctcttgattttgcctagctatttctttatgaacgcagtttactattgtttgtttccttgattatatgtatctgttttaacctgtcttgatgtatttgttttcttaaattactgattacttctttaacaaaaatggtcacatctgaaatggcatgatatataatttcaccattttttatgtatttgttggattttgaattacagaaaaggca

SEQ ID NO: 7007 - DNA, 632 bp, Lotus japonicus
gggtagcagagcatagcaatcagctagggtttctcttcacaacgacaaagaagcttcgcattcgcaatggcgagaatcaaggtgtacgagctcaggaacaaaacgaaagcagagcttcttagccaattgaaggatctcaaagcagagctcgctctcctccgtgttgccaaggtcactggtggagccccaaacaagctttccaaaatcaaggtggttcggctttcgattgcgcaggtgctgacagtgatttcccagaaacaaaaggcagcattgagggaagcttacaagaataagaagtatttgcctttggatctgcgtcccaagaagaccagagctatcagaaggcgcctcactaagcaccaggcttccttgaagaccgaacgagagaagaaaaaggaattgtacttcccactgagaaaatatgcagttaaggtgtaatgttggaatccaagtacggatagtaatatttttgctggcactttatttttgatataaaattgtttgttctggtcgctcaggttttatgctgctgagtttctacgttctagtttatttaatcatcaagaaactgaattaggagttagcttgcttactcttgtttttcaatatatatcaagcgttcaattttttgg

SEQ ID NO: 7008 - DNA, 659 bp, Lupinus angustifolius
ataaaggttcatcgttaaccttttgtgcctccgattctagggttttaggagttgctgcatttcacagctgcgtgtggttccaaaacaatggcgaggattaaggtttacgaacttaggagcaagacaaaggcggagctgctgaaccagctgaaggatctgaaggctgagctcgctcttctccgggtcgctaaggtcaccggtggtgcccctaataaactctccaaaatcaaggtggtaaggctgaacattgcgcaagtgttgacagtgatttcacagaagcagaaagcggctctcagagaggcttataagaataagaagtatttgcctcttgatcttcgtcccaaaaaaacacgtgctattcgtagacgcctcaccaaacaccaggcatcattgaagacggaacgggagaaaaagaaggaattgtactttccaataaggaagtatgcaatcaaagtttagacttcaattgcttttaagttgtgcatttttagaccggtaagttgaatgatattgaaattgtggttttgtaaccctgccattgtggcagcattccaaattttcgaaccagacaccttccaattttgtatttgtatgcagccaccctttggagctcttgaggtttaatgttggaatcagagttgtttcaagaaattctgctt

SEQ ID NO: 7009 - DNA, 3627 bp, Medicago truncatula
ctttaaatgaggatgatggagtagcacaatggtccacatccgttgttttatatgttttatgcggaacttgtggcgaagttctcttcatcgagaaagcataaactgtatccgtcagaggaagatgaaggtgatcaattcgtttcagtgacgaaatctattgatgctggtatatctagaccggtgcattgaaacacctgtagatcctgtgttgttgttgcgatatatacaatgatgaatgagcagaaagtccacaaaaggagttatatcctaaagggtttgtcaattttagtatcaataaataatgatcaacccttaagtgtatcagagcttggcctactatgatgtaaagcaagcaaagtttgtatcttcatgctttccttttgagtttctagctttatttgatcaggctatgattatctagataacttataactcctgcaaaattgtttttgagctgatcgtatgtataaagtacaccttgctagtgaaacaagatcatatgtgttatatgtataatgatatgaaaattgtagtctcttgtaaatgagtccatcagcctgtgcaatcttttgtacagggcaagcaaaccaaacatcaagtcaattatgcataatgataattgtgtttgattcttgcgtggtaagtagcaatttcatgcaaatgaattcaacttaattgttcaagctggaacttcattgaatattgagcactaatattattaagataacatgtttagaattgttaagaaatattcagaacctgaaccgacgatgaagttggtgacgcatggtcgttggttgacttagaattagattatttacaagagatgaagaggaatatggcgataaatgtttgtgagtcgtcacacttatcagctcctgattctctttttaccgaacatcctgcagcttcagactctatcttgtggaaaactggcaataaccaatttcagatgcaaccaagatagagtcgtgcgtgcgagccatgtggatttcaaaatttctttgagcgactcctcgtgtgggagtattgatgtggcagactggcagtagcattttctgaacaaaacaaaatgttaagagaacatgattttgtattgctcgaatacagcgctggaaaaggtagtgatgtttgcaattaatcacttggtcatgtgagaaaaaaactgaggttgttgcacactactaaaaaataaccaccaaacaattagccaattagattaggcaaacactgtaaaataaacaaaaatggtttacaagagacatcagaacagcaagggttagattgagattgagaagagaagagaatcatggagtaagaataagcatcaactcccgattcacatacatctccatctaccggtgtcaaccacaagtccacaaccacaaccacacctacaaccaccgcctctaatatgctgtcgaaactgttgcaactgcaacttcacagagacgatttccatctctctggcaccacaactgaatcagtcatgcattccaactcaaggtaaaattaaatcgaaattcaatatccgtatttcaattttagcgatactattttaattttatttatgaatttttgaagagtttgattcattattagccgggatttttacagtgaatcaatggtaactatattgagtcagtcctctaattcctttatgcttcttttgattcccagcccctattgcattttttttaacttatatggttgattaaatgaatgaataattgttgaactaacttaatcggatgatgcatgaggctggccattttgtatcggttggatttgatgattctgttaaggatgagatagattgaattcggtgtcgctttccttgggatagcagcagcgagggtggcgtgttactggagacggtgcaaatgaaaaattgttatccatttcaagtgatggtttgttatatcaagtaagatttcttaaataaaaagattactactcttttcttgagttcatagacaacctcttccttttgagtttgagttccaacttctccatattcatatgaaattaaataacatcctaatcctggatgatgtcaacaatgtgaggtatcatggcctctatgatgtagttaatgaagtggtagagtttccacacgagagaggttgaagtaattggtgatataaatttaaacatgtttgattggcattttatatacatgactttttggttatagcttttgtttgtatctttgccattcacctgccttatgtagctatttgaatccatatattctgccttaacctactgtagtattgtaggttcatgcagttaaacatatgattagatgcaggtgttcaatttgctatgttttttatctaattttctacatcttgctatctttatatggatgatttgtgctttagtagataacaacttaaaaaggactatgttcatgaaaggagggcttctcattgactatatgtatatggactgcatctaatagtgaaattattttttatcagaatttgtaagcttctaaagtgtaattatttgattttgtttttttaactatttgacaaacgtttttgttatgctagaatttcatacatttgtctaataatccaattccaaatttttgtagtgaataatatgcattggttatttttttaaactttgattctgatccttgctagccttgtccagatatttttttgtattccttgcagtgttggaccgcttgagatttatgaaaatctacaaatatatagttttagattcagatgcaaatgttattcattgttcatatagattgaaagtatgtttatgaggatttgatatgtttctgtgtttttactctgtacaatttgaatgtaattgatagtgtggtgggtattaagtgatttcttactaaagcagcaatgcaaagaagatgcattccaatcatgatttagttcatggccataagaagaactcaattaacttcttggtatacttcgtgtgtttctccttctcatgtgcaaggttaattatactacataatttaatttatgtgatgcatgaaatgtatgtttagttaacgcatgtatgagatgtatgtttaacatgttttagcagggttcaagaggcgcagtcgcagaagaacctcgtgaattcaacaatggccaggatcaaagttcacgagttgaggcagaagaccaaagctgatctattggctcagctcaaagacctcaaagctgaactagctttgctccgtgttgctaaggccactcgggctgcacccaacaatctctccaaaattaaggaggtaaggttgtcgattgctcaggttttgacagtgatttcccagaagcggaaagctgcattgagggaagtttacaagaacaagaagtatttgccaattgatctccgcccaaagaagaccagggccgttcgcaggaggctcaccaagcatcagtcctcattgaagaccgagatggaaaagaaaaaggagacatatttcacaatgaggaaatatgctatcaaggcataggattgtagatagtcatgccacttataggcacctttctattggagcaaattgagacgaaaaacttttctgcatttgatgtaataggatatcacttttgaataagtcaatcaagcttcaagtccaaggggtgtgaa

SEQ ID NO: 7010 - DNA, 730 bp, Momordica charantia
tggtcctatttacggccggggagtttcttgaacctagggttttgcaagttgcagacctccgccgaatccccaacagagcagccggcttctcctcaccagattctaatggcgagaattaaggttcacgagcttagacagaagtcgaaggcagatcttttgggccagcttaaggaccttaaggcggagcttgctcttctacgtgttgctaaggtcaccggtggtgctcccaacaagctctccaaaattaaggtggtgaggttgtcaatcgctcaggtgttgacagtgatttctcagaaacagaaggccgcgcttagggaagcttacaagaagaagaagcttttgcctcttgatttgcgccccaagaagaccagggccattcgtagaagactcaccaagcaccaagcatctctaaagaccgagcgacagaagaagaaagagatgtactacccattgaggaagtatgccattaaggtgtaggcatagggtgaattgatcgatcatcgttggtatcatgcatcttttactcatgttggcttttgatttatatctataacgttatttggacttgagtacccattttgaatcttattcttagatctatgaactttcaagtgctttctttttcatgtaatactttagtgtcctgagttataatgaaatggttttggttaatgactctttaagcaacgcaatcttttgccaatatgaatgtggtctgattttagataac

SEQ ID NO: 7011 - DNA, 509 bp, Nuphar advena
gcgcctccatcatcgtcttcatggcgaggatcaaggttcacgagctcagggcgaagacgaagacggagcttctgaaccaactgaaggatctgaaagccgagctcgctctgcttcgcgtcgccaaggtcaccggtggcgccccgaacaagctctccaagataaaggtggtgaggctgtcgatcgcgcaggtgctgacagtaatctcgcagaagcagaaggcagcgctcagggaggcttacaagaagaagaagtacctgcccctcgacctcaggcccaagaagacccgagccatccgacgaagcctcaccaaacatcaggcatctttgaagacagagcgcgagaagaaaagggagaagtacttcccgatcaggaagtatgccatcaaggtgtaggcagatgaactctagagctatcatttgtttttagattagaaactaaaaatgtctcagtttttgtgggaaactggttttgttgtgtctggaatacattctgaggttatttttgccact

SEQ ID NO: 7012 - DNA, 724 bp, Avena sativa
cttggcaccccctgcgtatcatctcctcgccgccgctgcagctgccgcctcttcgctgccaatcgttgtcatggcacggatcaaggtgcacgagcttcgcgggaagaacaaggcggagcttcaggggcagctcaaggacctcaaggcggagctatccctcctccgcgtcgccaaggtcaccggcggagcgcccaacaagctctctaagatcaaggtggtgcgcacatcgattgcgcgcgtcctgaccgtgatctcgcagaaacagaaggctgcgctgcgtgatgcgtacaagaacaagaagctgctccccctcgacctgcgtcccaagaagacccgcgccatccgccgccgcctcaccaaacaccagctttctcttaagactgagagggaaaagaagcgtgagaagtatttccccatgaggaagtatgccatcaaggcttaactaggcaacatgagatgtgtttagcacagtatcggataatttgtttgtgctgggaggttgttgaaccatgatgttatcctgtatggacgcccattgtggtttaagttcaatgtgatgacaaatcttgtcaaatgcctagtttggtttaagcacttcttgcatgttgacgttgattatctaaatttttgacatcttcccttctatttgaatgtctcatcggtgatgctacttacatggtcttgtgtatgaaaatgtattcatattttttcttttgatctaaaa

SEQ ID NO: 7013 - DNA, 639 bp, Elaeis guineensis
gttttcctacctgtctctatacgacttttctacctttgggaaccctgccgccatttcgtctcgcccgagccgagggagagtagggcagaagagatctcgatccgcttgcaatggcgaggattaaggtccacgagctacgggggaagtctaaggcggatctgttgaaccagctgaaggacctcaaggcggagctcgccctcctccgcgtcgccaaggtcaccggcggcgcccccaacaagctatccaagatcaaagtggtgaggctctcgatcgcgcgggtgctgacggtgatctctcagaagcagaaggaggtgctgcgggaggcgtacaagaagaagaagtaccagccgctcgatctccgccccaaaaagactcgcgccattcgccgccgactcaccaagcaccaggcttcattgaagactgagcgcgagaagaaaaaggagatgtacttcccaatgaggaagtatgcaatcaaggcctagattaggttattctgtttaagtgactcatttgggatccaattttgtcatttgctttatggattagcattcctgtttagtaccatgattgggtttatggcatacaaaatactaaatcgttggcgctcgaatttggataagcttgatgtttgattcttga

SEQ ID NO: 7014 - DNA, 685 bp, Elaeis guineensis
gttttcctacctgtctctatacgacttttctacctttgggaaccctgccgccatttcgtctcgcccgagccgagggagagtagggcagaagagatctcgatccgcttccaatggcgaggattaaggtccacgagctacgggggaagtctaaggcggatctgttgaaccagctgaaggacctcaaggcggagctcgccctcctccgcgtcgccaaggtcaccggcggcgcccccaacaagctatccaagatcaaggtggtgaggctctcgatcgcgcgggtgctgacggtgatctctcagaagcagaaggaggtgctgcgggaggcgtacaagaagaagaagtaccagccgctcgatctccgccccaaaaagactcgcgccattcgccgccgactcaccaagcaccaggcttcattgaagactgagcgcgagaagaaaaaggagatgtacttcccaatgaggaagtatgcaatcaaggcctagattaggttattctgtttaagtgactcatttgggatccaattttgtcatttgctttatggattagcattcctgtttagtaccatgattgggtttatggcatacaaaatactaaatcgttggcgctcgaatttggataagcttgatgtttgattcttgattcatctccctttgccagcattaactttctggatggtcatactagt

SEQ ID NO: 7015 - DNA, 790 bp, Orobanche aegyptiaca
ctttagcccaaaacacacatttctatccaccaccggaatgggctttggagctaaatcagcccaaaatgatacataaatacgtaaattagggtttgccggctgcttcatataacttatttgtcatctcccccaacgcaaagcctctctcctgcggaaccaagaagatggcgcggatcaaggtgcacgagcttcgacagaagagcaaggcggatctgttgtcgcagttgcaggaactgaagggggagctttcgctgctgcgcgtggccaaggtcaccggcggcgctccaaacaagctctccaaaatcaaggtggtcaggctgtcgattgcacaggttttgaccgtcatttctcaaaagcagaaggccgctctacgggaagtatacaagaacaagaagtatttaccgctcgatcttcgccctaagaagacgcgagccatccgccgtcgtctcaccaagcaccaggcatctttgaagacagagaaacagaagaagagagaaatgtacttcccgttgaggaaatatgccattaaagtttaagttgtgtttaagttgtgtttttgttttggaagtttgattttgggggattttgaaattatgcgcaattaaatttttacatttggagtttatttcagatattttggatcaagcttttgtatccatgctcgaaatttgtggttcaggttgtttctgttctgagttatttttcttgttttgcttaatcgtttatgcttcaagtagctttgcaaaagcttcttaaagatcaatactatatttttccgtggtgtggattg

SEQ ID NO: 7016 - DNA, 780 bp, Cajanus cajan
gaggctgaggtccagtttctgatttggcccaaaaagggcccagatccacttgataggttaagccgtgttgtgttatgtgttgttttttgggcacattagatgagggttttaggggagaggagtgaaggtaggtagggtttggcaatggcgagaatgaaggtgtacgagctgaggaacaaaaccaaagcagagcttctcaaccaattgaaggatctcaaagcagaactcgctcttctccgcgtcgctaaggtcactggcggagccccaaacaagctttccaaaataaaagtggttcggctttcgatagcgcaggtgctgacggtgatttcccagaagcaaaaagcagcgttgagggaggcttacaagaacaaaaagtacttgcctttggatctgcgtcccaagaagactagggctatcagaagacgcctcaccaagcaccaggtatcattgaagacagagcgtgagaagaagaaggaattgtattttccactgcgaaaatatgcacttaaagtgtaatatttatccacatacagataataattttggtgtcactttctatttgttatttgacatacaatttgttcctggccgctcagcttttatgccgtgtcttcctagtatcttaatcaccatgaaactaaattaaaagttagcttgttttactctggcttttggtttttcatcatatgaaaattttcaatttctttactacccaaggtaatctatattcttttgtatacacaattcatcatttaataagattcatagatcatttttgtt

SEQ ID NO: 7017 - DNA, 561 bp, Cajanus cajan
ttcattgttttgagaagaacacagagcagagcaattagggtttcacagtgacacaagcgcttcgcaatggcgagaatcaaggtttacgagctgaggaacaagacgaaagcagagcttctgaaccaattgaaggatttgaaagccgaactcgctcttctccgtgtcgctaaggtcactggtggagccccaaacaagctctcgaagataaaagtggttcggctttcgatagcgcaagtgctgacggtgatttcgcagaagcaaaaagcagcgttgagagaagcttacaagaataagaagtacttgcctttggatctgcgtcccaagaagaccagagctatcagaagacgcctcacaaagcaccaggaatcattgaagacagagcgtgagaagaagaaagaaatgtacttcccaattagaaaatatgcattaaaggtgtaatgtcgatccaagtttgggtgatttttttgacgttgctttctatttgttatttgacataattttaaagtttttcagttttcttaggttctatttttgtgtcttttcacttaacttatattctcc

SEQ ID NO: 7018 - DNA, 524 bp, Platanus occidentalis
gagagagagagatggcaaggatcaaggttcacgagctcagagggaagtcgaaggcagatcttctgactcagttgaaggatctgaaagcagagctcgctctgctccgagtcgccaaggtcactggtggtgcgcctaacaagctctccaagatcaaggttgttaggttgtcgattgcacaggtcttgacagtgatttcgcagaaacagaaagcggctttgagggaagcctacaagaagaagaagtttctgccacttgatctgcgtccgaagaaaaccagagccatcagaaaacgcctaaccaaacaccagttgtctttgaagacagagcgagagaagaagcgggagatgtactttccaatgaggaagtatgccatcaaggtgtagggtagtaaccatttacagaggatatgtagctccttttggaaatgccattgtgaggataaacatttgaaatttgtttcttttggttctggtctagatgcagacaatcttcttgtttcatcactcttttttgttttagaattt

SEQ ID NO: 7019 - DNA, 682 bp, Platanus occidentalis
tccgtgtctagggtttgattgatgagattagggctttgatcgtgggataaaaccaagccagagcctgtcgtctgccttctccagaagacgcacagagggagggcgagagagtgggggagtagtaggaggtcagagaaaaagaccagtagccatggcgaggatcaaggtccacgagctcagagggaagtcgaaaccagatctattgaatcagttgaaggatctaaaagcagagctcgctcttctccgagtcgctaaggtcactggtggtgcgcctaacaagctctccaagatcaaggttgttaggttgtcgatcgcgcaggtcctgacggtgatttcgcagaaacagaaggcggctttgagggaggcctacaagaagaagaagttcctgccacttgatctgcgtccaaagaaaaccagagccattagaaaacgcttaactaaacaccaggaatccttgaagacagagcgggagaagaaacgagagatgtacttcccaatgaggaagtatgctatcaaggtgtagggtaggatctatttacattttacatagggagattttgttatttattgcttttgcgatgccattgccaggataaactttgattttcttatttttcaattttgctcaagatgcagatgatattttgtattgcctttaatttggttttaatatttcggaatg

SEQ ID NO: 7020 - DNA, 765 bp, Populus trichocarpa
ccgtggatcctcaaataagaccatctccctgcctgctagggttttctgaaaggaacacaacggagcagcggcagagccttacaaccaccttaaaatggcaaggataaaggttcatgagttgagggaaaagtccaagacagagctgctggcccagctgaaggagctcaaagcagagctcgctctcctccgtgttgccaaggttactggcggtgcccctaacaagctctccaagataaaggtggtgaggttgtcaatagcgcaggtgttgactgtgatatcacagaaacagaaagccgcactcagggaagcttacaagaataagaagtttctgcctcttgatctccgtcccaagaaaactcgtgccattcgcagacgtcttactaaacaccaggcatctttgaagacaaaacgtgaggaaaagagggagatgtacttcccgatgagaaagtatgcaatcaaagtttaggatagtgcgtagcacatttggtataggtgcagccatgccagcaatcattttgtttctgcatctttttttggaccactttatttgtgtcttcatctcaaaattcagaatttcttgattttggttgccctcactttggatatcatattcctattcaatcttgttactgccatcttcactgatcgagttgattataattgaatttcacatcgactcccctactatcttgcttctgtattggtcttgctcattaaaatcagccaaagtttgattatttttccgtgacaattgccaatgattat

SEQ ID NO: 7021 - DNA, 750 bp, Populus trichocarpa
tacgcttatttagggtttccgtaaccaccgagaggaaacacagaaagccgcactgccgttgccagagagagagacgaagcaatggcaagaatcaaggttcatgagttgagaaacaaatcaaaggcagatcttttggctcagttgaaggatctcaaagcggagcttgctctccttcgcgttgctaaggtcaccggaggtgctcctaacaagctctccaagatcaaggttgtgaggttgtccattgcacaggtgttgactgttatttcacagaagcagaaggctatattgagggatgcatacaagaacaagaagtttttgcctcttgatctgcgtcccaagaagaccagggccatccgcaggaggcttactaagcatcagctatcactgaagactgagcgcgaaaagaatagagagatgtacttcccaatgagaaagtatgctattaaggtgtagggtgcatccatagcataggctattttgatttctttcttgaacctattctgttgacaagttttgattttgatggtatttgtgaactggagctcctctttttttcaatctatgcttttatacttttggagagggtgcatctcactctaaccgagaagctagatttatattggaattgcagctgaagagtatttctgttcatttgtttgtgaaatcgcatgcgcagcctgtgtttagggtttgttccaaacgtcgcctgagctcttacagttgcagtaataaataataactaggggtgta

SEQ ID NO: 7022 - DNA, 559 bp, Carthamus tinctorius
tctcaagcttgtgttttttcgtggcggcggcgatctcttcactcaatcggagagccatggcgaggatcaaggttcatgagttcaggaacaaaaacagagcagatttgttgggtcaattgaaggatctcaaggccgagctcgcccctcttcgtgtagccaaggtcaccggtggtgctcctaacaaattatccaaaataaaggttgttagaacatcgattgcccaggttttgaccgtgatgtcacagaaacaaaaagcggcactgcgggaagtgtacaagaacaaaaagtacctgcctcttgacttacgtcccaagaaaacgcgggctatccgaagacgtctaacaaagcaccaggcatcgttgaaaactgaaagagagaagaagaaagagaagtatttcccattgaggaagtatgccatcaaggtttagaggtgcattacggtcttttttgaatatttgagttcatcaatttcgctagtatttgtaaacccggtttcactgtgtttctgctttaatgatgatcaaaagatgcttaaatacgatggttgtttttttgcaaa

SEQ ID NO: 7023 - DNA, 699 bp, Carthamus tinctorius
ggcggggcaccctaaatttttctttatttttctaattagggtttcaagccagccatcatcgttgcagtctactccaccttcaatcaataatggctcgaatcaaagttcatgagcttaggaccaaatccaaggttgatttgtttgctcagttgaaagatctcaaggctgagcttgctcttcttcgagtcgccaaagttaccggtggtgcccccaacaagctctccaagataaaggtggtgaggacatcaattgcacaggtgctgactgtgatttcacagactcagaagtctgctctcagggaagcctacaagaacaagaagtatcttcctcttgatttgcgcccaaagaaaaccagagccattcgcagacgtctaaccaagcaccaggcttcattgaagactgaaagagagaagaagaaggagaagtacttccctttgaggaagtatgctatcaaggtctaaggtgggaaactatggagaaggagatttaagttgttgtgtgtaaatctctttccagttttgaagtcagagtttgtgtactatttgatcagaaatcatgtatttcatagtttttttctgcaatgaggtaaaagacaattgacattggagcatgttcttgatgttgcatacctatttgactttgtttttctgaaaggcagtgtattgttgattgcattatgaatttgtggttaacttcaaa

SEQ ID NO: 7024 - DNA, 536 bp, Senecio madagascariensis
ccattacaggttaatcaaatggctagaatcaaagttcatgagctaagagggaaaacaaaggctgatttgtttgcccaattgaaagatctcaaagctgaacttgctttgttacgtgttgctaaagtcaccggtggtgcccctaacaaactctccaagattaaagtggttcgtacatcgattgcacaagtgttgactgtgatttcacagacccagaaggctgcgcttagagacgcttataagaacaagaagtacttgcctcttgatcttcgtcccaagaaaaccagggccattcgtaaacgtttgaccaaacatcaggcttcgttgaagacagagcgagagaagaagaaagaaatgtacttcccattgagaaagtatgccatcaaggcataggttttttggaagttgatttaggtccagttttgaatttggattttgtgtacgttttcatcaaagtctatttgtttctaaaagttaccgttcagttaaacattggatcttgcattgaaatgctggagtcggtttttagtttttaaaaa

SEQ ID NO: 7025 - DNA, 635 bp, Solanum phureja
ctgaattttaacatctcctagggtttcggaattctcttcagtgtgagaagagtgaacctgtgagagaagcgccatggcaaggatcaaagttcacgaattgaggcagaaatccaaggctgatcttttgggtcagttgaaggatctcaaaactgaactcgctctcctccgtgttgctaaagtcactggcggtgcccccaacaagctctctaaaataaaggtggtaaggctgtcagtagcacaggtgttgacggtgatatcgcagaggcagaagtcagcactaagggaagcatataagaataagaagtacttgcctctcgaccttcgtcccaagaagaccagagccatccgtagacgtcttacaaagcaccaagcatctttgaagacggaaagagagaagaagaaagagatgtactttccattaagaaagtatgccattaaggtttaaatatccgacttagatagtcgttgtgatgttagaactagaactagaactagaactagctgagcaaagcagagttacattttcgctactgagtagttatattttccatcgtcattcgtgttattgtattgtgaagtggaaacttttgtttattttctcatgtttcagtgaaggttcttcagtttttacaagt

SEQ ID NO: 7026 - DNA, 921 bp, Glycine max
tatataagggatcgtccttaatattgtgtctccgattttagggtttcggagtcgttgcagagctgcgcgtcgatctagaaaatggcgaggataaaggtttacgagcttaggaacaagacgaaggcggagctgctgaaccagctgaaggatctcaaggcggagcttgccctgctccgcgtcgccaaggtcaccggcggcgcccccaacaagctctccaaaatcaaggtggtgaggctttcgatagcgcaggttttgacggttatttcccaaaagcagaaagcggcgctgagagaggcttacaagaagaagaagtatttgccccttgacctacgtcccaaaaagacccgcgccattcggagacgccttaccaaacaccaggcgtctttgaagacggaacgtgagaaaaagaaggagctgtactttccactaagaaagtatgcgatcaaagtttaggttagaattggtttcaagttgcattttttagggcagttacttgtattgaaattttaaggttttgatggcagccactgtggcagcattccaatttttagtaccagagttgtttccatacctgcattcagtttccaaggtctatctatatgttaaaaccagagttgtttcgagaaattatggttgctgtcggcttttttgctttatagcgtatcacctattgaatgatcaaatggccgtatcctttttgagttgtgatttatgcactaaggcacgacccaataagcccaacagagacacgtcacagacgacgttgtacgtattcaacaggtgcttcattcataagaatcataacattaatcacaacccagtacaatttccaaccatgcatcatccaaatcaaataaaaacagtcaagaaagactacagttgcatggacccataggttgtgcaaaatgaacccaaataggg

SEQ ID NO: 7027 - DNA, 733 bp, Glycine max
accgatattagggtttcggagtcgttgcagagctgcgcgttgatctagaaaaatggcgaggataaaggtgtacgagttgaggaataagacgaaggcggagctactgaaccagctcaaggatctcaaggcggagctagccctgctccgcgtcgccaaggttaccggcggcgccccaaacaagctctccaaaattaaggtggtgaggctatcgatagcgcaggttttgacggttatttcccagaagcagaaagcggcgctgagagaggcttacaagaagaagaagtatttgccccttgacctccgtcccaagaagacccgcgccattcgcagacgccttaccaaacaccaggtgtctttgaagacggaacgtgagaagaagaaggagctgtactttccactaagaaagtatgcgatcaaagtttaggttagaattggtttcaagttgcattttttaggacagttacttgtattgaaattttaaggttttgatgcctgccgctggggcagcattccaattattagtaccagagttgtttcaatgcttgcattaagtttccaaggtctatatgttaaaaactagagttgtttcgagaaactattgttgctttcggcctttaactttatagcgattacctgttgaatgatcaatggccgtaacctttatgagttgtgatttatgcacatctcaacagtggatacccaaatcgacactcttcatttctctcgtttttgt

SEQ ID NO: 7028 - DNA, 709 bp, Glycine max
cccagattagggtagtagcagaaagaaagagtaaccaggtggtagggtttctaattcttttcatcctcttcgcagagcctcagtagcttcgcattagcaatggcgagaatcaaggtgtacgagctgaggaacaagacaaaagcagagcttctgaaccaactgaaggatctcaaagcagaactcgctctcctccgcgtcgccaaggtcaccggcggagccccgaacaagctttccaaaatcaaagtggttaggctttcgatagcgcaggtgctgacggtgatttcccagaagcaaaaagcagcgctgagagaggcttacaagaagaagaaataccttcctttggatctgcgtcccaagaagaccagagccatccgaaggcgcttaactaagcaccaggcttcattgaagacagagcgtgagaagaagaaggaattgtattttccactgcgaaaatatgcaattaaagtgtaatgttagatcccaatacggatgataattttggcgtttgttagttgacacagttttgatgccgttttgtcctagttttcttttaatcatcatgaaacttttattaaatgttaactggttttactctcgcctttgttttttcgtcatatatgaaaattttcaatttttgcatgcacaggctaatctatattcttttgtgatttaccagttattaataaagttcgtagatcagttttattaa

SEQ ID NO: 7029 - DNA, 687 bp, Helianthus annuus
ttctaactttccggcagccttcatcgcagttcactccaccttcaatcaatggctcgaatcaaggttcatgagctcaggttcaaaacaaaggctgatttgtttgctcagttgaaagatctcaaggccgaactagctcttctccgtgttgccaaagttaccggtggtgctcccaacaagctctccaagataaaagtggtgaggacatcaattgcgcaggtgctgactgtgatttcacagactcagaaggctgctcttagggatgcctacaagaagaagaagtatttgcctcttgacttgcgtcccaagaaaaccagagccattcgtagacgtctaaccaagcatcaggcttcattgaagaccgaaagagagaagaagaaagagaagtacttcccattgaggaagtatgctatcaaggcgtaaggtcaaaactatcaaggaggatatctaggtgtgtaattctctttccagttttttatttgtacggttcatcagaaatatgtattcgttagtttgattgcaacgttagtttggttgcaacgacagaccttgctttttttattttaagtacctatttgacttgttttttgaaggcaatttacagttgtttcgttggttcattatgcactatgttagttccatgggttgaatcttgtaacatcaaaataatttatatgggcaaaagcaatg

SEQ ID NO: 7030 - DNA, 617 bp, Helianthus annuus
cgcggggcagctagggttctaactttcacggcagccttcatcgcagttcactccaccttcaatcaatggctcgaatcaaggttcatgagcttaggttcaaaacaaaggctgatttgtttgctcagttgaaggatctcaaggccgaactagctcttctccgtgttgccaaagttaccggtggtgctcccaacaagctctccaagataaaagtggtgaggacatcaattgcgcaggtgctgactgtgatttcacagactcagaaggctgctcttagggatgcctacaagaagaagaagtatttgcctcttgacttgcgtcccaagaaaaccagagccattcgtagacgtctaaccaagcatcaggcttcattgaagaccgaaagagagaagaagaaggagaagtacttcccattgaggaagtatgctatcaaggcgtaaggtcaaaactatcaaggaggatatctaggtgtgtaattctctttccagtttttgatttgtacggttcggttcatcagaaatatgtattcgttagtttggttgcaacgacagaccttgcttttttattttaagtacctatttgacttgatttttgaaggcaatttacagttgtttcgttgg

SEQ ID NO: 7031 - DNA, 664 bp, Helianthus annuus
actttccggcagccttcatcgcagttcactccaccttcaatcaatggctcgaatcaaggttcatgagcttaggttcaaaacaaaggctgatttgtttgctcagttgaaggatctcaaggccgaactagctcttctccgtgttgccaaagttaccggtggtgctcccaacaagctctccaagataaaagtggtgaggacatcaattgcgcaggtgctgactgtgatttcacagactcagaaggctgctcttagggatgcctacaagaagaagaagtatttgcctcttgacttgcgtcccaagaaaaccagagccattcgtagacgtctaaccaagcatcaggcttcattgaagaccgaaagagagaagaagaaagagaagtacttcccattgaggaagtatgctatcaaggcgtaaggtcaaaactatcaaggaggatatctaggtgtgtaattctctttccagtttttgatttgtacggttcatcagaaatatgtattcgttagtttggttgcaacgacggaccttgcttttttattttaagtacctatttgacttgttttttgaaggcaatttacagttgtttcgttggttcatcatgcactatattagttccatgagttgaatcttgtaacatcgaaaaattttatatcagcaaaagcaatg

SEQ ID NO: 7032 - DNA, 633 bp, Helianthus annuus
cggcagccttcatcgcacagttcactccaccttcaatcaatggctcgaatcaaggttcatgagcttaggttcaaaacaaaggccgatttgtttgctcagttgaaggatctcaaggccgaactagctcttctccgtgttgccaaagttaccggtggtgctcctaacaagctctccaagataaaagtggtgaggacatcaattgcgcaggtgctgactgtgatttcacagactcagaaggctgctcttagggatgcctacaagaagaagaagtatttgcctcttgacttacgtcccaagaaaaccagagccattcgtagacgtctaaccaagcatcaggcttcattgaagaccgaaagagagaagaagaaagagaagtacttcccattgaggaagtatgctatcaaggcgtaaggtcaaatctatcaagggggatatctaggtgtgtaattctctttccagtttttgatttgtacggttcggttcatcagaaatacgtattcgttagtttggttgcaacaacggaccttgctttttttttttttttattttaagtacctatttgacttgtttcttgaaggcaacttacagctgttttgttgggttcattatccactatattagttccatgggttg

SEQ ID NO: 7033 - DNA, 489 bp, Eutrema halophilum
atgacgtcagctcctacgcattccctttgggttcttctgctatctttcagcacacaagagactcgagagctcgaagacgccatggcgagaatcaaggttcatgagttgagggagaaatcgaagtcggatctttctgctcagttgaaagatctgaaggcagaacttgctgtcctccgcgtcgctaaggtcactggcggtgctcctaacaagctctctaagatcaaagtggtgaggaagtcgatcgcacaggtgttgactgtgatctcacagaaacaaaaatctgctctaagagaggcatacaaaaacaagaagttgttgccactcgatctccgtcccaagaagactagagctatcaggagaagactaaccaagcaccagtcttcgctgaagacagaacgagagaagaagaaagagatgtactttccaattagaaagtatgccatcaaagtttaatatatcattttttgttgtctccctctgttttttttt

SEQ ID NO: 7034 - DNA, 607 bp, Tragopogon dubius
ggtacggtttcgtccatttttcggaactagggtttcagaggcagcctccattgcagttcgcttctgcgtcgattacacttaatcaaatggctcggatcaaagttcatgaactgaggggcaaatcgaaggccgatttgtttgctcaattgaaggatcttaaaactgaacttgctcttctccgtgtcgccaaggtcaccggtggtgcgcccaacaagctctccaagataaaagtggtgaggacatcgattgcacaggtattgactgttatctcacaaacccagaaagccatgcttagggaagcttacaagaacaagaagtaccttccactcgatcttcgtcccaagaaaaccagagccattcgcaggcgtctcaccaagcaccaggtttctttgaagacagagcgagagaagaagaaagagaagtacttcccattgaggaagtatgcaattaaggcttagtgagaaattaaatccaacctttttttcaattttgaatctggatttttgtaaggttttataattttaaaggttttcagttgatgttcaattgaatgttggatcttgctttaaagttgaggcagcattttggttgtgttgttattttgatt

SEQ ID NO: 7035 - DNA, 684 bp, Triphysaria pusilla
ctcgcttcagtcgtcgcctctctcctgcagaaacagagacctaaacagacgagagaaatggctcggatcaaggtccacgagctccgccagaagagcaagtcagatctattggcgcagttgaaggacctgaagacggagctttcgttgcttcgcgtggccaaggtaaccggcggcgcacccaacaagctatccaaaatcaaggtggttaggttgtcaatcgctcaggtgctcaccgtcatctcgcagacgcagaagtccgctctgagagaagcctacaagaacaagaagtatttgccgctcgatctccgccctaagaagacccgtgccatccgccgtcgcctcaccaagcaccaggcatctttgaagaccgaaaagcagaagaagaaagcaatgtacttccctttgaggaagtatgctattaaagtttaagttctgtattggaagtctaatcttggatggtattgaaattttgtgttcaattcagtttttaaatttggagttcagttcaggtgtcaaaactagaagaagactgggagttcagttcatttgagttcagttcagtttttaaatttggagttgagttcagtctaatctttgaagaacctctgcttgatatttcaatgttctattgacacattgtttctgtttgtttttgcattatcccttttgtgtttccaatagcct

SEQ ID NO: 7036 - DNA, 773 bp, Triphysaria pusilla
cagatatataaaaacgtgattagggtttccttccgctacacagcattccagtcgcttgtcattcgtcgcctctcctgcagaaacagaaactaaacgaaagagagaaatggctcggatcaaggtgcatgagctccggcagaagagcaagacggaactgttgtcgcagttgaaggacctaaagacggagttgtcgttgctgcgtgttgccaaggttaccggcggcgcacccaacaagctgtctaaaatcaaggtggttaggttgtcaatcgcccaggtgctcaccgtcatctcgcagacgcagaagtccgctcttagagaagcgtacaagaacaagaagtatttgccgctcgatctccgtcctaagaagaccagagccatccgccgtcgcctcaccaaacaccaggcatcgttgaagactgaaaagcagaagaaaaaagaaatgtatttcccgttgaggaagtatgctattaaagtttaagtttttattttggaagtctgatcttggaggatattgaaaatttgtgcccaattcagtttttcaaatctgtagtttggttcagatatcagaactcgaagacttagaaccattgatctatttgtatgatcagccaaattatgttcttgttatgtatccctgctagacatttgatacatggttaagttttcttttttgcttcatctcgtctttgtttgcaattgcttttctgaagctgtgttcatttgcaggatggcatttcttagaaggggttggagaactgtgtgttttatattga

SEQ ID NO: 7037 - DNA, 669 bp, Triphysaria pusilla
ctcgcttcagtcgtcgcctctctcctgcagaaacagaactaaacagacgaaagaaatggctcggatcaaggtccacgagctccgccagaagagcaagtcagatctattggcgcagttgaaggacctgaagacggagctttcgttgcttcgcgtggccaaggtgaccggcggcgcacccaacaagctatccaaaatcaaggtggttaggttgtcaatcgctcaggtgctcaccgtcatctcgcagacgcagaagtccgctctgagagaagcctacaagaacaagaagtatttgccgctcgatctccgccctaagaagacccgtgccatccgccgtcgcctcaccaagcaccaggcatctttgaagaccgaaaagcagaagaagaaagcaatgtacttccctttgaggaagtatgctattaaagtttaagttctgtattggaagtctaatcttggatggtattgaaattttgtgttcaattcagtttttaaatttggagttcagttcaggtgtcaaaactagaagaagactgggagttcagtaatgagttcagttcagtttttaaatttgtagttgagttcagtctaatctttgaagaaccattgatctatttgtagatcagatgaattatgtttgttttaagtatctctgcttgatatttcaaggttcta

SEQ ID NO: 7038 - DNA, 618 bp, Triticum aestivum
gccgccgccgctcccgccgctagaccagctcgccagcagcaatggcccggatcaaggtgcacgagctgagggggaagaacaaggcggatctgcagggccagctcaaggacctcaaggcggagctctccctcctccgcgtcgccaaggtcaccggcggcgcccccaacaagctctccaagatcaaggtggtgcgcacctcgattgcgagggtgctcacggtgatctcgcagaagcagaagtcggcgctgagggaggcgtacaagaacaagcgtctcccgctcgacctccgccccaagaagacccgcgccatccgcaggcgtctcaccaagcaccagctctctttgaagacggagagggagaagaagcgcgagaagtacttccccatgaggaagtatgctatcaaggcctaggttaggagtacatgttttaccggccgagttttgctcagaagttgcatgaattttatgttctgtgtggacaccgctgctatctaagtactatgtattcgatatcctgcatgaaattcgaacttatgcttattgacactatgatctatagctgcttgtttgtgttgcaatgtgttggttattgtactttgttagtttccagttcatctga

SEQ ID NO: 7039 - DNA, 459 bp, Avena sativa
gcacgggtcaaggtgcacgagcttcgtgggaagaacaaggcggagcttcaggggcagctcaaggacctcaaggcggagctctccctcctccgcgtcgccaaggtcaccggcggagcgcccaacaagctctctaagatcaaggtggtgcgcacgtcagtagcgcgcgtcctgacggtgatctcgcagaaacagaaggctgcgttgcgggaggtttacaagaacaagccgctccccctcgacctccgtaccaagaagacccgtgctatccgccgccgccttaccaaacaccagctttctcttaagacggagagggaaaagaagcgtgagaagtatttccccatcaggaagtacgccatcaaggcttagttatgcaacatgagatgtgtttagcacagtttcggataattcgttgaaccttgatattatcgtgtatggacacacccccttgtggttttaagt

SEQ ID NO: 7040 - DNA, 633 bp, Cucurbita pepo
ggggggttcccaaaagccctagtcttcttagtagcagctcttttcaccgggttccatcttctcttcctagggtttcgccgcgggcggcgcagagtcgaagaggacgctagaagaaatgacgaggattaaggttcacgagttgaggcagaaatcgaaggctgatctgttgacacagcttaaagatcttaaggcggagctttctctccttcgagttgctaaagttactggcggagccccaaacaagctatccaaaatcaaggtggtaagattatcgatcgctcaagttttgacagtaatttcacagaagcagaaagcagcattgagggaagcttacaagaagaagaagcttttgcctctcgatctgcgtccaaagaagaccagagccattcgtagaaggctcaccaagcaccaggcatctctggtaactgagcgacagaagaaaaggagatgtactatccattgaggacttatgctattaaggtgtagtagtattgtcttgtgttcttgtggacaagttttgtctcgtgttcttgataatcttatgtctgatacactttaatcattcccccaaacccgaaatgtttgatttccatagacagttctatatttttacagatagcgtaagttcaattt

SEQ ID NO: 7041 - DNA, 563 bp, Flaveria ramosissima
gggtttcaaactttctacgccggaccttccacagcagttcacaccagcttcaatcaatggcccgaatcaaggttcatgagcttaggaacaaatcgaaggctgatctgtttgctcagctgaaggatctcaaggctgaattagctcttcgtcgtgtcgccaaagtcaccggaggtgctccaacaagctctccaagataaaagtggtgaggacatcaattgcgcaggtgttgactgtgatttcacagactcagaaagctgctcttagggacgcctacaagaagaagaagtacttgcctcttgatttgcgtccaaagaaaaccagagccatccgtagacgtctaaccaagcatcaggcttcattgaagaccgaaagagagaagaagaaagagaagtacttcccgttgaggaagtatgccatcaaggcgtaaggtcaaaactattgaggagatttaggtgtgtaaaaatctctttccagtttttgactttgtgttcaattcatcagaaatatgtattcgttagtttggttgcaatgagttgcaagacagttgacatcggacctttctt

SEQ ID NO: 7042 - DNA, 593 bp, Avena sativa
tctccgctcgccaccgccgccgctagaccagctcgccgacagcaatggcccggatcaaggtgcacgagctgcggggtaagaacaaggcggacctgcagggtcagctcaaggacctcaaggcggagctctccctcctccgcgtcgccaaggtcaccggtggcgcccccaacaagctctccaagatcaaggtggtccgcacctcgatcgccagggtgctcacggtgatctcgcagaagcagaagtctgccctgcgggaggcgtacaagaacaagagctgctccgctcgacctccgcccaagaagacccgtgcaatccgcaggcgccttaccaagcaccagagctctttgaagaccgagagggagaagaagcgtgagaagtattccccatgaggaagtatgctatcaaggcctaggttaggagtgcgtgttttaccggtcaagttttgcccagaagttgcctggattatgttgtgtgtggactccatgagatgtacaatgtatttgatctactccatgagatggtcatcttttgcttaactttatgaggtatctggttataactgcttgctgatgttggaatgtgatggttatcgt

SEQ ID NO: 7043 - DNA, 491 bp, Elaeis guineensis
cctgccgccatttcgtcttcgcccgagccgagggagagtagggcagaagagatctcgatccgcttgcaatggcgaggattaaggtccacgagctacgggggaagtctaaggcggatctgttgaaccagctgaaaggacctcaaggcggagctcgccctcctccgcgtcgccaaggtcaccggcggcgcccccaacaagctatccaagatcaaagtggtgaggctctcgatcgcgcgggtgctgacggtgatctctcagaagcagaaggaggtgctgcgggaggcgtacaagaagaagaagtaccagccgctcgatctccgccccaaaaagactcgcgccattcgccgccgactcaccaagcaccaggcttcattgaagactgagcgcgagaagaaaaaggagatgtacttacccaatcgaggaagtatgcaatcaaggcctagattacggttattctgtttaagtgactcatttgggatcctaattttgtc

SEQ ID NO: 7044 - DNA, 1138 bp, Ananas comosus
gccaattcgcatcgccatgggtaagaattgatcccttctcccccgcgatcctctcccctggatttcccgatctccacattctcatcgatctcctctctttctccttcgatcgcagcgaggatcaaggtccacgagctccgggggaagacgaaggcggagctcctcgcccagttgaaggatctcaaggcggagctctccctcctccgcgtcgccaaggtcaccggtggcgcccccaacaagctctccaagataaaggtggtgagggtttcgatcgcgagggtgttgacggtgatctcgcagaagcaaaaggcggcgctgcgggaggcatacaagaagaaaaattaccagccgctcgatctcaggcccaaaaagactcacgccatccgactccgcctcaccaaacaccaggcgtctttgaagacggaacgagagaagaagagggagaagtattttcccatgaggaagtatgcaatcaaagcatgaaaagagtaggagtatttgatgttcttagctggaattcgacgcttttagttatatcagttgcattttattgtaatatttgctctgttggttagtgtgaacttatcaccaaattgcgtttcttcattatggattgaaacagcagcttttagatgcttgaatttctgcatgtctgtagcatcattttgttggattcacaaagccccccccccccccccccccccccccccccccccccccccccccccccccccccccccccccccctgaaatacatcctgttctggatgtgatattcttttgtgtgccacaataaaattcgtttgttatgaatcttacggtaactctatgtattgagtttctattagttattaagttgcccccccccccccccccccccccccccccccccccccccccccccccccccccgagagatagtagcatgctattcgtttcggttatttcatttagaaataaacttctggaaatgtgaatcaactaggattagaacttggatctcggtactaaactatcaagttcttttgccatttgctctaagaacggtcggtaagttaagaaattttgttggtacaaatgaagatcggatcttccgttcgaattagaagacgtgtgagattgacacatgaaatactct

SEQ ID NO: 7045 - DNA, 491 bp, Arnica chamissonis
tctgaggcagcctccattgcagcttgcatttgctccgaatacagttaatcaatggctcggatcaaagttcatgagttgagaggcaaatcgaaggccgatttgtttgctcagttgaaggatctgaaagcagaacttgctcttcttcgtgtcgccaaggtcacaggcggtgcaccgaacaagctctctaaaattggttagaacctctattgcgcaggtgctgactgttatatcacagactcagaaagccatgcttagggaagcttacaagaataagaaatacttgcctctcgatcttcgtcccaagaaaaccagagccattcgcaggcgtctcaccaaacatcaggcttcgttgaagacggagcgagagaagaagaaagagaagtatttccccttgaggaagtatgcaatcaaggcttaggtctatttttgaattttgattaattgtttgtgtatgatttcatgaaagtttgttggatttgaaaggttaattg

SEQ ID NO: 7046 - DNA, 645 bp, Centaurea maculosa
atggctcgaatcaaagttcatgagcttaggaccaatcgaaggtcgatttgtttgctcagttgaaagatctcaaggctgaacttgctcttcttcgagtcgccaaagttaccggtggtgcccccaacaagctctccaagataaaggtggtgaggacatcaattgcacaggtgctgactgtgatttcacagactcagaagtccgctctcagggaagcctacaagaacaagaagtacttgcctcttgatttgcgcccaaagaaaaccagagccatccgaaaacgtcttaccaagcatcaggcttcattgaagactgaaagagagaagaagaaggagaagtacttccctttgaggaagtatgctatcaaggtgtaaggtgtgaaactatggaggaggagatttaagtagtagttgtgtaaatctctttccagttttgaagtctgagtttgtgttctatttgatcagagatcatgtatttcatagttttctttttctgcaatgaggtaaaagacaattaacattggaagcttgttgcataccagtttacttgctttttttggaagacagtgtattgttgattgcattatgcatttgtggttaacctctattgcatcatttctacatcaaaaaagaaaaagtaccgactgcg

SEQ ID NO: 7047 - DNA, 494 bp, Flaveria ramosissima
cgaatcaaggttcatgagcttaggaacaaatcgaaggctgatttgttcgctcagttgaaggatctcaaggcgaacttgcgtcttcgtcgtgttgcgaaagtcaccggtggtgctccaacaagctttccaaaataaagttgtgaggacctcaattgctcaggtgctgactgtgatttcacagactcagaaggctgctcttaagggaagacttacaagaacaagaagtacttgccactcgacttgcgcccaaagaaaaccagagccatccgaagacgtcttaccaagcatcaggcttcgttgaagaccgaaagagagaagaagaaagagaagtacttcccattaaggaagtatgctattaaggcataaggtgaaaaccatcaaggaggagatttaggtgttcgaatcactttcaagttttggacttaaattcatcagaaatgtgtttgttagtttgtttgcaatgagttataagacattctacattggatcttgct

SEQ ID NO: 7048 - DNA, 576 bp, Oryza sativa
cctctccccgctcgccgccgccgccgccgccagccaagctcgccgctcgccatggcccggatcaaggtgcacgagctccgggggaagaacaaggcggagctgcaggcccagctcaaggacctcaaggcggagctctccctcctccgcgtcgccaaggtcaccggcggcgcccccaacaagctctccaagatcaaggtggtgcgcacctcgatcgcgcgcgtgctgacggtgatctcgcagaagcagaaggcggcgctgagggaggcgtacaagaagaagagcctgctcccgctcgacctccgccccaagaagacccgcgccatccgcaggcgcctcaccaagcaccagctctctttgaagaccgagagggagaagaagcgtgagaagtatttccccatgaggaagtatgctgttaaagcttaggttattaggaacataaatgttttaccggtcaagttttgcccagttgcctaaatttgatgttttgtgtggacatccattgtcaccttagtacaatgtatttggtctactgcatgaagtgcgtactattttgccttttaacgttgttatttggtt

SEQ ID NO: 7049 - DNA, 492 bp, Glycine max
ggacacaaagtagcagagcagagtaaccagctaggtagggttttctctttctcacgttcctcttcgcagcgccacagtagcttcgcattagcaatggcgagaatcaaggtgtacgagctgaggtacaagacaaaagcagagcttctgaaccaacttaaggatctcaaagcagaactcgctctcctccgcgtcgctaaggtcaccggcggagccccaaacaagctttccaaaatcaaagtggttcggctttcgatagcgcgggtgctgacagtgatttcccagaagcaaaaggcagcgttgagggaagcttacaagaagaagaaataccttcctttggatctgcgtcccaagaagaccagagccatcagaaggcgcttaactaagcaccaggcttcattgaagacacagcgtgagaagaagaaggaattgtattttccaatgcgaaaatatgcaattaaagtgtaatgttagaaccaaatatgatgataattt

SEQ ID NO: 7050 - DNA, 951 bp, Abies balsamea
gggaggacatatacaaaccctagtttaaaccctagatataataaaccctagctcttcattttgtgtctttatcatctgtttacctttagggtttggaaggggagaggagaggagaggaagcgggagcagacgaacctagctgagtcgcggaggttctacttgtgacaggatttgagtcgaaatggccaggattaaggttcatgagctccgtaataagagcaaagtagatctgttaagtcagctcaaggatctcaaagctgagcttgccttgctcagggttgcaaaggttactggaggggcgcccaacaagctctctaagatcaaggtcgtgaggctatcaatagctcaggtcctgactgtgatttctcaaagccaaagatctgcattgagggaagcatacaagaaaaagaagtacttgcctcttgatttgcgtcccaagaagactcgtgctatcaggcgacgccttaccaagcatcaagcatcattgaagacagagagagagaagaagaaagagatgtattttcctatgagaaagtatgcagttaaggtgtaaagcctaggatttgagctttcatgcaatttttttgctacttgcgggatgatattgcctaatatatttccactgagcttttggctttctttttgcatcagaatgcaagttgtgataggtgttctttcattgttgagcagtgaatattgttttccctttacttctcttgaattgcaaccatattttgatgtaatgaatgaaatataatatggtggtatctccatgtggaactcatgtaagaaatgattgtactctgattagaaagttgatatttcaagaactatgatatttttactgtcaattgtttttcaatcttatagtcaaactaactgactgggcaaatgaccctgtgagtctagaaagtatacatgattttttttgacaaaagctgggctaaatga

SEQ ID NO: 7051 - DNA, 804 bp, Amaranthus tuberculatus
cgtggtgtttgagatggaggagagctttctcgactacttttaacgcgagggtttctgagcattcatagtcgccgttccaactaaatcaaaatggctcggatcaaagttcatgaattgaggcagaaaacgaaggtagagctgttgaatcagctcaaggatctcaaagctgagctcgccctccttcgtgttgctaaggttacaggcggtgcaccgaacaagctttccaagattaaggtggtgagattggggatcgcacaagtattgacggtgatgtctcagaagcaaaagtcggcattgagggaagcttacaagaacaagaagtatttgcctcttgatcttcgtcctaagaagacccgtgctattcgtcgccgtctaactaagcaccaggcatctttgaagaccgaaagggaaaagaaaagggagatgtactatcctatgaggaagtatgccatcaaggtttaggcttaggcaatcctttctataggttgttaagatgtttgttgatcattttaaagtggcttatgacaaaagattactgacttttgattttgtgtgttgtgctttttatatattcatatccataagtagcaatgtgattgatttatgacgaattgacgatctttgatagggaatggtgggtatggacacatttatgtgtttttttgagtaattcttcaaacggcatagcaaactagttttgtttgtgatatacttcctcctttctagctatattagttgtaacattaggcaaaataacactatttatggatatgaatatataaaaagcacaacagtcgtgggagg

SEQ ID NO: 7052 - DNA, 819 bp, Amorphophallus konjac
ctacaaaagcctggaacgaagcgcctcccctccccaacgccgtgttcgtcccccactagctgctgccgtcgcacacggctagatctccccttccgccgtctccatggcgaggattaaggtccacgagctgcgcgccaagtcgaaggttgacctgctcagccagctcaaggacctgaagacggagctctccctgctgagggtggccaaggtcaccggaggcgcccccaacaagctctcgaagattaaggtggtgagactttctattgcccgcgtgcttacggtcatctcgcagaagcagaaggccgcgctgagggaggcctacagcaagaagaagtacctccccttggatctgaggccgaagaaaacccgtgccatcaggaagcgcttgactaagcaccaggcatcattgaagacggaaagggagaagaagagggagatgtattttccaaagaggaaatatgcaatcaaggcttgacattcagtagaaattctcctagcctttctttagttaatttctgtgtttggatcgtgtcactgtttgttttgtattttcttatcactgtgccttttttttcttcttctttttcactagaatgggttgagtatcttcccccattaccttgtttcttgatgagaaaaatccaattggtcttgtgacagttcctgtttcttcggtgctttgtaagcctttctcacgagattcataggaagaagtaagatattgtcttttgtctttctgaacattacattgcagattgtgttacctgccaatcagcatgtgcataatagcatattcctgaagacgtgccgtctctaact

SEQ ID NO: 7053 - DNA, 552 bp, Aquilegia formosa
ccattttcatcatcgaaagaagaagagccgcagatccactcataacactattcgatggcgagaatcaaggttcatgaacttcgtgacaaatcaaagactgatcttttgagtcagcttaatgagcttaaggctgaacttgctttgcttcgtgttgctaaggtcactggtggtgcacctaacaagctttctaagattaaggtggtaaggttgtctattgctcgtgtgcttactgttatctcacaaactcagaaggctgctttgaggaatgcttacaagaacaagaagcttttgcctttggatcttaggccaaagaagacacgtgctatcaggaggcgtctcaccaaacatcaagcatcactgaagacagagagggagaagaaaaaggagatgtactttcccatgaggaaatatgctatcaaggtgtaagcaagatgagttatcggtgtagtggtaattcagagttttgtagttcgcttttaaatttgaagtatgtttacattgggatcattaatctgatgtcttttacagactttattacagttggaattggtc

SEQ ID NO: 7054 - DNA, 574 bp, Arabidopsis lyrata
ttaccatagcagtgcaaagagactgaaagagagagagagagctcgaagacgccatggcgagaatcaaggttcatgagttgaggggtaaatcaaaatcggatctttctactcaattgaaagatctgaaggcagagcttgctctcctccgtgtggctaaggtcactggtggtgctcctaacaagctctctaagatcaaagtggtgaggaagtcgattgcgcaagtgttgactgtgatctcacagaaacaaaagtctgctcttagagaagcatacaagaacaagaagttgttgccactcgatctccgtcccaagaagactagagccatcagaaggagactcactaagcaccaggcgtctctaaagacagagcgagagaagaagaaagaaatgtactttccaattagaaagtatgccatcaaggtttaataatctttctgctgtcaaagatctccttcttctctaattttctttgaatcaaagatttgattcctcaaacatatcattgtatgatctctcaccttcttcgtttcaaatatgatataaactctatataacttttgagaactagctcctgg

SEQ ID NO: 7055 - DNA, 726 bp, Aristolochia fimbriata
attctcttaatccgtttcgcggcgcatttgcagctcgctccgtgtagggtttctttacgaggcacattaccggagtcctcttttgcagccgccatggccagaatcaaggttcacgagctgagaaccaaatctaagaccgatctcttgaaccaactcaaagaactgaaagcggagcttgctctgcttcgcgttgccaaagttaccggcggagctcctaacaagctctcgaaaatcaaggtggtgaggctatcgattgctcaggttttgacggtgatatctcagaagcagaaagctgcgctgagggaagcttataagaataacaagttcttgcctctcgatctgcgacccaagaagaccagagctatcaggaaacgtttaaccaaacaccaggcttcactgaaaacagaacgtgagaagaaaagggaaatgttcttccctatgaggaaatatgccataaaggtctagatttgtttttacttgcagtatttacaagtccttttgtttcaaactcagcagactgatagacaggtttttggtagttattatgtgatgtgatgatcatcttgtaaggacttactagatcatatgtttgttaattacattgttttccatgacaccgttgatcctggcttcgttaattacgacaaagagcagatgaactatgttctattcatctgtccctaatgagaaaataatgtagataatgggaagtagtgagtggaatag

SEQ ID NO: 7056 - DNA, 621 bp, Arnica chamissonis
tttcataacaacacggcattgcagctgcggcttctgcatccaacccataatccatggctcggatcaaagttcatgagttgagggagaaatcaaaggccgatttgtttactcagttgaaggatcttaaggctgaactcgcacttctccgtgtcgccaaagtcaccggcggtgctcccaacaagctctccaaaataaaagtggtgaggacgggtattgcacaggtattgactgttatttcacagacgcagaaggcaaagctgagggaagcttacaagaacaagaagtacttgccacttgatttgcgtccaaagaaaaccagggccatccgtaggcgtttgaccaaacatcaggtctcgttgaagacggaacgcgagaagaaaaaggagaagtactttccattgaggaagtatgctattaaggcttaggacagataaacaattatttatgctcttttcacttgaaatttcaacttggtcttctttttataattttttggtttgaattcattctgtagtttgttgttgattttgaggcttggtttggtccacagaatccttttgggactagaattggagtgttttgcagtagaaatgatgtttgggaactataattagggtgcat

SEQ ID NO: 7057 - DNA, 672 bp, Artemisia annua
atcttttatttcaggcgcagcctccattccaaaccaaacaaaacaatcaaatggcacggattaaggttcatgaattgagaggcaaatcaaaagctgatttgttcagccagctgaaggatttgaaagctgaacttgctcttcttcgtgttgctaaagttactggtggtgcacccaacaagctctccaaaattaaagtggtgaggacatctatcgcccaggtgctgactgtgatttcacagactcagaaggccacacttagggaagcttacaagaacaagaagtacatgcctcttgatttgcgtcccaagaaaaccagagctattcgcaggcgtttgaccaagcatcaggcttctttgaagacagagcgagagaagaagaaagagaagtacttcccgttgagaaagtatgcaatcaaggcttaagtagttttagttccagttttgaacttgtgtacgcttttgtcaatgtttgttggatttaaaaggttgctggtgttcaagtttacattggattttcttggaaatccggttctggtgttatgtttgtttttagttttatgcagcaactgatgttggtaatttgtttctagacaacagccggcattattatgctttaagattcatagttacttgtgcttttgtcaatgaagctgaaacattaattattacgaag

SEQ ID NO: 7058 - DNA, 513 bp, Brassica oleracea
cataacacaacactcaaacagagtaaggggaagccagagaactcgaagacgccatggcgaggatcaaggttcatgagctgagagagaaatcaaaaaccgatctttccactcagttgaaagatttcaaggccgagctagctcttctccgcgtcgccaaggtcactggaggtgctcccaacaagctctctaagattaaggtggtgaggaaatcaatcgctcaggtgttgacagtgatctcacagaagcagaagcttgctctgagagaggcatacaagaacaagaagtttttgcctcttgatcttcgtcccaagaagactagagctatcaggaggagactcaccaagcatcaggcatcgctgaagacagaaagggagaagaagaaagaaatgtactttccaattagaaagtatgctattaaggtgtaaccttgaccttgttcttattaatcacatcatcaatctttgtgttttgaatattatctctcgagtgagttggctttttgttttatgttcc

SEQ ID NO: 7059 - DNA, 690 bp, Brassica rapa
atcgtccccataacacaacactcaaacagagtaaggggaagccagagaactcgaagacgccatggcgaggatcaaggttcatgagctgagagagaaatcaaaaaccgatctttcgactcagttgaaagatttcaaggccgagctagctcttctccgcgtcgccaaggtcactggaggtgctcccaacaagctctctaagattaaggtggtgaggaaatcaatcgctcaggtgttgacagtgatctcacagaagcagaagcttgctctgagagaggcatacaagaacaagaagtttttgcctcttgatcttcgtcccaagaagactagagctatcaggaggagactcaccaagcatcaggcatcgctgaagacagaaagggagaagaagaaagaaatgtactttccaattagaaagtatgctattaaggtgtaaccttgaccttgttcttaattattattaatcacatcatcaatctttgtgttttgaatattatctctcgagtgagttggctacttggctttttgttttatgttcctttttaccgattcttctgaatgatagattttgattcacaaacgcattattgttttctgatcaagctgtgagtgaaagccttggggttaaaaattaagatgatcatattttaaaccggttctaccctttactccgaatatatatgtccattggat

SEQ ID NO: 7060 - DNA, 666 bp, Fagus grandifolia
ctggaccttggctgtcactcagttgagggtttcttttctttcataaagaaacagctccatccgccgcagtgaagctcaaagacgcgcagcaatggcgagaatcaaggtccacgagttgcgtcagaagacaaaggcggagctgttgaaccagctcaaggatctcaaggccgagcttgctctcctccgcgtcgctaaggtcactggtggcgcacccaacaagctttccaagatcaaggtcgtgaggctgtcgattgcgcaggttttgacagtgatgtcacagaagcagaagtctgctctgagggaagcttacaagaagaagaagtaccttccactcgatctgcgtcccaagaagactagggctattaggagaaagcttaccaagcaccagctgtcattgaagactgaacgtgagaagaagagggagatgtactttcccatgaggaagtatgctatcaaggtgtagggtgtagggcttttagcttaagagatcttgctaccttactaccatatatcgatttggtttacaaattttggcatttgttaactcttaatttcattttggtgaacttgatcttatgttcttggttgacgttgtaaactttggtgttagttcaaacctaaagtgagatgctaggttattttggtgtgagataaagtatgaatttc

SEQ ID NO: 7061 - DNA, 898 bp, Centaurea maculosa
cctccgttgcggtttgattcagttctgcttcgatcaaacgttatcaatggctcggatcaaggttcatgagcttaggggcaaatcgaaggccgatttgtttgctcagttgaaggatcttaaagccgaacttgcacttcttcgtgttgctaaagtcaccggtggtgcgccaaacaagctctccaagattaaagtggtgaggacatcgattgcacaggtgctgactgtgatttcacagacccagaagtctatgcttagggaagcttacaagaagaagaagtatctacctcttgacctccgtcccaagaagacaagagccattcgcaggcgtctgaccaagcatcaggcttcgttgaagacagagcgagagaagaagaaagagaaatacttcccgttgaggaagtatgcaattaaggcgtaggtagaaaactattgagatggaaacgtaggtgtgttacttcctttaccatttttgaattttggatctgtgtacggttttatcagaatttgatgtttttgaaaaggttgccagtgttccattaaacatcggatcttgctttgaaatggtgcaagtggttttttaaaagcagcaataaatagaatccttatagttgataaaatgaccacaaactgactctaacacaatttctgatacagtagatattgacataattattgccaacaaacggtttaaaaaagaccgaccgaccgacccacagacagctttaattcataataagacatcacaaccactcttcaactacaaacatccctggcagcaattgtcaaatggggcaggccagatgcaccagccatggaagctcaatgagatcaatcagatttgtttagcttccccataagccaacctctcccagtcttaattcacatgaaacataacacg

SEQ ID NO: 7062 - DNA, 649 bp, Centaurea maculosa
acctacgccttcgttcgcacgcctacctaccaccttccttccatacaatggctcgaatcaaagttcatgagcttaggaccaaatcgaaggtcgatttgtttgctcagttgaaagatctcaaggctgaacttgctcttcttcgagtcgccaaagttaccggtggtgcccctaacaagctctccaagataaaggtggtgaggacatcaattgcacaggtgctgactgtgatttcacagactcagaagtctgctctcagggaagcctacaagaacaagaagtacttgcctcttgatttgcgcccaaagaaaaccagagccatccgcaaacgtcttaccaagcatcaggcttcattgaagactgaaagagagaagaagaaggagaagtacttccctttgaggaagtatgctatcaaggtgtaaggtgagaagctatggaggaggagatttaagtagttgttgtgtaaatctctttccagttttgaagtcttgagtttgtgttctatttgatcagagatcatgtatttcatagttttttttcctgcaatgaggtaaaagacaattaacattggaagcttgttgcataccagtttactttcttttttcttttggaagacagtgtattgttgattgcattatgcatttgtggttaa

SEQ ID NO: 7063 - DNA, 516 bp, Chrysanthemum coronarium
atcacagccgcacagcagcagcagcatctcaaacattttctctgcaatggcaaggattaaggtgcatgagttgagggagaagtcaaagactgatttgttcagtcagttgaaggaattgaaagctgaacttgcccttcttcgtgttgctaaagttactggcggtgctcccaacaagctttccaaaatcaaagttgtgaggacatcaattgcacaagtgttgactgttatttcacagacacaaaaggcaaagctcagggaagcttacaagaacaagaagtacatgcctcttgatttgcgtcccaagaagaccagagctatccgtaggcgtttgaccaagcatcaggtttccttgaagactgaacgtgagaagaagaaagagaagtactttccattgaggaagtatgctatcaaggcttagggtagatgaagtattcatgctcatgtcgcctgaatttcgaactatgttttatcgacattttattaatgtttttggacctagttaagttttgtagcctg

SEQ ID NO: 7064 - DNA, 672 bp, Chrysanthemum coronarium
ttttaacaaaacatattcttcagcgcagcctccatcacaaacaatcaaatggctcgtattaaggttcatgaattgagagtgaaatcaaaagctgatttgttcagccagttgaaggatttgaaagctgagcttgctcttcttcgtgttgctaaagttactggtggtgctcccaacaagctctccaaaattaaggtggtgaggacatctattgcacaagtgctgactgtcatttcacagacccagaaggccacactcagggaagcttacaaaaacaagaagtacatgcctcttgatttgcgtcccaagaaaaccagagccattcgcaggcgtttgactaaacatcaggcttctttgaagacagaacgtgagaagaagaaagagaagtacttcccattgaggaagtatgcaatcaaggcttaagtagtttttagttctagttttgaacttgtgtacgcttttgtcaatgttgttggatttaaaaggttgctggtgttcaagtttacattggatttttcttgttaatgccattctggtgttatgtttgtttttgtttttagattaagtcgtcttttgccccatatcaatgcaacattctgcagtaagatttataaagctatgcttttgtcgaacatttcttcctgaataaccatttttcattggcagtctgcccaa

SEQ ID NO: 7065 - DNA, 676 bp, Chrysanthemum coronarium
gtaaagtgtcaagattgattcttttttgaatttgtcccagaatcttttagcagtgtggccttctgctgccattgaagaaaaagatgagttgaaaagatgattagatcgaatgaagagggtttgagaatgacaaccgcaacagcagcagcaacttcaacattttctcaaatggcaaggattaaggtgcatgagttgagggagaagacaaagactgatttgttcagtcagttgaaggaattgaaagctgaacttgctcttcttcgtgttgctaaagttactggtggtgcacccaacaagctctccaaaattaaagtggtgaggacatctatcgcccaggtgctgactgtgatttcacagacccagaaggccacacttagggaagcttacaagaacaagaagtacatgcctcttgatttgcgtcccaagaaaaccagagccattcgcaggcgtttgaccaagcatcaggcttctttgaagacagaacgagagaagaagaaagagaagtacttcccattgaggaagtatgcaatcaaggcttaagtagttttagttccagttttgaacttgtgtacgcttttgtcaatgtttgttggatttataggttgctggtgttcaagtttacattggatttattttgggaattcggttctggtgttatgtttgtttttgtctttag

SEQ ID NO: 7066 - DNA, 781 bp, Cichorium intybus
cccccaaccatccgtttattactcgtagttagggtttcaaactttcagaagagccttcactgcagtttacttcggcttagatcaatggctcgaatcaaagttcatgagcttaggaacaaatcgaaggctgatttgtttaccgagttgaaggatctcaaggctgaacttgctcttctccgtgtcgccaaagttaccggtggtgctccgaacaagctctccaagataaaagtggtgaggacatcaattgctcaagttctgactgtgatttcacagactcagaaatctgctcttagggaagcttacaagaacaagaaatacttgcctcttgatttgcgcccaaagaagaccagagccatccgcagacgtttaaccaagcatcaggtttcattgaagaccgaaagagagaagaagaaggagaagtacttcccattgaggaaatatgctatcaaggcgtaagttggaagctattgatgatgaaatttaggtatttatatgtttaattttgttccagttttgaagtctgaatacttgtacggttgatcagagatcatgtatttgatagtttgtttgcaatgagttataagacagttaacatttgggtttgttttttgtgttgcctagtatttccagttttcaaggcagtttacagttgtttgttgcattatgcatttgtggttaacctgtgttgatagtaattgattattaaggtacacctaaacttatttaactattgcttgttttatgcaactgttgggtagttatctgatgggaatatgttcta

SEQ ID NO: 7067 - DNA, 373 bp, Cirsium arvense
caatggctcggatcaaagttcatgagcttaggggcaaatcgaaggccgatttgtttgctcagttgaaggatcttaaagccgaacttgcacttctccgtgtcgccaaggtcaccggtggtgcaccaaacaagctctccaagattaaagtggtgaggacatcgattgcacaggtgctgactgtgatttcacagacccagaagtctatgcttagggaagcttacaagaagaagaagtatctacctcttgatctgcgtcccaagaagacaagagccattcgcaggcgtctaaccaagcatcaggtttcgttgaagacagagcgagagaagaagaaagagaagtacttcccgttgaggaagtatgcaattaaggcgta

SEQ ID NO: 7068 - DNA, 666 bp, Cleome gynandra
tataaatactccttcctctccagttagggttttcgactctgggagccaacactttcagcagcggcatcagcagttcaacaccagcaacctgacgatggcgaggattaaggttcacgagctcagggacaagtcgaagacagatctgttgaaccagcttaaggatctcaagaacgagcttgcactcctccgtgtcgcaaaagtcaccggcggtgctccgaacaagctctctaaaatcaaggtggtgaggaaatccattgctcaggtattgacagtgatttctcagaagcaaaaatctgctctgagagaagcatataagaacaagaagttcctgcctcttgatcttcgtcctaagaaaacccgtgctatcagaaggcgccttaccaaacatcaggcgtcacttaagacggagcgggaaaagaagagggatatgtacttcccaatgaggaagtatgctatcaaaatgtaatctcttcctcctagtttgatctttaattgaacatgttcattatgtttttatcaccaccagttttacagactcggacttcatcgtagtcgctttggtcttttgcagttctgttgtgtaacaccgaatttaaactctatatttttaggaagttgggtatttggaacgataaaaaatgggatggtgtagtttagaagaaccat

SEQ ID NO: 7069 - DNA, 627 bp, Cleome gynandra
actttgattgaaggcacttggtagagaactcgacatagccgccatggcgcgaattaaagttcacgagctgagggagaaatcgaaagctgatctctcgagtcagttgaaggaactgaaggcggagcttgccctcctccgcgtcgctaaggtcaccggtggtgctccaaacaagctctccaagatcaaggtggtgaggaagtccattgcccaggtcttgactgtaatctcacagaagcagaagtctgctttgagagaggcatacaaaaacaagaagtacttaccacttgatctccgtcccaagaagacacgagctatcaggaggcgactcaccaagcaccaggcatcattgaagaccgaacgagagaagaagaaagagatgtacttcccattgaggaagtatgccatcaaggtgtaagacctttcttttgcctcgcttctcatttttctttggggtttcaccattattttctggttatatagtttcaaacaactgctatcatatgttcgaattagatatttgattcaccttagcaatgtttcatcagttttaatttatcattcattgtttcaaatacgcttcaattgttgaaaaatgatgctggtgttttgatgttcatcaatagtttt

SEQ ID NO: 7070 - DNA, 933 bp, Gossypium hirsutum
tgtaaaagtctggttgggctgagaaacgttgcccaaattaagaaaagcctgccagattgcaacgctccaaaatgccttattgcatctccgaagtcgtaaaacccaaaggttctatttcttcctttcaaattctagggtttctgagaagagattaagcagccgcggcagcaaaactcaacaatggcgaggataaaggttcacgagttaaggaacaagtccaagacggagctgctaagccaattgaaggacttgaaagctgaacttgctctcctccgcgtcgctaaggtcacaggcggcgcccctaataagctctccaagataaaagttgtgaggttatcgatcgcgcaggttttgacggtgatttcgcagaagcaaaaatctgcgcttagagaagcttataagaagaaaaagttcctccctttggatctccgtcccaagaagactcgtgccattcgccgccgccttactaaacatcaggcatctttgaagacacagcgtgaaaagaagaaggagatgtacttcccactaaggaaatatgccattaaagtgtaagcaggcggagctattttttgttctatcaaagtctaaaaagtagaattatggtttagatgcagttatatgagcatcatttttgtcccttcattagttttccttgaacatctatttgagcgctataatatgatttcacatttcagaatgtgttttgacttgtacatgcaaggaattctctttttgcgttgtttaaggcaccgtaattctcaagctcggggtgcacataggttctgtttgtctcacaaactgatttgtggaaaatgttttttgtatttccttgtgtttgtttcttggagaacacatggtcaacagaccaacgaaaaataaggtgttttcttttttttgtgaattgacttacgaaaagcactagttattcatttg

SEQ ID NO: 7071 - DNA, 643 bp, Cucurbita pepo
gaacctagggttgtgcacgctgcaggcctccgccgtatcccaaacacacaacagccggtctctgcttgctagattctaatggcgagaattaaggttcacgagcttagacagaagtcgaaggcggatcttctgacccagcttaaagaccttaaggcggagcttgctcttctccgtgtcgctaaggtcactggtggtgctcccaacaagctctccaaaattaaggtggtgaggctgtcaattgctcaggtgttgaccgtgatttctcagaaacagaaggctgctcttagggaagcttacaagaagaagaagcttttgcctcttgatttgcgccccaagaagaccagggccattcgccgaaggctcaccaagcaccaagcatctctattgaccgagcgacagaagaagaaagagatgtactacccattgaggaaatacgccattaaggtgtaggcatatagcaaattgattgatcatccttggtatgatgccatcttctactcattttggcttttgatttatggataacgttattcagacttgagtttgtctattttcaatctcattttgttagatctttgagaactttgaagtatttccttttccatgtagtaatacgttagcgtttcccaagtttataatgaaa

SEQ ID NO: 7072 - DNA, 802 bp, Cucurbita pepo
agggaacctagggttgtgcacgctgcaggcctccgccgtctcccgaacacacaacagccggtctctgcttgctagattctaatggcgagaattaaggttcacgagcttagacagaagtcgaaggcggatcttctgacccagcttaaagaccttaaggcggagcttgctcttctccgtgtcgctaaggtcactggtggtgctcccaacaagctctccaaaattaaggtggtgaggctgtcaattgctcaggtgttgaccgtgatttctcagaaacagaaggctgctcttagggaagcttacaagaagaagaagcttttgcctcttgatttgcgccccaagaagaccagggccattcgccgaaggctcaccaagcaccaagcatctctattgaccgagcgacagaagaagaaagagatgtactacccattgaggaaatacgccattaaggtgtaggcatagagcaaattgattgatcatccttggtatgatgccatcttctactcattttggcttttgatttatcgataacgttattcggacttgagtttgtctattttcaatctcattttgttagatctttgagaactttgaagtatttccttttccatgtagtaatactttagcgttcccaagtttataatagaaaataggttttggtttagttggaatttgatctgagcttcaaacccatctgtaattatgcagtgtagttaaatgtttctctttaatatcgctgaaatttggtagaacagaaacatgggggttggagttaataatcaaatggttcaagctatggttctgt

SEQ ID NO: 7073 - DNA, 557 bp, Cyamopsis tetragonoloba
cacgaggctttcgatcatctttgcaatcgcaatggcgagaatcaaagtgtacgagctcaggaacaaaacgaaagcagaacttctgaaccagttgaaggacctcaaagccgaactcgctctccttcgcgtcgctaaggtcactggtggagccccaaacaagctctccaaaataaaagtggttcggctttcgatagcgcaggtgcttaccgtgatttcgcagaagcaaaaagcagcgttgagggaggcttacaagaagaagaagtatctgcctttggatctgcgtcctaagaagaccagagctatcagaagacgcctcaccaagcatcaggcttccttgaagacagagcgtgagaagaagaaggaattatattttccattgcgaaaatatgctgttaaggtgtaatgttaggtccaagtatggataataattttgcttcactatatttgttatttaacataaattttctatggccgaacttgttttatgctgctgttctagtttatataatcatcgttaaactgaattaaaaaaaggtagctattttactctggttaaa

SEQ ID NO: 7074 - DNA, 573 bp, Distylium racemosum
tgcagaggagtgacaggggtttgcatcacaatggcgaggatcaaggttcacgagttgcgtgcgaagtcgaagggagatctgcttgctcagcttaaggagctcaaggccgagcttgccctgcttagggtcgccaaagtcaccggaggagcccccaacaaactctccaaaattaaggtggtaaggagatctatagcacaggttcttacagtgatctcgcagacccagaaggcggcgttgagagaagcgtacaagaagaagaagtatatgcccctggacctgcgccccaagaagactcgcgctataaggcggcgtctcaccaagcatcaggcttctttgaagacagagagacagaagaaaaaggagatgtatttccccatgagaaagtatgcaattaaggtctagagtttaggatcatttggaggacagtttttccacacaaattttctcctcgaactattgatgttttattgacattttgcgaattcaatgtgtttcagaatttgagtttttgataaaaagcgcgttttcattattaatcaaatttattatttgcttagtatatcccaaagaggc

SEQ ID NO: 7075 - DNA, 626 bp, Echinochloa colona
cctgcttcgccctccatttttcatctcctcaccagccgccgccgccgcaggaagcccggctcgccgctcgccatggcccggatcaaggtgcacgagctgcgggggaagaacaaggcggacctgcaggcgcagctcaaggagctcaagtcggagctctccctcctccgcgtcgccaaggtcaccggcggtgcccccaacaagctctccaagatcaaggtggtgcgcacctccatcgcgcgcgtgctcaccgtgatctcgcagaagcagaagtcggctctgcgggaggcgtacaagaagaagaagctgctcccgctcgacctccgccccaagaagacccgcgccatccgcaggcgcctcaccaagcaccagctctctttgaagactgagagggagaagaagcacgagaagtatttccccatgaggaagtatgctatcaaggcctagattagcttaaaagaacatgttttaccctgtcaagttttgcccagaagttaccagaatttgatgtaccgcacatctattgtcatctaagtacaatgtagctgatcaactgcgtgatgaaaatgcgtactctttgcttgttgaaatcttctggtcaattttgttttgattctacttgatcctag

SEQ ID NO: 7076 - DNA, 710 bp, Echinochloa colona
gaccagccgccgccgccgcaggaagcccggctcgccgctcgccatggcccggatcaaggtgcacgagctgcgggggaagaacaaggcggacctgcaggcgcagctcaaggagctcaagtccgagctctccctcctccgcgtcgccaaggtcaccggcggtgcccccaacaagctctccaagatcaaggtggtgcgcacctcgatcgcgcgcgtgctgacggtgatttcccagaagcagaagtcggctctgcgggaggcgtacaagaagaagaagctgctcccgctcgacctccgccccaagaagacccgtgccatccgccgccgcctcactaagcaccagctttctctgaagacggagagggaaaagaagcgtgagaagtacttccccatgaggaagtatgctatcaaggcctaggtcagaactgtgggatgcagatgctaagcttagcatatcatcggctgtttctttccctaggaagtgttttgagttttgatttgtatggacatttgctgtgggttgaaagtacgatgtatttcttctgttacctcaaatgcctagattggtttaaggggcagttcgtattggcacttgtttgtgtgaatctgtcatatctacagttatgcctagaagaccatcgttgccacttcccaattgtgacatcttaaaatttattagatgagccatacagtgttaagtcatccagtagagt

SEQ ID NO: 7077 - DNA, 650 bp, Euonymus alatus
gttaggggtttcatcagtcgcgtagcaggagcagagccgccgttcccaagcagaatcaatggctaggattaaggtccacgaactgaggcagaaatcgaaggcggagctcttgaaccagctgaaggatctcaaggccgagcttgctctcctccgtgtggctaaggtcaccggtggcgcacctaacaagctctctaaaatcaaggtggtgagattgtcgattgcccaggtgttgactgtgatttcccagacccaaaaggctgcactgagagaggcttacaagaataagaagttcatgccccttgatctgcgtccgaagaagaccagagccattcgcagaaggctaacaaagcatcaggcatccttgaagacagaaaggcagaagaagaaggagatgtattttcccgtgaggaagtatgctatcaaggtgtaatctaatgcagttttattacataggaaattttggtttcttgcagttataaaacgtttggctatgaaattttgtcgttattgactgctcttgtatcgttcgtgagcaatattgtcattttttaacgctaaatttggatggcttgtgctggaaaagtttgatggctaggtttgtgatagaattgaggacaatacttggctatttatttccatgattgattaga

SEQ ID NO: 7078 - DNA, 687 bp, Euonymus alatus
gaaatcctgggctatataaaacctaaacccgcaatgaatttgacgccttgctcgttaggggtttcatcagtcgcgtagcaggagcagagccgccgttcccgagcagaatcaatggctaggattaaggtccacgaactgaggcagaaatcgaaggcggagctcttgaaccagctgaaggatctcaaggccgagcttgctctcctccgtgtggctaaggtcaccggtggcgcacctaacaagctctctaaaatcaaggtggtgagattatcgattgcccaggtgttgactgtgatttcccagacccaaaaggctgcactgagagaggcttacaagaataagaagttcatgccccttgatctgcgtccgaagaagaccagagccattcgcagaaggctaacaaagcatcaggcatccttgaagacagaaaggcagaagaagaaggagatgtattttcccgtgaggaagtatgctatcaaggtgtaatctaatgcagttttattacataggaaattttggtttcttgcagttataaaacgtttggctatgaaattttgttgttattgactgctcttgtatcgttcgtgagcaatattgtcattttttaacactaaatttggatggcttgtgctggaaaagtttgatggctagttttgtgatagaattgaggacaatacttggctatttatt

SEQ ID NO: 7079 - DNA, 566 bp, Euonymus alatus
tttaagaccgtagaacagacggagaggcagccatggcgaggatcaaggtacacgagctgaggaacaaatccaaaacggagctgttgaaccaattgaaagatctgaaagcagagcttgctctcctccgcgtagctaaggttaccggtggcgcccccaacaagctatccaagattaaggtcgtgaggctgtcaatagcgcaggtgttgacggtgatttcgcagacgcaaaaggccgcattgagagaagcctacaagaataagaagtacatgcctctcgatctccgacccaagaagaccagagctatccgtagacgcctcactaagcaccaggcatctctaaagacagaacgccaaaagaagcgcgagatgtatttcccaacgaggaaatatgctatcaaggtgtaagattgaatcaactcgagaaggaagttgtggtatttgattcatcaggttccataggaaggatgcctctttcttctttttcttcgaatttcgtgttgttaatttttaaatttgcatgtttatcctcatcaaactcggataatgaatgaatttttggtagtccag

SEQ ID NO: 7080 - DNA, 588 bp, Euphorbia peplus
aaagagggagaagacgaagcagagccatggcaagaatcaaagttcatgagttgagaaataaatcaaagacagagctactaagccagctcaaggatctgaaatctgagctagctctcctccgcgttgctaaggtcaccggcggcgcccctaataagctctctaaaattaaagtcgtgagactatcgatagcgcaggttttgaccgtaatatcgcagaagcaaaaggctgctcttagggaagcctacaagaacaagaagtttttgcctctggatttgcgtccaaagaagactcgagctattcgaagacgcctaaccaagcaccaggcatcgttgaagacagagcgagagaagaagagggagatgtattatccactgaggaagtatgccattaaggtgtagagtttggtccatcaagaagttggtttctgtgctgccctcaggaatgaagacctaagcaaatgatttacatttttggatcttttacttcaatgtattgtttttggaatttcaccgtatttagagttcaattatgcgtgaatttacttgaacgagattggtatcctgagtagttctagctttcttggatttc

SEQ ID NO: 7081 - DNA, 530 bp, Festuca arundinacea
gccgccgctagtccagctcgccgaccgcaatggcccgcatcaaggtgcacgagctgcgggggaagaacaaggcggacctccagggtcagctcaaggacctcaaggcggagctctccctccttcgcgtcgccaaggtcaccggcggcgcccccaacaagctctccaagatcaaggtggtccgcacctccatcgcgagggtgcacacggtgatctcgcagaagcagaagtctgcgctgcgtgaggcctacaagaacaagcggctcccgctcgacctgcgccccaagaagacccgcgccatccgcaggcgtcttaccaagcaccaggtctccttgaagacggagagggagaagaagcgtgagaagtacttcccgatgaggaagtatgctatcaaggcctaggttagaagagtatgcttcactggttaagttttgcccagaagttgcctgaattttatgttctgtgcggactgcaccatcacctaagtacaatgtatttgatctactctatgagatgtcaacgtttgcttatta

SEQ ID NO: 7082 - DNA, 580 bp, Flaveria ramosissima
catcgtttccaaattagggtttcaaaacaccattgcagcagcggcttctgcaacaaactcataatccatggctcgaatcaaagttcatgaattgagggagaaatcaaaggctgatttgtttactcaattgaaggatctcaaggctgaactcgctcttcttcgtgttgctaaagtcaccggtggtgcccccaacaagctctccaaaataaaggtggtgaggacatcaatcgcgcaggtgttgactgttatttcacagacacagaaggcaaagcttagggacgcttacaagaataagaagtatttgcctcttgatttgcgtcctaagaaaactagagccatccgaaggcgtttgaccaaacatcaggcctcgttgaagactgaacgagagaagaaaaaggagaagtacttcccattgaggaagtatgctattaaggcttagggtagatgaacaagcatgtatgttcttctcacttgaattttgaacctggtttatatttattacattaatatggctgcttttggttaaagttcatttgtagcttgattttgataattgatattgaaattgtcaaatgacatt

SEQ ID NO: 7083 - DNA, 744 bp, Linum usitatissimum
gatctctagggttttagcaggaggaagtgaagagcggagccgctgaaggaagccaaccatggcgaggattaaggttcacgagttgaggaacaagtcgaagacagatctcttgaaccagttgacggagctcaagtcggagctttccctcctccgcgtcgccaaggtcaccggcggtgcacctaacaagctatccaagatcaaggtggtgagactgtcgattgctcaggtgcttaccgtgatttctcagaagcagaaggcagctctcagagaagcttacaaaaacaaaaagctcttgccactggatctgcgtcccaagaagactcgcgccatccgcagacgcctcaccaagcaccaagcatcactgaagaccgagcgagagaagaagcgggagatgtacttcccgttgaggaaattcgcaatcaaagtttagagtagggaggatggcacttcattaaaatgcgttgtttctttttaagcttttgatccaaggcaatgacgcagagtttgttcaatttctgggtttgttttttattgtagcacgatctaagaattctgtctaagcatccatgggttattttgcaactcttatttgattacctgatcttggtttgcaacttgcttaatcccttttgtctatcaaccgtgatgtccttctcccatctgtagtatgtgagttgtgttttcttctttctgactagcagagatgaaaccgatttgcaacaaactaatcctttcttttccacg

SEQ ID NO: 7084 - DNA, 643 bp, Fraxinus spp
ctgacccttcactctcatccgcctccctcaaacactagagagaagacgtagaagggagaacgtgaaatggctcggatcaaggtgcatgagttgagacagaagaacaaggcggagcttttggcgcagttgaaggatctgaaggcggagctggcgttgctaagggtcgcaaaggccactgctggtgccgctaacaagctgtcgaagattaaggtggtcagactctctatagcccaggtgctgaccgtcatttctcagaagcagaaggcagctctcagggaagcgtacaagaacaagaagttcttacctcttgatctccgccccaagaagactcgtgctattcgcaggcgcctaaccaaacaccaggcatctttgaagactgaaagggagaaaaagaaagagatgtacttcccaatgagaaaatacgacaattaaagtttaagttgctttgggtattatccatgtttaatctagtaggaggataactatattttgtttcgtaagttgttagctgataattgttatgattttgaggactttttgagttttgagtgttattatttcttattatctaatgatttcatctgcgctttatttatgctctttttgtattggtgttatagtttgtgtcccatcattttttgga

SEQ ID NO: 7085 - DNA, 634 bp, Vitis vinifera
agtgtgtaccagagtgagagaaggacgccgttgcggatcacgaagacacacacatggcgaggatcaaggttcacgagctgagaggtaagcctaaggccgatctgttggcccaattgaaggagctgaaagcagagctcgctcttctccgagtcgccaaggtcactggtggtgctcccaacaagctttctaagataaaggtggtgaggctgtcgattgcgcaggtgttgacagtgatttcccagaagcagaaggctgctttgagggaagcttacaagaagaagaagttcctgcctctggatttgcgtactaagaagaccagagctatcaggaaacgccttactaagcatcaggcatctttgaagactgaacgagagaaaaagaaggagatgtattatcccatgaggaagtatgccattaaggtgtaagcgtggatttacacagttatggacgacatcttggtgtcttttaactctctaaattccaatacaaggatattgtttgagattttttgcccttgaatctttagttaccgtctctccctatcttagtttgaacatcatgaaagaacgaacttctgtaagttgaattttacttcctagtgctgaaatttcctagtttcatggtttggctgagg

SEQ ID NO: 7086 - DNA, 915 bp, Humulus lupulus
caaggtctgattcgctccaaattagggttttgggaagtgaggtatattacttgagctaatttcttaaagtttcaaccctccgccttcttcttcttcgaagcaggaaaaaccctaatttacaggaatggcgaggattaaggttcacgaacttaggaacaagaataaggccgatttgcagagccagttgaaagatctgaaagctgagctcgctcttctccgggttgctaaggtcactggcggtgcccctaacaagctctccaagataaaggtggtgaggctttcgatagcacaggttttgactgtgatttcgcagaagcaaaagtcagctttaagagaagcatacaagaataagaggtttttgccgctcgatctgcgtacaaagaagaccagggctatcaggaggcgtctcaccaagcaccaggtatcattgaagacagaaagagagaagaagagagaaatctactttcctatgaggaagtacgctattaaggtgtaatgttggatctccttgggaattgattaacatgttatcatccattcctaggatatacttttaaaatgtttttagctgcttttcaaatttaatcatcggagacagtatcccaattgagttttggtttatcctttgttcggtcatatccctgtactactactttaattattggttttggtctcgataagtttttgtgttaatttagggagctagtatgttcgtcctcctttgaaagcgtatctaggtcatcggcaagttaatttgatcaaactcaatttgtctaaacggcataattgaattaataattgttttgatatttattttcttttccttgacaaaaataaatgatgtaatcttaaacatcttaagaaaaaaaaaaaactaaaacctacgacggcgtccgtccggtaccgttacgtacg

SEQ ID NO: 7087 - DNA, 592 bp, Ipomoea batatas
tacggccgggggtaacagcattcaagctagggttttcggaattctaaggaagcagcagccatggcgagaatcaaggttcacgagctgaggaacaagagcaaagcggagctgctggctcaattggctgaactcaaggccgagctcgccctcctccgcgtcgccaaggttaccggtggtgctccaaataagctgtcaaaaatcaaggtggtaaggctgtcaattgcacaggtattgaccgtgatttctcagactcagaaggctgcacttagaaatgcttataagaacaagaagtatttgcctcttgatctccgccccaagaagaccagagccatccgcaggcgtctgaccaagcaccaggcttctttgaagacagaaagggaaaagaagaaggagatgtatttccccttgaggaaatatgctatcaaagtgtagaataggactatgctctgtctgttttgaactaagtatatcagttagaacattgaattcaagaattttgtttactgtgttaatgtgttgatgttaactttgattggaagattaatcagtttgcaacataccattaatttcgatttgtgtgaagtaatcttgt

SEQ ID NO: 7088 - DNA, 683 bp, Lolium multiflorum
tcgtcctcctccggcgaccacagacccttgcggagcttgggctgctgagcgccgccgctgccgccgccgctagaccagctcgccgaccgcaatggcccgcatcaaggtgcacgagctgcgggggaagaacaaggcggacctccagggtcagctcaaggacctcaaggcggagctctccctcctccgcgtcgccaaggtcaccggcggcgcccccaacaagctctccaagatcaaggtggtccgcacctccatcgcgagggtgctcacggtgatctcccagaagcagaagtctgcgctgcgtgaggcctacaagaacaagcggctcccgctcgacctccgcgccaagaagacccgcgccatccgcaggcgtctcaccaagcaccaggtctccttgaagaccgagagggagaagaagcgtgagaagtacttcccgatgaggaagtacgctatcaaggcctaggttataggagagtatgcattactggttaagttttgcccagaagttgcctgaattttatgttctgtgcggactgcaccgtcacctaagtacaatgtatttgatctactctatgagatgtcaacgtttgcttattaactctgttatggttatagctggttgtcgatgttggcgtgtgattgttattgcagtactttctcagtttccgttcatctgattgtggatt

SEQ ID NO: 7089 - DNA, 629 bp, Lolium multiflorum
cctcagagcctcatttttccctttcccccgccgccgccgctgccaccgccgctagaccagctcgccgaccgcaatggcccgcatcaaggtgcacgagctgcgggggaagaacaaggcggacctccagggtcagctcaaggacctcaaggcggagctctccctcctccgcgtcgccaaggtcaccggcggcgcccccaacaagctctccaagatcaaggtggtccgcacctccatcgcgagggtgcacacggtgatctcgcagaagcagaagtctgcgctgcgtgaggcctacaagaacaagcggctcccgctcgacctgcgccccaagaagacccgcgccatccgcaggcgtctgaccaagcaccagctctctttgaagaccgagagggagaagaagcgggagaagtacttcccgatgaggaagtatgctatcaaggcttaggttataagagtatgcttcactggttaagttttgcccagaagttgcctgaattttatgttctgtgcggactgcaccgtcacctaagtacaatgtatttgatctactctatgagatgtcaacgtttgcttattaactctatgtctgggttataactgcttgtcgatgtttgtgtgagattgttattcta

SEQ ID NO: 7090 - DNA, 479 bp, Nuphar advena
cgtcatcgtcgtccccaaaaacccttctgtcctttccccccaaaaccctgcgcgtcgagtcgcaatggcgaggatcaaggttcacgagctcaggacgaagacgaagacggagcttctgaaccagctgaaggatctgaaggccgagctcgcgctcctccgtgtcgccaaggtcaccggcggtgcccctaacaagctctccaagataaaggtcgtgaggttgtcgatcgcccaggtgttgacggtcatctcgcagaagcagaaggctgcgctcagggaggcctacaagaagaagaagtacattccgctcgatctgaggcccaagaagacccgatccattcgccgccgtttaaccaagcatcaggcatctttgaagactgagcgcgagaagaaaagggagaagtactttccattgaggaaatatgcgatcaaagtgtaggcttagtgaaggacggatttaatggtcatcatttgcttttgga

SEQ ID NO: 7091 - DNA, 699 bp, Quercus alba
gcctcctttcatttcagatttctagggtttttcattcagagagcaacgaggaaccgaagccgccgcgttatttcacaatggcgaggatcaaagtacacgagttgaggaacaagacaaaggcagagctgctggctcagttgaaggacctcaaagctgagctcgctcttctccgtgtcgctaaggtcactggtggtgcacccaacaagctctccaagataaaggtagtgaggcttggaatagcgcaagtgttgacagtgatatcgcagaagcagaaatcagctcttagggaggtctacaagaacaagaaatacatccctctcgatcttcgtcccaagaaaacccgtgctatccgcagacgcctcaccaagaaacaggcatctttgaagacagaacgtgagaagaagagggagatgtactttccattgaggaagtatgctatcaaagtgtaggctaggcctctagggtctacttttcctaattttcattatggacatgttactttttttttcttctgaatttgccattagttgcagccatgcaggcagcatttttgtttatcttgtatcgggtttgaaccatctagcttgaagttttaaacatgagattgtttttcactcatctttctgtaattttatctttgatttctcctgtatgatgtctgttctaggcttatgctttggtttgatgagagggtagata

SEQ ID NO: 7092 - DNA, 515 bp, Avena sativa
cctcccacgactcgccgctcccgccgctagaccagctcgccagcagcaatggcccggatcaaggtgcacgagctgagggggaagaacaaggcggagctgcagggccagctcaaggacctcaaggcggagctctccctcctccgcgtcgccaaggtcaccggcggcgcccccaacaagctctccaagatcaaggtggtgcgcacctcgattgcgagggtgctcacggtgatctcgcagaagcagaagtcggcgctgagggaggcgtacaagaacaagcgtctcccgctcgacctccgccccaagaagacccgcgccatccgcaggcgtctcaccaagcaccagctctctttgaagacggagagggagaagaagcgcgagaagtacttccccatgaggaagtatgctatcaaggcctaggttaggagcacatgttttaccggccgagttttgctcagaagttgcatgaattttatgttctgtgtggacaccgctgctatctaagtactatgtattcg

SEQ ID NO: 7093 - DNA, 598 bp, Avena sativa
cgtatcatctcctcgccgccgctgcagctgccgcctcttcgctgccaatcgttgtcatggcacggatcaaggtgcacgagcttcgtgggaagaacaaggctgagcttcaggcgcagctcaaggacctcaaggcggagctgtccctcctccgcgtcgccaaggtcaccggcggagcgcccaacaagctctctaagatcaaggtggtgcgcacgtcgatagcgcgcgtcctgaccgtgatctcgcagaaacagaagtctgccctgcgggaggcgtataagaacaagaatctgctccccctcgacctccgtcccaagaagacccgcgccatccgccgccgcctcaccaaacaccagctttctcttaagacggagagggagaggaagcgcgagaagtatttccccatgaggaagtatgccatcaaggcttagttcaggcaacatgaaatgtgtttagcacagtatcggataatttatttgcctgggagttcgttgaactttgatgttatcgtgtatggacttcccttgtggtttaagttcaatgtgatgacccattttctcaaatacctagtttgatttaagcactaatatgttgactttga

SEQ ID NO: 7094 - DNA, 619 bp, Elaeis guineensis
ctcttctctacctttgggacccctgccgccatttcgccttgcccgagccgagggagagtagagcagaaaagatctcgatccgcttccaatggcgaggattaaggtccacgagctacggggaaagtctaaagcggatctgttgaaccagctgaaggacctcaaggcggagctcgccctcctccgcgtcgccaaggtcaccggcggcgcccccaacaagctatccaagatcaaggtggtgaggctctcgatcgcgcgggtgctgactgtgatctctcagaagcagaaggaggtgctgagggaggcgtacaagaagaagaagtaccagccgctcgatctccgccccaaaaagactcgcgccattcgccgccgactcaccaagcaccaggcttcattgaagaccgaacgccagaagaaaaaggagatgtacttcccaatgaggaagtatgcaattaaggcatagattaggttattctgtttaagtgactctctttgggatccaattttgtcatttgatttttgaattagcaatcctatttagtactatgcttgggtttatggcatacaaaatactaattgtttgctttggtattcggttaagtttgatgtttcattcttgatt

SEQ ID NO: 7095 - DNA, 674 bp, Elaeis guineensis
gcccgagccgagggagagtagagcagaaaagatctcgatccgcttccaatggcgaggattaaggtccacgagctacggggaaagtctaaagcggatctgttgaaccagctgaaggacctcaaggcggagctcgccctcctccgcgtcgccaaggtcaccggcggcgcccccaacaagctatccaagatcaaggtggtgaggctctcgatcgcgcgggtgctgactgtgatctctcagaagcagaaggaggtgctgagggaggcgtacaagaagaagaagtaccagccgctcgatctccgccccaaaaagactcgcgccattcgccgccgactcaccaagcaccaggcttcattgaagaccgaacgccagaagaaaaaggagatgtacttcccaatgaggaagtatgcaattaaggcatagattaggttattctgtttaagtgactctctttgggatccaaatttgtcatttgatttttgaattagcaatcctatttagtactatgattgggtttatggcatacaaaatactaattgtttgctttgttattcggttaagtttgatgtttcattcttgattcatcttccattgctggcattaactttctggatggtcatacttccatcaagtgtatgatgtattattcattgcaatttccgcaaaaaaaaaaaaaa

SEQ ID NO: 7096 - DNA, 483 bp, Olea europaea
ggggggttttcgaggtttcgatcactctattccactttcaacagagagaaagaagaaacttgaaatggcgaggattaaggtgcacgaattgaggcagaagagcaaggcggagttgctggcccagctgaaggatttgaaggcggagctggcactgttgcgggtggcgaaggccaccggtggcgccgcgaacaagctttcaaaaatcaaggtggtgaggctctccattgcccaggtgctgaccgtgatttctcaaacgcagaaggccgcactcagacaagcttacaagaataagaagtacttgccgcttgatctccgcccgaagaagacccgcgctattcgcaggcgccttaccaagcaccaggcatctttgaagacagaaaggcagaaagtgaaagagatgtatttcccaatgagaaagtatgcaattaaagtttgagttttttgtgctggatttgagtttttggaggataatgatactagcct

SEQ ID NO: 7097 - DNA, 627 bp, Petroselinum crispum
tctagcagaaacaacaaatccgccgcctctcagctcacacactccaccatcaatggcgaggattaaggtacatgagctgaggacaaagtccaaggcggatttgttgactcagcttcaggaattgaaggctgagctttcgcttcttcgggttgcgaaagtcactggtggagctcctaacaagctctccaagataaaagtggtgagattgtcaatcgcacaggtattgacagtcatgcaacagaagcagaaggctgctcttagggaagtctataagaacaagaaactcatgccacttgatttgcgtcccaagaagaccagagccatcaggaagcgtcttactaagcaccaggcatcgttgaagaccgagcgagaaaagaaaaaggagaagtactttcccatgagaaaatatgccatcaaggtgtaggctagtaaatgttcagggagggaaattgagatattttttgcaagcgtctctagttctttatatactttgttgattggtcccaagtactttgtggcttatgtttacttttaaaaacactatttctgttatatttgctttgagctaactaatttttatgagatagtgcaatcttttttccacgagtattatcaagaatagcaagg

SEQ ID NO: 7098 - DNA, 1002 bp, Phalaenopsis aphrodite
aatttacgtcttcgcctgcattttctagggtttttgcgatacgctcgagtgtcgtccgcagcaacggagaagaagagatggcaaggattaaggttcacgaacttcgacagaagtctaagacggagctcctgaatcaactgaatgacctcaaagcggagctcgctcttcttcgagtcgccaaggtgactggaggagcccccaacaagctttccaagatcaaggtggtgaggctctcgattgcgcaggtgctgactgtgatatcccagaagcagaaggcggcccttagagaggcttacaagaagaagaagtttctcccgcttgatctccgacctaagaagacccgcgcgataaggcgtaaactcaccaagcgtcaggcctcactgaagactgaacggcagaagaaaaaggagttgtattttccgttgaggaagtatgctatcaaagcttagaagtttatcatccccacctatctgttttttttctggaatttttagcacttaaatttatgcagaatgtattttgtatttgaatctgatgttatcaatttgccttcatttgaatgaatgctttcatgcaattttctgctctgcattttttctcgcttaaactctctctctcacaaaacattgcagatttatcctgcactgatgaatttgattgagtgctttaaaaatgttgtcatatcctgattaaatattattattgttgttgttgatattaattaatcaaatattacaaccttcttgccccaagatgctccattgttaagggtttttgggtaataataataataacaaggatatagaatcaatacataaatttacaggcatgcacctctaatttttatgtatttacatatgtatcatctaaacttgttttctgtatgtggtctgagtaggttcagatggtatccaataataaaaaaaacaggaccaaacaagctgctattcattagctactaaatactgtctttgcgtgtactttaatatctattatttaacg

SEQ ID NO: 7099 - DNA, 416 bp, Ananas comosus
atggcgaggattaaggtgcacgagctccgggggaagacgaaggcggagctcctcgcccagttgaaggatctcaaggcggagctctccctcctccgcgtcgccaaggtcaccggtggcgcccccaacaagctctccaagataaaggtggtgagggtatcgatcgcgagggtgttgacggtgatctcgcagaagcaaaaggcggcgctgagggaggcgtacaagaagaagaagtatcagccgctcgatctccgcccgaagaagactcatgccattcgccaccgcctcacgaagcatcaggcatctctgaagacagaacgagagaagaaaagggagaagtacttcccgatgaggaagtatgcaatcaaggcgtagtttttgttggtcgaatagattattgagccctttctatcggagca

SEQ ID NO: 7100 - DNA, 618 bp, Platanus occidentalis
attagccattaccgaatatcttcagatggcgaggatcaaggtccatgagctccgaaccaaacctaaaactgagctgttgaaccagctcaaggaactcaaggctgagcttgctttgctccgagtggccaaggtcactggaggtgcacctaacaagctctcaaagattaaggtggttaggctttccattgcccgtgtgcttactgttatctcccagaagcagaaagctgcgttgcgagaagcatacaagaagaagaagtttttgccgctggatcttcggccaaagaagacccgtgcaatcaggcgtcgtctcacaaaacatcaggcatcattgaagacggaaagggagaagaagagggagatgtatttcccaatgaggaaatatgctatcaaggtttgagatagttcactggtcattatagtagtggtggtttaattaagcatttttgttttagcttttgcattcaatcctatgtaaccgtggatgtcttggaactttaatggtaaagctggagcaactttcgtgcttttggctagaatagttcctgtgaactgattccgatttttgtagttaaaatctgaagttagcgttgaccgagatctcagacatatttgtgggtt

SEQ ID NO: 7101 - DNA, 737 bp, Populus trichocarpa
acttgaaattggcccaaagtactaaatagcccattagaaatagtgcgtccatttgtctctctttcgcctttggatcatcaaataagagggagtctccactgctagggttttgaaagagttgtccaactgagcagcagaagctgaagcggagcctcacaacaaccttaaaatggcaaggataagggttcatgagttgagggagaagtccaagacagagctcctagcccagttaaaggagctcaaggcagagctagccctcctccgtgttgctaaggttactgggggtgccccaaacaagctctccaagataaaggtggtgaggttgtcaatagcgcaggtgttgacggtgatatcacagaaacagaaatccgcactcagggaagcttacaagaataagaagtttctgcctcttgatcttcgtcccaagaaaacccgtgccattcgcagacgtcttactaaacaccaggcatctttgaagacagaacgtgagaagaagagggaaatttacttcccaattagaaaatatgcaatcaaagtatagggtattctgtggcgcatttgatatagttgcagccatgttgaggcaaccattttatttcttaattcttgttggagtacttatttagtttttttatcttgaaaatcagaatttgtgttctttggattcgatcatattgcatatccttgactgagttgtttagtttgcctgtaaattaccgattttcattagctgctcc

SEQ ID NO: 7102 - DNA, 580 bp, Solanum tuberosum
tctcttcagtgtgagaagagtgaacctgtgagagaacggcatggcaaggatcaaagttcacgaattgaggcagaaatccaaggctgatcttttgggtcagttgaaggatctcaaaactgaactcgctctcctccgtgttgctaaagtcactggcggtgcccccaacaagctctctaaaataaaggtggtaaggctgtcagtagcacaggtgttgacggtgatatcgcagaggcagaagtcagcactaagggaagcatacaagaataagaagtacttgcctctcgaccttcgtcccaagaagaccagagccatccgtagacgtcttacaaagcaccaagcatctttgaagacggaaagagagaagaagaaagagatgtactatccattgagaaagtatgctattaaggtttaaatatccgacttagatagtcattgtgatgttagaactagtacgagctgagcaaagcagagttacattttcgctactgagtagttatattttccatcgtcattcctgttattgtattgtgaagcggaaacttttgtttattttctcatgtttcagtgaaggttcttcagt

SEQ ID NO: 7103 - DNA, 982 bp, Oryza sativa
ctagggtttcctcatcctcgatggggtttatccttcgagcacatatataatccgcacgccgccgcctccctctctgcttcgcactccattttccctctccccgctcgccgccgccgccgccgccagccaagctcgccgctcgccatggcccggatcaaggtgcacgagctccgggggaagaacaaggcggagctgcaggcccagctcaaggacctcaaggcggagctctccctcctccgcgtcgccaaggtcaccggcggcgcccccaacaagctctccaagatcaaggtggtgcgcacctcgatcgcgcgcgtgctgacggtgatctcgcagaagcagaaggcggcgctgagggaggcgtacaagaagaagagcctgctcccgctcgacctccgccccaagaagacccgcgccatccgcaggcgcctcaccaagcaccagctctctttgaagaccgagagggagaagaagcgtgagaagtatttccccatgaggaagtatgctgttaaagcttaggttattaggaacataaatgttttaccggtcaagttttgcccagttgcctaaatttgatgttttgtgtggacatccattgtcaccttagtacaatgtatttggtctactgcatgaagtgcgtactattttgccttttaacgttgttatttggttatagctgcctgtcacctgtctgttgaaaatgtgatggttaccttaatgtttaagagattccacttgaactatgtccctacgtagttcaaccgtggatgggcattcaaattcaatctataccaaaggtagtgtgtgctagtgctgaactgaggagcacattcttcatctctggtagttttgctgaaacctgatgtgcaaattatagtagttactaccaggtttcacttttttttgattgaggtggattcactccagggctgcggtgctttttgtgaaactttgatcaaaatatggcttggaattggaattggta

SEQ ID NO: 7104 - DNA, 636 bp, Sciadopitys verticillata
tttcaagcgggcgaggaaggaggtgctgcggaggagtttgatagagctgatatcaaaatggcgaggatcaaggttcatgagttgcgcactaagggcaaacaagatctgctgaatcagctcaaggacctgaaggccgagcttgccttgctcagggtcgctaaagttacaggaggagcggccaacaagctctctaagatcaaggtggtaagaaaatctattgctcaggttctgactgtgatttcccagagccagaaagctgccttaagagaagcatataagaagaagaagtacttgcctcttgacttgcgccccaagaagactcgtgctatcaggcgacgtctcaccaagaatcaggtctcattgaagacagagagagagaagaaaaaggagatgtatttccccatgagaaagtatgcaattaaggtgtagggattaggatttgattaggtgacaggactgtctgcacaattttctgaatggtaaaatgcaccattatatttccgtgagttttttgggaagttctttgcttcaaaatctgagttataaaaagtgcgttttatttttattcaccttcacttatctccaaatgtggttctattttaatatgttggatgaattatgatattatggcatgcg

SEQ ID NO: 7105 - DNA, 705 bp, Sorghum bicolor
cgctcctcctcaccccgccgccgcagccgtcgcagccgcaactgccaccgtcgccatggcccggatcaaggtgcacgagctccgggggaagagcaagacggacctgcaggcgcagctcaaggagctcaagtctgagctctccctcctccgcgtagccaaggtcaccggcggcgcacccaacaagctctccaagattaaggtggtgcgcacttcgatcgcgcgcgtgctcacggtgatctcgcagaagcagaagtcggcgctgcgggaggcgtacaagaagaagaagctgctccccctcgacctccgccccaagaagacccgtgccatccgccgccgcctgaccaagcaccagctttctctgaagacggagagggaaaagaagcgtgagaagtacttccccatgaggaagtatgctatcaaggcctaggtcagaactgtgagatgctgtgcttagcatatcatcagctgttcctttccctaggaagtgttttaagttttgatttgtatggacacatgctgtggtcgaaagtaagatctgtttgctctgtaaccacaaatgcctagattggtttgactggcaattcgtatcggctctcatatttggtgttaatttctcttggtcaacaatcttatcgcaagatgtttaacggtcattatatctgtgtgactgacccaattgtactcatgctgtaatgtttttgcccc

SEQ ID NO: 7106 - DNA, 625 bp, Sorghum bicolor
cgcgcaccgctcctcccccaccccgccgccgccgccgccgccgccgcaactgccaccgtcgccatggcccggatcaaggtgcacgagctccgggggaagagcaagacggacctgcaggcgcagctcaaggagctcaagtctgagctctccctcctccgcgtagccaaggtcaccggcggcgcacccaacaagctctccaagattaaggtggtgcgcacctcgatcgcgcgcgtgctcacggtgatctcgcagaagcagaagtcggcgctgcgggaggcgtacaagaagaagaagctgctccccctcgacctccgccccaagaagacccgtgccatccgccgccgtctgaccaagcaccagctttctctgaagacggagagggaaaagaagcgtgagaagtacttccccatgaggaagtatgctatcaaggcctaggtcagaactgtgagatgctgtgcttagcatattatcggctgtttctttccctaggacgtgttttaagttttgatttgtatggacatttgctgtgggtcaaaagtacaatgtatttcctctgttaccacaaatgcctagattggtttgactggcaattcgtataggcgttcatatttgatggcaacttctc

SEQ ID NO: 7107 - DNA, 782 bp, Glycine max
aacaggtattatgttttgtcccagattagggttttaaggacacaaagtagcagagcagagtaaccagctaggtagggttttctctttctcacgttcctcttcgcagcgccacagtagcttcgcattagcaatggcgagaatcaaggtgtacgagctgaggtacaagacaaaagcagagcttctgaaccaacttaaggatctcaaagcagaactcgctctcctccgcgtcgctaaggtcaccggcggagccccaaacaagctttccaaaatcaaagtggttcggctttcgatagcgcgggtgctgacagtgatttcccagaagcaaaaggcagcgttgagggaagcttacaagaagaagaaataccttcctttggatctgcgtcccaagaagaccagagccatcagaaggcgcttaactaagcaccaggcttcattgaagacacagcgtgagaagaagaaggaattgtattttccaatgcgaaaatatgcaattaaagtgtaatgttagaaccaaatatgatgataattttggcgtcactttctatttggtatttgacatacaatttttttctggccattcagttttgatgccgtttcttcctagttttcttttaatcatcatgaaacttttattaaatgttcgctggttttactctggctttttttttttagtcatacatgaaaattttcaatttcttgcatgcacggtctctccgctattcttcattattttgtgtacacgattcaccggttaataaaattcataaatcagttttattaat

SEQ ID NO: 7108 - DNA, 634 bp, Saccharum officinarum
gttctcccacggggttttaggaggcacatatataagccacacgccgccgcctccctctcgcttcgccctccatttttcatatcctcactcgccgcagccacagccgccgcaggaagccccgctcgtcattcgcgatggcccggatcaaggtgcacgagctgcggggaaagagcaagacggatctgcaggcacagctcaaggagcttaagtcggagctctccctcctacgcgtcgccaaggtcaccggcggggctcccaacaagctctccaagatcaaggttgtgcgcacctccatcgctcgcgtgctaaccgtcatctcgcagaagcaaaagtcggcgctgcgtgaggcgtacaagaagaagaagctgctcccgctcgacctccgccccaagaagacccgcgccattcgcaggcgcctcaccaagcaccagctctccttgaagaccgagagggaaaagaagcgtgagaagtatttccccatgaggaagtacgctatcaaggcctagattagtgaaagaacatgctttatcctgtcaagatttgcccagaaattccttgaatttgatgtatcgcacatctctctattaatctaagtacaatgtagttgatcaactgcatgatgaaaaatgcatac

SEQ ID NO: 7109 - DNA, 741 bp, Saccharum officinarum
cgctattcagcctagggttttgtctccgccacacgccctccgccgccacccttcttcttcccctcgcgcaccgctcctccccagcccgccgccgcagccgcagccgtcgcaactgccgccgtcgccatggcccggatcaaggtgcacgagctccgggggaagagcaagacggacctgcaggcgcagctcaaggagctcaagtctgagctctccctcctccgcgtagccaaggtcaccggcggcgcacccaacaagctctccaagatcaaggttgtgcgcacctcgatcgcgcgcgtgctcacggtgatctcgcagaagcagaagtcggcgctgcgggaggcgtacaagaagaagaagcttctccccctcgacctccgccccaagaagacccgtgccatccgccgccgcctgaccaagcaccagctttctctgaagacggagagggaaaagaagcgtgagaagtacttccccatgaggaagtatgctatcaaggcctaggtcagaactgtgagatgctgtgcttagcatatcatcggctgtttctttccctaggaagtgttttaagttttgatttgtatggacatttgctgtgggtcgaaagtacggtgttttgctctgtaacaacaaatgcctagattgctttgactggcaattcgtatcggctctcatatttggtgttagtttctcttcgcctacaatcttattgctggatgtttaacggtcattatatctgtgtgactg

SEQ ID NO: 7110 - DNA, 596 bp, Helianthus annuus
aaccctaaattcgcgatttgccggcagccagcttcattcagttccgattccagttaatcaaatggctcggatcaaagttcatgagcttcgtggcaaatcaaaggccgatttattcgctcaattgaaggatctgaaagctgagcttgctcttcttcgtgtcgccaaggtcactggtggtgctcccaacaagctctcaaagataaaagtggtgaggacctcaattgcgcaggtgctgaccgtgatttcacagacccagaaatcaatgcttagagaagcttacaagaagaagaagtacctcccgcttgatctgcgtcccaagaaaaccagagccattcgcaggcggctcaccaagcatcaggcttcgttgaagacagaacgagagaaaaagaaagagaagtacttcccgttgaggaagtacgcgatcaaggcttaggtttggtagttttaagattttgaatttgaattttgtgtgttcttttatcggtttgttggattcggaaggttatgttaacattggatcaaagcatttttgataatcagattttgatcatcatttgtatttgagcataaatagttgccttttcaatcgaggcata

SEQ ID NO: 7111 - DNA, 594 bp, Tragopogon dubius
gggggggtcttcctctaattttagatattagggtttcgtaagaccttccattgcagctgcggctcctacaaccaacgcataatccatggctcggatcaaagttcatgagttgagggacaaatcgaaggctgatttgtttgctcaattaaaggatcttaaggctgaactcgctcttctccgtgtcgccaaagtcaccggcggtgctcccaacaagctcgccaaaataaaagtggtgaggacctcaattgcacaggtgttgactgttatttcacagacacagaaggcaaaactcagggaagcttacaagaacaagaagtacttgcctcttgatttgcgtcctaagaaaaccagagccattcgtaggcgtttgaccaaacatcaggtttctttgaaaactgaaagggagaagaaaaaggagaagtatttcccattgaggaagtatgctattaaggtgtaagggtagaattaaactatgtaggagagtttaagtacttttgatttttgaacttgaatttatttacattattttgatgttttgaaaagagttgaattttggaggttgcacttgattattgaagttatattgttcctgac

SEQ ID NO: 7112 - DNA, 548 bp, Tragopogon dubius
tttcaaactttcaagggagtctacgttgccgtttactccgccttcgatcaatggctcgaatcaaagttcatgagcttaggaacaaatcgaaggccgatttgtttgccgagttgaaggatctcaaggctgaacttgctcttctccgtgtcgccaaagttaccggtggtgctcccaacaagctcgccaagatcaaagtggtgaggacatcaattgctcaggttctgactgtgatttcacagactcagaagtctgctcttagggaagcctacaagaacaagaagtacctccctcttgatttgcgtccaaagaaaacaagagccatccgcagacgtttaaccaagcatcaggtttcattgaagactgaaagggagaagaagaaggagaagtacttcccattgaggaagtatgctatcaaggcgtaaggaaggggattaggtattttcatgtatttaaatctcggtccagttttgaagtcgggtttgtgtacgattgatcagaaatcatgtatttgatagtttgttggcaatgagttataagacagttaacta

SEQ ID NO: 7113 - DNA, 622 bp, Valeriana officinalis
cattcctaagggtttcaagagcaggaaatccgaattccgccaccatggcaaggatcaaggttcatgagctcagaactcagaagaaggaggatttgctgaatcagctaaaggatttgaagacggagctgtctctactccgagtcgcaaaggttactggtggtgctcctaataagctatcgaagataaaggttgttagactgtctattgcgcaagtgttgactgtgattcagcagaaacagaaggcggcattaagagaagtttacaaaaacaagaagttgatgccacttgatttgcgtcctaagaaaaccagagccattcgcaagcgtttgaccaagcaccaggcttcattgaagacagagagagagaagaagaaagagatgtactttcccttgaggaagtatgccatcaaggtttagggcttaggttttcaatttttggttgcaaacatttttactttgtccgtatttgttcagatattgtatgaggaattttatgaacttgtcttttgacaagaaatttttattggctgttctgtttcagcttgttgaatctattttcttatttacaaaacaaatgttccttgtgtttttgaaatccacagaaaaaacgtactgtagaaaaa

SEQ ID NO: 7114 - DNA, 769 bp, Citrullus lanatus
aggtttggatcttcttcagtttctacaacctagggttttgctagttgcagacctccgccgaatcccaaatcacaacagccggtctctgcttaccagattttaatggcgagaattaaggttcatgagcttagacagaagtcgaagggggatcttttgacccagcttaaggaccttaaggcggagcttgctcttctccgtgtcgctaaggtcactggtggtgctcctaacaagctctccaaaattaaggtagtgaggttgtcaatcgctcaggtgttgacagtgatttctcagaaacagaaatctgctcttagggaagcttacaagaagaagaagcttttgcctcttgatttgcgccccaagaagaccagggccattcgtagaaggctcaccaaacaccaagcatcactaaagacggagcgacagaagaagaaagagatgtactacccattgaggaaatatgccatcaaggtgtaggctttagagggaattgatttatcgtccgtggtatcatgcatcttttactcattttggcttttgatttatctataactttattcagacttgagtgcctattttcaatcttattgttagatctctgaactttgaagtctttcattttccatgtaatactttagttttccaagttataatgaaatggttttggttaatgaccttaggcagtgcaatcttttgccaagatgaatgtgctctgatcttaaaccgcgtgtgtgatttgtctggattgagatttttatgtatcaagctgtaa

SEQ ID NO: 7115 - DNA, 603 bp, Zostera marina
cacctgcttctatcgccgtcggagcaaccctaagatatctgcattcgtcgcaaggacagcaagaggcggaatggcgaggatcaaggttcacgagttgcgaggaaagacgaaggtagatctggttaatcaactcaatgatctgaaaactgagttatcacttctccgtgtcgccaaggttaccggtggagctcccaataagctctccaagattaaggtggtgcgaaaatccatcgctcaggttctaaccgttgtgtcccagaagcaaaagagtgccctgagggaggcgtacaagaacaaaaagtatcttcctcttgatctaaggcccaaaaagacccgtgcgatccgtcgccgtctgacaaagcatcagctctcgcttaaaactgaacgtgaaaagaagagggagagatacttcccaatgaggaagtatgccataaaagcttagtttaagttagttttcaatatcattcaagttttgaacactacactgttttcagataaaagcagtttctttttattcaaagtgtattatctatcaatcaagtgttagacatattttccttgaattttgtaccttgtttatttttatgttgcatcgaaatatta

SEQ ID NO: 7116 - DNA, 497 bp, Pteridium aquilinum
gagaatcaaggtccatgagttgagacagaaatcaaaaactgagctttttggctcagttgaaagatctcaaggctgaacttgctctcttcgcgttgctaaagttaccggtggcgcacctaacaagcttttcccaaaggataaaaggtggtgaggctgtcaattgctcaggtgttgacagtaatctcacagaagcagaaggccgcactgagggaggcatataagaataagaagtcttgccccttgatctgcgtcctaagaagaccagagccattaggagaaggcttaccaagcaccgggcatcattgaagactgaacgggagaagaagagggagatgtacttcccaatgaggaagtatgccattaaggtgtaggctaggatctttcagataggattctatttacaaatccatttaccgttctactttctagtgtcatatttgtgaaacctgagttttgattttgttcaatttcttgtttatcaacttttccttttgtgc

SEQ ID NO: 7117 - DNA, 534 bp, Nicotiana benthamiana
tttgttttggttgtattagcaagaatcaaagttcatgagctgaggggaaaatcgaagactgatcttttggctcagttaaaggatctgaaagcagaacttgctctcctccgtgttgctaaggtcactggcggtgcccctaacaaactctccaaaattaaggtggtgaggttgtcaatagcacaagtattgacagtgatatcacagaagcagaagacagcactgagggaagcttataagaacaagaagtacttgccccttgaccttcgtcccaagaagaccagggccattcgtaaacgtcttaccaaacatcaggcatctttgaagaccgaaagggagaagaagaaagagatgtactttccaattagaaagtatgccattaaggtttaaattgatccatcttttagatagtttgtcatgtttgcacttgcagaccaaagctgaggatcatatttttgccattttacaatgttatattttgtattacttctattaattccgaagttggagttttattattttgtttgccttcttttt

SEQ ID NO: 7118 - DNA, 1467 bp, Arabidopsis lyrata
tggtttttagagattttatcagaagcaacaatggcgtctccggcgaattttcaactctctagaccaaaatttaaccttctgacctacctcgagcgaaaatctcctcaaaatctctcctttccccttttattcagagaccaagcaaacctcaccgcagccgcagctctgttctcagcatccttttacttcgtctacaaacccgccgcgacgactccggttgctgtggtagaggagactctcgagatactatcaaacgatgtgaaagctttatcattgctgacggagatcaaatttaagtccgatagacatgagcaggcaatagaagttctggaccgtctgatcgagatcgagcccgatgaacgaaaatggccggctatgaaggctaggattctctcataccacggaaaaagcgaattggcaatcgaagctttcgagaggattcttgagaaggacccgatacgtgttgacgcttatcattacttggtgatggagtattacaactctaaacccaaattaacagagctagagaagagaatcaacaaagtgattcgaagatgcaagaaggagaagaaggcgaaagagatttgtggtttcagaatgttgatcgcgcagatcaagtttatccaaggaaactcacttgaagccattcggatttgtgaagagttagtgaaagatgatccagaagatttcactatatatctgtttcaaggaatcgtgtatatattgatgaataaggaagaggaagctgcgaagcaattcgagcaagttgcaagggttatgccgatgaatcatccgtccagagagactgcgaccacctcaaagcaatggagagtcatcgtagcttacgataatgctttcgatgccttccttgtttaccaagtgtggaaaatgaaaaagcggagattttacatactacaacactcttacgatttttgtaagaaaattggtggtttaaacagttcatcgaggattaaggttcacgagttgagggaaaagtcgaagagcgatcttcaaaaccagcttaaggaactcaaagctgagctcgctctccttcgtgtcgccaaagtcaccggaggtgctcctaacaagctctctaaaatcaaggttgtgcgtaaatccatagctcaggttttgacagtgtcctctcagaagcagaagtctgctctaagagaagcatacaagaacaagaagtttcttcctcttgatctccgtcccaagaagacccgtgctatccgcagacgtctcaccaaacaccaggcctctttgaagacagagcgtgagaagaagaaggagatgtatttcccaataaggaagtacgctatcaaagtttaagtttagctgctagaaactgtttctactttggtttttgatggaaacttgttcttgttctttttcacttgttttgtcgtctcaaacagtttctgatacttggattttggttattattgatgatcttttgcttctata

SEQ ID NO: 7119 - DNA, 670 bp, Elaeis guineensis
gccgccatttcgtctcggcccgagccgagggagagtagggcagaagagatctcgatccgcttgcaatggcgaggattaaggtccacgagctacgggggaagtctaaggcggatctgttgaaccagctgaaaggacctcaaggcggagctcgccctcctccgcgtcgccaaggtcaccggcggcgcccccaacaagctatccaagatcaaagtggtgaggctctcgatcgcgcgggtgctgacggtgatctctcagaagcagaaggaggtgctgcgggagcgtacaagaagaagaagtaccagccgctcgatctccgccccaaaaaactcgcgccattcgccgccgactcaccaagcaccaggcttcattgaagactgagcgcgagaagaaaaggagatgtacttcccaatgagaagtatgcaatcaaggcctagattaggttattctgtttaagtgactcatttgggatccaattttgtcatttgctttatggattagctattcctgtttagtaccatgattgggtttatggcatacaaaatactaaatcgttggcgctcgaattttggataagcttgatgtttgattctttgattcatctccctttgccagcattaactttctggatggtcatactagtattgacttgtccacggagatttctgctcta

SEQ ID NO: 7120 - DNA, 532 bp, Elaeis guineensis
gtagggcagaagagatctcggatccgcttgcaatggcgaggattaaggtccacgagctacgggggaagtctaaggcggatctgttgaaccagctggaaaggacctcaaggcggagctcgccctcctccgcgtcgccaaggtcaccggcggcgcccccaacaagctatccaagatcaaagtggtgaggctctcgatcgcgcgggtgctgacggtgatcctctcagaagcagaaggaggtgctgcgggaggcgtacaagaagaagaagtaccagccgctcgatctccgccccaaaaagctcgcgccattcgccgccgactcaccaagcaccaggcttcattgaagactgagcgcgagaagaaaaaggagatgtacttacccaatcgaggaagtatgcaatcaaggcctagattaggtattctgtttaagtgactcatttgggatccaattttgtctatttgctttatggattagctattcctgtttagtaccatgagttgggtttatggacaataacaaaattactaaatcgtt

SEQ ID NO: 7121 - DNA, 950 bp, Cycas rumphii
tttcacttgaacaatcaagcggacacccccacaagctttccatcaccctaatttcttggccagttctccggaaacgaaggcaggtgccaattttctccttagcactacctcagccggtagttagtgggcttgaccggcagaagccggtgagagatattttaaccctaactgtaaacatagctctttccagttcgatcttcacgagggtttccaggggcgagaaggaaaggatcgccgaggagtatcgataagattcagaatcaaaatggcgaggatcaaggttcacgagctacgaaccaagagcaagtcggagttgttaaatcagctgaaggagctcaaggcggagcttgctttactcagggttgccaaggttacgggaggagctcccaacaagctctctaaaattaaggtggtaaggctgtcaatagcccaggtacttactgtgatttctcagaaccaaaaggctgcattgagggaggcctacaagaaaaagaagtacctgcctctcgacttgcgacccaagaagactcgtgctatcaggcgacgccttaccaagcatcaggcttcaatgaaaacagagcgacaaaagaagaaagagatgtactttcccatgagaaagtatgcaattaaagtttagagactagcttgcacacttttagcaggattttgttacccgaaagacagaattactcttcttattggccaattgtgagttttgtgtgaattcatatttccttggaaatttaattccagttttgatacattacgtttcataatcaatcaaattaatttatgctttacctttactcattttcttaatttccaatgggcaaactgtaatgttgtgatatctgaaattagggcttcctaccatatattttccatgcatagtttataaatggttgaacttgtgtaggggtgaattccaggaatttgatgttcagtttatg

SEQ ID NO: 7122 - DNA, 582 bp, Oryza sativa
cgccgcccgccgcgccgcctccgtcgccatggcccggatcaaggtcgacgagctacgggggaagaacaaggcggagctgcaggcccagctcaaggacctcaaggcggagctctccctcctccgcgtcgccaaggtcaccggcggcgcccccaacaagctctccaagatcaaggtggtgcgcacgtcgatcgcgcgggtgctgacggtgatctcgcagaagcagagggcggcgctgcgtgaggcgtacaagaagaagagcctcctccccctcgacctccgccccaagaagacccgcgccatccgccgccgcctcaccaagcaccagctttcgctgaagacggagagggaaaagaagcgcgagaagtatttccccatgaggaagtatgccatcaaggcgtaggtcagggaacatgagagaatgttatgtttagcacatcactcagtcaatttatctgccctcgagttccttgaattttgatgttatcatgtatggacatgccttgtggtcaagtacaatgtgacgggggtttgagtacttgcatgctaacattgatatatctaatctcatatcgtcgtcttcgg

SEQ ID NO: 7123 - DNA, 855 bp, Amborella trichopoda
gtatggcacaggggccacgtcaaagccaagggctagcccgttccacgcccttaattctagttgttatttttttcctcggcgcggccctaaaattttacaagccgggctacaccgggttcgatcctcgattgtaaaatttacagccgagcccaaattgaattttcgagcctattctaaccaataattttcggtcctggcccgacccatttgtagccctactacagaatcgcgaccttctccttccccttggtttccagcgtgtcttcctcatcagaaaccgtagggcgccatggcgagaatcaaggtccatgaactacggactaagtccaagacagagcttcttaaccaactgaaagagcttaaggctgagcttgcattgctcagagttgccaaggtcactgggggtgcccccaacaagctctcaaaaattaaggtggtacggctctcaattgcccaggttctcactgtcatctctcagaagcaaaaagctgcactgagggaagcctacaagaagaaaaagttcctccccttggatctccgcccaaagaagactcgtgcaattcgacgccgtctcactaagcatcaggcttccttgaagaccgagagggagagcaagaaagagaaatatttccccaaaaggaaatccgccatcaaggtttaaagcagtggcgtgtagtatgctgcagttctgaaatattttaacccatttgtcttccatggttttgtggattctgaactcagtgatttcctttttgttcactttatatgcttcttttgtttcgagggataggcagttatttgaatatattagaagaattggggattcttttttttgaaggaaaagtagtttatgca

SEQ ID NO: 7124 - DNA, 742 bp, Ambrosia trifida
tcaaataatccaacagattagcccacacatagctccatcctcagatacataaaccctaataatccttcattcatttatcatagctagggttccaagctttaacgccgtccgtcatcgcagtacactctagttagaatcaatggctcgtatcaaggttcatgagctcaggaacaaatccaaggccgatttgttttctcagttgaaggatctgaaggctgaacttgctcttcttcgtgtcgctaaagttaccggcggtgcccctaacaagctttccaaaatcaaagtggtgagaactggaatagctcaggtgttgactgtgatttcacagactcagaaggctgctcttagggatgcctacaagaagaagaaatacttgccccttgatttgcgtccaaagaaaaccagagccatccgtagacgtcttaccaagcaccaggcttcattgaagaccgaaagggagaagaagaaagaaaagtactttccattaaggaagtatgccatcaaggcataagttgaaagctatcaagcagattttgttttcagttttggacttaaagtttatcagaaatatgtgtttgttagtttgtttgccatgagtcacatgacatttgacattgaaacttgcactgttatgttttttactgttatgttggcctgtactccagagctctgtctttgcttttgtcggttagttttttaaccattttagtagaggtagaagaaagacccgacaattcgaact

SEQ ID NO: 7125 - DNA, 591 bp, Ambrosia trifida
tagctagggttccaagctttaacgccgtccgtcatcgcagcacactctagttagaatcaatggctcgtatcaaggttcatgagctcaggaacaaatccaaggccgatttgttttctcagttgaaggatctgaaggctgaacttgctcttcttcgtgtcgctaaagttaccggcggtgcccctaacaagctttccaaaatcaaagtggtgagaactggaatagctcaggtgctgactgtgatttcacagactcagaaggctgctcttagggatgcctacaagaagaagaaatacttgcctcttgatttgcgtccaaagaaaaccagagccatccgtagacgtcttaccaagcatcaggcttcattgaagaccgaaagggagaagaagaaagaaaagtactttccattaaggaagtatgctatcaaggcataaggtgaaaactatcaagcagattttgttttcagttttggacttaaaatttatcagaaatatgtttttgttagtttgtttgccatgagtcacatgacatttgacattgaaacttgcactgttatgttttttactattatgttggcccgtactccagagttct

SEQ ID NO: 7126 - DNA, 616 bp, Arabidopsis lyrata
gtataaattatcttcttcatcaaaattagggtttggagccagaaacgagcaagtagcggcacatcagttctcaacactcacgatggcgaggattaaggttcatgagcttagagataaatcaaagactgatcttcagaatcagttgaaggaattcaaggctgagctcgctctcctccgtgtcgctaaagtcaccggaggtgctcctaacaagctctctaaaatcaaggttgtgaggaaatccattgctcaggtgttgacagtgatctcccagaagcagaaatatgctttaagagaggcatacaagaacaagaagttcttgcctcttgatctccgtcccaagaaaacacgtgctatccgtagacgtctcaccaagcatcaggcttcgttgaagacagagcgtgagaagaagaaggagatgtatttcccagtgaggaagtatgctatcaaagtgtagtttcattcaccacctttagcttctagaaatgattcagcttttgattatcatcggcttatgtattctcctctctttttgtccaaccttctattttagttttgctgaagttttgttatcaaaccattattttatatatatattgaacccagttctgggttttgt

SEQ ID NO: 7127 - DNA, 584 bp, Arabidopsis thaliana
ggagccagaaaagagcaaataggcggcacatcagttctcaacactcacgatggcgagaattaaggttcatgagcttagagataaatcaaagaccgatcttcagaatcagttgaaggaattcaaggctgaactcgctctcctccgtgtcgctaaagtcaccggaggcgctcccaacaagctctccaaaatcaaggttgtgaggaaatccattgctcaggtgttgacagtgatctcccagaagcagaaatctgctttaagagaggcatacaagaacaagaagctcttgcctcttgatctccgtcccaagaaaacacgagctatccgtagacgtctcaccaagcatcaggcttcgttgaagacagagcgtgagaagaagaaggagatgtatttcccagtgaggaagtacgctatcaaagtgtagtttcattctcccagctctagcttctagaaatgaatgattcagcctttgattatcggcttatgttatctcctctctttttgtccaaccttattaattttagttgtactgaagttttgttatcacacaacctctctaaaatcattagtatttcataaatattgaa

SEQ ID NO: 7128 - DNA, 802 bp, Aristolochia fimbriata
ctctattcgaacagccatactcgccattttccagtcgattcaatggcgaggatcaaggttcatgaactccgaaccaagtcaaaaactgatctgctcggccagctcaaggagctgaaagctgagcttgcattgctgcgggtggccaaggtgactggtggtgccccaaacaagctctctaaaatcaaggttgttaggctctccattgctcgtgttcttactgttatctcccagaaacagaaagctgcactgcgagaagcttacagcaagaagaaatttcttcctttagatcttcgtccaaagaaaacccgtgctatcaggcgtcgcctcacaaaacatcaggcatcacttaagacggagcgggagaagaagagagagatgtacttcccaaagagaaaatatgccatcaaggtctgagatttgctgccgtagagtagtagaggaatttttgcaagttcgttgtctgttattagaggaaccctgttaactatcagtcacctgagctgttatgctgtagctatatttttgctttgtatcaactagcttttggttgggtggatatttgatcaatatattgggtaggtgggtttttaactagctgtacctgaccttaaactgtttttgagttgcacaaattcataaagcagtctgatatcaaggattgatgccttagtagaggaattacgtaatgctgattctgaaagttgcagttaaaactactcttttaatgcagtgtttaccggaaaagcaaacttgcaaatgcagatagcaaaggttaaacggtttattgattgatgaaaaaaaa

SEQ ID NO: 7129 - DNA, 1015 bp, Musa acuminata
taaatttctcctgacatgaattatggaccactgcagcccacagcccacggcccacggaccacggaccacggctcaactaagcctcttggtaagctggcttatgtgagccgagttcttttggcggctagggttctgaaactcctctctgtatataattctcgcctccgactaggattggggtttgctcgcggcggaagcgggagaacgcgacgagggcggcgaatcgatccgatcctaatggcgaggattaaggtccacgagcttcgcgggaagacgaagggggagcttcagaaccagctgaaggacctcaagaatgagctctccctcctccgcgtcgccaaggtcacgggcggcgcccccaacaagctctccaagataaaggtggtgaggctgtcgatcgcgcgggtgctgacagtgatctcgcagacgcagaaggcgaagctgagggaggtctacaagaagaagaagcacattccgctcgatctccgccccaagaagactcgagccatccgccgccggctaaccaagcatcaggagtcactgaagactgagcgtgagaagaaaaaggagatgtacttcccaatgagaaagtatgccatcaaagcttagattggaatgttagacgagtccaatcatgctttctattgattactatatggtttcataattcgacttctgctgtatggattagtgtacaacactatggttgggttttgcacttgaaaatggctgagcaacactcgcaagatacagtgtgtttgattgctgaatcatctgcttattctaacattcaattggtcattacatggcatcattggtttaacaagacgatttcttttgtggaatcatgattgatgttacgaagctcctctctgcgtgatcaaatctgcatatctccttcatgagaaaatgattttgtcacacatcaacaagctaattggttcgatatattgtttggcaaatcttaacatcacatttggtcaatggtttacgatcaacacaaaatttaaggcac

SEQ ID NO: 7130 - DNA, 594 bp, Theobroma cacao
tttctagggttttgacagggaggagcacagccgcggcagcaaagctcacaatggcgaggataaaggttcacgagctgaggaacaagtccaagacggagctgttgagccaattgacggacttgaaagcagagctcgctctcctccgcgttgctaaggtcaccggcggtgcccctaacaagctctcgaaaataaaagttgtgaggttatctatcgcgcaggttttgacggtgatatcacagaagcaaaaatcggcgcttcgagaagcttataagaagaagaagttccttcctttggatctccgtcccaagaagacacgtgccattcgccgacgccttactaaacaccaggcatctttgaagacagagcgagaaaagaagagggagatgtatttcccattaaggaaatatgctatcaaagtgtaatggagccaagtgttctctttctttttttgtgtgagttacttgtttagaagtctaaaaagttctgaatcgcggtttagatgcagcctatatgagcatcatttttgtccctttatcagtttttccataagaacatcttgcttgagcatttataatatgatttatcatttcagaa

SEQ ID NO: 7131 - DNA, 568 bp, Brassica napus
aaacagagtaaggggaagccagagaagtcgaagacgccatggcaaggatcaaggttcatgagctgagagagaaatcaaaaacggatctttccactcagttgaaagatttcaaggccgagctagctcttctccgcgtcgccaaggtcactggaggtgctcccaacaagctctctaagatcaaggtggtgaggaaatcaatcgctcaggtgttgacagtgatctcacagaagcagaagcttgctctgagagaggcgtataagaccaagaagtttttgcctcttgatcttcgtcccaagaagactagagctatcaggaggagactcaccaagcatcaggcatcgctgaagacagaaagggagaagaagaaagaaatgtactttccaattagaaagtatgctattaaggtgtaaccttgttcttattaatcacatcatcaatctttgtgttttgaattttagctcttgagtgagttggctttttgttttatgttcctttttaccgattcttctgaatgatagattttgattcacaaacgcattattgttttctgatcaagctgtgagtgaaa

SEQ ID NO: 7132 - DNA, 848 bp, Cedrus atlantica
gggagtcgaggcgcggagcggacttcttgtgagaggatctgaattgaaatggccaggattaaggttcatgagctccgtactaagagcaaaacagagctgttaaatcagctcaaggagctcaaggctgagcttgccttgctcagggttgcaaaggttactggaggagcgcccaacaagctctctaagatcaaggtcgtgagactatcaatagctcaggttctaactgtgatttctcagaatcagagatctgcattgagagaagcatacaagaaaaagaagtacttgcctctcgatttgcgtcccaagaagactcgtgctatcaggcgacgccttaccaagcatcaggcatcattgaagacggagagagagaagaagaaagagatgtatttccctatgagaaagtatgcagttaaggtgtaaagcctaggatttgatcttttcatgcaatttttttgctacttgcgggatgatatggcctattatgtttccactgagcttttgtctaattcctatttgcatcagaatgcaagctgtgataggtgttctttcaaggttgagcagtgaatattgttttccttttacttgtcttgaattacaaccataatctcatgtaatgaatgaattataatattgtggtatcttcatgtggaactcacgtatgaaattattgtactctgattagaaagttggcatttatttttcaactatgatatttcaactgtcaatagttgaacagtatagtcaaacgaattgacttggcaaatgaacttgtaagactagacagttttagttggacacagcgaaaacatgattttttttgaacaaaaaccggggcaaatgaaaataac

SEQ ID NO: 7133 - DNA, 869 bp, Cedrus atlantica
gcaaacatggccaggtttaaggttcacgagctgcgggtcaagagcaaagcagagctcctgaatcaactcaaggagttaaaggcggagcttgctctgcttagggttgctaaagtcacaggaggagcccctaataagctttctaaaatcaaagtggtgaggttatcaattgcacaggtgttgacagtaatatctcaaaatcagaaaacagcgttgagggaagcctacaaaaagaagaagtatttgccccttgacttgcgtcctaagaagacccgcgccatcagacgacgcctcaccaagcaccaggcttcattaaagaccgagagagagaaaaagaaggagatgtacttcccaatgagaaagtatgcagtcaaggtctaaaggctgcagttttttgctagcattatttgttttgcttgttggatacaggagcctaagtgttcagggtcagagcgagtcatctatattagattaatttgggaagcttagattggattcgagttttgttgattgtgcatttgagttgaaattaaaacatgttcacgtttcattgtggtattcaaattcaaaaactcccaagtttgtttgactgtaacatattagggttgattatcctgtattgattttttggagtatagtcattagcgatgtagagatgtttttagtctaacctggtcatgattaaagaaggctgttttaggtatccaatttgcaatattattcaaagtagatctagaagactagaaattgcattcttaagaataattgaaggtgcagtgtttcagctgaaatcctctttggaaaagaaatatcatgaggtacatgagtaatatgaatgggtatcatcctctgcaacctttgaatgcaaagcc

SEQ ID NO: 7134 - DNA, 706 bp, Cenchrus ciliaris
cccgctgccaccgccgcttcgccgccgaaaccgcaaccgtcgccatggcccggatcaaggtgcacgagctcagggggaagaacaaggcggagctgcaggcgcagctcaaggagctcaagtccgagctctccctcctccgcgtcgccaaggtcaccggcggggcacctaacaagctctccaagatcaaggtggtgcgcacctcgatcgcgcgcgtgcatacggtgatctcgcagaagcagaaggcggcgcttcgggaggcgtacaagaagaagaagctgcttcccctcgacctccgccccaagaagacccgtgccattcgccgccgcctcaccaagcaccagctttctctgaagacggagagggaaaagaagcgggagaagtacttccccatgaggaagtatgctatcaaggcctagatcagaactgtgagatgccaagcttagcatatcatcggctgtttctttgccccggaagtgttttatgttttgatttgtatggacatttgctgtgggaaagtatggtgtatttcctctgttatctcaaatgcctagattggtttaaggggcagttcgtattggcactgaaatcttgtttatttgttctgaaaaacgccatgtctgcagttcgatcttgtttatttgttctgaaaaacgccatgtctgcagttcgatccatagaattctgaaagcagattttgtctgaccaa

SEQ ID NO: 7135 - DNA, 644 bp, Chrysanthemum coronarium
taacaatcagagccacctttcttgatcagcggcagcaggagactcaaaaccaaccaaatggctaggattaaggttcatgagttgaggagcaaatcaaaggcggatttgtttgcacagttgaaggatttgaaagctgaacttgctcttcttcgtgttgctggtggtgctcccaacaagctctccaagatcaaagtggtgaggacatcaatcgctcaggtgctgaccgtgatttcacagacccagaagtctgctcttagggaggcatacaagaacaagaagtacttgcctcttgacttacgtccaaagaaaaccagagccatccgcagacgtctcaccaagcaccaggtttctttgaagaccgaaagggagaagaagaaggaaaagtacttcccgttgaggaagtatgctatcaaggcttaagtttgaagctatgaaggatgagatttaggtacttatgtgtgtaaatctctttccagttttgggttttagtttgtgaacggttggtcagaaattcatgtatttgatagttttattgcaatgactgcaagacggtttatgttggagcttgtttcttggtgccgcttacctattcgacttgtattttgaaaggcaatttagagctcttttgctgcttgctttactct

SEQ ID NO: 7136 - DNA, 569 bp, Cleome spinosa
cataaattctccctccgtcccgattagggttttgaactctcggagctaactaactcgaacagccgcggcgggaacagcagtccaataccagcaagctcacgatggcgaggattaaggttcacgagctaagggacaagtcgaagacggatctactgaatcagcttaaggaactcaaggccgagctcgcgctcctccgtgtcgccaaagtcaccggcggcgctcccaacaagctctctaaaatcaaggtggtgaggaaatccattgctcaggtgttgacggtgatttctcagaagcaaaaatctgctctgagagaagcatacaagaacaagaagttcctgccccttgatctccgtcccaagaaaacccgcgctatcaggaggcgccttaccaaacaccaggcgtcgttgaagacggagcgggaaaagaagagagatatgtacttccccttgaggaagtacgctatcaaagtgtaatcaacttggactgcgtttgttttctaatgggaagatgttgggtgttactcttttatgttttttgtcacagacttggaccttttccgcttcggtttg

SEQ ID NO: 7137 - DNA, 681 bp, Echinochloa colona
tcgccatggcccggatcaaggtgcacgagctccgggggaagaacaaggcggagctgcaggcgcagctcaaggagctcaagtccgagctctccctcctccgcgtcgccaaggtcaccggcggagcccccaacaagctctccaagatcaaggtggtgcgcacctcgatcgcccgcgtgctgacggtgatctcccagaagcagaagtcagcgctgcgggaggcgtacaagaagaagaagctgctccccctcgacctccgccccaagaagacccgtgccatccgccgccgcctcactaagcaccagctttctctgaagacggagagggaaaagaagcgtgagaagtacttccccatgaggaaatatgctatcaaggcctaggtcagaactgtgggatgcagatgctaagcttagcatatcgttggctgtttctttccctaggaagtgttttgagttttgatttgtatggacatttgctgtgggttgaaagtacgatgtatttcttctgttacctcaaatgcctagattggtttaagggcagttcgtattggctgtttgtgttaatctgtcatctacagttatgcctagaaaaccatcgttgccactttccaattgtgacatcttaaagtatattagatgagtcatacagtattaagtcatccagtagattgggagcatctctgaa

SEQ ID NO: 7138 - DNA, 681 bp, Echinochloa colona
tcgccatggcccggatcaaggtgcacgagctccgggggaagaacaaggcggagctgcaggcgcagctcaaggagctcaagtccgagctctccctcctccgcgtcgccaaggtcaccggcggagcccccaacaagctctccaagatcaaggtggtgcgcacctcgatcgcgcgcgtgctgacggtgatctcccagaagcagaagtcggcgctcagggaggcgtacaagaagaagaagctcctccccctcgacctccgccccaagaagacccgtgccatccgccgccgcctcactaagcaccagctttctctgaagacggagagggaaaagaagcgtgagaagtacttccccatgaggaagtatgctatcaaggcctaggtcagaactgtgggatgcagatgctaagcttagcatatcgttggctgtttctttccctaggaagtgttttgagttttgatttgtatggacatttgctgtgggttgaaagtacgatgtatttcttctgttacctcaaatgcctagattggtttaagggcagttcgtattggctgtttgtgtgaatctgtcatctacagttatgcctagaaaaccatcgttgccacttcccaattgtgacatcttaaagtatattagatgagccatacagtgttaagtcatccagtagattgggagcatctctgaa

SEQ ID NO: 7139 - DNA, 679 bp, Euonymus alatus
aagacataagaggtgagccaaggggattgcagagatacactagagtttttaagaccgtagaacagacggagaggcagccatggcgaggatcaaggtacacgagctgaggaacaaatccaagacggagctgttgaaccagttgaaagatctgaaagcagagcttgctctcctccgcgtggccaaggttaccggtggtgcccccaacaagctatccaagattaaggtcgtgaggctgtcaatagcgcaggtgttgacggtgatttcgcagacgcaaaaggccgcattgagagaagcctacaagaataagaaatacatgcctctcgatctccgacccaagaagaccagagctatccgtagacgcctcactaagcaccaggcatctctaaagacagaacgccaaaagaagcgccagatgtatttcccaacgaggaaatatgctatcaaggtgtaagattgaatcaactcgagaaggaagttgtggtatttgattcatcaagttccataggaaggaggcctctttcttcttttttttttcgaatttcgcgttgtttaatttttagattttgcatgttttatcctcatcaaactcggattatgaatgaatttttggtagtccagcatttatcgtgttggcatttgattacataacttccccttggccttggatggtcaatttagc

SEQ ID NO: 7140 - DNA, 720 bp, Festuca arundinacea
ccgccgccgctagaccagctcgccgtccgcaatggcccgcatcaaggtgtacgagctgcgggggaagaacaaggcggagctccagggtcagctcaaggacctcaaggcggagctctccctactccgcgtcgccaaggtcaccggtggcgcccccaacaagctctccaagatcaaggtcgtccgcacctcgatcgcgagggtgcacacggtgatctcgcagaagcagaagtctgcgctgcgtgaggcgtacaagaacaagaagtatctcccgaccgacctccgccccaagaagacccgtgccatccgcaggcgtctcaccaagcaccagctctctttgaaaaccgagagggagaagaagcgtgagaagtacttccccatgaggaagtatgctatcaaggcctaggttaggagcccatgtttcagcggttaagttttgcccagaagttgcctgaattctatgttctgtgtggactcccctgtcacctaagtactatgtatttggtctactccatgagatgtcaacgtttgcttattaaaactatattgatctggttatagctgcttgttgatgttggaatgtgatggttatcgtaatttgttagtttttagttcatctgaatgtggaattaaggttaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 7141 - DNA, 682 bp, Festuca arundinacea
agtggtatcaacgcagagtacgggggggcctcattttcttctctccgcccgccgccgctagaccatctcgccgaccgcaatggcccgcgtcaaggtgcacgaggtgcgggagaagaacaaggcggagctccagggccagctcaaggacctgaaggcggagctctccctcctccgcgtcgccaaggtcaccggaggcgcccccaacaagctctccaagatcaaggtggtccgcacctcgatcgcgagggtgcacacggtgatctcgcagaagcagaagtctgcgctgcgtgaggcgtacaagaataacaagtatctcccgctcgacctccgcgccaagaagacccgcgccatccgcaggcgtctcaccaagcaccagcaatctttgaagaccgagagggagaagaagcgtgagaagtacttccccatgaggaagtatgctatcaaggcctaggttaggagcccatgtttcagcggttatgttttgcccagaagttgcctgaattttatgttctgtgtggactcccctgtcacctaagtactatgtatttggtatactccatgagatgtcaacgtttgcttgttagcactattgatctggttatacctgcttgttgatgttggaatgtgatgattatacgtaaaaaaaagaaaaaaaacaaaggtactctgcgttgataccact

SEQ ID NO: 7142 - DNA, 484 bp, Setaria italica
gccgccgcctgcactcttcccttcgcgcaccgctccaccccaccccgccgccaccgccgcttcgccgccggaaccgccaccgtcgccatggcccggatcaaggtgcacgagctccgggggaagaacaaggcggagctgcaggggcagctcaaggagctcaagtccgagctctccctcctccgcgtcgccaaggtcaccggcggggcacccaacaagctctccaagatcaaggtggtgcgcacctcgatcgcgcgcgtgctgacggtgatctcgcagaagcagaaagcggcgctgcgtgaggcgtacaagaagaagaagctgctccccctcgacctccgccccaagaagacccgtgccatccgccgccgcctcaccaagcaccagctttctctgaagacggagagggaaaagaagcgtgagaagtacttccccatgaggaagtatgctatcaaggcctaggtcagaactgtgagatgctaagctt

SEQ ID NO: 7143 - DNA, 547 bp, Gerbera hybrid cultivar
acagcaacggttcaagcgatccttcattgcagttcgcttaagcttcaatcaatggctcgtatcaaggttcatgagcttaggagcaaatcgaaggttgatttgtttgctcagttgaaggatctgaaggctgagcttgctcttctccgattcttcaaagttaccggtggtgctccgaacaagctctccaagatcaaagttgtgaggacatcaatcgctcaggtgctgactgtgatttcacagactcagaagtctgctcttagggaagcttacaagaacaagaagtatttgcctcttgatttgcgtcccaagaaaaccagagccatccgtagacgtcttaccaagcatcaggcttcgttgaagaccgaaagggagaagaagaaggagaagtactttccattgaggaagtatgccatcaaagtgtaaggcctaaactataaaagaagagatttaggtttttacgactttagtttgtgtacgatttttcggaaatcgtgtatttgatggtttctactttctgtttgcaacgagttacatgacaagtaacaac

SEQ ID NO: 7144 - DNA, 489 bp, Zingiber officinale
agcgagcgcaacgaaggagaggcgattcggttgcgatggcgcggattaaggtccacgagcttcgggggaagaccaagacggaactccagaatcaactgaaggacctcaagaatgagctctccctcctccgcgtcgctaaggtcactggcggcgcgcctaacaagctctctaagataaaggtcgttaggctgtcgatcgctcgtgtgcttactgtcatctcgcagaaacagaaagcggcgttgagggaggcttacaagcataagaagctccttccgctggatctccgccccaagaagacgcgggccatccgccgtcgactcaccaagcatcaggagtccttgaagactgaacgtgagaagaaaagggaaaggtacttccctcagaggaaatatgctatcatggcttagaggttaatgttctatgatttctattctaccatttaaggttttgttgtctttgaaaaattaatgatcaggtttttgtacctgc

SEQ ID NO: 7145 - DNA, 672 bp, Panax ginseng
aagcagtggtatcaacgcagagtacgcgggggaggaagggaggagataccccagagagagagagagattgaaaatcgaaatggcgaggatcaaagttcacgaactgaggcaaaagtccaaggctgatctattggcacaattgaatgaactcaaatctgagctttctctcctccgtgtcgctaaggtcaccggcggtgctgctaacaagctctccaagataaaagttgtgaggcaatctatagcgcaggtatcgacggtgatgtcacagaagcagaaggcggttttgagagaagcttacaagaataagaagtatttgccccttgatcttcgtcccaagaagaccagagccatccgcaggcgcctcactaagcatcaggcgtctctaaagacagaacgggaaaagaagaaggagatgtactttccaccgaggaagtatgccatcaaggtttaatatgtttgatttatccagagttagtttggtgtttctagcgtctaattaaggatgagagatgttaactgtttcttccgtacaatttatctagtttctgttacccttgatatataatggaaacatatttggagcttcattcttgttaaaattcatttccactggatgagaaacaatcctgctttgtttttcaatattttgagtgaatgttgatttgcttgata

SEQ ID NO: 7146 - DNA, 694 bp, Carpinus betulus
atgggataaaagctcaaagcgctgctcattcccatctctagggttttcagacggcaacgaggagtcgggagcagctgcgttgtttgttcagaatggcgaggatcaaggtccacgagttgaggaacaagtcaaaggcggagctactgggtcagttgaaggatctcaaggcggagctcgctctcctccgtgtcgctaaggtcaccggtggtgctcccaacaagctctccaagataaaggttgtgaggctgggaatagcccaggttttgactgtgatatcacagaaacagaaggaggcgcttagggaggtctacaagaagaagaagtatattcctctcgatcttcgtcccaagaaaactcgagccattcgtagacgcctcaccaagcatcagctatctttgaagacagagcgtgagaagaagaaggagatgtactacccgttgaggaagtatgctatcaaagtgtaggctagggtctactgctcttaaggttcattttaaggacgtgtgacattatttttagttgcaaccatgcaaggtctatttgtctgttattgggtttgaaccatctagcttgaagtttttaatatgagattgtttttgcttcgaaacttgtggttgatttctcctttaaggatatgtttgttttaggattatgcattggttttatgacaggttgggtcaacctgttcaacccg

SEQ ID NO: 7147 - DNA, 564 bp, Liriodendron tulipifera
gtcattctcatattctttcaatggcgaggatcaaggtccatgagctccggaccaagtccaagactgaccttcttagccagctcaaggagctgaaggccgagctggcattgctgcgagtggccaaggttactgggggtgctcccaacaagctttccaagattaaggtggtcaggctctccattgctcgtgtgctcactgttatctcccagaagcaaaaagctgccttaagggaagcctacagcaagaagaagttcctgccgttggatttgcgacctaagaagacccgtgctatcaggcgccgtcttacaaagcatcagcaatcactgaagacagagagggagaagaagagagaaatgtacttcccgaagaggaaatatgctatcaaggtctgagattgcaagatcactgttgcaggtgagcctacatttttgttttttcagttagagaaattcagtttgggagcctttgaagctcaagatatttcatctagacttctgttctttattcaaagtagtgttggattaaatgcctttgcagacatgtgaaaggagtgtgtgtttattt

SEQ ID NO: 7148 - DNA, 718 bp, Lotus japonicus
ggtggggaagaacgcagaacagagaaatccagtgttttcgcggcgacacagcaccgaagctttcccaatggcgagaatcaaggtgtacgagctcaggaacaaatcgaaagcagagcttctgaaccaattgcaggagctgaaagcggaactcgctctcctccgtgtcgctaaggtcaccggcggagccccaaataagctctccaaaatcaaagtggttcggctttcgattgcgcaggtgttgacggtgatttcgcagaagcaaaaggctgctttgagggaagcttataagaacaagaagtatcttcctttggatttgcgtcctaagaagactagagccatcagaaggcgtctcacgaagcaccaggcatctttgaagacagagcgtgagaagaagaaggaactatacttcccactgagaaaatatgcagttaaggtgtaatattgcctcgaagtttggatgatattttgatgtcatctttttgttatttaacatggttttccgaaatattttggacttctcatattctatttttgtttcctttaaaatttaaccaatcatcatgaaactgagttataaacaagctttgaaagaggtattcttttatttcaatggcacaccatttatttgtgacttggacaaattgaaacaagctattgttagtcaaataccgtaagatggaactcatgtatccgaaaatatatgactaaattttgttcg

SEQ ID NO: 7149 - DNA, 1174 bp, Lupinus angustifolius
atcaaagcttcagattagggtttctaacacagaagctgcagaatcctcgtgaattcaacaatggcaaggatcaaggtttacgagttgaggcagaagaccaaagctgagttgttgaatcagctcaaggatctcaaggccgaactcgctttgcttcgagttgctaaggtcactggtggagcccccaacaagctttccaaaatcaaagtggtgaggttgaacattgctcaggttttgaccgtgatttctcagaagcagaaatctgcattgagggaggcttataagaacaaaaagtatttgcctcttgatctgcgcccaaagaagaccagggctattcgtagaaggcttaccaagcaccagcaatcattgaagaccgagcgtgagaagaagagagaaatatatttcccactgaggaaatttgccatcaaggtgtaagttttggttcatttcttcatagttgatgagttttggttcatttcaacttgtagtttcatgtttgttattggatgtgttaaatttcatgtcttcagacccgtggttctctttaagctactagtttttatttttatttttgatgaagtgatagtctataagtggttttaaaagttcaaagttgatcaatccatttagcttttgcttttacacttatttcaaacttgtaatctcattttggaaggatccttctacctgtctgcatcattgttccttaattctgtgtttgaggaattggttaatcacatgcaaaaatagctgtgatagtgaccatatgcaaagtgtatgcattcttcgtttcaaggtctggtataaccaagtcttatttcttgaccataaacaagttgctttattccgcaaatgatatatggggttaacttaactaaacaattgaacaaaattctaactttgatctaaacatatggaagcaactaggaaaaaaagataataaatttaggaaattgagcaggaccaaagcaagagaacctgagagggtggtgacggaatagacaggaccatggaggccaccgatggtgaccctcagcaccactggccatggccctccagttggaatcatcatcaccgtgtggtaacaatgatgccatgcttgtcatacgagtttcccaatccaacgttgaatctctccctcttatgtttttgttttaacatgtcttgaatctctccc

SEQ ID NO: 7150 - DNA, 616 bp, Lupinus angustifolius
agagcttgacactagggtttgtagcgaagagaggccgcagaagctcgtgaattcagcaatggcgaggatcaaggtttacgagttgaggcagaagacaaaagctgagttgttgaatcagctcaaggatctaaaaaccgagctttctttgctccgtgttgctaaggtcactggtggagcccccaacaagctctccaagatcaaagtggtgaggttgaatattgcacaggttttgaccgtgatttcacagaagcagaaatctgcattgagggaagcttataagaacaagaagtacttgcctcttgatctgcgcccaaagaagaccagggctattcgcagaaggctcaccaagcatcagcaatcattgaagaccgagcgtgagaagaagagagaaatatattttccattgaggaagtttgctatcaaggtgtaagaatagtgcaatcttgtttattgatggaaacttatcatagttgaagagttatgatacattccaacttggtgttattggttgctttaaatttcatgatttcagacctgtggatctctctttaagctactagggttttatttttttggagtgatagtctatgtggatttcaatgcattaaaaaaattt

SEQ ID NO: 7151 - DNA, 742 bp, Zea mays
tcccctcgcgcaccgctcctgagtcctgtccaccctgccaccgccgacgccgcgccgccgcagcaattgtcaccgtcgctatggcccgtatcaaggtgcacgagctccgggggaagagcaagacggacctgcaggcgcagctcaaggagctgaagtctgagctctccctcctccgcgtagccaaggtcaccggcggcgcacccaacaagctctccaagatcaaggtggtgcgcacctcgatcgcgcgcgtgctcacagtgatctcgcagaagcagaagtcggcgttgcgggaggcgtacaagaagaagaacctgctccccctcgacctccgccctaagaagacccgtgccatccgccgccgtctgaccaagcaccagctctctctgaagaccgagagggaaaagaagcgtgagaagtacttccccatgaggaagtatgctatcaaggcctaggtcagaactgtgagatgctgcgcttagcatatcatcggctgtgttttaatttttggtttgtatggacatttgctgtgggtcggaagtacgatgtattcctccatttccataaatggctaaattggtttgactggcaattcgtattggcgttcatatttggtggcaacttttctttgtattcttctaaactagatgtttgctgttcattatatttgtgtgaccgttgctcatggtatgtactccgtcccagaaacagaagttgagccgaggctcgacagtactggagtgtt

SEQ ID NO: 7152 - DNA, 672 bp, Avena sativa
gtctttggcaccgccgccgtatcatcctctcgccgccgcagcagctgccgcctcttcgctaacaatcgttgccatggcacggatcaaggtgcacgagcttcgcgggaagaacaaggcggagcttcaggggcagctcaaggacctcaaggcggagctatccctcctccgcgtcgccaaggtcaccggcggagcgcccaacaagctctctaagatcaaggtggtgcgcacgtcgatagcgcgcgtcctgaccgtgatctcgcagaaacagaagtctgcgctgcgggaggcgtataagaacaagaatctgctccccctcgacctccgtcccaagaagacccgcgccatccgccgccgcctcaccaaacaccagctttctcttaagacggagagggagaggaagcgcgagaagtatttccccatgaggaagtatgccatcaaggcttagttcacgcaacatgaaatgtgtttagcacagtatcggataatttatttgcctgggagttcgttgaaccttgatgttatcgtgtatggacgtcccttgtggtttaagttcaatgtgatgacccattttctcaaatacctagtttgatttaagcactaatatgttgactttgatatctaattttgttgacaactcttcgatttgaatgtctcatccgcgatgctagttcc

SEQ ID NO: 7153 - DNA, 637 bp, Avena sativa
caccgccgccgtatcatcctctcgccgccgcagcagctgccgcctcttcgctaccaatcgttgccatggcacggatcaaggtgcacgagcttcgcgggaagaacaaggcggagcttcaggggcagctcaaggacctcaaggcggagctatccctcctccgcgtcgccaaggtcaccggcggagcgcccaacaagctctctaagatcaaggtggtgcgcacgtcgatagcgcgcgtcctgaccgtgatctcgcagaaacagaagtctgccctgcgggaggcgtataagaacaagaatctgctccccctcgacctccgtcccaagaagacccgcgccatccgccgccgcctcaccaaacaccagctttctcttaagacggagagggagaggaagcgcgagaagtatttccccatgaggaagtatgccatcaaggcttagttcaggcaacatgaaatgtgtttagcacagtatcggataatttatttgcctgggagttcgttgaactttgatgttatcgtgtatggacttcccttgtggtttaagttcaatgtgatgacccattttctcaaatacctagtttggtttaagcactaatatgttgactttgatatctaattttgttgacaactcttcgatct

SEQ ID NO: 7154 - DNA, 646 bp, Avena sativa
cagcaacttcatcccctccctgtcgccgccgccagcgtatcatctcccctgccgccgccgctgcctcttcgccgccaatcgttgccatggcacggatcaaggtgcacgagcttcgtgggaagaacaaggctgagcttcaggcgcagctcaaggacctcaaggcggagctgtccctcctccgcgtcgccaaggtcaccggcggagcgcccaacaagctctccaagatcaaggtggtgcgcacatccgtggcgcgcgtcctgacggtgatctcgcagaaacagaaggctgcgctgcgggaggcgtacaagaacaagcggctcccgctcgacctccgtaccaagaagacccgcgccatccgccgccgccttaccaaacaccagctttctctcaagacggagagggaaaagaagcgcgagaagtatttccccatcaggaagtatgccatcaaggcttagttaagcaacatgagatgtgtttagcacagttttggagaatttcttcgcctgggagttcgttggaccttgatattatcgtgtatggacgccccctgtggtttaagttcgatatgatgacctactttgttaaatgcgtttggtttaagtacttatttcatgttgccatggttatatgaagttgatatcttctc

SEQ ID NO: 7155 - DNA, 642 bp, Avena sativa
acttcatcccctccctgtcgccgccgccagcgtatcatctcccctgccgccgccgctgcctctacgctgccagtcgtcgccatggcacggatcaaggtgcacgagcttcgcgggaagaacaaggctgagctccaggcgcagctcaaggacctcaaggcggagctgtccctcctccgcgtcgccaaggtcaccggcggagcgcccaacaagctctccaagatcaaggtggtgcgcacatccgtggcgcgcgtcctgacggtgatctcgcagaaacagaaggctgcgctgcgggaggcgtacaagaacaagcggctcccgctcgacctccgtaccaagaagacccgcgccatccgccgccgccttaccaaacaccagctttctctcaagacggagagggaaaagaagcgcgagaagtatttccccatcaggaagtatgccatcaaggcttagttaagcaacatgagatgtgtttagcacagttttggagtaatttcttcgcctgggagttcgttggaccttgatattatcgtgtatggacgccccctgtggtttaagttcgatatgatgacctactttgttaaatgcgtttggtttaagtacttatttcatgttgccatggttatatgaagttgatatcttctc

SEQ ID NO: 7156 - DNA, 693 bp, Avena sativa
ccctccagactataaccctccgcagcaacttcatcccctccctgtcgccgccgccagcgtatcatctcccctgccgccgccgctgcctcttcgctgccaatcgttgccatggcacggatcaaggtgcacgagcttcgcgggaagaacaaggcggagcttcaggggcagctcaaggacctcaaggcggagctatccctcctccgcgtcgccaaggtcaccggcggagcgcccaacaagctctctaagatcaaggtggtgcgcacgtcgatagcgcgcgtcctgaccgtgatatcgcagaaacagaagtctgcgctgcgggaggcgtataagaacaagaatctgctccccctcgacctccgtcccaagaagacccgcgccatccgccgccgcctcaccaaacaccagctttctcttaagacggagagggagaggaagcgcgagaagtatttccccatgaggaagtatgccatcaaggcttagttcacgcaacatgaaatgtgtttagcacagtatcggataatttatttgcctgggagttcgttgaaccttgatgttatcgtgtatggacgtcccttgtggtttaagttcaatgtgatgacaaatcttgtcaaatgcctagtttggtttaagcacttcttgcatgttgacgttgattatctaaatttttgacatcttctcttctatttgaatgtc

SEQ ID NO: 7157 - DNA, 540 bp, Avena sativa
ctgccgccgccgctgcctctacgctgccagtcgtcgccatggcacggatcaaggtgcacgagcttcgcgggaagaacaaggctgagctccaggcgcagctcaaggacctcaaggcggagctgtccctcctccgcgtcgccaaggtcaccggcggagcgcccaacaagctctccaagatcaaggtggtgcgcacatccgtagcgcgcgtcctgacggtgatctcgcagaaacagaaggctgcgctgcgggaggcgtacaagaacaagcggctcccgctcgacctccgtaccaagaagacccgcgccatccgccgccgccttaccaaacaccagctttccctcaagacggagagggaaaagaagcgcgagaagtatttccccatcaggaagtatgccatcaaggcttagttatgcaacatgagatgtgtttagcacagtttcggataatttattcacctgggagttcgttgaacctttgataaaccttgatatttattatcgtgtatggacgccccttgtggtttaagttcactgtgatgac

SEQ ID NO: 7158 - DNA, 745 bp, Ananas comosus
tggcccacgacgacacgcgaagctagggttttctccggggcgctagggtttatttaagctcttcctacgccgccgcccatttcttcgagccattctcctccacccgcgtcgcgccgatcccctaccaattcgcatcgccatggcgaggatcaaggtccacgagctccgggggaagacgaaggcggagctcctcgcccagttgaaggatctcaaggcggagctctccctcctccgcgtcgccaaggtcaccggtggcgcccccaacaagctctccaagataaaggtggtgagggtttcgatcgcgagggtgttgacggtgatctcgcagaagcaaaaggcggcgctgcgggaggcatacaagaagaaaaagtcccagccgctcgatctcaggcccaaaaagactcacgccatccgactccgcctcaccaaacaccaggcgtctttgaagacggaacgagagaagaagagggagaagtattttcccatgaggaagtatgcaatcaaagcatgaaaagagtaggagtatttgatgttcttagctggaattcgacgcttttagttatatcagttgcattttattgtaatatttgctctgttggttagtgtgaacttatcaccaaattgcgtttcttcattatggattgaaacagcagcttttagatgcttgaatttctgcatgtctgtagcatcattttgttggattcacaaagatggcatgtagttaagcagtcctaatacaatttgc

SEQ ID NO: 7159 - DNA, 824 bp, Oryza sativa
aagcctccgccgccgcctcctcacctcttccccttcctagcaccgccgccgccgccgccgccgccgccgcccgccgcgccgcctccgtcgccatggcccggatcaaggtcgacgagctacgggggaagaacaaggcggagctgcaggcccagctcaaggacctcaaggcggagctctccctcctccgcgtcgccaaggtcaccggcggcgcccccaacaagctctccaagatcaaggtggtgcgcacgtcgatcgcgcgggtgctgacggtgatctcgcagaagcagagggcggcgctgcgtgaggcgtacaagaagaagagcctcctccccctcgacctccgccccaagaagacccgcgccatccgccgccgcctcaccaagcaccagctttcgctgaagacggagagggaaaagaagcgcgagaagtatttccccatgaggaagtatgccatcaaggcgtaggtcagggaacatgagagaatgttatgtttagcacatcactcagtcaatttatctgccctcgagttccttgaattttgatgttatcatgtatggacatgccttgtggtcaagtacaatgtgacgggggtttgagtacttgcatgctaacattgatatatctaatctcatatcgtcgtcttcggttaacttggttaatacgaattatgtggtgtgctgaactgaatgtggtgcttttgcatggtggttgtcgttatgaaatttgtagagcggttaaacaaactatcagtttggaacagcttgcagggttcaaatagtcagatgaaaggagaaatggtagcaggatgctactatggtacgagc

SEQ ID NO: 7160 - DNA, 585 bp, Carthamus tinctorius
gttttgggactagggtttcagaggcagcctccgtcgcggtttgattctgcttccgatcagacgatatcgatggctcggatcaaggttcatgagcttaggggcaaatccaaggccgatttgtttgctcagttggaggatcttaaagccgagcttgctcttctccgtgtcgccaaagtcaccggtggtgcgccaaacaagctctccaagattaaggtggtgaggacatcgattgcacaggtgctgactgtgatttcacagacccagaagtctatgcttagggaagcttacaagaagaagaagtatctacctcttgacctgcgtcccaagaagacaagagccatccgcaggcgtctaaccaagcatcaggcttcgttgaagacagagcgagagaagaagaaagagaagtacttcccgttgaggaagtatgcaattaaggcgtaggtagaaactattgaggtggaaacgtaggtgtgttacttcctttcccatttttgaattttggatttgtgtacggttttatcagaatttgatgtttttaaaaaggctgccagtgtttcattaaacatcggatcttgctttgacaaa

SEQ ID NO: 7161 - DNA, 720 bp, Silene vulgaris
cacagcatttaagccccatattattgtacatttcccagagctagggttgaacaacatccacgccgccgtttcaaagtctcacactctctgcatcaatcgaaagcaacaaagatggcaagaatcaaggtgcatgagttaagggagaaatcaaaggttgacttacagacccaactcaaggaactcaaggctgagcttgcccttcttcgtgttgctaaggtcactggtggtgcccctaacaaactctccaagattaagatagtgaggttgggaattgcacaagtgttgacagtcatatcacagaaacagaaggccgctttgagggaagcatacaagaacaagaagtatctaccacttgatcttcgtcccaagaagactcgtgccatccgtaggcgtctcaccaagcaccaggcatcgttgaagaccgagagggaaaagaagaaggaaatgtactacccgttgaggaagtacgccatcaaggtgtaggatggatgccatatttaggactttttgcatggtttttatttctattttcaacatgaagtttgttcgaagattgatgttatgtttctttgataaggacatttgccagttcatttccgttatctgtgattgttaaaatcatgttttggtctatcttcccgatctgctcatttgaaagacttgggttaaaagttagggactgcggagttctcttttctgtgagctcttaaggcgggattt

SEQ ID NO: 7162 - DNA, 2217 bp, Panicum virgatum
gtcccactctcctctccctctgttatatatattccttgcccgccgccacccgtcctcttcccttcgctcaccgctccaccccacgccgccgcttcgccgccgcagccgccaccgtcgccatggcccggatcaaggtgcacgagctccgggggaagaacaaggcggagttgcaggcgcagctcaaggagttcaagtccgagctctccctcctccgcgtggccaaggtcaccggcggagcccccaacaagctctccaagatcaaggtggtgcgcacctcgatcgcgcgcgtgctgacggtgatctcgcagaagcagaaggcggcgctgcgggaggcgtacaagaagaagaagctgctccccctcgacctccgccccaagaagacccgtgccatccgccgccgcctcaccaagcaccagctttctctgaagacggagagggaaaagaagcgtgagaagtacttccccatgaggaagtatgctatcaaggcctaggtcagaactgtgagatgtttctagcatattgtgggctgtttctttgcctaggaagtgttttaagttttgggttttatggacctttgctatgggttgaaactacggtacaattcctcggttacctcaaatacctagatgggtttaaggggcaattcgtattggcaatgaaaccttgcatgcttgttgtgatatggtcctttctacagttgtatcgccagacgatgatttttgtgtaggcctgctggatgcattgtgacagacttagacaagttatagattccttttagtttcaactttagtgatatctccatgtaacttgtcgacaattcagtttacagataactgaaagcaaacaaacatatactacaaatgcatgacccccggccccactgatcttgaaaggattttagcataacccattcaggagagctaagtgacttgcaaaagtgagcttatcagcttacaaacaggggttacaataggttggcagaggttgaaaagtaaaatcaacatttgcagtaaactaaaagtaatccatttcaccgaaacatgtaaattaaaagaaagcgagcaagaaagctttgcaaatgtcattcatgatgcaccaacgtatctggattgttcgactccatgtgcaaccagccagcatgacaccggcgagagcgctgcagcaccaccctccctgctcttcgtgggcgttgaattccagcttgagcttgtggaggcagggcatcgttgacggtgctctctctgtgggggcgcccccgatcgacaggtcgaggtggacaagggcgggcagccctgcgaggacggcgacgccgtccctggatagctccccgacgccgagctccaagctgtacactggggaaccacgcctccgatgatgttgtgggtcgaaccccctgatcctgatctcctgcgaattattttctaccacggtgaggaaattctcctctgcagagtacttacggatgatgcataagatcaagcatcatgtcgtgcactctgcacgacagaatctcgccattgtagtcagtcgttactggttgaatcatgcttctgtttaccagctccttgaaactgctgtctgcgacgccgacggcctccagaaaaccttcagctacccattgcctcaggccagaccacagaatcttctgggtgtgcgccaagatacagaaagcatgtcttgagatgaggaggaaggtttttgtagctaaggtttagaatttgtctaatcacctccaaccgatctgtgccgacattggagcctatggaattctgcacatactcccaatcttcctccactttggttgcctggctagctaaaaggctagagatagtctcccacgcactaattcgcgagcgagtttgatgaatggggttgtgaatcacattctcattcctcaggcttttgtttaattggttcaaggaatgaaatggattgatacatcgccgactcacacctcacaagtcacaatcacatggttagcttatcaattaggaatgggttcatcctataaaaattatgggagaaacttatgatggaccattcaattccagatgagaagattcctgaaaccaaacaattaattatatagtttatgtgtcaagcagtgttggtaggagatcctcgtcccccgcgtcgcctcccgctagggcgactcggacggcgcccccaaaccctcaccgccgccacccccatcccccgcctctcctcgccgtcgcc

SEQ ID NO: 7163 - DNA, 763 bp, Panicum virgatum
tcggcccaggagcccaccaaacaggcctagggtttcctcgctcccacggggttttagcacccacatatataagccgcaagccgccgcctccctacccgcttcgacctccatttttcatcccctcacccgccgccgccgccggaagcccggctcgctaatcgccatggcccggatcaaggtgcacgagctgcgggggaagaacaaggcggagctgcaggcgcagctcaaggagttcaagtcggagctctccctcctccgcgtcgccaaggtcaccggcggcgcccccaacaagctctccaagatcaaggtggtgcgcacctccatcgcgcgcgtgctcaccgtgatctcgcagaagcagaaggcggcgctgcgggaggcgtacaagaaaaagaagctgctcccgctcgacctccgccccaagaagacccgcgccatccgcaggcgcctcaccaagcaccagctctctttgaagaccgagagggagaagaagcgtgagaagtatttccccatgaggaagtatgctatcaaggcctagattagtgaaagtgaacatgttttacccttgtcaagttttgccgagaagttaccagaatttgatgtatcgcacatctattgtcatctaagtacaatgtagctgatcaactatgtgatgaaaatgtgtactatttgcttggtaacatatgctggctattgttagttttgcttccacttgattctcgtctgctttactgcagcttgatatttgaatctctgttttgaagat

SEQ ID NO: 7164 - DNA, 1008 bp, Panicum virgatum
ccgctccaccctaccccccccccccccgcccgccgcccccgcctgccgccgcaaccgccatcgtcgccatggcccggatcaaggtgcacgagctccgggtgaagaacaaggcggagctgcaggcgcagctcaaggagttcaagtccgagctctccctcctccgcgtggccaaggtcaccggcggagcccccaacaagctctccaagatcaaggtggtgcgcacctcgatcgcgcgcgtgctgacggtgatctcgcagaagcagaaggcggcgctgcgggaggcgtacaagacgaagaagcggctccccctcgacctccgccccaagaagacccgtgccatccgccgccgcctcaccaagcaccagctttctctgaagacagagagggaaaagaagcgtgagaagtacttccccatgaggaagtatgctatcaaggcctaggtcagaactgtgagatgttcctagcatatcatgggctgtttctttgcctaggaagtgttttaagttttggtttgtatggacctttgctatgtgttgaaagtatggtacatttcctctgttgcctcaaatacctagatgggtttaaggcgtaattcgtattggcaatgaaacctggcatgcttggtgtgatatggtcctgtctacagttgtattgccagatgctggcgatgatttttgcgtaggcctgaagaacgcattatggcagattttctcttctctggttacaaactacttcggaatcacagtagcttcaggtgtaggcaagccatacaataggtctttgacaagttatagatcccttttagtttcaactttagtgatatctccatgtaacttgtctgacaattcagttaacagaaaactgaatgatttacaaaagtgagcttgcatgcagggactagcagaggttgaaaaagtaaaaaatcaacatttgcagtaaactgaaagtaaccatttgaccgaaacaacatgtaaattgaaagaaagcgagcaagaaagcattgcgaat

SEQ ID NO: 7165 - DNA, 830 bp, Panicum virgatum
cgccgctggaagcccggctcgctaatcgccatggcccggatcaaggtgccagagctgcgggcgaagaacaaggcggagctgcaggcacagctcaaggagttcaagtcggagctctccctcctccgcgttgccaaggtcaccggcggcgcccccaacaagctctccaagatcaaggtggtgcgcacctccatcgcgcgcgtgctcaccgtgatctcgcagaagcagaaggcggcgctgcgggaggcgtacaagaacaagaagctgctcccgctcgacctccgccccaagaagacccgcgccatccgcaggcgcctcaccaagcaccagctctctttgaagactgagagggagaagaagcgggagaagtatttccccatgaggaagtatgctatcaaggcctagattagtgaaagtgaacatgtttacccttgtcaagttttgcccagaagttaccagaatttgatgtatcgcacatctattgtcatctaagtacaatgtagctgatcaactgcgtgatgaaaaatgtgtactctttgcttggtagaatatgctggccattgttagttttgcttccacttgatcctcgtcagctttgctgtagcttgatatttgaatctatgttttcaagattactcatttgggccttgtctagatcccttgctcgttatggcttaaacagttatccttgcacatgggtattggtaatgcttgcagcgaccatacctcccagattcagcctttcactattggtcccaatgctggtattgtgacctgttctgcttttgttctcctgcttttccttaataataaacacaatctactttcttaaa

SEQ ID NO: 7166 - DNA, 786 bp, Taxus baccata
gggctctccattagatttgcagtaggagttgaaggggtttacgccgaagtcatatcgtaatggcgaggatcaaggttcatgagctacgcactaaggggaagactgaattgctgaatcagttgaaggagcttaaggccgagttggccctgcttagggtcgctaaagttactggaggagctcccaataagctatccaaaattaaggtggtcaggaaatcgatagctcaggttctgactgtgatatcacagacccagaaagctgcattgagggaagcattcaagaagaagaagtacatgcctctcgatctgcgcccaaagaagactcgtgccatcaggcgacgtctcaccaagcaccaggcttctttgaagacagagagggagaagaaaaaggaaaagtatttccccatgagaaagtatgcaattaaggtctagagattaggattgcttaggtctagaagagattatttctcaatgagagttctttctgcacaattgttctacatgaactgtagaataccccattacatttccatgggctttttgtgaggtcaaattgagtttgtgataaagagagttttcaatgttaagaactatatttatgtctgatttggcaatacgataaaatgtttcggtgaatgtcggtttcagttgctatcacaatatttttttcttcaggggcctagattttcctgattgtaatgcatctctctttaactgatttttttccagtataaattggtgtttcacatcttaattattaatcactgatctggtagcattcatgttg

SEQ ID NO: 7167 - DNA, 690 bp, Eutrema halophilum
ttcacaaaaggcatcgtataaattgccttcttcctccaaattaggcttgcgagccagaaacgaggaagtagcggcgcagcaagttcaacaccagcaagctcacgatggcgaggattaaggttcacgagcttagagagaaatcgaagaccgatcttcagaaccagttgaaagatttcaagaatgagctcgccctcctccgtgtcgctaaagtcaccggaggtgcccctaacaagctctccaaaatcaaggttgtgaggaaatccattgctcaggtgttgacagtgatctcacagaagcagaaatttgctctaagagaagcatacaagaacaagaagttgttgcctcttgatctccgccccaagaaaacacgtgctatccgcagacgtcttaccaagcatcaggcttcgttaaagacagagcgtgagaagaagaaggagatgtatttcccagtgcgaaagtacgctatcaaagtctagtttcattctccagattagctcctagaaatgattcagctttttgattactcctttatgtattctcttccgttttgtccaccttttatttctatttgtactcaagttttgttatagaactgccaaatctccctctctcgcgaacctttttttcttcataaatattgaaccaagtctcgcttttgtggtttcttcgtatcaaattcgacaaattcgt

SEQ ID NO: 7168 - DNA, 636 bp, Eutrema halophilum
ctgattctctgagtagcagcggcgcagcagttgaacacgagtcaagctcacgatggcgaggattaaggttcacgaactcagggacaagtcgaagagcgatctacagaaccagcttaaggatcttaaggctgagctcgctctcctccgtgttgccaaagtcaccggaggtgctcccaacaagctctctaaaatcaaggtcgtccgtaaatccatagctcaggtgttgacagtgacctctcaaaagcagaaatctgctcttagagaagcatacaagaacaagaagttccttcctcttgatctccgtcccaagaaaacccgtgctatccgcagacgcctcaccaaacatcagctctcgttgaagacagagcgtgagaagaagaaagaaatgtatttcccagtaaggaagtacgctatcaaagtttaatctccatcctttcaatctagctactagaaactgtttcagcttttgtttttgatggaaacttgtttttgctcttcacttgcgctattgtgtgtcaaacagtttcagatacatggattttgcttcctttttataatttgtctttttcttgttcaccagaaataaacctaaatcgctatcttcttgatattctagccattattctacttgacact

SEQ ID NO: 7169 - DNA, 663 bp, Eutrema halophilum
gtcttagccgtcatcgtcttcattttgtctagggtttctgatcttttataacacccaagagagtaaaggaaaccagagaactcgaagacgcaatggcgagaatcaaggtccatgagctgagagagaaatcaaaagcggatctttctgctcagttgaaggatttcaaggcggagcttgctcttcttcgcgtcgctaaggtcactggaggtgctcccaataagctctccaagatcaaggtggtgaggaagtcaatcgctcaggtattgacagtgatctcacagaaacagaagtctgctcttagagaggcatacaagaccaagaagtttttgcctctcgatcttcgtcccaagaagactagagctatcaggaggagactcaccaagcatcaggcatcgctgaagacagagagggaaaagaagaaagagatgtactttccaataagaaagtatgctattaaggtgtaaaagctttatttcttaaatcacatcaatctttgtgttttgaatccattttggctcgtgcgtgagtttgtctttttttggttcctgattgaagattttaaaggctcttaatgaaagatttgatttacaaaagcagtttattgttattatcacttggctacctagtcaagtttctctatcataaaacctgaggtttctgtga

SEQ ID NO: 7170 - DNA, 611 bp, Eutrema parvulum
tggagctacgaggaagcagcggcgcagcaagttcaacaccagcaagctcacgatggcgaggattaaggttcacgagctcagagagaaatcgaagaccgatcttcagaaccagctgaaagatttcaagaatgagctcgccctcctccgtgtcgctaaagtcaccggaggtgcccctaacaagctctccaaaatcaaggttgtgaggaagtccattgctcaggtattgacagtgatctcacagaagcagaaatttgcactaagagaagcatacaagaacaagaagttgttgcctcttgatctccgccccaagaaaacacgtgctatccgcagacgtcttaccaagcatcaggcttcgttaaagacagagcgtgagaagaagaaggagatgtatttcccagtgcgaaagtacgctatcaaagtctagtttcattctccagattagctcctagaaatgattcagctttttgattactcctttatgtattctcttccgttttgtccaccttttatttctatttgtactcaagttttgttatagaactgccaaatctctctctctcgaaccattacttttcataaatattgaaccaagtctcggctttgtggtttct

SEQ ID NO: 7171 - DNA, 620 bp, Eutrema parvulum
agtgcagcggcgcagcagttgaacacgagtcaagctcacgatggcgaggattaaggttcacgaactcagggacaagtcgaagagcgatctacagaaccagcttaaggatcttaaggctgagctcgctctcctccgtgttgccaaagtcaccggaggtgctcccaacaagctctctaaaatcaaggtcgtccgtaaatccatagctcaggtgttgacagtgacctctcaaaagcagaaatctgctcttagagaagcatacaagaacaagaagttccttcctcttgatctccgtcccaagaaaacccgtgctatccgcagacgcctcaccaaacatcagctctcgttgaagacagagcgtgagaagaagaaagaaatgtatttcccagtaaggaagtacgctatcaaagtttaatctccatcctttcaatctagctactagaaactgtttcagcttttgtttttgatggaaacttgtttttgctcttcacttgcgctattgtgtgtcaaacagtttcagatacatggattttgcttcctttttataatttgtctttttcttgttcaccagaaataaacctaaatcgctatcttcttgatattctagccattattctacttga

SEQ ID NO: 7172 - DNA, 587 bp, Triphysaria pusilla
ttccatttacaacaccttatatacacattagggttttgttgtataacaatatcacaccaccgccagctccaaaccctaaatcccaatcccctcggaaacaaaccccaaatggcgaggattaaggtgcacgagttgaggcagcagaacaagtcggacttgctggcgcaattgacagatctgaagacggagctgtcgtcgctgagggtggcgaaagttaccggtggagctccgaacaagttatcgaagattaagattgtcaggctagcgattgcccaggtgctcaccgtcatttctcagaagcagaaatccgctctcagggaagtctacaagaataagaagtatttgccgctcgatctccgccctaagaagactcgtgccatccgccgccggttgaccaagcaccaggcatcattgaagactgaaaagcagaagaagaaagatatgtatttccccttgagaaagtatgccattaaagtttaagtgatttgttttgtgctcaaatatatttttggtactgtttatctaaacattgtggtggtggatattaatgcttctgctgatgagtttttcagatttcaaattaattt

SEQ ID NO: 7173 - DNA, 789 bp, Cannabis sativa
ttttttgtgtttgttaaagcgaggattaaggttcacgagcttaggaccaagaacaaggccgatttgcagagccagttgaaggatctgaaggctgagcttgctcttctccgggtcgctaaggtcactggcggtgcacctaacaagctctccaagataaaggtggtgaggctttcgattgcacaggttttgactgtgatttcgcagaagcaaaaggctgctttgagagaagtatataagaataagaagcttttgccgctcgatctgcgtacaaagaagaccagggctatcaggaggcgtctcaccaagcaccagttgtcattgaagaccgaaagagaaaagaagagagaaatctactttccaatgaggaagtacgctatcaaggtgtaatgttggatcttcttgggaagttcttaacatgttttcatccatttctaggatatacttttaaaatgtttgtttagctgcttttcaaatttaatcattggggacagtatcaccattgagtttttggtttttcctttgttcagttatatgcatcctatgtagtactactactacttcaattattggttttagtctcaacaaattcttaatgtgttacttttgggaactacgctgttcttccttcctccttttatagcatcacatctaatcatcaattaatttgatcgaagctcagtttgtccagaaaaacagaattgaactaatatttatttattattattttacttaacaaaagtaactatgcaatcaataaagttaaaatagagtgaaataacaaattaaaac

SEQ ID NO: 7174 - DNA, 1073 bp, Cocos nucifera
gcgaggattaaggtccacgagctacgggggaagtctaaggcggagctgttgaaccagctgaaggacctcaaggcagagctcgccctcctccgcgtcgccaaggtcaccggtggcgcccccaacaagctctccaagatcaaggtggtgaggctctcgatcgcgcgggtgctgacggtgatctctcagaagcagaaggaggtgctgagggaggcgtacaagaagaagaagtcccagccgctcgatctccgccccaaaaagactcgcgccattcgccgccgactcaccaagcaccaggcttcattgaagaccgaacgtgagaagaaaaaggagatgtacttcccattgaggaagtatgcaattaaggcctagattaggttattatttagacttatctttttctgtttgactctcttttgggatccaatttttgtcatttgttttatggattaacaatcctgtttagtactatgtttgggtttatggcatacaaaatactaattgtttgctctggaattcggataagtttgatgtttgattcttgattcatcttcctttgctggcgtcaactttctggatggtcatactagtttggacttgtccatggagatttcttcgctacacctacttccatcaagtgtatgaggtattcattgcaatttctgcatgaagcagtgttgcttcatctgtctgcttgaattatggagaactgcaatctgaatgctcagccatctacgttctgttcttgctgccttgctgggtggccgggtttgcccccttttcatcgccagaaaagtaagtattcttggtctttggaaatgcagggtgcggcttggcgtggttcttgttcttactttgttattattgtgctatatcaagtaaattggcacatctgaaaacaaccacaattacgagtccgtccttcagaaagaatttgttaaaatgcaagactttttcgttttattctttgaagtccagaaggtgggcttgtccgtctagttttatcccattaaactatcgatggaatggaattgttttaaggacataaaaacttatctccttgtattacgaccgtg

SEQ ID NO: 7175 - DNA, 745 bp, Ananas comosus
gcgaggatcaaggtgcacgagctccgggggaagacgaaggcggagctcctcacgcagttgaaggacctcaaggccgagctctcgctcctccgcgtcgccaaggtcaccggaggagcccccaacaagctctccaagatcaaggtggttagggtttcgatcgcgagggttttgacggtgatctcgcagaagcagaaggcggcgctgagggaggcctacaagaagaagaagtaccagccgctcgatctccgccccaagaagacccacgccatccgccacaagctcaccaagcaccaggagtcattgaaaacagaaagggagaagaagagagaaaaatacttccccatgcggaaatatgcaatcaaagcctagattagaaacatggggtgaactttcttgtcatcttattggacgaattttttgtttatttttgatcttcgactctgctgtttttcatgaattttgtcttctcaatgagtgatttggtacgattttgtttaatttccacaatatctgtagttattttctgtaatcggtctgatttcagacttggatccgtgggagtataaagcttatcctagctttcttctgcagcaagtgctagattccttattaatcttcaaacattttgttactgctcacgcattacaaaagtggaaattcatttcggtccccgaactttggacttctatatccaaggattaaactttttaatgtgattttaatttagtttttgaacttcccacca

SEQ ID NO: 7176 - DNA, 1262 bp, Medicago truncatula
gttttgggtagaaacaacagttacactttgtaccaagttttcttttctcgcggcggcgattcaagaccttcgaaatggctaaaacatatgagctgaggcaaaaaacaaaaccagatcttctgaatcaattgaaggatctgaaagcagaacttgctctccttcgcgtcgcgaaagtcaccggcggtgcccctaataaaatatccaaaatcaaagttgttcggcttaacatcgcacaggttttgacagtgatttcacagaaccaaaagacagcattgagggcagcgtataagcacaaaaagtacttgcctttggatcttcgtcccaaaaagaccagagctattagaagacgtctcactaagaatcagctctctttgaagacagaccgtgagaagaagaaggaaatctacttcccattgagaaagtatgccattaaagcgtaatgttggaccctttttttttttttgtggacatttttctaaaaatatttggtgttgtgttctatgtttgtttccttgagtttaacttatcttcatgaaatggaattacaagtacatttgttctcattccagcttcaggtttttactgcttgaactgtttgtttactttaccatttggcacaaatatgtttacaaatagtcgcatcaatatatatgcaagtatgatcgttgtaacttgaatgactatgcggtacgagagtcatgttgtgtttgctccactctatgtgaatgcacgtcatcgtgcgctacttcggacagctccaacacaggactaacggcctgaggtaaccttccttgagggatttcatccataacattatgcaatgcaaagctgaacgagttggcggaaacgtcgttattaacggctacgacataaacaacgttattaacgggtacaacaacatcgttattaacgggagctgactgttcctgattgttcaaaccacctattgtagaagttggggctgtatcaacatgttgaaccatatgtgtgtatttagcgacaacagtttgagttaatgcctgttcttggttctgcttctttgtaatatagaacgttgatctatactactatgtattattgctgttgaagcaggggaagaacagaacatgtccattcttttcatggatataagttgaattgaagttaagttgtttaatttgtttggtttgtaaatggctttttaagtagtagctgaaggtaatgaaggctaaagggagtgtaattgtaagatctttctaatattgagagagggaaaagaagag

SEQ ID NO: 7177 - DNA, 682 bp, Avena sativa
gggcttcggccccctccagactataaccctccgcagcaacttcatcccctccctgtcgccgccgccagcgtatcatctcccctgccgccgccgctgcctcttcgctgccaatcgttgccatggcacggatcaaggtgcacgagcttcgcgggaagaacaaggcggagctccaggcgcagctcaaggcctcaaggcggagctatcccccctccgcgtcgccaaggtcaccggcggagcgcccaacaagctctccaagatcaaggtggtgcgcacatccgtggcgcgcgtcctgacggtgatctctcaaaaacagaaggctgcgctgcgggaggcgtacaagaacaagcggctcccgctcgacctccgtaccaagaagacccgcgccatccgccgccgccttaccaaacaccagctttctctcaagacggagagggaaaagaagcgcgagaagtatttccccatcaggaagtatgccatcaaggcttagttaagcaacatgagatgtgtttagcacagttttggagaatttgttcgcctgggagttcgttgaaccttgatattatcgtgtatggacgccccctgtggtttaagttcgatatgatgacctactttgttaaatgcgtttggtttaagtacttatttcatgttgccatggttatatgaagttgatatcttctcttcc

SEQ ID NO: 7178 - DNA, 389 bp, Brassica rapa
cgagaatcaaggttcatgagctgagggagaaatcaaaaactgacctttcggctcagctgcaggacttcaaggcggagctagctcttcttcgcgtcgccaaggtcactggaggcgctccaaacaagctctcaaagattaaggtggtgaggaagtcatagctcaggtgttgaccgtgatatcacagaagcagaagcttgctctgagagaggcgtacaagaccaagaagtttttgcctcttgatcttcgtcccaagaagactagagctatcaggaggagactcaccaagcatcaggcgtcgctcaagacagagagggaggagaagaaagaaatttactttccaattagaaagtacgctattaaggtgtaatcttttattaatcacatcattt

SEQ ID NO: 7179 - DNA, 717 bp, Panicum virgatum
cccctcaccccgccgccgccgcaggaagcccggctctgactttcgctaccgatggcagcccggatcaaggtgccagagctgcgggcgaagaacaaggcggagctgcaggcacagctcaaggagttcaagtcggagctctccctcctccgcgttgccaaggtcaccggcggcgcccccaacaagctctccaagatcaaggtggtgcgcacctccatcgcgcgcgtgctcaccgtgatctcgcagaagcagaaggcggcgctgcgggaggcgtacaagaacaagaagctgctcccgctcgacctccgccccaagaagacccgcgccatccgcaggcgcctcaccaagcaccagctctctttgaagactgagagggagaagaagcgtgagaagtatttccccatgaggaagtatgctatcaaggcctagattagtgaaagtgaacatgtttaccccttgtcaagttttgcccagaagttaccagaatttgatgtatcgcacatctattgtcatctaagtacaatgtagctgatcaactgcgtgatgaaaaatgtgtactctttgcttggtgaaatatgctggccattgttagttttgcttccacttgatcctcgtcagctttgctgtagcttggtatttgaatctatgttttcaagattactcatttgggccttgtctagatcccttgctcgttatggcttaaacagttatccttgcaca

SEQ ID NO: 7180 - DNA, 593 bp, Ambrosia trifida
gtacgtcggggtctggttttttgttaattctaggtttcagaacattgtgcggctccagcagcagcaacaacaaactcataatccatggctcgaattaaagtccatgagttgagggagaagacaaaggccgatttgtttgctcagttgacggaactcaaaactgaacttgcacttcttcgtgttgctaaagtcactggcggtgctcccaacaagctctccaaaataaaggtggtgaggactggtatcgcgcaggtattgactgttatttcacagactcagaaggcaaagctcagggaagcttacaagaacaagaagtacttgcctcttgatttgcgtccaaagaaaaccagagccatccgtaggcgtttaaccaaacatcaggcctcgttaaagaccgagcgggagaagaaaaaggagaagtactttccattgaggaagtatgctattaaggcttaggatagatactcaagtgtcaatgatcttctcactttagtatggagcttggtatttaaacattatattttgatgttttggtataacttcattttgtatcttgatctttgatattgaaaaagaaaaaagtaccgactgcg

SEQ ID NO: 7181 - DNA, 502 bp, Ambrosia trifida
ggtttcagaacattgtgcggctccaacaacaaactcataattcatggctcgaattaaagtccatgagttgagggagaagacaaaggcagatttgtttgctcagttgacggaactcaaaactgaacttgctcttcttcgtgttgctaaagtcactggcggcgctcccaataagctctccaaaataaaggtggtgaggactggtatcgcgcaggtattgactgttatttcacagactcagaaggcaaagctcagggaagcttacaagaacaagaagtacttgcctcttgatttgcgtccaaagaaaaccagagccatccgtaggcgtttaaccaaacatcaggcctcgttaaagaccgagcgggagaagaaaaaggagaagtactttccattgaggaagtatgctattaaggcttaggatagataatcaagtatcaatgatcttctcactttagtattgagcttggttatatttaaacattatattttgatgcttttggtataa

SEQ ID NO: 7182 - DNA, 567 bp, Arabidopsis lyrata
tagggtttctaatctcttataacatcgcccaaaagagttaagggaagcttgagagagaactcgaagacgcaatggcgagaatcaaggttcatgagctgagggagaaatcaaaagctgatctttcgagtcagttgaaggaatttaaggcagagcttgctcttcttcgtgtcgctaaggtcactggaggtgctcccaacaagctctctaagatcaaggtggtgaggaagtcgattgctcaggtgttgacagtgatctcacagaaacaaaagtctgctttgagagaggcatacaagaacaagaagcttttacctctcgatcttcgtcccaagaagactagagctatcaggaggagactcaccaagcatcaggcatcattgaagacagagagggagaagaagaaagaaatgtactttccgataagaaagtatgctattaaggtgtaagcttttaccttaatcacatcaatttttgtgttttgaatttgagctcttgtgtgagtttttgcttgttttcgttccttgttaaagatattgaaatctcatcttaatgaaagattgaatcagaaaa

SEQ ID NO: 7183 - DNA, 553 bp, Arabidopsis thaliana
agggtttctaatctcttataacaacaccgcaaaagagtaaagggacgctagagagagctcgaagacgcaatggcgagaatcaaggttcatgagctgagggagaaatcaaaagctgatctttcgggtcagttgaaggaatttaaggcagagcttgctctccttcgtgtcgctaaggtcactggaggtgctcctaataagctctctaagatcaaggtggtgaggaagtcgattgctcaggtgttgacagtgatctcacagaaacaaaagtctgctttgagagaggcatacaagaacaagaagcttttgcctcttgatcttcgtcccaagaagactagagccatcaggaggagactcactaagcatcaggcatcgttgaagacagagagggagaagaagaaagaaatgtactttccaataaggaagtatgctattaaggtgtaagcttttatcttgatcacatcaatttttgtgtttgaatttgagctcgtgtgagtttttgctttgttttccttccttgttaaagatattaaaagctcatcttaatgaaagattg

SEQ ID NO: 7184 - DNA, 521 bp, Arabidopsis thaliana
ctgattctcggagctaaaagaagagcaagcagcggcgcagaagttgaacacaagtgaagctcacaatggcgaggattaaggttcacgaattgagggagaagtcgaagagcgatcttcaaaaccagctgaaggaactcaaagctgagctcgctctcctccgtgtcgctaaagtcaccggaggtgctccaaacaagctctctaaaatcaaggtcgtgcgtaaatccatagctcaggttttgacagtgtcttctcagaagcagaagtctgctctaagagaagcatacaagaacaagaagttgcttcctcttgatctccgtcccaagaagacccgtgctattcgtagacgcctcaccaaacaccaggcctcgttgaagacagagcgtgagaagaagaaggagatgtatttcccaataaggaagtacgctatcaaagtttaagttttagctgctagaaacactgtttcagcttttgtttttgatggaaacttgttcttgttcttcacttgtgttatcgtctcaaac

SEQ ID NO: 7185 - DNA, 625 bp, Persea americana
gaaccctagttcttcagtatcacgtactaagctccaacttctcaaagcatcttccatcgccatatttacattactcttcaatggcgaggattaaggttcatgagcttagaacgaagtctaaaactgaccttctcaaccagcttaaggagttaaaggctgagcttgcattgttacgagtggccaaggttactggaggtgccccaaacaagctatcaaagattaaggtggtcaggctctccattgcgcgtgtgcttactgtcatctcccagaagcagaaagccgccttaagagaagcatacagcaagaaaaagttgttgcctttggatctgcggcctaagaagacgcgtgctatcaggcgtcgccttacaaaacatcaggcatcattgaagacacagagggagaagaaaagagagatgtacttccctcagagaaaatatgcaatcaaggtttgagatggcttttgcagaactgcagtgggtttagtgccctgaattttgcaattttctttctcagtgtgggtatggccactgagaaactgtcctcttgattttatgttctaattgaatatatagctgcaaactatgaatggccaatttcttttcagtaattcaagtaattaaaatta

SEQ ID NO: 7186 - DNA, 549 bp, Brassica juncea
agagaactcgaagacgccatggcgagaatcaaggttcatgaactaagggagaaatcaaaatcggatctttcgactcagttgcaggatttcaaggcggagcttgctcttctacgagtcgccaaggtcactggaggtgctcccaacaagctctctaagatcaaggtggtgaggaaatcaatcgctcaggtgttgacagtgatctcacagaagcagaagcttgctctgagagaggcatacaagaacaagaagtttttgcctcttgatcttcgtcccaagaagactagagctatcaggaggagactcaccaagcatcaggcatcgctgaagacagaaagggagaagaagaaagaaatgtactttccaataagaaagtacgctattaaggtgtaacctgttctttttaattacatcatcaatctttatgttttgaattttatctcttgtgtgagttggctttcttcattattatgttccatgttaaaagactcatctgaatgaaagattttgattttgaccaaaagaaaagagaatgaaagatttggatttcac

SEQ ID NO: 7187 - DNA, 468 bp, Brassica juncea
gcaagctcacgatggcgaggattaaggttcatgagctcagagagagatcgaagacggatcttcagagccagcttcaggagttcaaagctgagctcgccctcctccgtgtcgctaaagtcaccggaggcgcccctaacaagctttccaaaatcaaggtcgtgaggaaatcaattgctcaggtattgacagtgatctcacagaagcagaagttagcactaagagaagcatacaagaacaagaagttcttgcctcttgatcttcgtcccaagaagactcgtgctatccgtagacgtcttaccaagcatcagtcttctttgaagactgagcgtgagaagaagaaagagatgtatttccctctgaggaagtatgctatcaaagtctagtttcactctccatctttgctaactagaaatgattcagttttgattattcgcttatgtattctccctttttgctattggtttaagt

SEQ ID NO: 7188 - DNA, 573 bp, Brassica oleracea
tggagccagaaacgaggaagcagagttcaacaccagcaagctcacgatggcaaggattaaggttcatgagcttagagagagatcaaagacggatcttcagagccagcttcaggagttcaaggctgagctcgccctcctccgtgtcgctaaagtcaccggaggtgcccctaacaagctttccaaaatcaaggtcgtgaggaaatcaattgctcaggtattgacagtgatctcccagaagcagaaattagcactaagagaagcatacaagaacaagaagtttttacctcttgatcttcgtcccaagaagactcgtgctatccgcagacgtcttaccaagcatcagtcttctttgaagacagagcgtgagaagaagaaagagatgtatttccctctgaggaagtatgctatcaaagtctagttttccttctctccttcttagcgctactagaaatgattctgcttcttgattgtttcgcttatgtattctcctttttttccacctttcatttttactcaagttttgttatgaatatctttaaaagaccttgaaattgaacgtttcattttgtaatc

SEQ ID NO: 7189 - DNA, 1053 bp, Musa acuminata
atgagatcctgcaataaatccttggtaggaattttcttctgttgtttcttggaaaaagggtggaggaaaaaggatgtttccgctgggatctctttactatcagctgcttccacaccccatgtacgaataagagagatctctatcatcatcgtggaaaagtacaccaaagacatcgatatggtaattatattcttgccgcccgccgccatctgcattcgaggtcggagagtcccaggaagaagacatccgttcccaatggcgaggattaaggtccacgagctccgggggaagtcgaggacggagcttcataaccagctcaaggacctcaagaacgagctcagcctcctccgcgtcgccaaggtcaccggcggtgcccccaacaagctctccaagattaaggtggtgaggctgtcgatcgcgcgggtgctgacggtcaactcacagaagcagaaggcggcgctgagggaggtatacaagaagaagaagcacatcccgctggacctccggcccaagaagactcgcgccatccgccgccgccttaccaagcatcaggagtccttgaagacagaacgacagaagaagaaagagatgtacttcccaactaggaagtatgcaatcaaagcttagacgaagatagggtctctcctaaaccaagctcttcttttccagctgtggttttattagtttatccactagagactacattttagagagttctgaacttgcaaacattgagtttccatctggaatatgagctatgttcttgacacgtgaaatatgttaatgtcctggtgcttcattgtcaatgtcaatgttatgccagtgtggcacttatagtattttctcgtctcactctgttgagaatgttggatagctgctgttcgctgtttcctcgtgcttccaagtgaaccccagtcaccttatcgttggcctgtccaatgattcacttgtctatgggctcttcatgacttgaagatgaacacgaagagatgcactacggtttgaagaggatcaccgaggctgccttgacatccaccaccaagcatggcaagc

SEQ ID NO: 7190 - DNA, 421 bp, Daucus carota
aaactcgaatcaccagcagaaagaacaaagcagccgccgccgctcacttgaaacatttttagcatcaatggcgaggattaaggtacatgagctgaggacaaagtccaaggcggatttgttggcgcagcttcaggaattgaaggctgagctttcgcttcttcgggttgcgaaagtcaccggtggagctcctaacaagctctccaagataaaagttgtgaggttgtcaattgcccaggtgctgactgttatgcaacagaagcagaaggctgctctgagggaagtctacaagaacaagaagctcatgcctcttgatttgcgtcccaagaagaccagagccatccgtaggcgtcttaccaagcaccaggcatctttgaagactgagcgtgagaagaaaaaggagaaatacttccccatgagaaag

SEQ ID NO: 7191 - DNA, 536 bp, Cleome spinosa
gagacagtacgaggcgcccttgatagaagactcgaaagagctgccatggcgagaatcaaggttcacgagcttagggagaaatcgaaagccgatctctcgagtcagctgaaggatctgaaggcggagcttgccctcctccgcgtcgctaaggttacaggcggtgctccaaacaagctatccaagatcaaggtggtgaggaagtcgattgcacaggttttgactgtgatctcgcagaagcagaaatctgcattgagagaggcataccaaaacaagaagtttttgccactcgatctccgtcccaagaagactagagctatcagaaggagactcaccaagcaccaggcatcgttgaagacggaacgggagaagaagaaagatatgtactttccattgagaaagtatgccatcaaggtgtaagccgttgtcttgctccatctagtgtttcattttcttcaatgccggttaaagactaaagagttccaaactcgaatcttttgccatcatatatctatttgaattagagatttgatttgccc

SEQ ID NO: 7192 - DNA, 606 bp, Cleome spinosa
gacgtctccgagccaacacgagcagcagcggcaacagcacttcaacgccaggaggctcacaatggcgaggattaaggttcacgagctcagagacaagtcgaagaccgatctactaaaccagcttaaggaactcaaggcggagctcgcgctcctccgtgttgccaaagtcaccggcggtgctcccaacaagctctccaaaatcaaggtggtgaggaaatccattgcacaagtgttgacagtgatttctcagaagcaaaaatctgctctgagagaagcatacaagaacaagaagtttctgcctctcgatcttcgtcccaagaaaacccgtgctatcaggaggcgcctcactaaacaccaggcatcattgaggacggagcgagaaaagaaaagagatatgtacttccccttgaggaagtacgcaatcaaagtgtaatccacttcccattttgatgcgtttagtattcgatggaaaacatgttctcgtcactctctctctctctctcatgtttttgtcagactcggacattattagtcggttggattttgcaaaatttccagtttcgtacgttggaacagctgtcttagttaattcatttcgataaaatt

SEQ ID NO: 7193 - DNA, 582 bp, Cleome spinosa
gggtttcctacggcatacagagcaggaggcaactgattgagaactcgagagagccgccatggcgaggatcaaggttcacgagctgagggagaaatcgaaagctgatctctcgaatcagctgaaggaactgaaggcggagcttgccctactccgcgtcgcgaaagtcactggcggtgctccgaacaagctctccaaaatcaaggtggtgaggaagtccattgcacaggtattgactgtgatctcacaaaagcagaagtctgcattgagagaagcatacaaaaccaagaagttgttgccactcgatctccgtcccaagaagactagagctatcaggagaagactcaccaagcaccaggcttcgttgaagacggaacgagagaagaagaaagaaatgtactttcccttgagaaagtatgctatcaaagtgtaagccttttttggtcctactgagtgtttttgccttctggatcatactatcaaagctctctttccctttgtgagtttcacttctatttcttatttgaagggtttcaaactctaattgcaatcgggtatttgaatttcagattcgattatactgtc

SEQ ID NO: 7194 - DNA, 846 bp, Gossypium raimondii
gccagattgcaacgctccaaaatgcctaattgcagctccgaagtcgtaaaaaccaaaggttctatttcttcctttcaaattctagggtttctgagaagagattaagcagccgcggcagcaaaactcaacaatggcgaggataaaggttcacgagttaaggaacatgtccaagacggagctgctaagccaattgaaggacttgaaagctgaacttgctctcctccgcgtcgctaaggtcacagacggcgcccctaataagctctccaagataaaagttgtgaggttatcgatcgcgcaggttttgacggtgatttcgcagaagcaaaaatctgcgcttagagaagcttataagaagaaaaagttcctccctttggatctccgtcccaagaagactcgtgccattcgccgccgccttactaaacatcaggcatctttgaagacacagcgtgaaaagaagaaggagatgtacttcccactaaggaaatatgccattaaagtgtaagcaggagctactttttgttctatcaaagtctaaaaagtagaattatggtttagatgcagttatatgagcatcatttttgtccctttattagttttccttgaacatctgtttgagcgctataatatgatttcacatttcagaatgtgttttgacttgtacatgcaaggaattctctttttgcgttgtttaaggcaccgtaattctctagctccgggttcatataggtttgtttcacaaactgatttgtggaaaatgttttttgtatttccttgtgtttgtttcttggagaacacatggtcaacagacaaacgaaaaataaggtgttttttttttttttaaattga

SEQ ID NO: 7195 - DNA, 735 bp, Zea mays
gggaagtaaaacacacattttatcgactcaatgtgcatgagtcaaggcccattcggcccggctagagcccacaacaggtctagggtttcctggttctcccacggggtttcaggagacacatataatccacacgccgccgtctttctaaacttcgccatccatttttcatatcctcactcgccgccgccgccgctcgtccctcgccccatcgcgatggcccggatcaaggtgcacgagctgcgggggaagagcaaggcggatctgcaagcgcagcttaaggagtttaagtcggagctctccctgctacgcgtagccaaggtcaccggcggggctcccaacaagctctccaagatcaaggttgtgcgcacctccatcgcgcgcgtgctgaccgtcatctcgcagaagcagaagtcggcgctgcgtgaggcgtacaagaagaagaagctgctcccgctcgacctccgccccaagaagacccgcgccatccgcaggcgcctcaccaagcaccagctctccttgaagaccgagagggaaaagaagcgtgagaagtatttccccatgaggaagtacgctatcaaggcctagatcagtgaaagaacatttatcctgtcaagttttgctcagaagttacttgaatttgagacaaatctatctccatccaagtactatgtagctgatcaactgcatgatgaaaaacgagtactttttgcttgtttaaacgtgctttacattttc

SEQ ID NO: 7196 - DNA, 690 bp, Zea mays
ctgtaccaaccgaggcccattgggcccgctcgagcccacaaaagatctagggtttcctgcttgtcccacggggttttaggaagcacgcagccacacgccgccgcctcgctctctgctcccctctccatttttcatctcattcggcgccgcggcaccccctgctcgtcactcgcgatggcccggatcaaggtgcacgagctgcgcggaaagagcaagacggatctgcaagcgcagctcaaggagcttaaatcggagctctccctcctacgcgtcgccaaggtcaccggcggggctcccaacaagctctccaaaatcaagatcgtgcgcacctccatcgctcgcgtgctcaccgtcatctcgcagaagcagaagtcggcgctgcgtgaggcgtacaagaagaagaagcttctcccgctcgatctccgccccaagaagacccgcgccattcgcaggcgcctcaccaagtaccagctctccttgaagactgagagggaaaagaagcgtgagaagtattttcccatgcggaagtacgctatcaaggcctagattagtgaaagaacagcttttatcctatcaagttctgcccagaagtttcttgagtttgatgtaccgcacatctatcgtcattacaatggaatgatgaaaacgaatatgttttcggcttctactccacacagtctttgttggcga

SEQ ID NO: 7197 - DNA, 724 bp, Pennisetum glaucum
gccaccgccgcttcgccgccgaaaccgcaaccgtcgccatggcccggatcaaggtgcacgagctcagggggaagaacaaggcggagctgcaggcgcagctcaaggagctcaagtccgagctctccctcctccgcgtcgccaaggtcaccggcggggcacctaacaagctctccaagatcaaggtggtgcgcacctcgatcgcgcgcgtgcatacggtgatctcgcagaagcagaaggcggcgcttcgggaggcgtacaagaagaagaagctgcttcccctcgacctccgccccaagaagacccgtgccattcgccgccgcctcaccaagcaccagctttctctgaagacggagagggaaaagaagcgggagaagtacttcccgttgaggaagtatgctatcaaggcctagatcagaactgtgagatgccaagcttagcatatcatcggctgtttctttgccccggaagtgttttatgttttgatttgtatggacatttgctgtgggaaagtatggtgtatttcctctgttatctcaaatgcctagattggtttaaggggcagttcgtattggcactgaaatcttgtttatttgttctgaaaaacgccatgtctgcagtttgatccagagaattctgaaagcagattttgtctgaccaggaattttagttgcatggccatcgtcaccatttcctaatttcgggacattcacaaagttcaattagt

SEQ ID NO: 7198 - DNA, 657 bp, Pennisetum glaucum
ctcagggggaagaacaaggcggagctccaccccaccccgccgccaccgccgcttcgccgccgaaaccgcaaccgtcgccatggcccggatcaaggtgcacgagctcagggggaagaacaaggcggagctgcaggcgcagctcaaggagctcaagtccgagctctccctcctccgcgtcgccaaggtcaccggcggggcacctaacaagctctccaagatcaaggtggtgcgcacctcgatcgcgcgcgtgcatacggtgatctcgcagaagcagaaggcggcgcttcgggaggcgtacaagaagaagaagctgcttcccctcgacctccgccccaagaagacccgtgccattcgccgccgcctcaccaagcaccagctttctctgaagacggagagggaaaagaagcgggagaagtacttcccgttgaggaagtatgctatcaaggcctagatcagaactgtgagatgccaagcttagcatatcatcggctgtttctttgcccggaagtgttttatgtgttgatttgtatggacatttgctgtgggaaagtatggtgtatttcctctgttatctcaaatgcctagattggtttaaggggcagttcgtattggcactgaaatcttgtttatttgttctgaaaaacgccatgtctgcag

SEQ ID NO: 7199 - DNA, 954 bp, Pinus taeda
aattcggcacgaggtttttaatttattggggtaccttgaaaccctagcttgtcgtcaaaacccgacggcacatacagattgttgatttcgctttggttactggtgttacagcgaggggaaggtcaaaggattttgggcaaacatggccagaattaaggttcacgagctacggctgaagagcaaagcagatctcctgaatcaactcaaggagctcaaggcggagcttgctctgctcagggttgccaaagtcacaggaggagcccctaacaagctttctaaaatcaaggtggtgagattatcaattgcacaagtgttaacagtgatatctcagaatcagaaaacagcgttgagggaagcctacaaaaagaagaagtatttgcctcttgacttgcgtcctaagaagacacgcgccatcagacgacgcctcaccaaacaccaggcctcaatgaagactgagagacagaaaaagaaggagatgtacttccccatgagaaaatatgcagtcaaggtttaaagacaacatttttgccaaattatttttttcgtttgttggatacaggagcccaagtgttcagtctcagtgagtcgtctatattagattgtttaggaagcttatgttggattccagttctattgattgtacatggagttgaaattagaattccatgttcacgtttcattgtggtattcaaattaaaaaactccaagttggtttgactcctaacctattaggattgattatcctgtgtgattttttagattattgtcttcagctatgttgggatgttttttgtctgtcccggttaagattagagaaagaagcttctttgtttatccaatttggagtatttttcaaaagtacacctagacgactaggagactagaagttgctttattaagattaactaaagttgcagtgtttgaaccaaaatcgacagttggatttaaagataa

SEQ ID NO: 7200 - DNA, 661 bp, Podocarpus macrophillus
ggcgagagcagagcggcagcccagtacagaagatcaaccataatggcgcggatcaaggttcacgagttgagaactaagagcaaggcggatctgacgaatcagttaaaggagctcaaagccgagctcgccttgcttagggtcgccaaagttactggcggagcccctaacaagctctccaaaatcaaggtggtgaggcgatctatagcccaggttttgacagtgatatcacagaatcagaaagcagcgctgagagaggcctacaagaagaagaagtacatgcctctcgatctccgccccaagaaaacccgtgctatcaggcgtcgccttacaaaacatcagacttctttgaagacagagagacagaagaagaaggaaatgtattttcccatgagaaagtatgccattaaggtctagagattagtgtggctttattgttgagtcttcctgcacaaatttctacctggatgatagaatgcccatttaattttttagtgatatcatacttgcttcaaaattggagtttacgatgcaatgctaatttttgatcttggaaagtggttttgcgtttgagcaaaaactaatttctttcaagctaatgtgtctgtattttaaattatcggaataattataatatcatggtaattatctttttaattttaat

SEQ ID NO: 7201 - DNA, 588 bp, Podocarpus macrophillus
gcaaagcagagcggcagcccagcacagcagaatggcgaggatcaaggttcacgagttgagaactaagagcaaggcggatctgacgaatcagttaaaggagctgaaagccgagctctccttgctcagggtcgctaaagtcactggtggagcccccaataagctttctaaaatcaaggtggtgaggcgatctatagcccaggttttgacagtgatatcacagaatcagaaggcagcactgagagaggcctacaagaagaagaagtacatgcctctcgatctccgccccaagaagacccgtgctatcaggcggcgtctaaccaagaatcaggcttctttgaagacagaaagacagaagaagaaggaaatgtattttcccatgagaaagtatgccattaaggtctagagattagtgtggctttattgatgggtcttcctgcacaaatttgtacgtggatgatagaatgcccatttaattttttagtgatatcgtacttgcttcaaaattggagtttatgatgtactgttaagttttgatcttggaaagtgattttgtgtttgagcaaaaaatagtttctttcaagctaatgt

SEQ ID NO: 7202 - DNA, 844 bp, Chenopodium quinoa
ctccacatatatattcatcaaatcaccataaaccctaggtcagccattcctttttccacacacgccgtcgttgcagcaaacaccggagcacagaaatggcaaggattaaaccgcatgagttgaggcaaaagcctaaggctgatttgctgaatcagcttaaggatctcaaggctgagctcgctcttctccgtgttgctaaggttaccggcggtgctcctaacaagctctccaagattaaggtggtgagattagggattgctcaagtattgacagtgatgtcacagaagcagaagtcggcattgagggaagcatacaagaagaagaagtttttgccacttgatcttcgtcccaagaagacccgtgccattcgtcgtcgcctcactaagcatcaggcatctttgaagaccgaaagggagaagaagagggagaggtactatcccatgaggaagtatgccatcaaggtgtaggctacgtatctattatctaagggggtttctacattccatgaaattttttgttccaatgttcgttaaacttctaaaaagtgagcttcaatttatgacattagccagtttctgccagcattttgtgttgctaaatagaatctttgtttgtgatctatgatgaattttgacatagaaaggtgtttagattcaatctactagtgttcactttttaacatctgcatgtgtttatgatgtggagcaggttagttcgtctttactatatactccgtagacgtgcaaattaatattcttgttttcgatcaattccaaccgttgccatttacggcaatttaaaattaattgcaaccagttgcctttcaaatctaatttgaaattta

SEQ ID NO: 7203 - DNA, 709 bp, Chenopodium quinoa
gcacagaaatggcaaggattaaaccgcatgagttgaggcaaaagcctaaggctgatttgctgaatcagcttaaggatctcaaggctgagctcgctcttcttcgtgttgctaaggttaccggcggtgctcctaacaagctctccaagattaaggtggtgagattaggtattgcgcaagtattgacagtgatgtcgcagaagcagaagtcggcattgagggaagcatacaagaagaagaagttcttgccacttgatcttcgtcccaagaagacccgtgccattcgtcgtcgcctcactaagcatcaggcatctttgaagaccgaaagggagaagaagagggagaggtactatcccatgaggaagtatgccatcaaggtgtaggctaggtatctattctctaaggggggtgtctacattccatgaaattttcgttctaatgttttttaaacttataaaaagtgagcttcaattaaggacattagatgccagatttgttctaccttgtgattttatcttgccagcattttgtattttgctaaaatagaatcgttgtttatgattgctaaaatagaatccttgtttatgatctatgaccatttttgacgtagaaaggtgctgtagattcaatcttactagcacactttttaacatttgcatgtatattgtgtggaagtgtggaccgggtatctggtctaaaccaaggacctggt

SEQ ID NO: 7204 - DNA, 499 bp, Chenopodium quinoa
cataaaccctgcttttatagctgagccatttcttcttctagggtttccactctctcaatttcgccgttgttgcagcaaacactcacctcagaagcgcagaaatggcaagaatcaaaccccatgagttgaggcagaagcctaaggctgacttgttgaatcagctcaaggatctcaaggctgagctcgctcttcttcgtgttgctaaggttaccggcggtgctcctaacaagctctcaaagattaaggtggtgagattagggattgcgcaagtattgacagtgatgtcacagaagcagaagtcggcattgagggaagcatacaagaagaagaagttcttgccgcttgatcttcgtcccaagaagacccgtgccattcgtcgtcgcctcactaagcatcaggcatctttgaagaccgaaagggagaagaagagggagagatactatcccatgaggaagtatgccatcaaggtgtaggctacgtatctattatctaagggggt

SEQ ID NO: 7205 - DNA, 540 bp, Chenopodium quinoa
tttgcagcaaaaatccacctcaggagcgcagtaatggcaagaattaagccccatgagctgaggcaaaagcctaaggctgatttattgaatcagcttaaggacctcaaggctgagctcgctcttctccgtgttgctaaggttaccggcggtgctcctaacaagctctccaagattaaggtggtgagattagggattgctcaagtattgacagtgatgtcacagaagcagaagtcggcattgagggaagcatacaagaagaagaagtttttgccacttgatcttcgtcccaagaagacccgtgccattcgtcgtcgtctcactaagcaccaggcatctttgaagaccgaaagggagaagaagagggagaggtactatcccatgaggaagtatgccatcaaggtgtaggctaggtatctataatctagggcggttttcacatttcatggaaattttgttcaaatgttttttaaacttctataaagtgatgttttagattatgacatgagttatttatcttctaccttgtgattttatgttgcc

SEQ ID NO: 7206 - DNA, 773 bp, Chenopodium quinoa
tcaaatcaccataaaccctaggttagccgttccttttctagggtttctcaaattcgacgtcgttgcagcaaacacaaacatcaggagcgaagtaatggcaagaattaaaccacatgagttgaggcaaaagcctaaggctgatttattgaatcagcttaaggatctcaaggctgagctcgctctcctccgtgttgctaaggttaccggcggcgctcctaacaagctctcaaagattaaggtggtaagattaggaattgcccaagtgttgacagtgatgtcacagaagcagaagtcggcattgagggaagcatacaagaagaagaagtttttgccacttgatcttcgtcccaagaagacccgtgccattcgtcgtcgtctcactaagcaccaggcatctttgaagactgaaagggagaagaagagggagaggtactatcccatgaggaagtatgccatcaaggtgtaggctaggtatctataatctagggcggttttcacattccatggaaattttgttcaaatgtttgttaaacttctataaagtgatgtttcagattatgacattagcaagttatcttctaccttgtgattttatgttgcctgcattttgtattcttaaatagaattgtggtggttgtcttaattttgacagagaaaggtggtttatgctttcaaggcatgcaggtaatagttgtttagtcttggtgttgctactcgatcatgtgatcttgaccatgatttgtatgatccagcacagcatgtttatgggatcc

SEQ ID NO: 7207 - DNA, 595 bp, Raphanus sativus
ggggggcgacacttgggagttggagcaaacgacgaagcaaagctcacgatggcaaggattaaggttcatgagcttagagagagatcgaagacggatcttcagagccagcttcaggagttcaaggctgagctcgccctcctccgtgtcgctaaagtcaccggtggtgcccctaacaagctttccaaaatcaaggtcgtgaggaaatccattgctcaggtattgacagtgatctcacagaagcagaaattagcactaagagaagcatacaagaacaagaagttcttgcctctcgatcttcgtcccaagaagacacgtgctatccgtagacgtctcaccaagcatcagtcttctttgaagacagagcgtgagaagaagaaagagatgtatttccctctgaggaagtatgctatcaaagtctagtttcaatgtttcattctccaggattccttactaggaatgattcagctttttgattgttcacttattttgtccacctttgtttttttactcaagttttgtcatgtaacagtcaaatctatctctcactcctcgaaaacattgtttcgtaataattgaaattgaaccagttctcggc

SEQ ID NO: 7208 - DNA, 637 bp, Raphanus sativus
gggggggacacttgggagttggagccagaaacgaaaacgaggaagcagaagagttcaacaccagaaagcaaagctcacgatggcaaggattaaggttcatgagcttagagagagatcgaagacggatcttcagagccagcttcaggagttcaaggctgagctcgccctcctccgtgtcgctaaagtcaccggaggtgcccctaacaagctttccaaaatcaaggtcgtgaggaaatcaattgctcaggtattgacagtgatctcacagaagcagaaattagcactaagagaagcatacaagaacaagaagttcttgcctcttgatcttcgtcccaagaagacacgtgctatccgtagacgtcttaccaagcatcagtcttccttaaagacagagcgtgagaagaagaaagagatgtatttccctctgaggaagtatgctatcaaagtctagtttcaatgtttcattctccaggattccttactaggaatgattcagctttttgattattcacttattttgtccacctttgtttttttactcaagttttgtcatgtaacagttaaatctatctctcactcctcgaaaacattgtttcgtaataattgaaattgaaccagttcttggctttgtgttaaa

SEQ ID NO: 7209 - DNA, 906 bp, Picea glauca
cagccaagactctttatcgataggagattatttgtaaataaattacatggtctttgcaacaacaaatacaaacactcgtctaaaccctaggtatagtaaaccctatctcgtcattttctttctttatcatctgtttacctttagggtttgggagaggagaggcgaggagaggagaggagacgagacgagacgagccgagctgaggcacgaagagggcttcttgtgaaagcatctgaatcgaaatggccaggattaaggttcacgagctccgtaataagagcaaagcagagctgttaaatcagctcaaggacctcaaggccgagcttgccttgctcagggttgcgaaggttactggaggagcgcccaacaagctctctaagatcaaggtcgtgaggctatcaatagcccaggtactgactgtgatttctcagaatcagcgatctgcattgagagaagcatacaagaaaaagaagtacttgcctcttgatttgcgtcccaagaagactcgtgctattaggcgacgccttactaagcatcaggcctcattgaagactgagagacagaagaagaaagagatgtattttcctatgagaaagtatgcagttaaggtgtaaagcctaggatttgagctttcatgcaattttttttgttacttgcaggatgatattgcctattatatttccactgagtttttggcaaattcctatttgcatcagaatgcaagttgtgataggtgttctttcaatgttgagcagttaatattgtttgccttttctttctcttgaattgcaaccatattctaatgcaatgaatgaattataatattgtggtatccccatgtggaactcacgaatgaaatgattgtaatctgagtagaaaatggacatttattttaaatttttactg

SEQ ID NO: 7210 - DNA, 878 bp, Picea glauca
attattttcaaaataaattacatggtctttgcaacaacaaatagtctctttgcaacaacaaatacaaacactcgtctaaaccctaggtatagtaaaccctatctcgtcattttctttctttatcatctgtttacctttagggtttggtagaggagaggagaggagaggagacgagacgagctgaggcacggagagggcttcttgtgaaagcatctgaatcgaaatggccaggattaaggttcacgagctccgtaataagagcaaagcagagctgttaaatcagctcaaggacctcaaggccgagcttgccttgctgagggttgcgaaggttactggaggagcgcccaacaagctctctaagatcaaggtcgtgaggctatcaatagcccaggtactaactgtgatttctcagaatcagcgatctgcattgagagaagcatacaagaaaaagaagtacttgcctcttgatttgcgtcccaagaagactcgtgctattaggcgacgtcttactaagcatcaggcctcattgaagactgagagacagaagaagaaagagatgtattttcctatgagaaagtatgcagttaaggtgtaaagcctaggatttgagctttcatgcaattttttttgttacttgcaggatgatattgcctattatatttccactgagtttttggcaaattcctatttgcatcagaatgcaagttgtgataggtgttctttcaatgttgagcagttaatattgtttgccttttctttctcttgaattgcaaccatattctaatgcaatgaatgaattataatattgtggtatccccatgtggaactcacgaatgaaatgattgtaatctgagtagaaaatggacatttattttaaa

SEQ ID NO: 7211 - DNA, 838 bp, Picea glauca
ttaattaaattaatcccccccccccccgagtctctttgcaacaacaaatacaaacactcgtctaaaccctaggtatagtaaaccctatctcgtcattctctttctttatcatctgtttacctttagggtttgggagaggagaggagacgagacgagacgagctgaggcacggagaggacttcttgtgaaagcatctgaatcgaaatggccaggattaaggttcacgagctccgtaataagagcaaagcagagctgttaaatcagctcaaggacctcaaggccgagcttgccttgctcagggttgcgaaggttactggaggagcgcccaacaagctctctaagattaaggtcgtgaggctatcaatagcccaggtactgactgtgatttctcagaatcagcgatctgcattgagagaagcatacaagaaaaagaagtacttgcctcttgatttgcgtcccaagaagactcgtgctattaggcgacgccttactaagcatcaggcctcattgaagaccgagagacagaagaagaaagagatgtattttcctatgagaaagtatgcagttaaggtgtaaagcctaggatttgagctttcatgcaattttttttgttacttgcaggatgatattgcctattatatttccactgagtttttggcaaattcctatttgcatcagaatgcaagttgtgataggtgttcttccaatgttgagcagttaatattgtttgccttttctttctcttgaattgcaaccatattctaatgcaatgaatgaattataatattgtggtatccccatgtggaactcacgaatgaaatgattgtaatctgagtag

SEQ ID NO: 7212 - DNA, 774 bp, Picea glauca
ggagaggagaggagacgagacgagacgagctgaggcacggagaggacttcttgtgaaagcatctgaatcgaaatggccaggattaaggttcacgagctccgtaataagagcaaagcagagctgttaaatcagctcaaggacctcaaggccgagcttgccttgctcagggttgcgaaggttactggaggagcgcccaacaagctctctaagatcaaggtcgtgaggctatcaatagcccaggtactgactgtgatttctcagaatcagcgatctgcattgagagaagcatacaagaaaaagaagtacttgcctcttgatttgcgtcccaagaagactcgtgctattaggcgacgccttactaagcatcaggcctcattgaagactgagagacagaagaagaaagagatgtattttcctatgagaaagtatgcagttaaggtgtaaagcctaggatttgagctttcatgcaattttttttgttacttgcaggatgatattgcctattatatttccactgagtttttggcaaattcctatttgcatcagaatgcaagttgtgataggtgttcttccaatgttgagcagttaatattgtttgccttttctttctcttgaattgcaaccatattctaatgcaatgaatgaattataatattgtggtatccccatgtggaactcacgaatgaaatgattgtaatctgagtagaaaatggacatttattttaaattttcactgttaatagtttttcaacagcatagttaaagtttaaaaaa

SEQ ID NO: 7213 - DNA, 784 bp, Picea glauca
tctttgcaacaacaaatacaaacactcgtctaaaccctaggtatagtaaaccctatctcgtcattttctttctttatcatctgtttacctttagggtttgggagaggagaggagaggagacgagccgagctgaggcacggagaggacttcttgtgaaagcatctgaatcgaaatggccaggattaaggttcacgagctccgtaataagagcaaagcagagctgttaaatcagctcaaggacctcaaggccgagcttgccttgctgagggttgcgaaggttactggaggagcgcccaacaagctctctaagatcaaggtcgtgaggctatcaatagcccaggtactaactgtgatttctcagaatcagcgatctgcattgagagaagcatacaagaaaaagaagtacttgcctcttgatttgcgtcccaagaagactcgtgctattaggcgacgtcttaccaagcatcaggcctcattgaagactgagagacagaagaagaaagagatgtattttcctatgagaaagtatgcagttaaggtgtaaagcctaggatttgagctttcatgcaattttttttgttacttgcaggatgatattgcctattatatttccactgagtttttggcaaattcctatttgcatcagaatgcaagttgtgataggtgttctttcaatgttgagcagttaatattgtttgccttttctttctcttgaattgcaaccatattctaatgcaatgaatgaattataatattgtggtatccccatgtggaactcacgaat

SEQ ID NO: 7214 - DNA, 620 bp, Eutrema parvulum
gtcttagccgtcatcgtcttcatttttctctctagggtttctgatcacttataacacacaccccacaagagagtaaggtaagccagagaactcgaagacgcaatggcaagaatcaaggtccatgagctgagagagaaatcaaaagcggatctttcgacccagttgaaggatttcaaggcggagcttgctcttcttcgcgtcgccaaggtcactggaggtgctcccaataagctctccaagatcaaggtggtgaggaagtcaatcgctcaggtattgacagtgatctcacagaaacagaagtctgctcttagagaggcatacaagaccaagaagtttttgcctctcgatcttcgtcccaagaagactagagctatcaggaggagactcaccaagcatcaggcatcgctgaagacagaaagggagaagaagaaagaaatgtactttccaataagaaagtatgctattaaggtgtaagcttttcttaatcacatcaatctttgtgttttgaattttagcttttgcgtgagttggccttttattctgtccctgttaaagatttgaaatactcatcttaatgaaagaatttaattcagaacgcattattgttatccgctgtgagt

SEQ ID NO: 7215 - DNA, 607 bp, Triphysaria pusilla
atatcacaccaccgccagctccaaaccctaaatcccaatcccctcggaaacaaacccgaaatggcgaggattaaggtgcacgagttgaggcagcagaacaagtccgacttgatggcgcaattgacagatctgaagacggagctgtcgtcgctgagggtggcaaaagtgaccggtggagctccgaacaagctgtcgaagattaagattgtcaggctagcgattgcccaggtgctcaccgtcatttctcagaagcagaaatccgctctcagggaagtctacaagaataagaagtatttgcccctcgatctccgccctaagaagactcgggccatccgccgccgtttgaccaaacaccaggcatcactgaagactgaaaagcagaagaagaaagatatgtatttccccttgagaaagtatgccattaaagtttaagtgatttgttttgtgctcaaatatatttttggtactgtttatctaaacattgtggtggtggatattaatgcttctgctgatgagtttttcagatttgaaattaattttcaaagtagttttgatgtctacacaaaccgaactgcaattttccctttaaagtgattctttgttttct

SEQ ID NO: 7216 - DNA, 732 bp, Zamia vazquezii
ttgctcttggactgtttgagatttgcagggaagggctaagtcgccgggggatttctgatacgatttaaatcaaaatggcgaggatcaaggttcacgagcttcgtaacaagagcaaatcggagctgttgaatcagctcaaggagcttaaggcagagctcgctttgctcagagttgccaaggtcacggggggggccccgaacaagctctccaaaatcaaggttgtaaggctgtcaatagcccaggtgttgacggtgatttctcagaaccagaaggctgcattgagggaggcttacaagaaaaagaagtacatgccccttgacttgcgccctaagaagactcgcgcgatcaggcggcgccttactaagcatcaggcttcattgaaaacagagagacagaagaagaaagagatgaactttcccatgagaaaatatgctatcaagatttagagactaggtttgtattgttttagcaggattttgttacctgaacggcagaattgtgtttcctggtggctaattatggctatatgtgaatccatgtttacatgaaaatttaagtactaagtaacgcatgctgattcctaatcaatttaagttggggtaggggcacatttagagcacttaattctttgaggaatagagaaggggttgatgattgggaaaagatacgccaactgctatttatatattctcacttctttttaaattgggatttttttttcaaaaaaaaaaa

SEQ ID NO: 7217 - DNA, 574 bp, Solanum melongena
agtgaagctgtgagggatacgccatggataacaaggatcaaagtgcacgaattgaggcagaaatccaaggctgatcttttgggtcagttgaaggatctcaaaacagaacttgctctcctccgtgatgctaaagtcactggaggcgccccgccccaacaagctctctaaaataaaggtggtaaggctgtcaatagcacaggtgttgacagtgatattgcagaggcagaagtcagcacttagggaagcatacaagaataagaagtattcacctctcgaccttcgtcccaagaagaccagagctatccatagacgtcttacaaagcaccaagcatctttgaagacggaaagggagaagaaaaaagagatttactttcccttgagaaagtatgtgattaaggtttaaatatccaacaaagattagtcattgtgatgttagaactaggatgagcaaatcagagtaaaattttccccagtgagttgttatattttctgttgtttattttgtgttcaatgaaggttgttcacttttcagtagtataatttcatatatcgaaatatctcgagttattctgca

SEQ ID NO: 7218 - DNA, 469 bp, Brassica juncea
tggcgaggattaaggttcacgaactgagagacaagtcgaagagcgatctgcagaatcagcttcaggatcttaaagctgagctcgctctcctccgtgtcgctaaagtcaccggtggtgctcccaacaagctctccaaaatcaaggttgtccgcaaatccatagctcaggtcttgacagtgacatctcagaagcagaaatctgctctcagagaagcatacaagaacaagaagttcatccctcttgatctccgtcccaagaaaacccgtgctatccgcagacgcctcaccaaacatcagctctcgttgaagacagagcgtgagaagaagaaggaaatgtatttcccaatcaggaagtacgctatcaaagtttaaatctttcttttagaaactttgtttcagcttttgttgtttgatggaaacttgtttttgctcctcacttgttctattgtctcaaacaatttcagcaacat

SEQ ID NO: 7219 - DNA, 623 bp, Jatropha curcas
aacagacgcagagccatggcaagaatcaagggttcatgagctaagaaacaaatcaaagacagagctgttgagccaattgaaggatctaaaagcagaattagcacttcttcgtgttgctaaggtcactggaggcgcacctaacaagctttccaaaattaaggttgtgaggctgtccatagcccaggttttgactgtgatatcccaaaagcagaaggcagctttgagggaagcctacaagaacaagaagtttttacctcttgatttgcgtcccaagaagaccagagctattcgtagacgcctcacaaagcatcaggcatctttgaagacagagcgcgagaagaagagggaaatgtacttcccaatgaggaagtatgccattaaggtgtaagcttggataaggaaagattgtttgtgtgccccctacaaactgttacattttttcccaagttgttgttattattattattattattattattatttttaggcttacatttttatgaatttgaacttaatgagtttgttttagctcaagctcccttcatttttaattgggatagtttttagactaggcatgttgttttaaacatgttatttttttttattatttccgagtcagaatc

SEQ ID NO: 7220 - DNA, 1088 bp, Pinus pinaster
atccaaaagtctatgagcctcctttgatgttgaggttgttttcattagatagttactaagtaaaattcttatcccaaggtaaaatactactttgccatatggcaaatagtccaaggagacaaagagacatgcaatcgctcgtctaaaacctaggtacaataaaccctagctcgtcattttctttctttattatctgttgttttagggtttgaggtgaggagcggagcggagaggagagcagaggagccgaggcgcagagcggacttgcgaaaatatttgaatcgaaatggccaggattaaggttcatgagctccgcaacaagagcaaatcagagctgttaagccagctcaaggagctcaaggctgagcttgccttgctcagagttgcaaaggtcactggaggagcgcccaacaaactctctaaaatcaaggtcgtgaggctatcaatagctcaggttctgactgtgatttctcagagccagcgatctgcattaagagaagcatacaagaaaaagaagtacctgcctcttgatttgcgtcccaagaagactcgtgctatcaggcgacgccttaccaagcatcaggcatcattgaagactgagagacagaaaaagaaagagatgtatttccaatgagaaagtatgcagtcaaggtgtaaagcataggatttgagctttcatgcaattttttgttactcgcgggatgattttgcctattatatttccatccaagtttttggcaaatttcgatttgcatcagaattcaagttatgataggtgttctttcgcttttgagcagaattcaagttatgataggtgttctttcgcttttgagcagttgatattgtttatcttttatttctcttgaattgcaaacatattctaatgcaatgagtggattattatattgtggtatttccatgttgaactcatatatgaaatgagtgtaatttgagtggtagcactaggatattttcactgttaatagcttttcatcaacatagttaatttgactccgcaaatgatcttgcgaggctaagtatgacttcgacacagtgaaaacatgaaatatttgtgacaaaaactggct

SEQ ID NO: 7221 - DNA, 1005 bp, Pinus pinaster
tttttaatttattggggtaccttgaaaccctagcttgtcgtcaaaacccgacggcacatacagattgttgatttcgctttggttactagtgttacagcgaggggaaggtcaaaggattttgggcaaagatggccagaattaaggttcacgagctacggctgaagagcaaagcagatctcctgaatcaactcaaggagctcaaggcggagcttgctttgctcagggttgccaaagtcacaggaggagcccctaacaagctttctaaaatcaaggtggtgagattatcaattgcacaagtgttaacagtgatatctcagaatcagaaaacagcgttgagggaagcctacaaaaagaagaagtatttgcctcttgacttgcgtcctaagaagacacgcgccatcagacgacgcctcaccaagcaccaggtacctcaatgaagactgagagacagaaaaaggagatgcacttccccatgagaaaatatgcagtcaaggtttaaagactttttgccaattttttttttcgcttgttggatacaggagcccaagtgttcaggctcagtgagtcgtctatattagattgtctaggaagcttaggttggattccagttctattgattgtacatggagttgaaattataattccatcttcatgtttcattgtggtattcaaattaaaaaactctaagttgctttgactcctaacctattaggattgattatcctttgtgattttttagattatcgtctttagctatgttgggatgtttttgtctgtcctggtcaagattagagaaagaggcttctttgtttatccaatttggaatatttttcaaaagtacacctagacgactaggagactagaagttgctttattaagattaactaaagttgcagtgtttcaaccaaaatccacagttttgaaaatatacatcttgtggtaaatgagtaacaataggaatgggtatcaatctctgcaacctttgaattcaagcctagaaggcag

SEQ ID NO: 7222 - DNA, 725 bp, Picea glauca
ggagaggagacgagacgagctgaggcacggagaggacttcttgtgaaagcatctgaatcgaaatggccaggattaaggttcacgagctccgtaataagagcaaagcagagctgttaaatcagctcaaggacctcaaggccgagcttgccttgctgagggttgcgaaggttactggaggagcgcccaacaagctctctaagatcaaggtcgtgaggctatcaatagcccaggtactaactgtgatttctcagaatcagcgatctgcattgagagaagcatacaaaaaaagaagtacttgcctcttgacttgcgtcctaagaagacccgcgccatcagacgacgcctcaccaagcaccaggcttcaatgaagactgagagacagaaaaagaaggagatgtacttcccagtgagaaagtatgcagtcaaggtctaaaggcaacaattttcttgctagcattatttgttttgcttgttggatacaggagtccaagtgttcaggctcagtgagtcgtctatattaggtttgtttgggaagtttagattgaattccagttctattgattgtacatggagttgaaattagaactccatgttcatgtttcattgtggtattcaaattcaaaaactccaaagtttgacttagaacctataaacctattacctgtgtgatttttggattatagtctttagctatgtagagatgttttagtcttgtcctggtcaag

SEQ ID NO: 7223 - DNA, 637 bp, Cirsium arvense
aatcaatcaatggctcgaatacaaagttcatgagcttaggacccaatcgaaggtcgatttgtttgctcagttgaaagatctcaaggcggaacttgctcttcttcgagtcgctaaagttaccggtggtgcgccaaacaagctctccaagataaaggtggtgaggacatcaattgcacaggtgttgactgtgatttcacagactcagaagtctgctctcagggaagcctacaagaacaagaagtacttgcctcttgacttgcgcccaaagaaaaccagggccatccgcagacgtcttaccaagcatcaggtttcattgaagactgaaagagagaagaagaaggagaagtacttccctttgaggaagtatgctatcaaggtgtaaggtgggaaattatggaggaggagatttaagtagttgttgtgtaaatctctttccagttttgaagtctgagtttgtgttctatttgatcagagatcatgtatttcatagttttttcttctgcaatgaggtaaaagacaattaacattggaagcctgttgcataccagtttacttgctttttttgtggaagacagtgtattgttgattgcattatgcatttgtggttaacctcaaaaagaaaaaagtaccgactgcg

SEQ ID NO: 7224 - DNA, 637 bp, Setaria italica
cacgccgccgcggccgccgcaggaagcccggcccgcgactcgccatgggtaagcccccctttcacgactctcgccgccgcctttcctgctcgcgtgttccctgccggatctaacctttcgttgtgcctatggcagcccggatcaaggtgcacgagctgcgggggaggaacaaggcggagctgcaggggcagctcaaggagctcaagtcggagctttccctcctccgcgtcgccaaggtcaccggcggcgcccccaacaagctctccaagatcaaggtggtgcggacctccatcgcgcgtgtgctcaccgtgatctcgcagaagcagaaggcggcgcttcgggaggcgtacaagaagaagaagctgctccccctcgacctccgccccaagaagacccgtgccatccgcaggcgcctcaccaagcaccagctctctttgaagactgagagggagaagaagcgcgagaagtacttccccatgaggaagtatgctatcaaggcctagattagtgaaaatgaacatgttttacccttaagttttgctcagaagttaccaggatttgatgtatcgcacacctattgtcatccaagtacaatgagcgtgatgaaaatgtgtactctttgcttcttgaaatctgc

SEQ ID NO: 7225 - DNA, 870 bp, Cycas rumphii
ggccttgccaaaagtcgatcaactggaaagagaaagccagaccctagttttagaacttgtcgaactgatggatataaaccctagccggaaatttcatttctcctctccttgatttttatcgctgagatcttccagcgacgagaaggcaagaattgccaaggagttttgagaagaattcgattcaatatggcgaggatcaaggttcacgagctacgtaacaagagcaaagcagagcttttgaatcagctcaaggagctcaagtcggagcttgctttgcttagggttgccaaggttaccggaggagcccccaacaagctctccaagattaaggtggtaaggctgtcgatagcccaggtattgactgtgatttctcagaaccaaaaggctgcattgagggaggcttacaagaaaaagaagtacattccgctcgacttgcgtcctaagaagacccgcgctatcaggcgccgtcttaccaagcatcaggcttcaatgaaaacagagagacagaagaagaaagagatgtactttcccatgagaaagtatgcaattaaagtttagagactagcttgcacacttttagcaggattttgttacccgaaagacagaattactcttcttattggccaattgtgagttttgtgtgaattcatatttccttggaaatttaattccagttttgatacattatgtttcataatcgatcaaattaatttatgcttacctttactcattttcttaatttccaatgggcaaactgtaatgttgtgatatctgaaattagggcttcctaccatatattttccatgcatagtttataaatggttgaacttgtgtaggggtgaattccaggaatttgatgttcagtttatg

SEQ ID NO: 7226 - DNA, 832 bp, Amborella trichopoda
atcgaaattagtctccccttctacaaaactacaaagtgggtcaaaaccctagttataagaggccctagagcaaaggcttttccaccctcggttatcagctagctttcctcatcagaaaccctagggcgtcatggcaagaatcaaggtccatgagttacggactaagacgaagacagagcttcttaatcaattgaaggagcttaaggctgagcttgcattgctcagagttgccaaggttactgggggtgctcccaacaagctctccaaaattaaggtggtacgtctctcaattgcccaggttctcactgttatatctcagaagcagaaagcagcgttgagagatgcctaccagaagaaaaagttccttcctttggatctccgcccgaagaagactcgtgcaattcgacgccgtctcactaaacatcaggcttccttgaagaccgagagggagattaagagagagaaatatttcccccaaaggaaatatgccatcaaagtatgaagcagaggcatgtggtaaactgcagttttgagatatttaaccctatttgttttccatggttttgtctctatgtggattctgaacttccatttcaatcactttcactatttttcttttgttcactttacttgttttgtttcagaggtttaagtagtagttcttaggttgctaggaaatgtattagaagaaattgtgtttcgaggacattcatgttttctttaatttcatgttgaaagaggaagagactacaatctaatgatatgagtgtggggattagctatcaaaagagatgccttattccaaattttcacttgaccattttgccctgaa

SEQ ID NO: 7227 - DNA, 406 bp, Ambrosia trifida
caacaacaaactcataatccatggctcgaattaaagtccatgagttgagggagaagacaaaggcagatttgtttgctcagttgacggaactcaaaactgaacttgcacttcttcgtgttgccaaagtcactggcggtgctcccaacaagctctccaaaataaaggtggtgaggactggtatcgcacaggtattgactgttatttcacagacacagaaggcaaagctcagggaagcttacaagaacaagaagtacttacctcttgatttgcgtccaaagaaaaccagagccatccgtaagcgtttgaccaaacatcaggcctcgttaaagaccgagcgggagaagaaaaaggagaagtactttccattgaggaagtatgctattaaggcttaggatagataatcaag

SEQ ID NO: 7228 - DNA, 734 bp, Amorphophallus konjac
cggccgggggcgcttcagtaagtttgtccttgttgtcgtctagttcgtctcccaccgtcgccatggcgaggattaaggtccacgagctccgcgccaagtcgaaggccgagctgctcaaccagctcaaggacctgaagacggagctctcgctgctgcgggtggccaaggtcactggtggtgcccccaacaagttgtcaaagattaaggtggtcaggctctccattgcccgcgtgctcactgtcatctcgcagaagcagaaggccgcgttgagggaggcctacagcaagaagaagttcttgcccttggatctgaggccgaagaagacccgcgccatcaggaagcgtctcactaagcatcaggcatctttgaagaccgagaggcaaaagaagagagagatgtactttcccaagagaaaatatgcaatcaaggcttaagttgaggtggagcatttacgccctttgttcgagttcacttctcagatacggtggtgtcagcattttgttttcttccttctgactgcaacggactgtttgcatctgtagtaagttattgttctggaggactctacgagtttatggtcagtcggcggtgttcaccgattgcgatgccctgtttcttgtggaggataatttaataggtgttgtgaagaatgcgtggtgccgcgttgagtggatgctacatttctgagaggattttttacccaaagaggggagagaaacttaatggtttcttgt

SEQ ID NO: 7229 - DNA, 567 bp, Brassica juncea
ggattctccgagccaacaagtagcagcgccgcaccatttgaacaagattcaagctcacgatggcgaggattaaggttcacgaactgagagacaagtcgaagagcgatcttcagaaccagcttcaggatcttaaggctgagctcgctctcctccgtgtcgctaaggtcaccggaggtgctcccaacaagctctccaaaatcaaggttgtccgaaaatcgatagctcaggtgttgaccgtgacatctcagaagcagaagtctgctctcagagaagcgtacaagaacaagaagttcatccctctcgatctccgtcccaagaaaacacgtgctatccgcaggcgccttaccaaacatcagctatcgttgaaaacagagcgtgagaagaagaaggaaatgtacttcccaatcaggaagtacgccatcaaagtttaaatctttctattagaaactctgtttcagcttttgttcttttggtggaaacttgttattggttctttacttgtgctatggtgtcgaacagtttcagtaacatggattttggttcttatttatattttcattttatctg

SEQ ID NO: 7230 - DNA, 646 bp, Brassica juncea
aaagaagagtagcagcggcggaacaggagtgaagataacacgatggcgaggatcaaggttcacgagctgagggacaagtcgaagagcgatctgcagaatcagcttcaggatctgaaggctgagctcgctctcctccgtgtcgctaaagtcaccggcggtgctcccaacaagctctctaaaatcaaggttgtcaggaaatcaatagctcaggtgttgacagtgacttcacagaagcagaaatctgcactcagagaagcatacaagaacaagaagttcatccctctcgatctccgtcccaagaagacccgtgctatccgcagacgcctcaccaaacaccagctctctttgaagacagagcgcgagaagaagaaggagatgtatttcccaataaggaagtacgcgatcaaagtttaagtcttagctactagaaactctgtttcagctttgtgtttttgatgcaaacttgttttgttattggctttctgctattttctcaaacagtttcaccaacatggattttggttcctattgatactttgcattttatcttttgctcactttcatattttaacttgtgttattcatgctgatattttacttgaaattgaagttaaccagctcaaactacaacaaaaaattacacaca

SEQ ID NO: 7231 - DNA, 429 bp, Brassica juncea
ggggagccaacaagtagcagcggcgcagcagttgaacacgagttaagctcacgatggcaagaattaaggttcacgaactgagagacaagtcgaagagcgatcttcagaaccagcttcaggatcttaaggctgagctcgctctcctccgcgtcgctaaagttaccggtggtgctcccaacaagctctctaaaatcaaggttgtccggaaatcaatagctcaggtgttgacagtgacatctcagaagcagaaatcagctctaagagaagcatacaagaacaagaagttcatccctcttgatctccgtcccaagaaaacccgtgctatccgtaggcgcctcaccaagcatcagctctcgttgaagacagagcgtgagaagaagaaggaaatgtatttcccaatcaggaagtacgctatcaaagtttaaatct

SEQ ID NO: 7232 - DNA, 698 bp, Brassica juncea
tcggggtctccgttagtagggtttctgattctctgagccaaagaagagcagcggcggcggcgtaacacgagtgaagatcacaatggcgaggattaaggttcacgaactgagggacaaatcgaagagcgatctgcagaatcagcttcaggatctgaaggcggagctcgctctcctccgtgtagctaaagtcaccggtggtgctcccaacaaactctctaaaatcaaggttgtcaggaaatcaatagctcaggtgttgacagtgacctcgcagaagcagaaatctgcactcagagaagcatacaagaacaagaagttcatccctcttgatctccgtcccaagaagacccgcgctatccgtagacgtctcactaaacatcagctctcgttgaagacagagcgtgagaagaagaaggagatgtacttcccaatcagaaagtacgctatcaaagtttaaatctttctactagaaactctgtttcagctttgtgttttttttttttgatggaaacttgttttactcttctctttgtgctatcttgtcaaactatttcaccaacatggattttgcttcctattgttattttgcattttcttaactcgggcgtctaaagatgagtttaggcgtaatataattgagttatattgtttatgcttggaaaccattgaggtcagtatgataatggagttatttataatct

SEQ ID NO: 7233 - DNA, 592 bp, Brassica juncea
gcggcggcgtaacacgagtgaagttcacgatggcaaggattaaggttcacgaactgagggacaagtcgaagagcgatcttcagaatcagcttcaggatctgaaggctgagctcgctctcctccgtgtcgccaaagtcaccggtggtgctcccaacaagctctctaaaatcaaggttgtccggaaatcaatagctcaggtgttgacagtgacttcacagaagcagaaatctgcactcagagaagcatacaagaacaagaagttcatccctcttgatctccgtcccaagaaaacccgtgctatccgcaggcgcctcaccaaacatcagctttcgttgaagacagagcgtgagaagaagaaggaaatgtatttcccaatcaggaagtacgccatcaaagtttaagttacctgtcctttaaaaaatctttagactataaactctgtttcagctttgttgtttgatggatacttgtttttgttcttcacttgtgtcagcaacgtggattttgtttcctattgatgttttgaaattttttatctttgcaagttttgttttgcttagttaaaaataacacacgcccatctctaaccagg

SEQ ID NO: 7234 - DNA, 715 bp, Brassica juncea
agttcatcaccagaaagctcacgatggcgaggattaaggttcatgagcttagagagagatcgaagacggatcttcagagccagcttcaggagttcaaagctgagctcgccctcctccgtgtcgctaaagtcaccggaggtgcccctaacaagctttccaaaatcaaggtggtgaggaaatccattgctcaggttttgacagtgatctcacagaagcagaagttagcactaagagaagcatacaagaacaagaagttcttgcctcttgatcttcgtcccaataagactcgtgctatccgtagacgtcttaccaagcatcagtcttctttgaagactgagcgtgagaagaagaaagagatgtatttccctctgaggaagtatgctatcaaagtttagtttctctccagctttcctactaggaatgattcagctttttgattattcacttattttgtccacctttttttttactcaaagttttgttatggaacagtcaaatctctctcctactcgtccaaaacattatttcataataagtgaaattgaactagttctcggctttgtggtaacccctaggtaatattgatcttttgtatacgtttagttcaagagatgacgaaatgaaaacaagttagtttggttaataacttggtttgtactatttaggattgttaatggttgactgaaattaaaagctaaatgcaaattcgtagaat

SEQ ID NO: 7235 - DNA, 606 bp, Brassica juncea
gagccaactttaaaaagagtagtagcggcgcagcaggtgaacacacagcgaagcttaacgatggcgaggattaaggttcacgaactgagagacaagtcgaagagcgatcttcagaaccagcttcaggatcttaaggctgagctcgctctcctccgcgtcgctaaggtcaccggaggtgctcccaacaagctctccaaaatcaaggttgtccgaaaatcaatagctcaggtgttgaccgtgacttctcagaagcagaagtctgctctcagagaagcgtacaagaacaagaagttcatccctcttgatctccgtcccaagaaaacccgtgctatccgcaggcgcctcaccaaacatcagctttcgttgaagacagagcgtgagaagaagaaggagatgtacttcccaatcagaaagtacgctatcaaagtttaaatctttctattagaaactcagtttcagcttttgttcttttgatggaaacttgttcttgttctttacttgtgctatggtctcaaacagtttcagtaacatggattttggttcttatttatattttcattttatcttgtgcccatctctaacagcttgttattccgtccattattc

SEQ ID NO: 7236 - DNA, 429 bp, Brassica juncea
aactttaaaaagagtagtagcggcgcagcaggtgaacacacagcgaagcttaacgatggcgaggattaaggttcacgaactgagggacaagtcgaagagcgatcttcagaatcagcttcaggatcttaaggctgagctcgctctcctccgtgtcgctaaagtcaccggtggtgctcccaacaagctctccaaaatcaaggttgtccgcaaatccatcgctcaggtgttgactgtgacatctcagaagcagaagtctgctctcagagaagcatacaagaacaagaagttcatccctcttgatctccgtcccaagaaaacccgtgctatccgcaggcgcctcaccaaacatcagctttcgttgaagacagagcgtgagaagaagaaggaaatgtatttcccaatcaggaagtacgccatcaaagtttaagt

SEQ ID NO: 7237 - DNA, 565 bp, Brassica oleracea
gagctaaagaagagtagcagcagccagcggcggaacacgagtgaagatcaacacgatggcgaggatcaaggttcacgaactgagggacaagtcgaagagcgatctgcagaatcagcttcaggatctgaaggctgagctcgctctcctccgtgtcgctaaagtcaccggtggtgctcccaacaagctctccaaaatcaaggttgtcaggaaatcaatagctcaggtgttgacggtgacttcacagaagcagaagtctgcactcagagaagcatacaagaacaagaagttcatccctcttgatctccgtcccaagaagactcgtgctatccgcagacgcctcaccaaacaccagctctctttgaagacagagcgcgagaagaagaaggagatgtatttcccaataaggaagtacgctatcaaagtttaagtcttagctactagcaaactctgtttcagctttgtgtttttgatgcaaacttgttttgttattggctttgtgctattttctcaaacagtttcaccaacatggattttggttcctattgatactttgcattttatcttt

SEQ ID NO: 7238 - DNA, 564 bp, Brassica oleracea
gagcggcgcagcagttgaacgaacacgagtgaaagcttcacgatggcgagaatcaaggttcacgagctgagggacaagtcgaagagcgatcttcagaaccagcttcaggatcttaaggctgagctcgctctcctccgtgtcgctaaagtcaccggtggtgctcccaacaagctctccaaaatcaaggttgtccgcaaatccatagctcaggtgttgactgtgacatcccagaagcagaagtctgctctcagagaggcgtacaagaacaagaagttcattcctcttgatctccgtcccaagaagacccgtgctatccgcagacgcctcaccaaacatcagctctctttgaagacagagcgtgagaagaagaaggagatgtacttcccaatcaggaagtacgccatcaaagtttaagttacctgtcctttaaaaaaaaaactctagctactagaaactctgtttcagctttgttctgtttgatggaaacttgtttttgttctccacttgttctattgtgtcaaacaatttcagcaacatggattttgtttcttattttatgttttg

SEQ ID NO: 7239 - DNA, 563 bp, Brassica oleracea
gagccaacaagtagcagccgcgcatcatttgaatacgattcaagttaacaatggcgaggattaaggttcacgagctgagggacaagtcgaagagcgatcttcagaaccagcttcaggatcttaaggctgagcttgctctcctccgtgtcgctaaggtcaccggaggtgctcccaacaagctctccaaaatcaaggttgtccgaaaatccatagctcaggtgttgacagtgacttctcagaagcagaagtctgctctcagagaagcgtacaagaacaagaagttcatccctctcgatctccgtcccaagaaaacacgtgctatccgcaggcgcctcaccaagcatcagctatcgttgaaaacagagcgtgagaagaagaaggaaatgtacttcccgatcaggaagtacgccatcaaagtttaaatctttctattagaaactctgttttcagctttttttttttctttttgatggaaacttgttatgggttcgttacctgtgctatggtgtcaaacagtttcagtaacatggattttggttcttattgatattttcatattatct

SEQ ID NO: 7240 - DNA, 762 bp, Brassica rapa
ttgtttcgtatataaatcccatttttagggtttctgatacactgagctaaagaagagtagcagcggcggaacaggagtgaagataacacgatggcgaggatcaaggttcacgagctgagggacaagtcgaagagcgatctgcagaatcagcttcaggatctgaaggctgagctcgctctcctccgtgtcgctaaagtcaccggcggtgctcccaacaagctctctaaaatcaaggttgtcaggaaatcaatagctcaggtgttgacagtgacttcacagaagcagaaatctgcactcagagaagcatacaagaacaagaagttcatccctctcgatctccgtcccaagaagacccgtgctatccgcagacgcctcaccaaacaccagctctctttgaagacagagcgcgagaagaagaaggagatgtatttcccaataaggaagtacgcgatcaaagtttaagtcttagctactagaaactctgtttctgctttgtgtttttgatgcaaacttgttttgttattggctttctgctattttctcaaacagtttcaccaacatggattttggttcctattgatactttgcattttatcttttgctcactttcatattttaacttgtgttattcatgctgttattttacttgaaattgaagttaaccagctcaaactacaatgttcattgtctaaatatatttgtgtttaagagcatctccaatgtattattctaaattttactccaaaatggtgtaactccaaa

SEQ ID NO: 7241 - DNA, 685 bp, Brassica rapa
gggttttgtgagctctctttgattatatatcaccttcctcctgctctaggttttcagattcctccgagcggcgcagcagttgaacgaacacgagtgaaagcttcacgatggccagaatcaaggttcacgagctgagggacaagtcgaagagcgatcttcagaaccagcttcaggatcttaaggctgagctcgctctcctccgtgtcgctaaagtcaccggtggtgctcccaacaagctctccaaaatcaaggttgtccgcaaatccatagctcaggtgttgactgtgacatcccagaaacagaagtctgctctcagagaggcgtacaagaacaagaagttcattcctcttgatctccgtcccaagaagacccgtgctatccgcagacgcctcactaaacatcagctctctttgaagacagagcgtgagaagaagaaggaaatgtatttcccaatcaggaagtacgccatcaaagtttaacttacctgtccttttaaaaaaaaactctagctactagaaactctgcttcagcttttgttgtttgatggaaacttgtttttgttattcacttgttctattgtgtcaaacaatttcagcaacttggattttgtttctttttttatgttttgaattttatctttgcaagttattcttttgcgtactgaagaacccaccatctcgagttc

SEQ ID NO: 7242 - DNA, 739 bp, Brassica rapa
tcttgggcttttacggcccattatatttgactcataaatgggttttcaactcattcgcatcgtataaatttgcattgttactcaaaattagggttttgcaacatttggaaccagaaacgaggaagcagagttcaacaccagcaagctcacgatggcaaggattaaggttcatgagctcagagagagatcgaagacagatcttcagagtcagcttcaggagtttaaggctgagctcgctctcctccgtgtcgctaaagtcaccggcggtgcccctaacaagctttccaaaatcaaggtggtgaggaaatcaatcgctcaggtattgacagtcatctcccagaagcagaaattagcactaagggaagcatacaagagcaagaagtttttacctcttgatctccgtcccaagaagactcgtgctatccgcagacgtcttaccaagcatcagtcttctttgaagacagagcgtgagaagaagaaagagatgtatttccctctgaggaagtatgctatcaaagtctagttttccttctctccttcttagcgctactagaagtgattctgcttcttgattgtttcgcttatgtattctcctctttttttttttttttccacctttcatttttactcaagttttgttatgaatatcttcaaagaccttgttgaaattgaacgtttcattttgtcatcgtttagttgaagaggataaatgaaaacaagtcagtttggttaatagctt

SEQ ID NO: 7243 - DNA, 660 bp, Brassica rapa
accgttcctccgttcctagggtttctgattctccgagccaacaagtagcagcgccgcaccatttgaacaagattcaagctcacgatggcgaggattaaggttcacgaactgagagacaagtcgaagagcgatcttcagaaccagcttcaggatcttaaggccgagctcgctctcctccgtgtcgctaaggtcaccggaggtgctcccaacaagctctccaaaatcaaggttgtccgaaaatcaatagctcaggtgttgaccgtgacttctcagaagcagaagtctgctctcagagaagcgtacaagaacaagaagttcatccctcttgatctccgtcccaagaaaacacgtgctatccgcaggcgccttaccaaacatcagctatcgttgaaaacagagcgtgagaagaagaaggaaatgtacttcccaatcaggaagtacgctatcaaagtttaaatctttctattagaaactctgtttcagcttttgttcttttggtggaaccttgttattggttctttacttgtgctatggtgtcaaacagtttcagtaacatggattttggttcttatttatattttcattttatcttgtgcccatctctaacagcttgttattccgtccattattcacttgaaattcgaagtttacttatcacaa

SEQ ID NO: 7244 - DNA, 764 bp, Beta vulgaris
ttcttttctagggtttgcagaatccaaaatcgccgtaacacaactcaggagcagaaatggcgagaatcaaggttcatgagctgagggataaaccaagggcagagctgttgaatcagctcaaggatctcaaggctgagctcgcgcttcttcgtgttgctaaagttacaggcggtgcgcctaacaagctctccaagattaaggtggtaagattagggattgcgcaagttttgacagtgatgtcacagaagcagaagtcggcgttgagggaagcttacagtaagaagaagtatttgcctcttgatcttcgtcctaagaagactcgtgctattcgtcgccgcctcacgaagcaccaggcatctttgaagactgaaagggagaagaaaaaggagaggtactatcccatgaggaagtacgccatcaaggtgtaggctaggcattcctatatctaggaggattgttatattccatggaaattttgttcaaatgtttgttaagctttttaaagcgattttcagttacgaaaatagtcagttctctacctttttatttcatgttgcaagagttttattttcttaaataggattgtggttgtgatctaaagatttttgacacagaatggatggtgaaagttttcaacagtgtttattgtgttgagtaagttatatttggacctttactatacgcacaagatgtgttaattttgccatcttggctcccaggtctaatcaaatctagtatgtggaatgtgatgcatgcattgaatc

SEQ ID NO: 7245 - DNA, 507 bp, Brassica napus
atttgaacaagattcaagctcacgatggcgagaattaaggttcacgaactgagggacaagtccaagagcgatcttcagaaccagcttcaggatcttaaggctgagctcgctctcctccgcgtcgctaaggtcaccggaggtgctcccaacaagctctccaaaatcaaggttgtccgaaaatcgatagctcaggtgttgaccgtgacttctcagaagcagaagtctgctctcagagaagcgtacaagaacaagaagttcatccctctcgatctccgtcccaagaaaacacgtgctatccgcaggcgccttaccaaacatcagctatcgttgaaaacagagcgtgagaagaagaaggaaatgtacttcccaatcaggaagtacgctatcaaagtttaaatctttctattagaaactctgtttcagcttttgttcttttggtggaaccttgttattggttctttacttgtgctatggtgtcaaacagtttcagtaacatggattttggtt

SEQ ID NO: 7246 - DNA, 562 bp, Brassica napus
ggagcggcgcagcagttgaacgaacacgagtgaaagcttcacgatggcgagaatcaaggttcacgagctgagggacaagtcgaagagcgatcttcagaaccagcttcaggatcttaaggctgagctcgctctcctccgtgtcgctaaagttaccggtggtgctcccaacaagctctccaaaatcaaggttgtccgcaaatccatagctcaggtgttgactgtgacatcccagaagcaaaagtctgctctcagagaggcgtacaagaacaagaagttcattcctcttgatctccgtcccaagaagacccgtgctatccgcagacgcctcactaaacatcagctctctttaaagacagagcgtgagaagaagaaggaaatgtatttcccaatcaggaagtacgccatcaaagtttaacttacctgtccttttaaaaaaaaactctagctactagaaactctgtttcagcttttgttgttttatggaaacttgtttttgttattcacttgttctattttgtcaaacaatttcagcaacatggattttgtttcttattttatgttt

SEQ ID NO: 7247 - DNA, 866 bp, Brassica napus
aagcaaagcgttcgcaagtgcatgcagctctttattataaaccgtgaggatgtttctcgcgttgttataagccttctccaaaagaagcttcacttccctctcgatgagaagcctcgtctccgtgctcatgctcttcccattgtcatcatagttatgcgccacgagaccaacccagcggcggaacaggagtgaagataacacgatggcgaggatcaaggttcacgagctgagggacaagtcgaagagcgatctgcagaatcagcttcaggatctgaaggctgagctcgctctcctccgtgtcgctaaagtcaccggcggtgctcccaacaagctctctaaaatcaaggttgtcaggaaatcaatagctcaggtgttgacagtgacttcacagaagcagaaatctgcactcagagaagcatacaagaacaagaagttcatccctctcgatctccgtcccaagaagacccgtgctatccgcagacgcctcaccaaacaccagctctctttgaagacagagcgcgagaagaagaaggagatgtatttcccaataaggaagtacgcgatcaaagtttaagtcttagctactagaaactctgtttctgctttgtgtttttgatgcaaacttgttttgttattggctttctgctattttctcaaacagtttcaccaacatggattttggttcctattgatactttgcattttatcttttgctcactttcatattttaacttgtgttattcatgctgttattttacttgaaattgaagttaaccagctcaaactacaatgttcattgtctaaatatatttgtgtttaagagcatctccaatgtattattctaaattttactccaaaaaaaaaaa

SEQ ID NO: 7248 - DNA, 521 bp, Brassica napus
aacaagtagcagcgccgcaccatttgaacaagattcaagctcacgatggcgaggattaaggttcacgaactgagagacaagtcgaagagcgatcttcagaaccagcttcaggatcttaaggccgagctcgctctcctccgtgtcgctaaggtcaccggaggtgctcccaacaagctctccaaaatcaaggttgtccgaaaatcgatagctcaggtgttgaccgtgacttctcagaagcagaagtctgctctcagagaagcgtacaagaacaagaagttcatccctcttgatctccgtcccaagaaaacacgtgctatccgcaggcgccttaccaaacatcagctatcgttgaaaacagagcgtgagaagaagaaggaaatgtacttcccaatcaggaagtacgctatcaaagtttaaatctttctattagaaactcagtttcagcttttgttcttttgatggaaacttgttcctgttctttacttgtgctatggtctcaaacagtttcagtaacatggatt

SEQ ID NO: 7249 - DNA, 741 bp, Brassica napus
tctaggcttatcttatccctcccccacctctatcttataccctaactaacccaccccgggcgcctcccccaattcccttcccgcatgccgtacggtacggaattctcgggtcgaccacgcgtccgaacaagtagcagcgccgcaccatttgaacaagattcaagctcacgatggctaggattaaggttcacgaactgagagacaagtcgaagagcgatcttcagaaccagcttcaggatcttaaggctgagcttgctctcctccgtgtcgctaaggtcaccggaggtgctccaaacaagctctccaaaatcaaggttgtccgaaaatcaatagctcaggtgttgaccgtgacttctcagaagcagaagtctgctctcagagaagcgtacaagaacaagaagttcatccctcttgatctccgtcccaagaaaacacgtgctatccgcaggcgccttaccaaacatcagctatcgttgaaaacagagcgtgagaagaagaaggaaatgtacttcccaatcaggaagtacgctatcaaagtttaaatctttctattagaaactctgtttcagcttttgttcttttggtggaaccttgttattggttctttacttgtgctatggtgtcaaacagtttcagtaacatggattttggttcttatttatattttcattttatcttgtgcccatctctaacagcttgttattccgtccattattcacttgaaattcgaagtttacttat

SEQ ID NO: 7250 - DNA, 639 bp, Brassica napus
tttctctgagccaacaagtagcagccgcgcatcatttgaatacgattcaagttaacaatggcgaggattaaggttcacgagctgagggacaagtcgaagagcgatcttcagaaccagcttcaggatcttaaggctgagcttgctctcctccgtgtcgctaaggtcaccggaggtgctcccaacaagctctccaaaatcaaggttgtccgaaaatccatagctcaggtgttgacagtgacttctcagaagcagaagtctgctctcagagaagcgtacaagaacaagaagttcatccctctcgatctccgtcccaagaaaacacgtgctatccgcaggcgcctcaccaagcatcagctatcgttgaaaacagagcgtgagaagaagaaggaaatgtacttcccgatcaggaagtacgccatcaaagtttaaatcctttctattagaaactctgttttcagcttttttttttctttttgatggaaacttgttatgggttcgttacctgtgctatggtgtcaaacagtttcagtaacatggattttggttcttattgatattttcattttatctgtgcccatctctaccagcttgttattccgtccattattcacttgaaattcaaagtttacttatcacaag

SEQ ID NO: 7251 - DNA, 604 bp, Brassica napus
gcggcgcagcagttgaacgaacacgagtgaagcttcacgatggcgagaatcaaggttcacgagctgagggacaagtcgaagatcgatcttcagaaccagcttcaggatcttaaggctgagctcgctctcctccgtgtcgctaaagtcaccggtggtgctcccaacaagctctccaaaataaaggttgtccgcaaatctatcgctcaggtgttgactgtgacatcccagaagcagaagtctgctctcagagaggcgtacaagaacaagaagttcattcctcttgatctccgtcccaagaagacccgtgctatccgcagacgcctcaccaaacatcagctctctttgaagacagagcgtgagaagaagaaggagatgtacttcccaatcaggaagtacgccatcaaagtttaagttacctgtcctttaaaaaaattctagctactagaaactctgtttcagctttgttctgtttgatggaaacttgtttttgttctccacttgttctattgtgtcaaacaattccagcaacatggattttgtttcttattttatgttttgaattttatctttgcaagttattcttttccgcactgaagaaaccacc

SEQ ID NO: 7252 - DNA, 556 bp, Brassica napus
ggagcggcgcagcagttgaacgaacacgagtgaagcttcacgatggcgagaatcaaggttcacgagctgagggacaagtcgaagatcgatcttcagaaccagcttcaggatcttaaggctgagctcgctctcctccgtgtcgctaaagtcaccggtggtgctcccaacaagctctccaaaataaaggttgtccgcaaatctatcgctcaggtgttgactgtgacatcccagaagcagaagtctgctctcagagaggcgtacaagaacaagaagttcattcctcttgatctccgtcccaagaagacccgtgctatccgcagacgcctcaccaaacatcagctctctttgaagacagagcgtgagaagaagaaggagatgtacttcccaatcaggaagtacgccatcaaagtttaagttacctgtcctttaaaaaaattctagctactagaaactctgtttcagctttgttctgtttgatggaaacttgtttttgttctccacttgttctattgtgtcaaacaattccagcaacatggattttgtttcttattttatg

SEQ ID NO: 7253 - DNA, 653 bp, Brassica napus
gatcgtataaatttgcattgttactcaaaattagggttttgcaacatttggaaccagagttcgacaccagcaagctcacgatgtctaggattaaggttcatgagctcagagagagatcgaagacagatcttcagagtcagcttcaggagtttaaggctgagctcgcgctcctccgtgtcgctaaagtcaccggaggtgcccctaacaagctttccaaaatcaaggtggtgaggaaatcaatcgctcaggtattgacagtgatctcccagaagcaaaaattagcattaagggaagcatacaagagcaagaagtttttacctcttgatctccgtccaaagaagactcgtgctatccgcagacgtcttaccaagcatcagtcttctttgaagacagagcgtgagaagaagaaagagatgtatttccctctgaggaagtatgctatcaaagtctagttttccttctctccttagcgctactagaagtgattctgcttcttgattgtttcgcttatgtattctgctcttcttcttttttccacctttcatttttactcaagttttgttatgaatatcttcaaagaccttgaaattgaacatttcattttgtcatcgtttagttgaagaggataaatgaaaacaagtcagtttggttaa

SEQ ID NO: 7254 - DNA, 505 bp, Brassica napus
cagcggcggaacacgagtgaagatcaacacgatggcgaggatcaaggttcacgaactgagggacaagtcgaagagcgatctgcagaatcagcttcaggatctgaaggctgagctcgctctcctccgtgtcgctaaagtcaccggtggtgctcccaacaagctctccaaaatcaaggttgtcaggaaatcaatagctcaggtgttgacggtgacttcacagaagcagaagtctgctctaagagaagcatacaagaacaagaagttcatccctcttgatctccgtcccaagaagactcgtgctatccgcagacgcctcaccaaacaccagctctctttgaagacagagcgcgagaagaagaaggagatgtatttcccaataaggaagtacgcgatcaaagtttaagtcttagctactagaaaactccgtttcagctttgtgtttttgatgcaaacttgttttgttattggctttgtgctattttctcaaacagtttcaccaacatgg

SEQ ID NO: 7255 - DNA, 558 bp, Brassica napus
caaggaggaagcagcggcgcctcagttcaccaccaccaccaggaagctcacgatggcgagaattaaggttcacgagctcagagagagatcgaagacggatcttcagaaccagcttcaggagttcaaggctgagctcgccctcctccgtgttgctaaagttaccggcggtgcccctaacaagctctccaaaatcaaggtggtgaggaaatccattgctcaggttctgacagtgatctcacagaagcagaaactagcactaagggaagcatacaagagcaagaagttcttgcctcttgatctccgtcccaagaagacacgtgctatccgcagacgtcttaccaagcatcagtcatctctgaagacagagcgtgagaagaagaaagagatgtatttccctctgaggaagtatgctatcaaagtctagttactagaaatgattcaactctttttgattattcgcttattatgtattctccttttttttatttttttgttactcaagttttgtcatggaacagccgaaactttcttgctcgaatcattcatttatctcataaa

SEQ ID NO: 7256 - DNA, 607 bp, Brassica napus
tcagttcaaaaataaggttattgggtcttttacggccctattatatttgagtttttaagggttttcaactcactcgcatcgtataaattgcctggttcctcaaaattagggtttgcgactgttggagccagaaacgaggaagcagagttcaacaccagcaagctcacgatggcaaggattaaggttcatgagcttagagagagatcaaagacggatcttcagagccagcttcaggagttcaaggctgagctcgctctcctccgtgtcgctaaagtcaccggaggtgcccctaacaagctttccaaaatcaaggtcgtgaggaaatcaattgctcaggtattgacagtgatctcccagaagcagaaattagcactaagagaagcatacaagagcaagaaatttttacctcttgatcttcgtcccaagaagactcgtgctatccgcagacgtcttaccaagcatcagtcttctttgaagacagagcgtgagaagaagaaagagatgtatttccctctgaggaagtatgctatcaaagtctagttttccttctctccttcttagcgctgctagaaatgattccgcttcttgattgtttcgcttatgtatt

SEQ ID NO: 7257 - DNA, 793 bp, Cephalotaxus harringtonia
aatttcacagacgctatcatgaagagactggcatcacatttgcagtcattctcacccatctcagcaccatagctgctcatgttgcaggtggtttcaacaatctccaccccgaagctgttgcgcttcttggtgcactggcttttgtcggcgcagtcacagtttccgcatccagaagacccattaggatttcaagcggaccagggtgttctatcgaattcatatcgagatggcgaggatcaaggttcacgagttgcgcaccaagggaaaatccgaattgctgaatcagctgaaggagctcaaggccgagttggccttgctcagggtcgctaaagttacaggaggagcgcccaacaagctctcaaagatcaaggtcgttagaaaatcgatagctcaggttctgacagtgatttcccagacccagaaagctgcgttgagggaggcattcaagaagaagaagtacatgcctctcgatcttcgtcccaagaaaactcgtgctatcaggcgacgtctcaccaagcaccaggcttctttgaagacagaaagggagaagaagagggagaagtacttccccatgagaaagtatgcaatcaaggtctagatattaggatcacttaggtctaaaagagacaatttatcaatgagagttctttctgcacaattgttttacttgaattgtagaataccccgctacatttccatgggctttttgagaagtcaaattgagttttcattgtgaacgattttaaattctgatttggtaaaatgaactaatgtctggtaaatatgatttttt

SEQ ID NO: 7258 - DNA, 681 bp, Cephalotaxus harringtonia
ccagggtgttctatcgaattcatatcgagatggcgaggatcaaggttcacgagttgcgcaccaagggaaaatccgaattgctgaatcagctgaaggagctcaaggccgagttggccttgctcagggtcgctaaagttacaggaggagcgcccaacaagctctcaaagatcaaggtcgttagaaaatcgatagctcaggttctgacagtgatttcccagacccagaaagctgcgttgagggaggcattcaagaagaagaagtacatgcctctcgatcttcgtcccaagaaaactcgtgctatcaggcgacgtctcaccaagcaccaggcttctttgaagacagaaagggagaagaagagggagaagtacttccccatgagaaagtatgcaatcaaggtctagatattaggatcacttaggtctaaaagagacaatttatcaatgagagttctttctgcacaattgttttacttgaattgtagaataccccgctacatttccatgggctttttgagaagtcaaattgagttttcattgtgaacgattttaaattctgatttggtaaaatgaactaatgtctggtaaatatgattttttacattgctggcatttttttgtttcaggagtctagggtatcctgaatgtattacaattataaccagtttttaatatttaggcattt

SEQ ID NO: 7259 - DNA, 564 bp, Cycas rumphii
ttgagaagaattcgattcagtatggcgaggatcaaggttcacgagttacgtaacaagagcaaagcagagcttttgaatcagctcaaggagctcaagtcggagcttgctttgcttagggttgccaaggttaccggaggagcccccaacaagctctccaagattaaggtggtaaggctgtcgatagcccaggtgttgactgtgatttctcagaaccaaaaggctgcattgagggaggcttacaagaaaaagaagtacattccgctcgacttgcgtcctaagaagacccgcgctatcaggcgccgtcttaccaagcatcaggcttcaatgaaaacagagagacagaagaagaaagaaatgtactttcccatgagaaagtatgcaattaaagtttagagactagcttgcacacttttagcaggattttgttacctgaaagatagaattactcttcttattggccaattgtgagttttgtgtgaattcatatttccttggaaatttaattccagttttgatacattatgtttcataatcaatcaaattaatttatgcttacctttactc

SEQ ID NO: 7260 - DNA, 506 bp, Gerbera hybrid cultivar
ggcggtccgcatctgctccagttacacttaatcagatggctcggatcaaagttcatgaattgaggggcaaatcgaaggctgatttgttcgctcagttgaaggatcttaaggctgaacttgctcttctccgtgtcgcccaggtcactggtggtgcgccgaacaagctctcccagataaaagtggtgaggacgtccatcgcacaggtgttaactgtgatttcacagacccagaaggccacacttagggaagcctaccagaacaagaaatacctgcctcttgacttgcgccccaagaaaaccagagccattcgcaggcgtctaacccagcatcaggcttcgttgaagaccgaaagagagaagaagaaagagaagtactttccattgaggaagtatgcaattaaggtgtagaaggagatgcgtgttttaactcttattccagttttgaatttacgtttgcgaacaaatgatttcatcggagtttgatgtatttgaaagaaatattgcctc

SEQ ID NO: 7261 - DNA, 660 bp, Panax ginseng
tcaacgcagagtacatgggggagtaaggaaggagatatcagagagagagagagagattgaaaatcgaaatggcgaggatcaaagttcacgaactgaggcaaaagtccaaggctgatctattggcacaattgaatgaactcaaatctgaactttctctcctccgtgtcgctaaggtcaccggcggtgctgttaacaagctctccaagataaaagttgtgaggcaatctatagcgcaggtatcgacggtgatgtcacagaagcagaaggcggttttgagagaagcttacaaggataagaagtatttgccccttgatcttcgtcccaagaagaccagagccatccgcaggcgcctcactaagcatcaggcatctctaaagacagaacgggaaaagaaggagatgtactttccaccgaggaagtatgccatcaaggtttaatatgtttgatttatccggagttagtttggtgtttctagcgtctaattaaggatgagagatgttaacggtttcttccgtacaatttatctagtttctgttacccttgatatataatggaaacatatttggagcttcattcttgttaaaattcattttcactagatgacaaacaatcctgcattgtttttcaataatttgagtgaatgttgatttgcttgcaaaa

SEQ ID NO: 7262 - DNA, 566 bp, Ipomoea batatas
gacagagagagagagagagagagaggtcccatggagaggatcaaggtacatgagctgaggcagaagtctactgccgagctgttggctcagctgaaggatctgaaggcggagctcgctctcctccgcgtcgccgaggtcaccggcggcgcccccaataagctctccaagattaaggtggtgcggttgtcaattgctcaggtgttgacagtgatttcccagacgcagaaagcagcactaaggaaagcatatgagaaaaagaagtatttgcctcttgatcttcgccctaagaagactacagctatccgcaggcgcctcactaagcaccaggcatctctgaagacagaaaggcagaagaagaaagagatgtacttcccagtgagaaaatatgctattaaggtttaatatattacagcttatatagtgaaactagttgtggctgaacattaaggacagacaaaacctttgccccatgagatttctagggattttttgttaagtggaaactttgctgtgttgagatttttgtttcagatattcttggccaaagactaaatatgttatcagtg

SEQ ID NO: 7263 - DNA, 599 bp, Pennisetum glaucum
cccaccccgccgccaccgccgcgacgccgccggaaccgccaccgtcgccatggcccggatcaaggtgcacgagctccgggggaagaacaaggcggagctgcaggggcagctcaaggagctcaagtccgagctctccctcctccgcgtcgccaaggtcaccggtggggcacccaacaagctctccaagatcaaggtggtgcgcacctctatcgcgcgcgtgcatacggtgatctcgcagaagcagaaggcggcgctgcgggaggcgtacaagaagaagaagctgcttcccctcgacctccgccccaagaagacccgtgccattcgccgccgcctcaccaagcaccagctttctctgaagacggagcgggaaaagaagcgtgacaagtacttccccatgaggaagtatgctatcaaggcctagatcagaactgtgagatgctaagcttagcatatcatcggctgtttcttttcctaggaagtgttttatgttttgatttgtatggacatttgctgtgggaaagtatggtgtatttcctctgttatctcaaatacctagattggtttaaggggcagttcgtattggcactgaaattttgttt

SEQ ID NO: 7264 - DNA, 720 bp, Arachis hypogaea
cccccccctatcccctgtgtgccttggcagtctcagaagcagtggtatcaacgcagagtacgggggagtttacgtaagaaaaaaccagagcgcattgcaattaggggcttttgaattttgattcgctttcggtttcagcagcatcaacaactttgcaatggcgagattgaaggtgtacgagctgaggaacaaaacgaaagcagagcttctgagccaattgaaggatctgaaagctgagctggcactcctccgtgttgccaaggtcactggcggagcacccaacaagctctccaaaataaaattggtgcggctatcgatagcgcaggtgttgacggttatttcccagaagcaaaagtcggtgctgagggaagcttacaagaagaagaagtatctgcctttggatctgcgtcctaagaagaccagagctatcagaagacgcctcaccaagcaccaggcttctttgaagacagagcgtgagaagaagaaggaagtatacttcccattgagaaaatatgcagttaaggtgtaatgttctccttgttacttgacgaaattctcaaagttttgttaaatcttcatgaattttttgtgcaaaacaatttctttttttgttttaatctagtcaaagcttgcatctttgtcattacaactttattagtcaatataatgttcaaacattccaaacactattgaaagagagtattatcattgtttgtttga

SEQ ID NO: 7265 - DNA, 649 bp, Arachis hypogaea
aagcagtggtatcaacgcagagtacgggggagtttacggaagaaaaaaccagagcgcattgcaattaggggttttgaattttgattcgctttcggtttcagcagcatcaacaactttgcaatggcgagattgaaggtgtacgagctgaggaacaaaacgaaagcagagcttctgagccaattgaaggatctgaaagctgagctggcactcctccgtgttgccaaggtcactggcggagcacccaacaagctctccaaaataaaattggtgcggctatcgatagcgcaggtgttgacggttatttcccagaagcaaaagtcggtgctgagggaagcttacaagaagaagaagtatctgcctttggatctgcgtcctaagaagaccagagctatcagaagacgcctcaccaagcaccaggcttctttgaagacagagcgtgagaagaagaaggaagtatacttcccattgagaaaatatgcagttaaggtgtaatgttctccttgttacttgacgaaattctcaaagttttgttaaatcttcatgaattttttgtgcaaaacaatttctttttttgttttaatctagtcaaagcttgcatctttgtcattacaactttattagtcaatataatgttcaaacattccaaaca

SEQ ID NO: 7266 - DNA, 642 bp, Phalaenopsis aphrodite
ccgcagtcctctaggctttctcgtctcatccagaggagcggtggagcaatggccaggattaaggttcacgaacttcgacagaagtcgaagacggagcttctgaaccagcttaatgacctgaagacagagctcgctcttctccgtgtcgcaaaggtcactggtggagccccaaacaagctctcaaagatcaaggtggtgaggctttcgatcgcgcaagtgctgacggtgatatcccagaagcagaaggcggcgctgagggaggcttacagaaagaagaagttcatcccgcttgatctgaggccgaagaaaacccgcgcaataaggcgcaagcttaccaagcgtcaggcgtcactgaagactgagcggcagaagaaaaaggagatgtatttcccgctgaggaaatatgccatcaaagcttagaaatctgtgccatgctctcattttgatgcaatcttgtctttttttaaacagaaaggttcaattgccaaattaatattgttagtttatgtttaaaatctacgaatttgagatttgtggtttgaacttttattccagcagatgatttatgatttttttggcggtttattttgctaattttatgcaaatatcttacatttttctgttgtataacacccagaaatt

SEQ ID NO: 7267 - DNA, 751 bp, Pinus taeda
ggtccaaggagacaaagagacatgcgatcactcgtctaaaccctaggtacaataaaccctagctcgtcattttctttctttattagctgttgttttagggtttgaggcgaggagcggagaggagaggagccgaggcacagagcgtactttgcgaaaggatttgaatcgaaatggccagaattaaggttcatgagctccgcaacaagagcaaatcagagctgttaagccaactcaaggagctcaaggctgagcttgccttgctcagagttgcaaaggtcactggaggagcgcccaacaaactctctaaaatcaaggtcgtgaggctatcaatagctcaggttctgactgtgatttctcagagccagcgatctgcattaagagaagcatacaagaaaaagaagtacctgcctcttgatttgcgtcccaagaagactcgtgctatcaggcgacgccttaccaagcatcaggcatcattgaagactgagagacagaaaaagaaagagatgtattttccaatgagaaagtatgcagttaaggtgtaaagcataggatttgagctttcatgcaattttttgttactcgcgggatgatattgcctattatatttccgtccaagtttttggcaaattccgatttgcatccgaattcaagttatgataggtgttctttcgcttttgagcagttgatattttttatcttttatttctcttgaattgcaaacatattctaatgcaatgagtggattattata

SEQ ID NO: 7268 - DNA, 805 bp, Pinus taeda
gaggagcggagcgtagcggagaggagaggagccgaggcgcagagcggacttgcgaaaggatttgaatcgaaatggccaggattaaggttcatgagctccgcaacaagagcaaatcagagctgttaagccagctcaaggagctcaaggctgagcttgccttgcttagagttgcaaaggtcactggaggagcgcccaacaaactctctaaaatcaaggtcgtgaggctatcaatagctcaggttctgactgtgatttctcagagccagcgatctgcactaagagaagcatacaagaaaaagaagtacctgcctcttgatttgcgtcccaagaagactcgtgctatcaggcgacgccttaccaagcatcagggatcattgaagactgagagacagaaaaagaaagagatgtattttccaatgagaaagtatgcagtcaaggtgtaaagcatacgatttgagctttcatgcaatttttttgttactcgcgggatgatattgcctgttatatttccgtccaagtttttggcaaattccgatttgcatcagaattcaagttatgataggtgttctttcgcttttgagcagttgatattgtttttcttttatttctgttgaattgcaaccatattctaatgcaatgagtggattataatattgtggtatttccatgttgaacgcacatatgaaatgagcataatttgagtggtagaactaggatattttcactgtcaattgcttttcatcaacatagttaatttgacaccgcaaatgatcttgcgaggctagacagtaaaatgattacttcg

SEQ ID NO: 7269 - DNA, 912 bp, Pinus taeda
gggtttgaggcggcgagcggagaggagaggagccgaggcgcagagcggacttgcgaaaggatttgaatcgaaatggccaggattaaggttcatgagctccgcaacaagagcaaatcagagctgttaagccagctcaaggagctcaaggctgagcttgccttgctcagagttgcaaaggtcactggaggagcgccgaacaaactctctaaaatcaaggtcgtgaggctatcaatagctcaggttctgactgtgatttctcagagccagcgatccgcattaagagaagcatacaagaaaaagaagtacctgcctcttgatttgcgtcccaagaagactcgtgctatcaggcgacgccttaccaagcatcaggcatcattgaagactgagagacagaaaaagaaagagatgtattttccaatgagaaagtatgcagtcaaggtgtaaagcataggatttgagctttcatgcaatttttttgttacttgcggggatgatattgcctattatatttccgtccaagtttttggcaaattccgatttgcatcagaattcaagttatgataggtgttctttcgcttttgagcagttgatattgtttatcttttatttctcttgaattgcaaacatataatgcaatgagtggattattatattgtggtatttccatgttgaactcacatatgaaatgagcgtaatttgagtggtagcgctaggatatttacactggcaatagcttttcatcaacattgttaatttgactccgcaaatgatcttgcgaggttaaacagtaaaagcatgacttcgacacagcgaaaacatgaaatatttgtgacaaaaactggctataagcaaaaataactaatttagttggcaaatgaaaacattgtcaaaagcttggcaaataaaataaac

SEQ ID NO: 7270 - DNA, 818 bp, Pinus taeda
cggccgggggattgcgagcgctcaacctcacaagggccttcacaatttagacctgcaaggccgatattttaacgtcaaagccagtcgatatacccagtataacgtgagctgtcttgtgtttactgtgctgtgatcacagctctcgaactcagccatggcggacgaggactacaatgactttgacggaggagatgtcggatacgaagaggagccgaggcacagagcgtactttgcgaaaggatttgaatcgaaatggccaggattaaggttcatgagctccgcaacaagagcaaatcagagctgttaagccaactcaaggagctcaaggctgagcttgccttgctcagagttgcaaaggtcactggaggagcgcccaacaaactctctaaaatcaaggtcgtgaggctatcaatagctcaggttctgactgtgatttctcagagccagcgatctgcattaagagaagcatacaagaaaaagaagtacctgcctcttgatttgcgtcccaagaagactcgtgctatcaggcgacgccttaccaagcatcaggcatcattgaagactgagagacagaaaaagaaagagatgtattttccaatgagaaagtatgcagttaaggtgtaaagcataggatttgagctttcatgcaattttttgttactcgcgggatgatattgcctattatatttccgtccaagtttttggcaaattccgatttgcatcagaattcaagttatgataggtgttctttcgcttttattgtttatcttttatttctcttgaattgcaaacatattctaatgcaatgagtggattat

SEQ ID NO: 7271 - DNA, 1093 bp, Pseudotsuga menziesii
gggatccctcatccgagtatcataacgaaaaacatacttcatagtagaaacttgttaattggtccaactcgaaaccctagcccatcgtcaaaaccctactgcccatatcgattattttcgcgaaaccctagcccatcgtcaaaaccctactgcccatatcgattattttcgcttctgttacagttgttacaacgagggcaaggccaaggatcttgggcaaacatggccaggattaaggttcacgagctgcggaacaagagcaaagcagagcttctgaatcaactgaaggagctaaaggcggagcttgctcttctcagggttgccaaagtcacaggaggagctgctaacaagctttctaaaatcaaggtggtgagattatcaattgcgcaggtgttgacagtaatatctcaaaatcagaaaacagcgctgagggaagcatacaaaaagaagaagtatttgcctcttgacttgcgtcccaagaaaacccgcgccatcagacgacgcctcaccaagcaccaggcttcattgaagactgagagacagaaaaagaaggagatgtacttcccaatgagaaagtatgcagtcaaggtctgaaggcagcagtttgcttgccagcattatatcttttgcttattagacataggagccgttcaggctcggtgggttatctttattagattcgtttgggaagcttagattggattccagttttgttgattgtgcattgagttgaaattaaaactccatgttcatgtttcactgtagtattcatattaaaaaattccaactatggttttgacctataacttattagggttgattattctgtgttattttggagtatagtctttaccaatgtagagatgtttttagtataacctggtcaagatttgggaaggaggctgctttggcttatccaatttggaatgttattctgaagtacatttagaagattagaagtttctcaattaaaactgaagttacagtgtttcagcagaaaaccacttttggaaaagaaatgtcgtgtcacttgaataatatttatggttctcatcctgcaacctttgaatgcaagcccagaaggcagttttct

SEQ ID NO: 7272 - DNA, 830 bp, Pseudotsuga menziesii
aataaatcttagctgtccaatttctttcttgatcatctgtttacctttagggtttgggagaggagagggagaggcgacgcgagcgaaaggcgagtcgagacttctgtgaaaggatttgaatcgaaatggccaggattaaggttcatgagctccgtattaagaccaaagcagagctgttaaatcagctcaaggagctcaaggctgagcttgccttgctcagggttgcgaaggttactggaggagcccccaacaagctctctaagatcaaggtcgtgagactatcaatagcccaggttctgaccgtgatttctcagaaccagagatctgcattgagagaagcatacaagaaaaagaagtacctgcctcttgacttgcgtcccaagaagactcgtgctattaggcgacgccttaccaagcatcaggcatcattgaagacagagagacagaagaagaaagagatgtattttcccatgagaaagtatgcagttaaggtgtaagatgtaggatttgagctttcatgcaatttttttgctatttgcgggatgatattgccttataatatttacactgagtttttagcaaattcctatttgcatcagatgcaagttgtgataggtgttttctcaatgttgagaaattaatattgtttgcctttcacttccctggagttgcaattagtctaatacattgaatgaattttatattttgatatctccatgtggaactctctatgaaatgattgacatttattttccaagtaactatgatattttaactgttagttttcaacagcacatttaaaactaattcgatttgacaaatgaccttct

SEQ ID NO: 7273 - DNA, 548 bp, Chenopodium quinoa
tttgcagcaaaaatccacctcagtagagcagtaatggcaagaatcaagccacatgagctgaggcaaaagcctacggctgatttgctaaatcagcttaaggatctcaaggctgagctcgctctcctccgtgttgctaaggttaccggcggtgctcctaacaagctctccaagattaaggtggtgagattagggattgcgcaagtattaacagtgacgtcgcagaagcagaagtcggcattgagggaagcatacaagaagaagaagtttttgccacttgatcttcgtcccaagaagacccgtgccattcgtcgtcgcctcactaagcaccaggcatctttgaagaccgaaagggagaagaagagggagaggtactatcccatgaggaagtatgccatcaaggtgtaggctaggtatctataatctagggcggttttcacatttcatggaaattttgttcaaatgtttgttaaacttctataaagtgatgtttcagattatgacatgagctagttatcttctaccttgtgattttatgttgcctgcatttt

SEQ ID NO: 7274 - DNA, 599 bp, Raphanus sativus
ggctcccagccaacttttaaaagagagtagtagcggcgcagcaaggtgaacacgagtgaagctcacgatggcgaggattaaggttcacgaactgagggacaagtcgaagagcgatcttcagaatcagcttcaggatcttaaggctgagctcgctctcctccgtgtcgctaaagtcaccggtggtgctcccaacaagctctccaaaatcaaggttgtccgcaaatccattgctcaggtcttgacagtgacatctcagaagcagaagtctgccctcagagaagcatacaagaacaagaagttcatccctcttgatctacgtcccaagaagacccgtgctatccgcaggcgcctcaccaagcatcagctctcgttgaagactgaacgtgagaagaagaaggaaatgtatttcccaatcaggaagtacgccatcaaagtttaagttacctgtcccttctaaaaaaaatctttctactagaaactctgtttcagctttgttgtttgatggaaacttgtttttgttcttcacttgtgtcagcaacattgatcttgcttcctattgatgttttgaaaatcctatctttgcaatttttgttttgctt

SEQ ID NO: 7275 - DNA, 554 bp, Raphanus sativus
ggaacacacacaaacagagtaaggggaagccagagagctcgaagacgcaatggcgaggatcaaggttcatgagctaagggagaaatcaaaatctgatctttcgactcagttgcaagatttcaaggccgagctagctcttctccgcgtcgccaaggtcactggaggtgctcccaacaagctctctaagatcaaggtggtgaggaaatcaatcgctcaggtgttgacagtgatctcacagaagcaaaagtctgctctaagagaggcgtacaagaacaagaagtttttgccacttgatcttcgtcccaagaagactagagctatcaggaggagactcaccaagcatcaggcatcgctgaagacagaaagggagaagaagaaggaaatgtactttccaatcagaaagtacgctgttaaggtgtaacctgttcttatcaatcacatcatcaatctttgtgttttgagttttagctcttgtgtgagttggctttttgttttatgttccatgttaaaagactcatctgaattaaagattttgattcacaagcgttattgtt

SEQ ID NO: 7276 - DNA, 585 bp, Raphanus sativus
agggtttctgattctctgagccaaaagaagagtagcggcggcgtaacacgagtgaagaagatcacgatggcaaggattaaggttcacgaactgagggacaagtcgaagagcgatcttcagaaccagcttcaggatctcaaggctgagctcgctctcctccgtgtcgctaaagtcaccggtggtgcccccaacaagctctctaaaatcaaggttgtccggaaatccatagctcaggtgttgaccgtgacctcacagaagcagaaatctgctctaagagaagcatacaagaacaagaagttcatccctcttgatctccgtcctaagaagacccgtgctatccgcagacgcctcaccaaacatcagctctctttgaagacagagcgtgagaagaagaaggagatgtacttcccaatcagaaagtacgctatcaaagtttaaattcgttctactagaaactctgtttcagctttttgttgtgtttttgatgcaaacttgttttgttcttcttcgctttgtgctcttttctcaaacagtttcaccaactttgattatggttaccattgatattttgcattttcttaactc

SEQ ID NO: 7277 - DNA, 699 bp, Raphanus sativus
ggctcccagccaacttttaaaagagagtagtagcggcgcagcaaggtgaacacgagtgaagctcacgatggcgaggattaaggttcacgaactgagggacaagtcgaagagcgatctccagaatcagcttcaggatcttaaggctgagctcgctctcctccgtgtcgctaaagtcaccggtggtgctcccaacaagctctccaaaatcaaggttgtccgcaaatccattgctcaggtcttgacagtgacatctcagaagcagaagtctgctctcagggaagcatacaagaacaagaagttcattcctcttgatctccgtccaaagaagacccgtgctatccgcaggcgcctaaccaaacatcagctctcgttgaagactgaacgtgaaaagaagaaggaaatgtatttcccaatcaggaagtacgccatcaaagtttaagttacctgtcttttaaaaaaaaaatctttctactagaaactctgtttcagctttgttgtttgatggaaacttgtttttgttcttcacttgtgtcagcaaaatggatcttggttcctattgatgttttgaaaatcctatctttgcaagttttgtttgctttagtgaaaaaaacacgcccgtccttaactttcttttgctattctggctttgattcattaatttgaaacttaacaatgtcaggttgtgcggttagttacaga

SEQ ID NO: 7278 - DNA, 564 bp, Raphanus sativus
gggattctctgaaccaacaagtagcagcggcgcatcagttgaacacgattcaagctcacgatggcaagaattaaggttcacgagctgagagacaagtcgaagagcgatcttcagaaccagcttcaggatctcaaggccgagctcgctctcctccgtgtcgctaaagtcacaggaggtgctcccaacaagctctccaaaatcaaggttgtccgaaaatcgatagctcaggtgttgaccgtgacatctcagaagcagaagtctgctctcagagaagcgtacaagaacaagaagttcatccctctcgatctccgccccaagaaaacacgtgctatccgcaggcgcctcaccaaacatcagctctcgttgaagacagagcgtgagaagaagaaggaaatgtatttcccaatcaggaagtacgctatcaaagtttaattctagcttactagatactctgtttcagatttgttttttatggacttgttcttttcttgtgctcttgtgtcgaacagttttttgtttatcaacactctcttttcattaaagaaagcctctaataagcccgta

SEQ ID NO: 7279 - DNA, 595 bp, Raphanus sativus
ggactccgtcactagggtttctgattctcttagccaaaagaagagtagcggcggcgtaacacgagtgaagatcacgatggcaaggattaaggttcacgaactgagggacaagtcgaagagcgatcttcagaaccagcttcaggatctcaaggctgagctcgctctcctccgtgtcgctaaagtcaccggtggtgcccccaacaagctctctaaaatcaaggttgtccggaaatcaatagctcaggtgttgaccgtgacctcacagaagcagaaatctgctctaagagaagcatacaagaacaagaagttcatccctcttgatctccgtcctaagaagacccgtgctatccgcagacgcctcaccaaacatcagctctctttgaagacagagcgtgagaagaagaaggagatgtacttcccaatcagaaagtacgctatcaaagtttaaattcttggctactagagactttgtttcagctttttttttgtgtttttgatgcaaacttgttttgtacttcgctttgtgctattttctcaaactgtttcaccatcatggattttgcttcctatttatattttccattttcttaattcc

SEQ ID NO: 7280 - DNA, 557 bp, Rhizophora mangle
actttcaaggtagaaaccggagttcagaggaagcgcgcagcaaagcgtacgaaaatggcaaggttaaaggttcacgagttgaggagcaagtcaaagacggagcttttaaaccagttgaaggaactcaaatcagagctcgctctcctccgcgtagccaaggtcaccggaggcgcccccaacaagctttctaagataaaggtggtaaggttgtcgattgcgcgggtactgacagtgatatcgcagaagcagaaagcggcgctgagggaagcttacaagaaaaagaagtttctgcctctggatctccgccccaagaaaacccgcgccattcgccggcgccttactaagcaccaggtatctttgaagacacaacgtgagaagaagagggagatgtatttcccaattaggaagtacgcaatcaaagtgtagaataggttgtgactgcttcttcaactcttgcctattatgaaatcttaatttagatcacttcatgctgtcaacattctttatcagattacctatttttgaattttcgtacccttcttggagaatcttttttt

SEQ ID NO: 7281 - DNA, 758 bp, Sequoia sempervirens
cgcccattcgcgggtacacaggcatacatttttacctgcagtttattctcgtaggggttcatttgtaaggtatttttcacacagggtttcggatttcgacagaaatcggatatggcgaggatcaaggttcatgagcttcgcacaaagagtaaatcagatctgctgaatcagctgaaggagctcaaggccgagttggcactgctcagggtagctaaggttacaggaggagcccccaacaagctctcaaagatcaaagtggtaaggaagtcgatagcccaggttttgactgttatttcccagacccagaaaacagcgttgagagaagcatacaagaagaagaagtacatgccacttgacctgcggccgaagaaaacccgtgctataaggcgacgtctcacgaaacgccaggcttcattgaagacagagagagagaagaaaaaggatatgtatttccctatgagaaagtatgcgatcaaagtctagagttttgaactgtagaattgccaatttcattcccatgtgtctttttgataaagtgagttttcattgttgaacgatggtttttatatttggtaacatgatttttcattctggtaatacaatgcttatcattgatggaaaaatacttattttcactggatacagttaaccgttgagttccctcaatttatttgtaccaagtaatacagatttaaactgtggagagtttaattaaattctatacataaatgggattgcaaaaagcaaatgactaacag

SEQ ID NO: 7282 - DNA, 448 bp, Tamarix hispida
ggggattgcaactagggtttcgatacctgcctatcctgtgcccgcagtcgccatttgttcctgagtcgagtcgaagagcaccaacaatggcgagaatcaaggtgcacgagttgagacagaactcgaacgctgacctcttgactcagctcaaagatcttaaggctgagctcgctctccttcgtgtcgctaaggttaccggaggtgcgcctaacaagctctccaagatcaaggttgtgaggttatcgattgcgcaagtattgactgtgatttcacagaaaccaaaagctgcgttgagggaagcgtacaagaataagaagtatttgcctctcgatcttcgtcctaagaagaccagagcaattcgtcgccgtctcacccagcaccaggcatcgttgaagacggagaagcaaaagaagaaggagatgtactaccctatgagaaagtatgcgat

SEQ ID NO: 7283 - DNA, 453 bp, Zostera marina
gtttcaatttttagggtttcgttttttccgaccgaaagctgaagcaatggccagaatcaaagtccacgagcttagagggaagacaaaattggatctcttgaaccagttgaatgagttgaagacagagctttcactcctccgcgtcgccaaggtcaccggaggtgccccaaacaagctcagcaagattaagattgttagaaaatcgatcgcgcaggttctaactgtggtatcacagaagcagaaggccgcgctcaaggaagcttataagaacaagaaatatttgccactcgatcttaggaccaaaaagactagagctattcgtcgacgcctcactaagcaccagttatctttgaagactgaacgggaaaagaaaagggagaagtatttccctatgagaaagtatgccataaagacctaaatccatatattgagaatttgaattttgagaagaag

SEQ ID NO: 7284 - DNA, 537 bp, Nicotiana benthamiana
tttgttttggttgtattagcaagaatcaaagttcatgagcttaagggaaaatcaaagactgatcttttggctcagttaaacgatctgaaagcagaacttgctctcctccgtgttgctaaggtcactggcggtgcccctaacaaactctctaaaattaaggtggtgaggttgtcaatagcacaagtattgacagtgatatcacagaagcagaagacagcactgagagaagcttataagaacaagaagtacttgccccttgaccttcgtcccaggaagaccagggccattcgtaaacgtcttaccaaacatcaggcatctttgaagactgaaagggagaagaagaaagagatgtactttccaattagaaagtatgccattaaggtttaaattgatgcaacttagatagtttgtgatgtttagcactggcagagcaaagctgaggatcttatttttgccattttgcaatgttataagtattttgtaatactactattattgcattatgaggttggagttttgttattttgtttgccttct

SEQ ID NO: 7285 - DNA, 504 bp, Brassica napus
cacgatggcgaggatcaacggttcacgaactgagggaccaagtcgaagagcgatctgcagatcagctcaggatctgaaggctgagctcgctctcctccgtgtcgctaaagtcaccggtggtgctcccaacaagctctccaaaatcaaggttgtcaggaaatcaatagctcaggtgttgacggtgacttcacagaagcagaagtctgcactcagagaagcgtacaagaacaagaagttcatccctcttgatctccgttccaagaagactcgtgctatccgcagacgcctcaccaaacaccagctctctttgaagacagagcgcgagaagaagaaggagatgtatttcccaataaggaagtacgctatcaaagtttaagtcttagctactagaaaatctgtttcagctttgtgtttttgatgcaaacttgttttgttattggctttgtgcttttttctcaaacagtttcaccaacatggattttggttcctattgatactttgcat

SEQ ID NO: 7286 - DNA, 658 bp, Panax ginseng
aagcagtggtatcaacgcagagtacatgggattaggtttcggaacaaagaacaagcagctaccaactgcaatggcgaggatcaaggtgcctgagctgaggaccaaatcgaagtaggatatggtgaatcaacttaaggatctcaaggctgagcttgctcttctccgtgttgccaaggtcaccggcggcgcctctaacaagctgtccaagataaagttgtgagattgtcaattgcgcaggtgttgactgtgatgcgacagaaacaaaaggctgctctgagggaagcctacaagaacaagaaatacgtgccgcttgatttgcgtcccaaaaaaacgagagccatccgcaggcgtcttaccaaacaccaggcatcattgaagactgaacgagagaagaaggagaagtacttccccttgagaaagtatgctattaaggtgtagggtagaatctattggaggagattttgctagtttgtgtctgtaaatctcattccaaatttgaattatgagatatgcttacaattatcctacagtggtggatcctagcggacttgtgtttttgttcaattatatgacaagtaaactacatagttctcttcagatctagaattctagttgttttactatgaaaatgaaaaggcacttgtgttattgttgttta

SEQ ID NO: 7287 - DNA, 358 bp, Primula obconica
ttggcgaggattaaggttcacgagcttaggaacaagaataaggccgtatttgcagagccagttgaaagatctgaaagctgagctcgctcttctccgggttgctaaggtcactggcggtgcccctaacaagctctccaagataaaggtggtgaggctttcgatagcacaggttttgactgtgatttcgcagaagcaaaagtcagctttaagagaagcatacaagaataagaggtttttaccgctcgatctgcgtacgaagaagaccagggctatcaggaggcgtctcaccaagcaccaggtatcattgaagacagaaagagagaagagagagaaatctactttcctatgaggaagtacg

SEQ ID NO: 7288 - DNA, 445 bp, Tripterygium wilfordii
gagaggcagccatggcgaggatcaaggtccacagtgggagtaacgaatcagcgagctatgaaccaattgaaggatctgaaagcagagcttgccctcctccgcgtcgctaaggttaccggtggcgcccccaacaagctatccaagattaaggtcgtgaggctgtccatagcgcaggtgttgacggtgatttcgcagacgcagaaggccgcattgagagaagcctacaagaataagaagtatttgcctcttgatctccgccccaagaagactagagctatccgtagacgcctcactaagcaccaggcatctcttaagacagaacgccaaaagaagcgggagatgtatttcccaatgaggaaatatgccatcaaggtgtaaaagattgaatcaactgaagaagaaatctgtggtatttgattcatcaaagttccataggaaggatgtc

SEQ ID NO: 7289 - DNA, 942 bp, Abies balsamea
tcggcaaacatggctaggattaaggttcacgagctgcggatcaagagcaaatcagagctgctgaatcaactcacggagttaaaggcggagcttgctctgcttagggttgccaaagtcacgggaggagccgctaacaagctttctaaaaattaaggtggtgagattatcaattgcacaggtgttgaccgtaatatctcaaaatcagaaaacagcgttgagggaagcctacaaaaagaagaagtatttgccccttgacttgcgtcctaagaagacccgtgccatcagacgacgcctcaccaagcaccaggcttcaatgaagaccgagagacagaaaaagaaggagatgtacttcccaatgagaaagtatgcagtcaaggtctaaaggcagcggttttcttgctagcattatttgttttgcttgttggatacaggagcctaagtgttcaggcttagagcgagtcatctatattagagtaatttgggaatattagattggactccatttttgttgattgtacatggagttgaaattagaacatgttttcgtttcattatgacattcagattcaaaactcgtaagtttgtttgacctataacctatcagggttgattatcccgtgtcgatttttcggagtagtctttagcttagctatgaagagatgattttactctaacctggtcaagattagaggaggaggctgctttcgctatccaatttgcaatattattcaaaagtacatctagaagactagaagttgcttttatcaagaataactagagttgcagtgtttaagctaaaatccaattttggaaaagaaatatcatgtggtacataagaatgggtattatcctctgcaacctttgaatgcgagactcgaagcagtttccccttttcaggttgcgcaactagtcttatttttttggcccttggaccaaagatgc

SEQ ID NO: 7290 - DNA, 505 bp, Papaver somniferum
caagaattaaggttcatgaactcagggccaagtccaaggcaggttattggaaccagttgaaagatctcaaagctgagctcgctttacttcgtgttgctaaggtcactggtggtgcccctaacaagctctccaagattaaagtggcgaggttatcgattgctcaagtattgacagttatatctcagaagcagaaattagcacttagggatgcttacaagaacaagaagtttttgccacttgatcttcgtcctaagaaaactagagctatccgtaggcgtctaactaagaaccaggtatcattgaagacagaacgcgagaagaagaagaaaatgtacttccctgtgaggaagtatgccattaaggtgtaggatattatttatatttttgcagaatagtagtttgttgacttttttattgcagtaccagacccttcgacttgttttgttctaagcacatttaaaatagataatctgcaattttattgagcgtttcaacttgttttgca

SEQ ID NO: 7291 - DNA, 715 bp, Beta vulgaris
agtataaaacccttccacaaacaattaatctagggtttctagagttcttccccaaatcgccgtttcagctctcactagtcggagaaaaccaaaaaaaaatggcctcaagaattaagccacatgagttgagacagaaatccaaggctgaattgttcaatcaattgaaagatttgaaggctgaacttgctcttcttcgtgttgctaaagttactggtggtgctcctaacaaactatctaaaattaaggtagtgaggttggggattgcgcaagtgttgactgtgatttcacaaactcagaaggagaaactgagagaggtttacaagaagaagaagtatttacctcttgatctccgtcctaagaagacgagagccattcgtcgtcgtcttaccaagcatcaggcatcactgaagacactgagggagaaaaagaaagagatgtactatccgatgaggaagtatgccatcaaggtgtaggctagaaatacacatttgtaggacatttgtttctttcgaacttatctattatggtaattttgttccaaggttactcaagttttttggatgatgagcattgcaattttaatcttttagtcgatgactgcactatttttgtcaattatggatgtgccatgcttttcgattcgatgtttttgacaagagcatactgaaagaagctgataaactatgagtgaatttgtcataaattcacccttctc

SEQ ID NO: 7292 - DNA, 621 bp, Curcuma longa
ggaagagggagaggcgatttggttgcaatggcgagcatcaaggttcacgagctccgagggaagtccaagacggaactccagaaccaactgaaggacctcaagaacgagctctcactcctccgtgtcgctaaggtcaccggcggggcacccaacaagctctcgaagataaaggtggttaggctgtcgatcgctcgtgtgcttactgtcatttcccagaagcagaaagcggcgttgagggaggcttacaaaaagaagaagctcctcccgttggatctccgccccaagaagacacgagccatccgccgccgtctcaccaagcatcaggaatctttgaagactgaacgtgagaagaaaagagctatgtacttcccaaagagaaagtatgcccttttagcaaattagtatcttatgctcctgctctaccattgaagatactgttatgtgcttctgaagttggttatcaactttaaaatttatgattagggctcagtgcttgagctatgcatcattaaaattttgttagttggcatttgttatttgttgttcttgagtttgtgtttcaaaatttgaattgcctttaatttataaattattaaaggacatattttccttgtctaagag

SEQ ID NO: 7293 - DNA, 607 bp, Elaeis guineensis
ccgccatttcgtctcgcccgagccgagggagagtagggcagaagagatcctcgatccgcttccaatggcgaggattaaggtccacgagctacgggggaagtctaaggcggatctgttgaaccagctgaaggacctcaaggcggagctcgccctcctccgcgtcgccaaggtcaccggcggcgcccccaacaagctatccaagatcaaagtggtgaggctctcgatcgcgcgggtgctgacggtgatctctcagaagcagaaggaggtgctgcgggaggcgtacaagaagaagaagtaccagccgctcgatctccgccccaaaaagactcgcgccattcgccgccgactcaccaagcaccaggcttcattgaagactgagcgcgagaagaaaaaaggagatgtaacttcccaaatgaggaagtatgcaatcaaggcctagattaggtattctgtttaaagtgactcattttgggatccaattttgacatttgctttatggaattagcattcctgttttagtaccatgattgggttttattggcatacaaaaatacttaaaatcgtttggcgctcgaattttggataagctttgatgtttgattcttga

SEQ ID NO: 7294 - DNA, 687 bp, Spinacia oleracea
cacaaccacaaccaattcttcgtatatgaaaaagctccccataaacccttctttaaagtgagccatttctgttctagggtttccagtatcccacattcgccgtcgtcacagcaaccagcacctcaagaagcgcagagatggctagaatcaaaccccatgagttgagacagaaacccaaggctgatctcttgactcagctcaaggatctcaaggctgagctagctctcctccgtgttgctaaggttaccggtggtgctcctaacaagctctccaagattaaggtggtgagattagggattgcacaagttttgacggtgatgtcacagaagcagaagtctgcattgagggaagcttacagtaagaagaagtttttgccccttgatcttcgtcccaagaagacccgtgctattcgtcgtcgcctcactaagcatcaggcatccttgaagactgaaagggagaagaagagggatatgtactaccccatgaggaagtatgccattaaggtctaggctagttaatccactgaaattttgttcaaacgtttgttaaacatctaaaagttgagcttcagcttatgacattagtcagttttcttcaaatgtattgcgaccattttgtattcttgagaactgtggttgagatctatgaagacatttttaaagaaaggtagtagatggttttaacgtc

SEQ ID NO: 7295 - DNA, 556 bp, Arabidopsis thaliana
actatagcagtgcaaagagactgagtcagagagggctcgaagacgccatggcgagaatcaaggttcatgagttgagagataaatcaaaatcggatctttctactcaattgaaagaattgaaggcagagcttgcttccctacgtgtcgctaaggtcactggtggtgctcctaacaagctctctaagatcaaagtggtgaggaagtcgattgcgcaagtgttgactgtgagctcacagaaacaaaagtctgctcttagagaagcatacaaaaacaagaagttgttgccactcgatctccgtcccaagaagactagagccatcagaaggagactcactaaacaccaggcgtcgctgaagacagaacgagagaagaagaaagacatgtactttccaattagaaagtatgccatcaaagtttaattatctttctactgtcagagagtcctccctcagtcttctctaatatatctgaattttctttcaattaaagatttgattcttcaaacatgattgtatgatctctcacgcacgttctttgttataaatttgagatttac

SEQ ID NO: 7296 - DNA, 378 bp, Brassica juncea
gaagctcacgatggcgagaattaaggttcacgagctcagagagagatcgaagacggatcttcagagccagcttcaggagttcaaagctgagctcgccctcctccgtgtcgctaaagttacaggaggtgcccctaacaagctctccaaaatcaaggtggtgaggaaatccattgctcaggttctgacagtgatctcacagaaacagaaactagcactaagggaagcatacaagagcaagaagttcttgcctcttgatcttcgtcccaataagactcgtgctatccgtagacgtcttaccaagcatcagtcttctttgaagactgagcgtgagaagaagaaagagatgtatttccctctgaggaagtatgctatcaaagt

SEQ ID NO: 7297 - DNA, 505 bp, Brassica oleracea
cagcagcaagcaagctcacgatggcgagaattaaggttcacgagctcagagagagatcgaagacggatcttcagaaccagcttcaggagttcaaggctgagctcgccctcctccgtgtcgctaaagttaccggaggtgcacctaacaagctctccaaaatcaaggtggtgaggaaatccattgctcaggttctgacagtgatctcacagaaacagaaactagcactaagggaagcatacaagagcaagaagttcttgcctcttgatctccgtcccaagaagacacgtgctatccgcagacgtcttaccaagcatcaggcgtctttgaagacagagcgtgagaagaagaaagaaatgtatttccctctgaggaagtatgctatcaaagtctagtttcactctccggcttagctaactagaaatgattcaattctcttttgattattcgcttatgtactctcaagttttgtcatggaacagccaaatctttcttgctcgaatcattc

SEQ ID NO: 7298 - DNA, 657 bp, Brassica napus
gtacctacggtttctttaccttacggtccgaaaccccaaacccggaactcgaattacacctaaacccaacctttctcggtttagtctctactcgagctagcaccagagattgcgcagcagcagttgaacgaacacgagtgaagcttcacgatggcgagaatcaaggttcacgagctgagggacaagtcgaagatcgatcttcagaaccagcttcaggaacttaaggctgagctcgctctcctccgtgtcgctaaagtcaccggtggtgctcccaacaagctctccaaaatcaaggttgtccgcaaatctatcgctcaggtgttgaccgtgacatcccagaagcagaagtctgctctcagagaggcgtacaagaacaagaagttcattcctcttgatctccgtcccaagaagacccgtgctatccgcaggcgtctcaccaaacatcagctctcattgaagacagagcgtgagaagaagaaggaaatgtactttccaatcaggaagtacgccatcaaagtttaagttacctgtcctttaaaaaaaaaaaatctagctactagaaactctgtttcagctttgttctgtttgatggaaacttgtttttgttctccacttgttctattgtgtcaaacaatttcagcaacatggattttgttt

SEQ ID NO: 7299 - DNA, 699 bp, Cryptomeria japonica
tcctacagcgcagggtttcatttgctcgaggatttcctcgacagaaatcggataacaaatggcgaggatcaaggttcatgagctgcgcacgaagagcaaggtagatctgcagagtcagctgaaggagctcaaggccgagttggcactgctcagggtggctaaggttacaggaggagcccccaacaagctctcaaagatcaaagtggtaaggaaatcgatagcacaggttcttactgttatctcccagacccagaaaagtgctttgagagaggcatacaagaagaggaagtacatgccacttgacttgcgcccaaagaagactcgtgccattaggaggcgtctcaccaaacaccaggcttcattgaagacagagagagagaagaaaaaggacaagtatttcccaatgagaaagtatgcaatcaaagtctagagagtatgactacttaggtcttgaactgtagaattcccaatccattcccatgggtttttatttttgttaaagcgagttttaattgttgaatggcggttctgataaattgatgatacgatttaatgatctggtaatacaattttattcattgatgggaaatattaatttattgaggattccagagtatcttgattgtattatagttatgacctgttagtatttttcattggggtatttcttatagaatctacagtgaaaaaagttcaagt

SEQ ID NO: 7300 - DNA, 748 bp, Cryptomeria japonica
gcttgcagtattttgtcataggggttcatctgtaaggtgattttttacgcagggtttaggatttcgacggaattcggattactaatggcgaggatcaaggttcatgagttgcgcacaaagagcaagttagatctgcaaaatcagctgaaggagctcaaggctgagttggcactgctcagggtagctaaagtaacaggcggagcccccaacaagctgtcaaagatcaaagtggtaaggaaatcgatagcgcaggttttgactgttatttcccagactcagaaatctgcgttgagagaagcattcaagaagaagaagtacatgccacttgacctccgcccaaagaagactcgtgccattagacgacgtctcaccaaacaccaggcttcattgaagacagagagagagaagaaaaaggacaagtatttccctatgagaaagtatgcaattaaagtctagagataaggactatttaggtcgtcaactgtagaattgccaattgcatgcccatggtttttttttgatgaagtgagttttcattgttgaacagcggttttcataaattggtaatatgatttaatgttcttgtaataccatgttcatcattgatgaaaaatacttattttcattggatgtgtttaactgtttaaacctgtcccattttttttgtaccaagtaatacatatttaaactgttaagagttaaattaaattctatacataaatgggattgcaaaaagcaaatgacttac

SEQ ID NO: 7301 - DNA, 601 bp, Curcuma longa
gcacgaggcctcgtgccgaattcggcacgaggacgaagcgaggggggaggctggcgatggcgaggattaaggtccatgagcttcgcgggaagacgaaaactgagctccagaatcagttgaaggagctgaagaatgagctttccctcctccgcgtcgctaaggtgaccggtggtgcgcccaacaagctctcgaagataaaggtggtgagattgtcgatcgcgcgtgtgctgactgtgatctcgcagaagcagaaatctgcgctaagggaggcttacaagaagaagaagctcctcccgcttgatctccgccccaagaagacgcgtgcgatccgccgccggcttaccaagcatcaggagtctttgaagacagaacgtgagaagaaaaaggcgaggtacttccccctgaggaagtatgccatcttaacttagatatcaatattgtgattcttaagctttgccagattttgttatttatattggagttccaattcgatcaagattcatatgttttcatcttgttatgccattagatttgttattctggaattgttcatctgatccattctagagaagtaatttactaatttgccccttctcttctg

SEQ ID NO: 7302 - DNA, 664 bp, Linum usitatissimum
agcgacctctagggttttagcagtcggaactgaacggcggagccgctgaagcaagcttaagatggcgaggattaaggttcacgagttgaggaccaagtcgaagacagatctcttgaaccaggtcacggagctcaagtccgaggtttccctactccgtgtcgccaaggtcaccggaggtgcacctaacaagctctccaagatcaaggtggtgagacggtcgattgcgcaagtgcttaccgtgatttctcagaagcagaaggaagctctcagagaagcttacaagaacaagaagctcttgccactggatctgcgtcccaagaagactcgcgccatccgccgacgcctcaccaagcaccaagcatcactgaagacagagcgagagaagaagcgggagatgtacttcccgttgaggaaattcgcaatcaaagtttagagtagggaggatagcacttcattaaaatgcattgcttctttcttagcttttgatctacggaaatgacgctgagtttgttcaatttctgggtttcttttttattatagcacgacctaagaattctgtctaagcatcaatgagttattttgctactcttatttgattacctgatcttagtttgcaacttgcagagatcaaactgatttgcaactaatcaatcctttcttttcc

SEQ ID NO: 7303 - DNA, 771 bp, Panax ginseng
gagcgaaatataaagcgttggaaataaaaccctaaatccctcccaattcgtattaggcctttcggaacaaagaacaagcagctaccaaatgcaatggcgaggatcaaggtacctgagctgagggccaaatcgaagcaggatatagtgaatcaacttaaggatctcaaggctgagcttgctcttctccgtgttgccaaggtcaccggcggcgcccctaacaagctgtccaagataaaagttgtgagattgtcaattgcgcaggtgttgactgtgatgcgacagaaacaaaaggctgctctgagggaagcctacaagaacaagaaacatgtgccgcttgatttgcgtcccaaaaaaacgagagccatccggaggcgtcttaccaaacaccaggcatcgttgaagactgaacgagagaagaaggagaagtacttccccttgagaaagtatgctattaaggtgtagggtagaatctattggaggagattttgctagtttgtgtaattaaatctcattccaaatttgaattatgagatttgcttacaattatcctatagtggtggatcctagcggacttgtgtttttgttcaattatatgacaagtaaactacatagttctcttcagatctagaattctagttgttttactatgaaaatgaaaaggcacttgtgttattgttgtttattcttcatctatgtgtgcttttagatatgactattaatttcaagtagtttaaaaaaaaaaaaaaaaaagaaaaaaaaaaaaaaaaaaat

SEQ ID NO: 7304 - DNA, 690 bp, Gnetum gnemon
ctaaaccctaaccctatattgtgggagtgggcgtggctgagtccttggcaatcgtcattcgtcacgtattaggcagagattttgggtagcagaacgagcgagcgagcgattgttgcagcaatggcaagaattaaggttcatgaactgcggccaaagtctaaaacagatctgctgaaccagctcaaagaattgaaggctgagcttgccctcttgagggttgcaaaagtcaccggcggagcgcccaacaaactttctaagatcaaggtagtcaggaaatcaattgcgcaggtgctgaccgtgatatcgcaaacgcagaagtcggctcttagggaggcctacaagaagaagaaatatctgccccttgatctgcgccctaaaaaaacccgtgccatccgcaggcgtctttcaaagcaccagttgtctttgaaaactgagaaacagaagaagaaagagatgaacttcccaatgaggaagtatgcagtaaaggtatagagccattgcttgttaatgggatatggttttgtactggagtccatgagggtgctgttgggcacaagcaagacttttggatcactgttttttacccaaattatttacatattgcaaattgcagcaatcctaattaatggaaacttatcctagttttatgtttacatttctgctatttagactatttcaacatctgtagac

SEQ ID NO: 7305 - DNA, 725 bp, Arachis hypogaea
cccctgtgtgccttggcagtctcagaagcagtggtatcaacgcagagtacgggggagcctttgtccctcccatttgaaactagggtttgtaaaggaagaggcgcagcagccacatcaggtgaagagagaagctcgagaattcagaaatggcgaggatcaaggtttacgagctgaggcagaagaacaagactgagctgttgaaccagctcaaggatctgaaagccgagcttgctttgctccgtgtcgccaaggtcactggtggtgcccccaacaagctctccaagatcaaggttgtgaggttgtccattgcacaagtcttgactgtgatttctcagaagcagaaggctattttgagggaagtttataagaagaagaagtacacacctcttgatctccgtcctaagaagaccagagccattcgcagaaggctcaccaagcaccaggcatctttgaagaccgagagggagaagaagaaggaaacatattcccaatgaggaaatatgccatcaaggtgtaggagtctatgcatatttaattttatattgcgcatttaccagttatagttggcaaattttgaggtagtttcatgttggagttatttgttgtcttcaaattttacctatttggaccttttgtttctctttgaaatggatttatgatcaaaattgaggattaaaaaaaaagaaaaaaaaacaaaagtactctgcgttgataccactgcttct

SEQ ID NO: 7306 - DNA, 579 bp, Raphanus sativus
ggccttgctcctcaaaagtagggttttgcgagcttagaaaggaggaagcagcggcgcatcagttcaacaccaccagaaaagctcacgatggcgagaattaaggttcacgagcttagagagagatcgaagaccgatcttcagaaccagcttcaggaattcaaggccgagctcgccctcctccgtgtagctaaagtcaccggaggcgcccctaacaagctctccaaaatcaaggtcgtgaggaagtccattgctcaggtactgacagtgatctcacagaaacagaagcttgcactaagggaagcatacaagagcaagaagttcttgcctctcgatctccgtcccaagaagactcgtgctatccgcagacgtcttaccaagcatcaggcgtctttgaagacagagcgtgagaagaagaaagagatgtatttccctctgaggaagtatgctatcaaagtctagtagtttcgtttctccttgctttagcttagctaccagaaatgatgattcaactctttttgattattcgcttatgtattgaccatttttatttttgtttctcgctcaagttttgttatggaa

SEQ ID NO: 7307 - DNA, 563 bp, Raphanus sativus
ttctgattctctgagccaaagaagagtagcggcggcgtaactcgagtgaagaagatcacgatggcaaggattaaggttcacgaactgagggacaagtcgaaaagcgatcttcagaaccagcttcaggatctcaaggctgagctagctctcctccgtgtcgctaaagtcaccggtggtgctcccaacaagctctctaaaatcaaggttgtccggaaatccatcgctcaggttttgactgtgacctcacagaagcagaaatctgctctaagagaagcatacaagaacaagaagttcatgcctcttgatctccgtcctaagaagacccgtgctatccgcagacgcctcaccaaacatcagctctctttgaagaccgagcgtgcgaagaagaaggagatgtacttcccaatcagaaagtacgctatcaaagtttaaattcgttctactaggaactctgtttcagctttttgttgtgtttttgatgcaaacttgttttgttgttcgctttgtgctcttttcccaaacagtttcaccaactttgatcatggttaccattgatattttgc

SEQ ID NO: 7308 - DNA, 593 bp, Sequoia sempervirens
ggcaggttttcgtttgtaatttttcttttgtagcgcagggtttcatttgttggaggatttcgacagaagtcgaataacaaatggcgaggatcaaggttcatgagctgcgcacgaagagcaagtcagatctgctgagtcggctgaaggagctcaaggccgagttggcactgctcagagtggctaaggttacaggaggagcccccaacaagctctcaaagattaaagttgtgaggaaatcgatagcacaggttctgactgttatctcccagacccagaaaactgctttgagagaggcattcaagaagaagaagtacatgccacttgacttgcgcccaaagaagactcgtgccattaggcggcgtctaacaaaacaccaggcttcattgaagacagagagagagaagaaaaaggatatgtattttcctatgagaaagtatgcaattaaagtctagagagtatgactacttagatcttgaattgtagaattcccaatccattctcatgggttttttgataaagtgagttttaattgttggacggtattattgataaattggtaatatgatttaatgatctggtaatacaagtgtttt

SEQ ID NO: 7309 - DNA, 1187 bp, Picea glauca
ttgtgagatcacaatgtaatcaatgcatcccctcaaccatttaaagttgctaggttcaaatctaacacaaaatcttgtctccgttgttatggtgttaacttgaaaccctagcccatcgtcaaaaccctacggctcatgtcggtattttctttgctacgggtactgttgttacagcgagggcaaggctaaggattttgggcaaacatggccaggattaaggttcacgagctgcggatcaagagcaaagcagagctcctgaatcaacttacggagctaaaggcggagcttgctctgctaagggttgccaaagtcacaggaggagcccctaacaagctttctaaaatcaaggtggtgagattatcaattgcacaggtgttgacagtaatatctcaaaatcagaaaacagcgttgagggaagcctacaaaaagaagaagtatttgcctcttgacttgcgtcctaagaagacccgcgccatcagacgacgcctcaccaagcaccaggcctcaatgaagactgagagacagaaaaagaaggagatgtacttccccatgagaaagtatgcagtcaaggtctaaaggcaacaattttcttgctagcattatttgttttgcttgttggatacaggagtccaagtgttcaggctcagtgagtcgtctatattaggtttgtttgggaagtttagattgaattccagttctattgattgtacatggagttgaaattagaattccatgttcatgtttcattgtggtattcaaattcaaaaactccaagtttgcttgacctataacctattacctgtgtgattttttggattatagtctttagctatgtagagatgtttttagtctgtcctggtcaagattagagaaggaggcttctttggctatccaatttggaatatttttcaaaagtacacctagaagactagaagttgctttattaagaattactagagttgcggagtttcagctaaaatccacttttttgaaaagaaatatcatgtggtatatgagtaacaatttgaatgggtatcatcctctgcaacctttgaattcaagcctagaaggcagtttttcttttcaggtggcgcaactagtcttattttttggcccttggtccaaatatgtagtaaaaaagcattgtgaacatttgtgattatctttaaacatgtatgatgtgaata

SEQ ID NO: 7310 - DNA, 370 bp, Utricularia gibba
tcggatcaaggttcatgaactccggcagaagaacaaggcggagctgctggcgcagctgaaagatctgaaggcggagttatcgcttctacgggtggcgaaagtcaccggcggcgctcctaacaagctcgcaaaaatcaaggtcgttaggctttcgattgcccaggtactaacggtgatttcgcagaagcagaaaggcgctctcagggaagcctacaagaacaaaaagtacctgcctctggatctccgccctaagaagacgcgagccattcgccgtcgtctcactaagcatcaggcatctttgaagacagaagaaaacaagaagaagaaaggaaatgttacctttccccttaagaaagtatgccatcgaggg

SEQ ID NO: 7311 - DNA, 1136 bp, Amborella trichopoda
aaagtagacgagggatattgcgacatctcagtgtgtattcagaatggcgtccaaagcttgcccttaattcgtaatccaattcttccattcacgtgtgcaaacaggcaaagcgtccacagcaagaggagggattctgcagtgaagtttagcacgaagcaactccactatctgcaccatggctagggtcaaggttcacgagcttcgggccaaaagcaaggcagaacttctgaaccagttgaaggacctcaaggcagagctttccttgcttagggttgcaaaagtcacaagaggggctcccaacaagctctccaagataaagactgaggctttcagttgctcaggttttgaaggtgatttcgcagaagcagaaggcagcgttgagggaagcgtacaagaagaagaagttgctgcccctcgatttaaggccaaagaagacccgtgccatcaggcggcgcctaaccaagcaccaggcttctctgaagacagaatgtgagaagacgcagaagatgtactttcccatgaggaagtatgcaatcaacatgtaggtcgcaggttctgattttatcctagttctctagaatgggtttgtttgtatattgcctcactgagattcataatctggcatcacatggtcccttttttggtaaataaactatttttgtccatctctccttgagcaatgagattttgagaaatttttcacccttttttcaagttagaattaccttgggtgggaccttgcttttaagtgccaaccacgcatattcagagctgatcaataggttcgcctaggtgaatcattcctcttggacaagttcttacattgagctgttaatgtaagataggaattgagaaccactaagatgtattatcgtagattagtcttgtagtagggattgaattccatattgaactcttaaagatctgatttcttgattagaaggatttcattagtaggggttatattttaactgattattaagctttttttatgtaattttttaaaattagccgactccaaatagttgggataagactcggatgatgatgaagcttttttttttaaaaaatgttgataacattggctaaggttttacctggtttctaccttggttcagctttgatggatgtttaag

SEQ ID NO: 7312 - DNA, 610 bp, Allium cepa
cagccatcagaaatttttctaggaaatgatggtacaatttctgaagccatttctaatccttcatcgttcagcttctgcaatggccagaatcaaggtccacgagttacgcaccaagtcaaaggctgatcttctgacccaacttaacgagttgaaatctgaactggctttgcttcgcgttgctaaagttaccggcggcgcccctaacaaactatccaagattaaagtcgtgaggaagggaatagctcaggtattgactgtgatttctcagaagcaaaagcaggcgctaagagaagtgtacaaaaagaagaagttgctgcctttagatttgaggcctaagaagactaaagccattcggatgaagctgacaaaacatcaggaatctttgaagactgaacgtcaaaagaaaagggagatgtacttccccatgaggaagtatgccatcaaggctcagtaatcagtttatgctgcattcttttcttgattatgtagaacttttgggttttcctgtttttgttatttgaccgcactcttgtgtttttgaagtaccgagttattgtgaaccttgttatctttttctagaacctctattcataatttattgtgagctcga

SEQ ID NO: 7313 - DNA, 436 bp, Lippia dulcis
aagaagctaaaccattcagcactcgtcacttccgccgcagcttgcagagaggcaaagtcaggaaaatggctcggatcaaggtgcacgagcttcggttgaagaacaagacggagctgctagcgcagctgaaggatctgaaggcggagctcgcgctgctgcgggtggccaaagtcaccggaggcgctcccaacaagctctctaaaatcaaggtggtgaggctgtcgatcgcgcaggtgctcaccgttatatcgcagaagcagaagtccgctctgcgcgaggcataaaaaaataagaagtatttgccgctcgatctccgccctaagaagacgcgcgccactccgccgccgccttacgaagcaccaggcttcgcgaagacggaaagcagaagaagaaggaatgtacttcccttgaggaagtacgccatcaaagtctaaac

SEQ ID NO: 7314 - DNA, 495 bp, Eschscholzia californica
tgatctcttgaaccagttgaaagagctgaaagcagaactcgctttgcttcgtgtcgccaaggtcaccggtggagctcctaacaagctttccaagatcaaggtggtgaggttgtcgattgctcaggttctgactgttatctctcagaagcagaaagcagctcttagggaagcttataagaacaagaagttcttgcctcttgatcttcgccctaagaaaactagggcaattcgaagacgtctcaccaaacaccagctatctttgaagacggaaagagagaagaagaaagaactacacttccctatgaggaagtatgccatcaaggtataagctttgtttttagtttagcagacaagacagacctctttggtccattgtatttctcttgaatcttaattttgaaggatatgatttttctgaaacttgatggtcatagagatttagattgaaacttgttcctgaatgattcaaattaaacaatatttagttttgtttaa

SEQ ID NO: 7315 - DNA, 548 bp, Heritiera littoralis
aaatcaaaaactgagcttttagctcagttgaaagatctcaaagctgaacttgctcttcttcgcgttgctaaggttaccggcggcgcacctaacaagcttttcaagataaaggtggtgaggttgtcaattgcacaggtgttgacagtgatctcacagaagcagaaggccgcactaagggatgcatataagaagaagaagttcttgccccttgatctgcgtcccaagaagaccagagccatcaggaggaggcttaccaagcaccaggcatcattgaaaaccgatcgggagaagaagagggaaatgtacttcccaatgaggaagtatgcaattaaggtttaggctcagatctttcagataggattctattttcaaagccagtcgactttacttactagtgtcatatttggggaacctgagttgtgattttgttcaattttatggttgtgaactttgcccttgtcaaaccaagatgttgatcctttgatgggagtagtaatcaaatgaggggttttgcatttgttgatgagataatagaatgtttagatgag

SEQ ID NO: 7316 - DNA, 494 bp, Avena sativa
agcttcgtgggaagaacaaggcggagcttcaggggcagctcaaggacctcaaggcggagctatccctcctccgcgtcgccaaggtcaccggcggagcgcccaacaagctctccaagatcaaggtggtgcgcacgtcggtagcgcgcgtcctgacggtgatctcgcagaaacagaaggctgcgctgcgtgaggcgtacaagaacaagcggctccccctcgacctccgtaccaagaaaacccgcgctatccgccgccgccttaccaaacaccagctttctcttaagactgagagggagaagaagcgcgagaagtatttccccatcaggaagtatgccatcaaggcttagttatgcaacatgagatgtgtttagcacagttttggagaatttgttcgcctgggagtttgttgaactttgatattatcctgtatggttgccctttgtggtttaacttcgatgtgatgacctattttgttaaatgcgtatggtttaagt

SEQ ID NO: 7317 - DNA, 433 bp, Selaginella moellendorffii
gcacgagctgcgcacgaaatctaagcaggacttgctcgtccagctcaaggagctcaaatccgagctcgctttgctgcgcgtggccaaagtcactggaggcgcccccaacaagctctccaaaatcaaggtcgtgaggctctcgatcgcgcgcgttctcacagtaatctcccaaacccagaaggccaagctgagagaggcctacaagaacaagaagtacatgcctctggatcttcgtcccaagaagacccgagcgatcaggcgacgcttgacaaaacatcagctttccctcaagacggagaagcaaaagaagaaggaggcttacttcccgatgagaaagtacgctgtgagggcgtgaggagagacgcaagcagcgtgagatggatcttctttcttgttttcgaacgcgctaactaatgcaagaggaaaatttttc

SEQ ID NO: 7318 - DNA, 648 bp, Arachis hypogaea
tggtatcaacgcagagtacgggggagtttacggaagaaaaaaccagagcgcattgcaattaggggttttgaattttgattcgctttcggtttcagcagcatcaacaactttgcaatggcgagattgaaggtgtacgagctgaggaacaaaacgaaagcagagcttctgagccaattgaaggatctgaaagctgagctggcactcctccgtgttgccaaggtcactggcggagcacccaacaagctctccaaaataaaattggtgcggttatcgatagcgcaggtgttgacggttatttcgcagaagcaaaagtcggtgctgagggaagcttacaagaagaagaagaagtatctgcctttggatctgcgtcctaagaagaccagagctatcagaagacgcctcaccaagcaccgggcttctttgaagacggagcgtgagaagaagaaggaagtatacttcccattgagaaaatatgcagttaaggtgtaatgttctccttgttacttgacgaaattctcaaagttttgttaaatcttcatgaatcttttgtgcaaaacaatttctttttttgttttaatctagtcaaagcttgcatctttgtcattacaactttattagtcaatataatattcaaacattccaaacact

SEQ ID NO: 7319 - DNA, 500 bp, Selaginella moellendorffii
gggcggctagggttttagggttgtggggaagccgcaaagatggcagggaagatcaaagtgcacgagctgcggacgaaatctaagcaggatttgctcgtccagctcaaggagctcaaatccgagctcgctttgctgcgcgtggccaaagtcactggaggcgcccccaacaagctctccaaaatcaaggtcgtcaggctctcgatcgcgcgcgttctcacagtaatctcccagacccagaaggccaagctgagagaggcgtacaagaacaagaagtacatgcctctggatcttcgtcccaagaagacccgagcgatcaggcgacgcttgacaaaacatcagctttccctcaagacggagaagcaaaagaagaaggaggcttacttcccgatgagaaagtacgctgtgagggcgtgaggagagacgcaagcagcgtgagatggatctttcttgttttcgaacgcgctaactaatgcgagaggaaaatttttctttgcagtgtc

SEQ ID NO: 7320 - DNA, 371 bp, Aquilegia formosa
tgtagcaaggattaaggttcatgagctgagagatcagtcgaagccagatttattgaagcaattgaaggagttgaaagatgaacttgctttgcttcgtgttgctaaggttactggtggagctccaaacaagctttccaaaataaaggtggtgagaacagggattgcgcaagtattaacagtgatttcacagaagcagaaacaagcattgagggatgtttataagaagaagaagttgttgcctcttgatcttcgacctaagaagactagagctattcgcagacgtcttactaaccatcagttgtctttgaagactgatcgtgagaagaagaaggagatgtacttcccaatgaggaagtatgcaatcaaggttt

SEQ ID NO: 7321 - DNA, 731 bp, Brassica rapa
aataaaattgccttgctccaccgaactagggtttgtgagctatagcaaggaggaagcagcggcgcatcagttcaacaccagcaagcaagctcacgatggcgagaattaaggttcacgagctcagagagagatcgaagacggatcttcagaaccagcttcaggagttcaaggctgagctcgccctcctccgtgtcgctaaagttaccggaggtgcacctagcaagctctccaaaatcaaggtggtgaggaaatccattgctcaggttctgacagtgatctcacagaaacagaaactagcactaagggaagcatacaagagcaagaagttgttgcctcttgatctccgtcccaagaagacacgtgctatccgtagacgtcttaccaagcatcaggtctctttgaagacagagcgtgagaagaagaaagaaatgtatttccctctgaggaagtatgctatcaaagtctagtttcactctccatcttggctaactagaaatgattcagttttgattattcgcttatgtattctccctttttgctattggtttaactcaaagtttttttatggaacagccaaatatctctcttactcgagagttatgtatctcataaacacaaaaaccacacatttgaaaatgagattttaggaacgcatcgttggtagtaagtatatgtaataatatctatcgaatttatcacccgagaatgtttagaatttaattttacaaaac

SEQ ID NO: 7322 - DNA, 935 bp, Musa acuminata
atggatccaattaaaggactatcggcttatgccgccgtcgccgtttggatttacggttgctacctcgatcgagcggagagccgcaccggctggcgaaggcgaagaagacaaccatttagaatggctaggattaaggtccacgaactccgagggaagacgaaggcggaactgcagaaccaactgaaggacctgaaaaacgaactcagccttctccgcgttgccaaggtcaccggcggtgcccccaacaagctctccaagattaaggtggtgaggctgtcgatcgcgcgggtgctgacagtcacctcccagaagcagaaggctgcgctgagggatgcatacaagaagaagaagcttatcccgcttgacctcaggcccaagaagactcgtgccatccgccgtcgcctaaccaagcgtcagggctccttgaagacagaacgccagaagaaaaaggagatgtactttccaacgaggaagtatgcaatcaaagcttagataaaagtagggaccaggcttgttaagctcttctgtgttaattgctacttgatttcattgtttagtgaagtcttttttgcaatactgtgagcatcctttgaaaattttgttatatgtttgaaccgtggaatgttttgtccttgaactctgtttcacgatgttggtgccacatcgtcgacttcctaatggtttttaaaccggcatgtgaatctcacttgtctgctgcaggattgtcatcggcttcctgctatctcaattgctgagttagtaattgaattatacagctggatgtaaagagaagacgattatatcgtagtgtttgtgccttaacaagtttgcaggctgggtaagattttgacaatgctgagtgtggcaatctacagctctacgaagtcgaagcattaaggcaaagccgccactcaccacgatgcagaaattaagcg

SEQ ID NO: 7323 - DNA, 601 bp, Brassica napus
ggagctatagcaaggaggaagcagcggcgcctgagttcaccaccaccaccaccaccaccagcaagctcacgatggcaaggattaaggttcacgagctcagagagagatcgaagacggatcttcagaaccagcttcaggagttcaaggctgagctcgccctcctccgtgtcgctaaagttaccggaggtgcacctaacaagctctccaaaatcaaggtggtgaggaaatccattgctcaggttctgacagtgatctcacagaaacagaaactagcactaagggaagcatacaagagcaagaagttcttgcctctcgatctccgccccaagaagacacgtgctatccgcagacgtcttaccaagcatcaggcgtctttgaagacagagcgtgagaagaagaaagacatgtatttccctctgaggaagtatgctatcaaagtctagcttcattctccggcttagctaactagaaatgattcaattctcttttgattattcgcttatgtgctctcaagttttgtcatggaacagccaaatctttcttgctcgaatcattcatttatatctcattaacactcataatgaacgcagtatgtaataat

SEQ ID NO: 7324 - DNA, 765 bp, Marchantia polymorpha
ctctcaatcctctgcttctgttgctgctgcgttacgctgtcgcgatggctaaaatcaaagtgcatgaattgcgcactaagtcgaaggctgatctcctcaatcaattgaaggagttgaaggcagagcttgccttgttgagagtggctaaggtcaccggtggtgcccctaacaagctctctaagatcaaggtggtgaggctgtccatcgcccaggtgctgactgtcatttcccagactcaaaaggcacaccttcgcgaggtttacagcaagaagcgattcttaccccttgacttgaggcccaagaagacccgcgccatcagaaagcgcttgaccaagcatcagatgtctctcaagaccgagaagcaaaagaagaaggaagcctacttccctttgaggaagtacgccgtgaaggcttaagtttaatgttccgcgaatacgctgagttgtcatgctgagttcccttctgacaggatctagagtcctatacgatttctgctggatgtacatcttgtgaatgaacatcattgagttcgctcctccacattgtgttggacgagttgtacaacgtagccaaatgtggtccaccggacacgaaggttaccgctcaaaccgttcatatcgagagtaaatgtacaccatcatcaggtgatattgcataagtgatacccattttttgccggttcatatacatcattatcatgaaactgtgttcaattttttatgaatgtgcttgtacatgcgttcatggcatttttcaaaaaaaaaa

SEQ ID NO: 7325 - DNA, 756 bp, Lippia dulcis
acgacggacaacaatggctcggatcaaggtgcacgagctcaggcaaaagaacaaggcggagctgttggcgcagctgaaggatctgaaggcggagctcgccttgctgcgtgtggccaaggtcaccggcggcgctcctaacaagctctccaaaatcaaggtcgtgaggctatcgattgcgcaggttctgaccgtgatttcgcagaagcagaaggctgctcttagggaagtgtacaagaacaagaagtatttgccgctggatctccgccctaagaagactcgagccatccgccgccgcctcactaagcaccaggcatctatgaagacagaaaaggagacgaaagaaagagatgtacttcccaatgagaaagtatgctattaaagtttagcttgttttctgctcgaagcaattttgggtattttagttgctcgctattgagaatgttgaattttatacggacgactctaagtactctatctagcctttcgtcaaatgcccgttttatatgctgttgttcttgcttacacttatgatttatcagtgcaattgatagtttcttcacgatttattcttcgatcttctctatttgcctgcttctcttccctctccagcagccatcttctattacctcgccagtaatccgactgagtcctcctcgcatgcagcatgcgtccttgatcttccgactggttacagtcaaaactcacaattagtggtaatttttatgaggtaccatgcatattttgtagtgtataagt

SEQ ID NO: 7326 - DNA, 937 bp, Pteridium aquilinum
gttgttggcgcagttcttcttctcatcggctcgcgcagatatggccaagatcaaggtccatgaactgcgtacaaagagcaagtccgatctacaggcacagttgaaggatttgaaggccgaactcgcacttctgcgagttgcgaaggtcacaggtggtgccccaaacaagctttcaaaaatcaaagtggtcagactttcgatagcgcaagtgttgactgttctctctcagaaccagaaagacgcccttcgggcagcttacaagaagtccaagttgctacctctggacttacgtcccaagaagacccgtgcgatcagaaggcgtctgaccaagcaccaggctagtgtgaagacagagaagcagaagaaaaaggaaacctactttccgaagagaaaatatgcattgaaggcttaaagtgccacttatttttgagggaactaccatgttttagtaaccagctgtatgaccttaatcttgcaaattatcaaaggtcggatgagcactacgagttttttggctctcttcacatgaattccctttatttctaattaaaccatttttaccatttctgtacctcaatgtttcgaaaagctcaggatgaatttgttaaacatcacatgatggaactacacacctagatggacccgtaactgcatgtctgtcatggatgcattgtctcctttggacgttgtaccaacacaaaattcttatcaagcattgccacagaattttgtgacgtaggggttggtgtaacatacctccatgtgttgtgggtttgtttgtggatgtcttgtttcgccagaacaacaggcctgttttgccagaataacgggcaccaccaaagaacacagtcttgtaattcagacttcagccagctgttatttaacctttgctactagcaagctgagtcagtaagctcattctttttgtaaaaaagaa

SEQ ID NO: 7327 - DNA, 607 bp, Raphanus sativus
cccagccaacttttaaaagagagtagtagcggcgcagcaaggtgaacacgagtgaagctcacgatggcgaggattaaggttcacgaactgagggacaagtcgaagagcgatctccagaatcagcttcaggatcttaaggctgagctcgctctcctccgtgtcgctaaagtcaccggtggtgctcccaacaagctctccaaaatcaaggttgtccgcaaatccattgctcaggtcttgacagtgacatctcagaagcagaagtctgctctcagagaagcataccagcacaagaagttcattcctcttgatctccgtcccaagaagacccgtgctatccgcaggcgcctcaccaaacatcagctctcgttgaagactgaacgtgagaagaagaaggaaatgtatttcccaatcaggaagtacgccatcaaagtttaagttacctgtccttcttaaaaaaatcgttctactagaaactctgtttcagctttgttgtttgatgcaaacttgtttttgttcttcacttgtgtcagcaaaatggatcttgcttcctattgatgttttgacaattctattttgcaagttttgtgttgcttagtgaaaaaaacac

SEQ ID NO: 7328 - DNA, 679 bp, Picea glauca
tttgttacagcgagggcaaggctaaggattttgggcaaacatggccagaattaaggttcacgagctgcggatcaagagcaaagcagagctcctgaatcaacttacggagctaaaggcggagcttgctctgctaagggttgccaaagtcacaggaggagcccctaacaagctttctaaaatcaaggtggtgagattatcagttgcacaggtgttgacagtaatatctcaaaatcagcgatctgcattgagagaagcatacaagaaaaagaagtacttgcctcttgatttgcgtcccaagaagactcgtgctattaggcgacgtcttactaagcatcaggcctcattgaagactgagagacagaagaagaaagagatgtattttcctatgagaaagtatgcagttaaggtgtaaagcctaggatttgagctttcatgcaattttttttgttacttgcaggatgatattgcctattatatttccattgagtttttggcaaattcctatttgcatcagaatgcaagttgtgataggtgttctttcaatgttgagcagttaatattgtttgccttttctttctcttgaattgcaaccatattttaatgcaatgaatgaattataatattgtggtatccccatgtggaactcacgaatgaaatgattgtaatctgagtagaaaat

SEQ ID NO: 7329 - DNA, 1181 bp, Picea glauca
gatcatctgtgaacgaaccgcctctatgttttatttgcctagggtgcctccccacgggattccagcatcataatgaaaaattactcttactaatataaaacgaactttgttaattgggccaacttgcttccaaaaccctagcccatcgtcaaaaccctacggctcatatcggtattttcttcgcttctggtactgttgttacatcgagggcaaggctaaggattttgggcaaacatggccaggattaaggttcacgagctgcggatcaagagcaaagcagagctcctgaatcaacttacggagctaaaggcggagcttgctctgctaagggttgccaaagtcacaggaggagcccctaacaagctttctaaaatcaaggtggtgagattatcaattgcacaggtgttgacagtaatatctcaaaatcagaaaacagcgttgagggaagcctacaaaaagaagaagtatttgcctcttgacttgcgtcctaagaagacccgcgccatcagacgacgcctcaccaagcaccaggcttcaatgaagactgagagacagaaaaagaaggagatgtacttcccagtgagaaagtatgcagtcaaggtctaaaggcagttgttttcttgctagcatttttttgttttgcttgttggatacaggagcataagtgcttcaggctcagagtgagtcatctatgttcaaactccatggagtttaaattaaaactccatgttcacgtttcattgtggtattcacattcaaaaacttcaagtatgtttgaactataacatattagggtgttgattatcctgtttgattttttggcgtgtatttttttagctatgtagagatttttttggtctaacctggtcaggattagaggaggcttctttggctatccaagttggaatattattcaaacgtacatctagaagactagaaattgctttattaagaataactaaagttgcagtgttacggctaaaattaacttttggaaaagaaatatcatgtggtacatgaatattaatgggtatcattctctgcaacctttgaatgcagacctagaagtcagtttttcttttcaggtggcgcaactagtcttaattttttggcccttgttccaaatatgtagtaaaacagaatatatgaacttttgtgatgatctttaaacatgtacggtt

SEQ ID NO: 7330 - DNA, 1128 bp, Picea glauca
agcatcataatgaaaaattactcttactaatataaaacgaactttgttaattgggccaacttgaaaccctagcccatcgtcaaaaccctacggctcatatcggtattttcttcgctacgggtacttttgttacagcgagggcaaggctaaggattttgggcaaacatggccaggattaaggttcacgagctgcggatcaagagcaaagcagagctcctgaatcaacttacggagctaaaggcggagcttgctctgctaagggttgccaaagtcacaggaggagcccctaacaagctttctaaaatcaaggtggtgagattatcagttgcacaggtgttgacagtaatatctcaaaatcagaaaacagcgttgagggaagcctacaaaaagaagaagtatttgcctcttgacttgcgtcctaagaagacccgcgccatcagacgacgcctcaccaagcaccaggcctcaatgaagactgagagacagaaaaagaaggagatgtacttccccatgagaaagtatgcagtcaaggtctaaaggcaacaattttcttgctagcattatttgttttgcttgttggatacaggaatccaagtgttcaggctcagtgagtcgtctatattaggtttgtttgggaagtttagattgaattccagttctattgattgtacatggagttgaaattagaattccatgttcatgttcaaattcaaaaactccaagtttgcttgacctataacctattacctgtgtgattttttggattatagtctttagctatgtagatgtttttagtctgtcctggtcaagattagagaaggaggcttctttggctatccaatttggaatatttttcaaaagtacacctaaaagactagaagttgctttattaagaattactagagttgcggagtttcagctaaaatccacttttttgaaaagaaatatcatgtggtatatgagtaacaatttgaatgggtatcatcctctgcaacctttgaattcaagcctagaaggcagtttttcttttcaggtggcgcaactagtcttatttttggcccttggtccaaatatgtagtaaaaaagcattgtgaacatttgtgattatctttaaacatgtatgatgtg

SEQ ID NO: 7331 - DNA, 534 bp, Zingiber officinale
cgaggcaagcgaggggaggctgtttgtttttcatagcgatggcgaggattaaggtccatgagcttcgcgggaagacgaaaactgagctccagaatcagttgaaggacctgaagaatgagctctccctcctccgtgtcgccaaggtgaccggtggcgcacccaacaagctctcgaagataaaggtggtgagactgtcgatcgcgcgtgtgctgactgtgatctcgcagaagcagaaagctgcgttgagggaggcttacaagaagaagaagctcctccctctggatctccgccccaagaagacacgtgccatccgccgccggcttaccaagcatcaggagtccttgaagactgagcgtgagaagaaaagggagaggtacttcccactgaggaaatatgctatcatggctcgagatagggttttatgatttatgttctacaatttaaggttttattgtctctgaaaaattaatgattaggtttctgtattttcaaatgattgcatgctatcttttcaatttccgttgatttaaaaaa

SEQ ID NO: 7332 - DNA, 638 bp, Tropaeolum majus
tctccgttacttcagcggccgggggtatgagacagcatttgaatctgcagaaggggccgagtgtttcactttcatctccaagtttcttcgtcgagaccagaatcaggcagtaatggcaagaatcaaggttcacgagctaaggaacaaatcgaaggctgaccttttgagtcaattgaaagacttgaaggcagagctcgccctcctccgcgtcgccaaggtcaccggtggtgcaccaaacaagctttccaagatcaaggttgtgaggctatcgattgctcaggtgttgactgttatatcacaaacagagaaggcagcactgagggaagtgtacaagaacaagaagtttttgcctctagatctgcgccccaagaagaccagagctattcgtagacggctcactaaacaccaggcttctttgaagaccgaacgggagaaaaagaaggagatgtacttccccttgaggaagtatgctataaagcgtagttttatgtgcctagaaacagagtactgatgttttaagcgatatttttatttgagattgaattctattttgttcgcccaacaaatactacacttgaattgaggttttggtacatttcagctttcaatcccttgagtaattatttcttattttgaaa

SEQ ID NO: 7333 - DNA, 360 bp, Cyclamen graecum
tctcccccgccgagagagagaaagacagagaacgacgccatggcgaggataaaggtacacgagcttaggcagaagacgaaggcggatctgttggctcagctgaaggatctcaaggccgagctctccctcctccgcgtcgctaaggtcaccggcggcgcaccaaacaagctctccaagataaaggtggtgcggctgtcgcttgcgcaggtgctgacggtgatatcgcagaaacagaaggcggcgctgagggaggtgtataagaacaagaagtatcttccgctcgatctccgccccaaaaagactcgtgccattcgcaggcgactcaccaagcaccaggcatcattaagaacagaaagggag

SEQ ID NO: 7334 - DNA, 610 bp, Pteridium aquilinum
cttcttctcgccatcagattctggagctcgccattttttctcaatggccaagatcaaggtgcacgagttgcgcaataagagcaagactgagcttcaggggcagcttaaggacctgaaggcggagcttgcactcttgagagtggcaaaggtcactgggggtgcacccaacaagttatccaaaatcaaggtagtcaggctctcaatagcgcaggtgctgacagtactttctcaaactcagaaagcagcccttcgcacagcatacaagaacaagcggctacctttagatttgcgtcccaagaagacccgagccattaggcggcgtcttaccaaatatcaggccaacatgaagactgagaagcagaagaaaaaggaggcttattttccacagaggaaatatgcattgaaggcgtgatttcaagaatggtagagctgcctttgtttttttgaggaagtaggtactagtcgcatggctggagtttttgtaataccttttataccccgactcaaagctggttatttttgaatggttgtccacaatggaggtgacttgttatgtgcatctcactcaattttctcttttgtggctaatttgttgaatgtctgtttcttt

SEQ ID NO: 7335 - DNA, 666 bp, Allium cepa
ttcttagttttttctagtcctatttctaaacttccatcgttcagcttccgcaatggccagaatcaaggtccacgaattacgtaccaagtcaaagaccgatcttctgacccagctcaacgagctgaaatctgaactagctctgcttacgcgttgctaaagttaccggcggtgcccctaacaaactctctaagattaaagtgtgaggaagggaatagctcaggtgttgactgtgatttcgcagaagcaaaagcaggctttaagagaagtgtacaagaagaagaaattgctaccactggatttgaggcctaagaagactaaagccattcggatgaagcttacaaaacatcaggagtctttgaagaccgaacgtcagaagaaaagggagatgtacttcccatgagaaagtatgccatcaaggctcagtaatcagtttatgcagcactcttttcttggttatgtagtaaccttttgtatttactttgttattttatccgcactcttgggtttttgaattgccgagttattgtgaacctgttcatcatcttcttgtagaacctcaattcataattgttgtgagctggagaattaattttggtgttttattctgttcatttgctcctgtagtgttatcggtttgttctcagatatgattagtttatatttgtg

SEQ ID NO: 7336 - DNA, 621 bp, Cenchrus ciliaris
tttttcgtttgtgcccatggtcagcccggatcaaggtgcacgagctgcgggggaagaacaaggcggagctgcaggggcagctcaaggagctcaagtcggagctctccctcctccgcgtcgccaaggtcaccggcggtgcccccaacaagctctccaagatcaaggtggtgcgcacctcgatcgcgcgcgtgctgacggtgatctcgcagaagcagaaggcggcgctgagggaggcgtacaagaagaagaagctgctccccctcgacctccgccccaagaagacccgtgccatccgccgccgcctcaccaagcaccagctttctctgaagacggagagggaaaagaagcgtgagaagtacttccccatgaggaagtatgctatcaaggcctagatcagaactgtgggaagctaagcttagcatatcatcggctgtttctttgcctaggaagtgttttatgttttgatttgtatggacattttctgcgggaaagtacggtgtatttcctctgttatctcaaatgcctagattggtttaaggggcagttcgtattggcactgaaatcttgtttatttggtgtgaaaatgccatgtctgcagttctatccctagaattccgaaat

SEQ ID NO: 7337 - DNA, 673 bp, Allium cepa
tacggggggttcttagtttttctagtccatttctaaacttccatcgttcagcttccgcaatggccagaatcaaggtccacgaattacgtaccaagtcaaagaccgatcttctgacccagctcaacgagctgaaatctgaactagctctgcttcgcgttgctaaagttaccggcggtgcccctaacaaactctctaagattaaagttgtgaggaagggaatagctcaggtgttgactgtgatttcgcagaagcaaaagcaggctttaagagaagtgtacaagaagaagaaattgctaccactggatttgaggcctaagaagactaaagccattcggatgaagcttacaaaacatcaggagtctttgaagaccgaacgtcagaagaaaagggagatgtacttccccatgagaaagtatgccatcaaggctcagtaatcagtttatgcagcactcttttcttggttatgtagaaccttttgatttactttgttattttatccgcactcttgggtttttgaattgccgagttattgtgaacctgttcatcatcttcttgtagaacctcaattcataattgttgtgagctggagaattattttggtgttttattctgttcatttgctcctgtagtgttatcggtttgttctcagatatgattagtttatatttgtgcc

SEQ ID NO: 7338 - DNA, 659 bp, Allium cepa
tttttctagtccatttctaaacttccatcgttcagcttccgcaatggccagaatcaaggtccacgaattacgtaccaagtcaaagaccgatcttctgacccagctcaacgagctgaaatctgaactagctctgcttcgcgttgctaaagttaccggcggtgcccctaacaaactctctaagattaaagttgtgaggaagggaatagctcaggtgttgactgtgatttcgcagaagcaaaagcaggctttaagagaagtgtacaagaagaagaaattgctaccactggatttgaggcctaagaagactaaagccattcggatgaagcttacaaaacatcaggagtctttgaagaccgaacgtcagaagaaaagggagatgtacttccccatgagaaagtatgccatcaaggctcagtaatcagtttatgcagcactcttttcttggttatgtagaaccttttgatttactttgttattttatccgcactcttgggtttttgaattgccgagttattgtgaacctgttcatcatcttcttgtagaacctcaattcataattgttgtgagctggagaattattttggtgttttattctgttcatttgctcctgtagtgttatcggtttgttctcagatatgattagcttatatttgtgaccc

SEQ ID NO: 7339 - DNA, 553 bp, Allium cepa
tttctttagtttttctagtacctatttctaaacttccatcgttcagcttccgcaatggccagaatcaaggtccacgaattacgtaccaagtcaaagaccgatcttctgacccagctcaacgagctgaaatctgaactagctctgcttcgcgttgctaaagttaccggcggtgcccctaacaaactctctaagattaaagttgtgaggaagggaatagctcaggtgttgactgtgatttcgcagaagcaaaagcaggctttaagagaagtgtacaagaagaagaaattgctaccactggatttgaggcctaagaagactaaagccattcggatgaagcttacaaaacatcaggagtctttgaagaccgaacgtcagaagaaaagggagatgtacttccccatgagaaagtatgccatcaaggctcagtaatcagtttatgcagcactcttttcttggttatgtagaaccttttgatttactttgttattttatccgcactcttgggttttgaattgccgagttattgtgaacctgttcatcatcttcttgtaga

SEQ ID NO: 7340 - DNA, 469 bp, Vinca minor
gctcccactcgaagaagaagaagcaatggccagaattaaggttcatgaattgaggaacaagacaaagcaagagttgcttgcacagttgaaggatctgaaagcggagctcgctcttctccgtgtcgctaaggtcaccggtggtgctcctaacaagctctccaagatcaaggttgtgaggttatccattgcccaggttttgactgttatctcacaaaaacagaagtctgctttgagggaagcctacaagaacaagaagtacttgccccttgacctgcgccctaagaaaaccagagccattcgtagacgtttgaccaagcaccaggcctcattgaagaccgagagagaaaagaagaaggagatgtactatcccatgaggaagtatgccattaaagttttagggcaggagatttgtgttattcgaagtttttgatgtttacggatcaagcctcgagttaatacaatttttttt

SEQ ID NO: 7341 - DNA, 346 bp, Ocimum basilicum
atgcagcgagaattaaagtgcacgagctgcggcagaagaacaggtcggatcttctggcacagctgaaggaattgaagacggagttagcgctgctgcgcgtggcgaaagtgaccggcggtgccccaaacaagctgtcgaagatcaaggtcgtgcgtctgtcgatagcgcaggttcttacggtgatctcgcagaagcagaaaagcgctctcagagaagtctataagaatcgcaagtatcttccgcttgatctccgccctaagaagactcgcgctatccgccgccgcctcaccaagcaccaggcatctctgaagacggagaaacaaaagaagaaagagatgtatttccc

SEQ ID NO: 7342 - DNA, 391 bp, Cyclamen graecum
tctcccccaagaaaccctaatttcagcgctctgtgtattaactagacagatcgagagagattcgcggaaatggctcggattaaggtacacgagctgaggcaaaaatcgaaggcggatttattggcgcagctgaaggatctcaaggctgagctcgcactcctgcgagtcgctaaagtcactggcggggctcctaacaagctctccaagataaaagtggtgagattatccatcgcccaggtgctgacggtgatctcacagaaacaaaaagctgctctaagagaagtctacaaaaacaagaagtatttgccccttgatctgcgtccaaagaaaactagagctatccgcaggcgtctcaccaagcaccaggcctcattgaaaaccgaaagggaga

SEQ ID NO: 7343 - DNA, 805 bp, Gnetum gnemon
attcgtgcgcaggtgggggagaattcgttgtcggcggcagaagcagtagcaagagcaatagagtttcagcaatggcgaggattaaggttcatgagttgaggcccaagagcaagcaggagcttctcaaccaactcaaggacctcaagggcgagctcgccctcctcagggttgccaaggtcaccggcggagcccagaacaagctttccaagatcaaggttgtgaggaagtcgatcgcacaggttctgacggtgatttctcagaaccagaaagccgctctcaggaaagcctacaaaaagaagaagtatttaccgctcgatctgcgccctaagaagacccgcgccatcaggcgtcgtctctcgaagtaccagttgtctctgaagacagagaggcaaaagaagaaagaaatgaactttccaatgaggaagtatgctattaaggtctagaatctttgtcttacaaaggaattgtttggtttccagttttggatcattattttacagttaggaattcaggcgtgaacctgtgagggggattacgttgccttttttgagaatgtattgtggaattaacagttagcagatttaatagttgtattgtgaagcaggatggtggaagatttagctttcttgtaatcccgtcgcacgactatatttcatgtattccggttttgcccgaggaattgttttgttattgaagaaaattttcaggaaatatggatatccttttaggagctattacctgtggaattgcaattgaatgctaggtgacagccgcagctgttggttgttaatcatgctgaaacacg

SEQ ID NO: 7344 - DNA, 766 bp, Mesostigma viride
agagggaacgaagggatggccaagatcaaggtgcatgagctgcgcaataagaggaaggaggagctccttgctcagctgaaggagctgaagacggagcttgccgctctccgcgtggcgaaggtcacgggaggtgcaccaaacaagctgtccaaaatcaaggtcgtcaggttgtccattgctcaggtcctgacggttatcagccagacgcagaaggcgagcctgcgtgaagtttacaagggaaagaagttcgtgccattggacctgcgccccaagaagacgcgggccattcgcaggaggttgaccaagtatcaggccaacctgaagaccgagaaggaaaaaaagaagcttgcgtatttccctatgcgcaagtatgccgtcaaggcgtaaattgtcttctgaccgcttagatggtgaatgagtgacgagctgaaagttgtctcagcctgaacggtgggagatggcggccattcccggcagttgagctgtacgacgaacagctgactttagatcggatggcttgcctcacgctgttgaaggaaccaaaaccaaagccgctggatgtgcagaagcggctggccttcttttcctagcttgttcaaggcatgggatgaaggtgtatctattggattgagtaaaccattttttacttccaagccgtcgtgttctttgcgcacagccgcacgtgtttgataaccccatcagagactgcagagtatttgttgtgtctgtcactcaattctgtttataatcgaacggacgggtttgg

SEQ ID NO: 7345 - DNA, 633 bp, Physcomitrella patens
gcttgatgagatcgcctcctttgccgttactcgtcttccgcgcgtagggttcgccaccagtttctgcgatggccaagatcaaagtgcatgagctccgcgccaagagtaaaaatgaactgctcagccagttgaaggagctgaaggccgagctcgctgccttgagggttgccaaggttactggaggcgctcccaacaagctgtctaagatcaaagtggttaggctgtcgattgcacaggttttgaccgtcatctctcagactcaaaaggctagccttcgtgaagcttacagcaagaagaagtaccttccgattgatttgcgcccaaagaaaactcgtgctattcggaggaggttgacaaagcatcagtcttcgatgaagaccgagaagcagaagaagaaagaagcttactttccgatgagaaaattcgcagttaaggcttaaattctcatgtttaatatggtactggcttgtcatgtagtctaaacgctggcatgcgacttgccttgtcaaccgtgtaggcgattgcttgtcgactctcaagaaattttgatactcttttgttcacatatttcttctatggacgaagagaggaacatgttactgagtggagctgaattgtcttaagatttcccgg

SEQ ID NO: 7346 - DNA, 521 bp, Vinca minor
cttaaagatctcaaagccgagctagctctccttcgcgttgccaaagtcactggcggtgctccgaacaagctctccaaaaaaaaagtggtgaggttgtcaattgcgcaggtgctgacagtgatttcccagaagcagaagtccgctttgagagaagtgtataagaacaagaagtatttgccattggacctccgccctaagaagaccagagctatccgcaggcgccttactaagcaccaggcatctttgaagacagaaagggagaagaagaaagaaatgtacttcccgatgaggaagtacgcaatcaaggtttaatcatcaagcgaaattcttgcttgaaattgttttgttggatcaagcttttaaaactctcctagttgataaaaagaactcttaatcgtgatgagatacaatatatttttttagtcccttcttctccatcatatgacgagattgttccttgctaggctacaaatggtagattcaaggtgggatttaacagttaagtagtactccctccattc

SEQ ID NO: 7347 - DNA, 1034 bp, Amorphophallus konjac
cggccggggccgcagtccctattttcgacgccgacttcgcgcctcgtgagctccgtcttccccgcgggatcgccatggcgaggattaagccccatgagctccgaaccaagtcgagggaggagctcctcaaccagctcaaggagctgaagacggagcttgcgctgctgcgggtggccaaggtcactggaggcgcccccaacaagttgtcgaagattaaggtcgtcaggctctccattgctcgtgtgctcactgtgatgtcacagaagcagaaggcagccctgagggaggtctacagcaagaagaagttcatgccgttggatctgaggccaaagaagacgcgtgcgatcaggaagcgccttacgaagcaccaggcttctttgaagaccgagaggcagaagaagagggagatgtatttcccccagagaaaatacgcgatcaaggcctgaagtgcagtacaagtcttgcggctgttttgaatcaaaattttagatctggaccctattcaccattttgcattttatctcacttttatgagagatgacttgaacagattttggacaactcggttttgttgatgtggatctttatggtttgttagattagttctctccatggttcgtcgatttggtgatccgtatcggatctttcttgatctgatacggtacactcgagtcaattaacttgatctgactcgacatgtatcatcttcttcctcgctctctctctttttcactgtgactcgatccgactctgtcgatcttaaagatgatttacaccgtatcaatttttttagatatgatacggcacgtctgaatcggcctttagtcaaattaagtcgccgaatcatggttctctctttgcgcgatatcattgtgaaacgccggaaggcacaaaaaccggtacgagaggcggcaaatggaggacgacgtacgaggggacgggggatcgtctaatctgccgttcaacttccggaaaaatcaaggtgctttgggagcagagacaagtggtgaaatgagtaaaatccccaattccga

SEQ ID NO: 7348 - DNA, 422 bp, Carpinus betulus
ccaacccccatttttctagggtttcattcgtagagaaacaagtctgccgcggcgaagctcctagacgcacaacgatcaatggcgagaatcaaggtccatgagctgcgtcagaaatcgaaggctgagctgctgaaccatttcaaggatttcaaggcagagcttgcccaactccgtgtcgccaaagtcaccggcggtgcacccaacaagctctccaagataaaggtggtgaggctgtcgattgcgcaggtgttgactgtgatctcgcagaagcagaaggaggctctgagggaagtttacaaaaagaagaagtacctgcctcttgatctgcgtcccaagaagaccagggccattcgaagaaggcttaccaagcaccaggcctcattgaagactgaaagggagaaaagaaagagatgtattttccc

SEQ ID NO: 7349 - DNA, 652 bp, Mesostigma viride
agagggaacgaagggatggctaagatcaaggtgcatgagctgcgcaacaagaggaaggaggagctccttgctcagctgaaggagctgaagacagagcttgccgctctccgcgtggcgaaggtcacgggaggtgcaccaaacaagctgtccaaaatcaaggtcgtcaggttgtccattgctcaggtcctgacggttatcagccagacgcagaagtcgagcctgcgtgaggcttacaaggggaagaagttcgtgccattggatctgcgccccaagaagacgcgggccattcgcaggaggttgaccaagtatcaggccaacctgaagaccgagaaggaaaaaaagaagcttgcgtatttcccgatgcgcaagtatgccgtcaaggcgtaaattgtcttctgaccgcttagatggcgaacgaatgacgagctgaaagtggcatcagcatgaacggtgggagatggcggccattcccggcagttgagctgaacgacgaacagctggctttagatcggatggctttcctcacactgttggagaaaccaaaagcaaagttgcaggatgtgcagcagcggctggccttcatttcctagcttattcaagggaagggatgaaggtgtatgtattggattgagtaaaccattttttcttccaa

SEQ ID NO: 7350 - DNA, 521 bp, Physcomitrella patens
ggcttgttgtctgagctccttccgctgcttcaccgctccacgcattgagcgcttgactctcttccgcaatggcgaagatcaaagttcacgagctccgcgccaagagcaagaatgaactccttaatcagttgaaggagttgaaagccgagctcgctgccttgagagttgctaaagtgaccgggggtgcgccgaacaagttgtctaagatcaaggtggttaggctttcaatagcccaggtgttgactgtcatttctcagacacagaaggcaagtcttcgagaagcctacagcaagaagaagttccttcccattgacttgcgtccgaagaagactcgcgctattcgcaggaggttgaccaagcaccaggcttccatgaagaccgagaggcaggagaagaaggaggcttacttccccatgaggaagttcgcagttaaggcttagaaatctgtgcttggtgcatcgatcgcttgttggagcatcttttttattgttttgaatgcaacgtgggaaattctgttttta

SEQ ID NO: 7351 - DNA, 450 bp, Secale cereale
gccagcagaccagctcgacagacgcaatggcccggatcaaggtgcacgagctgagggggaagagcaagacggacctgcagggccagctcaaggacctcaaggcgagctgggtcctacgtcgcgtcgccaaggtcaccggcggcgcccccaacaagctctccaagatcaaggtggtgcgcacctcgattgcgagggtgctcacggttatctcgcagaagcagaagtcggcgctgagggagcgtacagaacagaagctgctcccgctcgacctccgccccaagagacccgcgccatccgcaggcgtctcaccaagcaccagctctctttgaagaccgagagggagaagaagcgtgagaaagtccttccccatgaggaagtatgctatcaaggcctaggttggagcaggtgttttaccggtcgagtttgcccggagttgcatgaatttatgtt

SEQ ID NO: 7352 - DNA, 1165 bp, Trifolium pratense
attcattcattcattctgtaacaatggcacttagactcattgataatgctcttccaacaataacccaagaaagacccaaaaaacaacctaaaattgctgtctcaactcaaaaacaacaacaacctcgtacttcttctaatgacgaaaatcaagtcccattggaacccaccattgattacatttcatccgacaaccttaaacccatgtcggatcctgaagctcagattcaaagtttgattgaagatttggattcgaaaaattgggtcaaggtttgtgaatcgttgaatgatgttaggagatttgcattgtacaactcttctcttctattacccatcttggataaaattttgttggtggtggtgaagtcaatgaagaaccctcgtagtgctttatgcaaaacctctattatggctgcttctgatattttcaatgcttttggtgacaaattgtttgatccttccacttctgaggcatttggtggcttgctgttgcagttgcttctgaaagcttctcaggataaaaagtttgtgtgtgaagaagctgagaaagcacttggatcaatggtgggttcaatgacacctcttccattgcttcagaaactaagagtttctgtgagtcacaccaaccttaggatcagggctaaagctgctgtctctctatctaaatgtgtctccaagatgggaattgatgaaatggaggagtttggaatgggaaagttgatagaagttgcagctgatttagtgaatgataggcttccagaggcaagagaagcagcaagaagtattgcaacttcagggtatgaagcaatcattaaggatgtggaagaagtggaacagaagatggaggtgtggcaaagcttctgccactctaagttaacaccaattaatgcactttcaatcttgaagattgttagaccttagaattggaggagtattttgttttgtagggcttgctcatactttgaggcatgtttagaaatttagttttatttgtggcaatgttcatggttctacatgagcagtcattagcaaataagttttcattttgtttgatgtagctacattgcttttatatatttttattttgaaaatgcaaaatttattagattcactgttgacatacaccaattacacatgttcttattgtttatttattataaaataat

SEQ ID NO: 7353 - DNA, 1103 bp, Trifolium pratense
atactcaaaatcaaatctcacaaaaccatactattctctcataacatcatcgatcaatcaacaaagattcttcgttttcttcattcattcattctgtaacaatggcacttagacccattgataatgctcttccaaccataacccaagaaagacccaaaaaacaacctaaaattgttgtttcaactcaaaaacaacaacctcgtacctcttctaatgacgaaaatcaagtcccgtcggaaccgaccattgattacatttcatccgacaaccttaaacccatgtcggatcctgaagctcagattcaaaatttgattggagatttggattcgaaaaattgggtcaaggtttgtgaatcgttgaatgatgttaggagatttgcattgtacgattcttctcttctattacccatcttggataaaattttgttagtggtggtgaagtcaatgaagaaccctcgtagtgctttatgcaaaacctctattatggctgcttctgatattttcaatgcttttggtgacaaattgtttgatccttccacttctgaggcatttggtggcttgctgttgcagttgcttctgaaagcttctcaggataaaaagtttgtgtgtgaagaagctgagaaagcacttggatcaatggtgggttcaatgacacctcttccattgcttcagaaactaagagtttctgtgagtcacaccaaccttaggatcagggctaaagctgctgtctctctatctaaatgtgtctccaagatgggaattgatgaaatggaggagtttggaatgggaaagttgatagaagttgcagctgatttagtgaatgatagacttccagaggcaagagaagcagcaagaagtattgcaacttcagtgtatgaggcaatcattaaggatgttgaagaaatggaacagaagatggaagtgtggcaaagcttctgccactctaagctaacaccaattaatgcactttcaatcttgaagattgttaaaccttagaattggtggagtattttgttttgtagggtttgctcatactttgaggcatgtttagaaatttagttttatttgtggtaatgttcatggttctctacatgagcagtcatt

SEQ ID NO: 7354 - DNA, 1109 bp, Trifolium pratense
atactcaaaatcaaatctcacaaaaccatactattctctcataacatcatcgatcaatcaacaaagattcttcgttttcttcattcattcattctgtaacaatggcacttagacccattgataatgctcttccaaccataacccaagaaagacccaaaaaacaacctaaaattgttgtttcaactcaaaaacaacaacctcgtacctcttctaatgacgaaaatcaagtcccgtcggaaccgaccattgattacatttcatccgacaaccttaaacccatgtcggatcctgaagctcagattcaaaatttgattggagatttggattcgaaaaattgggtcaaggtttgtgaatcgttgaatgatgttaggagatttgcattgtacgattcttctcttctattacccatcttggataaaattttgttagtggtggtgaagtcaatgaagaaccctcgtagtgctttatgcaaaacctctattatggctgcttctgatattttcaatgcttttggtgacaaattgtttgatccttccacttctgaggcatttgatggcttgctgctgcagctacttctgaaagcttctcaagataaaaagtttgtttgtgaagaagctgagaaagcacttggatcaatggttggttccatgacacctcttccattgcttcagaaactaagggtatctgtgagtcacaccaaccttaggatcagggctaaagctgttgtttctctatccaaatgtgtctccaagatgggaattgaggaaatggaggagtttggaatggaaaagttgatagaagttgcagctgatttagtgaatgatagacttccagaggcaagagaagcagcaagaagtatcgcaacttcggtgtatgaggcaatcattaaggatgctgaagaagttgaagagaagatggaagtgtggcaaagtttctgccactctaagctaacaccaaataatgcactttcaatcatgaagattcttaaaccttagaattggaggagtattttgttttgtagggtttgctcatacttgaggcatgtttagaatttaaattttatttgtggcaatgttcatggttctacatgagcagtcattagctaataa

SEQ ID NO: 7355 - DNA, 1202 bp, Trifolium pratense
atcaacgcagtacatggggatactcaaaatcaaatctcacaaaaccatactattctctcataacatcatcgatcaatcaacaaagattcttcgttttcttcattcattcattctgtaacaatggcacttagacccattgataatgctcttccaaccataacccaagaaagacccaaaaaacaacctaaaattgttgtttcaactcaaaaacaacaacctcgtacctcttctaatgacgaaaatcaagtcccgtcggaaccgaccattgattacatttcatccgacaaccttaaacccatgtcggatcctgaagctcagattcaaaatttgattggagatttggattcgaaaaattgggtcaaggtttgtgaatcgttgaatgatgttaggagatttgcattgtacgattcttctcttctattacccatcttggataaaattttgttagtggtggtgaagtcaatgaagaaccctcgtagtgctttatgcaaaacctctattatggctgcttctgatattttcaatgcttttggtgacaaattgtttgatccttccacttttgaggcatttgatggcttgctattgcagctgcttctgaaagcttctcaggataaaaagtttgtgtgcgaagaagctgagaaggcacttggatcaatggttggttccatgacacctcttccattgcttctaaaactaagggtatctgtgagtcacaccaaccttaggatcagggctaaagctgctgtttctctatccaaatgtgtctccaagatgcagggaattgagggaatggaagagtttggaacggaaaagttgatagaagttgcagctgatttagtgaatgatagacttccagaggcaagagaagcagcaagaagtattgcaacttcagtgtatgaggcaatcattaagaatgtggaagaagtggaagagaagatggaagtgtggcaaagcttctgccactctaagctaaccccaattaatgcactttcaatcttgaagattgttaaaccttagaattataggagtattttgttttgtagggtttgctcatacttgaggcatgttttgaaatttagttttatttgtggcaatgttcatggttctacatgagcagtctttagctaataagatttcattttgtttgatgttgtagctacatttacttatatatttttatattgaaaaagcaaaatttatta

SEQ ID NO: 7356 - DNA, 1193 bp, Trifolium pratense
ttcattcattcattctgtaacaatggcacttagacccattgataatgctcttccaaccataacccaagaaagacccaaaaaacaacctaaaattgttgtttcaactcaaaaacaacaacctcgtacctcttctaatgacgaaaatcaagtcccgtcggaaccgaccattgattacatttcatccgacaaccttaaacccatgtcggatcctgaagctcagattcaaaatttgattggagatttggattcgaaaaattgggtcaaggtttgtgaatcgttgaatgatgttaggagatttgcattgtacgattcttctcttctattacccatcttggataaaattttgttagtggtggtgaagtcaatgaagaaccctcgtagtgctttatgcaaaacctctattatggctgcttctgatattttcaatgcttttggtgacaaattgtttgatccttccacttttgaggcatttgatggcttgctattgcagctgcttctgaaagcttctcaggataaaaagtttgtgtgcgaagaagctgagaaggcacttggatcaatggttggttccatgacacctcttccattgcttctaaaactaagggtatctgtgagtcacaccaaccttagaatcagggctaaagctgctgtttctctatccaaatgtgtctccaagatgggaattgagggaatggaagagtttggaatggaaaagttgatagaagttgcagctgatttagtgaatgatagacttccagaggcaagagaagcagcaagaagtattgcaacttcagtgtatgagacaatcattaagaatgtgggagaagtggaagagaagatggaagtgtggcaaagcttctgccactctaagctaacaccaaataatgcactttaaatcttgaagattgttaaaccttagaattggaggagtattttgttttgtagggtttgctcatacttgaggcatgtttagaatttaaattttatttgcggcaatgttcatggttctacatgagcagtcattagctaataattaatatttcattttgtttgatgtagctacattgcttttatatttttattatgaaaaagcaaagtttaataaattcaccgttacatacaccattgaagaaatttagattgcggttttctaactttatattaagatgagagaggactgtcaacatcattgaaga

SEQ ID NO: 7357 - DNA, 1202 bp, Cicer arietinum
taccgttatacaccacacctctaacgtctctttccatttctatatttcaaatcttcaacacaacaccctacaatttttatacacaacattcattcacaatctcttcattcattcattctgcaacaacaatggcacttagacccattgataacgctcttccagcaacaacccaagaccgacccaaaaaacaacctaaaatcgctgtcgcagcaaccgtaaaacaacaacaacaaaaacctattgcttccaatgacgaaaatcaagttccattggaaccctccattgattatatctcatccgacaaccttaaacccatgtcggatcccgaagctcaaattcaaagtttgattgaagatttggattcgaaaaactggatcaaggtttgtgaatcgctgaatgatgttaggcgattcgcattgtaccattcttctcttctattacccatcttggataaaattgtgttggtggtggctaagacaatgaagaaccctcgtagcgctctttgtaaaacctctattatggctgcttctgatattttcaatgcttttggtgacaagttgtttgatccttctatctccgatgcatttgatagcttgatgttgcagctgcttcttaaagcttctcaggataaaaggtttgtttgtgaagaagctgtgaaagcacttggatcaatggtgggtaccatgacacctcttccattgcttcagaaactaagggtatacgtgagtcacaccaaccttagggtcagggctaaagctgctgtttcgctatccaaatgtgtctccaagatgcaggggattgaggaaatggaagagtttgggatggaaaagttgattgaagttgcagctgatttactgaatgatagacttccagaggcaagagatgcagcaagaagtattgcaacttcagtgtatgaggcattgattaaagatgtggaagtggaacagaagatggaggtgtggcagagcttctgccactcaaagctaacaccaattcacgctctttcaattttgaagatagttaagccttagaattggaggaatgtttcttttgtgtagatgtttgctcatacttgaggcatttttagaattttagctttatttgtgccaatgctcatgattctacatgagtagccattatcaaaaataaaatttcattttgtttgatgtagctacattgctttaatatattagaattatatt

SEQ ID NO: 7358 - DNA, 954 bp, Trigonella foenum-graecum
actaaccaagaacgaaccaaaacaacctaaactcgctgtctcaacacaaaacaaccacaacctcctacttcttctaatgatgaaaatcaagtccctttggaacccaccattgattatgtttcctccgacaaccttaaacccatgtcggatcctgaagctcagattcaaagtttgattgaagatctggattcgaaaaactgggtcaaggtctgtgaatccttgaatgatgttaggcgatttgcattgttcaattcgtctcttctattacccatcttggataaaattgtgatggtggtggtgaagtcaatgaagaaccctcgtagtgctctttgcaaaacctctattatggctgcttctgatattttcaatgcttttggtgacaaactgtttgatccctctatctctgaggcgtttgatggcttgatgttgcagctgctgctgaaagcttctcaggataaaaagtttgtgtgtgaagaagctgagagagcattaggatcaatggtgggttccatgacaccacttccattgcttcagaaactaagggtatctgtgagtcacaaaaaccttaggatcagggctaaagctgctgtttctctatccaaatgtgtctccaagatgggaattgaagaaaaggaagagtttgggatggaaaagttgattgaagtggcagctgatttagtgaatgatagacttccagaggcaagagatgcagcaagaagtgttgcaacttcagtgtatgaggaaatcattaaggatgtggaagaggaacagaaaatggagatgtggcagagcttctgccactctaagctaacaccacttaatgctcttctaatttgaagatagttaaatcttagaattgaaagatatttattttgtaggtttgctcatacttgaggcatatttagaagtttagttttatttgtggcagtgctcatggttctacatgagcagcca

SEQ ID NO: 7359 - DNA, 1913 bp, Trigonella foenum-graecum
ggtgatgtgcaaggcacaatggttattagttgcacataattcaacgcaaactatgcatcgttatctggttgtcatcaaagggtcgtgatttgatcataaaatttcgtcttgtgtccatctcaacacggtagggtccatgtagagggtaaaaccctacgccactaatgtgagtgagcacacaaaaacgaaaatgaaaaatcctatatataagccaaaacttgcctcctctttgaaaccctagtttcacttcacaaacctcatttcttcgaatctttgcggcaaaacccatttcttcatcacccattaatttatcttaattctcatctttttcatttctgcactaatcatcagggattgaacaggtgaaggcaccatgtcggatgatgaaagagaggagaaggagttagatctcacttcgcctgatgttgtaaccaaatacaaaactgcagctgagatcgttaacaaggcattgaagttagttatttcggaatgtaaaccgaaggccaagattgttgacatttgcgagaaaggagattcatttattagagagcaaactagtaacgtgtacaagaatgtgaagaagaagatagaaagaggtgttgctttcccaacttgcatttctattaacaacacaatctgccatttctctcctctagccagtgatgagacagtgttggaagaaggcgatataatcaaaattgatttggcatgtcatatagatgggtttattgctgctgtggctcacactcatgttcttcaggaaggtccggttactggacgggcagcagatgtcattgctgctgcaaacactgctgctgaggtggccttaaggcttgtaaggccaggaaagaagaacaaggatgtatctgatgcaattcaaaaggttgctgctgcctatgattgtaaaattgttgagggtgttctaagccaccaaatgaagcagtttgtgattgatggaaacaaggttgtgcttaatatatctaatccagatacaagggttgatgatgcagagtttgaagaaaatgaagtttatgcaattgatatagtaacaagtactggagaaggcaagcctaagttattggatgagaagcaaacaactatttataagagggctgttgacaagagctatcacttgaagatgaaagcatctcgattcattttcagtgaaattagccaaaaatttccaatcatgccattttctgctagggctttggaggagaaaagagctcgcttgggtttagtggaatgtatgaatcacgagctcttgcagccatatcctgttctgcatgaaaagcctggtgattttgttgcacacatcaaattcacggtcttgttaatgccaaatggatcggaccgcgtcacatctcatccactccaacaattgcagccctcaaaaacagtagatgatcccgagatcaaggcatggctagccttgggcacaaagacaaagaagaaaggtggtggaaaaaagaaaaaaggtaagaaagaggacaaggctgatgagtcagcagaagctgaaccagaggactcaacaaatgggaccacacctcagcaatgagttaaataccctcctcagtcctaaaacggaaatgctgttcatttcatttttctaataccttttttcagttttggtacattgttcactaaattatatcttttgggatatgcattttagtatagtgtttagacatcgattctcatagcagttttcagtgcactttttagtctcaaatatcaactaaaaaacaaagaaaatgctatgtttggaaatttgatctgtcttagtattttaatctaaatactacaccatacagtagttgaacttaattaatacaggaatgggtgcatcaatgtctgaatgcagttaatatactgaaataaggtttatttccgtttatttattggaatgaaaa

SEQ ID NO: 7360 - DNA, 1458 bp, Trifolium pratense
ggtaccatgtcggatgatgaaagagaggagaaggagttggatctctcttcttctgaagttgtcaccaaatacaaaactgcagctgagatcattaacaaggctttgaagttagttatttcagaatgtaaacccaaggctaagattgtggacatttgtgagaaaggagattcatttattagagagcaaactagtaatgtgtacaagaatgtgaaaaagaagatagagagaggcgttgctttcccgacttgcatatctgttaacaacacaatctgccatttttcacctctagcaagtgatgaaacagtgttggaagaaggtgatatagtgaaaattgatttggcttgtcatatagatggtttcattgctgccgtggctcacactcatgttcttcaggaaggtccagttactggacgagcagcagatgttatcgctgctgcaaacactgctgctgaagtggccttgagacttgtaaggccaggaaagaagaacaaggatgtaactgatgcaattcaaaaggttgctgctgcctatgattgtaaaattgttgagggtgttcttagtcaccaattgaagcagtttgtgatagatgggaacaaggttgtgcttagtatcactaatccagatacaagggttgatgacgccgagtttgaggaaaatgaagtttatgcaattgatatattgacaagtactggagaaggaaagcctaagttattggatgagaagcagacaactatttataagagggctgttgacaagagttatcacttgaagatgaaagcatctcggttcatattcagtgaaataagccaaaaatttccaatcatgccattttctgctagggctttggaagagaaaagagctcgtctgggtttagtagaatgtatgaatcacgagctcttgcagccttatcctgttctgcatgaaaagcctggtgattttgttgcacacatcaaattcacggtattgttaatgccaaatgggtcggatcgcgtcacatctcatcctctccaagaattgcagcctacgaagacaatagatgatcctgagatcaaggcatggctagctttgggcacaaagacaaagaagaaaggtggcggaaagaagaaaaaaggtaagaaagaggacaaggctgaagctgagccagaggactcaacaaacggggccacacctcaggaatgagttaacacacacctccccaatcccaaaaaagaaatgtttttcatttcatttttctgacaccccttttcaattttggtacattgttcactaaattgtatctctgtttggaatttggatatgaatttagtatagtgtttagacatctattttaatagctgttttcagtgcactttttagtctcaaataccaaattataaaacaaagaaaatgttatgtttggaaaattgagttgtccttgtattttaaatattccaaatctatgttctaaattctaattct

SEQ ID NO: 7361 - DNA, 1829 bp, Cicer arietinum
acgaaagtgaaaaatcatatataaaccaaaatttgcctctttgttctaaccctagttgcactcatcccttttatctccatactgtctcttttttcttcgaatctttcccatcaaatcccttttttcctcacttatcaatcttcattctcatcattttcatttcttcactaacatcagggattcaaacaggtgagttaccaccatgtcggatgatgaaagggaggagaaggagttggatctctcttcttctgaagtcgtcaccaaatacaaaactgcagctgagatcgttaacaaggctttgaagttagttatatcagaatgtaaaccgaaggccaagattgtagacatttgcgagaaaggggattcgtttattagagagcaaactagtaatgtgtacaagaatgtgaagaagaagatagagagaggtgttgctttcccaacttgcatatctgttaacaacacaatctgccatttctctcctctagccagtgatgagacagtgttggaagaaggtgatatagtgaaaattgatttggcttgtcatatagatgggttcattgctgctgtggctcacactcatgttcttcaggaaggtccggttactggacgggcagccgatgtcattgctgctgcaaacactgctgctgaggtggccttgaggcttgtaaggccgggaaagaagaacaaggatgtaactgatgcaattcaaaaggttgctgcggcctatgattgtaaaatcgttgagggtgttctaagtcaccaactgaagcagtttgtgatagatgggaataaggttgtgcttagcatcacaaatccagacacaagggttgacgacacagagtttgaggaaaatgaagtttatgcaattgatatagtgacaagcactggagatggaaagcctaagttattggatgagaagcaaactactatttataagagggcagttgataagagttaccacttgaagatgaaagcatctaggttcattttcagtgaaataagccaaaaatttccaatcatgccgttttctgctagggccttggaggagaaaagagctcgtcttgggttagtggaatgcatgaatcatgaactcttgcagccatatcctgttctgcatgaaaagcctggtgattttgttgcacacatcaaattcaccgtcttgctcatgccaaatggatcggatcgcgtaacgtctcatccactccaagaattgcagcccacaaaaacaattgaagatccagagatcaatgcctggctagccttgggaacaaagacaaagaagaaaggtggtggaaagaagaaaaaaggtaagaaagaggacaaggctgatgggtcagcagaagctgtgccagaggactcaactaatggggccacacctcaggaatgattgagtttataacactcctcaatcccaaaaaggaaatgtttttcatttcatttttctgacacctttcaattttggtacattgttcactaaattgtatctgtttggatatgaatttagtatagtgtttagacatcaattccaatagcaattttcatgtgcacattttagtcccaaacacaacttaaaacagaaaaaggttgtttggaaattatgtttgtccttttattttactatacatacaatagtggaacttaattaatgggtgcaacagtgaaattagaaaacaattggtatattgaaaccaagtgttggatcgatcggaacttattttggattaacaggggctttttaattgttgaaacgtaaagttaagcaaaaattaagttttattattacatgtttacaagaataaagttatacataaatgaagaggcattattat

SEQ ID NO: 7362 - DNA, 1411 bp, Trifolium pratense
gtgattcaacagttgaggtaccatgtcggatgatgaaagggaggagaaggagttggatctctcttcttcggaagttgtcaccaaatacaaaactgcagctgagatcattaacaaggctttgaagttagttatttcagaatgtaaacccaaggctaagattgtggacatttgtgagaaaggagattcatttattagagagcaaactaataatgtgtacaagaatgtgaagaagaagatagagagaggtgttgctttcccgacttgcatatctgttaacaacacaatctgccatttttcgcctcttgcaagcgatgagacagtgttggaagaaggtgatatagtgaaaattgatttggcttgtcatatagatggattcattgctgcggttgctcacactcatgttcttcaggaagatccagttactggacgagctgcagatgttattgctgctgcaaacactgctgctgaagtggccttgagacttgtaaggccaggaaagaagaacaaggatgtaactgatgcaattcaaaaggttgctgctgcctatgattgtaaaattgttgagggtgttttaagtcaccaattgaagcagtttgtgattgatgggaacaaggttgtgcttagtatctctaatccagatacaagggttgatgatgcagagtttgaggaaaatgaagtttatgcaattgatatagtgacaagcactggagaaggaaagcctaagttattggatgagaagcagacaactatttataagagggctgttgacaagagttatcacttgaagatgaaagcatctcggttcatattcagtgaaataagccaaaaatttccaatcatgccattttctgctagggctttggaagagaaaagagctcgtctgggtttagttgaatgtatgaatcacgagctcttgcaaccatatcctgttctgcatgaaaagcctggtgattttgttgcgcacatcaaattcaccgtcttgctaatgccaaatggatcggatcgtgtcacatctcatccactccaagaattgcagcctacaaagacaatagatgacgctgagatcaaggcatggctagctttgggcacaaagacaaagaagaaaggtggcggaaagaagaaaaaaggtaagaaagatgacaaggctgaagctgagcctgaggactcaacaaatggggccacacctcaggaatgagttaacacccacctccccaatcccaaaaaagaaatggttttcatttcatttttcggacaccccttatcaatttttggtacattgttcactgaattgtatctttgtttggatatgaatttagtatagtgtttagacatctattctaatagcagttttcagtgcacttttgtctcaaataccaactataaaacaaagaaaatgttatgtttggaaatt

SEQ ID NO: 7363 - DNA, 1575 bp, Trifolium pratense
accctagcttcactttcacagacccatttttcgccacactctgccgcaaaaccattttcttcctcactcatcaatctccactttcatcattctcatttccacaccaatcatcagtgaggtaccatgtcggatgatgaaagggaggagaaggagttagatctctcttcttctgaagttgtcaccaaatacaaaacttcagctgagatcattaacaaggctttgaagttagttgtttctgaatgtaaacccaaggctaagattgtggacatttgtgagaaaggagatgcatttattagagagcaaactagtaatgtgtacaagaatgtgaagaagaagatagagagaggtgttgctttcccgacttgcatatctgttaacaacacaatctgccatttttcgcctctagcaagcgatgaaacagtgttggaagaaggtgatatagtgaaaattgatttggcttgtcatatagatggattcattgctgcggtggctcacactcatgttcttcaggaaggtccagttactggacgagcagctgatgttatcgctgctgcaaacactgctgctgaagtggccttgagacttgtaaggccgggaaagaagaacaaggatgtaactgatgcaattcaaaaggttgctgctgcctatgactgtaaaattgttgaaggtgttctaagtcaccaattgaagcagtttgtgattgatgggaacaaggttgtgcttagtatctctaatccagatacaagggttgacgacgcagagtttgaggaaaatgaagtttatgcaattgatatattgacaagttctggagaaggaaagcctaagttattggatgagaagcagacaactatttataagagggctgttgacaagaattatcacttgaagatgaaagcatctcggttcatattcagtgaaataagccaaaaatttccaatcatgccattttctgctagggctttggaagagaaaagagctcgtctgggtttagtggaatgtatgaatcacgagctcttgcagccatatcctgttctgcatgaaaagcctggtgattttgttgcacacatcaagttcactgtcttgttaatgccaaatgggtcggatcgcgtcacatctcatccactccaagaattgcagcctacgaagacaatagatgatcctgagatcaaggcatggctagctttgggcacaaagacaaagaagaaaggtggcggaaagaagaaaaaaggtaagaaagaggacaaggctgaagctgagccagaggactcaacaaatggggcaacacctcaggaatgagttaacatctaccccccaatcccaaaaaagaaatgtttttcatttcatttttctgacaccccttttcaattttggtacattgttcactaaattgtatctctgtttggaatttggatatgaatttagtatagtgtttagacatctattttaatagctgttttcagtgcactttttagtctcaaataccaaattataaaacaaagaaaatgttatgtttggaaaattgagttgtccttgtattttaaatattccaaatctatgttctaaattctaattcta

SEQ ID NO: 7364 - DNA, 1360 bp, Glycine max
aatagcacaggtagcaccgattggctcttcaagacttgcttctttaccatttcattcctaaaaccctattcttcttcgctcattcatcagcactgccatcagccccaacctccccacaaggtcacagggactaaagaggtgtaccaccatgtcggacgatgaaagggaggagaaggagttggatctctcttctgcagaagttgtaaccaaatacaaaaccgcggctgagatcgttaacaaggccttgaagctagttatttcagaatgtaaaccaaaggcgaagattgtggatatttgtgagaaaggggattcatacattcgagagcaaactggaaatgtgtacaagaatgtgaagaggaagattgagagaggtgttgctttccctacatgtttgtctgtaaacaacgttgtctgccatttctctccactagccagtgacgaggcagtgttggaagaaggtgatatattgaaaattgatatggcatgtcatatagatggattcattgctgccgtagctcacacccatgttcttcaggaaggtcctgttacaggaagggcagctgatgtcattgctgccgcaaatactgctgctgaggtggccttgaggcttgtcaggccaggaaagaagaacaaggatgtaagtgatgcaattcaaaaggttgctgctgcctatgactgtaaaatcgttgagggtgttcttagccaccaaatgaagcagtttgttattgatgggaataaagttgtgcttagtttgtctaatccggacacaagggttgacgaagcagagtttgaggagaatgaagtttatgcaattgatatagtaacaagcactggggacggcaagcctaagctgttggatgagaagcagacaactatctataagagggctgttgacaagagttatcacttgaagatgaaagcgtctaggttcattttcagtgaaataagccaaaagtttcctatcatgccgttctctgctagggctttggaagagaaaagagctcgacttggtttggtggaatgcgtcaaccatgagctcttgcagccatatcctgttttgcatgaaaagcctggtgatttggttgcgcacatcaaattcacagtcttgttgatgccaaatggatcggatcgaatcacaactcatccactccaagaattgcagcctacaaaaacaatagatgatcctgatattaaggcctggctagccttgggcacaaagacaaagaagaaaggtggtgggaagaagaaaaaaggtaagaaaggggacaaggcagatgagacaactgaagctgaggctatggactcaacaaacggggccactcctcaagagtgacttaactacccttccctctcctctcct

SEQ ID NO: 7365 - DNA, 1494 bp, Glycine max
aggagcaccgtttggctctacaagtctttccttttctatttaattcctaaaatcccattcttcttcgctcattcctctgcactgccatcatccccaacttcctcacaaggttacaaggactaaagagttgtgccaccatgtcggacgatgaaagggaggagaaagagttggatctctcttctgccgaagttgtcaccaaatacaaaaccgctgctgagatcgttaacaaggccttgaagctagttatttcagaatgtaaaccaaaggcgaagattgtggatatttgtgagaaaggggattcatacattagagagcaaactggaaatgtgtacaagaatgtgaagaggaagattgagagaggtgttgctttcccaacatgtttatcaatcaacaacgttgtctgccatttctctccactagccagtgatgaggccgtgttggaagaaggtgatatattgaaaattgatatggcatgccatatagatgggttcattgctgtggtagctcacacccatgttcttcaggaaggtcctgttactggaagggcagctgatgtcattgctgctgctaatactgctgctgaggtggccttgaggcttgtcaggccgggaaagaagaacaaggatgtaagtgatgcaattcaaaaggttgctgctgcctatgactgtaaaattgttgagggtgttcttagccaccaaatgaagcagtttgttattgatgggaataaagttgtgcttagtttgtctaatccagacacaagggttgacgaagcagagtttgaggagaacgaagtttatgcaattgatatagtaacaagcactggggatggcaagcctaagctgttggatgagaagcagacaactatttataagagggctgttgacaagagttatcacttgaagatgaaagcgtctaggttcattttcagtgaaataagccaaaaatttccaatcatgccattctctgctagggctttggaagagaaaagagctcgacttggtttggtggaatgcgtcaaccatgagctcttgcagccatatcctgttttgcatgaaaagcctggtgattttgttgcacatatcaaattcacagtcttgttgatgccaaatggatcggatcgaatcacaactcatccactccaagaattgcagcccacaaaaacaatagatgatcctgatattaaggcctggctagccttgggcacaaagacaaagaagaaaggtggtggaaagaagaaaaaaggtaagaaaggggagaaggcagatgagtcagctgaagctgagcctatggactcaacaaacgaggccactcctcaagagtgacttaactctcctcccctctcctctcccccaaacaatgaaagaagttttttcatttcattttcgataccccttttcaattttggtacactgttcaccaaattgtattttgcttggatatcaattttagtatagtgttccgacattgattctaatagcaattttcatatgctca

SEQ ID NO: 7366 - DNA, 1696 bp, Glycine max
aacgaaaatgaaaaactcctatataaggcaaagctgcctcctgcaggaaaaatagcacaggtagcaccgtttggctcttcaagacttgcttctttaccatttcattcctaaaaccctattcttcttcgctcattcatcagcactgccatcagccccaacctccccacaaggtcacagggactaaagaggtgtaccaccatgtcggacgatgaaagggaggagaaggagttggatctctcttctgcagaagttgtaaccaaatacaaaaccgcggctgagatcgttaacaaggccttgaagctagttatttcagaatgtaaaccaaaggcgaagattgtggatatttgtgagaaaggggattcatacattcgagagcaaactggaaatgtgtacaagaatgtgaagaggaagattgagagaggtgttgctttccctacatgtttgtctgtaaacaacgttgtctgccatttctctccactagccagtgacgaggcagtgttggaagaaggtgatatattgaaaattgatatggcatgtcatatagatggattcattgctgccgtagctcacacccatgttcttcaggaaggtcctgttacaggaagggcagctgatgtcattgctgccgcaaatactgctgctgaggtggccttgaggcttgtcaggccaggaaagaagaacaaggatgtaagtgatgcaattcaaaaggttgctgctgcctatgactgtaaaatcgttgagggtgttcttagccaccaaatgaagcagtttgttattgatgggaataaagttgtgcttagtttgtctaatccggacacaagggttgacgaagcagagtttgaggagaatgaagtttatgcaattgatatagtaacaagcactggggacggcaagcctaagctgttggatgagaagcagacaactatctataagagggctgttgacaagagttatcacttgaagatgaaagcgtctaggttcattttcagtgaaataagccaaaagtttcctatcatgccgttctctgctagggctttggaagagaaaagagctcgacttggtttggtggaatgcgtcaaccatgagctcttgcagccatatcctgttttgcatgaaaagcctggtgatttggttgcgcacatcaaattcacagtcttgttgatgccaaatggatcggatcgaatcacaactcatccactccaagaattgcagcctacaaaaacaatagatgatcctgatattaaggcctggctagccttgggcacaaagacaaagaagaaaggtggtgggaagaagaaaaaaggtaagaaaggggacaaggcagatgagacaactgaagctgaggctatggactcaacaaacggggccactcctcaagagtgacttaactacccttccctctcctctcctctcctctccccaaacaatgaaagaagctttttcgtttcattttcgacacctcttttcaattttggtacattgttcaccaaattgtattttgcttgcttggatgtcaattttagtatagtgttccgacattgattttaataggaatttatatatgcacattttagttggggtcctttttttcaaaaaagaaaaaagacaaaccgaaccagttaaatggtttagttcttcatccaaactgtttgataataataaagcggtttggtttttggttaactgattctgaacc

SEQ ID NO: 7367 - DNA, 1515 bp, Glycine max
agttgcacaggagcaccgtttggctctacaagtctttccttttctatttaattcctaaaatcccattcttcttcgctcattcctctgcactgccatcatccccaacttcctcacaaggttacaaggactaaagagttgtgccaccatgtcggacgatgaaagggaggagaaagagttggatctctcttctgccgaagttgtcaccaaatacaaaaccgctgctgagatcgttaacaaggccttgaagctagttatttcagaatgtaaaccaaaggcgaagattgtggatatttgtgagaaaggggattcatacattagagagcaaactggaaatgtgtacaagaatgtgaagaggaagattgagagaggtgttgctttcccaacatgtttatcaatcaacaacgttgtctgccatttctctccactagccagtgatgaggccgtgttggaagaaggtgatatattgaaaattgatatggcatgccatatagatgggttcattgctgtggtagctcacacccatgttcttcaggaaggtcctgttactggaagggcagctgatgtcattgctgctgctaatactgctgctgaggtggccttgaggcttgtcaggccgggaaagaagaacaaggatgtaagtgatgcaattcaaaaggttgctgctgcctatgactgtaaaattgttgagggtgttcttagccaccaaatgaagcagtttgttattgatgggaataaagttgtgcttagtttgtctaatccagacacaagggttgacgaagcagagtttgaggagaacgaagtttatgcaattgatatagtaacaagcactggggatggcaagcctaagctgttggatgagaagcagacaactatttataagagggctgttgacaagagttatcacttgaagatgaaagcgtctaggttcattttcagtgaaataagccaaaaatttccaatcatgccattctctgctagggctttggaagagaaaagagctcgacttggtttggtggaatgcgtcaaccatgagctcttgcagccatatcctgttttgcatgaaaagcctggtgattttgttgcacatatcaaattcacagtcttgttgatgccaaatggatcggatcgaatcacaactcatccactccaagaattgcagcccacaaaaacaatagatgatcctgatattaaggcctggctagccttgggcacaaagacaaagaagaaaggtggtggaaagaagaaaaaaggtaagaaaggggagaaggcagatgagtcagctgaagctgagcctatggactcaacaaacgaggccactcctcaagagtgacttaactctcctcccctctcctctcccccaaacaatgaaagaagttttttcatttcattttcgataccccttttcaattttggtacactgttcaccaaattgtattttgcttggatatcaattttagtatagtgttccgacattgattctaatagcaattttcatatgctcattttagttggggt

SEQ ID NO: 7368 - DNA, 1562 bp, Arachis hypogaea
ccgagccacagccacctctctgcttttctaacacttgcacaccgttccattcacttctaaaaccctacctttcgttcttcactgccaccaaacccttcgctaagtgagaacaattgaacaagaaagcaaccatgtcagatgatgaaagggaggagaaggagttggatctctcttctcctgaagttgtcaccaaatacaagactgcggctgagatcgttaacaaggctttgaagttggtggtctcagaatgtaaaccgaaggccaagattgtggacatttgcgaaaaaggagattcatacattagagagcaaactggtaatgtgtacaagaatgttaagagaaagattgagagaggcgttgcttttccaacctgcatatctgtaaacaatacagtctgtcatttctctcctctagcaagcgatgaggcggtgttggaaggaggtgatatattgaaaattgatatggcttgtcatatagatggattcattgctgctgtggcacacacacatgtgcttcaggatggcccagttacaggacgggcagctgatgttatcacagctgcaaacactgctgccgaagtagccttaagacttgtaaggccaggaaagaagaataaggatgtaaccgaggcaattcaaaaggttgctgctgcctatgattgtaaaattgttgagggtgtgcttagtcaccaaatgaagcaatttgtaattgatgggaacaaagttgtgcttagtgtaacaaatccagatacaagggttgatgatgcggagtttgaggaaaacgaagtttatgcaattgatatagtaacaagcactggagaaggcaagcccaagctgttggacgaaaagcagacaactatttataagagagccgttgacaagagttatcacttaaagatgaaagcatctagattcattttcagtgaaataagccaaaaatttccaattatgccattctctgctagggctttggaagagaaaagagctcgcctgggtctagtggaatgtgtgaatcatgagctcttgcagccatatcctgttctgcatgaaaagccgggtgattatgttgcgcacatcaaattcacagtcttgctaatgccaaatggatcagatcgagtcacctcttatccactccaagagttgcagccaacgaaaaccatagaggatccagatatcaaggcatggctggctttgggcacaaagacaaagaagaaaggtggtggaaaaaagaagaaaggtaagaagggggacaaggcagatgaatcagctgaagctgagcctatggactctacaaatggtcaagaatgagtttaaaatgatctcgtttcatttttcaaccccctttcaattttggtacactgttcactgaattgtatctctgcttggatatgaatttagtatagtattcactgttcagatattagatactaacagcaagttttcgtatgcccattattgttgcaccccaaatgcttactttgttctgccttttcttagagcaaatatcccttttctcaaaacaaagagtttgtactttataaagatgggtttcaatttgtttta

SEQ ID NO: 7369 - DNA, 1635 bp, Phaseolus vulgaris
aaccctagttgcacagagccaccgtttggctctacaagactacccttctccattttgtttcctgaccctttcccttcttcaccattttttgcctctttcatcatccccaacatcttcacgaggtaagagggactacagaactgtgtcaccatgtcggacgaggaaagggaggagaaggagttggatctctcttctgcggaagtggtcaccaaatataagaccgctgctgagatcgttaacaaggccttgaagttagttatttcagaatgcaaacctaaggcaaaaattgtggacctttgtgagaaaggggattcatatattagagagcaaactggaaatgtgtacaagaacgtgaagaggaagattgagcgaggtgttgcttttccgacatgtttatcagtaaacaacttggtctgccatttctctccactagccagtgatgaggccgtgttggaagaaggtgatatattgaaaattgatatggcttgtcatatagatggtttcattgctgcggtggctcacacccatgtacttcaggaaggtcctgtttcaggaagggcagccgatgtcattgctgctgcaaatactgctgcagaggtggccttgaggcttgtcaggccaggaaagaagaacaaggacgtaactgatgctattcaaaaggttgctgctgcctatgactgtaaaattgttgaaggtgttctcagccaccaaatgaagcagtttgttattgatgggaataaagttgtgcttagtttgtctaatccagacacaagggttgacgaagcagagtttgaggagaacgaagtttatgcaattgatatagtaacaagcacgggagatggcaagccgaagttatttgatgagaagcagacaaccatctataagagggctgttgacaagagttatcacttgaagatgaaagcatctaggttcatcttcagtgaaatcagtcagaaatttcctattatgccattttctgctagggctttggaagagaaaagagctcgtctgggtttagtggaatgtgtcaaccatgagctcttgcagccatatcctgttctgcatgaaaagcctggtgattatgttgctcacatcaaattcacagtcttgttaatgccgaatggatcggatcgggtcacatctcatacactccaagaattgcagcctacaaaaactatagatgatcctgatattaaggcctggctagccttgggcacaaaaacaaagaaaaagggtggtggaaagaagaaaaaaggtaagaaaggggacaaggtagatgagtcagctgaagctgagcctatggactcaacaaacggggccacttcttaagattgagttaaacccatcctctctccccaaacaatgaaagaaattttcatttcattaccccttttcaattttggtacattgttcaccaaattgtattttgttggattatgaattttagtatagttttccgaccttgattccagtagcaattttcatatggttccttaaaaaaaccaaaccgttcacttcaatggtttggttaattatccaaactgtttgttaatttgataaaatggtttggtttttggtgaactgaatctgaattaaatagttttcggctgatttttaaagccaaaccagtttcaa

SEQ ID NO: 7370 - DNA, 1525 bp, Vigna unguiculata
atttctttccagagccttcaccttcttcattcattctttttctctttcataatccacaacaacatcttagcgaggtcagaggactacatagttgtgccaccatgtcggacgaagaaagggaggagaaggagttggatctctcttctgccgaagtggtaaccaaatacaagacagctgctgagatcgttaacaaggccttgaagttagttatttcagagtgcaaacctaagacaaaaattgtggacatctgtgagaaaggggattcatatatcagagaacaaactggaaatgtgtacaagaatgtgaagaggaagattgagagaggtgttgcttttccaacatgtttatcagtaaacaatgttgtttgccatttctccccactagccagtgacgaggcagttttggaagaaggtgatatattaaaaattgatatggcttgtcatatagatggtttcattgctgctgtggctcacacccatgtacttcaggatggtcctgttacaggaagggcagccgatgtcattgctgctgcaaatactgctgcagaggtggccttgaggcttgtaaggccaggaaagaagaacaaggatgtaactgaggcaattcaaaaggttgctgctgcctatgactgtaaaattgttgagggtgttctcagccaccagatgaagcagtttgttattgatgggaataaagttgtgctcagtttgtctaatccagaaacaagggttgatgaagcagagtttgaggagaatgaagtttatgcaattgatatagtaacaagcacaggggatggcaagcccaagttgttggatgagaagcagacaaccatttataagagggctgttgacaagagttatcacttgaagatgaaagcatctaggttcatcttcagtgaaatcagtcaaaagtttccaattatgccattttctgctagggctttggaagagaaaagagctcgtctgggtttagttgaatgtgtcaaccatgagctcttgcagccatatcctgttctgcatgaaaagccaggtgattatgttgcacacatcaaattcacagtcttgttgatgccaaacgggtcggatagggtcacatctcatccactccaagaattgcagcctacaaaaacaatagatgatcctgatattaaggcctggctagccttgggcacaaaaacaaagaaaaagggtggtggaaagaagaaaaaaggtaagaaaggggacaaggtagaagagtcagctgaagctgagcctatggactcaacaaatggggccacttctcaagattgagttaaccccctcttctccccccgaacaatgaaagagattttcttttcattaccccttttcaattttggtacattgttcgccaaattgtattttgtttgattatgaattttagtatagttttccgaccttgattctaacagcaattttcatatggttccttaaaaaaaccaaaccgtatactggtttggttattcatccaaactgtttgataatttgataaaatggtttggtttttggtg

SEQ ID NO: 7371 - DNA, 1474 bp, Lupinus angustifolius
gcagccctagcagttgtacttcatttctcaccgagtcagctacactacccataccttcgatcaaacccattcactaagtgagaaaccatgtcggacgatgaaagagatgagaaagagttggatctctcttctcatgaagttgttaccaaatacaaaactgcagctgagattgttaacaaggccttgaagttggttatttcagaatgcaaaccaaaggcgaagattgttgacatttgtgaaaaaggggattcatttattagagagcaaactggaaatgtgtacaagaatgtgaagaggaagattgagagaggtgttgctttcccgacatgcttatctgtgaacaacacagtttgtcatttctctcctctagccagtgatgaggcggtcttggaagaaggtgacatattgaaaattgatctggcttgccatatcgatgggttcattgccgctgtggctcacacacatgttcttcagaacggtccagttacaggacgagcagctgatgtcttagcagctgcaaacactgctgccgaggtggccttgaggctggtcaggccaggaaaaaagaataaggatgtaactgaagcaattcaaaaggttgctgctgcctatgattgtaaaatcgtagagggtgttcttagccatcaattgaagcagtttgttattgatgggaacaaggttgtgcttagtgtatctaatccggatacaagggttgatgaagcagagtttgaggagaatgaagtttatgcaattgatattgtcacaagcaccggagatggcaagcctaagctgttggatgagaagcagacaactatttataagagggctgttgacaagagttatcacttgaagatgaaggcgtctagatttattttcagtgaaattagccagaaatttccaatcatgccattctcagctagggctttggaagagaaaagagctcgtctgggcttagtagagtgcgtgaatcatgaactcttgcagccatatcctgttctacatgaaaaacctggtgattttgttgcacatatcaaattcacagtcttgctaatgccaaatggatcggaccgtctcagttctattccactccaggaattgcagcctacaaaaactgttgatgatcccgaaattaaggcatggctagccttgggcacaaagacaaagaagaaaggtggtggaaagaaaaagaaaggtaagaagggggacaaggcagatgagtcagttgaagctgctgagcctgtggactcaacaaattgagcaaaaacctcaagattgatcccttccccctaacaaaaaaagtacttttttaatttagtttacaaaagcactttcaaattttggtacattgcttattgagttgtatctgcttgaatgtgtttagtgtgcacattgtagttggtacttatctccttgctttgatgcttgtttttataaaaacaatagaaaagtttatgtttaaaaatgtgtttatgct

SEQ ID NO: 7372 - DNA, 1636 bp, Phaseolus vulgaris
ttctggtagtaaccctagattcactaagccacactcttgcctcattcttcattttcctttttccatttccatttctaaaaccctttcatttttcacccattcttctgaactgcatcatcttcaaaccttctcactgtgagagattacagacagagggactaaagggttgtgctgccatgtcggacgacgaaagggaggagaaggagttggatctttcttctgccgaagtggtaaccaaatacaagactgctgctgagattgttaacaaggccttgaagcttgttatttctgaatgtaaacctaaggctaaggttgtggacatttgtgagaaaggggattcatatattagagaacaaactggaaatgtttacaagaatgtgaagagaaagattgagagaggcattgcttttcctacatgtttatcagtaaacaacgtgatttgccatttctctccactagccagtgatgaggcagtgttggaagaaggtgatatattgaaaattgatatggcttgtcatatagatggtttcattgctgctgtggctcacacccatgtacttcaggaaggtcctatcacaggtagggcagcagatgtcattgctgctgcaaatactgctgcagaggtggccttgaggcttgtcagaccaggaaagaagaacaaggatgtttctgaagcaattcaaaaagttgctgctgcctatgactgtaaaattgttgagggtgttcttagtcaccaaatgaagcagtttgttattgatgggaataaagttgtgcttagtttgtctaatccggagactagggttgacgaagcagattttgaggagaatgaagtttatgctatagatatagtaacaagcacaggggatggcaagcctaagttgttggatgagaagcagacaactatttacaagagggctgttgacaagagttatcatctgaagatgaaagcttctaggtttatttttagtgacataagtcaaaaatttccaatcatgccattctctgctagggctttggaagagaaaagagctcgtttgggtttagtggaatgtgttaaccatgagctcttgcagccatatcccgttctgcacgaaaagcctggtgattatgtagcacacatcaaattcacagtcttgttaatgccaaatgggtcggatcgagtcacatctcatccacttcaagaattgcagcctacaaaagcaattgatgatcctgatgttaaggcctggttagcattgggcacaaaaacaaaaaagaaaggtggtggaaagaagaaaaaaggtaagaaaggcgacaaggtagatgagtcagttgaagctgagccgatggactcaacgaacggggctactccgcaagattaagttaacccaaatcctctttggaaacaatgaaagaagattttcattttcgacctcctctttcaattttggtacattgttcaccaaattgtattgcttgggtatgaatcttagtgtagtcttctgacattgatactaacagtaatttttcatgtggacattctagttataggtgtgggactgtttctgaaccggtttgaaatgaatgtttcgagctgatttctaaaatcagtccagttttgaatctttttgtttgagaaattgttttttatttgagt

SEQ ID NO: 7373 - DNA, 1670 bp, Cajanus cajan
atgctgtgcaccagtaagtcagtaaccctagttcattgaactgccacttagccacacaaacccctttcttaggttctccttataccctcataaccccttctcttcttcacgctttttctgcaccaatcagaatccagcagggttatccggagaagctaccatgtcggacgatgagagggaggagaaggagttggatctcacttctccggaagttgtcaccaagtacaagagtgcagctgagattgttaacaaggctttgcagttagttatttcagaatgtaagccgaaggccaagattgttgacctttgcgagaaaggggattcatatattagagagcaaactggaaacatgtacaagaatgtgaagaggaagattgagagaggtgttgcctttccaacttgtgtgtctgtgaacaacactgtgtgtcacttctctcctctcgccagtgatgaatcggtgttggaggaaggtgatatagtgaaaattgatatggcttgtcatatagatgggttcattgctgctgtggcacacactcatgttcttcaggagggtccagttacaggacgtgctgctgatgccattgcagcagcaaacactgctgctgaagttgccctgaggcttgtgcggccaggaaagaagaacaaggatgtatctgaagcaatccagaaagttgctgctgcgtatgactgtaaaattgttgagggtgttcttagccaccaaatgaaacagtttgtgattgatgggaacaaggttgtgcttagtgtatccaatcctgatacaagggttgatgacgcagagtttgaggagaatgaagtttatgcaatcgatattgtagcaagtactggagatggcaaacctaaattattggatgaaaagcagacaactatttataagagagctgtcgacaagagctatcacttgaagatgaaagcatcaaggttcattttcagtgaaataagccaaaagtttcccatcatgccattttctgcaagagccttggaagagaaaagagctcgtctgggtttagtggaatgtgtgaatcatgagctcctgcaaccttatccagtgctgcatgaaaagccgggtgattatgttgcacacatcaaatttaccgtattgttgatgcctaatggatcagatcgcgtcactactcatccactccaggaattgcagcccaccaaaacaatagatgatcctgaaatcaaggcgtggttagctttaggcacaaagacaaagaagaagggtggtggaaagaaaaagaaaggtaagaagggagcagaagctgagccaatggaggcaacaaatggtgccacaccccaagagcaagattgagacagaaacccttttgatccctttcaattttggtacttttttcaccaagttgtatctgcttaatttagtacagcttccggacatccaatgttaataggaatttaaattccttgcgcaattgtacttacctgaatgctgtactcctgattaagcataaatgcttgtttgtggggtttattgttttataaacaaaagatattaaatttaaaatctcaattttatgttttaaaaaaattgtgttctggtcctacattttgacataggttaaactatgttggtttggtgacacaaatgtggtcttcatatgcatagtcgtgagattgttgtgttgaatgaa

SEQ ID NO: 7374 - DNA, 1573 bp, Vigna unguiculata
caccatttgtctcagcaacaaattccctcttctatttcaattcctaaaacccttaccttcttcactcattctccagtactgcgtcatcttcaaccctcctcacttgatacacacagaggggcctcagagttgtgccaccatgtcggacgaggaaagggaggagaaggagttggatctttcttctgccgaagtggtcaccaaatacaagacagccgctgagatagttaacaaggctttgaagcttgttatttcggaatgtaaacctaagaccaagattgtggatatctgtgagaaaggggattcatatattagagagcaaacgggaaatgtgtacaagaatgtgaagaggaagattgagagaggagttgcttttcctacatgtatatcagtaaacaatgtagtctgccatttctctccactagccagtgatgagtcagtgttggaagaaggtgatatattgaaaattgatatggcttgtcatatagatggtttcattgctgctgtagctcacacccatgtacttcaggaaggtcctatcacaggaagggcagcagatgtcattgctgcagcaaatactgctgcagaggtggccttgaggcttgtcaggccaggaaagaagaacaaggatgttactgaagcaattcaaaaggttgctgctgcctatgactgtaaaattgttgaaggtgttcttagtcaccaaatgaagcagtttgttattgatgggaataaagttgtgcttagtttgtcaaatccggacacgagggttgaagaagcagagtttgaggagaatgaagtttatgctatagatatagtaacaagcacaggcgatggcaagcctaagttgttggatgagaagcagacaactatttacaagagggctgttgacaagagttatcatctgaagatgaaagcctctaggtttatttttagtgagataagtcaaaaatatccaatcatgccattctctgctagagctttggaagagaaaagagctcgtctgggtttagttgaatgtgtcaaccatgagctcttgcagccatatcctgttctgcacgaaaaacctggtgattatgttgcacacatcaaattcacagtcttgttaatgccaaatgggtctgatcgagtcacatctcatccactccaagaactgcagcctacaaaatcaattgatgatcctgatatcaaggcctggctagccttgggcacaaaaacaaagaagaaaggtggtggaaagaagaaaaaaggtaagaaaggggacaaggtagatgagtcagttgaagctgagcctatggactcaacagacggtgctactcctcaaggttgagttaacccagttctctccagaaaaaatgaaagaagattttcatttcattttcaagcctcctttttcaattttggtacattgttcaccaaattgtatttttcttggatatgaattttagtatagttctgacattaattctaacagtaattttacatatgaacattttagttataggtgtgggactttttctgaaccggtttgaaatgaatatgtttcgagctgatttctaaaatcagtccagttttgaat

SEQ ID NO: 7375 - DNA, 1501 bp, Glycine max
gttcattgcactgcaacttagccacttaaaccccattcgttagcctctccacatcttcactgcttcttccatacaaatccgaaaccagacggaattcacaaaagacgttaccatgtcggacgatgagagagaggagaaggaattggatctcacttctccggaagttgtcactaagtacaagagcgccgctgagattgttaacaaggccttgcagttagttatttcggaatgtaaaccaaagacaaagattgttgacctttgcgagaaaggggattcgtatattagagagcaaactggtaacatgtacaagaatgtgaagaggaagattgagagaggtgttgccttcccgacatgtgtgtctgtgaacaacactgtctgtcacttctctcctcttgccagtgatgaaacagtgttggaagacggtgatatagtgaaaattgacatggcttgtcatatagatgggttcattgctgctgtggctcacacccatgttcttcatgaggggccagttacaggacgggcagctgatgctattgcagcagcaaacaccgccgccgaagtggctttgcggcttgtaaggccaggaaggaagaacaaggatgtaactgaagcaattcaaaaggttgctgctgcgtatgattgtaaaattgttgagggtgttcttagccaccaaatgaaacagtttgtgattgatgggaataaggttgtgcttagtgtatccaatccagatacaagggttgatgatgcagagtttgaggagaatgaagtttatgcaattgatatcgtagcaagtactggagatggcaagcctaagctgttggatgagaagcagacaactatttataagagagctgttgacaagagctatcatttaaagatgaaagcatctaggttcattttcagtgaaataagccaaaagtttcccatcatgccattctcagcaagggctttggaagagaaaagagctcggttaggtttagtggaatgtgttaatcatgagctcctgcaaccttatcctgttctgcatgaaaagcctggtgatgatgttgcacatatcaaattcactgtattgctaatgcctaatggatcagatcgtgtcacatctcacccactccaggaattgcagcccaccaaaacaatagacgatcctgaaatcaaggcatggctagcattgggtacgaagacaaagaagaagggtggtggaaagaagaagaaaggtaagaagggggcagaagctgaaccaatggaggcaacaaatggtgctacaccccaagagcaagattgagacaaaaaccatagattttgctttttgatccctttcaattttggcacatttttcaccaagttgtatctgcttgattgtgaatttagtacagccttcggacacccaatgttaataggaatttgatttccttggctattgtacttgacctgaatgctgtactcctgattaagcataaatatgcttaattgttggaaaatatatcaaatttaaaacccc

SEQ ID NO: 7376 - DNA, 1574 bp, Euonymus alatus
gaacgccaaccctagcttctatcgtggcacctcataatctgctctctttcccacctctgcttatccctgttaaaccctagccttcgccgaacagacgctcaaacatttacagccgtcaatacttcctgagtcgcgatattcagacacacggaaacgatgtcgtcggacgatgaaagagaggagaaggagctcgatctcacttctcccgaggtcgtcaccaagtataagagtgcagccgagattgttaacaaggcgttacagttagtgatatcagaatgcaagccaaaagcgaaggttgtggacgtctgtgagaagggcgattcatatatcagagagcaatcaggaaacatgtacaagaatgttaagaagaagattgaacgcggcgttgcttttcctacttgcgtttctgtaaacaacactgtttgccatgtctcaccacttgccagtgatgagacagttttggaagaaggtgatttggtgaaaatagatatggggtgtcacattgatgggttcattgctgtagttgcacatacccatgttcttcaagaagggccagttacagggaaggctgcagatgttattgcagcttcaaatactgctgctgaagttgccttgaggcttgttaggccagggaagaagaacaaagatgtaacagatgcaattcagaaggttgctgctgcttatgactgcaaaattgttgaaggtgttcttagccaccagttgaagcagtttgtgatagatgggaacaaggtcgtacttagtgtttctagtccagatactagggttgatgatgcagaatttgaggagaatgaagtgtatgctgtagatatagttacaagcacaggagaaggcaagccaaagctgttggatgagaagcagactactatttataagagggcagttgacaagaactatcacttgaagatgaaagcttccagatttatttttagtgaaattagtcagaaatttccaatcatgccattctctgcaagggctttggaagagaaaagggctcgtttgggattagtggaatgtgtgaatcatgatctcctgcagccatatcctgttcttcatgagaagccgggtgacctagttgcgcacatcaaattcacagttttgctaatgccaaacggatcagataggatcacatctcattctctgcaagagctgcagcccacaaagaccatcgatgatcctgaaattaaggcctggttagccttgggcacaaagacaaagaagaaaggaggcggaaagaagaagaaaggtaagaagggcgacaagcctggggagtcggcggaagctgagcctatggatgcaaccacaaatggtgcatcgcaagaatgagccggtcctacatttgtcactaccttttatttagtgttgttactttgttgtcattgtaacttcttggtaatgagttgatccttaaaaaacagtgtttattgacgctcctaaatgagtatcctttactactgatgaagccattagtctaattcgtgatgaaccgaattagatttgcagattttgacttcgactttatatcagagaatgatcgaaagagaggaaaagttgtt

SEQ ID NO: 7377 - DNA, 1573 bp, Lupinus angustifolius
ataagttattgtaatattgtaaggaaatgagataatccttataagccaaacatgtctttgtgagtgcagttgtactaaaacacttcatttcatttcaaatttctacagagtcagctactacattcactaagtgaggaaccatgtctgatgatgaaagagatgagaaggagttggatctttcttcccatgaagttgttaccaaatacaaaactgcagctgagattgtaaacaaggccttgaagttagttatttcagaatgcaaaccaaaggcgaaaattgtggacatttgtgagaaaggagatttgtttattagagagcaaactggtaatgtgtacaagaatgtgaagaggaagattgagagaggtgtcgctttcccgacatgcttatctgtaaatagcacagtttgtcatttctctcctctagccagtgatgagacagtgttggaagaaggtgacataatgaaaattgatatggcttgtcatatagatgggttcattgcggctgtggctcatactcatgttcttcaggaaggtccagttacaggacgagcagctgatgtcttagcagctgcaaacactgctgctgaggtggccacgaggctgatcaggccaggaaagaagaacaaggatgtaactgatgcaattcagaaggttgctgctgcctatgattgtaagattgttgagggtgttcttagccatcaaatgaagcagtttgtgattgatgggaataaggttgtgcttagtgtaactaatccagacacaagggtcgatgaagcagagtttgaggaaaatgaagtctatgcaatcgatatagtaacaagcaccggagacggcaagccgaggctgttggatgagaagcaaacaactatctataagagggccgttgacaagagttatcacttgaagatgaaggcatctaggttcattttcagtgaaattagccaaaaatttccaatcatgccattctctgccagggctttggaagagaaacgagctcgtctgggcttagttgagtgtgtgaatcatgagctcttgcaaccatacccggttctgcatgaaaagcctggtgactatgtcgcacacatcaaattcaccgtcttgctaatgccaaacgggtcggatcgtctcagttctttcccactccaggaattgcagccgacgaaaacagttgatgatcctgaaattaaggcctggctagccttgggcacaaagacaaagaagaaaggtggtggaaagaggaagaaaggcaagaagggggacaaggccgatgaattgcctgaagctgctgagcctacaaacacaacaaatgaagccacaccgcaagattgactccccccttaacaaaaaaaaatgctttttaatttaatttacagtagccctttcaaattttggtacattgtttattgagttgtatttgcttagatgagtttagtgtgcacattgtagtctgtactcaatgcctgctttgttgcttatttttaaagcagataccaatttctaaaaccaatagaaagattatgtttagaaatgtgtttgtttgttatattgcctttaagagtgggtaaaaatgtttt

SEQ ID NO: 7378 - DNA, 1748 bp, Cicer arietinum
agaaagggtaacaaagctaaaaccctatacgcctccatctgtgtcacgacaggaataatcgatcctctatataaacaaagtaaccctagtttctttcaccacaacttagccactatcagtttccaactttcctcttcttccaccgattcttcttcaataatccaaaacaaccttcacgctattcataataaccaatccactatgtcggatgatgaaagagaggagaaggagctggatctcacttctcctgatgttgtaactaagtacaaaagcgctgcagagatcgttaacaaggctttgcagttgataatttcagagtgtaaaccgaaggtcaaggttgttgaaatttgtgagaaaggggattcatttataagagagcaaactggtaacatgtacaagaatgtgaagaagaagattgagaggggtgttgccttcccaacttgcatatctataaacaacactgtatgccacttttctcctctggccagtgacgaaactgtgttggaagaaggtgatatactgaaaattgatttggcttgtcatatagacggtttcattgctgctgtggctcatactcatgtacttcaggaggggcctgtaacgggtcgtgcagctgatgtcattgcagcagctaacactgctgctgaagtggccttgaggcttgtaaggccaggaaagaagaacaaggatgtaactgatgcaattcagaaggttgctgctgcttatgattgtaaaattgtcgagggtgtgcttagccaccaaatgaagcagtttgtgattgatgcgaataaggttgtcctaagtgtatctaatcctgacacaagggttgacgatgccgagttcgaggagaacgaagtttatgcaattgatattgtagccagcactggtgaaggcaagcctaagctgttggatgagaagcaaacaactatttataagagagctgttgatagaagctatcacttgaagatgaaagcatctcggtttatttacagtgaaattacccaaaactttcccatcatgccattctctgccagggctttggaagaaaaaagagctcgtctcggtttagtggaatgcatgaatcacgagctcctgcagccgtatcctgttctacacgaaaaggctggtgattatgttgcacacatcaaattcacggtcttgttaatgccaaatggatcggatcgcatcacaactcattcactccaggaattgcagcctactaaaactgtagatgatcccgaaattaaggcctggctagcattgggcataaagacaaagaagaaaggtggtggaaagaagaagaaaggaaagaagggtgccgaaggtgaagcccaagctgagcccatggatgcaacaaatggtgcctcaacccaagagcaagaatgagtctgcctgaaaaaaaccctttgattttcctttgtaatcccttgcaattttggtacattttacactagttgtattggccaagtgtgaatttagtatagcattcctacgatatcgataggaatttccatgtgcacattccagtatacattgacatgaatgctatactctgtttaaaacataaatcccggttttatggtacttttatttaaaggaatcatatcaaatttaagaaccaaacttcatgttgagatgagtgatcctggatgttttgtggttgaaatagatgcaagcgatgtaaagaagaaaaaaataatctaattaacaacgttcaaggactagggcttttttttttaattaatcaa

SEQ ID NO: 7379 - DNA, 1620 bp, Cucumis melo
gctttcaactttcacttctctatcctaatttgcttcatcttcttctcttcgccgtatccaaatccctcccactgcttgttgttcttcaccgccgtaaatgatgtccgacgaggaaagagaggagaaggagctcgatcttacttctcctgaagtagtcaccaaatacaagagcgccgccgagattgccaacaaggcattgcagttggtgatatcggaatgcaaaccgaagacgaagattgttgacatttgcgagaaaggggattccttcattagggaacaaactggaaatatgtacaagaatgttaagaagaagattgaaagaggcgttgcttttccaacttgcatttctgttaacaacactatatgccatttctctccgctttcaagtgacgagacagtgttggaagagggcgatatggttaagattgatttgggttgtcatattgacgggtttattgctgtagtcgctcatactcatgtgctgcaagaaggtccggttacaggaagagctgctgatgtaattgcagctgctaacactgcagctgaagttgccttgaggcttgtgagacctggaaaaaagaacaaggatgttacagaagcaattcaaaaggttgctgcttcctatgactgcaaaattgtcgaaggtgttcttagccatcagctgaagcagtttgtgattgatgggaacaaggttgtattgagtgttgccaatcctgagacaagggttgatgaggcagaattcgaggagaacgaggtgtattcgatagatatagttacaagcactggggaaggaaagcccaagttgttggatgagaagcagactactatttataagagagctgtggacaggaattatcacttaaagatgaaagcctctagatttattttcagtgaaataactcagaagttccctataatgcctttcacagcaagagctttggaagagaaacgggctcggcttggattggtggaatgtgttaaccatgatcttttgcagccatatcctgttcttcatgagaagcctggtgattttgttgctcatatcaaattcaccgttttgttgatgcctaatggatccgaccgagtcacatctcatcctctgcaagatctgcagcctacaaaaacaatagacgatcctgaaatcaaggcatggttagcattgggcattaagacaaagaaaaagggtggtggaaagaagaagaaaggtaagaaaggagataagacagaggaccctgcggatgctgagcccatggataccacggccaatggtgcggcatcccaagaatgaacatctacacaaccacatccttgaaaaaaggaaaagaaaaaaaaagaaattagtaattcccctcgcctttttccttcaaatttgggtctgcccccaccgttgatctcatttgtatacgatgagcaggtgagtgtagttgccaaattaaaatggtgaacgttctttattgggtattattaatgaatccaacctcttttgtatggtcgacatactttgcttttttttttttctcttttttttttttttttcatttcaaactccatagatgcttgattgtctctcgagatgtgcaactgaatgagcctaaatttatttctttactaatcttttca

SEQ ID NO: 7380 - DNA, 1711 bp, Glycine max
ccatgaccctgtgttcgactaaccctagttcattgcactgcaacttagccacttaaaccccattcgttagcctctccacatcttcactgcttcttccatacaaatccgaaaccagacggaattcacaaaagacgttaccatgtcggacgatgagagagagaagaaggaattggatctcacttctccggaagttgtcactaagtacaagagcgccgctgagattgttaacaaggccttgcagttagttatttcggaatgtaaaccaaagacaaagattgttgacctttgcgagaaaggggattcgtatattagagagcaaactggtaacatgtacaagaatgtgaagaggaagattgagagaggtgttgccttcccgacatgtgtgtctgtgaacaacactgtctgtcacttctctcctcttgccagtgatgaaacagtgttggaagacggtgatatagtgaaaattgacatggcttgtcatatagatgggttcattgctgctgtggctcacacccatgttcttcatgaggggccagttacaggacgggcagctgatgctattgcagcagcaaacaccgccgccgaagtggccttgcggcttgtaaggccaggaaggaagaacaaggatgtaactgaagcaattcaaaaggttgctgctgcgtatgattgtaaaattgttgagggtgttcttagccaccaaatgaaacagtttgtgattgatgggaataaggttgtgcttagtgtatccaatccagatacaagggttgatgatgcagagtttgaggagaatgaagtttatgcaattgatatcgtagcaagtactggagatggcaagcctaagctgttggatgagaagcagacaactatttataagagagctgttgacaagagctatcatttaaagatgaaagcatctaggttcattttcagtgaaataagccaaaagtttcccatcatgccattctcagcaagggctttggaagagaaaagagctcggttaggtttagtggaatgtgttaatcatgagctcctgcaaccttatcctgttctgcatgaaaagcctggtgatgatgttgcacatatcaaattcactgtattgctaatgcctaatggatcagatcgtgtcacatctcacccactccaggaattgcagcccaccaaaacaatagacgatcctgaaatcaaggcatggctagcattgggtacgaagacaaagaagaagggtggtggaaagaagaagaaaggtaagaagggggcagaagctgaaccaatggaggcaacaaatggtgctacaccccaagagcaagattgagacaaaaaccatagattttgctttttgatccctttcaattttggcacatttttcaccaagttgtatctgcttgattgtgaatttagtacagccttcggacacccaatgttaataggaatttgatttccttggctattgtacttgacctgaatgctgtactcctgattaagcataaatatgcttaattgttggaaaatatatcaaatttaaaaccccaattttgtgtttggaaatgtgtgttctgtgcctaggttgaaatgttgacctttttgcattggttagacactattgttttgtatatgcacgtagctggaccgattgttttgtgggagaatgaatatttatgtaatatcggcaaaacttaaaagaggaaataatacatgagattttgtgaaatta

SEQ ID NO: 7381 - DNA, 1664 bp, Cucumis sativus
gtaaccctaaatccttcttacgggtctcacccactttccttgctttcaagcttcacttctctatcccaatttgcttcaccttcttctcttcgccgtctccaaatccctcccactgcttgccgtttttcaccaccgtaaatgatgtccgacgaggaaagggaggagaaggagctcgatcttacttctcctgaagtagtcaccaaatacaagagcgccgctgagattgccaacaaggcattgcagttggtgatatccgaatgcaaaccaaaggcgaagattgttgacatttgcgagaaaggggattccttcattagggagcaaactggaaatatgtacaagaatgttaagaagaagattgaaagaggcgttgcttttccaacttgcatttctgttaacaacactatatgccatttctctccgctttcaagtgacgagacagtgttggaagagggcgatatggttaagattgatttgggttgtcatattgacgggtttattgctgtagtcgctcacactcatgtgctgcaagaaggtccggttacaggaagagctgctgatgtaattgcagctgctaacactgcagctgaagttgccttgaggcttgtgagacctggaaaaaagaacaaggatgttacagaagcaattcaaaaggttgctgcttcctatgactgcaaaattgtcgaaggtgttcttagccatcagctgaagcagtttgtgattgatgggaacaaggttgtattgagtgttgccaatcctgagacaagggttgatgaggcagaatttgaggagaatgaggtgtattcaatagatatagttacaagcactggagaaggaaagcctaagttgttggatgagaagcagactactatttataagagagctgtagacaggaactatcacttaaagatgaaagcctctagatttattttcagtgaaataactcagaagtaccctataatgcctttcaccgcaagggctttggaagagaaacgggctcggcttggattggtggaatgtgttaaccatgatcttttgcagccatatcctgttcttcatgagaagcctggtgattttgttgctcatatcaaattcaccgttttgctgatgcctaatggatccgaccgagtcacatctcatcctctgcaagatctgcagcctacaaaaacaatagacgatcctgaaatcaaggcatggttatcattgggcataaagacaaagaaaaagggtggtgggaagaagaagaaaggtaagaaaggagataagacagaggatgctgaaccaatggataccacaaccaatggtgctgcatcccaagaatgaacatctacacaaccacatccttaaaaaaaggaaaaaaaaaagaaattagtaattcccttcgcctttttccttcaaatttgggtctgcccccaccgttgatctcatttgtatacgatgagcaggtgagtgtagttgccaaattaaaatggtgaacgttctttattgggtattattaatgaatccaacctctcttttgtatggtcgacatactttgctttttcttcttttctttttttttcctcatttcagactccatggatgcgttgtttgtctctcgagatgtgcaactgaatgagcctaaatttattttctttactaatcttttcacttcctttctgctgctg

SEQ ID NO: 7382 - DNA, 1703 bp, Eucalyptus grandis
cacgcgtccggctcgcgcacccccatccctccctttctcgctctatataagcccagctgatctctccgcctcctctctccactagccccccgccgaaaaccctaatcccctctctcggctccttccttccttccttccttctgcttcgcttctgcggaatctcaatcgggaggcgttgagggggttcccggggccgtcgagctgagcagcgatgtcggacgacgagagagaggagaaggagttggatctcacctcccccgatgtcgtcaccaagtacaagagcgctgctgagatcgtcaacaaggccttgcagttagtcatctcggaatgtaaaccaaaggctaaggtcgtggacgtttgtgaaaaaggcgactcctttatcagagagcaaacagggaacatgtacaagaatgtcaagaaaaagatcgagaggggtgttgcgtttccaacttgtatttctgttaacaacaccgtctgccatttttctcccttggcaagtgacgagacggttttggaagaaggtgatatattgaaaattgatatgggatgccatatagatgggttcattgctgtagtggcacacacacatgtccttcaagaaggaccagtaacgggtagagcagcagatgtaattgctgcagcaaataccgctgcagaagttgctttgaggcttgtgagaccgggaaaaaataacaaagatgtaacagaagcaatcaataaagttgcagctgcatatgactgcaaaattgtcgaaggtgtgcttagccaccaactgaagcagtttgtgatagatggcaacaaggttatcatcagcgtttcaaatccagacacaaaagttgatgagtttgaatttgaggagaacgaagtttatgcaatagatattgtcacaagtacgggcgaggggaagcctaaactgttggatgagaagcagacaactgtatataagagagctgtggacaagaattatcacttaaagatgaaggcctctaggtttattttcagtgaaataaaccagaaatttcccatcctaccattcagtgcaagggcactggaagagaaaagggcccggctgggattagttgaatgtgtaaatcacgagctcttgcagccttatcctgtacttcatgagaagcctggtgattatgctgcccatatcaagttcactgtcttattaatgccaaatgggtcagataggattacatcgcattcgttgcaggagcttcagccgacaaagacgatagatgatcctgagatcaaggcttggttggctctggggaccaaaaccaagaagaaaggtggagggaagaagaagaaagggaagaaaggtactgaatcagcggagaccgagccaatggatgcaacaacaaacggtgccgaatctcaagaatgatccctttttttggttattccttttctccaattttgataccctaaaccatgttagcatgattgtgtatttgtgacttataatagcatgcggtcgagctgtttatggattgtcgaattcaacatgttcatcttgatactcttttcgactgtcatccatctttataaaggaagtgacgacgcctaatgctatctagtcagtcttttctcaaatctcattctgccgttacaagatgatgcggcgaagctgtactgtttcagtagaggttcgaatactttgaatgttgtctacaatgatgataatataactttcccaa

SEQ ID NO: 7383 - DNA, 1719 bp, Citrullus lanatus
ataattggaaatgaaatcttatataaagtaatctaagcgcggcctcaccgattgtaaccctaaatccttctactcggtctcagccactttccttgcttccttcctcttgttctctttcaaccttcacaccgttatcctaatttgcttcacttcttctccccgccgtcttcaatccctccgactgcttgttcttcgccagcgtagatgatgtccgacgaggaaagggaggagaaggagctcgatcttacttctcctgaagtagtcaccaaatacaagagcgccgctgagattgtcaacaaggcattacagttggtgatatcggaatgcaaaccaaaagcaaagattgttgacatttgcgagaaaggggattccttcattagggaacaaactggcaatatgtacaagaatgttaagaagaagattgaaagaggcgttgcttttccaacttgcatttctgttaacaatactgtatgtcacttctcaccgctttccagtgacgagacactgttggaagagggcgatatggttaagattgatttgggttgtcatattgatgggtttattgctgtggtcgctcatactcatgtgcttcaagaaggtcccgttaccggaagagctgctgatgtaattgcagctgctaacactgcagctgaagttgccttgaggcttgtgagacctggaaaaaagaacaaggatgttacagaagcaattcaaaaggttgctgcatcttatgactgcaaaattgtcgaaggtgttcttagccatcagctgaagcagtttgtgattgatgggaataaggttgtattgagtgttgccaatcctgagacaagggttgatgaggcagaatttgaggagaatgaggtgtattcaatagatatagttacaagcacaggagaaggaaagcctaagttgttggatgagaagcagacaactatttataagagagctgtggacaggaactatcatttaaagatgaaagcctctagatttattttcagtgaaataactcagaagtttcctataatgcctttcacagcaagggctttggaagagaaaagggctcggcttggattggtggaatgtgttaaccatgatcttttgcagccataccctgttcttcatgagaagcctggtgattacgttgctcatatcaaattcactgttttgctgatgcctaatgggtctgaccgagtcacatctcatcctctgcaagatcttcagcctacaaaaacaatagatgaccctgaaatcaaggcatggttagcattgggcacgaagacaaagaaaaagggtggtggaaagaagaagaaaggtaagaaaggagataagactgaggaccctacggatgctgagccaatggataccacagccaatggtgctgcatctcaagaatgaacatccccacaaccacacccttaaaaaaaggaaaaaagaaaaatagaaattctcctcgccttttcctttcttcaaatttggctctgccccaccgttgaatctcatttgtatacgatgagcaaggtgagtgtggttggcagatcagattaaagtggtgaacgttctttattgggtattattaatgaatccaacttctcttttgtatggtcgacatacttgccttttcatttcggactccatggacgcgttgattgtcactcgagatgtgcgactgaattagcctaaatttattttcattactaatcttttcattcctttctgctg

SEQ ID NO: 7384 - DNA, 1541 bp, Glycine max
ccctagttcattgcactgcaacttagccacttgaacccccttcgtaagcctcttcacatcttcacttcttcttccgcactaatacgaaaccagagggaattcacaaaagaggttaccatgtcggacgatgagagagaggagaaggagttggatctcacttctccggaagttgtcaccaagtacaagagcgccgcggagattgttaacagggctttgcagttagttatttcagaatgtaaaccgaaggcaaagattgttgacctttgcgagaaaggggattcgtatattagagagcaaactggtagcatgtacaagaatgtgaagaggaagatagagagaggtgttgccttccctacatgtgtgtctgtgaacaacactgtctgtcacttctctcctcttgccagtgatgaaacagtgttggaagatggtgatatagtgaaaattgacatggcttgccatatagatgggttcattgctgctgtggcacacactcatgttcttcaggaggggccagttacaggacgggcagccgatgctcttgcagcagcaaacaccgctgccgaagtggccttgcggcttgtaaggcctggaaggaagaacaaggatgtaactgaagcaattcagaagattgccgcagcgtatgattgtaaaattgttgagggtgttcttagccaccaaatgaaacagtttgtgattgatgggaataaggttgtggtaagtgtatccaatccagatacaagggttgatgatgcagagtttgaggagaatgaagtttatgcaattgatatcgtagcaagtactggagatggcaagcctaagcttttggatgaaaagcagacaactatttataagagagctgttgacaagagctatcacttgaagatgaaagcatctaggttcattttcagtgaaataagccaaaagtttcccatcatgcccttctctgcaagggctttggaagagaaaagagctcgtttgggtttagtggaatgtgtgaatcatgagctcctgcaaccttatcctgttctgcatgaaaagcctggtgattatgttgcacatatcaaattcactgtcttgctaatgcccaatggatcagatcgtgttacgtctcactcactccaggagttgcagcccaccaaaacaatagatgatcccgaaatcaaggcgtggctagcattgggcacaaagacaaagaagaaaggcggtggaaagaagaagaaaggtaagaagggggcagaagctgaaccaatggatgcaacaaatgatgctacaccccaagaacaagattgagagacaaaaaccctttgattttgcttttgatccctttcaattttggtacatttttcaccaagttgtatctgcttgattgtgaatttagtacagctttcggacatccaatgttaataggaatttgatttccttggctattgtacttgacctgaatgctgtactcctgattaagcataaatatgcttaattgttggaggggttttaatttataaacaaaagatatcaaatttaaaacccaattacatggttgg

SEQ ID NO: 7385 - DNA, 1313 bp, Ricinus communis
aaccctagcttcttactttatattctcaccttccgcttcgccgtcaattttgtttatttataatttatcactgaggaagttctttaaagcttatcaaaacgatgtcggacgacgaaagagaggagaaggagttggatctcacttctcctgaagttgttaccaagtacaaaagcgctgctgagatcgttaataaggcattgcagttagtaatttcagaatgcaaaccaaaggctaagattgttgacctttgtgagaaaggagatgcatttatcagagagcaaactggtaatatgtacaagaatgtgaagaagaagattgaaagaggagttgcatttcctacttgtgtttctgtaaacaatactgtctgccattgttctccacttgctagtgatgagactctgttggaagaaggtgatgttgtcaagattgatatgggatgtcatatagatggtttcattgctgtggttggacatactcatgttcttcaggcaggaccagttactggcagggcagctgatgttattgcggctgcaaatactgctgctgaagttgccttaaggcttgtaaggccaggaaagaagaacaaggatgtgacagaagcgattcagaaagttgctgctgcttatgactgcaaaattgttgaaggtgtcctcagtcaccagctgaagcagtttgttatagatgggaacaaggttatactgagcgtctctaatcctgaaacaagagtcgatgatgctgaatttgaggagaatgaagtgtatgccatagatatagttactaccacaggtgaaggcaagcctaagctgctggatgaaaagcatacgaccatttacaagagagctgtggacaagaattatcacttgaagatgaaagcttctagatttatcttcagtgaaattagtcaaaagttccccatcatgccattcactgccagggcattggaagagaaaagagctagacttggattagtggaatgtgtgaatcatgatcttctacagccatatcctgtgcttcacgagaagcctggtgatattgttgctcatatcaagttcacggtcttgctaatgccaaacgggtcagataggatcacatctcactctctgcaggagctgcaacccaccaagacaatagatgatccagaaatcaaggcctggttggctttgggtacaaagacaaagaagaaaggcggtggaaagaagaagaaagctaagaagggtgacaaagctgaggagtcgacagaagcagaacctatggatgcaacaaatggggccgaaacccaagaatgaggctttaataaataattattttattct

SEQ ID NO: 7386 - DNA, 1627 bp, Euonymus alatus
ttacggccgggcccgggaagattcctataaaatgcaaacgctgccgtctggtccgcaacgccaaccctagcttctatcgtggcacctcataatctgctctctttcccacctctgcttatccctgttaaaccctagccttcgccgaacagacactgaaacatttaccgccgtcaatacttcctgagtcgcgatattcagacacacggaaacgatgtcgtcggacgatgaaagagaggagaaggagctcgatctcacttctcccgaggtcgtcaccaagtataagagcgcagccgagattgttaacaaggcgttacagttagtgatatcagaatgcaagccaaaagcgaaggttgtggacgtctgtgagaagggtgattcatatatcagagagcaatcaggaaacatgtacaagaatgttaagaagaagattgaacgcggcgttgcttttcctacttgcgtttctgtaaacaacactgtttgccatgtctcaccactcgccagtgatgagacagttttggaagaaggtgatttggtgaaaatagatatggggtgtcacattgatgggttcattgctgtagttgcacatacccatgttcttcgagaagggccagttacagggaaggctgcagatgttattgcagcttcaaatactgctgctgaagttgccttgaggcttgttaggccagggaagaagaacaaagatgtaacagatgcaattcagaaggttgctgctgcttatgactgcaaaattgttgaaggtgttcttagccaccagttgaagcagtttgtgatagatgggaacaaggtcgtacttagtgtttctagtccagatactagggttgatgaagcagaatttgaggagaatgaagtgtatgctgtagatatagttacaagcacaggagaaggcaagccaaagctgttggatgagaagcagactactatttataagagggcagttgacaagaactatcacttgaagatgaaagcttccagatttatttttagtgaaattagtcagaaatttccaatcatgccattctctgcaagagctttggaagagaaaagggctcgtttgggattagtggaatgtgtgaatcatgatctcctgcagccatatcctgttcttcatgagaagccgggtgacctagttgcgcacatcaaattcacagttttgctaatgccaaacggatcagataggatcacatctcattctctgcaagagctgcagcccacaaagaccatcgatgatcctgaaattaaggcctggttagccttgggcacaaagacaaagaagaaaggaggcggaaagaagaagaaaggtaagaagggcgacaagcctggggagtcggtggaagctgagcctatggatgcaaccacaaatggtgcatcgcaagaatgagccggtcctacatttgtcactaccttttatttagtgttgttactttgttgtcattgtaacttcttggtaatgagttgatccttaaaaaacagtgtttattgacgcacctaaatgagtatcctttactactgatgaagccattagtctaattcgtgatgaaccgaattagatttgcagattttgacttcgactttatatcagagaatgatcgaaagagaggaaaagttc

SEQ ID NO: 7387 - DNA, 2574 bp, Prunus mume
tcacctccacaacgaatgagaaaggagaagacgagaacagaagagagagacgaatttctcttcttcctcttcttcttctcaacaaaaccctgttttcatttcccacagagagattcagtgtcacaaaaccatgaaagaaaaccaaaatgaaagccccaattcgacggcgagtccaaccaagaggcccatcccgccgtacgtcaaggccttgtccggttcgctcgggggaatcgtggaggctacgtgtctgcagcccatcgacgtcatcaagacccggctccagctggaccggaccggcgcctacaagggaattatccactgcggcgccacggtttcgcgcaccgaaggtgttcgcgctctctggaagggcttgaccccctttgccactcacctgaccttgaagtatgcgcttcggatgggctccaatgcggtgcttcagggcgcgttcaaggacgctgagactgggaaggtcagcaatcacgggcggctcatttctgggtttggagctggagttcttgaagctcttgttatcgttacgccttttgaggtggtgaaaattagactgcagcaacagaagggattgagtcatgatcttctaaagtataagggtcctattcactgtgctcgtatgatcatccgggaggaaggtatccttgggctctggtcaggggctgctccaactgttatgcgcaatgggacgaatcaggctgccatgtttacagccaaaaatgcctttgacgttctcttgtggaagaaacatgaaggagatgggagggtcctgctgccatggcagtctatgatatcgggtttcctagcaggcacagcaggtcccgtttgcacgggtccctttgatgttgtgaaaacaagactgatggctcagagccgaggtgtggatggccagatgaaatacaaaggcatgatccatgctatcaggacaatatatgcagaggaagggcttcttgccttgtggaaaggactgctgcctcggctcatgcggataccacctgggcaggccattatgtggacggtggctgaccaagtaataggattgtatgagagacgatatcttccgagtgcacctttgttttagaagtcggagaatttacaaggtcccgaaacgatgtcggacgatgagagggaggagaaggagttggatctcagctctcctgaagtagtcaccaaatacaagagtgccgctgagattgttaacaaggctctgcagttggtaatatccgaatgcaaaccgaaagctaagattgtggacctttgtgagaaaggtgattcatacatcagagagcaaactggtaatatgtacaaaaatgtgaagaagaagattgaacgaggtgttgcctttccaacttgcatttctgtgaacaacactgtatgccatttctccccgcttgccagtgacgagacagtgttggaagaaggagatattctgaagattgatttgggttgtcatattgacgggttcattgccatagttgcacatactcatgctcttcaagcagggcctgttacaggaaaggcagctgacgttattgcagctgctaatactgctgctgaagttgccttaaggcttgtaaggccaggaaaaaagaataaagatgtaacagaggcgatccaaaaggttgctgcagcttatgactgcaaaattgttgaaggtgttctgagccatcagttgaagcagtttgtgatcgatgggaataaggtcatattaagcgcatccaatccagatacaagagttgatgaggcagaatttgaggagaacgaagtttattcaattgatattgtcacaagcacaggtgaaggaaagcctaagctgttggatgagaagcagacgactgtctataagagagctgttgacaagaactatcacctgaagatgaaagcttctaggtttattttcagtgaaataagggagaagtttcccatcatgccattcactgctagagctttggaagagaaaagggctaggctgggtttacttgaatgcgtcaaccacgagcttctgcagccatatcctgttcttcacgagaaacctggtgatttggttgcccatatcaagttcactgtcttgctgatgccaaatggatcagatcggattacatctcatcctttacaggagctgcagcccactaaacaaatagatgatcctgaaatcaaagcctggttggctttggggacaaagaccaagaagaaaggtggcggcaaaaagaaaaagggtaagaagagtgacaaagctgaggagtctacagaagccgaaccaatggatgcgacaacaaatggtgctgagtctcaagcatgagcccttgtttcttgttagcgatcagatttcaattttggttattttctctccccacattgtatctggttggatattaatttaatatagtgttcagactttgattccagctgggttttctctacttttcaaattccagttcttgctgtttacttgtgtatctcatcgaattttgttgtcgattaacattatattttaatttatataaaaacctaacatagacaattgagttgaggctgtcaatatatcaaccaaaatttcgaaccgaa

SEQ ID NO: 7388 - DNA, 2531 bp, Prunus persica
tcacctccacaacgaatgagacaggagaagtcgagaacagaagagagacgaatttctcttcttcctcttcttcttctcaacaaaaccctgttttcatttcccacagagagattcagtgtcacaaaaccatgaaagaaaaccaaaatgaaagctccaatccgacggccagtccaaccaagagacccatcccgccgtacgtcaaggccttgtccggttcgctcggggggatcgtggaggccacgtgtctgcagcccatcgacgtcatcaagacccggctccagctggaccggaccggctcctacaagggaattatccactgcggcgccacggtttcgcgcaccgaaggtgttcgcgctctctggaagggcttgaccccctttgccactcacctgaccttgaagtatgcgcttcggatgggctccaatgcggtgcttcagggcgcgttcaaggacgctgagactgggaaggtcagcaatcacgggcggctcatttctgggtttggagctggagttcttgaagctcttgttatcgttacgccttttgaggtggtgaaaattagattgcagcaacagaagggattgagtcatgatcttctaaagtataagggtcctattcactgtgctcgtatgatcatccgggaggaaggtatccttgggctctggtcaggggctgctccaactgttatgcgcaatgggacgaatcaggctgccatgtttacagccaaaaatgcctttgacgttctcttgtggaagaaacatgaaggagacgggagggtcctgctgccatggcagtctatgatatcgggtttccttgcaggcacagcaggtcccgtttgcacgggtccctttgatgttgtgaaaacaagactgatggctcagagccgaggtgtggatggccagatgaaatacaaaggcatgatccatgcaatcaggacaatatatgcagaggaagggcttcttgccttgtggaaaggactgctgcctcggctcatgaggataccacctgggcaggccattgtgtggacggtggctgaccaagtaataggattgtatgagagacgatatcttccgagtgcagctttgttttagaagtcggagaatttacaaggtcccgaaacgatgtcggacgatgagagggaggagaaggagttggatctcagctctcctgaagtagtcaccaaatacaagagtgccgctgagattgttaacaaggctctgcagttggtaatatccgaatgcaaaccgaaagctaagattgtggacctttgtgagaaaggtgattcatacatcagagagcaaactggtaatatgtacaaaaatgtgaagaagaagattgaacgaggtgttgcctttccaacttgcatttctgtgaacaacactgtatgccatttctccccgcttgccagtgacgagacagtgttggaagaaggagatattctgaagattgatttgggttgtcatattgacgggttcattgccatagttgcacatactcatgctcttcaagcagggcctgttacaggaaaggcagctgacgttattgcagctgctaatactgctgctgaagttgccttaaggcttgtaaggccaggaaaaaagaataaagatgtaacagaggcgatccaaaaggttgctgcagcttatgactgcaaaatcgttgaaggtgttcttagccatcagttgaagcagtttgtgatagatgggaacaaggtcatattaagcgcatccaatccagatacaagagttgatgaggcagaatttgaggagaacgaagtttattcaattgatattgtcacaagcacaggtgaaggaaagcctaagctgttggatgagaagcagacgactgtctataagagagctgttgataagaactatcacttgaagatgaaagcttctaggtttattttcagtgaaataagggagaagtttcccatcatgccattcactgctagagctttggaagagaaaagggctaggctgggtttacttgaatgcgtcaaccacgagcttctgcagccatatcctgttcttcacgagaaacctggtgatttggttgcccatatcaagttcactgtcttgctgatgccaaatggatcagatcggattacatctcatcctttacaggagctgcagcccactaaacaaatagatgatcctgaaatcaaagcctggttggctttggggacaaagaccaagaagaagggtggcggcaaaaagaaaaagggtaagaagagtgacaaggctgaggagtctacagaagccgaaccaatggatgcgacaacaaatggtgctgagtctcaagcatgagcccttgtttcttgttagcgatcagatttcaattttggttcttttctctccccccattgtatctggttggatattaatttaatatagtgttcagactttgattccagctgggttttctctacttttcaagttccagttcttgctgtttaattgtgtatctcatcgaattttgttgtcgattaacattatattttaatttatataaaaacctaacatagacaattg

SEQ ID NO: 7389 - DNA, 3483 bp, Glycine max
cacaaatcctatataagccaccgcttaaccttgaccctgtatgcgactaaccctagttcattgcactgcaacttagccacttgaacccccttcgtaagcctcttcacatcttcacttcttcttccgcactaatacgaaaccagagggaattcacaaaagaggttaccatgtcggacgatgagagagaggagaaggagttggatctcacttctccggaagttgtcaccaagtacaagagcgccgcggagattgttaacagggctttgcagttagttatttcagaatgtaaaccgaaggcaaagattgttgacctttgcgagaaaggggattcgtatattagagagcaaactggtagcatgtacaagaatgtgaagaggaagatagagagaggtgttgccttccctacatgtgtgtctgtgaacaacactgtctgtcacttctctcctcttgccagtgatgaaacagtgttggaagatggtgatatagtgaaaattgacatggcttgccatatagatgggttcattgctgctgtggcacacactcatgttcttcaggaggggccagttacaggacgggcagccgatgctcttgcagcagcaaacaccgctgccgaagtggccttgcggcttgtaaggcctggaaggaagaacaaggatgtaactgaagcaattcagaagattgccgcagcgtatgattgtaaaattgttgagggtgttcttagccaccaaatgaaacagtttgtgattgatgggaataaggttgtggtaagtgtatccaatccagatacaagggttgatgatgcagagtttgaggagaatgaagtttatgcaattgatatcgtagcaagtactggagatggcaagcctaagcttttggatgaaaagcagacaactatttataagagagctgttgacaagagctatcacttgaagatgaaagcatctaggttcattttcagtgaaataagccaaaagtttcccatcatgcccttctctgcaagggctttggaagagaaaagagctcgtttgggtttagtggaatgtgtgaatcatgagctcctgcaaccttatcctgttctgcatgaaaagcctggtgattatgttgcacatatcaaattcactgtcttgctaatgcccaatggatcagatcgtgttacgtctcactcactccaggagttgcagcccaccaaaacaatagatgatcccgaaatcaaggcgtggctagcattgggcacaaagacaaagaagaaaggcggtggaaagaagaagaaaggtaagaagggggcagaagctgaaccaatggatgcaacaaatgatgctacaccccaagaacaagattgagagacaaaaaccctttgattttgcttttgatccctttcaattttggtacatttttcaccaagttgtatctgcttgattgtgaatttagtacagctttcggacatccaatgttaataggaatttgatttccttggctattgtacttgacctgaatgctgtactcctgattaagcataaatatgcttaattgttggaggggttttaatttataaacaaaagatatcaaatttaaaacccaattacatggttggaaatgtatgttgtgaggttttgaaatggttaaccttgttggtttgggaacacaattgtttggtatgcacgtagctgctagattgttgtgggaagaatgagtttttacgtgagatgagcaaaaatctttaataaaattatcatcttgaagatgaactattttgggaaactagtattttaacctgtattttaattttttgatttaaaatttataatttaaattgtactatagattattactttgataatttgttatgttgtttttcaatgcaaattaaatagtttttgtattttttgattggtaggaactcaagacacttccagtggtttatatattctatttacattctcattctcatctaattataaatttttgctatatagataaaactttctataaaaattctcagatatttttaatgtgtttggaatggtgttgaaacccacccattacttgattttcaagtccaattcttatttgatgcaaaaactaatacacgttgcttcccaaaaattcacatatttgatccaaaattttatgtgttgcagtaaaaaaaaaaacaaaatattgttagtgttattcttcaataaaaaataagttacctattttacaaaaaaaaatgatttttttacaatgaagataaagcttagatacaattcttgggttctgttagtgctatttttcaaacaaaaaataattataccattaacaagtgtctatagagtttgaactcaatgcttatcaaaataaataaagttctaattgtgaatttgtcatcatcactcaattttaattttgaaaaaaaaaaagaagaggaaaagcagaagataaactacacagcagataatagggttgctaatgcactcaacatttaacatgaaaagacaaaaatacccctatgtgtttttaaaaatatttttgtgcacccagctcattcaggttgatccgcataggttttagttgatccgcagttgatataaatgatccgcaagcttcttatggatcaagttggtccgcaagttaattttttagttaattttttagacttacgggtcaagttgatccgtaagtcttttacggatcaacttgatccgtaagcttcttacggatcaagttgatccgcaagttgatttttaaaacttacggattaagttgatctgtaagtcttttactgatcaacttgatccgtaagtcttttacggatcaacttgatccgcaagcttcttacgaatcaagttgatccgtaaagagagaaagaaaacaggtgtaattttgccatttttaaagaaggctgggtgcacctaacaacactccacataataatgcagcaaccagcaatacaacagtgcactctcactcactataagtcatgcactcactgcactcctcgctgcctcattgcgtatcaaccagcagcatcaatggccaccacggagccaccacaatgacgacgatgaccatgtgccagcggaggacgaggacacgggagcgcaggtcgctccgatcgtgaagctcgaagaggtcgccgtctccactggtgaagaggaagaggatcccatccttgatctgaaagcgaagctgtatcggttcgaaaaggaagggaatcagtggaaggagcgtggtggtggaaacgttaagctgctgaaacataaggtcaccgggaaggtgaggctcgtcatgcgccaatccaagacgctcaagatctgcgccaatcatcttggagcattctgggaatgagaaatcgtgtgtgtggcatgcttctgattttgcagatggagaattgaaggatgagctgttctgtattaggtttccctctgttgagagccttcatgacaactatgcaagaagtggctgaatcacaaggagaggaggaggaaaacaaagatgcttcag

SEQ ID NO: 7390 - DNA, 1901 bp, Glycine max
taaaatttactcagattaacgacaattaaattacatacgagtgagagaagaatgatctcttaccttaaaaaaaactccaaaagagagagaaacgttattattaggaactaaagcaaaaaccctaacgctagtgcaaccaaagcacaaatcctatataagccaccgcttaaccttgaccctgtatgcgactaaccctagttcattgcactgcaacttagccacttgaacccccttcgtaagcctcttcacatcttcacttcttcttccgcactaatacgaaaccagagggaattcacaaaagaggttaccatgtcggacgatgagagagaggagaaggagttggatctcacttctccggaagttgtcaccaagtacaagagcgccgcggagattgttaacagggctttgcagttagttatttcagaatgtaaaccgaaggcaaagattgttgacctttgcgagaaaggggattcgtatattagagagcaaactggtagcatgtacaagaatgtgaagaggaagatagagagaggtgttgccttccctacatgtgtgtctgtgaacaacactgtctgtcacttctctcctcttgccagtgatgaaacagtgttggaagatggtgatatagtgaaaattgacatggcttgccatatagatgggttcattgctgctgtggcacacactcatgttcttcaggaggggccagttacaggacgggcagccgatgctcttgcagcagcaaacaccgctgccgaagtggccttgcggcttgtaaggcctggaaggaagaacaaggatgtaactgaagcaattcagaagattgccgcagcgtatgattgtaaaattgttgagggtgttcttagccaccaaatgaaacagtttgtgattgatgggaataaggttgtggtaagtgtatccaatccagatacaagggttgatgatgcagagtttgaggagaatgaagtttatgcaattgatatcgtagcaagtactggagatggcaagcctaagcttttggatgaaaagcagacaactatttataagagagctgttgacaagagctatcacttgaagatgaaagcatctaggttcattttcagtgaaataagccaaaagtttcccatcatgcccttctctgcaagggctttggaagagaaaagagctcgtttgggtttagtggaatgtgtgaatcatgagctcctgcaaccttatcctgttctgcatgaaaagcctggtgattatgttgcacatatcaaattcactgtcttgctaatgcccaatggatcagatcgtgttacgtctcactcactccaggagttgcagcccaccaaaacaatagatgatcccgaaatcaaggcgtggctagcattgggcacaaagacaaagaagaaaggcggtggaaagaagaagaaaggtaagaagggggcagaagctgaaccaatggatgcaacaaatgatgctacaccccaagaacaagattgagagacaaaaaccctttgattttgcttttgatccctttcaattttggtacatttttcaccaagttgtatctgcttgattgtgaatttagtacagctttcggacatccaatgttaataggaatttgatttccttggctattgtacttgacctgaatgctgtactcctgattaagcataaatatgcttaattgttggaggggttttaatttataaacaaaagatatcaaatttaaaacccaattacatggttggaaatgtatgttctgtgaggttttgaaatggttaaccttgttggtttgggaacacaattgtttggtatgcacgtagctgctagattgttgtgggaagaatgagtttttacgtgagatgagcaaaaatctttaataaaattatcatcttgaagatgaactattttgggaa

SEQ ID NO: 7391 - DNA, 1522 bp, Tripterygium wilfordii
tctatcgcgccacttcatattttgctgtctttcctaccacctcttcttatccctgttaaaccctagccttcgccgaacagacgctcgaacacattcaccgccgtcaacacttcctgagtcacgatattcagacaaaccgaaacgatgtcgtcggacgatgaaagggaggagaaggagttagatctcacttctcctgaggtcgtcaccaagtataagagcgcagcagagatcgttaacaaggctttacagttagtgatatcagaatgcaagccaaaagcaaaggttgttgacgtctgtgagaagggtgattcatatatcagagagcaatcaggcaacatgtacaagaatgttaagaggaagattgaaaggggcgttgcatttcctacttgcgtgtctgtaaacaacactgtttgccatttctcaccacttgccagtgacgagacagtttttgaagaaggtgatttggtgaaaatagatatggggtgtcacattgatgggttcattgctgtagttgcacatacccatgttcttcaaggagggccagttacagggaaagctgcagatgttattgcagctgcaaataccgctgctgaagttgccttgaggcttgttaggccagggaagaagaacaaagatgtaacagatgcaattcagaaggttgctgctgcttatgactgcaaaattgttgagggtgttcttagtcaccagttgaagcagtttgtgatagatgggaacaaagtcgtacttagtgtttctaatccagataccagggtcgatgaagcagaatttgaggagaatgaagtgtatgctgtagatatagttacaagcacaggtgaaggcaagccaaagctgttggatgagaagcagactactatttataagagggcagttgacaagaactatcacttgaagatgaaagcttccagatttatttttagtgaaattagtcagaaatttccaatcatgccattctctgcaagggctttggaagagaaaagggctcgtttgggattagtggaatgtgtgaatcatgatctcctgcagccatatcctgttcttcatgagaagcctggtgatatggttgcgcacataaaattcacagttttgctaatgccaaacggatcagataggatcacatcccattctctgcaagaactgcaacccacaaagatcgtagatgatcctgaaataaaggcctggttagcattgggcacaaagacaaagaagaaaggaggcggaaagaagaagaaaggtaagaagggcgacaagcctggggagtcggcggaagctgagcctatggatgcaacaacaattagtgcatcacaagaatgaacctgttttaaatttgtcaccaccttttattcagttttgttacgttgttctcattgtaactgtttggtaatgagttgatccttaaaaaggtatagtgtttattgacgatcctaaatgattctcctttcctactgatgaagccattaaaatttcagaacttaattactgacaattgaggatgtaaaaattc

SEQ ID NO: 7392 - DNA, 1506 bp, Arachis hypogaea
tcacacacacgcacattctcaagccacctcactacacactttctttctattcgaaccttcccctcttaaaaccctcttccatttcttcaccgattcatcagtcaaaaacccttttcggtggtaactgaagctgctcaaaggggtttaatcaggtgaagctataaccatgtcggaggatgagagggaagagaaggagttggatcttacaactcctgaagtggtcactaagtataagagtgcagctgagattgttaacaaggctttgcagttagttgtttcagaatgtaaaccaaagtctaagattgtagacatttgtgaaaaaggggatagctacattagagagcaaaccggtaacatgtacaagaatgtgaagaggaagattgagaggggagttgctttcccaacttgcatttctgttaacaacactgtgtgtcatttttctccactagccactgatgaaactgtgttggaagaaggtgatattttgaaaattgatatggcttgccatattgatggatttattgctgccgtggcgcacactcatgttctgcagcaaggaccggttactggacgggtggctgatgtaattgcagctgcaaacactgctgctgaagtggccttgagacttgtaaggccgggaaggaagaacaaggatgtaactgatgcaattcaaaaggttgctgctgcctatgattgcaaaatcgttgagggtgttcttagtcaccaaatgaagcaattcgtgattgacggaaacaaggttgtgttgagtgtatctaatccggatactagggttgatgatgctgagttcgaggaaaatgaagtttatgctattgatatagttgcaagcaccggagaaggcaagcctaagcttttggatgagaagcagacaactatctataagagggctgttgacaagagctatcacttgaagatgaaagcatcgaggttcattttcagcgaaattagccaaaattttccaatcatgccattttctgctagggctttggaagagaagagagctcggttaggtttagttgaatgtgtgaatcatgaactcttgcagccttatcctgttcttcatgaaaagcctggtgattatgttgcgcacatcaaattcacggtgttgttgatgccaaacggatcagaccgcatcacatctcatgcgctccaagaattgcagccgaccaaaacgattgacgatcctgaaattaaggcctggctagcattggccacaaagacaaagaagaagggtggtggaaagaagaagaaaggtaagaagggtgctgaagctgagcccatggaagaggaggcaacaaatggtgccacaccccaagaatgagatctgctcctcaaaaaaaggaagaaaaagaaatattgttttgatttctcatttgatatctttaaaaattttctaccgtgttgtatgacatgtgcttgaatgagaatttagtgttcgatgttcaggataaagtttagttggaatttcctctgctcgtttcattagca

SEQ ID NO: 7393 - DNA, 1654 bp, Quercus alba
ctagctaaagcttttgagtcatagccacatccacctgttaccttgtctctctctcttcatctctatctctatctctctctcccttaaaccctagctctcaaagctcgctaccgcttcacttcctcgccgccattttcttcgattgcagaaggagttttttcttaaagctccaaaacgatgtcgtcggacgaagaaagagaggagaaggagttggatctcacttcccctgaagtcgtcaccaaatacaaaagcgctgccgagatcattaacaaggctttgcagttagttgtatctgaatgcaaaccaaaggctaagattgtagatgtttgcgagattggtgactctttcattagagagcaaactggcaatatgtacaagaatgttaagaagaagattgaaaggggtgttgcgttcccaacttgcatttctgtaaacaacactgtgtgtcatttctctccactcgcgagcgatgagaccgtgatggaagccggtgatgtcttgaaaattgatatgggttgccatatagatgggtttatcgcggttgtggcacatactcatgttcttcaggatgggccggttactggaaaggcagctgatgtaattgccgcagctaatacagctgcggaagttgctttgaggcttgtaaggccaggaaagaagaacaaagatgtaactgatgcaattcagaaggttgcagctgcttatgactgcaaaattgttgagggtgttcttagccaccagctgaagcagtttgtgatagatggtaacaaggttgtgctgagtgtgtctaatacagatacaagagttgatgatgcggagtttgaggagaatgaagtttatgctattgatattgtaacaagctcaggtgaaggcaagcctaagttgttggatgagaagcagacaactatttacaagagagctgttgacaagaactaccacctgaagatgaaagcatctaggtttattttcagtgaaataagccagaaattccctatcatgccattcactgctagggctctggaggagaagagggctcgtcttggtttagtggaatgtgttaatcatgagctattgcagccatatcctgttcttcatgagaagcctggtgattatgttgctcacatcaaattcacagttttactaatgccaaatgggtcagatcgggtcacatctcatcctctgaaggagctgcagcccacaaagacaatagatgatcctgaaatcaaggcttggttagccttgggcacaaagacaaagaagaaagggggtggaaagaagaagaaaggtaaaaagggtgacaaaactgaagagtccacagaagctgatcctatggatgaaacaactacaaatggtgctgcatcccaggaatgagttttcttacatttcatttttttccaacccccgccttgtcaattttggtacttcatccattgtatcaggttgaatatgagctggtttactagtctttggacattaatcttaatcatgttttcttgcaaatataccattttatgtatcttctagataatcctaatttcttagacacactctagaatcaaagagtttagcagcagattcaatcgacgttgtggtatattgtgtgacatttctaaggttactggaagtgataagacccaaaattaatatacaataa

SEQ ID NO: 7394 - DNA, 1622 bp, Manihot esculenta
ctcatcctcttttgtcctcttctttcctttactttctctctcttatctgtgctaaaccctagctattccctttactcgccgtcagattttctgtgggttctgcttccctttcttatcgaattgtttcgatttcggtattgctttaggctttaagccttcttcttgttttttaattgactcgaagtcgtattcctggttattaggagtcttgaaagttatcaaatctgctaaaccatgtcggacgatgaaagagaggagaaggagttggatctcacttctcctgaagttgtcaccaaatacaagagcgctgctgaaatcgtcaataagtcgttgcagttggtagtatcagaatgcaaagcaaaggctaaggttgttgacgtttgtgagaagggagatgcatatatcagagagcaaacaggtaacatgtacaagaatgtgaagaagaaaattgaaagaggagttgcgtttcctacttgcatatccgtaaacaacactgtttgccatttttctccacttgctagtgatgagacagtgttggaagaaggcgatatagtgaagattgacatgggatgtcatatagatgggtttattgccgtagtggcgcatacccatgttattcaagctggaccagttactggcagggcggctgatgttattgcagcagcaaatactgctgctgaagttgccttgaggcttgtaaggccaggaaagaagaacaaagatgtgacagaagcaattcagaaggtagctgctgcttatgactgcaaaattgttgaaggtgttcttagccaccaactgaagcagtttgtgatagatgggaacaaggttatcttgagtgtgtctaattcagatacacgagttgatgatgcagaatttgaagagaatgaagtgtatgcaatagatatagttacaagcacaggagaaggcaagcctaagctgctagatgagaagcatactaccatttacaagagagctgtggataagaattatcacttgaagatgaaagcttccagatttattttcagtgaaattaatcaaaaatttcctatcctgcctttcactgccagagccttagaagagaaaagagctagactgggattagtggaatgtgtgaatcatgatcttctacagccatatcctgttcttcatgagaagcctggtgatctagttgctcatatcaaattcacagttttgctcatgccaaatgggtcagacaggatcacatctcatcctcttcaagagttgcagccaaccaagccaatcgatgatcctgaaatcaaggcctggctagctctgggtacaaaaacaaagaagaaaggtggcggaaaaaagaagaaagctaagaagggtgacaaagcagaggagtcgacagaagctgagccaatggatgcaacaagtgggaatgatggccaagaatgagccttgatattttctgcccaatatatgaatatttttttcattttccaattttggtaatttgttcaccccgtatctggttgcctatgagatgaatttaatagtgtcttggacgtcgatcctaattggatttctctgcatgttgaatctcataaaacccttgttctgtttgacatgttaaaatgttcaaagaacgtgcacaaaca

SEQ ID NO: 7395 - DNA, 1629 bp, Citrus clementina
tttcctatataagccaacgctgccgtaagaaccaaaccctagctgtgtccctatcgagccacctcttcagtcttcaccctctttctctctatctcgtattctattttttatctttgcagtaccctagcttcaccgccgtcaccgtcagtttatcacaattgtttggtagattttttctacaaaaatcaaaacgatgtcggacgatgaaagggaggagaaggagttggatctcacttctcctgaagttgtcaccaaatacaaaagcgctgctgagatcgccaataaggcgttgcagttggtagtatcagaatgcaaacccggtgttaagattgttgacctttgtgagaagggagattcatttattagagaacaaaccggcaacatgtacaagaatgtaaagaagaagatcgagaggggcgttgcattcccaagttgtgtttctgttaacaacacactctgtcatttttcaccacttgcaagtgatgagacagtcttgcaagaaggagacatgatcaagattgatttgggatgtcacatagatgggtttattgctgtagttgcacacactcatgtcctccaggatgagcctgtaacaggcagggcagctgatgttattgctgcagcaaatactgctgctgaggttgccttgaggcttgtaaggccaggaaagaagaacaaagatgtaacagaagccattcagaaggtagctgctgcatatgattgcaagattgttgaaggtgttctcagccaccagctgaagcagtttgtgattgacggaaacaaagttgtactgagtgtctccaatccagataccagagttgatgatgcagaatttgaggagaacgaagtttatgctgtagatatagttacaagcacaggtgatggaaagccaaagctgttggatgagaagcagacgactatttacaagagagccgtggacaaaaactatcacttaaaaatgaaagcttctagatttatctttagtgaaattaatcagaaatttccaatcatgcctttcactgcaagggctttggaagaaaaaagggctaggctaggattagtggaatgtgtgaatcatgagcttctgcagccatatcctgttcttcacgagaagcctggtgattatgttgctcatatcaaattcacagttttactgatgccgaatgggtcagatcggatcacatctcatactctgcaggagattcagtccaccaagacaatcgatgatcctgaaattaaggcctggttagccttgggcatcaagactaagaagaaaggtggtggaaagaagaagaaaggtaagaagggcgacaaagctgaggaatcaacggaagccgagcccatggatgcaacaaatggagctgcaactcaagaatgagtgtttacttatttattttcctttctttcccccaattttgatgctttgttcacttgtatctggttggttacagtttactatagtgtttagacaatgattctaactgtgttatccaccaaatcatatctgcatccttcctcctctgaactgtatcttttctgttttagtagccgttactgactatttattgaaacatagatcaataaacccaagcagcatgacatgatagatataattttggcgctgcattc

SEQ ID NO: 7396 - DNA, 1462 bp, Cucurbita pepo
ctaaaatccttctccactttccttgcttactcccttctgtcctctatcaaccttcacacttttatcctaatttctcattctttcctcagccgttttcaatccgtcggactgttttttcttcgccggcgtagatgatgtccgacgaggaaagggaggagaaggagctcgatcttacttctcctgaagtagtcaccaaatacaaaagcgccgctgagattgccaacaaggcattgcagttggtgatatccgaatgcaaaccaaaagcaaagattgttgacgtttgcgagaaaggggattcattcattagagagcaaactggcaatgtgtacaaaaatgccaagaagaagattgaaagaggtgttgcttttccaacttgcatttctgttaacaacactgtatgtcacttctcacccctttcatccgacgcgacagtgttggaagagggcgatatagttaagattgacttaggttgtcatattgacgggtttattgctgtggtcgctcatactcatgtgctccaagaaggtcccgttacaggaagagctgccgatgttattgcagctgctaacactgcagccgaagttgcgttgaggctcgtgaggcctggaaaaaagaacaaggatgttacagaagcaattcaaaaggttgctgcatcttatgactgcaaaatcgtcgaaggtgttcttagccatcagctgaagcagtttgtgattgatgggaacaaggttgtattgagcgttgccaatcctgagacgagggttgatgaagcagaatttgaggagaacgaggtgtactcaatagatatagttacaagcacaggagaaggaaagcccaagttgttggatgagaagcagacaactatttataaaagagctgtggacaggaactatcatttaaagatgaaagcctctagatttattttcagtgaaataactcagaagtttcctataatgcctttctcagcaagggctttggaagagaaaagggctcggcttggattggtggaatgtgttaaccatgatcttttgcagccataccctgttcttcatgagaagcctggtgattacgttgctcatatcaaattcaccgttttgctgatgcctaatggatccgatcgagtcacatctcatcccctgcaggatctgcagcctacaaaaacaattgaggatcctgaaatcaaggcatggttggcattgggcacgaagacaaagaaaaagggtggcggaaagaagaagaaaggtaagaagggagacaaaacagaggaccctaaagatgctgatgagcctatggatgccacagtcaatggtggtgcctcccaagaatgagcacccaaaaaccacactctaaaaaagagtaaaggacaaacaggaatccccttcgcttttctttcttgaaatttggctttacctcgttgtacacacaatgagcagtgatggttgccagatttaagtggtgaacgttc

SEQ ID NO: 7397 - DNA, 1515 bp, Vitis vinifera
caaaccctagctcaactgagccaccaccccctccccaaagacaatcgcatcttttccgtctcttctgaaccctagctgttcgtcttctcaagcctcgaaacgatgtcggatgacgaaagagaggagaaggagttggatctcacttctcctgaagtcgtcaccaaatacaagagcgctgctgagattgctaacaaggctttgcagttagtcttgtcggaatgcaagccaaaggcaaagattgttgacatctgcgagaaaggcgattcattcattagagagcaaactggcaatatgtacaagaacgttaagaagaagatcgagaggggtgttgcctttccaacttgcatttctgttaacaacactgtctgtcatttttctccccttgccagtgacgagacagtgttggaagatggtgatatgttaaaaattgatttgggttgccacatagatgggttcattgcagtagttgcgcacactcatgttcttcagggagggccagtgatgggtagagcagctgatgttcttgcagcagcaaatactgctgctgaagttgctctgaggcttgtaaggccaggaagaaagaataaggatgtaacagaagcaattcagaaggttgctgctgcctatgactgcaaaattgtcgaaggtgtactcagccaccagctaaagcagtttgtgatagatgggaacaaagttgtactgagtgttcccagtccagagaccagagttgaggatgcagagtttgaggagaatgaagtttatgcagtagatatagtcacaagcacaggtgatgggaagccaaggctacttgatgagaagcagacaactatttacaaaagagcagtcgacaagagctatcatttgaagatgaaagcttctagattcattttcagtgagattagccaaaagtttcccatcatgccattttcagcaagggctttggaagagaagcgggctcgactgggtctagtggaatgtgtgaatcatgatcttttacaaccataccctgttcttcatgaaaagcctggtgactatgttgctcacatcaaattcactgtcctgctaatgccaaatggatcagatcggattacatctcattcactgcaggaactgcagcctacaaagacgacagatgacccagaaatcaaggcctggttagccttgggcacgaagacaaagaagaaaggtggtgggaagaagaagaaaggtaagaagggggataaacctgaagagtcagcagaagctgaacctatggatgcaacaactaatggggcatctcaagaatgagaggatgttcctttttgtgctttttttttttttttttaaatgtcaattttggtacttcactcctttgtatctggttgattaagagttgatttggatagtgttagaaagatgatcctaatcggggtttcctgcctatgcagctgatgcatgcatccagagttacccttgtatctcttttttttcttcaatcatttttatgacaattgaaaagcaggaatttaggctcaa

SEQ ID NO: 7398 - DNA, 1630 bp, Citrus sinensis
tttcctatataagccaacgctgccgtgagaaccaaaccctagctgtgtccctatcgagccacctcttcagtcttcaccctctttctctctatctcgtattctatttttttatctttgcagtaccctagcttcaccgccgtcaccgtcagtttatcacaattgtttggtagattttttctacaaaaatcaaaacgatgtcggacgatgaaagggaggagaaggagttggatctcacttctcctgaagttgtcaccaaatacaaaagcgctgctgagatcgccaataaggcgttgcagttggtagtatcagaatgcaaacccggtgttaagattgttgacctttgtgagaagggagattcatttattagagaacaaaccggcaacatgtacaagaatgtaaagaagaagatcgagaggggcgttgcattcccaagttgtgtttctgttaacaacacactctgtcatttttcaccacttgcaagtgatgagacagtcttgcaagaaggagacatgatcaagattgatttgggatgtcacatagatgggtttattgctgtagttgcacatactcatgtcctccaggatgggcctgtaacaggcagggcagctgatgttattgctgcagcaaatactgctgctgaggttgccttgaggcttgtaaggccaggaaagaagaacaaagatgtaacagaagccattcagaaggtagctgctgcacatgattgcaagattgttgaaggtgttctcagccaccagctgaagcagtttgtgattgatggaaacaaagttgtactgagtgtctccaatccagataccagagttgatgatgcagaatttgaggagaacgaagtttatgctgtagatatagttacaagcacaggtgatggaaagccaaagctgttggatgagaagcagacgactatttacaagagagccgtggacaaaaactatcacttaaaaatgaaagcttctagatttatctttagtgaaattaatcagaaatttccaatcatgcctttcactgcaagggctttggaagaaaaaagggctaggctaggattagtggaatgtgtgaatcatgagcttctgcagccatatcctgttcttcacgagaagcctggtgattatgttgctcatatcaaattcacagttttactgatgccgaatgggtcagatcgaatcacatctcatgctctgcaggagattcagtccaccaagacaatcgatgatcctgaaattaaggcctggttagccttgggcatcaagactaagaagaaaggtggtggaaagaagaagaaaggtaagaagggcgacaaagctgaggaatcaacggaagccgagcccatggatgcaacaaatggagctgcaactcaagaatgagtgtttacttatttattttcatttctttccccaattttgatgctttgttcacttgtatctggttggttacagtttaatatagtgtttagacaatgattctaactgtgttatccaccaaatcatatctgcatccttcctcctctgaactgtatcttttttgttttagtagccgttactgaactatttattgaaacatagatcaataaacccaagcagcatgacatgatagatataattttggcaatgcattc

SEQ ID NO: 7399 - DNA, 1564 bp, Trigonella foenum-graecum
cttcaccgctacttggctactctcaaaatttcctcttaaccctttccttcttccaccgattcttcaacaatcaaaaccctacaagggaaattttcacaggccaattcaccatgtcagatgatgagagagatgagaaggagttggatctcacttctcctgatgttgtaaccaagtacaagagtgcagcagagattgttaacaaggctttgcagttggttgtttcagaatgtaaaccgaaggctaaggttgttgacatttgtgagaaaggggattcattcattagagagcaaactggtaaattgtacaagaatgtgaagaagaagatcgagagaggtcttgcattcccaacatgcatatctgtaaacaacactgtatgtcacttttctcctctcgccagcgatgaaactttgttggaagaaggtgatatagtgaaaattgatttggcgtgtcatatagatgggttcattgctgctgtggctcacactcatgttcttcaggagggacctgttacaggacgtgctgctgatgtaattgcggcagcaaacactgctgctgaagtggccttgagactagtaaagccaggaaagaagaaccaagatgtaactgatgcaattcagaaggtcgcggctgcctatgattgtagaattgttgagggtgttcttagtcaccaaatgaagcagtttgtgattgatgcaaataaggtcgtgctaagtgtatctaatccggaaacaagggttgatgatgcagagttcgaagagaatgaagtttatgctattgatattgtagccagtactggagaaggcaagcctaagctgttggatgagaagcagacaactatttataagagggctgttgacagaagttataacttgaagatgaaagcatctaggtttatttacagtgaaataagccaaaattttcccatcatgccattctctgcaagggctttggaagaaaaaagagctcgtctgggtttagtggaatgcatgaatcatgagctcctgcaaccttatcctgttctacatgaaaagcctggtgattatgttgcacacatcaaattcacagtcttgctaatgccaaatggatcggatcgtatcacatctcatccactccaggaaattcaacctactaaaacagtagatgatcctgaaattaaggcctggctagcattgggcgtaaagacaaagaagaagggtggtggaaagaagaagaaaggcaagaagggggctgaaggtgaagccgaagccgaagctgatcccatggatgcaacagatggtgctgcaacccaagagcaaaattgagtctgcatatgatttaacttttgttgcctttcaattttgttacatttttcacctagtgtatctgccagagtttagtatagcattcctacagtgtcgataggaatttccatttgcacaattcagtagacatgaatgctatgatgtctgtttaaacaaaagtacatgttttgttgtggagttttatttaatgcaaagtatatcaaattaagaacctaatttcatgtgttcttagctgtttatgctgaatatatcgatgttgaatg

SEQ ID NO: 7400 - DNA, 1423 bp, Tripterygium wilfordii
ggcggtctggtccgcaacgccaaccctagcttctatctagccacttcatattttgcgctctctcctaccacatcttcttatccctgttaaaccctagcattcgccgaacagacccttgaaacattcaccgccgtcaacccttcccgattcgcgaaattcagacacaccgaaactatgtcgtcggacgatgaaagggaggagaaggagctggatctcacttctcctgaggtcgtcactaagtataagagcgcagccgagatcgttaacaaggcgttacagttagcgatctcagaatgcaagccaaaagcaaaaattgttgatgtctgtgagaagggtgattcatacatcagagagcaatcaggcaacatgtacaagaatgttaagagaaagattgaaaggggcgttgcatttcctacttgcatctctgtaaacaacactgtttgccatttctcaccacttgccagtgatgaggcagttttggaagaaggtgatttggtgaaaatagatatggggtgtcacattgatgggttcattgctgtagttgcacatacccatgttcttcaagaagggtcagtgacagggaaagctgcagatgttattgcagctgcaaatactgctgctgaagttgcactgaggcttgttaggcctgggaagaagaacaaagatgtaacagatgcaattcagaaggttgctgctgcttacgactgcaaaattgttgaaggtgttcttagccaccagttgaagcaatttgtgatagatgggaacaaggtcgtacttagtgtttctagtccagataccagggttgatgatgcagagtttgaggagaatgaagtgtacgctgttgacatagtagcaagcacaggtgaaggcaagcccaagctgttggatgagagacagactactatttacaagagagcagttgacaagaactatcacttgaagatgaaagcttccagatttatttttagttgaaattagtcagaaatttccaatcatgccattctctgcaagggcattggaagagaagagggctcgtttgggattagtggaatgtgtgaatcatgaactcttgcagccgtatcctgttcttcatgagaagcctggtgatctagttgcgcacatcaaattcacagttttactgatgccaaatggatcagataggatcacatcccattctctgcaagagctgcaacccacaaagtcaatagatgatcctgaaattaaggcctggttagccttgggcacaaagacaaagaagaaaggaggcggaaagaagaagaaaggtaagaaggacgacaagcctgaggagtcgtcggcagcggagcccatggatgcaacaacaaatggtgcatcacaagaatgagcctcttttacatttatcaccgccttttattcagttttgttactttgttctcctcattgt

SEQ ID NO: 7401 - DNA, 1826 bp, Ananas comosus
ggccctaaatccgctcccgtcctctctagctatctcctcctctcccccgaaactcacaaaacctctcgccgcttcccaaaaaaccctagcgatagcgtatccgatcacattgtacatccgagtacgctattggattcagatatagtcttatacagaagctccttccctctccttcctcgctcgaaaccctaacttttggtgttcttctactgattttggactgagaagatgtcggatgacgagttaaaggaggagaaggagttggatctcacttcccccgatgttgtaaccaagtacaaaaccgccgctgagatcgttaacaaggctctgcagcttgttgtatccgagtgcaaaccgaaggcgaagatcgtagacatttgcgagaagggggatgcctttatcagagaacaaactggtaatgtgtacaagaacgtgaagaaaaagatcgagaggggtgtggcattcccaacttgcatatccgtaaacaacaccgtgtgccatttctcgcccctcgcgactgacgaaaccgtcttggaggaaaatgatattgtaaaaatagatatggggtgtcatatagatgggtttattgctgtcgtggcccatactcacgtaattcaggaaggaccggtcactgggcgtgcagctgatgttattgctgctgctaacactgcagctgaggttgctttgcggcttgttaggcctgggaagaagaacaaggatgttacagaagctattcagaaggtagctgctgcttatgactgcaaaattgtggaaggtgtccttagccatcagctgaaacagtttgtcattgatggaaataaagtcatacttagcgtgtcgaaccctgagaccagagttgacgatgctgaatttgaagaaaatgaagtttatgcaattgacatagtcactagcacgggcgaagggaagccaaaacttctggatgagaaacaaacgactatctacaagagagccgtggacaaaaactaccacttaaagatgaaagcgtcaagattcatttttagtgaaataaatcagaagttcccaatcatgccttttagtgcaagggctttggaagagaagcgtgctcggttgggcctggtagaatgtgtgaaccatgatcttctgcagccatatcccgtacttcatgagagaccaggtgaccttgtcgctcatatcaagttcacagtcttgttgatgccgaatggatcggacaggattacatcccatccgcttcagcagctgcagccaacgaaatccatcgaggacaatgctgagatcaaggcatggcttgctctgggcacaaaaacaaagaagaaaggcgggggaaagaagaaaaaaggtaagaaaggtgatgccaaagatgattcagctgaagcagagcccatggacgaggaagcatcaaatggtgcggcgacccagggatgagagatttacagttttgcccttttctttgtttctcgcttgtgttatctagagaccccttttttttcatcttttttttttttccgctcctgtcatggccctgaaaggaagtattctgcagaagcttctcggcaaacagtttacacagagggacaataaattttagagctgccgaagcttttggatcttaattatactaatttaaacagtcaaattgtggctatgctacgtggtttgtgttcattgtatgggatttaattcagattctatctcttctggacagtaggtttttctgttgaatcatttcgtccagtctcatgtgaactcataaaatctttgattagcacttctgaacgccgttctatatttcctaccattaaattgtaatcaatggtttcaggtgt

SEQ ID NO: 7402 - DNA, 1423 bp, Amsonia hubrichtii
ttctcattcttcttcttcatagcaagtagaccatcgtttcattttccattttatctctagaaggtgtttctggtagtttaattgttgaaatttgggttcagtacgatgtcggatgacgagagggaggagagggagttggatctcacctctcctgaagtcgtcaccaaatacaagagcgccgctgagattgttaacaaggcattacagttggtagtgtcagagtgcaagccgaaagctaaaattgttgacatttgtgagaagggcgatgcatttattcgagagcaaactgggaatatgtacaagaacgtcaagaagaagattgaaaggggtgtagcattcccaacatgcatctccgtaaataacactgtctgccatttttccccactggccagtgatgaggctcttttggaagaaggtgatgttgtgaaaattgatatgggttgccacatagatggattcatagctgtagttgcacatacacacgtccttcaagaagggccagtcactggcagagctgctgatgttattgctgcggctaatactgctgctgacgttgctctgagactcgttaggccaggaaaaaagaacaaagatgtgactgaagcagttcagaaagttgctgctgcatatgattgtaagatcgtcgaaggtgttcttagccatcagatgaaacagtttgttattgatgggaacaaggtcatattgagcgtttccaatcctgagacgagagttgatgatgctgaatttgaagagaacgaaatttattccattgatatagtaacaagtacgggtgaaggcaagcccaaattgttggatgaaaaacagactaccatctataaaagagctgtagataagaattatcacctgaagatgaaagcttctaggttcatattcagcgagataagtcagaaattcccaatcatgccatttacagccagggcgttggaagagaagcgtgctcgtctaggacttgtagaatgtgtcaatcacgaacttctgcagccatatcccgtacttcatgagaagcctggtgatttagtggctcatatcaaatttactgtgttgctaatgccaaatgggtcggatcgcattacatcccattctctacaggagcttcagcctactaaagcagtagatgaccctgagatcaaagcatggttagccttgggcacaaaaacaaagaagaaaggtggtgggaagaagaagaaaggtaaaaagggggataaagctgagccggcagctgatgctgagcctatggatgcagcaaatggttctgcatcccaagaatgaagcattggtgtttgtgctggccaattttggtaactctattgtatttggttgcttgagtttttcagttggtcatgatagtggtcatggtagaccaaatgtttactgaaatgtacacaaggcgaaccttgtatca

SEQ ID NO: 7403 - DNA, 1666 bp, Fagus grandifolia
cccagaggccagggtccataacgaaaaatcctatataaaccaagactggcttaaaggttcgcaaccctagctgtttgtcagccacctttcatttcgtcacgctcttcatatcttctctgctactaaaaccctagctccccaacctctcctttcactccctcgccgtcattttattcgactgcaaaagaatctccaaaacgatgtcggacgatgaaagggatgagagggaagagaaggagctcgatctcacttcccctgaagtcgttaccaaatacaaaagcgctgccgagatcgttaacaaggctttgcagttagttatatccgagtgcaaaccgaaggccaagattgtggacatttgcgagaaaagtgattcataccttagagagcaaactggcaatatgtataagaatgtgaagaagaagatcgaaaggggcgtggcgttcccgacttgcatttctgtaaacaacactatgtgtcatttctcaccgctcgcgagcgatgagtcagtgatggaagaaggtgatatcttaaaaattgatttgggttgccatattgatggttttatcgcggtggttgcacatactcatgttcttcaggaagggccagttactggaagggcagctgatgttattgcagcagctaatacggctgctgaagttgctttgaggcttgtgaggccagggaaaaagaacaaagatgtaactgatgcaattcagaaggttgctgctgcttatgactgcaaaattgttgaaggtgttcttagccaccagctgaagcagtttgtgatagatggtaacaaggttgtactgagtgtatctaacccggatacaagagttgatgatgcggaatttgaggagaacgaagtgtatgctattgatattgtaacaagcacaggtgaaggaaagcctaagctgttggatgagaagcagacgactatctacaagagagctgttgacaagagctaccacctgaagatgaaagcatctaggtttatattcagtgaaataagtcagaaatttcctatcatgccattcactgctagggctctagaggagaagagggctcggctcggtttagtggaatgtgttaatcatgagctcttgcagccatatcctgttcttcacgagaagcccggtgattttgttgctcacatcaaattcacagtattacttatgccaaatgggtcagatcgggtcacatctcatactctgcaggagctgcagcccacaaagtcgatagatgatcctgaaatcaaggcttggttagccctgggcacaaagacaaagaagaaaggtggtggaaagaagaagaaaggtaaaaagggtagaaaaaactagaggagtccacagaagctgagcctatggactcaacaacaaatggtgctgcttcccaagaatgagttttcttccatttcattttttcaaccccttgtcaattttggcacttcgtccattgtatccggttgaatatgagttggtttactatgtcctttggacattaatcctaatcatgctttgctgcaaatatacccttttatgtatcttttagatattcttaagttcttaaacaatctagaatcaaagaaagcttcaatcaactttgttgtatgttgtcttaaatggaagagttaactggaaggtaataatcgaggctcaaaataaaaata

SEQ ID NO: 7404 - DNA, 1507 bp, Malus domestica
gaaaccctagctttctctaccaagccaccttcatattggtcctattatactctgctatattaaaccctaacccccaaacactcacctcaacccccagcactcccctcatcgcatctcagattttcacccaatcagatttttgaagtcggagacttcactgagcttcgaaacgatgtcggacgatgagagagaggagaaggagctggatctcacatctccggaagtcgtcaccaaatacaagagcgccgctgaaattgttaacaaggctctgcagctggtaatatccgaatgcaaaccgaaagcgaagattgtggacctttgtgagaaaggggattcatacatcagagaacaaactggcaacatgtacaaaaatgcgaagaagaagatcgaacgaggcgttgccttcccgacttgcatttctgtgaacaacactgtatgccatttctctcctcttggcagtgacgagtcagtgttggaagaaggcgatattctgaaaattgatttgggctgtcatattgatgggttcattgccatagtcgcacatactcatgttcttcaagctggaccggttacagggagggctgctgatgttattgcagctgctaatactgctgctgaagttgcattaaggcttgttaggccagggagaaagaacaaagatgtaacagaggcaatacaaaaggttgcagcagcttacgactgcaaaattgttgaaggtgttcttagtcatcagctcaagcagtttgtgatagacgggaacaaggtcatattaagtgtttctaatccggagacaagagttgacgatgcagaatttgaggagaatgaagtttatgcagttgatatagtcgcaagcacaggtgaaggcaagcctaagctgctggatgagaaacagacgacaatctataaacgagctgttgacaagagctatcacttgaagatgaaagcttctaggtttattttcagtgaaattagccagaaatttcccatcatgccattcactgctagagctttggaagagaagagggctaggcttggtttacttgaatgcgtcaaccacgagcttttgcagccatatcctgttctgcacgagaagcctggtgactttgttgctcgtatcaagttcaccgtcttgctaatgccaaatggatcagaccggatcacatctcatcctgtacaggagctgcagcccactaaacaagtagatgatcctgaaatcaaagcctggttgtctttggccacaaagaagaagaaaggtggtggaaagaagaagaaaggcaagaagagcgataagcccgaggaggagtctgcagaagctgaaccgatggacgcaacaacgaacggtgctgagtctcaagcatgagccttcgttgattctagccgggtttctctaatatgcatttccacaactcgctgtttttttgtatgttctgagattttgtagtcgattaccgtcaaatttaagttatatatgaaatgtttttgaattctgagagcatgttttcttaac

SEQ ID NO: 7405 - DNA, 1442 bp, Theobroma cacao
ttgattttatttatttataaatcaacactctctcttctcttatcagctctccccaaaaccctagctcctttcaggaactgccgccaattccaaccagtttgtgataagctgcgaaaacgatgtcggacgacgagagagaggagaaggagttggatctcacctcccctgaagttgttaccaagtacaagagcgctgctgagatcgttaacaaggcgttgcagttggttgtaaaagattgcaagccaaaagctaagattgttgacatttgtgagaagggtgatgtatttatcagagagcaaaccggcaacatgtacaagaacgtgaagaggaagattgagaggggtgttgccttccccacttgcatttccgtgaacaacactgtgtgtcatttctctccgcttgctagtgacacgtcagagttggaagaaggtgatatggtgaagattgatttgggttgccacattgatgggtttattgctatagttgcacatactcatgttgttcaggatgggccaatcactggcaggcaggctgatgttgttgccgctgtcaatactgctgctgaagttgccttgaggcttgtcaggcctggaaagaagaataaagatgtcacagatgcaattcagaaggtagctgctgcttacgactgcaaaattgttgaaggtgttcttagccatcaactaaagcagtttgtgatagatggaaacaaagtcatattaagcgtctccaatccagacacaagagttgatgatgcggagtttgaggaaaatgaagtttatgcagtagatattgtcgcaagcactggtgaagggaagccgaagctgttggatgagaagcagacaactatttataagagagctgttgacaagaattatcatttaaagatgaagacctctagatttattttcagtgaaataaatcagaaatttcccatcctgccattcactgcccgggctttggaagagaaaagagctcgtctaggtttagttgaatgtgtgaaccatgatctcttgcagccatatcctgttcttcatgagaagcctggtgattatgttgctcatatcaaattcaccgtgttgctaatgcctaatggatcggatcgggtcacatcccatcctctgcaggagttgcagccaaccaagacaatagatgatcctgaaatcaaggcctggttagctttgggtacaaagacaaagaagaaaggaggtgggaagaagaagaaaggtaagaagggtgataaagctgaggaatcagcggaagcggagcctatggatgaagcaacaaatggtgctacgtcttaagaaaacattctctccttgtttttcaattttggtactcttgttcacttgtatctggttggttatgagttaaatttaatatagtatcagacattgatcctcctaattgggttttctcgtacaatcacacctccccttcgtgtc

SEQ ID NO: 7406 - DNA, 1577 bp, Momordica charantia
cggccgggggtaaccctaaatccttctcgtgctgggtctgagccactctcattccttccttgtcttctctttccagcttcaaacctttatccgaattagcttcacttcttctctccgccgttttcagtcttcgccggcagattttctttcgagggttcttggaagatgtcggacgaggagagggaggagaaggagctcgatcttacttctcctgaagtagtcaccaaatacaagagtgccgctgaaattgccaacaaggcattgcagttggtaatatcggaatgcaaaccaaaagctaagattgttgatgtttgcgagaagggcgattcgttcatcagagaacaaactggcaacatgtacaaaaatgttaagaagaagattgaaagaggcgttgcttttccaacttgcatttctgtgaacaacactgtttgtcacttctcaccgctttctagcgacgagaccctgtttgaagagggcgatattcttaaaattgatttgggttgtcatattgacggctttattgctgtagttgctcatactcatgtgctgcaagaaggtcccgttacaggaagagctgctgatgtaattgcagctgcaaacactgcagccgaagttgccttgaggcttgtgaggcctggaaaaaagaacaaggatgttacagatgcaattcaaaaggttgctgcttcttacgactgcaaaatcgttgaaggtgttcttagccatcagatgaagcagtttgtgattgatgggaacaaggttgtactgagtgttgccaatcctgagacaagagttgatgaagcggagttcgaggagaatgaggtgtactcgatagatatagttacaagcacgggagaaggaaagcctaggttgttggatgagaagcagacaactatttataagagagctgtggacaggaactatcatttaaaaatgaaatcttctagatttattttcagtgaaataactcagaagtttcccataatgccattcacggcaagggctttggaagagaaaagggctcggcttggattggtggaatgtgttaaccatgatcttttgcagccatatcctgttcttcatgagaagcctggcgattatgttgctcatatcaaattcaccgtgttgctgatgcccaacggatcggatcgagtcacatctcatcctctgcaagagctgcagcccacaaaaacattagatgatcctgaaatcaaggcgtggttagcattgggcacgaagacaaagaaaaagggcggtgggaagaagaagaaaggtaagaagagcgataaaatagaagagcccactgatggcgagcctatggatgccacagccaatggcgctgcatcccaagaatgaacttccacactcccaaaaaacagaaacacaaaaacaaagaaaaacagagaaattgtggtgggttttgttttttcttcgaatctggctctgtatctcatttgtatacgatgaggatgatgccagagtaaagtggtgaacgttccttattgggtatttattaatgaatccctctctcttttatgtatggtcgtacacatacttcttcaaattgatcttttgaatga

SEQ ID NO: 7407 - DNA, 1600 bp, Medicago truncatula
cctccatttgtgtaaagacagcagcaacaatcttctctttctatataaaccgctaaccctaatttcttacaccttcacacagctgcttagccactctcaactttcgtctcaaccctttccttcttccgccgattatttcactgattcttcgacaatcaatcaaaaccctacaaggaaattttcgaaggccaattcaccatgtcagatgatgagagagatgagaaggagttggatctcacttctcctgatgttgtaaccaagtacaagagtgcagcagaaatcgttaacaaggctttgcagttggttatttcagaatgcaaaccagatgttaagattgttgacatttgcgagaaaggggattcatttattagagagcaaactggtaaattgtacaagaatgtgaagaagaagattgaaagaggcgttgctttcccaacatgcatatctgtaaacaacactgtctgccatttctctcctctcgccagcgacgaaacagtgttggaagtaggtgatatattgaaaattgatatggcatgtcatatagatgggttcattgctgctgtggctcatactcatgttcttcgggagggaccagtcacgggacgcgctgctgatgtaattgcggcggcaaacactgctgctgaagtggccttgagactagtaaagccaggaaagaagaaccaagatgtaactgatgccattcagaaggtcgctgctgcctatgattgtagaattgttgagggtgttcttagccaccaaatgaagcagtttgtgattgatgcaaataaggttgtgctaagtgtatctaatccggatacaagggtcgatgatgcagaattcgaagaaaatgaagtttatgctattgatattgtagccagtactggagaaggcaagcctaagctgttggatgagaagcagacaactatttataagagggctgttgacagaagttataacttgaagatgaaagcatcgagatttatttacagtgaaataagccaaaattttcccatcatgccattctctgcaagggctttggaagaaaaaagagctcgtctgggtttggtggaatgcatgaatcacgagcttctgcagccttatcctgttctacatgaaaagcctggtgattatgttgcacacatcaaattcacggtcttgctaatgccaaatggatcagaccgtatcacatctcatccactccaggaaattcagcctactaaaacagtagatgatcctgaaattaaggcctggctagcattgggcgtaaagacaaagaagaagggtggtggaaagaagaagaaaggtaagaagggggctgaaggtgaaggtgaagctgatgcaacaaacgatgcctcaacccaagagcaaaattgagtctgcatatgatttagcttttgtccctttcaattttgttacatttttcacctagttgtatctgccagaatgtaagtttagcatagcattcctacaatgtcaggaattatccatgtcacattccagtatactttgacatgaatgctgtatgtctgtttaaacaaaagtgtctgtttttgttgtggagttttatttaatgcaaagtatatcaaatttaagaaccaaa

SEQ ID NO: 7408 - DNA, 1635 bp, Momordica charantia
cggccggggaaccctagtttcttctctgctttctacttcgagagttacaactcccttcaattacctgcgtttttgttgaaatttgcttgtaaacttggagttattcttcctgaatctgtcgtctctgatagttgaagagtttctgaagctcaaaagcaatgtcggacgatgaaagggaggaggtggagttggatctctcctctccggatgttgtcacgaagtacaaaagtgctgccgagatcgcaaacaaggcattgcagctggtgatatctgaatgtaaacctaaagcaaaaattgttgacatttgcgagaaaggagattccttcattagagagcaaactggcaacatgtacaagaacgttaagaagaagatagaacggggcgttgccttcccaacttgcatctctactaacaacacagttggccacttctcacctctggctagcgacgagacagtgatggaagaaggagatgtactgaagattgatttggggtgtcacattgatgggttcatcgctgtagttgctcacactcatgttctgcaagaaggtccggtgactggaagggctgctgatgttattgcagccgctaacactgccgctgaagttgcattgaggcttgttaggccagggaaaaagaataaagatgtaaccgaagccattcaaaaggttgctgctgcttatgattgcaaaattgttgaaggtgtacttagccaccagctgaagcaattcgtgattgatggaaacaaggttattctcagtgtttcaaatccagaaacaagagttgatgatgcagagtttgaagaaaatgaagtttatgcaatagatatagttacaaccacaggtgaaggcaagcctaagctgctggatgagaggcagaccactatatataagagagctgtggacaagaactaccacttgaagatgaaagcatctaggtttattttcagtgaaataagtcagaaatttcccattctgcctttcactgctagggccttggaagagaaaagagctaggctgggactagttgaatgtgttaatcacgacctattgcaaccgtatcctgtcctccatgaaaagcctggtgattatgttgcccacactaaatttacggtcttactaatgcccaatggatctgatcgaatcacctctcatgctctgcaagagcttcagcccacaaaaactatagatgatcctgaaatcaaggcttggttagctcttggaacgaagtcgaagaaaaagggtggtgggaagaaaagaaaggtaagaaaggcgacaacaaacccgatgattcaagagaggctgagccaatggatgcaactacaaaagatggtgcatcgcaggaatgagttacttcttttgcactgctctctcccatccatccatcttttcaattttggcactgttttttcctctttttattgtatgttgatcagccttaattatggatatcgttagcctggcttagtatgggttaccagacatcaaaggaatgccctttttattacttccccatgtatcatctacatatttttattggcaaagtacacaatttagcctaataaacacgccttcgtacattatttttattggcaaagttcattacaggaactgaatagccaggtttgttttaaag

SEQ ID NO: 7409 - DNA, 1599 bp, Malus domestica
gcttctattcgtccttttatccgctatattaaacccaaaccctaaacactcacctcagtgacctcaccccctgtactccgctccatcgcacctcatattttcccccaatcaggtttttgaagtcggagaattcacagagcttccgaacaatgtcggacgatgagagagaggagaaggagctggatctcacatctccagaagtcgttaccaaatacaagagcgccgctgaaattgttaacaaggctttgcagctggtaatatcggaatgcaaaccgaaggcgaagattgtggaactttgtgagaaaggagattcatacatcagagagcaaactggtaacatgtacaaaaatgcgaagaagaagatcgaacgaggcgttgccttcccgacttgcatttctgtgaacaacactgtttgccatttctctcctcttgccagtgatgagtcagtgttggaagaaggcgatattctgaagattgatttgggctgtcatattgatgggttcattgccatagttgcgcatactcatgttcttcaagcagggccagtcacaggaagggcagctgatgttattgcagctgctaatactgctgctgaagttgcattaaggcttgttaggccagggagaaagaacaaagatgtaacagaagcaatacaaaaggttgcagcagcttacgactgcaaaattgttgaaggtgttcttagccatcagctcaagcagtttgtgatagacgggaacaaggtcatattaagtgcttctaatccagagacaagagttgacgaggcagaatttgaggagaatgaagtttatgcagtggatatagttgcaagcacaggtgaaggcaagcctaagctgctggatgagaagcagacgactatctacaagcgagctgttgacaagagctaccacttgaagatgaaagcttctaggtttattttcagcgaaataagccagaaatttcccatcatgccattcactgctagagctttggaagagaagagggcaaggctgggcttacttgaatgcgtcaaccacgagcttttgcagccatatcctgttctgcatgagaagcctggtgattttgttgctcatatcaagttcaccatcttgctaatgccaaatggatcagatcggatcacatctcatcctgtacaggagctgcaacccactaaacaagtagatgaccccgaaatcaaagcctggttgtctttggccacaaagaagaagaaaggtggtggaaagaagaagaaaggtaagaagagcgataagcctgaggagtctacggaagctgaaccgatggatgcaacggcaaatggtgctgaatctcaagcatgagcctttgtttcgtgtttcaattttggttctctccccacacactgtatctggttggaagttggatatgaattaatttaatacagtgttcagacgtcgattctagccgggtttttctctaatacgcaattccggaacttgcgggtttttgtatgttcttagattttgtagtcgattaacgtcaagtttaaagttacataaaaatgtatggcaatttacgacattcgggaatttggttaccgcatgctatcctcaactttggaacaca

SEQ ID NO: 7410 - DNA, 1760 bp, Populus trichocarpa
aactgagaagcaagagtgtgtgtagaaaattcctatataatgcaattgcaaacgctgcggtaaagacccaaaaccctagctcttcacgaaccacctctagctatcctcatccatttctacatcactgctcttctctctctttgcccccccccccccccccccctgctttcaaaccaaaaaccctagctagcttccttatcccctcctctccgccgccaatttattttcaccaccaagtcggtgattgacataaaaaagctccaatacgatgtcgtcagacgacgagagagaggagagagagttggatctcacatctcctgaagtcatcaccaaatacaaaagcgccgcagaaattgtcaacaaggcattgcagttagtgatatcagaatgcaagccaaaggctaagattgttgatatttgtgaaaaaggcgattcttttataagagagcaaactggtaacatgtataaaaatgtgaagaagaagattgaaaggggagttgcttttccaacttgtgtttctgtcaacaacactatttgccatttttctccacttgctagtgatgaatcggtcttggaagaaggagatattgtcaagattgatttgggctgtcatatagatggatttattgctgttgttggacatacccatgctcttcagtcagggccagttacaggcagggcagctgatgttattgcagctgcaaatactgctgctgaagttgccttgaggcttgtaaggcctggaaaaaagaataaagatgtaacagaagctatccagaaggttgctgctgcttatgactgcaaaattgttgaaggtgttctcagccaccaattgaagcagtttgtgatagatggaaacaaggtaattctgagtgtctccaatcccgacacaagagttgatgatgcagaatttgaggaaaacgaagtgtatgccgtggatattgtcacaagtacaggggaaggcaagccaaaactgttggatgagaagagtactactatatacaagagagctgtagacaagaattatcacttgaaaatgaaatcttcgagatttattttcagtgaaattaatcagaaatttccaatcatgccattcactgcaagagctctcgaagagaaaagggctcggctgggattattagaatgtgtgaatcacgatcttctgcagccctatcctgttcttcatgagaagcctggtgattatgttgctcatatcaagtttacagtattgctaatgccaaatggatcagatcggatcacttcacattcactgcaagaattgcagcctagcaagacgatagatgatcctgaaatcaaggcctggttggctttgggtacaaagacaaagaagaagggtggtgggaagaagaagaaagctaagaagtctggtgaaaaagctgagtcaacagaagctgaacccatggatgcaacaacaaatggggctgctgcgcaagaatgaatctttatatagattttgcccatttgtcaagttttggaactctattcaccttcttgtatctggttggttgagaaattttttaatatagtgtctagacattgatcctaattggattttccttgcatacgcgttctcatgacgatccatatcctgtaccatcccccattttagaagttcagatggcaaaaggttttcttcattaaactatgtctagtattaaaatttccaaaatttgttcgaatgtaaaagagattttcatttagaaatatgattgtcttaaaaattctgtcaagataatttt

SEQ ID NO: 7411 - DNA, 1696 bp, Trifolium pratense
tccgattgtgtaacgacagcaacaaacaaaacaacaatcctctttctctctctaatctctatataaacccactaaccctaatttcttgcaccatcacttcaacttagccactctaaacgctttcatcttcaaccctttcattcttccatcgattctaacacaaccaaactccaccatgtcagatgatgagagagatgagaaggagttggatctcacttctcctgatgttgtaaccaagtacaaaagcgctgcagagattgttaacaaggctttgcagttggtgatttcagaccttaaaccaaaggttaaggttgttgatatttgtgaaaaaggggattcgtttattagagagcaaactgcgaaattgtacaagaatgtgaagaagaagattgagagaggtgttgcattcccaacatgcgtatgtgtaaacaacactgtatgccatttttctcctcttgccggtgatgaaacggtgtttgaagaaggtgatgtggtgaaaattgatttggcgtgtcatattgatgggttcattgctgctgtggctcacactcatgttcttcaggaaggacctgttacaggacgtgcagctgatgtcattgctgcagcaaatacggcggctgaagttgccttgaggcttgtaaagccaggaaaaaagaaccaagatgtaactgatgcaattcagaaggttgccgctgcctatgattgtagaattgttgagggtgttcttagccaccaaatgaagcagtttgtgattgatgcaaataaggttgtgctaagtgtatctaatacggataccagggttgatgatgcagagtttgaagagaatgaagtttatgcaattgatattgtagccagcacaggagaaggcaagcctaagctcttggatgagaagcagacaactatttataagagggctgttgacaaaagttataacttgaagatgaaagcatctaggttcatttatagtgaaataagccaaaaatttcccatcatgcccttctctgctagggctttggaagaaaaaagagctcgtctcggtttagtggaatgcatgaatcacgagctcctgcagccttatcctgttctacatgaaaaacctggtgattatgttgcacaaatcaaatttacggtcttgctaatgccaaatggatcggatcgcatcacgtcccatccactccaggaagtgcagcctactaaaacagtagatgatcctgaaattaaggcctggctagcattgggtgtaaagacaaagaagaagggcggtggaaagaagaagaaaggtaagaagggcgcagaaggcgaagctgaagtttctgaagccacaaatggtgcctcaacccaagatcaagaatgagtctttttaaaaaatcactttgatttaacttttgatcccttttaattttggtacatttttcacgtagttgtatgtgtatgaatgctgagtttagtatagcattccttcaatatcaataggaatttccatgtgcacattccagtataccatgacacatgaatgctatacatctgtttaaacataaatgtctgttttgttggggagttttatttaaaacaaaggacatcaaatttaaaataccaaacttaatgttatcgagtgtgtagcggctataccgatttatgaaacattaaccagttctgatatcaatacatagcggctataccggtttatgagaaaaac

SEQ ID NO: 7412 - DNA, 1369 bp, Humulus lupulus
aaagctacaagccacctttcattttcattcctttctttcttacatatactctcacacactctctctatctctctcgtttctatctgttaaaccctagcttacatacccagtactcaacctctccttcgccgtcaaacttatttctttcattcgttgctagtttcaaagcttcgtaacgatgtcggatgatgaaagagaggagaaggagttggatctctcttctcctgaggtcgtcaccaagtacaagggcgcagctgaaattgtcaataaggctttgcagctagtgttatccgaatgtaagccaaaggccaagattgtggatctatgtgagaaaggagattcatatattagagagcagactggcaacatgtacaaaaatgttaagaaaaagattgaaaaaggagttgcattcccaacttgcatctctgtgaacaatactgtttgccatttctcacctcttgccagtgatgagtcagtgttggaagaaggtgatatcttgaaaattgatatgggctgccatatagatggattcattgccgtagtcgcacatacacatgttcttcacgaaggcccagtgacaggaagagcagctgatgttattgctgctgccaacactgctgcctgaagttgccttgaggcttgtaaggccaggaaaaaatacaaagacgtaacagaagcaattcagaaggttgctgctgcttatgactgcaaaattgtgaaggtgttcttagccaccagctgaagcagtttgtgatagatggaaacaaggttgtattgagtgtatccagccctgatacgagagtagatgatgctgaatttgaggagaatgaggtttatgcaatcgatatagtcacaagcacgggtgatggcaagcctaagctattggatgaaaagcaaacgactatctataagagagcagttgacaagagctatcacttgaagatgaaagcttctaggtttattttcagtgaaattaaccagaagtttccaattatgcctttcactgccagggcgttggaagagaaacgtgcaagattgggtttagtggagtgtgttaaccacgaccttttgcagccatatcctgttctccatgagaagcctggtgatttggttgctcacatcaaattcacagttttgctaatgccaaacggatcagaccgaatcacatcccattctcttcaggagctgcagccaaccaagacagtagaggatcctgaaatcaaatcctggttggctttggccaccaagtcaaagaagaagggtggtggcaaaaagaagaaaggcaagaagggcgagaaagctgaggactctgcagcagaagctacaccaatggatgcaacaaatggtgctgagtctcaaggatgagtcc

SEQ ID NO: 7413 - DNA, 1719 bp, Rosmarinus officinalis
acacttcgaaggcggaaaccacattatataaagcccaccgttcactctaccttgccgacctcaagctctttcattcagttttcacacatcctctctcactcataaaccctaattttattcctttcttccgtaacttctgcagatattttttcatttgtttaaacgatgtcggatgaggagcgggaggagaaggagttggatctcacctctcctgaagtcgtcaccaagtacaaatccgcagctgaaattgttaacaaggcgctgcagttagtgttgtctgaatgcaaaccgaaggctaagatagcggatctttgtgagaaaggagatactttcatcagagaacaaactgcgaacatgtacaaaaatgtgaaaaagaaggttgaaaagggcattggtttcccaacatgtatatcggtcaacaatacggtttgccatttctcgccattgtccagtgatgaggctgttttggaagaaggagatatcttaaaaattgatatggggtgtcacattgacggctttatagctgtagttgcacacacccatgtacttcaggagggaccagttactggtagggtagctgatgttattgctgctgctaatacggctgcagaagttgcgttgagacttgtgaggccagggaaaaagaacaaagatgtttcagaggcaattcagaaagttgctgcagcttatggctgcaaaattgttgaaggagttttgagtcatcaaatgaagcaatatgtgattgatggaaacaaggtagttttgaatatctcaggccctgatacaagagtcgacgatgcagaatttgaggagaatgaggtttatgccattgacattgtaacaagtaccggtgaaggcaagccaagattgttggatgagaggaagacgactatatataaaagagccgttgataagaattatcacttaaagatgaaggcttctaggttcatctttagtgagattagtcagaagttccccatcatgcctttttctgctagggctttggaagaaaagcgtgctcgtttgggcctagttgaatgtgtgaaccatgaacttttacagccatatcccgtacttcatgagaagcctggtgatctggttgctcacatcaagttcacagttttgctaatgccaaatgggtctgatcgagtcacgtctcatccgctgcaggagctgcaacccactaaaacccttgatgatcctgagatcaaatcctggttggcgttggggacaaagacaaagaagaagggtggtggaaagaagaagaaaggaaagaaaggagataaaccagaggaagcagctgatgctgagcctatggatgaggcaactaacggtgcagcgtcgtaagcgagttaaggaatgctataaatccgaatatacagctgatgctcagctatgaacgtgggtacaaacaactcagctccacgagaaaaagagaaaggtcttgttttcatttgtgtatcttaaccatgaaatgaaattttggccgcccaattgtatttggttgctttctagtcgtgaatatgaatctaacttgagatgctttgagatgtgtctttatactgtattcaatttgttgtttgaatagaaaaggatataattgacagtttatatctcaaatgaatattatagttacaaatcaaaattatcaattatataatgtttgtgactagggatgaaacgaattgaattgaacaaaagatcaacgaatgaaatttg

SEQ ID NO: 7414 - DNA, 1644 bp, Cucurbita pepo
cggggcaccgattgtaaccctaatccttctccgcttttcttggttcctctctggtgtacctggtgtcctctatcaaccttcacacttttatcttaatttgcctcacttctttctcagccgcttttaatcggtcggactgtttttttcttcgccggcgtagatgatgtccgacgaggaaagggaggagaaggagctcgatcttacttctcctgaagtagtcaccaaatacaaaagcgccgctgatattgccaacaaggcattgcagttggtgatatccgaatgcaaaccaaaagcaaagattgttgacgtttgtgagaaaggggattcattcattagagaacaaactggcaatgtgtacaaaaatgccaagaagaagattgaaagaggtgttgcttttccaacttgcatttctgtcaacaacactgtatgtcacttctcacccctttcatccgacgcgacagttttggaagagggcgatatagttaagattgacttagggtgtcatatagacgggtttattgctgtggtcgctcatactcatgtgctccaagaaggtcccgttacaggaagagctgctgatgttattgcagctgctaacactgcagccgaagttgccttaaggctcgtgaggcctggaaaaaagaacaaggatgttacagaagcaattcaaaaggtcgctgcatcttatgactgcagaattgtggaaggtgttcttagccaccagatgaagcagtttgtgattgatgggaacaaggttgtattaagtgttgccaatcctgagacgagggttgatgaagcagaatttgaggagaacgaagtgtattcaatagatattgtaacaagcacaggtgaaggaaagcctaagttgttggatgagaagcagacaactatttataagagagctgtggacaggaactatcatttaaagatgaaagcctctagattcattttcagtgaaataactcagaagtttcctataatgcctttcaccgctagggctttagaagagaaaagggctcggcttggattggtggaatgtgttaaccatgatcttttgcagccataccctgttcttcaagagaagcctggtgattacattgctcatatcaaattcaccgttttgctgatgcctaatggatctgatcgagtcacatctcatcctctgcaagatctgcagcctacaataacgacggatgatcctgaaatcaaggcatggttagcattgggcacgaagacaaagaaaaagggtggtggaaagaagaagaaaggtaagaagggtgataagacagaggaccctacgaatgctgagcctatggataccacagcaaatggcgctgcatctcaagaatgatcagtcaacaacaaccacacccaaccaaaaaaaaaaaaaaaataactcccgtactatctcgtagttagtgtctgtcccgaccctacgtcggtagtagtagtaggtaggtagtaggtggtacggtacgacgaggtagtaaggtaggtaggacgtacgtttacttaggtagttattattatatagtactacttacttttacgtttgtagtcgtcgtacatacttaggtagttttagttagttacttacgactcctactagacgcgaggaggatgtggtccacctagtaagtgtag

SEQ ID NO: 7415 - DNA, 1620 bp, Mimulus guttatus
acctcactcattcacacaacagcccacctcaaacccttattcatcttccacgcctctatcacttgataaaccctaattccattatctgcgattttaattcaaattcgttgaaaccatgtctgatgaggatatggaggagaaggagttggatctcacctctcctgaagtagtcaccaaatacaaatccgctgccgaaattgttaacaaggcacttcagttagtattgtctgaatgtaaaccgaaggccaagattgttgacctttgtgagaaaggagatgtttacatcagagaacattctgggaatatgtacaagaatgtgaagaaaaagatagaaaggggtgttgcattcccaacttgcatatcagttaacaatacagtctgccatttctccccattggccagtgatgagaccgttttggaagatggagatattttgaaaattgatatgggctgtcatatagatggcttcattgctgtagttgcccatacccatgtacttcagcaaggaccagtcacaggcagagcagctgatgttattgctgctgcaaatactgccgctgaggttgccttgaggcttgtgaggccagggaaaaagaacaaggatgtcactgaggcaattcagaaagttgctgctgcttatgactgcaagattgttgaaggggttctaagtcatcaaatgaaacaatttgtgattgatggaaacaaggttgtattaagtgtgtcgggcactgatacaagagttgatgaatcagaatttgaggaaaatgaggtgtattccattgatattgttacaagtactggtgaaggcaagccaaaattattggatgagaaacagacgacaatctataaaagagcagttgacaagaattatcacctaaagatgaaagcatcccgattcatattcagcgagataagtcagaagttcccaatcatgccattttctgcaagggctttggaagagaagcgtgctcgtttgggtctagtagaatgcgtaaatcatgatcttttacagccatatcctgtacttcatgagaagcctggggacctagttgctcatatcaagtttactgtattgctaatgccaaatgggtcggatcgagtcacaactcatcctctacaagagctacaacccacaaaaacagttgatgatccggagattaaagcctggttagcattaggtactaaaacgaagaagaaaggtggtgggaagaaaaagaaaggtaagaaagtggaaaaatccgaggaagcagctgatgctgagcctatggacactggtgcagcttctcaagaatgatgaaaaatcagtttttatttgtatttcaaccatgaaattttggccgataccttgtattgggttttgctgtgagtcgtgaaatgtgaattcttaaaaatactatcagatgcgtcttgtaatattgtacacagctttgttgacttgtgtatttatttagttttagatacaaaaaagaaactaacagctatctaaatggttgatcatcacaattgaaattttagaatcattgaacatatgctttcgcatgacaataaatattcaaacgctggttacaacgattgggtagtagatggttatggatgaaaaaagtgatgccaattttatta

SEQ ID NO: 7416 - DNA, 1488 bp, Valeriana officinalis
gcgactcattttctgtatatataagcaaagcaacacagccgtcctcaaaccctagctctatcactcttaacgtccctttactctcttcttaccataaaccctaccgcatagctcaattcatctactaccaatttccttcaaacttcctggttaagtgaagctctgaaacgatgtctgatgatgaaagggaagagaaggagcttgatctctcctctcctgaagttgtaaccaaatacaagagcgctgctgagattgttaacaaggctttgcagttggtactgtctcaatgcaaaccaaaagcaaaggttgttgacatctgcgagcagggggattcgtttataagagagcaaactggaaatatgtacaagaacgtgaagaagaagatcgagagaggtgttgcattccctacgtgcatatcagtgaacaacaccatttgtcacttctctcctctagccagcgatgatactgttttggaagaaggtgatattttgaagattgatatgggctgtcatatagatggattcattgctgttgtcgcgcacacacatgttcttcaggaaggtccagtgactggtagagcagctgatgttatagctgcggctaacactgctgctgaagtagctttgaggcttgtcaggcctgggaaaaagaacaaagatgttacagaggcaattcagaaggttgctgctgcgtatgattgcaaaattgttgaaggagttcttagccaccagttgaagcagtttgttattgatggaaacaaggttgtgcttagtgtctcgaatcctgatactcgagttgatgatgcagagtttgaggagaacgaagtttatgccattgatatagtcactagtaccggtgatggcaagccaaagttgttggatgagaaacagaccacgatctacaagagagccgtggacaagaattatcacttgaaaatgaaagcatcgagattcatattcagtgagattaatcagaagttcccaatcatgccattcactgctcgagctctggaagagaagagggcaaggcttggtttggtggaatgtgttaatcatgagcttttgcagccatatcccgtgcttcatgagaagtctggtgaccatgttgctcatataaagttcaccgtattgctaatgccaaatggatcagatcgaattacaacccatgctctgcaggaattgcagccaaccaaaaccattgaagacccagaaatcaaagcatggttagctttagccacaaaaaccaagaagaaaggtggcggtaaaaagaagaaaggcaagaagggtgaaaagggggaagaaggcatggatgaagctgcatcttaagaggaagagtatgaatttgtaattttgtcttgtttcttcattgtttatctatctatctatctatctatccaaattttggttttgttggtgcaaacatgtactcggaggtgttttaaaatgttagagatcctaattgatgtgtatgtgcacagaattctctttc

SEQ ID NO: 7417 - DNA, 1569 bp, Valeriana officinalis
gtcgactcattttctgtatataagcaaagcaacacagccgtcctcaaaccctagctctatcactcttaacgtccctttactctctactcaccataaaccctaccgcatagccaaattcatctactaccattttccttaaaacttcctggttatttgaagctctgaaacgatgtctgatgatgaaagggaagagaaggagcttgatctctcctctcctgaagttgtaaccaaatacaagagcgctgctgagattgttaacaaggctttgcagttggtactgtctcaatgcaaaccaaaagcaaaggttgttgacatctgcgagcagggggattcgtatataagagagcaaactggaaatatgtacaagaacgtgaagaagaagatcgagagaggtgttgcattccccacgtgcatatcagtgaacaacaccatttgtcacttctctcccctagccagtgatgatactgttttggaagaaggtgatattttgaagattgatatgggctgtcatatagatggattcattgctgttgtcgcgcacacacatgttcttcaggaaggtccagtgactggtagagcagctgatgttatagctgcggctaacactgctgctgaagtagctttgaggcttgtcaggcctgggaaaaagaacaaagatgttactgaggcaattcagaaggttgctgctgcgtatgattgcaaaattgttgaaggagttcttagccaccagttgaagcagtttgttattgatggaaacaaggttgtgcttagtgtctcgaatcctgatactcgagttgatgatgcagagtttgaggagaacgaagtttatgccattgatatagtcactagtaccggtgatggcaagccaaagttgttggatgagaaacagaccacgatctacaagagagccgtggacaagaattatcacttgaaaatgaaagcatcgagattcatattcagtgagattaatcagaagttcccaatcatgccattcactgctcgagctctggaagagaagagggcaaggcttggtttggtggaatgtgttaatcatgagcttttgcagccatatcccgtgcttcatgagaagtctggtgaccatgttgctcatataaagttcaccgtattgctaatgccaaatggatcagatcgaattacaacccatgctctgcaggaattgcagccaaccaaaaccattgaagacccagaaatcaaagcatggttagctttagccacaaaaaccaagaagaaaggtggcggtaaaaagaagaaaggcaagaagggtgaaaagggggaagaagccatggatgaagcaacggatggtgcatcttaagaggaagagtatgaatttgtaattttgtcttgtttcttcaatgtttatctatctatctatctatccaaattttggttttgttggtgcaaacatgtactcggaggtgttttaaaatgttagagatcctaattgatgtgtatgtgcacagaattctctttctgtattccaattctttcttcaaataccctggtaaatgtctttttactttcaataatataataggaggattgaaattg

SEQ ID NO: 7418 - DNA, 1560 bp, Rosmarinus officinalis
ggtacgaatggttttccttttttcataaattactttagtatcaattctaagaagataaatagcaaaacggatacacaaacggtccagagcattgtacaaaatgagacaaacgcatgtctcaagaacaactgatcaacatttcaccaaaaaccaaccattacagcggaacggccaaaatttcgttgacaaaatacagagcacagacgattgattttctcattcttgagaagttgcgccatttggagcctcttcttccattggctcagcttcagccgggttctctgctttatcacctttcttacctttcttctttttaccaccacctttcttttttgattttgtgcccaatgctaaccaggctttgatctcaggatcatcaattgtttttgtgggctgcagctcctgtagaggatgggaggtgactcgatcagacccgtttggcagcagcaaaacagtgaacttgatgtgtgcgactaggtcaccaggcttctcgtgaagcacaggatatggttgtaagagatcatgatttacacattccactagacccaaacgaacacgcttctcttccaaggcccttgcagagaatggcatgatcgggaacttttggcttatttcactgaatatgaaccgagatgctttcatctttaggagatagtttttgtcaacagcccttttatagatagttgtttgtttctcatcaagtaattttggcttcccttcaccagtacttgtaacaatgtcaatggcataaacctcattttcctcaaattcagcatcgtcaactctggtatcagggcctgtggcacttaatacaaccttgttgccatcaatcacgaattgtttcatttgatgacttagtactccttcaacaatcttgcagtcataagcagcagcaactttttgaatcgcctcactaacatctttattcttctttccaggcctcacaagtctcaaagcaacctcagcagccgtatttgcagcagcaataacatcagctgccctcccggtgaccggcacctgttgaagtacatgggtgtgtgcaactacagcaataaagccatctatgtgacaccccatatcaattttcacaatatccccatcttccaatacagtctcatcaccgttcaatggtgaaaaatggcagactgtattgtttactgatatgcatgttgggaatgcaacacccctttctatcttcttcttcactttcttgtacatgtttcctgtttgctctctgataaatgagtctgctttctcacagaggtcaacaatcttagccttcggtctgcattcaggcaacacaagctgcaacgccttattgacaatttcagcagcggctttgtatttcgtgactacttcagaattgctgagatccaactcctgctcctctctttcttcgtccgacattgtttcgcactttcgcttcaaagaggacatgcaacaacacagaatcgaacggtttcaaggtaaggactaacgcgagaaaagcatgaaagatataatcgtccagaaatttaaattttaccaattgagattctcggaagctatataaggtacaga

SEQ ID NO: 7419 - DNA, 1743 bp, Cocos nucifera
aaggccgctctccatcgcttacggcgctgcctccctggccaggtgtcgtaacgcccaaatctcctctctcagatagccgccctcgacgtaaccgcagaccttgagggagccgttctctcctctttctcgacaaaagaaaccctaatttcagaaaagtttggtccattcgatttctccggggtttagggtttagtgtttagagagatgtcggacgacgaagcgaaggaggaggagctcgatctcacttcacctgacgtcgtcaccaagtacaagagcgcggcagagatcgtcaacaaggctcttcagctggttgtgtccgagtgcaagcccaaggcgaagatcgttgatatctgtgagaaaggcgatgcctttatccgagagcaagcgggaaacatatacaaaaatgtgaagaagaagatagagcggggtttggcattcccaacatgcatctctgtgaataacatcgtgtgccatttttcgcccctggcaggagatgagacggttttggaagagaatgacattgttaaaattgatatgggatgccacatagatgggtttattgcagtagtggcgcacactcatgtcctccgggaagggccggtgacgggaagggctgcagatgtaattgcagctgctaacactgcagcggaagtagcattgaggctagtgaggcctgggaaaaagaataaggatgtcacagaagctattcagaaggtagctgctgcctatgattgcaaaattgttgaaggggttcttagtcatcagctcaaacagtttgtgattgatggaaacaaagtcgttcttagtgtaagcaatcctgaggctagagttgatgaagcagaatttgaggaaaatgaagtatatgcagttgatatagtcaccagcacaggtgaaggcaagcctaaactcttggatgagaagcaaactactatctataagagagctgtggacaaaaactatcacctgaaaatgaagtcatcaagattcatctttagtgaaataaaccagaaatttccaatcatgccatttactgcaagggctttggaagagaaacgagctcggcttggtctagtagaatgtgtaaatcatgagcttttgcaaccatatcctgttttgcacgagaaacctggagatcttgttgctcacattaagtgcacggtgttgctaatgccaaatgggtcagacaggattacctcccatccattggaacagttgcagcctacaaaagccattgataatgatcctgaaattaaagcatggctagctttgggaacaaagacaaaaaagaagggcggaggaaagaagaagaaagggaagaaaggcggagctgacacagctgaaaccgaaccaatggatgcaacatcaaatggtgcccctgcccaagaatgagagtttcggtgctcttttccatttgttgctggtggcccctggaaacggtcagattttcatgcaatttttgtggggcaatgcacaagcgcacagaactcttatgtggaaaatgtttataattttaaaagtgggcaaagcttttgcaagatgatattaattaagttgctaaagctttgggcgtttggatatattaggatggaagagctggatattgagatacaagatgtattttatccatccatgcaaggatggttggaggagtaatgtgaatttggttcttggaaatgcattaaaatctgatgtttttatacattcaacatagtgtatctcgtgtgaaatgaggagtaatccaaa

SEQ ID NO: 7420 - DNA, 1526 bp, Amorphophallus konjac
gcttttgcgtctacacctcgccactttatccacagaccccatctgcactgggagcagttttcctgacctcgaaaccctagaaagcaaggcgttttcttgaggaggtatctaagttagggcagatgtcggacgacgaggcgaaagaggagaaggagttggatctctcctcccccgatgttgttaccaagtacaagaccgctgccgagatcgtcaacaaggctctgcagctagtaatttcggaatgtaagcccaaggccaagattgtcgacctgtgtgagaagggtgatgccttcatcagagagcaaactggcaatgtgtacaaaaatgtgaagaagaagattgagaggggcgtcgcgtttcccacgtgcatctctgtcaacaatacggtgtgccacttctccccacttgggagtgacgaaagtgttctagaagaaaatgacattgtaaaaatagatatgggttgtcacatagacgggtttattgctgtggttgcacacacccacatgcttcaggaaggggctgttactggtagagctgctgatgtaattgcagctgcaaacactgcgggggaagttgcactgaggcttgttagacccgggaagaagaacaaggatgttacagaagctatccagaaagttgctgctgcctatgattgcagaatagttgaaggagtgctaagtcatcagcttaaacagtttgtaattgatggaaacaaggttatattgagtgtgggcaatcctgagacaagggttgatgatgcagagtttgaggagaatgaagtctatgcgattgatattgtcactagtactggtgaaggcaagcctagacttttggacgagaagcaaactacaatctataagagagctgttgataagaactatcatttgaaaatgaagtcctcaaggtttatcttcagcgaaattaatcagaaatttccgattatgccttttactgcgagggctttggaagagaaacgtgctcggctaggacttgtagaatgcgtcaaccatgatcttttgcagccatatcccgttctgcacgagaagcctggtgaccttgttgctcatatcaaatttacagttctattgatgccaaatgggtcagacaggatgacttcccacccgttgcaagagttgaagcctgataagactgtggacaatgatcctgaaattaaggcctggctggctctgggaacaaagacaaagaagaaaggtggaggaaagaagaagaaaggtaagaaaggtgacgacgctaaagacgatttggctgaagcacaacccatggatacgtcttcaaatggagcacagcgaacagagtgatgaacaacagttttgagatcatttcatctacaattttctgtttaggttgttgaaaatctacttgcactaattagccagctttgttgcgagaaatatataaggaaaaaatgcactaagaaagtaatgtaaaagcttcctatggtatcatcttgtcaacttctaataatagagatctaaaaatccagccagactctgagcattgtttga

SEQ ID NO: 7421 - DNA, 1277 bp, Cyclamen graecum
ttccccacaagctccatccatcttcttcactctaaaccctagttttctctctctacctccattgcagttgcagagtgtgatttggagaagaaacgatgtcgtccgatgacgaaagaggggaagagaaggagctcgatctctcctcgcccgaagtcgtcaccaaattcaaatccgcctctgatatcatcaacaaggctctgcagttagtgttgtccgaatgcaaaccaaaagctaagattgtcaatctttgcgagaagggtgattcttttatcacagagcaaactggaaacatgtacaagaatgtgaaaaagaagatagaaaggggtgttgcattcccaacgtgtatatctgtaaacaacactatctgtcacttttccccacttgcaagtgacgagacagtgttggaagaaggcgacatggtaaaaatagatatgggttgtcacatagatggcttcattgctgtagttgcacatactcatatccttcaagacggtccaatcactggtaggaaagctgatgttgttgcagcggccaatactgctgcagaggttgctttgaggcttgttaggccaggaaaaaagaataaagatgtcacggaagcaattcagaaagtagctgctgcctatgattgcaagatagttgaaggtgtccttagtcaccagctgaaacagtttgtaattgatgggaacaaggtcgtattaagtgtctcaaatcccgatacaagagttgatgatgccgaatttgaggaaaatgaagtgtactccattgacatagtgacaagcactggagatggcaagcctaagctcttagatgagaagcaaacgaccatttacaaaagagccgtggataaaagctatcacttaaagatgaaagcctctcggtttatattcagtgaaatcagtcagaaatttcccattatgccatttactgcgagagccttggaagagaagcgggctaggttgggattggtagaatgtgtcaatcatgagttgttgcagccatatcccgtccttcatgagaaacctggagattatgttgctcatatcaaattcactgtgctacttatgccaaatgggtcggaccgcataacatcacatcctttgcaggagcttcaaccaactaaaacaatagatgaccctgaaataaaagcttggttagctatgggcacaaagacaaaaaagaaaggcggtggaaaaaagaagaaaggtaagaagggtgacaaagttgaggagcctgcaggagctgagcctatggatgcagaacctaatgaaggttga

SEQ ID NO: 7422 - DNA, 1591 bp, Platanus occidentalis
aagacttgcagaagacggcttactccattgctactccaataacctaattataatatctaccctctgaaataccgccaaaactcgagttagggggaggattcgaagctttgtgacgatgtcggacgacgaaacgaaggaggagaaggagttggatctcacttctcctgaagtcgtcactaaatataagagtgcagctgagatcgccaacaaggctttgcaactagtattatcagaatgcaaaccaaaggcgaagatcgtagatgtatgtgagaagggcgatgcctttatcagagagcaaactgggaatatgtacaagaatgttaagaagaagatcgagaggggtgttgcattccctacatgcatttcggtaaacaacactgtatgccacttctctccgctcgccagtgatgaggcggtaatggaagaaggtgatatattaaagatcgatatgggttgtcacatagatgggttcattgctgtagtcgcgcacacacatcttcttcaggaaggacctgtgacgggtagggcagctgatgttattgcagctgccaataccgctgctgaggttgctttaaggcttgtgaggccaggaagaaagaataaagaagttacagatgctattcagaaggtcgccgctgcctatgactgcaagatagttgaaggagttctcagtcaccagctaaagcagtttgtgattgatgggaacaaggtcatactgagtgtatccagtcctgagaccagagttgatgatgcagaatttgaggacaatgaggtctatgcaattgatatagtcaccagcacaggtgatggaaagcctaggttgttggatgagaggcaaaccactatttataaaagagctgtggacaagaattatcacttgaagatgaaatcatcaaggttcatcttcagtgaaataaatcagaaattccctatcatgccattttcggcaagggctttggaagagaagagagctcggctgggattagtggaatgtgtgaaccatgatcttttgcagccatatcctgttcttcatgagaagcctggggattttgttgcccatattaaattcacagttttattaatgccaaacgggtcagaccggattacatcccatgcactgcaggagctacggcccacaaagacgatagatgatcctgaaattaaggcctggttatctctgggcacaaagacaaagaagaaaggcggtggaaagaagaagaaaggtaagaagggtgacaaagctgatgagtctgccgaacctgagcttatggaggcaacatcaaatgatgcaccatctcaagattgagatttttcaatggtacttcttttactctgtatttgcttgctgtttcgggagacccttctgctattgagcaactgtattttctatgtatgcgtgcggttattaaagtctgatgcggagatgcacgttttccctgtttttcctaattcatgttttcatgttatcactttgggaaagaaaagaaatgcagagttatttatatatcacccattggaagatttcaataattagaatagattaacattgaatatgttgttgacgttaaaagagagtactggttttcaccac

SEQ ID NO: 7423 - DNA, 1665 bp, Panax ginseng
ctcacatgaaaaaactcgtaaaaatatactagtaacgcgaagctctctcttgctctctatataaagcaaacactgccgactcaaaccctaacacactgaagccacctccctcttcaaaccagtacattactgttgggctaaaaccctagctgcacagttattcctcgatcaatatctgctgatttcaggtctgattcgaaacgatgtcggacgatgaaagggaagagaaggagctggatctctcatctcctgaagttgttaccaaatacaagctcgccgctgagactgttaacaaggctttgcaattagtattgttagaatgcaagccaaaggcaaagattgttgacatttgtgagaaaggggattcattcattagagagcagaccggaaatatgtacaagaatgtgaagaagaagattgagaagggaattgcattcccaacttgtttatctgtaaacaacacagtgtgtcatttctcaccgctagccagtgatgagtctgtgttggaagaaggtgatgttttaaagattgatattggatgtcacatagatggattcattgctgtagttgcacacactcatgttcttcacgaagggaaagtgactgggaaagcagctgatgttattgctgcagcaaacactgctgctgaagttgctttgaggcttgtgaggccaggaaagaagaacaaagatgtgaccgaagcaattcagaaggttgctgctgcctatgactgcaaaattgttgaaggtgttcttggtcatcagctcaagcagtttgtgattgatggaaacaaagttgtactgagtgtctcaaaccctgatacaagagttgatgatgcggagtttgaggagaatgaagtttatgcaattgatatagtgacaagtacaggtgatggaaagcccaagctgttggatgaaaggcaaacaacagtctataaaagagctgtagacaagaactatcacttgaaaatgaaagcatcaaggttcattttcagcgagataagtcagaagttcccaattatgccgtttaccgcaagggctttggaagagaaacgtgctcgcctggggttggtggaatgtgtcaatcatgatctcttgcagccatatcctgttcttcacgagaagcctggtgattatgttgcacatattaaattcactgttttactgatgccgaatggatcagataggatcacttctcatcccttacaagagttggagcccacaaaaactatagatgaccctgaaattaaggcctggttagctttgggcacaaagacaaagaagaaaggtggtgggaagaaaaagaaagctaagaagggtgacaaagttgaggatacagctgagcctatggatgacgcaacgaatggtggtgcaccccaagaatgagaccacttcagtttaaaatctaatttttatttgtattcttgcttttatccaattttgggcttactacaatgtatctggtggtgttgattatgaattctttaagatggtaatcaattttaggtcctaactgggtgtaccagatgtgtgccttataagcctgtacacagttatacagtacctttcttgggtttttgttcttcaattagaaaatttttcaagcaacaattaacataattaagcaccttaaatttggttgaactctgaatagaacaattttggt

SEQ ID NO: 7424 - DNA, 1503 bp, Lippia dulcis
taagtctggcatcttcaaaccctaattcatccctatccaacctgcctctcacacttgctaaaccctgtttgtttcctagactgaggatctctggaaattaatcaatcggttgaagaaatgtcggatgacgagagggaggagagggagttggatctcacctctcccgaagttgtcactaaatacaaatccgccgctgaaattgtcaacaaggctctgcagttagtattatcagaatgcaaaccgaaggctaagattgttgacatttgtgagaaaggagatactttcatcagagaacaaactgcgaatatgtacaagaatgtgaagaagaagatagaaaggggtgttgcattcccaacttgcatatcagtgaacaatgtagtctgccatttttcgccattggccagtgacgagagtgtgttggaagatggagatttgttgaaaattgatatgggctgtcatatagatggctttattgctgtagtaggtcatacacatgtacttcagcaaggaccagttaccggcagggcagctgatgtcattgctgcggcaaatactgctgctgaggttgccttgaggcttgtgaggccagggaaaaagaacaaagatgtcactgaagcaattcagaaagttgcagctgcatacgactgcaagattgttgaaggagtgctgagtcatcaaatgaaacaatttgtcatagatggaaacaaagttgtcttaagtgtttccggccctgatacacgagttgatgatgcagaattcgaggaaaatgaggtgtattccattgacattgtaacaagtaccggagaaggcaagccaaaattgttggatgagaaacagaccacaatctataaaagagctgttgacaagaactatcacctaaagatgaaggcatctcgattcatatttagtgagataagtcagaaattcccaatcatgccattttctgccagggctttggaagagaagcgtgctcgtttgggcctggtagaatgtgtgaatcatgagcttttacagccataccctgttcttcacgagaaacctggcgacttggttgcacacatcaagttcactgtcttgctaatgccaaatgggtccgatagaatcacgagtctttctttgcaggagttgcagcccacaaaaacagttgatgatcctgagatcaaagcctggttatccttgggcacaaagacgaagaagaaaggtggtggaaagaagaagaaaggtaagaagggagagaaatcggaggacgcagccaagcctactaacgaggctggagaaaatgttgcagctccacaagaataaagcatattcttgctcctatctgtattttaaccaagaaattttgtcatggaatgtgaattcttatgcgttatgaacgtgtcttattacacagctttgagggcctttctgtatttattttgttgtttctagatagaaaatgatatttacagttaattttctttaaaaaataacaatttgaatctagaaatcacgttcatgtaa

SEQ ID NO: 7425 - DNA, 1521 bp, Cucurbita pepo
cgtgaatcatttgtttttcaggtagtttacgagtttttgaacctcaaaatttatgtcgtcggacgatgaaagggaggaggtagagttggatctctcctctccggatgttgttacgaagtacaaaaatgctgccgagatcataaacaaggcattgcagctggtgttatccgaatgtaaacctaaagcaaaaatcgttgacgtttgcgaaataggagattcgtttatcagagagcaaactggcaacatgtacaagaatgttaagaagaagatagaacgggcgttgcctttccaacttgcatctctgtaaacaacatagtcggccacttttcacctctggctagcgatcaaacagtgatggaagaaggagatatactcaaaattgatatgggctgtcacattgatgggttcatcgctgtagctgctcatactcatgttctgcaagaaggtccagtcactggaagggctgccgatgtcattgcagcggctaacactgctgccgaagttgccttgagacttgttcggcctggaaaaagaataaagatgtaacagaagcccttcaaaaggtcgctgctgcttatgattgcaaaattgttgaagggtgcttagccaccagttgaagcaatttgtgatcgatggaaacaaggttgttctcagtgtctcaaatccagatacaagagttgatgatgcagagtttgaagagaatgaagtttatgccatagatatagttacaagcacaggtgaaggcaagcctaagctggtcgatgagaagcagacaaccatatataagagagctgtggacaagaactaccacttgaaaatgaaagcatctaggtttattttcagtgaaataagtcagaaattccccattctacctttcactgctagggctttggaagagaaaagaggtaggctgggactagttgaatgtgttaatcatgatctattgcaaccatatcccgtcctccatgaaaagcctggcgattacgtcgcccacattaaatttactgtcttactgatgcctaatggatcggaccgaattacatctcatgcactgcaagaacttcaacctacaaaactattgatgatcctgaaataaaggcctggttagcacttggaacaaagactaagaagaagggtggcgggaagaagaagaaaggtaagaaaggcgacaacaaacccgatgattcaaccgtggctgagccaatggattcaacaacaaatgtgggtgcatcacaggaatgaggtattccttcgggtctgctcttttcccatccatgacttcaattttggcattgttttcttctttttaattgtatgttgatgaggcgtcatataggtttttagacatctaaggaatggtgtgcttaatacttcatgtatcatctacgtatttttattggcaacaacgtacactatttagttcaataaacatgtcttcacttgtaatattattccaaaagttggatggtcgagcaccatttcttctaaatcttattactataaacaacttgtatttctaat

SEQ ID NO: 7426 - DNA, 1643 bp, Musa acuminata
caactaatgccctaagccgccaccgactgtttgtgccggccgcccgaaaccctaaatcttttcttcttctcgttgatttgacgtgaccctcgaagagcccctgtacccgcgcacgcatcgttgtgctttccatctgttttcctcaggtctagggtttcgagagatgtcggacgacgaagcaagggaggagaaggagttggatctcacctcccccgatgtcgtcaccaagtacaagagcgccgctgagatcgtcaataaggcccttcagctggtggtatcggagtgcaaacccaaagccaagatcgttgatctctgcgagaaaggcgacgcttttatcagagagcaaacggggaacatgtacaaaaatgtaaagagaaagattgaaaggggtgtaggcttcccaacatgcgtttctgtcaataatacagtgtgccatttctcaccgctagggagcgacgaggcagttctggaagcgaatgacattgtgaaaattgacatgggatgccatatcgatgggtttattgcggtggtcgcacacactcatgttatccaggaaggacctgtgaccggcagggctgcagatgtgatcgctgctgccaataccgcagcagaagttgccttgcggctcgtgaggcctggaaagaagaataaggacgtcacagaagctattcagaaggtagctgctgcctatgattgcaaaattgttgagggagtgcttagtcatcagttaaaacagtttgtaatcgatgggaacaaagtcataataagtgtaacgaaccctgaaactcgtgttgatgaagtggaattcgaagaaaatgaagtgtacgcaattgatatcgtgactagtacaggtgaaggaaagccgaaactgttggatgagaagcaaactaccatatacaaaagagctgtcgataaaagctatcacttaaaaatgaagtcatcgaggtttattttcagtgaaataagccaaaaattcccaattatgccattttctgcaagggctttagaagagaagcgagctcgacttggacttgttgaatgtgtgaaccatgatcttttacagccataccctgtgttgcatgagaagcctggagatcttgttgcgcacattaagtttacgttactgttgatgcccaatgggtcagacagggttacttctcacccacttcaacagttgcagcctaccaagactatcgatgacaatcctgaaataaaggcatggttggcgttgggaacaaagacaaagaagaaaggtggaggaaagaagaaaaagggcaagaaaggagatggccgtgatgactccgctgacgccgaaccaatggacaccgcatcgaataccgcagttgcttagtctgaccagtgtcttgagttttggtgtactcctattgaatttgttagtgcttccccaagccttccaacctttgcatgaattgtgtgtttgggaaatggaaatccacattattctaattcgaggagaggtaaaggatttttgtactaaaatttcgcaaagcttcggtgaggaggatgtcaaaacaaataaattgtgttgcttcagtcgtggactcatttatgcacaagcatattaccttgtgaagacgagttgtatatgtggctggggctctgttgcagttgcttcagcgggg

SEQ ID NO: 7427 - DNA, 1686 bp, Cichorium intybus
atacataccccttgtcttttggatttaactatttaacaccatataaatgtaaatagttgcacaatgaacgtgaaccaggcaaaaaccctaaaaacagtgcagcctaacatacgacacccagtataaaagcaaaaccgctgccgatcccaaaccctagccccaggtaaacacaaccaccgagccacactttttgtctttgatttatctatccttaaaccctaatccattttctctgcgtattaattccgtttgaagaaagatgtcggatgacgaaagaggggaagagaaggagttggatctttcctcccctgaagttgtaaccaaatacaaatcggcggccgagattgttaacaaggccttgcagttggtattgtcagaatgcaaacccaacgccaagattgttgacatttgtgagaaaggagattcatatatcagagagcaaactgggaatatgtacaagaatgtaaagaagaagattgaaaggggtgttgcatttccaacatgtttgtctgtgaacaacacagtctgccattactctcctcttgcaagcgatgaaacagtcttgaaagaaggcgacatcttgaaaattgacatggggtgtcatattgatggtttcatagctgtggtgggacatacccatgctcttcaggaaggtccagtgacaggaagagcagctgatgtcattgctgctgcaaatactgctgctgaggtggcattaaggcttgtgagacctggaaaaaagaaccaagacgtgacagaagccattcaaaaggtcgctgctgcatacgactgcaaaattgttgaaggcgttctgagtcatcaaatgaagcaatttgtaatcgatggaaacaaagtcgttttaagtgtctcaaaccccgataccagagtcgatgatgctgaatttgaggaaaacgaagtctattcaatcgatatagtcacaagcaccggagacggaaagcctaagttattggacgagaaacagacgactatttacaaaagagccgtcgacaaaaactatcacttgaaaatgaaagcgtcacgtttcatcttcagtgaaatcagtcagaagttcccaatcatgccattttcagctaggtcactggaagagaagcgtgcgcggctaggattggttgagtgtgtgaatcatgagcttttgcagccgtaccctgttcttcatgaaaagcctggtgattttgttgcacatatcaaattcacggttttactcatgccaaatggatcggaccgtatcacatcacattctctacaagagttaaagcccacaaaaacggttgatgaccctgaaattaaagcttggttagctttagctgttaagaccaaaaagaaaggtggtggcaagaagaagaaaggtaagaaaggagaaaagggggaaggtgatgaagcggtggcaatggatgaaacaaacggggaaagttgaaaatttcttgtgtaattttgagtatttgaatcaaattttggttcctccagagttttttcttgaaggatatgatgatgtttctagagaagagagcattttcatttgtggtgttgttttctttgggaaatacaacataaagacgaagtctttcttgaaataacatatttgccatgctgtgtttggaggatcaagtgatctttcttgtgttgtttctgttattaccctgtcgttttgattagtttagtttctct

SEQ ID NO: 7428 - DNA, 1548 bp, Panax ginseng
aacgcaaaaccctaactcaaagtctgtaacgcgaagctcctctatataaagcaagcaaaccctacccacctcaaaccctaaccctacggcttcggagccacctcccccaccactttgataatcgcaatctgaaagattgtgtagattcgaaacgatgtcggacgatgaaagggaagagaaggagttggatctctcctctcctgaagttgttaccaaatacaagctcgccgctaagactgttaacaaggctttgcaattagtattgtcagaatgcaagcctaaggcaaagattgttgaaatttgtgagaaaggggattctttcattagagaacagactgaaaatatgtacaaaaacgtgaagaagaagattgagaagggcattgcgttcccaacttgtttgtctgtaaacaacacagtgtgccatttctcaccactagccagtgataaggctgtgttggaagaaggtgatatcttgaagattgatatgggatgtcacatagatggattcattgccgttgttgcacacactcatgttcttcaggaagggaaagtaactgggaaagcagctgatgttattgccgcagcaaacactgctgctgaagttgctctgaggcttgtgagaccaggaaagaagaacaaagatgtgactgaagcaattcaaaaggttgctgctgcctatgattgcaaaattgttgaaggtgttcttagccatcagctcaagcagtttgtgattgatggaaacaaagttgtactgagtgtctcaaaccctgatacaagagttgatgatgcggagtttgaggagaatgaagtttatgcagttgatatagtcacaagcacaggtgatggaaagcccaaactgttggatgaaaagcagacaacagtctataaaagagccgtggacaagaactatcacttgaaaatgaaagcctcgagattcatattcagggagataagtcataagttcccaattatgccgtttacagctagggttttggaagagaagcgggctcgcctgggactagtggaatgtgtcaatcatgatcttttgcagccatatcctgttcttcatgagaagcccggtgattctgttgcccatattaaattcactgttttgctgatgccgaatgggtcagatcggatcacttctcatcctttacaggagttggagcccaccaaaatcatagatgaccctgaaattaaagcctggttagcattgggtacgaaaacaaagaagaaaggtggtgggaagaaaaagagaggcaagaagggtgacaaaggtgtggattcagcagaagcagagccatgcatcaaccaatggaagtgcgccccaagaatgatgagacaaattttatttttaatcttttgtactttgtttcttatccaattttgggttagtgctactccagtgcatctggttgtggtgttgcgtatgatttctttcagataaagaaatcttctaactgggtgtaccagatgtgcgtagatgcttgccttgtacacagttgattgtttttaatccttttgctttctggtcttcaaataggaaaa

SEQ ID NO: 7429 - DNA, 1558 bp, Rosmarinus officinalis
gattacacacctcacagccgacttcaaaccctaccctcctctctctaacacggcccctcttaacttattttaaaccctaattctgtaccttatatagcttccgagaatctcaattgcgaaagtgcgaaacaatgtcggacgaagaaagagaggagcaggagttggatctcagcaattctgaagtagtcacgaaatacaaagccgctgctgaaattgtcaataaggcgttgcagcttgtgttgcctgaatgcagaccgaaggctaagattgttgacctctgtgagaaagcagactcatttatcagagagcaaacaggaaacatgtacaagaaagtgaagaagaagatagaaaggggtgttgcattcccaacatgcatatccgtaaacaatacagtctgctatttttcaccattgaacggtgatgagactgcattggaagatggggatattgtgaaaatcgatatggggtgtcacatagatggctttattgctgtagttgcacacacccatgtacttcaacaggtgccggtcaccgggagggcagctgatgttattgctgctgcaaatacggctgctgaggttgctttgagacttgtgaggcctggaaagaagaataaagatgttagtgaggcgattcaaaaagttgctgctgcttatgactgcaagattgttgaaggagtactaagtcatcaaatgaaacaattcgtgattgatggcaacaaggttgtattaagtgccacaggccctgataccagagttgacgatgctgaatttgaggaaaatgaggtttatgccattgacattgttacaagtactggtgaagggaagccaaaattacttgatgagaaacaaacaactatctataaaagggctgttgacaaaaactatctcctaaagatgaaagcatctcggttcatattcagtgaaataagccaaaagttcccgatcatgccattctctgcaagggccttggaagagaagcgtgttcgtttgggtctagtggaatgtgtatatcatgacctcttacaaccatatcctgtgcttcacgagaagcctggtgacctagtcgcacacatcaagttcactgttttgctgctgccaaacgggtctgatcgagtcacctcccatcctctacaggagctgcagcccacaaaaacaattgatgatcctgagatcaaagcctggttagcattgggcacgaaatcgaggaagaaaggtggagggaaaaagaagaaaggtaagaagggtgataaagcagagaacacggctgaagctgagccaatggaagaggaggctccaaacggtgcaacttctcaagaatgagaaagtccctcttctatgctctgtactttgtgaacgaaattttggccgctccgttgtaatgggtgctttttggtggaatgtcgatcgttgttcttgagacttgcgtttgtctcattttgtccggaccgtttgtgtatccatttttctatttttggatttagaattgataatttatgaaaagaagaaaacttgtccgaccaccttcgatgcacaatttctttccgtttttgtccgac

SEQ ID NO: 7430 - DNA, 1499 bp, Elaeis guineensis
gggtttagagagatgtcggacgacgaagcgaaggaggaggagctcgatctcacttcgcccgacgtcgtcaccaagtacaagagcgcggccgatatcgtcagcaaggctctccaactggctgtgtctgagtgcaagcccaaggcgaagatcgtagatatttgtgagaaaggcgatgcgtttatcagagagcaagcgggaaacatatacaaaaatgtgaagaagaagatagagaggggtttggcattcccaacgtgcatctctgtgaataacatcgtgtgccatttctcgcctctggcaggagatgagacggttttggaggagaatgacattgttaaaattgatatgggatgccacatagatgggtttattgcagtagtggcgcacactcatgtcctccaggaagggccggtgacgggaagggctgcagatgtaattgcagctgctaacactgcagcggaagtagcattgaggcttgtgaggcctgggaaaaagaataaggatgtcacagaagcaattcaaaaggtagctgctgcctatgattgcaaaattgttgaaggagttcttagtcatcagctcaaacagtttgtgatcgatggaaacaaagtcgttcttagtgtaagcaaccctgaggctagagttgatgaagcagaatttgaggaaaatgaagtatatgcagttgatatagtcaccagcacaggtgaaggcaagcctaaactcttggatgagaagcaaactactatttataagagagctgtggacaaaaactatcacctgaaaatgaagtcatcaagattcatctttagtgaaataaaccagaaatttccaatcatgccatttactgcaagggctttggaagagaaacgagctcggcttggtctagtagaatgtgtaaatcatgagcttttgcaaccataccctgttttgcacgagaaacttggagatcttgttgctcacattaagttcacggtgttgctaatgccaaatgggtcagacaggattacctcccatccattgcaacagtcgcagcctacaaaaaccattgataatgatcctgaaattaaggcatggctagctttgggaacaaagaccaaaaagaagggtggaggaaagaagaagagagggaagaaaggcggagctgacgcagctgaaactgaaccaatggatgcaacatcaaatggtgcccctgcccaagaataagagttttggtgctcttttccatttgttgctggtggttcctggaaacattcagattttcatgcaatttttgtttggcaaagcacaagcgcacagaaattttatggggaaaatatttataattttagaagtggttaaagcttttgcaagatggtattaaggcaactaaatttgttaagttgctaaagctttgggcatttgggtgtatcaggatggaagagctggatattgaaatacaagatgtattttatccacccatgcaaggatgcttggaggagttgatgtgaatttggttcttggaaatg

SEQ ID NO: 7431 - DNA, 1567 bp, Vinca minor
gaactcgtatttcggtaatttatctcgaagaattcgttgaagttttcgattcagtacgatgtcagatgatgagagggaggaggagagggagttggatctcacctcttctgaagtcgtcactaaatacaagagcgccgccgagattgttaacagggcattacaattggtagtatcacaatgtaaaccgaaagttaagattgtcgatgtttgtgagaaaggcgatgcttttattcgcgagcaaactgggaatatgtataagaatgcgaagaaaaagattgaaaggggtgtagcgttcccgacttgcgtctctgtgaacaacacggtttgccatttttcaccacttgccagtgatgaaactgttttccaagaaggtgatatagtgaaaattgacatgggctgccacatagatggtttcattgctgtggttgcacacacacatgtccttcaagaagggccggtcaccggcagagctgctgatgttattgcagctgccaatactgctgcagaagttgctttgaggcttgttaggccagggaaaaagaacaaagatgtgactgaagcagttcagaaagttgccgctgcttatgattgtaagattgtggacggtgttcttagtcatcagatgaaacagtttgttattgatgggaacaaggtcatattgagtgttaccaatcctgatacaagagttgatgatgctgagtttgaagagaatgaagtttattccgttgatatagtaacaagcaccggagaaggcaagcccaaattgcttgatgaaaaacagactaccatctataaaagagctgtagataagagttatcacctgaagatgaaagcttctaggttcatattcagtgagataagtcagaaattcccaatcatgccatttacagccagggcattggaagaaaagcgggctcgtctaggacttgtagaatgtgtcaatcatgaacttctgcagccatatcctgtacttcatgagaagcctggtgatttggtggcacatatcaaattcactgtgttgctaatgcctaatgggtcagatcgcattacatcccattctctacaggaaattcagccaactaaaacagtagatgaccctgagattaaaggatggttatccctgggaacaaagacaaaaaagaagggtggtgggaagaagaagcaaggtaagaagggagataaaactgaggcgtcagctgatgctgagcctatggatgttgctacaaatgatgccgaatcccaagaatgagatgcttgtgtatgtcttttgctggccagttttggtaactctgtatctggttgcttgagttgtcttggtgattattggtcattgtagacctaatggtagctgctgaaatgtacacaaggtgaaccttgtatcatttttgttttaaatagagagtaaatttattagactccttgatttacaacaaccttcgtagaccaattaaccacagaattccaggatggaagtttacatatctttcttctaaatccgagtttcggttctcctcgtgaaatatctttgtagaatccattaattccatgttatgtccactattgttgt

SEQ ID NO: 7432 - DNA, 1473 bp, Arnica chamissonis
gaaatacagtctctactcctttttcgtttctttagaccaaaatcacgcctgtcaatcgtttaattcattgttgatttggttgtgaagaatcatgtcggacgatgaacgaggggaagagaaggagctggatctttcctctccagaagttgtaaccaaatacaaatcggccgctgagattgttaacaaggccttgcagttggtcttgtcggaatgcaaacctaaagccaagattgttgatatatgtgagaagggggattcctacatcagagagcaaactgggagtatgtacaagaatgttaagaagaagattgaaaggggtgttgcattcccaacatgtttgtctgtgaacaacacggtctgtcatttctctccccttgccagtgatgaaacagtattggaagaaggtgacattttgaaaattgatatggggtgtcatattgatggtttcattgctgtggtgggacacacgcacgttcttcagcaagggcctgtaacaggtagagcagctgatgctattgcagctgcaaatactgctgctgaggttgccttaagacttgtgaagcctggaaaaaagaaccaagatgtaaccaaagccattcaagaggttgctgctgcgtatgactgcaagattgtggaaggcgttcttagccatcaattgaaacaatttgtgattgacgggaacaaggttgtattgagtgtctcaaatcccgatacaagagttgatgatgctgagtttgaagaaaatgaagtttatgcaattgatatagtcaccagcacaggagatggaaagccaaaattgttggatgaaaaacagacgacaatatataaaagagcagtcgacaagagttatcacttgaaaatgaaagcatctcggtttatatttagtgagatcagtcagaattttcccatcatgcccttttcagctagggctttggaagagaagcgtgctcggttaggattggtggaatgtgttaaccatgagctcttgcagccataccctgttcttcatgagaaacctggtgattttgtggcgcatatcaagttcacggttcttcttatgccaaatgggcctgaccgcataacgtctcatggacttcaggagttgcagccaactaaaacggttgatgaccctgaaatcaaagcgtggttgtctcttcccgtaaagaccaaaaagaaaggcggtgggaagaagaagaaaggtaagcgagctgaaaaaggcgacggggaggcggaggcggaggcgatggaagaaacatgaaagggttgttgtgatgaaatccaattttggttttcttctgttttgtatggtgtcaagaagagtgtgttgaatgaccttgtaccgtctctgaagatgtgtctaaaagcatgtgttgattcataacctttctcttacataaagttgaagtagaaaaggtgtcttgtgatcttggattaggacacccaaataccctttctgtctatgtcaatcacttt

SEQ ID NO: 7433 - DNA, 1705 bp, Vaccinium corymbosum
aaaaacagagagtctgtaacgcgaatcctccgtgtataaatacaaaaacagcaaaccctcaaacccttaaacttggtgagttgagccaccactcatacgccgcatccaacaccccttgttacacaaaatctcgactggtgaaaaccctagcccagcgatttcttcctctgaaatttctcggttgtagggaattatcttgaagcgatgtcggacgaagaaagggaggagaaggagttggatctctcgtctcctgaagttgtcaccaaatacaagagcgctgctgagatcgttaacaaggccttgcaattggtactgtcagaatgtaaaccgaaggctaaaattgttgatatctgcgaaaaaggcgattcctttatcagagaacaatctggcaatatgtataaaaacgtcaagaagaagattgaaagaggcgttgcattccccacatgtatgtctgttaacaacactgtttgccatttctctccgcttgccagtgatgagactgtgttggaagaaggtgatatattgaagattgatatggggtgtcacatagatggtttcattgctgttgttgcacatacccatgtgcttcaggaaggaccagtgactggtaggcaagctgatgttattgctgcagcaaatactgccgctgaggttgcattgaggcttgtcaggccgggaagaaagaataaagatgtaacagaagcaattcagaaggttgctgctgcctatgactgcaaaattgtagaaggtgtcctcagtcaccagttaaaacagtttgtgattgatggaaacaaggttgtgctgagtatttcaaatcctgagacaagagttgatgatgcggagtttgaggagaatgaagtttacgcgattgacatagtcacgagcacaggtgaaggcaagcccaagctattagatgagaaacagacgactatatacaaaagagctgttgacaagaactatcacttgaagatgaaagcatctaggttcatattcagtgagatcagccagaaatttcctatcatgccgtttacagcaagggctttggaagagaaacgtgctcggttgggattgttagaatgtgttaaccatgatttgttacaaccataccctgttcttcacgagaagcctggtgattatgttgcccatatcaaattcactgttttgctaatgccaaatgggtcagatcggattacatctcatcctcttcaggatctccaacccagcaaaacaattgatgaccctgaaatcaaagcttggttagctttgggaacaaaaacaaagaagaaaggtggagggaagaagaagaaaggtaagaaaaggtgacaaacctgaggattcaacggaagctgagccgatggacgaatctcgagaatgatagttcaagttttcgatattcagttccttctttaattaatcaattttgaggacttctttgtatctgtttgcttatgagttcatttcggtggtcgttagatgttgatcatcatcctaactgggctatatttgtcagttgcatgtacacaaggttgagccttttttgtatctttgtgttctctaaatacaaaagattgttttgaaaggcagtccgagtttaatccgaatgcaagttgtcatatttgaaccaggccaattacctggttataaacgaattagcttatttgaaccaggccaattacctggttataaacgaattagctgcttgccg

SEQ ID NO: 7434 - DNA, 1498 bp, Panax ginseng
acctcaaaccctaaccctacggctacggagccacctcccccaccactttgataatcgcaatctgaaagattgtgtagattcgaaacgatgtcggacgatgaaagggaagagaaggagttggatctctcctctcctgaagttgttaccaaatacaagctcgccgctaagactgttaacaaggctttgcaattagtattgtcagaatgcaagcctaaggcaaagattgttgaaatttgtgagaaaggggattctttcattagagaacagactgaaaatatgtacaaaaacgtgaagaagaagattgagaagggcattgcgttcccaacttgtttatctgtaaacaacacagtgtgtcatttctcaccactagccagtaataaggctgtgttggaagaaggtgatatcttgaagattgatatgggatgtcacatagatggattcattgccgttgttgcacacactcatgttcttcaggaagggaaagtaactgggaaagcagctgatgttattgccgcagcaaacactgctgctgaagttgctctgaggcttgtgagaccaggaaagaagaacaaagatgtgactgaagcaattcaaaaggttgctgctgcctatgattgcaaaattgttgaaggtgttcttagccatcagctcaagcagtttgtgattgatggaaacaaagttgtactgagtgtctcaaaccctgatacaagagttgatgatgcggagtttgaggagaatgaagtttatgcagttgatatagtcacaagcacaggtgatggaaagcccaaactgttggatgaaaagctgacaacagtctataaaagagccgtggacaagaactatcacttgaaaatgaaagcctcgagattcatattcagggagataagtcataagttcccaattatgccgtttacagctagggttttggaagagaagcgggctcgcctgggactagtggaatgtgtcaatcatgatcttttgcagccatatcctgttcttcatgagaagcccggtgattctgttgcccatattaaattcactgttttgctgatgccgaatgggtcagatcggatcacttctcatcctttacaggagttggagcccaccaaaatcatagatgaccctgaaattaaagcctggttagcattgggcacgaaaacaaagaagaaaggtgatgggaagaaaaagaaaggcaagaagggtgacaaaggtgtggattcagcagaagcagaacctatggatgcatcaaccaatggaagtgcgtcccaagaatgactagacaatttttatttttaatcttctgtactttgtttcttatccaattttgggttactgctactccagtgcatctggttgtggtgttgcgtataatttcttttagataaagaaatcttctaactgggtgtaccagatgtgcgtagatgcttgccttgtacacagttgattatttttaatcctcttgttttctggtcttcaaataggaaaaatatatttaaac

SEQ ID NO: 7435 - DNA, 1480 bp, Rhizophora mangle
attacataggatagtacttggtgtctttcccctttctcatattctgctaaaccctacaaccctcgccttctgtccatcgccgtcagtcccctttctgattctcccggggggcccctgttattgatttaataggagtggaggcgttgttggaactgcgaaatgatgtcggacgacgaaagggaggagaaggagttggatctcacttctcatgaagttgtcaccaaatacaaaaccgctgctgagatcgtcaatagggcattgcagttagtgatatctgaatgcaaatcaaaggctaaaattgttgatgtgtgtgagaaaggagacacatttatcaaagagcaaaccagtaatgtgtacaagaatgtgaagaggaagattgaaaggggaattgccttccctacctgcatttctgtaaacaacactgtctgccatttttctccgcttgcaagtgatgagatggtattggaagaaggagacattgttaagattgatatgggatgtcacatagatgggttcattgctgtggtaggacatacgcatgttcttcaggaagggccagttactggcagggctgctgacattattgctgcaacaaatacagctgccgaggttgccttaaggcttgtcaggccagggaggaagaacaaagatgtgactgaagcaattcagaaagttgccactgcttatgactgcaaaattgttgaaggtgtccttagccaccagatgaagcaatttgtgattgatgggaacaaggtcatactgagtgtctccaatccagaaacacgagttgatgatgcagagtttgaggagaatgaagtgtatgcaatagatattgtcacgagtacaggtgatggaaagcctaagatgctggatgagaagaatacgactatttacaagagagctgtggacaagaactatcacttgaaaatgaaggcctccagatttattttcagcgaaattaatcagaaattccctatcatgccattcactgcaagggctttggaagaaaaaagggctcggctgggattaatagaatgtgtgaatcatgatcttctacagccatatcctgttctgcacgagaagcctggcgatttagttgctcacatcaaattcactgtattgctcatgccaaatgggtcagataggatcacttcacatcctctacaggagttgcaggccacaaagacattagatgatcctgaaatcaaggcctggttggcattgggtacaaaaaagaagaaaggtggtggaaagaagaagaaaggaaagaagggtgacaaaggtgaggagtcaacagatgctgagcccatggctgcaacccccaacggggctgcatcccaagaatgagaccttatatattctcatttagctcagttttgttacttccctcacctccttgtatctggttggttatgagatgatttatatagtgtctagacattgatccatattggaatttttctgcatgattctcatgaac

SEQ ID NO: 7436 - DNA, 1322 bp, Vinca minor
tcacctctatatcataaaccctaattcctctctctctccataaaaacctctagctccatcacattcgtttcccaattccatctccggagcttgtttgtggtaaggaagtttgaattcagttcggtgagatgtcggatgatgagagggaagaggagagggagttggatctcacctcttctgaagtcgtaactaaatacaagagcgccgctgagattgttaacaagggactacagttggtagtatcagaatgcaagccgaaagctaagattgttgatgtttgtgagaaaggcgatgcatttatccgcgagcaaactgggaatgtgtataagaattaaagaagaagattgagaggggcgtagcgttccccacttgcatctctgtaaacaacaccatctgccatttttcaccacttgccagtgatgaaactgttttccaagaaggtgatatcgtgaaaattgatatggggtgccacatagatggattcattgccgtagttgcacacacgcatgtccttcaagaagggccagtcaaaggcagagctgctgatgttattgcagctgccaatactgctgcagaagttgctttgaggcttgttagaccaggaaaaaagaacaaagatgtgactgaagcagttcagaaagttgctgctgcttatgattgtaagattgtcgaaggtgttcttagtcatcagatgaaacagtttgttattgatgggaacaaagtcatattgagtgttactaatcctgatactagagttgatgataccgaatttgaagagaatgaagtttattcagttgatatagtaacaagcaccggcgaaggcaagccaaaattgttggatgaaaagcagaccacaatatataaaagagctgtagataagagttatcacctgaagatgaaagcttctaggttcatatttagtgagataggccagaaattcccaatcatgccgtttacagccagagcattggaagaaaagcgggctcgtctggggcttgtagaatgtgtcaatcatgaacttctgcagccatatcccgtgcttcatgagaaacctggtgatttagtggcacatatcaaattcactgtgttgctaatgccaaatgggtcggatcgcattacatcccattctctacaagaaatacagcccactaagacagtagatgaccctgagattaaaggatggttatccttgggaacaaagacaaaaagaaggtggtggaaagaagaaaaaggtaagaaggggagaaactgagcgtcagctgatgccgagcctatggatgttgctacaaatggtgctgaatcccaagaatgagatattcgta

SEQ ID NO: 7437 - DNA, 1404 bp, Centaurea maculosa
tcttcaacttctctcattcaaaatctttttctccaatccttaaaccctaatcttattaactttctgaaatatgtcggacgacgaaagaggggaagagaaggagttggatctttcctcttctgaagttgtaacgaaatacaaatcggccgctgagattgttaacaaggccttgcagttggttttgtcagaatgcaaacccaacaccaagattgttgacatttgtgagaaaggagactcatatatcagagagcaaactgcgagtatgtacaagaatgtgaaaaagaagatcgaaaggggtgtcgcattcccgacatgtttgtctgtgaacaacacggtctgccatttctcccctcttgccagcgatgagacggtcttgaaagaaggtgacattttgaaaattgatatggggtgtcatatagatggtttcatagctgtggtggggcacactcatgttcttcagcaaggtccagtgacaggaagagcagctgatgttattgctgctgcaaatactgctgctgaggttgccttgaggctcgtgagacctgggaagaagaaccaagacgtgacagaagccattcaaaaggttgcagctgcatatgactgcaaaattgtcgaaggtgttcttagtcatcaactgaagcaattcgtgattgacggaaacaaagtcgttttaagtgtcgcaaatcccgacaccagagttgacgatgccgagtttgaggagaatgaagtttatgcaatcgatattgttgcaagcactggagacggcaagccaaagttgttggatgagaaacagaccacaatatacaagagagctgttgacaagaattatcacttgaaaatgaaggcatcccgtttcatattcagcgagatcaatcagaagtttccaatcatgccattctcggccagggctctggaagagaagcgtgctcggctaggattggttgaatgtgttaatcacgagcttttgcagccataccctgttcttcacgaaaagcctggtgattttgttgcacatatcaaattcacggttcttctaatgccaaatggatccgatcgcatcacgtcacatactctgcaggagttgcagcctactaaaaccgttgacgacccagaaatcaaagcttggttagctctagctgtcaagagcaagaagaagggtggtggcaagaaaaagaaaggcaagaaaggtgaaaaaggtgaaggcgatgaagcggtggcaatggacgaaacaacaaatggtggcaaccaagggtgaagatccgaacgaatatttcttgtgtaattttgacgatttcgaatcaaattttggttccaaccttgttgcatgagagattttgtaggggttttttttattcctcgaagaatgtttgtttctacatgagagagagaacatgtacacaactt

SEQ ID NO: 7438 - DNA, 1766 bp, Cichorium intybus
atacataccccttgtcttttggatttaactatttaacaccatataaatgtaaatagttgcacaatgaacgtgaaccaggcaaaaaccctaaaaacagtgcagcctaacatacgacacccagtataaaagcaaaaccgctgccgatcccaaaccctagccccaggtaaacacaaccaccgagccacactttttgtctttgatttatctatccttaaaccctaatccattttctctgcgtattaattccgtttgaagaaagatgtcggatgatgaaagaggggaagagaaggagttggatctttcctcccctgaagttgtaaccaaatacaaatcggcggccgagattgttaacaaggccttgcagttggtattgtcagaatgcaaacccaacgccaagattgttgacatttgtgagaaaggagattcatatatcagagagcaaactgggaatatgtacaagaatgtaaagaagaagattgaaaggggtgttgcatttcccacatgtttgtctgtgaacaacacagtctgccattactcccctcttgcaagtgatgagacagtcttgaaagaaggtgacatgttgaaaattgacatggggtgtcatattgatggtttcatagctgtggtgggacatacccatgctcttcaggaaggtccagttacaggaagagcagctgatgtcattgctgctgcaaacactgctgctgaggtggcattaaggcttgtgagacctggaaaaaagaaccaagacgtgacagaagccattcaaaaggtcgctgctgcatacgactgcaaaattgttgaaggcgtgctgagtcatcaaatgaagcaatttgtgattgatggaaataaagtcgttttaagtgtcgcaaaccccgataccagagtcgatgatgctgaatttgaggaaaacgaagtctattctatcgatatagtcacaagcaccggagacggaaagcctaagttattggacgagaaacagactactatttacaaaagagccgtcgacaaaaactatcacttgaaaatgaaagcgtcacgtttcatcttcagtgaaatcagtcagaagttcccaatcatgccattttcagctaggtcactggaagagaagcgtgcgcgacttggattggttgagtgtgtgaatcatgagcttttgcagccgtaccctgttcttcatgaaaagcctggtgattttgttgcacatatcaaattcacggttttactcatgccaaatggatcggaccgtatcacatcgcattctctacaagagttaaagcccacaaaaaccgttgatgaccctgaaattaaagcttggttagctttagctgttaagaccaaaaagaaaggtggtggcaagaaaaagaaaggtaagaaaggagaaaagggggaaggtgatgaagcggtggctatggatgaaacaaatggtgaaagttgaaaatttcttgtgtaattttgagtatttgaatcaaattttggttcctccagagttttttcttgaaggatatgatgatgtttctagagaagagagcattttcatttgtggtgttgttttctttgggaaatacaacataaagacgaagtctttcttgaaataacatatttgccatgctgtgttggaggatcaagtgatctttcttgtgttgtttctgttattatcgtgtcgttttgattagttaaatttctctgtttctataatgttacgcaaatcttttgccaaggtacatattttcgaattgattatatggaaccggatacttttttggccg

SEQ ID NO: 7439 - DNA, 1316 bp, Cirsium arvense
tcttattaactttctgaaatatgtcggacgatgaaagaggggaagagaaggagttggatctttcctcttctgaagttgtaacgaaatacaaatcggccgctgagattgttaacaaggccttgcagttggttttgtcagaatgcaaacccaacaccaagattgttgacatttgcgagaaaggagactcgtatatcagagagcaaactgcgagtatgtacaagaatgtgaaaaagaagatcgaaaggggtgtcgcattcccaacatgtttgtctgtgaacaacacagtctgccatttctcccctcttgccagcgatgagacggtcttgaaagaaggtgacattttgaaaattgatatggggtgtcatatagatggtttcatagctgtggtggggcacactcatgttcttcagcaaggtccagtgacaggaagagcagctgatgttattgcggctgcaaatactgctgctgaggttgctttgaggcttgtgagacctggaaagaagaaccaagacgtgacagaagccattcaaaaggttgcagctgcatatgactgcaaaattgtcgaaggtgttcttagtcatcaactgaagcaattcgtgattgacggaaacaaagtcgttttaagtgttgcaaatcccgacaccagagttgacgatgccgagtttgaggagaatgaagtttatgcaatcgatattgttgcaagcactggagacggcaagccaaagttgttggatgagaaacagaccacaatttacaagagagctgttgacaagaattatcacttgaaaatgaaggcatcccgtttcatattcagcgagatcaatcagaagtttccaatcatgccattctcggccagggctctggaagagaagcgtgctcggctaggattggttgaatgtgttaatcacgagcttttgcagccataccctgttcttcacgaaaagcctggtgattttgttgcacatatcaaattcacggttcttctaatgccaaatggatccgatcgcatcacgtcacatactctgcaggagttgcagcctactaaaaccgtcgacgacccagaaatcaaagcttggttagctctagctgtgaagagcaagaagaagggtggtggcaagaaaaagaaaggcaagaaaggcgaaaaaggtgaaggcgatgaagccgtggcaatggacgaaacaacaaatggtggcaaccaagggtgaagatccgaatgaatatttcttgtgtaattttgacgatttcgaatcaaattttggttccaaccttgttgcatgagagagttttgtaggggtttttttattctcgaaggatgt

SEQ ID NO: 7440 - DNA, 1457 bp, Flaveria ramosissima
ctttcctttttcatttcattaaaccctaattacctaaatcctctaatttctttatccttttgcttctgaagaaacatgtccgacgacgaacgagtggaagagaaggagctcgatctttcctctcccgaagttgtaaccaaatacaaatccgcagctgagattgttaacaaggccttgcagttggtcttgtcagaatgcaaacccaaagccaagattgttgatatatgtgagaagggagattcatacattagagagcaaactgggagtatgtacaagaatgttaagaagaagattgaaaggggtgttgcatttccaacatgtttgtcagtgaacaacacagtctgtcatttctctccccttgccagtgatgaaacagtattggaagaaggtgacatattgaaaattgatatggggtgccatattgatggtttcattgctgtggtggctcacacacatgtgcttcagcaagggcctgtaacaggtcgagcagctgatgtcattgcagctgcaaatactgcagctgaggttgctttaagacttgtgaagcctggaaagaagaaccaagatgtgacaaaagccattcaagaggttgctgctgcttacgactgcaaaattgtggaaggtgttcttagccatcaattgaaacaatttgtgattgatgggaacaaagttgtattgagtgtctcaaatcctgaaacaagagtcgatgatgctgagtttgaggaaaatgaagtttatgcaattgatatagttaccagcacaggagagggcaagccaaaattgttggatgaaaaacagacgacgatctataaacgagcagttgacaagagttatcacttgaaaatgaaagcatctcggtttatattcagtgagatcagtcagaattttccaatcatgccattttcagctagggctttggaagagaagcgtgctcggttaggattggtggaatgtgttaaccatgagcttttgcagccataccctgttcttcatgaaaagcctggtgattttgtggcacatatcaaattcacggttcttttgatgccaaatgggtctgaccggataacgtctcatggactccaggagttgcagccgactaaaacggttgatgaccatcctgaaatcaaagggtggttatcccttcctgtaaagatcaaaaagaaaggtggtgggaaaaagaagaaaggtaagcgagttgaaaagggtgaaggcgaggcggaggtagagcccatggaagaaacatgaagtggtggtgccattaaattcaattttggtttcttcccttttgtatggtgtcaaggagtttgttgagtcaaatttatgtctgtctaaaagcatgtgttgattcataacctttttcttacataaagctcaggtagaaaaggagtctctgggcttctcttttaagtattgttaaaacttggtttatgttgttacctgtttaagttatgtagtta

SEQ ID NO: 7441 - DNA, 1581 bp, Gossypium raimondii
aaacgctgccgtaaagaaccgtaaccctaactctctacttcactactcaccacccgcccttcctattttagtttatatactccctccaaaaccctagcgctttcactcgccgccgccaatttcaaccaatagattcttgataagactcgaaagcgatgtcagacgacgagagagaggagaaggagctggatctcagctcctctgaagttgttacaaaatacaagggcgctgctgagattgttaacaaagcgttacaattagttgtaaaagaatgtaagcccaaagctaagattgttgacatttgtgagaagggtgatgcatttataagagagcaaacaggtaacatgtacaagaattctaagaagaagattgagaggggtgttgccttccctacttgtctctctgtaaacaacacagtctgccatttctctccacttgctagtgacacctcggagttggaagaaggtgatatggtcaagattgacatgggttgccacattgatgggtttattgcggtagttgctcatactcatgttgttcagagcgggccaatcactggtaagcaggctgatgttgttgctgctgcaaatactgctgctgaagtggccttgaggcttgtaaggcctggaaaaaagaacaaagatgtatctgatgcaattcagaaggtagctgcagcttatgattgcaaaattgttgaaggtgttcttagccatcaactgaagcagtttgtgatagacgggaacaaagtcatactaagcgtctccaatccagatacaagagttgatgatgcagagtttgaggagaatgaagtttatgctgtagatatagttgcaagcactggtgaaggcaagccaaagttgttggatgagaagcagacaactatttataagagagctgtcgacaagaactatcatttaaagatgaaggcctctagatttattttcagcgagataaatcagagattccccatcctgccattcaccgctcgtgccttggaagagaaaagggctcgtctaggtttagttgaatgtgtgaatcacgatctcttgcagccataccctgttctctatgagaagcctggtgattatgttgctcatatcaaatttacagtattgctaatgccaaatggatcagatcggattacatcccatcccctgcaagaactgcagccaaccaagacgatagatgatcccgaaatcaaggcctggttggctttgggaacaaagacaaagaagaaaggtggtgggaagaagaagaaaggtaagaagggtgataaagctgagggtggagccgagggtgaggccatggatgcatcgacaaatggtggtgcatcataaggaaacaataataaaaatgtttttgcgcatattttctaatctgcccttttatatattatgatgattgccaaaatttttgatactgtgttcacttgtagcttgttggttatgagttcaaattttaatatcgagtagttttttttattttatggcatgacatccacttggagtcttgtgtttgtgtgtgatgtgcaacttaataggaaattaaatgtgcttcatttctctatcgtctgcttatttt

SEQ ID NO: 7442 - DNA, 1572 bp, Vitis vinifera
caaacccatatatacccagagtgacttgaaagaatcagaagtcaaggcctccccatctctttaaaccctagctcaaccctacccttttgatcctttcctttgcttttgtccattcttcgaattacttggttcttgggtatttgtagctttggtgaatatgtcggacgatgaacgagaagagagagagttggatctcacctcgcctgaggttgttaccaagtataaaaccgctgctgaaattgtcaacaaggccttgcaggtggtgctgtcggaatgcaaaccgaaagccaagattgtagacgtatgcgaaaagggcgatgcattcatcagagagcaaactgggaatgtgtacaaaaatgtcaagaagaagatcgagaggggtgttgcatttccgacttgcatttcagtaaacaacactgtttgtcacttctcaccactgtcaagtgatgagacattgttggaagcaggtgatatattaaagatcgatatgggatgtcacatagatgggtttattgcagtagtagcccatactcatgttctccaagatgggccagtgacaggtagagcagctgatgttattgcagcagcaaacactgctgctgaagttgcattgagacttctgaggcctggaaggaagaacaaggaagtaacagatgctattcagaaggtggctgctgcctatgactgcaagattgttgaaggtgttctcagtcaccaactaaaacagtttgtgattgatgggaacaaggttgtattgagtgtgcccagtggtgaaacccgagttgatgatgcagaatttgaagagaatgaagtttatgcagttgatatagtcatcagctctggtgatggaaaacctaggctgttggatgagcggcaaacaaccatatataaaagagcagtggacaaaaattatcacttgaaaatgaagtcgtcaaggtttatcttcagtgaaataaatcaaaagttccccatcatgccatttacagccagggctttggaagagaagagggctcgtctgggtctagtggaatgcgtgaaccatgatcttttgcagccataccctgttctccatgagaagcctggtgattttgttgcccatattaaattcacagttctgttaatgccaaatgggtcggacaggatcacatcccatcctttgcaggagctgcggcccaccaagacaatagacaatgaccctgaaatcaaggcttggttggcacttgggacaaagacaaagaagaaaggtggtgggaaaaagaagaaaggtaagaaaggtgacaaaacagagaattcaggcgaagccgaacccatggatgcagcatctcaagaatgaggaattttccattctcagagcttgttttggctggttgcagacttgcagttaaaaaggttcctagaaggagaaccctgacatgaagctctgttgggggttctggtgtgtgtgtgtgtgggggctggggttggggttgatgtaatataatgcacatatgcatcctttccccattccaatacttgttcctcttaactttccaaattgtccacacacagtgtgaaacaaagagatgcataaat

SEQ ID NO: 7443 - DNA, 1403 bp, Allium cepa
attattctctatctaaaaccctaacctcggtcctaattgaaagatgtctgacgacgaagtgatcgaagagaaggagcttgatctctcatcttctgatgtcgttaccaagtacaagaccgcagccgagattgtcaacaaggctcttaaattggttgtgtcggaatgcaaaccaaaggctaagattgtcgacatatgtgagaaaggagattcttttatcagagagcaagctggaaacatgtacaagaatgcaaagaagaagattgagaggggtgttgctttcccaacatgtatctctgttaacaacactgtttgtcatttttcaccagtagctggcgatgagactgttctggaagagaatgacatcgtcaagattgatatgggttgccacatagatggtttcattgcagttgttgcacacactcatgtacttcaagaaggacccataactgggagagcagctgatgtaattgcagcagctaatactgctgctgaagttgccttgaggcttgttaggcctgggaaaaagaacacagatgttaccgaagctattcagaaggtggcagctgcttatgattgtaaaattgctgaaggcgttcttagtcatcagcttaaacaatttgtgattgatggaaacaaagtcgttcttagtgtatcaaatcctgataccaaagttgatgtcgtagaatttgaggaaaatgaagtgtatgccatagacatagtgactagcactggtgaaggcaagcccaagttactggatgagaagcaaactactatttacaaaagagcggtggacaaaaactataacttaaaaatgaaagcgtcaaggtttatttttagtgaaattagccagaaatttccaatcatgccatttactgcaagggctttggaagagaagcgagctaggcttgggttgttagaatgtatgaaccatgaccttttgcaaccatatcctgttctacatgagaaaccaggtgatcttgtagctcacataaagtttacagtattattgatgccgaacggctcagacagaattacttctctcccgttgcaacagttgcaacccactaaaaccatcgatgatccagaaattaaagcgtggttggctttgagcacaaagacaaagaaaaaaggtggagggaagaaaaagaaaggcaagaaatctgaaactgcagaagctggtgaagctgtaccaatggaagaagaagcatcagatgcagtagctgcaaaataattggaagtttgatgttaatttttgatgcaatctgaaccatgatatttatctttgagtagacagagagatgcatgaagaggcaaattttttaggtggcaagtgcgctcatatttttaacaaaactatatagttgtcacaaattactgaagctttgccttttttttttttgttt

SEQ ID NO: 7444 - DNA, 1323 bp, Platanus occidentalis
caacgctcacggtatctcttcctgccactccgctaaaccctagttacagtttccatctccgaatcctctaaagccctagatttggtcgaagcgtctctctgttgattcgttcagtcgtgggagattcgaagctttgtaacgatgtccgacgacgaagcaaaggaggagaaggagttggatctcagttcccccgaagtcgtcaccaaatataagagtgcagctgagatcatcaacaaggctttgcagctagtgttgtcggaatgcaaaccaaaggcgaagatcgttgatatatgtgagaaaagcgatgcctttatcagagagcaaactgggaacatgtacaagaatgttaagaagaagattgagaggggcgttgccttcccaacgtgcatttcggtaaataatatcgtcggccacttctctccgcttgccagcgatgaaacggttttggaagaaggtgatttgttaaagatagatatgggttgtcacatagatgggttcatcgctgtagttgggcacactcatgtcctccatgaaggcccggtgacgggtagggcagcggatgttattgcagctggcaatactgctgccgaagttgctttaaggcttgtgaggccaggaaaaaagaataaagatgtaacagaagctattcagaaggtcgctgctgcctatgactgcaaggttgttgaaggtgttctcagccaccagctaaagcagtttgtgattgatggtaataaggtcatattgagtgtttccagtcccgataccagagttgatgatgcagaatttgaagagaatgaagtctatgcaattgatattgtcaccagcacgggtgatggaaagcctaagctgttggatgagaggcaaactactatttacaaaagagccgtggacaagaattatcacttgaagatgaaatcatcaaggttcatcttcagcgaaataagtcagaaattccctatcatgccatttacagcaagggctttggaagagaagagggcccggttgggattagtggaatgtgtgaaccatgatctcttacagccatatcctgttcttcatgagaagcctggtgattttgttgcccatattaaattcacagttttgttaatgccgaatgggtcggaccggatcacatcccatactctgcaggagctgcagcccacaaagacgatagatgatgaccctgaaattaaggcctggttagctcttggcacaaagacgaagaagaaaggtggtggcaagaagaagaaaggtaagaagggtgacaaagtggacgagtcggcagatactgaacctgtggatgccgcgtcaaatggtgcagca

SEQ ID NO: 7445 - DNA, 1630 bp, Solanum tuberosum
ccctagcttccaaacccttgttgcctccatttttcttccatcgcaaaatcccaattttgcttcgaatttgtgtgtttgaattaatagctgttttgtaactatgtcggacgacgagagagaagagaaagaattggatctcacaagtcctgaggtcgtcaccaagtacaagagcgccgctgaaattgttaacaaggcgctgcagttggtgttgtccgaatgcaagccaaaagcaaagatagttgatctttgtgagaaaggggatgcctttatcaaagagcaaactggaaatatgtacaagaatgtgaagaagaagattgagagaggtgttgcatttccaacatgtatttcagttaataacaccgtgtgccatttctctccattggctagtgatgagacagtagtggaagaaggtgatatattgaagattgatatgggatgtcacattgatggatttattgcagtagttggacatacacatgttcttcacgaaggaccagttactggtagagctgctgatgtcattgcagctgctaatacagctgctgaagttgctttgagacttgtaagaccaggaaagaagaactcggatgtaacagaagctattcagaaggttgctgctgcctatgactgcaagattgtcgagggtgtattgagccatcaaatgaagcagtttgttattgatggaaacaaagttgtattgagcgtgtccaatcctgacacaagagtagatgaggcagaatttgaagagaatgaggtctactccattgatatcgtgacgagcactggtgatggaaagcccaagttgttggatgagaaacaaacaaccatctacaagagagctgtggacaaaagctataacctgaagatgaaagcctcaaggttcatcttcagtgaaatcagtcagaagttccctatcatgccatttaccgcaagggatttggaggagaagagggctcgtttgggccttgttgaatgtgttaaccatgagcttttgcagccatatcctgttctacatgagaaacctggtgatttggttgctcacattaagttcacagtgctgttaatgcccaatggatcggatagggtaacatctcatgcgctccaggagcttcagcctacaaagacaacagagaatgaacctgaaatcaaggcttggctagcccttcccaccaagactaagaagaaaggtggtgggaagaaaaagaaaggaaagaaaggtgacaaggtagaagaggcatctcaagctgagcctatggaaggatagtgaagtggctccaaaactttcatacttgcaattttgaggtgctttgatcgatcaactttactgaaactattggttcagtgtgagtcgattcggcacgttgagctgcttatgttcatctttgtggggttatgaaagacgattattgtacccgttcatgttaagttgttctccttaggtttttcaatgctattcaaaattctcttatcattttaattttaaaccttcaataagtccgtattgtgctcttctctatttgtttgaagttagaaagatcacatttttgtttctgatattgacaaatatggactgacttgtaaaatcaaacatgaataggaaacataacaatcatttttctgattctactag

SEQ ID NO: 7446 - DNA, 1613 bp, Solanum lycopersicum
atcactactttgtctcctttttatcacctcatacacctttaacttcactaaaaaccctagcttccaaaccttgttgcctccatttttcttccaatcgcaaaatcccaattttgcttcgaatttgtgtgtttgaattaatagctgtttggtaactatgtcggacgacgagagagaagagaaggaattggatctcacaagtcctgaggtcgtcaccaagtacaagagcgccgctgaaattgttaacaaggctctgcagttggtgttgtccgaatgcaagccaaaagcaaagatagttgatctttgtgagaaaggggatgcctttatcaaagagcaaactggaaatatgtacaagaatgtgaagaagaagattgagagaggtgttgcatttccaacatgtatttcagttaataacaccgtgtgccatttctctccattggctagtgatgagacagtagtggaagaaggtgatatattgaagattgacatgggatgtcacattgatggatttattgcagtagttggacatacacatgttcttcaaaatggaccagttactggtagagctgctgatgtcattgcagctgctaatacagctgctgaagttgctttgagacttgtgagaccaggaaagaagaactcggatgtaacagaagctattcagaaggttgctgctgcctatgactgcaagattgttgagggtgtattgagccatcaaatgaagcagtttgttattgatggaaacaaagttgtattgagcgtgtccaatcctgatacaagagtagatgaagcagaatttgaagagaatgaggtctactccattgatatcgtgacgagcactggtgatggaaagcccaagttgttggatgagaaacaaacaacgatctacaagagagctgtggacaaaagctataacctgaagatgaaagcctcaaggttcatcttcagtgaaatcagtcagaagttccctatcatgccatttaccgcaagggatttggaggagaagagagctcgtttgggccttgttgaatgtgttaaccatgagcttttgcagccatatcctgttctacatgagaaacctggtgatttggttgctcacattaagttcacagtgctgttaatgcctaatggatcggatagggtaacatctcatgcgctccaggagcttcagcctacaaaatcaacagagaatgaacctgaaatcaaggcttggctagcccttcccaccaagactaagaagaaaggtggtgggaagaaaaagaaaggaaagaaaggtgacaaagtagaagaggcatctcaagctgagcctatggaaggatagtgaagtggctctaaaactttcatacttgcaattttgaggtgctttgatcgattaactttactgaaactattggtttagtgtgggtcgattcggcacgttgagctgcttatgttcatctttgtggggttatgaaagacaattattgtaccctttcatgtgacgttgttctcgttaggtttttcaatgctattcaaaattctcttttatcattttaattttgaaccttcaataagtccgtattgtgcttttctgtatttgaagttagaaagatgacatttttgtttctgatattgac

SEQ ID NO: 7447 - DNA, 1590 bp, Aquilegia formosa
cccccttctccaactcgcacacaccaaaaccctaattcctcttcatttgttgttcatcactcactttcagtgttttgtttctcaatccattctatttctttctctgtttgaagaagatttgtgaaaacaatgtcggatgatgagattaaggaagagaaggaattggatctctcttcacctgaagttgttaacaaatacaaaagcgctgctgagataatcaacaaggctttacagttggttatatctgaatgcaaacccaaagtgaaaattgttgatgtttgcgaaaaaggggattcatttatcagagaacaaactgggaatatgtacaagaatgttaagaagaagattgaaaggggtgtagcattcccaacttgtatttcagtgaacaacactatctgtcacttttctccacttgctagtgatgaatctgtcttggaagccggtgatattgtgaagattgatatgggctgccacatagatgggttcattgctgtagtagcacacacacatgttcttcaggaaggaccagtgacaggaagggtagctgatgttattgctgcggccaacactgctgctgaagttgcattgagacttgtgcgacctggaaagaagaacaaagacgtaacagaagctattcaaaaggttgccgccgcctatgactgtaagattgttgaaggtgttctcactcaccagctaaagcaatttgtgattgacgggaacaaagttgtactcagcgtctccagtcctgagaccaaagttgatgatgcagagtttgaggagaatgaagtttatgcagttgatatagtcaccagcacaggagaaggcaaacctaagctattggatgagaaacaaactacaatttataaaagagctgtggataagaactaccacttaaagatgaaagcgtcaaggtttatcttcagtgaaataaatcagaactttcctatcatgccatttactgcaagagctttggaagagaagcgagctcggttgggattggtggaatgtgtgaatcatgagcttttgcagccctatcctgttcttcatgagaagcctggtgactttgtagcccatataaaatttacagtgctgttaatgcctaatggatcagaccgaatcacatcccaccctctccaggaggttcagtctacaaagtcagtaactgaagatcctgaaatcaaggcgtggctatctttgggaactaagtccaagaagaaaggtggtggcaagaagaagaaagctaagcagggtgacaagggtgatgatactgctgaagctgagccatccgaagctgtagcaacaaatggggctacggcctagggatgagatatcaaattttgttgcctttttactctgtaattgaatgatactgttttgtcaggaagtttcttacatggagcctaatttatgttttactgatagtgtatgcctgatgttttgatgcacatgtgctcattatccccttttactttaatatcacagttgacttgaaaaattatctctctgttatgtaaacttgatgtgaacatgtggtagaaggaggtttgagaggcaatagttatgttggtatacacaaacaaggcttgggtt

SEQ ID NO: 7448 - DNA, 1572 bp, Lactuca sativa
ggcatctaacgtgaaaaccctaataacttagtaaccgaacactgccaactctatataaactaagaacggcagaagcaccgccgacctcaaaccctagctcacgacttactcccacactccgttttcgtctgtataaatcataatcgctcctgttcatcgtttatttgctagttaatctattttgtagttctgaggaatcatgtcagacgatgaaagaggggaggagaaggagctggatctttcctctccagaagctgtaaccaaatacaaatcagctgctgagattgttaacaaggccttgcagctggtattgtcagaatgcaaacccaaagccaagattgtcgatatttgtgagaagggagattcatatatcagagagcaaactgggaatatgtacaagaatgtaaagaagaaaattgaaaggggagttgcctttcccacatgtctgtctgttaacaacacagtctgccattattctccactagctagtgatgaaacagtattggaagaaggtgacattttgaaaattgatatggggtgtcatatagatggtttcattgcagtggtgggacacactcatgttcttcaacaaggacctgtaacaggtagagcagcagatgccattgcagctgcaaatactgctgctgaggttgccttacgacttgtgaagcctggaaagaagaatcaagatgtgacagaagccattcaaaaagttgctgcagcatacgattgcaaaattgttgaaggtgttcttagtcatcaactaaaacaatttgtgattgatggaaacaaagttgtattaagtgtctcaaatcccgaaacaagagttgatgatgcagaatttgaggagaatgaagtttatgcaattgacatagtcaccagcacaggagaaggcaagccgagattattggatgagaaacagacaacgatttacaaaagagcagttgacaagagctatcacttgaaaatgaaagcatctcggtttatatttagcgagatcaatcaaaagtttccaattatgcccttctccgctagggctttggaagagaagcgagctcggttgggattggttgaatgtgttaaccatgagcttttacagccataccctgttcttcatgaaaagcctggtgattttgttgcacatataaaatttacagttcttttgatgccaaatggatcggaccgaattacgtctcatacccttcaagaattgcaaacaacaactaataaaacggttgatgacccggaaatcaaagcatggttggctttacctgtaaagacaaaaaagaaaggtggtggcaaaaagaagaaaggaaagagagcagaaaagggtgaaggtgaagcaatggatgtggaggctacaaatggtggtggccaagattagaattaagattttgaaatgtaatttgatagttgaaatacagttttttttgtatcggaatttctttttagttttaggtttgtttgtatggtggatgaatatgatttaattatcataatatgtacacatttatatgtttttttttcttataaagacgaatgaaatgaaaaatactaatctttgtgtttgaa

SEQ ID NO: 7449 - DNA, 1650 bp, Mimulus guttatus
tctctctgccgacctcaaaccctaacctcactctgtcatttcctgctttgctccgaaccatttgctaaaccctaattccgtacgcctcttgagtttacgctaatttcttcaactggttgagacaatggcggacgagataagggaggagaacgaggagttggatctctcctctcctgaagttgtcaccaaatacaaatccgctgctgaaattgttaacaaagcgcttcagttagttttgtcgcaatgcaaaccaaaggttaagattgttgatctatgtgaggcaggggatgctttcatcagagagcaaactgggaacatgtacaagaatgtgaagaagaagatagaaaagggtgttgcatttccgacctgcgtttctgtgaacaacactgtctgccatttctcaccactagcgagtgatgagtccgtgttggaagatggagatattgtgaaaattgatatgggctgtcacatagatgggtttattgctgtagttgcacatacccatgtacttcaggaaggaccagtgactggcagagcagctgatgttattgctgcagcaaataccgctgccgaggttgccttgaggcttgtgaggccagggaaaaagaataaggatgtcactgaggcaattcagaaagttgctgctgcttatgactgcaagattgtcgaaggagtattgagtcatcaaatgaaacaatttgtgattgatggaaacaaggttgtgctaagtgtctcggcccctgatacaaaagttgatgaagctgagttcgaggaaaatgaggtgtactccattgacattgttactagtactggcgaagggaagccgaaattgttggatgagaaacaaactaccatatataaaagagctgttgacaagagttatcacctaaagatgaaagcatctcggttcatatttagtgagataagccagaagtttccaatcatgccgttttctgctagggctttggaggagaagcgtgctcgtttaggccttgtagaatgtgtgaatcacgatcttcttcagccatattctgtacttcatgagaagcctggtgacctggttgcacatatcaagttcaccgttttgctgatgccaaatggctcggatagagtcacatctcatgctctacaagaattgcaacccacaaaaacggtagatgatgatgagatcaaagcctggttagcattgggaacgaagacaaaaaagaagggtggaggaaagaagaagaaagcaaagaaagaggacaaagctgatgctgctgtgccagtggatgatgcttcaacaaatggcgtatgagaaaaaaacttgtttttattttgtaaaatcccggaaaattttggcctcttccatccctgtacttggttgtttgagacgtgaaatgtcgatcacaagttaaatcacttctaaatgtcttgtacactctactggtattttgggactttttttgtatctgtttctgttttatggatagaaatagataataatatattcagggaatatgtcgctattattctgttgggtggtgggtgattttctttcactctagtttagttagatatatgattatcaattattgcagtgattactcataatatatacattgcagaaacacaccagttcaaatatatctttgcttctcgactgtatct

SEQ ID NO: 7450 - DNA, 1756 bp, Solanum phureja
gccaaacaaggcataaactgcccattaggaaagagaaaaaaaaaatcagtactttgtctcctttttatcacctcatacatctttaacttcactaaaaaccctagcttccaaacccttgttgcctccatttttcttccatcgcaaaatcccaattttgcttcgaatttgtgtgtttgaattaatagctgttttgtaactatgtcggacgacgagagagaagagaaagaattggatctcacaagtcctgaggtcgtcaccaagtacaagagcgccgctgaaattgttaacaaggcgctgcagttggtgttgtccgaatgcaagccaaaagcaaagatagttgatctttgtgagaaaggggatgcctttatcaaagagcaaactggaaatatgtacaagaatgtgaagaagaagattgagagaggtgttgcatttccaacatgtatttcagttaataacaccgtgtgccatttctctccattggctagtgatgagacagtagtggaagaaggtgatatattgaagattgatatgggatgtcacattgatggatttattgcagtagttggacatacacatgttcttcacgaaggaccagttactggtagagctgctgatgtcattgcagctactaatacagctgctgaagttgctttgagacttgtaagaccaggaaagaagaactcggatgtaacagaagctattcagaaggttgctgctgcctatgactgcaagattgtcgagggtgtattgagccatcaaatgaagcagtttgttattgatggaaacaaagttgtattgagcgtgtccaatcctgacacaagagtagatgaagcagaatttgaagagaatgaggtctactccattgatatcgtgacaagcactggtgatggaaagcccaagttgttggatgagaaacagacaaccatctacaagagagctgtagacaaaagctataacctgaagatgaaagcctcaaggttcatcttcagtgaaatcagtcagaagttccctatcatgccatttaccgcaagggatttggaggagaagagggctcgtttgggccttgttgaatgtgttaaccatgagcttttgcagccatatcctgttctacatgagaaacctggtgatttggttgctcacattaagttcacagtgctgttaatgcccaatggatcggatagggtaacatctcatgcgctccaggagcttcagcctacaaagacaacagagaatgaacctgaaatcaaggcttggctagcccttcccaccaagactaagaagaaaggtggtgggaagaaaaagaaaggaaagaaaggtgacaaggtagaagaggcatctcaagctgagcctatggaaggatagtgaagtggctccaaaactttcatacttgcaattttgaggtgctttgatcgatcaactttactgaaactattggttcagtgtgagttgattcggcacacgttgagctgcttatgttcatctttgtggggttatgaaagacaattattgtacccgttcatgttaagttgttctccttaggtttttcaatgctattcaaaattctcttatcatttaaattttaaaccttcaataagtccgtattgtgctcttctctatttgtttgaagttagaaagatcacatttttgtttctgatattgacaaatatggactgacttcagtaaaatcaaacatgaataggaaacataacaatcatttttctgattctactagaaaaaatgtttcaaagtttttagt

SEQ ID NO: 7451 - DNA, 1571 bp, Papaver somniferum
gaaacttggcacatacctgtagctgaccaaaaatatcaacaagatcttatcactttcttccttcacgaaaacttcatttcataaaccccagtttcttctgaaaaccctagaagagctcaaaattcatctgtttcttctataatgtctgacgacgaaaacaaagaggagaaggagttggatctcacttcacctgaagttgttaccaaatacaagaccgctgctgagatcgttaacaaggcacttcaattggtgctatcagagtgcaaacctggagcgaaaattgtagatttgtgtgaaaagggtgattcctatattagagagcaaagtgggagtgtgtacaagaatgttaagaagaagattgagaggggagttgctttcccaacatgtatttcggttaataacatcgtctgtcatttctctccacttgctagtgatgaaaccgtattggtacaaggcgatatgatgaagattgatatgggatgtcatatagatgggttcattgctgtagtaggtcacactcatgtcctccaggacggacctgtgaccggtagggcagctgatgttgttgcagctgcaaatactgctgctgaagttgctttaagactcgtgaaaccaggaaacaagaacaaagatgtcacgaaagctattcagaaagttgctgctgcatatgactgcaagattgttgaagctgttcttagtcaccaactaaagcagtttgtgattgacgggaacaaggtcatactaagtgtatctaatccagagaccagagttgacgatgcagagttcgaagagaatgaagtgtatgcaattgatatagttgtcagcacgggggagggcaagccaaaattagtggatgagaagcaaacaaccatttataagagagccgtggacaaaagctacagtttgaagatgaaagcatctaggtttatcttcagtgaaataagccagaaatttcctatcatgccattttcggcaagggctttggaggagaagcgggcacgactgggtttggttgaatgtatgagccatgagcttttgcaaccataccctgttcttcatgagaagcctggtgattttgtcgcccaaatcaagtttacagttctgttgatgccaaatgggtctgacagaataacaagccatgctctccaagagctgcagtccacgaaaacgatagacgatgatgctgaaatcaagggttggttagccctgggaaccaagaaaaagaaaggtggtggaaagaagaagaaagctaagaaaggaggagatagtaaagctgatgagacggtggaagctgaacctatggatgagacatcaaaagccactacatcataagaagtgcagcagcaatagggtattctgaattttttttaagttaaataatccttttgtaagtgggatgctccagaaagacgaggcacctttgtcccatatagcggtttatgtttggtccttggacagcgaatgattgtatttagcagcagcatcatcatcaacttaaactgtgtttaacaacatcaactaactgtgttttgagctgttctatttacttcagatgtcgtctaattctgtgc

SEQ ID NO: 7452 - DNA, 1417 bp, Rosmarinus officinalis
gttagggaagagaaggagctggatctttcatcaccagaagttgtgactaagtacaaattggcggctgagattgttaacaaggcgctacagctggtagtatcagaatgcaagccgaaagctaagattgttgacatttgtgagagaggcgatgcatttatccgagagcaagctgggaatatgtacaagaatgtgaagaagaagatcgagcggggcaccgcattcccgacatgcatctctgtaaacaacaccgtctgccatttttccccacttgccagtgatgaaaccctcttggaacagggtgatatggtaaaaattgatatggggtgccacatagatggattcatagctgtagttgcacacacacacgtccttcaagaaggaccagtcactggcagagcagcagatgttattgctgctgccaatacagctgctgaagttgctctgaggcttgttaggccagggaaaaagaacaaagatgtgactgaagcagttcagaaggttgccgctgcctatgattgtaaaattgttgaaggtgttcttagtcatcagatgaaacagttcgttattgacggaaacaaggtcatattgagtgtttccagtcctgagacaagagttgatgatgctgaatttgaagagaatgaagtttattccattgatttagcaacaagcactggtgaaggcaagcccaaattgttggatgaaaaacagactaccatctataaaagagctgtagataggacttatcacctgaagatgaaagcttctaggttcatattcagtgaaataagtcagaaattcccaataatgccgtttacagccagggcattggaagagaagcgggctcgcctaggacttgttgaatgtgtgaatcatgaacttctgcagccatatcccgtacttcatgagaagcctggcgatttagtagcacatatcaaatttactgtattgctaatgccaaatgggtccgatcgcatcacgtcccattctctacaagagcttcagcccactaaaacagtagatgaccctgagattaaagcatggttagccttgggcataaagacaaagaagaagggtggtgggaagaagaagaaaggtaagaagggggataaaacagagctgtcagctgatgctgaacctatggatgttgctacaaatggcactgcatcccaggaatgagatatttgtgcatgttttctgctggccgattttgagtacactgtatttggttgggtttttcagttggagattaggtcattgtaaacctgctgaaatgtacacaaggtgaaccttgaatcatttttgctttaaatagagaaggtaaatttattactccttgatttaaagtaacctttgtagagcaatagaccacaaaattccagaatggaaatttatacgcttagtttatttttattctttc

SEQ ID NO: 7453 - DNA, 1816 bp, Amorphophallus konjac
aaataaaaaaccgacaaaacgtgccctagcaaaaccctggtgcttatcttcgccattttatgcttggaggacgctttcgacaccgatagactgagataaaccctaaacttcatccaaagcctcgatcttgagaagggttttcagcctgggcagatgtcggacgacgaagcaagggaggagaaggagttggatctttcctcgcctgatgtcgtcaccaagtacaagagcgctgccgagatcgtgaacaaggctcttcagctggtgatttccgagtgcaagcccaaggccaagattgtcgacctgtgcgagaagggcgatgccttcataagagagcaaaccggcaacgtgtataagaatgtgaagaagaagatcgagaggggtgttgcgtttcctacatgcatctccgtgaacaacaccgtgtgccatttctcaccactggccagcgatgagagtgttctggaagaaaatgacatgataaaaattgatatgggatgtcatatagatggcttcattgcagtggtggcacacactcatgtggtacatcaggggcctgttaccgggagagctgctgatgtaattgctgctgcaaacactgcagcagaagttgcattaaggcttgttagacctgggaaaaagaacaaggatgtcacagaagctattcagaaagttgctgctgcttatgattgcaaaattgtcgaaggggtgctaagtcatcaacttaagcagtttgtaattgatggaaacaaggtcgtactgagtgtggctaaccctgagacacgggtcgatgatgcagaatttgaggagaatgaagtctatgctgttgatattgtcactagtacaggtgatggcaagcccaaaatgttggacgaaagggcaacaaccatttataagagagcggttgataaaagctatcatttgaaaatgaagtcatcaaggtttatctttagcgaaattaaccaaaaacatcaaattatgccttttactgcaagggctctggaagagaaacgtgctcggctaggactggtagaatgtgtcaaccatgatcttttgcagccataccctgttctgcacgagaaacctggggacctcattgctcacatcaagttcacagttctgttgatgccgaatgggtcagataggatcacatcccacccattgcaagatttacagcctcacaagactgttgatgatgaccccgaaattaaggcttggttagcacttggcacaaagacgaagaagaaaggtggaggaaagaagaaaaaaggtaagaaaagtgacaacaaagatgattctgaacccgtggatgctagttcaaatggtgcaccattgcaagaatgagaggtcgcacttgtgttctttccttcagtcatccttcagatagcctgagagctacttgcaagaaaagaattacggggagatgccagcggctgatttgttaccaggtccttcggtgcattgagaagcagttcaaggctgccactgacgcagatgtaaggcattctaatgatagattctcaaatctggtcaggttctgagcttttgtgtgagacttgcaaagtggggagctgtatttatcagtaagatggatggttgacggttcaaggcaatcgagaaaaaaaattgtttttaggcttccgtgattttaagtttctgtccgaagttttgcagtagtaggatttttgtttgaagttgcctgtcgaggaaaacttgcacttctcttacaacttgtccgagtaagcgcccccactggaggtcccgttgattccttattcgtgtacctgtgaacaagtttcagcctgcttctaatttctttttc

SEQ ID NO: 7454 - DNA, 1351 bp, Centaurea maculosa
gccaatctcacttccatttcccttttccctttaaaccctaattaatcaatcctcttgatccatctctatctgaaacaccttcgatttttcactctttaaacatgtcggatgatgaaagagcagaggagaaggagctggatctcacctctcccgaagttgtaaccaaatacaaatcggcagctgagattgttaacaaggccttgcagttggtattgtcagaatgtaagcccaaagccaagattgttgatatatgtgagaagggagattcatacatcagagagcaaactgggagcatgtacaagaatgttaagaagaagattgaaaggggtgttgcgtttcccacatgtttgtctgtgaacaacacagtatgccattactctccacttgccagtgatgagacagtattggaagaaggcgacattttgaaaattgatatggggtgtcatatagatggtttcatagctgtggtcggccacactcacgttcttcagcaaggacctgtaacaggtagagcagctgatgccattgcagcggcaaatactgctgctgaggttgccttaagacttgtgaagcctggaaagaagaaccaagatgtaacagaagccattcaaaaggttgctgctgcatacgactgcaaaattgttgaaggtgttcttagtcatcaactgaaacagtttgtgattgatgggaacaaagttgtattgagtgtctcaaatccggaaaccagagtggatgatgctgagtttgaggaaaatgaagtttatgcaatcgatatagtcacaagcacaggagatggcaagcctaaattgttggacgaaaagcagacaacaatctataagagagcagtggacaagaattatcacttgaaaatgaaagcatctcggtttatattcagtgagattaatcaaaaatacccaatcatgccgttctcagctagggctttggaagagaagcgtgctcggcttggattggtggaatgtgttaatcatgagctcttacagccatacccagttcttcatgaaaagcctggtgattttgttgcacatatcaagttcactgttcttttgatgccaaatggatcggatcggataacctctcatacgctgcaggaattgcagccaactaaaaccgttgatgaccctgaaattaaagcatggttatctctacccgtaaagagcaaaaagaaaggcggtggaaagaagaaaaaaggcaagaaagctgaaaagggtgaaggggaggtggagccaatggaggaatcatcaaatgaccaaggccaagggcaagaatgaaatttgactatgtaatttgttagaatttaaaaggaaaagaaaaaaaataaccatttaggttt

SEQ ID NO: 7455 - DNA, 1577 bp, Gossypium hirsutum
tatataaccaaacgctgccgtaaagaaccgtaaccctaactctctacttcactactcaccacccgcccttcctattttagtttatatactccctccaaaaccctagcgctttcactcgccgccgccaatttcaacacaattagatagattcttgataagactcgaaagcgatgtcagacgacgagagagaggagaaggagctggatctcagctcctctgaagttgttacaaaatacaagggcgctgctgagattgttaacaaagctttacaattagttgtaaaagaatgtaagccgaaagctaagattgttgacatttgtgagaagggtgatgcatttataagagagcaaacaggtaacatgtacaagaattctaagaagaagattgagaggggtgttgccttccctacttgtctctctgtaaacaacacagtctgccatttctctccacttgctagtgacacctcggagttggaagaaggtgatatggtcaagattgacatgggttgccacattgatgggtttattgcggtagttgctcatactcatgttgttcagagcgggccaatcactggtaagcaggctgatgttgttgctgctgcaaatactgctgctgaagtggccttgaggcttgtaaggcctggaaaaaagaacaaagatgtatctgatgcaattcagaaggtagctgcagcttatgattgcaaaattgttgaaggtgttcttagccatcaactgaagcagtttgtgatagacgggaacaaagtcatactaagcgtctccaatccagatacaagagttgatgatgcagagtttgaggagaatgaagtttatgctgtagatatagttgcaagcactggtgaaggcaagccaaagttgttggatgagaagcagacaactatttataagagagctgtcgacaagaactatcatttaaagatgaaggcctctagatttattttcagcgagataaatcagagattccccatcctgccattcactactcgcgccttggaagagaaaagggctcgtctaggtttagttgaatgtgtgaatcacgatctcttgcagccataccctgttctgtatgagaagcctggtgattatgttgctcatatcaaatttacagtattgctaatgccaaatggatcagatcggattacatcccatcccctgcaagaactgcagtcaaccaagacgatagatgatcctgaaatcaaggcctggttggctttgggaacaaagacaaagaagaaaggtggtgggaagaagaagaaaggtaagaagggtgataaagctgagggtggagctgagggtgaggccatggatgcatcgacaaatggtggtgcatcataaggaaacaataataaaaatgtttttgcgcatattttctaatctgcccttttatatattatgatgattgtcaaaatttttgatactgtgttcacttgtagcttgttggttatgagttcaaattttaatgtcgagtagttttttttattttatggcatgacatccacttggagtcttgtgtttgtgtgtgatgtgcaacttaataggaaattaaatgtgctcatttct

SEQ ID NO: 7456 - DNA, 1419 bp, Allium cepa
ctcgatctatatccgtctctacctaaaaccctaatcttgtttcaggtcctaatcgaaagatgtctgacgacgaagtaattgaagagaaggagcttgatctctcatcttctgatgtcgttaccaagtacaagagcgcagccgagattgttaacaaggctcttaaattggttgtgtcggaatgcaaaccaaaggctaagattgttgacatatgcgagaaaggagattcttttattagagagcaagctggaaacatgtacaagaatgcaaagaagaaaatcgagaggggtgttgctttcccaacgtgtatctctgttaacaacactgtttgtcatttttcaccggtggctggcgatgagactgttttggaagagaatgacatcgtcaaaattgatatgggatgccacatagatggtttcattgcagttgttgcacacactcatatacttcaagaaggacccataactgggagagcagctgatgtaattgcagcagctaatacggctgctgaagttgcattgaggcttgttaggcctggaaaaaagaacacagatgtcaccgaagctattcagaaggtggcggctgcttatgattgtaaaattgctgaaggggttcttagtcatcagcttaaacaatttgttatcgatggaaataaagtcgttctgagtgtatcaaatcctgataccaaagttgatgttgtagaattcgaggaaaatgaagtgtatgccatagacatagtaactagtactggtgaaggcaagcccaagttattggatgagaagcaaactactatctacaaaagagcagtggacaaaaactataacttaaaaatgaaagcatcaaggtttattttcagtgaaattagccagaaatttccaatcatgccatttactgcaagggctttggaagagaagcgagctaggcttgggttgttagaatgtatgaaccatgaccttttgcaaccatatcctgttctacatgagaaaccaggtgatcttgtagctcacataaagtttacagtattattgatgccgaacggctcagacagaattacttctctcccgttgcaacagttgcaacccactaaaaccatcgatgatccagaaattaaagcgtggttggctttgagcacaaagacaaagaaaaaaggtggagggaagaaaaagaaaggcaagaaatctgaaactgcagaagctggtgaagctgtaccaatggaagaagaagcatcagatgcagtagctgcaaaataattggaagtttgatgttaatttttgatgcaatctgaaccatgatatttatctttgagtagacagagagatgcatgaagaggcaaattttttaggtggcaagtgcgctcatatttttaacaaaactatatagttgtcacaaattactgaagctttgccttttttttttttgttt

SEQ ID NO: 7457 - DNA, 1611 bp, Triphysaria pusilla
gcgaaaaacacgttatataaagtacactgcacaccaagctgccgacctgaaaccctaaccattttatttcatttctgcctctgataaaccctaatttcgtacactcactggttcaagagaaggctcgaatttgaaggctgaaaaaatgtcggacgaggaacgggaggagaaggagttggatctcacctctcctgaagttgtcaccaaatacaaatccgctgctgaaattgttaacaaggcgctgcaattagttttgtcagaatgcaaaccgaatgtcaagattgttgacatttgtgagaaaggagatgctttcatcagggagcaatcagggaacacgtacaagaatgtaaagaagaagattgaaaggggcattgcattcccaacttgcatctcggtaaacaatacagtctgccattattcaccattggccagtgatgaatgtgtgttggaatccggagatattgtgaaagttgatatgggttgccacatagatggctttattgctgtagttgcccacacacatgtaattcagcaaggaccagtaactggcaggggagctgatgttattgctgctgctaatacagctgctgaggttgctttgaggcttgttaggccagggaaaaagaataaagatgtcgctgaggcaattcagaaagtcgctgctgcttatgactgcaagattgtcgagggagtgcttagtcatcaaatgaaacaatttgtgatcgatggtaacaaggtcgtcttaagtgtctcagcacctgatacaagagttgaagaagctgaattcgaggaaaatgaagtatactctattgacattgttacaagtactggtgaaggcaagccaaaactcttggatgagaaacaaacgactatatataaaagagctgttgacaggaattataaccttaagatgaaggcatctcggttcatatttagtgagataagccaaaagttcccaatcatgccattttctgcaagggctttggaagagaagcgtgctcggttgggccttgtggaatgtgtgaatcatgatcttctacagccatatcctgtactttacgagaagcctggtgactttgttgcacacatcaagtttaccgttttgctaatgccgaatggatcggatcgagtcacttctcatcctctacaggagctacaaccgacaaaaacaattgatgatcctgaaattaaagcgtggttagcgttggccacaaagacgaagaagaaaggcggtgggaaaaagaagaaaggtaagaaaggggacaaagctgaggatgcagcagtagttgaagttgagccaatggacaccacagcagcagatggtggggctgattcctaagattaagaacattcttgttttagtgtattttctctttgaaattttggccgcttcgttgtatttgcatgttgcctttgtttagtttcgtgatatgggagtctaaacgtgtcgtattttctgtattgtttttgtgttggccttccattttactaaacaaaatattagaaaaggatattaaaagaacttgataagaatttcacttatattataatgggtgttcttggctagcacttttgaattcagattgtcacttgtattaccaaaaaaaaaaa

SEQ ID NO: 7458 - DNA, 1455 bp, Tragopogon dubius
ggggtagccccggtgcaaagataaccaacgagccacactctgtctctcagtcctctttccttaaaccctaatctcttttctctgcgtattaatttccggttgaagaaacatgtcggacgatgaaagaggggaagaaaaggagttggatctttcctctcctgaagtagtaaccaaatacaaatcggcggccgagattgttaacaaggccttgcagttggttttgtcagaatgcaaaccaaacaccaagattgttgatatttgtgagaaaggagattcatatatcagagagcaaactggtaatatgtacaagaatgtaaagaagaagattgaaagggtgttgcgtttccgacatgtttgtctgttaacaacacagtctgccattattctcctcttgcaagtgatgaaacagtcttgaaagaaggcgacattttgaaaattgatatggggtgtcatattgatgggtttatagctgtggtgggacacacccatgttcttcagcaagggccagttacaggaagagcagctgatgttattgctgctgcaaatactgctgctgaggttgctttaaggcttgtgagacctggaaaaaagaaccaagatgtgacagaagcaattcaaaaggtggctgctgcatacgactgtaaaattgtggaaggtgttcttagtcatcaactgaagcaatttgtaattgatggaaacaaagttgttttaagcatttcaaatcccgaaacaagagttgatgatgctgaatttgaagagaatgaagtctatgcaatcgatatagtcacaagcacaggggatggcaagccaaagttgttggatgagaaacagaccacgatttacaaacgagcggttgataagaactatcacttgaaaatgaaagcatcacgtttcatatttagtgaaatcagtcagaagtttccgattatgcccttttcagctagggccctggaagagaagcgtgcacggttaggattggttgaatgtgtgaatcatgagctattgcagccgtaccctgttcttcatgaaaagcccggtgattttgtcgcgcatatcaaatttactgttttactaatgccaaacggttcagaccgcataacatctcacgctcttcaggactttcagcccactaaaaccatcgatgaccctgaaattaaaggctggctatctttagctgtcaaaagcaagaagaaaggtggtggcaagaagaagaaaggtaagaagggtgatgaagcggttgcaatggaggaaacaaacggtggtggtggtgagaagtgaaaatttgttgtgtaatttgaatgaaattttggttagagttttttcttgaaagattgtttgtttcaatagaagagacaacatttaacatttgatttgtgttgttctttttcttgagaaatgcaacctataaaaaccaagtctttcttgaaataacatattgtcatggtgtgttatcca

SEQ ID NO: 7459 - DNA, 1640 bp, Rosmarinus officinalis
gacttcaaaccctacccccactaacactgcctctctctaacttgttaaaccctaatcctgttctctatatagcttctgagaatctcaattggtaatttttctatttcgaaaaattcttaccttttcatccgttttatcgctttagtccttaccttgaaaacctttcgattactgtgttgttgcatgtcctctttgaagcgtaagtgcgaaacaatgtcggacgaggaaagagaggagcaagagttggatctcaccaattctgaagtagtcacaaaatacaaagccgctgctgaaattgtcaacaaggcgttgcagcttgtgttgtctgaatgcagaccgaaggctaagattgttgacctttgtgagaaagcagactcgtttatcagagagcaaacaggaaacatgtacaagaaagtgaagaagaagatagaaaggggtgttgcattcccaacatgcatttcggtgaacaatacagtctgccatttttcacctttgaacggtgacgagagtgtattggaagctggggatattgtgaaaattgatatggggtgtcacatagatggctttattgctgtagttgcacacacccatgtacttcaacaggtgccggtcactgggagggcagctgatgttattgctgctgcaaatacagccgctgaggttgctttgaggctcgtgaggcccggaaaaaagaataaagatgttagcgatgcaattcaaaaggttgctgctgcttatgactgcaagattgttgaaggagtactaagtcatcaaatgaaacaattcgtgattgatggcaacaaggttgtattaagtgccacaggccctgataccagagttgacgatgctgaatttgaggaaaatgaagtgtatgccattgacattgttacaagtactggtgaagggaagccaaaattacttgatgagaaacaaacaactatctataaaagggctgttgacaaaaactatctcctaaagatgaaagcatctcggttcatattcagtgaaataagccaaaagttcccgatcatgccattctctgcaagggccttggaagagaagcgtgttcgtttgggtctagtggaatgtgtaaatcatgatctcttacaaccatatcctgtgcttcacgagaagcctggtgacctagtcgcacacatcaagttcactgttttgctgctgccaaacgggtctgatcgagtcacctcccatcctctacaggagctgcagcccacaaaaacaattgatgatcctgagatcaaagcctggttagcattgggcacgaaatcgaggaagaaaggtggagggaaaaagaagaaaggtaagaagggtgataaagcagagaacacggctgaagctgagccaatggaagaggaggctccaaacggtgcaacttctcaagaatgagaaagtccctcttctatgctctgtactttgtgaacgaaattttggccgctccgttgtaatgggtgctttttggtggaatgtcgatcgttgttcttgagacttgcgtttgtctcattttgtccggaccgtttgtgtatccatttttctatttttggatttagaattgataatttatgaaaagaagaaaacttgtccgaccaccttcgatgcacaatttctttccgtttttgtccgac

SEQ ID NO: 7460 - DNA, 1564 bp, Olea europaea
catcaaaaccctacccatcacaccataaattcccacctacagttgcccactggccactgccgccttcaaaccctaaaacagccaacccgcctcctccctacttgctaaaccctaattttctcaccatccttggttgaagacaatgtcggatgaggaaagagaggagagggagttggatctcacctctcctgaagttgtcactaaatacaaatccgctgctgaaattgttaacaaggcattgcagttagtgttgtctgaatgcaagccaaaggctaagattattgacatctgtgagaagggggattcgtttatcggagagcaaacaggaaatatgtacaagaatgtgaagaagaagatagaaaggggtgtggcattccctacttgcatttcagttaataacacggtctgccatttttcaccgctggccagtgatgatactgtgttggaagaaggcgacttgttaaaaattgatatggggtgtcacatagatggttttattgcagttgttgcgcacacccatgttcttcagcaaggaccagttaccggaagggctgctgatgttattgctgcagcaaatactgctgctgaggttgctttgaggctggtcaggccaggaaaaaataacaaagatgttactgaagcaattcagaaagttgctgctgcttatgactgcaagattgttgaaggggttctcagtcatcaaatgaaacaattcgtaattgatggaaacaaggttgtattgagtgtttcagcccccgagacgcgagtagatgatgctgaatttgaggagaatgaggtttatgccatcgatatagttaccagcactggtgaaggcaagcccaagttattggatgagaaacagacaaccatatataagagggctgttgacaagagttaccacctaaagatgaaagcatcccgattcatatatagtgagataaaccagaagtttccaatcatgccatttactgctagggctttggaagagaagcgctctcgacttggccttgtagaatgtcttaatcatgatctcttggagccgtatcctgttcttcatgagaagcctggtgatcttgttgcgcacatcaaatttaccgttttgttaatgccaaatggatcggaccgcattacatcccattctctacaggagttgcagcctactaaaacggtagatgaccccgagataaaagcctggttatctttaggtacgaaggctaagaagaagggtggcgggaaaaagaagaaaggtaagaaagctgatgaggcggccaatgaagaagccaaggatgaaaattcacaaggatgagagactttatttctttctcttggaaattttgaccgttgctttgtaatttgttgctctagctgctgtgtctgttgatgagaatatttttgaatgattatactgcatatacacagcgtcattcgcccttttctgtatccttctctttgtagacaggataagagatactatagaaacttgaatcaaatccagaggaattattctcgaatttggatttgtagatatatcagtttcatttgttgtttttaaagaaaaaatgcg

SEQ ID NO: 7461 - DNA, 1374 bp, Triphysaria pusilla
atttctgcctctgataaaccctaatttcgtacactcactggttcaagagaaggctcgaatttgaaggctgaaacaatgtcggacgaggaacgggaggagaaggagttggatctcacctctcctgaagttgtcaccaaatacaaatccgctgctgaaattgttaacaaggcactgcaattagttttgtcagaatgcaaaccgaatgtcaagattgttgacatttgtgagaaaggagatgctttcatcagggagcaatcagggaacacgtacaagaatgtaaagaagaagattgaaaggggcattgcattcccaacttgcatctcggtaaacaatacagtctgccattattcaccattggccagtgatgaatgtgtgttggaatccggagatattgtgaaagttgatatgggttgtcacatagatggctttattgctgtagttgcccacacacatgtaattcagcaaggaccagtaactggcaggggtgctgatgttattgctgctgcgaatacagctgctgaggttgctttgaggcttgttaggccagggaaaaagaataaagatgtcgctgaggcaattcagaaagtcgctgctgcttatgactgcaagattgtcgagggagtgctcagtcatcaaatgaaacaatttgtgatcgatggtaacaaggtcgtcttaagtgtctcagcacctgatacaagagttgaagaagctgaattcgaggaaaatgaagtatactctattgacattgttacaagtactggtgaaggcaagccaaaactcttggatgagaaacaaacgactatatataaaagggctgttgacaagaattatcacctaaagatgaaggcatctcgcttcatatttagtgagataagccaaaagttcccaatcatgccattttctgctagggctttggaagagaagcgcgctcggttgggccttgtggaatgtgtgaatcatgaacttctacagccatatcctgcactttacgagaagcctggtgactttgttgcacacatcaagtttaccgttttgctaatgccgaatggatcggaccgagtcacttctcatcctctacaggagctgcaaccgacaaaaacaattgatgatcctgagattaaagcctggttagcgttggccacaaagacgaagaagaaaggcggtgggaaaaagaaaaaaggtaagaaaggggacaaagctgaggatgcagcagcagcaacagcagctgatgcggagccaatggacaccgcagctgataattcctaagataaagaatattcttgttctagtgtattttctctttgaaattttggcttctcctttgtatttgcttgttacctttgtttagttatcatgaaatgggactcttgtttc

SEQ ID NO: 7462 - DNA, 1542 bp, Chrysanthemum coronarium
ccccatcttcaaacaaacccccttttcttaaaccctaattttcacaaaagtctgcgtatcaatttccgaaagaaaaaaagatgtcttctgatgatgaaagaggtgaagagaaggagcttgatctttcttctcctgaagttgtcaccaaatacaaatcagctgctgaaattgttaacaaggctttgcagttggtattgtcagaatgcaagcccaatgtcaagattgttgacctttgtgagaaaggagattcatatatcagagagcaaactggtagcatgtacaagaatgtaaagaagaagattgaaaggggtgttgctttcccaacgtgtttgtctgttaacaacacggttggtcatttttctccacttgctagtgacgagtccgtcttaaaggaaggtgatatcttgaaaattgatatgggatgtcatattgatggtttcattgctgtggtggcgcacactcatgttcttcaggaagggccagtgacaggaagagcagccgatgttattgctgctgcgaatactgctgctgaggttgcattgaggctcgttagacctgggaaaaagaaccaagatgtgacagaagccatccaaaaggttgctgctgcttacgactgcaagattgttgaaggtgttctaagtcaccaactgaagcaattcgtgattgatggaaacaaggtcgttctaagtgtggcaaatccagacaccagagttgatgatgctgagtttgaagagaatgaggtctatggaattgatatagttacaagcacaggagatggcaagccaaagctcttggacgaaaaacagactaccatctataaaagagctgttgacaagaactatcacttgaaaatgaaagcatcccgcttcatcttcagcgaaatcagtcaaaagtttccaatcatgccattctctgctagggctttggaagagaagcgcgctcggctaggtttggttgaatgtgtcaatcacgagcttttgcaaccataccctgttcttcatgagaagcctggtgattttgttgcacatatcaagttcaccgttcttctgatgccaaatggatccgaccgcatcacatctcatcctctacaggagttgcagaccaccaaaaatgttgatgaccctgaggttaaagcttggttagctctacctgtgaagagcaagaagaaaggaggtggcaagaagaagaaagccaagaagggagatgaagcagagccaatggacgagacaaacgacggtgctcaagcatgaggagagttttatctgtaattttgaatttgaatcaagttttgggttcctgccttgttacatcagagttttcttgaatgtactgggttgtcgtaggatggttttaacaaaagagagcatgtacacagcatcattcgtgtttcttttgcttgcgtaaaaaacctttaaatgaaatctattctgaaacgcaagtcatgaactcgttcattgcatcaaaaacataatatttgccatgatgtgctcgggaatctggttttgtttcgtcgctcttactgtctttgttatctgtgttgcc

SEQ ID NO: 7463 - DNA, 1501 bp, Setaria italica
ggctgccttgcctccctttctaatcccccctctcccgaagcccaaaccctaaacctaaacctctcaccccgccgccgccgccgccaccaccaccactttcgccgccgccgcgactcccttccagacgccggcgccccccgcttcggatcgaagcaatgtcgtcggacgatgaggtccgggaggagaaggagctcgacctctcatccaacgacgtcgtcaccaagtataaggccgctgccgaaatcctcaacaacgctctgaagctggttgtatctgaatgcaagccaaaagccaagattgttgacctttgtgagaagggcgactctttcataagagagcaaactgggaatgtctacaagaatgcaaagaggaagattgaaaggggcattgctttcccaacctgtgtatccgttaataacacagtatgccacttctcaccgcttgccactgatgaggcagttctggaagaaaatgatatggttaaaatagatatgggctgtcatattgatggttttattgctgtggtggctcatactcatgtaattacaaatgggcctgtcacgggaagagcagcggatgttcttgctgctgccaacaccgcagcagaagttgcaatgaggcttgtgagacctgggaagaagaacaaggatgttactgaagcaattcagaaagttgctgctgcttatgattgcaaaattgttgaaggtgttctcagccatcagctgaaacaatttgtcattgatggtaacaaagtcgtgctcagcgtctccaatgctgacactaaggtggatgatgctgaatttgaagaaaatgaagtatatgcaattgatattgttaccagcactggggagggaaagcccaagttattggatgagaagcagaccaccatctacaaaagggctgtagacaagaattatcacttgaagatgaaagcatcaaggtttattttcagtgagatcagccagaagttccctatcatgcctttcaccgctagggcactggaagagaaacgtgcgcgcctaggcttggtggaatgcatgaaccatgagctattgcagccatacccagtacttcatgagaagccaggtgatcttgttgcacacataaaattcactgtgctgctgatgccaaatggatcggataaggttacatcacaccagctacaggagttacagccgacaaaatccattgaagacaatgctgagataaaggcatggcttgctttagggacgaaatcaaagaagaagggtggtggaaagaagaagaaaggcaagaaaggagatgcagcagagcctatggaggaggcaacaaatggtgctccaagccaagaataattctgatttttggaattgctacctctagttttgttcatgtttctttgctgcgtctgatggtgttatattacattcagttgtggaaaaattgagtactgtttcaagtgtctaagaaatgacgcatcctgctgcacattatcgcatctaatgacataattatctatgag

SEQ ID NO: 7464 - DNA, 2047 bp, Conyza canadensis
agaaaacccaaaccaaggccgacccattacaagttacaaaccctggccgaattcacacacaccctctctataattcttggaagatatttcccatccttaaaccctagttccatatcaatatcgacgattccagtttgaagaaagaaggaaagatgtcagatgatgaaagaggtgaagaaaaggagttggatctttcatctcctgaagttgttaccaaatacaaatctgctgctgaaattgttaacaaggcaatgcagttggtattgtcagaatgcaagcctcatgccaagattgttgacatttgtgagaaaggagattcatatatgagagagcaaactggtagtatgtacaagaatgtaaaaaagaagattgaaaggggtgttgcatttcctacatgtttgtctgtgaacaatacagtctctcatttttcgcctcttgccagtgacgagaccatcttaaaagaaggtgacattttgaagattgatatggggtgtcatatagacggtttcatagctttgctggcgcacacacatgttcttcaggaaggtccagtgacagggaaagcggctgatgttattgctgctgcaaatactgctgccgaggttgccttaaggcttgtaagacctggaaagaagaaccaagatgtgacggaagccattcaaaaggttgctgcagcatatgattgcaatattgttgaaggtgttcttagtcatcaacttaagcagtttgtgattgatggaaacaaagttgttttgagtgtctcaaatcccgacaccagagttgatgatgccgagtttgaggagaatgaagtatatgcaattgatatagtcactagcacaggagacggaaagcctaagttgttggatgagaaacagactactgtctataaaagagctgtggacaagagctattacttgaaaatgaaggcatcccgtttcattttcagtgaaattagtcaaaacttcccaatcatgcctttctctgctagggctctggaggaaaagcgtgctcggctaggattggttgaatgtgtgaatcatgagcttttgcaaccataccctgttcttcatgaaaagcctggtgattttgtggcacatatcaaatttacagttcttttaatgccaaatggatccgatcgtattacatcacactccttacaagagttgcagacaactaaaactgttgatgaccctgaaatcaaggcttggttggctttacccgtgaagagcaagaagaaaggtggcgggaagaaaaagaaaggtaagaaaggcgaaaaagctgaaggtgatgaagcagttgtgatggatgaaagcacaaatggtggcgcccaagggtaagaaccagatatctattgtgtaattttgacaatgcgaatccattttggttctttgttgcatcagagtctacttgaatgtacgggtgtttcctacaaggatgtttcaacagaagagagcatgtacacagctttatttgtgtgttcttttccttgccagagacaaccccaaaacaaagtcttaatcgaaaagtaactcttaaattcgtgcattacaataacatatagccatggtgtgttcaggatcactctatgcagtcaatttgcatcccctctgttactatttatgcctttttatctggcttgaaagtcttagttgttcctagtagacctcttttagtcgcctcactagaccaaatctgcttgatatgtggtcttatcatgctgattgaccagccagctgggttggtttcgctattcttttctattgaaaaggagtcggttgtctgtgcaagtaatctttttctagactccgctgcattctcgttttaataaatagttgttggccttgtaaataattgccatagttattttctttttacaatgaagtttttctattttattatttctagcacccccgccaaataacctattgccgtcgaaggtgaaaaatgagatgttctgtagttatacctttaaaaagatttaacttttaaaagttattcaagacatgagaaactcaattgtatttttatcaatataagaaaagtttag

SEQ ID NO: 7465 - DNA, 1583 bp, Euphorbia peplus
gtaaaagctcctatataaagcaaactgagctcgatctttctataaccctagcacctccattcagccacctcatctcttcgcacttatctctctcgtctccactaaaccctagctcctaacttttatttttccgccacctcaccgccggcacacatcctcgtaatttcattgctgtaagttatcaaagctttgaaacgatgtcggatgaagaaagagaggaggagctggatctcagctctcctgaagttgtcaccaaatacaaaagtgctgctgagatcgtaaacaaggcgttacagatagtgatagcagaatgtaagcctaaggctaagattgttgacctttgtgagaaaggagatgcttacattagagagcaaacaggtaatatgtacaagaatgttaagaagaagattgaaagaggagtagcttttcctacttgtatttctgtgaatagcactgtttgccatttttctccacttgctagtgatgagtctgtgttggaagacggtgatatgatcaagattgatatgggatgccatattgatggcttcattgctgtagtagcacacacccatgttcttcaagcaggaccagttactggcagggctgctgatgttattgctgcagcaaatacagctgctgaagttgccctaaggcttgtaaagccagggaagaagaacaaagatgttacagaagcaatccagaaggttgcttctgcttatgactgtaaaattgttgaaggtgttctcagccaccagcttaagcagtttgtgattgatgggaacaaggttatactaagttcctcaaatccagaaacaagagttgatgaggcagaatttgaggaaaatgaagtgtattcaatagatatagtgacgagcactggtgaaggcaagcctaagttgcttgatgaaaagcatactaccatttacaagagagcagtcgacaagaactatcacttgaaaatgaaagcttctagatttattttcagtgaaattagccagaaatttcctatcatgccattcagtgccagggctttggaagagaaaagagctagactaggattagtggaatgtgtgaatcatgaccttctgcagccatatcctgtactctatgagaagcctggtgatcttgtggcgcacatcaaattcacagttctactcatgccaaatggctcagataggatcacatctcattctctgcaggagttgcagccaaccaagacgatagaagatcctgatatcaaggcatggttagctttggccataaagaagaagaagggtggtgggaagaagaagaaagccaagaagggtgagaaagctgaagaagctgagcctatggatgcaacaaatgaggctgaaacccaagaatgaggcttacaaattatttaaaatgcctttctactcagttttgcacttagttgacctcattgtatctgtttgcttatgaaaagattttaaatatagtgtttagacatttttatcctgatttaattcccctgcatatggattttcatgaccacctttttcttttggttttgggaagtatcttaaacatgataagtatgtgaaaattaaccttgtctatgg

SEQ ID NO: 7466 - DNA, 1827 bp, Allium cepa
ccctagttacgggggacttcttataaatcacattgccttaccctatagccgccatcttctcgccgctcgctcgatctatatccgtctctacctaaaaccctaatcttgtttcaggtcctaatcgaaagatgtctgacgacgaagtaattgaagagaaggagcttgatctctcatcttctgatgtcgttaccaagtacaagagcgcagccgagattgttaacaaggctcttaaattggttgtgtcggaatgcaaaccaaaggctaagattgttgacatatgcgagaaaggagattcttttattagagagcaagctggaaacatgtacaagaatgcaaagaagaaaatcgagaggggtgttgctttcccaacgtgtatctctgttaacaacactgtttgtcatttttcaccggtggctggcgatgagactgttttggaagagaatgacatcgtcaaaattgatatgggatgccacatagatggtttcattgcagttgttgcacacactcatatacttcaaaaagaacccataactgggagagcagctgatgtaattgcagcagctaatacggctgctgaagttgcattgaggcttgttaggcctggaaaaaagaacacagatgtcaccgaagctattcagaaggtggcggctgcttatgattgtaaaattgctgaaggggttcttagtcatcagcttaaacaatttgttatcgatggaaataaagtcgttctgagtgtatcaaatcctgataccaaagttgatgttgtagaattcgaggaaaatgaagtgtatgccatagacatagtaactagtactggtgaaggcaagcccaagttattggatgagaagcaaactactatctacaaaagagcagtggacaaaaactataacttaaaaatgaaagcatcaaggtttattttcagtgaaattagccagaaatttccaatcatgccatttactgcaagggctttggaagagaagcgagctcggcttgggttgttagaatgtatgaaccatgatctcttacaaccatatcctgttctacatgagaaagctggtgaccttgtagctcacataaagtttacagtattattgatgccgaatggttcagacagaattacttctcatccgttgcaacagttgcaacccactaaaaccatcgatgatccagaaattaaagcatggttagctttgagcactaaaacaaagaagaaaggtggagggaagaaaaagaaaggcaagaaatctgaagctacagaaggtagtgaagccgtaccaatggaagaagcatctgatgcggcagctgcaaaataattgcaagtttgatgttaatttttgatactatctgaagaaccatggtaatttatcttttgtgtagagagagatgcatggggagaggcaaattttttaggtggcaagtgcgctcatgtttaaaaaaaaactatataatcgtcacaaattgctgaagctttgcctttttggttgatgtgcccttgaacaattttagtttgcaaatgtagtttttgtcaatttcaaaccaggattctagtttagttcatgtttaaatgttttggtcttgtcaccattaagtgcgcaggccaaccttacatagtttagatgttgccctcgatttcaaagagtatcatagagatacgcctttagggaatgcaaaatattaatgatgctcatgggtcgatttttattctgccgcttgttggtatgagagattaaatacaaaattcagcgcggtaagaataacccactttgtagaatctagtaatattcatgtccataactaagtaaagtgagaaacttatgagccgttgaa

SEQ ID NO: 7467 - DNA, 1556 bp, Petunia hybrida
cgcgggggaaacagtcttttgcacactcaaaaccctagctcaaaccctcgtcgcctccaaattttcattcgatactgttatttattaggtgatttgtaagtatgtcggacgacgaaagagaagagagagagttggatcttacaagtcctgaggttgtcaccaaatacaagagcgccgctgaaattgttaacaaggccttgcaattggtgttatctgagtgcaagccaaaagcaaagatagttgatctttgtgaaaaaggagatgcctatatcaaagagcaaactggaaatatgtacaagaatgtgaagaagaagattgagaggggtgttgcatttccaacctgtatttcagttaacaacacagtgtgtcatttctctccattgtccagcgatgagacagtactggaagagggagatattttgaagatagatttgggctgtcacatagatggatttattgcagtagttggacatacacatgtgcttcaggaaggaccagttactggtagagctgctgatgtcattgcagctgctaatacagccgcagaagttgctttgaggcttgtgaggccaggaaagaagaactcagatgtaacagaagctattcagaaagttgctgctgcctatgactgcaagattgttgagggtgtcttgagccatcaaatgaagcagtttgttattgatggtaacaaagttgtcttgagtgtgtccaatcctgaaacaagagttgatgaagcagagtttgaggagaatgaggtctattccattgatattgtgacaagcacaggtgaaggaaagccaaagttgttggatgagaaacaaacgactatctacaagagagccgtggacaagagctataacctgaagatgaaagcctcaaggtttatcttcagtgagatcagtcagaagttccctatcatgccattcaccgcaagggatttggaggagaagagggctcgtttgggtctcgttgaatgtgttaaccatgagcttttgcaaccatatcctgttctacacgagaaacctggtgatttggttgctcacattaagttcacagtgctattaatgcccaatggatcggacagagttacttctcatgctctccaggagctgaaccctacaaagacagtagagaatgaacctgaaatcaaggcctggcttgcccttccagttaagaccaagaagaaaggcggtgggaagaaaaagaaaggtaagaaaggtgagaagacagaagagtcatctcaagctgagcctatggaaggatagtggaatgctccaaaaccttgatacattgcaattttgatgtgcttgatcaatcaacttcactgaaactattggtttagtgttagctgactcggttgagctgcttgttgttcatctttatggggctatgagagttcttgttgtcatcctgtactgtcatgttaagctactctctgttggttttcagatgctattctaaatgcgctcatatcattttaaaccttcaataagacttgttctgcccctcaatttgaagtcgtatggtattccaattttgtttctctaccccaaagt

SEQ ID NO: 7468 - DNA, 1465 bp, Lippia dulcis
ttcgtatattcttattgccactttcatttcacaaccgctgaaccctaatttcctagctcttcccaagatttcatttggtcgaaacgatgtcggacgaggaaagggaggagaaggagctggatctcacctctcctgaagttgtgaccaaatataaatctgctgccgaaattgttaacaaggcattgcaattggtgttgtctgaatgcaagccaaagacaaagattgtcgacctttgcgagaaaggcgacgcattcatcagagagcaaactggtaacatgtacaagaatgtgaagaagaagatagaaaggggtgttgcattcccaacttgcatatcagtgaataacaccgtctgccatttttctccgttggccagtgatgagactgtgttagaagagggagatattttgaaaattgatttggggtgtcacatagatggatttattgctgtagttgggcacacccatattctgcagcaaggaccagtcaccggcagggcagctgatgttattgctgctgcgaatactgctgctgaggttgctttgaggcttgtgaggccagggaaaaagaataaagatgtaactgaggcaatacagaaagttgctgctgcttatgattgcaagattgtcgaaggagtactaagtcatcagatgaagcaatttgtgattgatggaaacaaggtcgtcttaagtgtttcaagccctgatacaagagttgatgaagctgaatttgaggaaaatgaaatatatgccatcgacattgttacgagtactggtgaaggcaagccaaaattgttgggtgagaaacaaacaactatctataaaagagctgtcgataagaattatcacctaaagatgaaagcatcacggttcattttcagtgagataagccagaaattccctatcatgccattttctgcaagggctttggaagaaaagcgtgctcgcttgggtcttgtagaatgtgtcaatcatgaacttttacagccctatcctgtacttcatgagaaaccaggcgatctggttgcacatatcaagttcactgttttgctcatgcccaacggttcagatcgaatcacaactcatcctctacaggagctgcagcccacaaaaaccatagatgatcctgagattaaagcctggttagcattgcccacgaagacaaagaagaagggtggagggaaaaaaaagaaggcaagaaaggtgacaaggctgaagataatacagctgatgctgagcctatggacgtagcagcaacaaatggtgcggcttcttgagaatagacaattattttcttttatttgtattttctatgaaattttgacagcatcctctgtatttggttgcattgagtcacgaaatatcagtcccttttaagtactttttgtacgctgatttgtgggtcttttttttatgtatccatcgttgtcttctatttagtcctaggtagatggtacaataatccagaa

SEQ ID NO: 7469 - DNA, 1865 bp, Fragaria vesca
gcaagtggagctgacattgcaaacaaaacattttgattttgatggtggcatgagattcatgttcaaacccagcttgtaaaaaaacatttatcaagatcgcgggttagtgtctgactgtaccaaaaaaaaaaagtgaataagcaattactgtaaaaatatagaattagcaataacgtgatattaataagtaatgaaaattaaaaccctacaaaaaacagcgacccaaaatcctataaaagcaaacgcagcctcacgttgaaaccctagcccttctactaagcccacctccatttcgtccttatttgttcccctctcttccctttaaaccctaacacaaacactcccactcgcctccatcgtctctcccaaatcttcttccacccaggtttcagaatccggtccccgaagcttcgaaacgatgtcgtccgacgacgagagggaggagaaggagttggatctcacctctcctgaagtggttaccaaatacaagagcgctgctgagattgttaacaaggctttgcagcgagtgatagcggaatgcaagccgaaagctaagattgtggacgtttgtgagataggtgattcattcatcagagagcaaaccggtaacatgtacaaaagtgcgaagaagaagattgaacgaggagttgctttcccaacttccatttctgtgaacaacactgtatgccatttctctccgcttgccaccgatgaaacagtgtttgaagaaggggatattgtaaagattgatatgggttgtcatattgatgggttcattgccatagtcgcacacactcatgctcttcaaacagggcctattactggaagagctgcagatgttatagcagctgctaacactgctgctgaagttgccttgaggcttgtcaagccaggaaaaaagaacaaagatgttacagaggcaattcaaaaggttgctgctgcttatgattgcaaaattgttgaaggtgttcttagccaccagatgaagcagtttgtgatagatgcaaacaaggtcatattgagcatatccaatccagagacaagagtggaggaggcagaatttgaggagaatgaagtttatgcaattgatatagtagcaagcacaggtgaaggaaagccaaagctactggatgagaagcagacaactatatacaagagagctgtggacaagaactatcacctgaagatgaaagcctctagattcattttcagtgaaattacccagaaattcccccttatgccattcactgcaagggctttggaagagaaaagggctcgtttgggtttatttgagtgcgtcaaccatgatcttttgcagccatatcctgttctgcacgagaaacctggtgatattgttgctcatatcaagttcactgtattgctcatgccaaatggatcagaccggatcacatctcatcccctacaagagttgcagcccactaagcaagtagatgatcccgaaatcaaagcatggttggctttgggcaccaagacaaagaagaaaggtggtggaaagaaaaagaaaggtaagaagggtgataaagtggaagggtctacagaagcagaacctatggatgctacaaatgatgctgaaactcaaggatgagcgtgtgttaccgaatcatatttcagttttggtcttttctgcccccttgtatctggctggatatgaattaatttaatacatagtctacttttctagctggattttctctaatttgcttttctagtacgctgcgttcttgtatcttgaaatgcaatggttgttagacttaattttgaccccttataaatataaaaaatctacagttaaggttattctctgtgaaattgaagagcatgatcctgtttgggtcatttctgtc

SEQ ID NO: 7470 - DNA, 1682 bp, Eschscholzia californica
atcttcttctatatatatatattgaacgctaacaagagtttgccctaagctctgaacccccgccacctctatctttatcacttcccccaccagttatcgccgccgtattctcttttcttcctcaaaaccctagctcaactagttcatttcttgtaagagaagttaagattcatatcaagaatgtcggacgatgaaatgaaggaggagaaggagttggatctcacttctcctgaagtcgtaaccaagtataagggtgctgccgagattatcaacaaggcgttacagttggtattgaaagattgcaaaccgaaagcaaagatcgtagatttatgtgaaaaaggagatgcttatatcagagagcaaactggaaacatgtacaaaaatgctaagaaaaagatagagaaaggcattgcatttcctacaagcatttcagtcaacaacacagtctgccatttctcaccacttgctagtgatgaaactgtcttggaagaaggtgacattataaagattgatatgggttgtcatatagatgggttcattgccgtagttggacatactcatgttcttcaggaaggacctgtgactgggagggcagctgatgttattgctgcagctaatactgctgctgaagttgctttgaggcttgtgagaccagggaaaaagaacaaagatgtgacagaagctattcagaaggttgctgctgcttatgactgcaagatcgttgagggtgttctcagccaccagcttaagcagtttgtgatagatgggaacaaggttgtacttagtgtatccagtcctgacacccgagttgatgatgcagagtttgaggagaatgaagtctacgctattgatatagtcaccagcacaggagatggcaagcctaagctgttggatgagaagcaaactacgatatataaaagggctgtggacaagaactatcacttgaagatgaaagcatccaggttcatcttcagcgaaataagtcagaaatttcccatcatgccattttcagccagggctttggaagagaagcgtgctcggttggggttagtagaatgcgtgaatcatgatcttttgcagccatatcctgttcttcatgaaaagcccggtgatttggtagcccatatcaagttcacagtcctgctaatgcctaatggctcagacagaatcacaacccatgctctccaggaactgaaacccactaaaacgatagatgaagaacctgaaatcaagtcctggttagctctggccacgaagacaaaaagaaaggaggtggaaagaagaagaaagggaagaagggggagactgctgaatcaactgaagctgagccaatggatgcagcatctgaaggtgcagcagccgcagcccaagaatgagaatgatttcaattttgtagggttctttttatacattggcactttgagacttgagagagactccctcctccccccttttacagtttgggaataactgttcttacttgacagtgtagtagttgtatgggacgtgattgaacagagaaatacaagtttgttgcggatcagtttcctatattctttattgtggtttcatttctttacttgtgagagaaactgcatgttttgtggtttgttactttgaacaaaccttaaaacgaaaagtaagattggtagtaagtagataaccattaccgctactgcttt

SEQ ID NO: 7471 - DNA, 1745 bp, Populus trichocarpa
acagaggcaagagtgtgtagaaaattcctatataaggcaaacgctgccgcaaagaaccaaaaccctagagctcccacctcaccgtctcaccatccttttatacaacttaactgcttctcttttcaaaaccctagctccctctttccctcctttcctccaccgccgctaatccattatcgccaccgagtcggttattgatatcaaaaggattcagtacgatgtcgtcagacgacgagagagaggagagagagttggatcttacttcccctgaagtcgtcaccaaatacaaaagcgcggctgaaattgtcaacaaggcattgcagttagcgatatcagaatgcaagccgaaggctaagattgttgatatttgtgaaaaaggagattcgtatatcagagagcaatctggaaatatgtataagaatgtgaagaagaagattgaaaggggagttgcttttcctacttgtgtttctgtcaacaacactgtttgccatttttctccgcttgctagtgatgaatcagtcttagaagaaggagatgttgtcaagattgacatgggatgtcatatagatggatttattgctgttgttggacatacccatgttcttcagtcagggccagtaacgggtagggcagctgatgttattgcagcagccaacactgcggctgaagttgcattgaggcttgtaaggcctggaaagaagaataaagatgtaactgaagcaattcagaaagttgctgctgcttatgactgcaaaattgttgagggtgtcctaagccaccagctgaagcagtttgtgatagatggaaacaaggtaattctgagtgtctctaatccagacacaagagttgatgatgcagaatttgaggaaaatgaagtgtatgcagtggatatctttacaagtacaggggaaggcaagccaaagctgttggatgagaagactactacaatttacaagagagctgtagataagaattatcacttgaagatgaaatcttccagattcattttcagtgaaatcaatcagaaatttcctatcatgccattctctgctagagccctcgaagagaaaagggctcggctgggattagtcgaatgtgtgaatcacgatctactgcagccatatccagttcttcatgaaaagcccggtgattgcgttgctcatatcaagttcacagtattgctaatgccaaatggatcagatcggatcacatcacatgctctgcaagagttgcagcctacaaaaacgatagatgatcctgaaatcaaggcgtggctagctttgggtacaaagacaaagaagaagggcggtgggaaaaagaagaaagctaagaaagcaggcgaaaaagctgaggaggcaacagaagctgaacccatggatgcaacagaagctgaacccatggatgcaactacaaatggggccaccgccgtctaggaatgtatctctatatacaagtgcccattttgttcagttttgctactccattcacctcgttgtacctcttgttggttgagatgatttaatatagtgtctagacagttgtcctaattcgattttttcttgcatatgccttgccatgactcacctttcctgtatcgcccctgttttaggtgttcatccaaaagtggagaagtggaatagttaatcacttggattagtacctttgcccatgatatcaagatccagtttttatcacccttagggcaacgaaaatgcacgcacctttcagttgccttcataataatg

SEQ ID NO: 7472 - DNA, 1692 bp, Aristolochia fimbriata
cggtaccataattgtgcagcatatttagggttagatccgtcctataaaaaatagtgaaagttcctcttcttaaggacggcatacctctagttcctcatcacccactaaaaccctagcactctcgcggaaccgtcggcccgcccactgaaaactttgtaagaacgtcaaggcaactcctgtattctaaatgatgtccgacgacgaggcgaaggaagagaaggagttggatctttcttctacggatgtcgtaaataaatataaaagcgcagccgaaatcgttaataaggcattgcagctcgtgttatccgagtgcaaaccaaaagctaaagttgtagacgtttgcgagaagggcgatgcttttatcagagagcaaactggtaacatgtataagaacaccaagaagaaaatcgaacgaggtgtcgcattccccacttgcatttccatcaataatacagtctgtcatttttctcctcttgcaagtgatgaagccgttatggaggagaacgatatagtgaaaattgacatgggatgtcatatagacgggttcattgcagtcgtggcccacacccacgtactccaagaagggccagtaacgggaagggctgcagatgtcattgctgctgctaatacagctgctgaagttgctctcaggcttgtgaggcctggccggaagaataaagatgtgacagaagctatacaaaaggttgctgctgcctatgattgcaaaatagtggaaggtgtactcagccatcaacttaaacagtttgtcattgatggtaacaaagttattctcagtgtaagcaatccagatactagagttgatgatgcagaattcgaggaaaatgaagtatatgcagttgatattgtcaccagcaccggtgatggcaagcctaggcttttggacgagaagcaaaccactatctacaagagagctgttgacaaaaactatcacctgaaaatgaagtcgtcaaggttcatattcagtgaaattagccagaagttcccaatcatgcctttcactgcaagagcgctggaagagaaacgtgctcggctcggtttagttgaatgtgtgaatcatgaccttttgcagccttatccggtgctgcatgaaaagcctggtgacctcgttgctcacattaaatttacagttttattaatgccaaatggatcggataggataacctcccatcccttgcaagatttgcagtctaccaagtctgtccaagatgatcctgaaatcaaggcttggttagctttgggtacgaggacaaagaagaaaggaggtgggaagaagaaaaaagggaagaaaggtgaggcatccgaggctgagcctatggagacaacggaacctgcaaatgccgcatcctaggaagatggttacaattttgctatttaacgtgtatttcaagtgttaatcctaggaacaaattgcattatcaagcatgactggtttttctaagaagagtccaggtgtttcccagtttgtttatgccttctatgatgggaaagcagaggggaaagctttaattgtaatttataccgggaagttgttgagggtaaatcgggttaaatctcagccgtaataacgttagctttctctagaattatttgaaagacaaaccaggaaagctatatactgactggtactatttatagacggactactcgtgcgggttacaacacggggttaca

SEQ ID NO: 7473 - DNA, 1450 bp, Musa acuminata
attacgccgcctgcccgaaggcctaattcctaaatcggcgcaccgattgctgtgctctccatctgatttctccctgggtgtagggtttagagagatgtcggatgatgaagcgagagaggagaaggagttggatctcacctcccccgatgtcgtgaccaagtacaagagcgccgctgagatcgtcaacaaggcgcttcagttggtgatatccaagtgcaagcccaaagccaagattgttgatctttgcgagcaaggcgacgcttttatcagggagcaagctgggaacatatacaagaatgtaaaaagaaagatcgagaggggtgtagcttttcccacatgcatttctgtcaataataccgtgtgtcatttctcaccactcgccagcgacgacgctgttctggaagagaatgacatcgtgaaaattgacatgggatgccatatcgatgggtttattgcagtggtggggcacactcatgttatccaggaggggcctgtgactggtagagccgcagatgtgattgctgctgctaataccgcagcagaagttgccttaaggcttgtgaggcccggaaaaaagaacaaggatgttacagaagctattcagaaggtagctgctgcctatgactgcaaaattgttgaaggagtgcttagtcatcagttaaagcagtttgtaattgatgggaacaaagtcataatcagtgtaacaaaccctgaaacacgtgttgatgaattcgaatttgaagaaaatgaagtatatgcaattgatgttgtgactagtacaggtgaaggaaagccaaaactgttggatgagaagcaaactacaatctataaaagagctgtcgataaaaattaccacctaaaaatgaagtcttcaaggttcattttcagcgaaataagccaaaagtttccaatcatgccattttctgcaagggctttggaagagaagcgagctcgtcttggacttgttgaatgtgtgaaccatgaccttttacagccgtaccctgtgttgcatgagaagcctggagacctggttgcgcacattaaatttacagtattgttgatgcctaatgggtcagacaggattacctctcatccacttcaacaattgctgccttccaaaatgattgatgacaatgccgaaattaaagcatggatggccttgggaacaaagacaaagaagaaaggtggaggaaagaagaaaaaaggcaagaaaggagatgcccaggatgatgcagcagaatctgaacccaaggatagtgcatcaaatagcacagcggcttagcgactaagctagaaagttttggtgcacctttattacatttattagtggcttcccgagcgtcatcctttcatgaattttatgtttatttatggaaatgaaaatgcaaaatattctaattttgagtaatgattttggattttgtatcgaaaaatcttacgagctccgccc

SEQ ID NO: 7474 - DNA, 1222 bp, Centaurea maculosa
gtcggatgacgaaagagcagaggagaaggagctggatctcacctctcctgaagttgtaaccaaatacaaatcggcagctgagattgttaacaaggccttgcagttggtattgtcagaatgcaagcccaaagccaagattgttgatatatgtgagaagggagatacatacatcagagagcaaactgggagtatgtacaagaatgttaagaagaagattgaaaggggtgttgcatttcccacatgtttgtctgtgaacaacacagtatgccattactctccacttgccagtgatgagacggtattggaagaaggtgacattttgaaaattgatatggggtgtcatatagatggtttcatagctgtggtgggccacactcacgttcttcagcaaggacctgtaacaggcagagcagctgatgccattgcagcggcaaatactgctgctgaggttgcgttaagacttgtgaagcctggaaagaagaaccaagatgtgacagaagccattcaaaaggttgctgctgcatacgactgcaaaattgttgaaggtgttcttagtcatcaactgaaacagtttgtgattgatgggaacaaagttgtattgagtgtctcaaatccagaaacccgagtggatgatgctgagtttgaggaaaatgaagtttatgcaatcgatatagtcacaagcacaggagatggcaagcctaagttgttggatgaaaagcagacaacaatctataaaagagcagtggacaagaattatcacttgaaaatgaaagcatctcggtttatattcagtgagattaatcaaaaatatccaatcatgccattctcagctagggctttggaagagaagcgtgctcggcttggattggtggaatgtgttaatcatgagctcttgcagccataccctgttcttcatgagaagcctggtgattttgttgcacatatcaagttcactgttcttctgatgccaaatggatcggatcggataacctctcatacgctgcaggaattgcagccaactaaaaccgttgatgaccctgaaattaaagcatggttatctttacccgtaaagagcaaaaagaaaggcggtggaaagaagaaaaaaggcaagaaagctgaaaagggtgaaggggaggtggagccaatggaggaatcatcaaatgaccaaggccaagggcaagaatgaaatttggctatgtaatttgatagaagttaaaaagag

SEQ ID NO: 7475 - DNA, 1578 bp, Cichorium intybus
aagcaccgccgacctccaaaccctagctcacgacatatactcccaccatcgcttccttttcgtttctttaaatcctaatcgctcctgttcatcgtttaattgcttgttctgaggaaacatgtcagacgatgaaagaggggaggagaaggagctggatctttcctctccagaagttgtaaccaaatacaaatcggcggctgagattgtcaacaaggccttgcagttggtattatcagaatgcaagcccaaagcaaagatcgttgatatttgcgagaagggagattcatatgtcagagagcaaacagggaacatgtacaagaatgttaaaaagaaaatcgaaagaggtgtagcatttcccacatgtttatcagtaaacaacacagtctgccattactctccacttgccagtgatgaaacagtattagaagaaggtgacattttgaaaattgatatggggtgtcatatagatggttttattgctgtggtggcccacactcatgttcttcaacaaggacctgtaacaggtagagtagcagatgcgattgcagctgcaaatactgctgctgaggtggcattaagacttgtgaagcctggaaagaagaaccaagacgtgacagaagccattcaaaaagttgctgctgcatacgactgcaaaatagtcgaaggagttttaagtcatcaattaaaacaatttgtaatcgacggaaacaaagtcgtattaagcgtctcaaatcccgaaacacgagtcgatgaagccgagttcgaagagaacgaagtttacgcgatcgatatagtcacaagcacgggagacggcaagccaaagttattggatgaaaaacaaacaacgatttacaaaagagcagtcgacaggagttaccacttgaaaatgaaagcctcccggtttatcttcagtgaaattaatcaaaagtttccaattatgcccttctcagcaagggcattggaagagaaacgcgcgcgattgggattggtggaatgtgtaaaccacgaacttttacagccgtaccctgttcttcatgaaaagcctggtgattttgttgcacatataaaattcacggttcttttgatgccaaatggatctgaccgcataacatctcataatcttcaagaattgcaaccgactaaaacagttgatgatcctgaaattaaatcgtggttggctttacctgtaaaatccaaaaagaaaggcggtggaaagaagaagaaaggtaagagagcggaaaaaggtgaaggtgacgtggaggtgatggaggtggatgcatcgaatggtggtggccaataatgagaggagagagaatggatgtaatttgatagttgaaaattgaaatccagttttgggattgttgtaggtttttctttgattttcttcaaaagatgtgtgaaagagcatatcataatatgtacacagggtttttaaacatcgtttgtgttctattttacaaagacaatcaaaagaacatgtcaaaatcaagatgaaaaagaaatacttgtggtgggagttgtgtataagaaaaaacaatagcatcgtatactaataatgttttctgttatataccctcc

SEQ ID NO: 7476 - DNA, 1592 bp, Gossypium hirsutum
ctgccgttaagcgtaaggaccgcaaccctagccacccttccctgatttcatttcttctgtactctcagtaatcacctctacaaaaccctagctcattcactcactgccgccaatttcaaccaattatttgtttataagcgtcgaaaacgatgtcggacgacgagcgagaggaaaaggagttggatctcacctctcctgaagttgttactaaatacaagagtgctgctgagatcgttaacaaggctttgcagttagttgtaaaagaatgcaaaccaaaaactaagattgttgacatttgcgagaagggtgatgcatttatcagagagcaaacaggcaatatgtataagaatgctaagaggaagattgagagaggtgttgccttccccacttgtctttctgttaataacattgtttgtcatttctctccacttgctagtgacacctccgagctgcaagaaggtgatatggtgaagattgacatgggttgccacattgatgggtttattgctgtagttgcgcacacccatgttgtccaggaaggaccagtcaatgacaggaaggctgatgttattgctgctgcaaataccgccgcagaagttgcattgaggcttgttaggcctgggaagaagaataaagatgtaacagatgcaattcagaaggtagctgcagcttatgactgcaaaattgttgaaggtgttcttagccatcaattgaagcagtttgtgatagatggaaacaaagtcatactcagtgtctccaacccagatacgagagttgatgatgcggagtttgaggagaatgaagtttatgcagtagatatagttgcttcaactggtgaaggcaagccaaaacttttggatgagaagcaaaccactatttataagagagcagttgacaagaattatcatttaaagatgaagacatctagatttattttcagtgaaataaatcagaaatttcctattctcccattcactgccagggctctggaagagaaacgagctcgtctaggtttagtcgaatgcgtgaatcatgatctgttgcagccatatcctgttcttcatgagaagcctggggattatgttgctcatataaaattcacggtgttgctaatgcctaatggatcagaccggatcacattgcatccgctgcaggagctgcagccaaccaagacaatagatgatcctgaaatcaaaggatggttagctttgggaacgaagacgaagaaaaaaggtggtgggaagaagaagaaaggtaagaagaatgagggtgataaagctgatgcagagcctatggatgcatcaaaaactgatgccgctgcatcttaagaaacaaactcctattcttctactcctaccttttttttttttacatttcaattttggtactttgttcactttgtatctgtttgtcaaatgttagtgcatcagatattgatccttttcctaattgaattgggcttttactcgaatgtcttcgtctaattatatcatatctatgggttttaattaggtttcctgagttgaagatgaaatgttattgttatcgtcgccataaataaagtttgatttatatgtgactttttaaaaaaa

SEQ ID NO: 7477 - DNA, 1556 bp, Gossypium hirsutum
atataaccaaacgctgccgtaaagacccgtaaccctaactctctacttcagtactcaccacccgcccttcctattttagtttatatactccctccaaaaccctagcgctttcactcgccgccgccaatttcaaccacaattagatagattcttgataagattcgaaagcgatgtcagacgacgagagagaggagaaggagctggatctcacctcctctgaagttgttacaaaatacaagagcgctgctgcgattgttagcaaagcgttacaattagttgtaaaagaatgtaagcccaaagctaagattgttgacatttgtgagaagggtgatgcatttataagagagcaaacaggtaacatgtacaagaattctaagaagaagattgagaggggtgttgccttccctacttgtctttctgtaaacaacacagtctgccatttctctccacttgctagtgacacctcggagttggaagaaggtgatatggtcaagattgacatgggttgccacattgatgggtttattgcagtagttgcacatactcatgttgttcagagcgggccaatcactggtaagcaggctgatgttgttgctgctgcaaatactgctgctgaagtggccttgaggcttgtaaggcctggaaaaaagaacaaagatgtatctgatgcaattcagaaggtagctgccgcttatgattgcaaaattgttgaaggtgttcttagccatcaactgaagcagtttgtgatagacgggaacaaagtcatactaagtgtctccaatccagataccagagttgatgatgcagagtttgaggagaatgaagcttatgctgtagatatagttgcaagcactggtgaaggcaagccaaagttgttggacgagaagcagacaactatttttaagagagctgtcgacaagaactatcatttaaagatgaaggcctctagatttattttcagcgagataaatcagagattccccatcctgccattcaccgctcgtgccttggaagagaaaagggctcgtctaggtttagttgaatgtgtgaatcacgatctcttgcagccataccctgttctctatgagaagcctggtgattatgttgctcatatcaaatttacagtattgctaatgccaaatggatcagatcggattacatcccatcccctgcaagaactgcagccaaccaagatgatagacgatcctgaaatcaaggcctggttggctttgggaacaaagacaaagaagaaaggtggtgggaagaagaagaaaggtaagaagggtgataaagctgagggtggagccgagggtgaggccatggatgcatcgacaaatggtggtgcatcataaggaaacaataataaaaatgtttttgcgcatattttctaatctgcccttttatatattatgatgattgccaaaatttttgatactgtgttcacttgtagcttgttggttatgagttaaaattttaatatgagtagttttttattttatggcatgacatccacttggagtcttgtgtttgtgtgtgatgtgcaacttaataggaaa

SEQ ID NO: 7478 - DNA, 2683 bp, Echinochloa colona
atccataccaagatggggatatcttcgtcaacaacaaaacaaacgattttatctcttctgttctaccttgccttcctaatgccaactccattcaaactcagaatcactgagaaactaccacatttattttgagatcttctgcatccccaagcaattattggtatcacgtcttttaacttgagatggtgaaaattcgacaagtttgggtggaacaacagacagcagaccgcacgcaatagcaacactgtgaatggccacatgaaaatatgaaagcttgcacctcactgacaaccagtcattctcgcccagtcaacaaactgcattcctccatacacattattggcaaagcgcacgcccacagtgaacgccagagaagcagctgggacacgcttggcaacaggtgatgcctcaaccaagcgctctagtccattaataatctgataacgagtgttggaagaaacaccaaggaatgcaccccacaaagcagaagttttgagaagaggtggaacaggtacatcattctcagacttcttaacactccgtttggcagtcattatcaaattagcaattccttgtcccacaataccacaaaagaatccaacgcaaccatataaaatccccttgaaaaaatatgttccaatccgttgttgtacagaaaatttgtatcctggcctttcagcttcaaaaacgctgcttgggagggcatcatatgcatgcctaacacgcccaaggagaccctcggatgcagatctgccaccgaatcgagcatatggtgctaacatgccgactaaagctacattaacaactactcctaccagcatatctgctgcatacaactcaaactccgaccaaaactcctcccctctcttctgaacctctgcaaatgtcgcgcagcatgtatctataactatctccgtcccgattttgaagaggaatgcaggatcaaccagcatcctgttccggagaagcgagcaggacctaatggcaggacccaggggccaggccgacgcctgcatgtccaagtatctgagcagcagcagcttctgaatcccgacggtcttggccgcctcgaccatgtccgcgggcatgctgggcaggctaaccccgcgcttctctgcctcctgcaccacctgctcgaagctcaggatgggcccgaactcatcctccccctcctcaccatcacccccgccgccaccaccaaccaccactttcgccgctgccgcgactcccccctcatccgccgacgtcccccgcctcggatcgaagccatgtcgtcggacgatgaggtccgagaggagaaggagctcgatctctcatccaacgatgtcgtcaccaagtacaaggccgccgccgaaatcctcaacaatgctctgaagctggttgtatctgagtgcaagccgaaagccaagattgttgacctttgcgagaagggtgatgctttcatcagagagcaaactgggaatgtctataagaatgcaaagaggaagattgaaaggggcattgctttcccgacctgtgtatccgtaaacaacacagtctgccacttctcaccgcttgccactgacgaggcagttctggaagaaaatgatatggttaagatagatatgggctgccatattgatggttttattgctgtcgtggctcatactcatgtaattacaaatgggcctgtcaccggaagagcagctgatgttcttgctgctgccaacactgcagcagaagtcgcaatgaggcttgtgagacctggaaagaagaacaaggatgttactgaagcaattcagaaagttgctgctgcttatgattgcaagattgtggaaggtgttctaagccatcagctgaaacaattcgttattgatggtaacaaagttgtgctcagtgtctccaatgctgatactaaggtggatgatgctgaatttgaagaaaatgaagtatatgcgattgatattgttactagcactggagagggaaagcccaagttattggatgagaagcagaccaccatctacaaaagggctgtagacaagaattatcacttgaaaatgaaagcatcaaggtttattttcagtgagatcagccagaagttccctatcatgcctttcaccgctagggcattggaagagaaacgtgcccgcttaggcttggtggaatgcatgaaccatgagctattgcagccatacccagtacttcatgagaagccaggtgatcttgttgcacacataaaattcacggtgctgctgatgccaaatggatcggataaggttacatcacatccgctacaggagttacaggccacaaaatctattgaagacaatgctgagataaaggcatggcttgcattggggacaaaatcaaagaagaagggtggtggaaagaagaagaaaggcaagaaaggagatgcagcagagcctatggaggaggcgacaaatggtgctccaagccaagaataattctgatttttggaattcctaccactagttttgttcatgtttctttgccgcatctgatggtgttatattacattcagttgtggaaaaattgagtactgtttcaagcgttgacgcatcgttgctgcacattatcgcacctaatgccagataattatctatgaaggtggcatgtccggtgcaagttctctgttctgcataacctcacgtaactcccagtttgaaactctagtgtttga

SEQ ID NO: 7479 - DNA, 1630 bp, Linum usitatissimum
agcacatccatcgcctccgttctccactgctaaaccctagcttcattatcaccgccgccatcatcgttttctgttcagtagcataagaaccagcagcttggagaagaaaaatcatccttccataatcatgtcggacgaagagagggaggagaaggagttggatctcacttctcctgaagttgtcaccaaatacaaaggcgctgctgagatcgtcaataaggccttgcagttggtcgtgaaggaatgcaaaccgaaggcgaagatcgttgacctatgtgagaaaggggattcttacatcatagggcaaactggtaacatgtacaagaacgctaagaagaagatcgaaaaaggagtggcatttcctacttgtgtctctgtgaacaataccgttggccatttctctccgcttgccagtgatgagagggtgttggaagagggtgacattgttaagattgatatgggttgtcatatagatggattcattgctgtggtcgcacatactcatgttgttcatgatggagcggttactggtagagctgctgacgttattgcagctgccaacactgctgctgaagttgctttgaggcttgtgaggcctgggaaaaagaaccaagacgtcacagatgcaattcagaaggttgctgccgcttatgactgcaagattgtggaaggtgtcctcagccaccagctgaagcagtttgtgatagatgggaacaaagttatacttagtgttgccaatccggacacaagagtggatgatatcgaatttgaggagaatgaagtttatgcagtagatattgtaacaagcaccggtgaaggcaagcctaagttgctagacgagaaagagactaccatatacaagagagctgtggacaagaattatcacttgaagttgaaagcatcaagattcattttcagtgaaattagtcagaagttccccatcatgcctttcactgccagggccttggaagagaaaagagctaggttgggactggtggaatgtgtgaatcatgaactactccagccttatcccgttctgcatgaaaagcccggtgattatgtagctcatatcaagttcaccgtcttgctgatgccgaatggttcggacaggattacgtcacatcctctacaggaactgcaatcttcaaagacgatagaagatcctgaaatcaaggcttggttagctcttggtaccaagacaaagaagaagggtggaggaaagaagaagaaaggtaagaaaggggagaaagctgaagatgctgctgaagccgaagccgaaccaatggacgaaacatccaaagcctaatctgttagttgagagattgccagttagtgttcccaattgagtaatctctgtatgcatcaggtggcattgctcctaacgttaatccacagtttttaaagtgttcaaaatttgaccagtttttgacagtcagtttgtattctgcaagttgcacaaacaactagaggctggcaattgctcaagttttattgaaaatggacttttgtactatacaggttttacgattgtatggccgattgtagtcttgcttgagctcgactttttaacgttggttatctagttgaggtagagctttgctcatttggtttgagcttgagattggctctt

SEQ ID NO: 7480 - DNA, 1698 bp, Pennisetum glaucum
gcgagcatcatcccctcccttctaagccctagtcagaccccgccgcctcaccccaggtccccagccggctgcctccaaattcccccctcccccgaagcccaaaccctaaacctaaacctctcatccccgccgccgccaccaccaccacttttgcagccgccgcgactccctccccagacgccgacgtcccccgcctcggatcgaagcaatgtcgtctgacgatgaggtccgagaggagaaggagctcgacctctcatccaacgatgtcgtcaccaagtacaaggccgccgccgaaatcctcaacaatgctctgaagctggttgtatctgagtgcaagccgaaagccaagattgttgacctttgtgagaagggcgacactttcataagagagcaaactgggaatgtttacaagaatgccaagaggaagattgaaaggggcattgctttcccaacctgtgtatccgtgaacaacacagtctgccacttctcaccacttgccactgatgaggcagttctcgaagaaaatgatatggttaaaatagatatgggctgtcatattgatggttttattgctgtggtggctcatactcatgtaattacaaatgggcctgtcacgggaagagcagctgatgttcttgctgctgccaacactgcagcagaagttgccatgaggcttgtgagacctgggaagaagaacaaggatgttaccgaagcaattcagaaagttgctgctgcctatgattgcaaaattgttgaaggtgttctcagccatcagctgaaacaatttgtcattgatggtaacaaagtcgtgctcagcgtctccaatgctgacactaaggtggatgatgctgaatttgaagaaaatgaagtatatgcaattgatattgttaccagcactggagaggggaagcccaagttattggatgagaagcagaccaccatctacaaaagggctgtagacaagaattatcacttgaagatgaaagcatccaggtttattttcagtgagatcagccagaagttccctatcatgcctttcactgccagggcattggaagagaaacgtgcgcgcctaggcttggtggaatgcatgaaccatgagctattgcagccatacccagttcttcatgagaaaccaggtgatcttgttgcacacataaaattcactgttctgctgatgccaaatggatcggataaggttacatcacatcagctacaggagttacagcctacaaaatccattgaagacaatgctgagataaaggcatggcttgctttagggacaaaatcaaagaagaagggtggtggaaagaagaagaaaggcaagaaaggagatgcagcagagccaatggaggaggcgacaaatggtgctccaagccaagaataattctgatttttggaattgctacctctagttttttgttcatgttcctttgctgcatctgatggtgttatattacattcagttgtggaaaaattgagtactgtttcaagtgtctaagaaatgacgcatccttctggacattatcgcatctaatgacaaagataattatccatgaggcatgcccactgctagtttgttttgcctaatctcacttaggataatttagaggtagtaccagcctgaaaaatcgtagtgtttgaaggaactgacgctttcagacggacgctctttgaatgtgctagcaatttctttga

SEQ ID NO: 7481 - DNA, 1488 bp, Sorghum bicolor
gcctcactacatttctattcccctctcgagcccaaaccctaaacctaaacctctcacccgccgccgccgccaccgtcaccgacagcaccaccaccaccactccctccgccgtcccggggctccatcccaccgccgccgacttccacctcggattgaagcaatgtcgtcggacgatgaggtcagggaggagaaggagctcgacctctcctccaacgacgtcgtcactaagtacaaggctgccgccgaaatcctcaacaatgctctgaagctggttgtgtctgagtgcaaaccaaaagccaagattgttgacctttgtgagaagggtgactctttcataagagagcaaactgggaatgtctacaagaatgcaaagaggaagattgaaaggggcattgctttcccaacctgtgtatctgtgaacaacacagtctgccacttctcaccgcttgccacagatgatgcagttctggaagaaaatgatatggttaaaattgatatgggctgtcatattgatggctttatcgctgtggtggcacacacacatgtaattacaagtgggcctgtcacaggaagagcagctgatgttcttgctgctgccaacacagcagcagaagttgctgtgaggcttgtgagacctgggaagaagaataaggatgttactgaagcaatccagaaggttgctgctgcttatgattgcaaaattgtggaaggtgttcttagccatcaactgaaacaatttgtgattgatggtaacaaagtggtgctcagtgtctccaatgctgatacaaaggttgatgatgctgaatttgaagaaaatgaagtctacgcaatcgatattgtcaccagtactggggaggggaagcccaagttattggatgagaagcagaccactatctacaaaagggctgtagacaagaattatcacttgaagatgaaagcatcaaggttcattttcagtgagatcagccagaaattcccaatcatgcctttcactgctagggcattagaagagaagcgtgcacgcttaggcttggtggaatgcatgaaccatgagctattgcagccgtaccctgtacttcatgagaagccaggtgatcttgttgcacacataaagttcactgtgcttctgatgcccaatggatcagataagattacatcacatccgctacaggagttaaagcccacaaaatccattgaagacaatgctgagataaaggcatggcttgctttggggacaaaatcaaagaagaagggtggtggaaagaagaagaaaggcaagaaaggagatgcagcagaagcagatcccatggaggcgacaaacggtgcaagccaagaataattctgatttttggaattactgcctccagccttttttcttgtttcttcactgcatctgatggtgttatattacattcagttgtggaaaaaattgagtactttttctagtgtcttaagaaatgaagcatcctgctgcacattatcgcatct

SEQ ID NO: 7482 - DNA, 1691 bp, Solanum lycopersicum
aaaaaacacagagtccaaaccctagctcaaaccccttttcgcctccatttctttcaatcaagaaatcaactgtgtaatacttgaaccatttgataactatgtcggatgatgagagagaagagaaggagttggatctgacaagtcctgaggttgttactaagtataagggtgctgctgaaatcgtcaacaaggctctgcagttggtggtgtctgaatgcaaggcaaaagcaaagatagttgatctttgtgaaaaaggagatgcctttattaaagagcaaacagggaatatgtacaagaatgtgaagaagaaaatcgagaggggtgtggcattcccaacctgcatttcagtaaacaataccgtctgccatttttctccactgtctagtgatgagacagtattggaggaaggtgatatagtgaaaattgatatggggtgtcatatagatggctttattgctgttgttgctcatacacatgtggtccagggaggacctgttactggtagagctgctgatgttcttgcggctgctaatacagctgctgaagttgctctgaggcttgtaagaccaggaaggaagaactcggatgtaacagaagctattcagaaagttgctgcagcatatgactgcaagatcgttgagggtgttttgagccatcaaatgaaacaatttgtgattgacggaaacaaagtcgtgttaagtgtgtctaatcctgataccagagtagatgatgcagagtttgaggaaaatgaggtctattcagttgacattgttacgagcaccggcgaaggaaagccaaagttgttggatgagaaacaaacaaccatctacaagagagctgtagataaaagctacaacctgaagatgaaagcgtcaaggtttatcttcagtgaaatcagtcagaagttccctatcatgccatttacagctagggatttggaggagaaaagagctcgtttgggactagttgaatgtgttaaccatgatcttttgcagccgtatcctgttctacatgagaaacctggtgatttggttgctcacataaaattcactgtgctattgatgcctaacgggtcagataggatcacatctcatgctctccaggagctgtcacctgcgaagacaatagacgatgaacctgaaattaagacctggctagcccttcccgtaaaaaccaagaagaaaggtggcggcaagaaaaagaaaggcaagaaaggtgaatcatgccaagctgagcctatggaaggcgaaccaaatgttgctgaatcttgatttcaattccaagaactatttggttcattgttatatttgattttgggattactgaggtggttttggatctttcttgcggcctttcgctatatacacaagataggacaatgatcagtagttgtttgttgttgtcctttgtcctgagacttttgtcatgttaaatggggtttccaatgctataatgcactatgatccaaacctacaagagaatgttttgtactcttttttactttatcagagtcgctcaaggcagtgacttagcggttaatgaagtggtatgagacccatactcttgaaaaaactaggtgatgagctttgatgggcagagttattttgtacctaagttattcaccatcactctcaagcacataacaagcttacaagttacaaataatgtaaaaatcacatacttttctacta

SEQ ID NO: 7483 - DNA, 1398 bp, Artemisia annua
aagcagtggtaatcaacgcagtactccgacggggttcacaaaagtctgcgtatcaaattccgaaaaaaagaaagaaaaaagaatgtcttctgatgatgaaagaggtgaagagaaggagcttgatctttcttctcctgaagttgtgaccaaatacaaatcagctgctgaaattgttaacaaggctttgcagttggtcttgtcacaatgcaaacccaacgtcaagattgttgacctttgtgagaaaggagattcatatatcagagagcaaactggtagcatgtacaagaatgtaaagaagaagatcgaaaggggtgtggctttcccaacgtgtttgtctgttaacaacacggttggtcatttttccccacttgctagtgacgagtccgtcttaaaggaaggtgatatcttgaaaattgacatgggatgtcatattgatggtttcattgctgtggtggcgcacacacatgttcttcaggaagggccagtgacaggaagagcagccgatgttattgctgctgcgaatactgctgctgaggttgcattgaggctcgttagacctgggaaaaagaaccaagacgtgacggaagccatccaaaaggttgctgctgcttacgactgcaagattgttgaaggtgttctaagtcatcaactgaagcaattcgtgattgacggaaacaaggtcgttctaagtgtggcaaatccggacaccagagttgatgatgctgagtttgaggagaatgaggtctatgcaattgatatagttacaagcacaggagatggcaagccaaagctcttggacgaaaaacagactaccatctacaaaagagctgttgacaagaactatcacttgaaaatgaaagcatcccgcttcatcttcagcgaaatcagtcaaaagtttccaatcatgccattctctgctagggctttggaagagaagcgtgctcggctaggtttggttgaatgtgtcaatcacgagcttttgcaaccataccctgttcttcatgagaagcctggtgattttgttgcacatatcaagttcaccgttcttctaatgccaaatggatccgaccgcataacatcgcatcctctacaggagttgcagcccagatgaccctgaggttaaagcttggctagctctaccttgaagagcaagaagaaaggtggcggcaagaagaagaaagccaagaagggagatgaagcagagccaatggacgaaacaaccgatggtgctcaagcatgaggaaagtttcttgtgtaattttgaatttgaatcaagttttgggttcctgccttgttacatcagagttttcttgaatgtactgggtttcatgtaggatgattttaacaaaagagagcatgtacacagcattatccgtgtttcttttgtttgcgtaaaaa

SEQ ID NO: 7484 - DNA, 1711 bp, Rosmarinus officinalis
gccaaaactgaaaaccctactacacttcgaaggcggaaaccacattatataaagcccaccgttcactctacattgccgacctcaagctctttcattcagcttccacacatactctctcactcataaaccctaattttgttcattccttctctaacgtctactgacaaattctcatttgttgaaacgatgtcggatgaggagcgggaggagaaggagttggatctcacctctcctgaagtcgtcaccaagtacaaatccgcagctgaaatcgttagcaggcactgcaattagtgttgtctgaatgcagaccgaaggctaagattgtggatctttgtgagaaaggagatactttcatcagagaacaaactgcgaacatgtacaaaaatgtgaaaaagaaggttgaaaagggcattggtttcccaacatgtatatcggtcaacaatacggtttgccatttctcgccattgtccagtgatgaggctgttttggaagaaggagatatcttaaaaattgatatgggatgtcacattgacggctttatagctgtagttgcacacacccatgtacttcaggagggaccagttactggtagggtagctgatgtcattgctgctgctaacacggctgcagaagttgcattgaggcttgtgaggccagggaagaagaacaaagatgtgtcggaagcaattcagaaagttgctgcagcttatgactgcaagattgttgaaggagttttgagtcatcaaatgaagcaatatgtgattgatggaaacaaggtagttttgaatgtctcaggccctgatacaagagttgatgatgcagaatttgaggagaatgaggtttatgccatagacattgtaacaagtaccggtgaaggcaagccaagattgttggatgagagaaagacaacgatatataaaagagccgttgacaagaattatcacctgaagatgaaagcttcccggttcatctttagcgagattagtcagaagttccccataatgccttttgctgctagggctttggaagagaagcgtgctcgtttgggcctagtagaatgtgtgaaccatgaacttttacagccatatcctgtacttcacgagaagcctggtgatcttgttgctcacatcaagttcacagttttgctaatgccaaatgggtccgaccgagtcacgtctcatttgcttcaggagctacaacccacaaaaatagttgatgatcctgagatcaaatcctggttggcattggggacaaagacaaagaagaagggtggtggcaggaagaagaaaggaaagaaaggagataaaactgaggaaacagctgattctgagtctatggatgagacaaccaatggtgcagcttcctaattgagttcagaaatgcgataaatatgaagatacagctgatgctgatatatgaacacggcaacaaacaacttggctccgcgagaaaaagagaaaggtcttgttttcatttgtgtatcttaaccatgaaatgaaattttggcagccccaattgtatgtggttgctttttagtcatgaatgtgaatctaacttgagatgctatgaaatgtgtctttatttgtacacagcttaacatttttactgtattcattttgttgtttagatagaaaaaagataattcatggttatctcaaatgaagattcgaattgcaaatcgaaattatcacagtgggaccattgatattcg

SEQ ID NO: 7485 - DNA, 1522 bp, Ambrosia trifida
acaacgtgtcatccaaagatgaaaccctagtaacggaccacttaccaactttatataatcaccgccgacctccaaaccctagcactcaacactccatactctatacccatttcatcaataaaccctaataataatctcaatctcgcctctccatcattcaattgcttctgttttttaaggaaaaatgtcagacgatgaaagagtggaagagaaggagcttgatctttcctcccctgaagttgtaaccaaatacaaatctgctgctgagattgttaacaaggctttgcagttggttttggctgaatgcaaacccaaagccaagattgttgatatatgtgagaaaggagattcatacatcagagagcaaactgggaatatgtacaagaatgttaagaagaagattgaaaggggtgtcgcatttccaacgtgtttgtcggtgaacaacacggtctgtcatttctctcctcttgctagtgatgaaacagtattggaggaaggtgacattttgaaaattgatatggggtgtcatatcgatggtttcattgctgtggtggctcacacacacgtgcttcagcaagggcctgtaacagggcgagcagctgatgtcattgctgctgcaaatactgcggctgaggttgccttaaggcttgtgaagcctggaaagaagaaccaagatgtgacaaaagccatccaagaggttgctgctgcatatgactgcaaaattgtggaaggcgttcttagccatcaactgaaacagtttgttattgatgggaacaaagttgtattgagcgtctcaaatcctgagacaagagtcgatgatgcggagtttgaggaaaatgaagtttatgcaattgatattgtcaccagcacaggagatggaaagccaaaattgttggacgaaaaacagacaacgatatataaacgagcagttgacaagagttatcacttgaaaatgaaagcgtctcggtttatttacagcgacatctgtcagaattttccaatcatgcccttttcagctagggctttggaagagaaacgtgctcgtttaggattggttgaatgtgttaaccatgagcttttgcagccctaccctgttcttcatgaaaagcctggtgactttgtagcgcatataaagttcacggttcttctgatgccaaatgggtctgaccgcataacgtctcatgcactccaggaactgcagccgactaaaacagttgatgaccaccctgaaatcaaagcgtggttatcgcttcccgtaaagagcaaaaagaaaggtggtggcaagaagaagaaaggtaagcaagctgagaaggctgctgaaggtgaggaggccaagccggaggcgatggaaacatgaaatggtggtgcctaacaaagacatgaatccaatttggttttaccttttgtatggtgtctgtctacaagaatttgttgaatgaagtttatgtctttaaagatgtgtttaaagcattgttgattctataacctttgtcttacataagtctgttttgttgaggccact

SEQ ID NO: 7486 - DNA, 1497 bp, Echinochloa colona
tcccccctcccgaagcccaaaccctaaacctaaacctctcaacctcgccgccgccaccaccaaccaccactttcgccgctgccgcgactcccccctcatccgccgacgtcccccgcctcggatcgaagccatgtcgtcggacgatgaggtccgggaggagaaggagctcgatctctcatccaacgatgtcgtcaccaagtacaaggccgccgccgaaatcctcaacaatgctctgaagctggttgtatctgagtgcaagccgaaaaccaagattgttgacctttgcgagaagggtgatgctttcatcagagagcaaactgggaatgtctataagaatgcaaagaggaagattgaaaggggcattgctttcccgacctgtgtatccgtaaacaacacagtctgccacttctcaccgcttgccactgacgaggcagttctggaagaaaatgatatggttaagatagatatgggctgtcatattgatggtttcattgctgtggtggctcatactcatgtaattacaaatgggcctgtcaccggaagagcagctgatgttcttgctgctgccaacactgcagcagaagtcgcaatgaggcttgtgagacctggaaagaagaacaaggatgttactgaagcaattcagaaagttgctgctgcttatgattgcaagattgtggaaggtgttctaagccatcagctgaaacaattcgttattgatggtaacaaagttgtgctcagtgtctccaatgctgatactaaggtggatgatgctgaatttgaagaaaatgaagtatatgcgattgatattgttactagcactggagagggaaagcccaagttattggatgagaagcagaccaccatctacaaaagggctgtagacaagaattatcacttgaaaatgaaagcatcaaggtttattttcagtgagatcagccagaagttccctatcatgcctttcaccgctagggcattggaagagaaacgtgcacgcttaggcttggtggaatgcatgaaccatgagctattgcagccatacccagtacttcatgagaagccaggtgatcttgttgcacacataaaattcacggtgctgctgatgccaaatggatcggataaggttacatcacatccactacaggagttacaggccacaaaatctattgaagacaatgctgagataaaggcatggcttgcattggggacaaaatcaaagaagaagggtggtggaaagaagaagaaaggcaagaaaggagatgcagcagagcctatggaggaggcgacaaatggtgctccaagccaagaataattctgatttttggaattcctacctctagttttgttcatgtttctttgccgcatctgatggtgttatattacattcagttgtggaaaaattgagtactgtttcaagcgttgacgcatcgttgctgcacattatcgcacctaatgccagataattatctatgaaggtggcatgtccggtgcaagttctct

SEQ ID NO: 7487 - DNA, 1802 bp, Secale cereale
gcttccattctaatccgccccctcccgagacgccaaagccccaaacccctcgccctcccgaaccctaaccctaaaacctccgccctcccgccgccgccgccgccgtcgcccgattcccctccccagcctccgcatcccccgtccggcttgaacgatgtcgtccgacgaggaggtcagggaggagaaggagctcgacctctcctccaacgaggtcgtcaccaagtataagaccgccgccgagatcatcaacaaggctctgaagttggtattggcagagtgcaagccgaaagccaagattgttgacatttgtgagaagggtgacaatttcataacagagcaaactgggaatgtctacaagaacgtgaagaggaagattgaaaggggcattgctttcccgacatgtgtatctgtgaacaacactgtttgtcatttctccccactggcaactgatgattctgtactccaagaaaatgacatggtgaagatcgacatggcttgccatattgatggttttattgctgtggtggctcatacacatgttatcaaagctgggccggttactggaagagcagctgatgttcttgctgctgcaaacaccgcagcagaagttgcaatgaggcttgttagacctgggaagaagaataaggatgtcactgaagcaattcagaaagttgctgctgcttatgattgtaaaattgttgaaggagttcttagccatcagctgaaacaattcgtcatcgatggtaacaaagtggtacttagtgttgcaaacgctgatacaaaggtggatgatgctgaatttgaagaaaatgaagtgtatgcaattgatattgtcaccagcactggcgagggaaagcctaagctattggatgagaagcagaccactatttacaagagagctgtagacaagaactatcacttgaagatgaaggcatcaaggttcatcttcagtgagattagccagaagttcccaatcatgccattcactgctagggcgctggaggagaagcgtgcacgcttaggtttggtagaatgcatgaatcatgagctgttgcagccataccctgttctacatgagaagccaggggacctggttgcccacatcaaattcaccgtgttgttgatgccaaatgggtctgacaagataacgtcacatcccctacagcaattggagccctcaaaatccatcgaggacgacgtggagatcaaggcttggcttgctttgggcacaaagtcaaagaagaagggtggtggcaagaaaaagaaaggcaagaaaggagatgcagcagaagcagcagcagagcccatggaggtttctaaggaagcaccaagccaggaataattctcaattttttttgaattgcttccgttacgtttgtacctgctcctttgctgcatctgattgtgttatattgcattcagctgtgggaatttgagtaccttttttgaagtgtctaatgaaaatggttgatcctgtgcacatcacatcaaagcacaagcctgataattatgtatggtgtgccgaatgtttacctgtcagtaatgcttataaatctggcttaagttcaactattgtttgtatgtttacctgtggtttaccgttttaggtgtggctgattggtgttcacctactaccgtaggtgttgatgtgtatgtactccctagtcctgtcgttatttagttaaacaaaaaaaaaaaaaaaaaaacaaaaaaaaaaaaaaaaacaaaaaaaaaaaaaagaaaaaaaaaaaacaaaaaagaagaactagacgagaacacacgaaggaggagagacccccccc

SEQ ID NO: 7488 - DNA, 1475 bp, Ambrosia trifida
cttgcctctccatcattcaattccttctggtttttaggaaaaatagtcagacgatgaaagagtggaagagaaggagcttgatctttctcccctgaagttgtaaccaaatacaaatctgctgctgagattgttaacaaggcgttgcagttggttttgtctgaatgcaaacctaaagctaagattgttgatatatgtgagaaaggagattcatacatcagagagcaaactgggaatatgtacaagaatgttaagaagaagattgaaaggggtgttgcatttccgacgtgtttgtcggtgaacaacacggtttgtcatttctctcctcttgccagcgatgaaacagtattggaggaaggtgacattttgaaaattgatatggggtgtcatatcgatggtttcattgctgtggtgggtcacacacacgtgcttcagcaagggcctgtaacagggcgggcagctgatgtcattgctgctgcaaatactgcggctgaggttgccttaaggcttgtaaagcctggaaagaagaaccaagatgtgacaaaagccatccaagaggttgctgctgcatacgactgcaaaattgtggaaggcgttcttagccatcaattgaaacaatttgttattgacgggaacaaagttgtattgagcgtctcgaatcctgagacaagagtcgatgatgctgagtttgaggaaaatgaagtttatgcaattgatatcgtcaccagcacaggagatggcaagccaaaattgttggacgaaaaacagacaacgatatataaacgagcagttgacaagagttatcacttgaaaatgaaagcgtctcggtttatttacagtgacatctgtcagaattttccaatcatgcccttttcagctagagcattggaagagaaacgtgctcgtttaggattggttgaatgtgttaaccatgagcttttgcagccctaccctgttcttcatgaaaagcccggtgactttgtagcgcatatcaaattcacggttcttctgatgccaaatgggtctgaccgcataacggctcatgcactccaggaactgcaaccgactaaaacagtagatgaccaccctgaaatcaaagcgtggttatcgcttcctgtaaagaacaaaaagaaaggcggtggcaagaagaagaaaggtaagcaagctgagaaggccgaaggtgaggccaagcccgagccgatggaaacataaaatggtggtgacctaagaaagacatcaaatccaattttggttttaccttttgtatggtgtctacaagaatttgttgaatgaagtttatgtctttaaagatgtgtctaaaagcattgttgattcataaccttttgtcttacataagtctgtttttgtgaggctactgtttcttttagttattgtttttcaactgacggtttcatacacacaacattaacatgaaaattgtttcatacacatgcctcatatgaacattaaaaaagaaa

SEQ ID NO: 7489 - DNA, 1628 bp, Chrysanthemum coronarium
cacacatttccccatcttcaaacaaaccccccttttcttaaaccctaattttcacaaaagtctgcgcatcaatttccggtgagcacacttgaccttattcaaattaatttctggaaaaatgtcttctgatgatgaaagaggtgaagagaaggagcttgatctttcttctcctgaagtggtgaccaaatacaaatcagctgctgaaattgttaacaaggctttgcagttggttttgtcgcaatgtaagcctgatatgaagatcgttgacctgtgtgagataggagattcatatatcagagagcaaactggtagcatgtacaagaatgtaaagaagaagatcgaaaggggtgttgctttcccaacgtgtttgtctgttaacaacacgattggtcatttttccccacttgctagtgacgagacagtcttaaaggaaggtgatatcttgaaaattgatatgggatgtcacattgatggttttattgctgtggtggcgcacacacatgttcttcaggaaggtcccgtcacaggaagagcagccgatgttatgctgctgcgaataccgctgctgaggttgctttgaggctcgctagacctggaaaaaagaatcaagacgtgacagaggccatccaaaaggttgctgctgcttacgactgtaagatcgttgaaggcgttctaagtcatcaactgaagcaattcgtgattgatggaaacaaggtggttctaagtgtggcaaatcccgacaccagagttgatgatgctgagtttgaagagaatgaggtctatgcaattgacatagttacaagcacaggagatggcaagccaaagctcttggacgaaaaacagactaccatctataaaagagctgtggacaagaactatcacttgaaaatgaaagcttcccgctttatcttcagtgaaatcagtcaaaagtttccaatcatgccattctctgctagggctttggaagagaagcgcgctcgtctaggtttggttgaatgtgtcaatcacgagcttttgcaaccataccctgttcttcatgaaaagcctggtgattttgttgcacatatcaagttcactgttcttctaatgccaaatggatccgaccgcatcacctcacattcactacaggagttgcagcccaccaaaaatgttgatgaccctgaggttaaagcttggttagctctacctgtgaagagcaagaagaaaggaggtggcaagaagaagaaagcggccaagaagggtgaagaagcagagccaatggacgaaacaaacgatggtgctcaagcatgaggaaatgaagtttcttgtgtaattttgaattttaatcaggttttggttcccgccttgttacatcagaattttcttgaatgtactgggttctcctaggatgatctttacaaaagagagcatgtacacagcatgatttgtgtttctttttcttgcgtgcgtataaaacctttaaaagaaatctactctgcaacgcaagtcatgtactcgtttattgcatatttgccagcatgtgctcgagcatatgattttgttttgtcgctttaattgttttgttatctgtgttgccactttgtcatggtgttattatttggaaaaaaatggtcggtaatagtttctca

SEQ ID NO: 7490 - DNA, 1444 bp, Cannabis sativa
ttgctaaactattgttaaacttaagcatagggaagggacatggtaccatactataaaccctacaatacaaagggttggtgacttggtgtaacgagaaaaagtcctatttaaagtaaagacaagcccgagtgttgaaaaccctaatgctaccaagccacctttcatttttcatttcttttactttcttacatatactctcactcttttcatttctatctgataaaccctagcttcttccatacccactcctactcaaccctctccttcgccgtcaaacgtattttttcattaagtactagattcagagcttcgtaacgatgtcggatgatgaaagagaggagaaggagctcgatctctcttctcctgaggtcgtcaccaagtacaagggcgcagctgagattgttaataaggctctgcagctagtgttatccgaatgcaagccgaaagctaagattgtggatctttgcgagaaaggagattcatatattagagagcagactggaaacatgtacaaaaatgctaagaagaagattgagaagggagttgcatttccaacttgtatctctgtgaacaatactgtttgccatttctcacctcttgcaagtgatgagtcagtgttggaagatggtgatatcttgaagattgatatgggttgccatatagatggattcattgctgtggtcgcacatacccatgttcttcacgaaggtccagtaacaggaagagcagctgatgttatcgcggctgccaacacagctgcagaagtagccttgaggcttgtaaggccaggaaagaataacaaggatgtaacagaagcaatccagaaggttgctgctgcttacgactgcaaaattgttgaaggtgttcttagccaccagctgaagcagtttgtaatagatggaaacaaggttgtattgagtgtatctagccctgatacgagagttgatgatgccgaatttgaggagaatgaggtctatgcaatcgatattgtcaccagcacgggtgatggcaagcctaagttattggatgaaaagcaaaccactatctataagagagcagtcgacaagagctatcacttgaagatgaaagcttctaggtttattttcagtgaaattaaccagaagtttcccattatgcctttcactgccagggccttggaagagaaacgtgcacgattgggtttagtggagtgtgttaaccacgaccttttgcagccgtaccctgttctccacgagaagcctggtgattttgttgctcacatcaagttcacagttttgctaatgccgaacggatcagaccgaatcacatcccattctcttcaggagttgcagccaaccaagactgtagaggatcctgaaatcaaagcctggttggctttggccactaagtcgaagaagaagggtggtggcaaaaagaagaagggtaagctatttgaatgtgctaa

SEQ ID NO: 7491 - DNA, 1418 bp, Daucus carota
gggaggtgagttgtgtgcacagtctatatatacacaagaggcaagaccctgccgttcctcaaaccctaacacactgtcgccacctcctcgtcacctcactctatccctctttcataaaaaatctctcattatcttcacaaactctaatttccattcaatttagcagctgaatttgtggtggataattaagctgcaaaacgatgtcggatgaagaaagggaagaggtggagctggatctatcctctcctgaagttgttaccaaatacaagcttgcagccgagactgttaacaaggctttacagttagtgttgtcggaatgcaggcccaatgcaaagattgttgatatttgcgagaaaggggattcatatattagaacgcagaccagtaatatgtacaagaatgtgaagaaaaaggttgaaaagggtatagcatttccgacttgtttatctgttaacaacacagtttgtcatttctcacctctggcaagtgacgagactgttttggaagagggtgatgttttgaaaattgatatgggatgccatgttgatggattcattgctgtagttgcacacactcatgttcttcaggacggaaaagtgacaggtaaagcagctaatgttatcgctgccgcaaacactgctgctgaagttgctctaaggcttgtcaggcctgggaagaagaacaaagacgtttctgaagccgttcagaaggttgctgctgcctatgactgtaaaattgttgaaggagttctcagtcatcagcttaaacaatttgtgattgatggaaacaaagttgttctgagtgtctcaaaccctgatacaagagttgatgatgcagagtttgaggaaaatgaagtttatgcaattgatatagttaccagcacaggagaagggaagcccaagttggtggatgaaaagcagacaactgtctataaaagagctgtggacaagaattatcacttaaaaatgaaagcatcaaggttcatatttagtgaaataagtcagaattttccgattatgccgttcacggcaagagctttggaagaaaaacgagctcgccttggattagtcgaatgtgtgaatcatgatcttttgcagccatatcctgttctacatgagaaaccaggcgactatgttgctcatatcaagttcactgttttgctgatgccaaatggatcagaccggatcacttctcaccctttacaggagttggaacctacgaaagccatagaagatcctgaaattaaagcttggttagcattggggatcaagacaaagaagaaaggcggtgggaagaaaaagaaagggaagaagagtgaaaaatgtgatgattcggccgagccagggccagttgatgctcctccaacaaatggcagtgcacctcaagaatgaagacataggttttgttaaccttctgta

SEQ ID NO: 7492 - DNA, 1543 bp, Cichorium intybus
aggccagaaagcaccgccgacctccaaaccctagctcaccacatatactcccaccaccactcccttttttgtttctttaaatcctaattgctcctgttcatcgtttaattgcttgttctgaggaaacatgtcagacgatgaaagaggggaggagaaggagctggatctttcctctccagaagttgtaaccaaatacaaatcggcggctgagattgtcaacaaggccttgcagttggtattatcagaatgcaagcccaaagtgaagatcgttgatatttgcgagaagggagattcatatatcagagagcaaacagggaacatgtacaagaatgttaaaaagaaaatcgaaagaggtgtagcatttcccacatgtttatcagtaaacaacacagtctgccattactctccacttgccagtgatgaaacagtattagaagaaggtgacattttgaaaattgatatggggtgtcatatagatggttttattgctgtggtggcccacactcatgttcttcaacaaggacctgtaacaggtagagtagcagatgcaattgcagctgcaaatactgctgctgaggtggcattaagacttgtgaagcctggaaagaagaaccaagatgtgacagaagccattcaaaaagttgcagctgcatacgactgcaaaatagtcgaaggcgttcttagtcatcaattaaaacaatttgtaatcgatggaaacaaagtcgtattaagcgtctcaaatcccgaaacacgagtcgatgaagccgagttcgaagagaacgaagtttacgcgatcgatatagtcacaagcacaggagacggcaagccaaaattattggatgaaaaacaaacaacgatttacaaaagagcagtcgacaggagttaccacttgaaaatgaaagcctcccggtttatcttcagtgaaattaatcaaaagtttccaattatgcccttctcagcaagggcattagaagaaaaacgcgcacggttaggattagtggaatgtgttaaccatgaacttttacagccgtaccctgttcttcatgaaaagcctggtgattttgttgcacatataaaattcacggttcttttgatgccaaatggatctgaccgaataacatctcataatcttcaagaattgcaaccgactaaaacagttgatgatcctgaaattaaatcatggttgtctttacctgtaaaatccaaaaagaaaggcggtgggaagaagaagaaaggtaagagagcggaaaaaggtgaaggtgacgtggaggtgatggaggtggatgcatcgaatggtggtggccaataatgagaggagagagaatggatgtaatttgatagttgaaaattgaaatccagttttgggattgttgtaggtttttttttttttgtttgatttttctttaaaagatgtgtgaaagagcatatcataatatgtacacagggtttttaaacatcgtttgtgttctattttttacgaagacaatgaaagaacatgataaaatgaaagatgaaaaagaaatacttgtggtgggagttgtgt

SEQ ID NO: 7493 - DNA, 1641 bp, Cichorium intybus
gagaaaaccctaattaactcataaccgaacactaccaactctatataaacgcagaaggccagaaagcaccgccgacctccaaaccctagctcacgacatatactcccaccaccgctccctttttgtttctttaaatcctaatcgctcctgttcatcgtttaattgcttgttctgaggaaacatgtcagacgatgaaagaggggaggagaaggagctggatctttcctctccagaagttgtaaccaaatacaaatcggcagctgagattgtcaacaaggccttgcagttggtattatcagaatgcaagcccaaagtgaagatcgttgatatttgcgagaagggagattcatatatcagagagcaaacagggaacatgtacaagaatgttaagaagaaaatcgaaagaggtgtagcatttcccacatgtttatcagtaaacaacacagtctgccattactctccacttgccagtgatgaaacagtattagaagaacttgacattttgaaaattgatatggggtgtcatatagatggttttattgctgtggtggcccacactcatgttcttcaacaaggacctgtaacaggtagagtagcagatgcaattgcagctgcaaatactgctgctgaggtggcattaagacttgtgaagcctggaaagaagaaccaagatgtgacagaagccattcaaaaagttgctgctgcatacgattgcaaaatagttgaaggcgttcttagtcatcaattaaaacaatttgtaatcgacggaaacaaagtcgtattaagcgtctcaaatcccgaaacacgagtcgatgaagccgagttcgaagagaacgaagtttacgcaatcgatatagtcacaagcacaggagacggcaagccaaaattattggatgaaaaacaaacaacgatttacaaaagagcagtcgaccggagttaccacttgaaaatgaaagcctcccggtttatcttcagtgaaattaatcaaaagtttccaattatgcccttctcagcaagggcattagaagagaaacgcgcgcgtttgggattggtggaatgtgtaaaccacgaacttttacagccgtaccctgttcttcatgaaaagcctggtgattttgttgcacatataaaattcacggttcttttgatgccaaatggatctgaccgcataacatctcataatcttcaagaattgcaaccgactaaaacagttgatgatcctgaaattaaatcgtggttggctttacctgtaaaatccaaaaagaaaggcggtggaaagaagaagaaaggtaagagagcggaaaaaggtgaaggtgacgtggaggtgatggaggtggatgcatcgaatggtggtggccaataatgagaggagagagaatggatgtaatttgatagttgaaaattgaaatccagttttgggattgttgtaggtttttctttgattttcttctaaagatgtgtgaaagagcatatcataatatgtacacagggtttttaaacatcgtttgtgttctattttacaaagacaatcaaaacaacatgtcaaaatgaagatgaaaaagaaatacttgtggtgggagttgtgtataagaaaaaacaatagcatcgtatactaataatgttttctgttatataccctcc

SEQ ID NO: 7494 - DNA, 1397 bp, Flaveria ramosissima
taactatgtaacggcacactaccaactttatataatcgctgaatcaccgccgacctccaaaccctagccctccacatacactctctactcctttttcatttcattaaaccctaattaccctctcaaaatcatctaatttcttgctgatttgcctctgaagaaacatgtcggacgatgaacgaggggaagagaaggagctcgatctttcctctccggaagttgtaaccaaatacaaattggcagctgagattgttaacaaggccttgcagttggtcttgtcagaatgcaaacccaaagccaagattgttgatatatgcgagaagggagattcatacattagagagcaaactgggagtatgtacaagaatgttaagaagaagattgaaaggggtgttgcatttccaacatgtttgtcagtgaacaacacagtctgtcatttctctccccttgccagtgatgaaacagtattggaagaaggtgacatattgaaaattgatatggggtgccatattgatggtttcattgctgtggtggctcacacacatgtgcttcagcaagggcctgtaacaggtcgagcagctgatgtcattgcagctgcaaatactgcagctgaggttgctttaagacttgtgaagcctggaaagaagaaccaagatgtgacaaaagccattcaagaggttgctgctgcttacgactgcaaaattgtggaaggtgttcttagccatcaattgaaacaatttgtgattgatgggaacaaagttgtattgagtgtctcaaatccagaaacaagagttgatgatgctgagtttgaggaaaatgaagtttatgcaattgatatagttaccagcacaggagagggcaagccaaaattgttggatgaaaaacagacgacgatctataaacgagcagttgacaagagttatcacttaaaaatgaaagcatctcggtttatattcagtgagatcagtcagaattttccaatcatgccattttcagctagggctttggaagagaagcgtgctcggttaggattggtggaatgtgttaaccatgagcttttgcagccataccctgttcttcatgaaaagcctggtgattttgtggcacatatcaaattcacggttcttttgatgccaaatgggtctgaccgcataacgtctcatggactccaggagttgcagccgactaaaacggttgatgaccatcctgaaatcaaagggtggttatcccttcctgtaaagaccaaaaagaaaggcggtgggaaaaagaagaaaggtaagagagttgaaagggtgaaggcgaggctgaggtagagcccatggaagaaacatgaagtggtggtgccattaaattcaattttggttctttccttttgtattgtgtcaaggagtttgttg

SEQ ID NO: 7495 - DNA, 1588 bp, Gossypium raimondii
gctgccgttagcgtaaggaccgcaaccctagccacccttccctgatttcatttcttctgtactcacagtaatcacctctccaaaaccctagctctttcactcactgccgccaatttcaaccaattatttgtttataagcgtcgaaaacgatgtcggacgacgagcgagaggagaaggagttggatctcacctcccctgaagttgttactaaatacaagagtgctgctgagatcgttaacaaggctttgcagttagttgtaaaagaatgcaaaccaaaaactaagattgttgacatttgcgagaagggtgatgcatttatcagagagcaaacaggcaatatgtataagaatgctaagaggaagattgagaggggtgttgccttccccacttgtctttctgttaacaacactgtttgtcatttctctccacttgctagtgacacctccgagctgcaagaaggtgatatggtgaagattgacatgggttgccacattgatgggtttattgctgtagttgcgcacacccatgttgtccaggaaggactagtcaatgacaggaaggctgatgttattgctgctgcaaataccgccgcagaagttgcattgaggcttgttaggcctgggaagaagaataaagatgtaacagatgcaattcagaaggtagctgcagcttatgactgcaaaattgttgaaggtgttcttagccatcaactgaagcagtttgtgatagatggaaacaaagtcatactcagtgtctccaacccggatacgagagttgatgatgcggagtttgaggagaatgaagtttatgcagtagatatagttgcttcaactggtgaaggcaagccaaaactattggatgagaagcaaaccactatttataagagagcagttgacaagaattatcatttaaagatgaagacctctagatttattttcagtgaaataaatcagaaatttcccattctcccattcactgccagggctctggaagagaaacgagctcgtctaggtttagtcgaatgtgtgaatcatgatctgttgcagccatatcccgttcttcatgagaagcctggtgattatgttgctcatataaaattcacggtgttgctaatgcctaatggatcagaccggatcacactgcatccgctgcagaagctgcagccaaccaagacaatagatgatcctgaaatcaagggatggttagctttgggaacgaagacgaagaaaaaaggtggtgggaagaagaagaaaggtaagaagaatgagggtgataaagctgatgcagagcctatggatgcatcaaaaactgatgccgctgcatcttaagaaacaaactcctattcttctactcgaccttttttctttttaaatttcaattttggtactttgttcactttgtatctgtttgtcaaatgttagtgcatcagatattgatccttttcctaattgaattgggcttttactcgaatgtcttcgtctaattatatcatatctatgggttttaattaggtttcctgagttgaagatgaaatgttattgttatcgtcgccataaataaagtttgatttatatgtgactttttaaaa

SEQ ID NO: 7496 - DNA, 1605 bp, Tropaeolum majus
cggccgggggttccccatttcttcgagacttacccctttatctatctgataaaccctagctacaagcttctgcgccgtcccttaattatcgaaagagacgatgtctgacgacgaaagagaggagaaggagttggatctcagctctcctgaagtagtcacaaagtacaagagtgccgctgagatcgtaaacaaggctttgcagcatgttttgttggaatgcaagccgaaagctaaaattgttgatatttgtgagaaaggagatgcgtttatcatagagcaaacggggaatatgtataagaatgctaagaagaagatcgaaaggggtgttgctttcccaacatgcatttccgtgaacaacaccgtctgccatttctctcccctggcaagtgacgagtctgtacttgaggaaggtgatttggtaaaaattgatatgggatgtcacatagatgggtttattgctgtggttggacacactcatgttctatcagaagggcctattactggtcggaaagctgatgttattgcagccgctaatactgctgctgaagttgccttgaggcttgtaaggcctgggaagaagaacaaagatgtgacggaagcaatccagaaggtagctgctgcctatgactgcaaaattgtggaaggtgtcctcagccatcagttaaaacagtttgtcattgatggaaataaggtcatactaagtgtttcaaatccggaaacaagagttgacgatgcagaatttgaggagaatgaagtttattcaatagatattgtcacaagcacaggcgatggcaagcctaagctgttggatgaaaagcaaaccactatttataagagagctgtggacaagagttatcacttgaaaatgaaagcttccaggtttatttttagtgaaatcagccagaaatttcccattatgccattcactgcaagggctttggaagagaaacgagctcgcctgggattattggagtgtgtcaatcatgatcttttgcaaccatatcctgttctccatgagaagcctggtgacattgttgcacatgtcaaattcactgttctgctaatgccaaatgggtctgacagggtaacatcccatgctctccaagaattgcagccaaccaagacgattgatgatcctgaaatcaaggcctggttagcattgggtacaaagacaaagaagaagggtggtggtaaaaagaagaaagcagctaagaagggtgagacacaagaggaggcatcaacagaagctgtgcccatggaatgagatgactctttaaaccaactaattttttttcttttcaaaattttgtactctgttactgtcaatgtaatctgtttttccgttggttggattcgatataagctatgttgcacattgggcttttatttaggttctcctgcaaatctctcatgctacttttttttttcttccttgtatcattctaaatttcaatatgtatgtgtataagatatgctagtatctttaggactaaggccctgcttctctgctccccattaggtttgggacaaactgcgtatgggtttggttggtttagtatgaccaaggccctggtttagaaggcactatattgaaccgtttttaag

SEQ ID NO: 7497 - DNA, 1489 bp, Capsicum annuum
cattactactaaaatctcaaaaccctagctcaaacgcctccattttcaagaacgcaaagctttctggtaagagttgataagtatgtcggatgatgagagagaagagaaggagttggatctgacaagtcctgaggttgttactaagtataagggtgctgctgaaattgtcaacaaggctctgcagttggtggtgtctgaatgcaagccaaaagcaaagatagttgatctttgtgaaaaaggagatgcctttatcaaagagcaaacagggaatatgtacaagaatgtgaagaagaaaattgagaggggtgttgcattcccaacttgcatttcagttaacaataccgtctgccatttttctccactatctagtgatgagacagtattggaggaaggtgatatggtgaagtttgatatggggtgtcatattgatggctttattgctgtagttgctcatacacatgtactccagggaggacctattactggtagagctgctcatgttcttgcagctgctaatacagctgctgaagttgctctgaggcttgtaagaccaggaaagaagaactcagatgtaacagaagctattcagaaagttgctgcagcatatgactgcaagatcgttgaaggtgttttgagccatcaaatgaaacagtttgtgattgacggaaacaaagttgtcttaagtgtgtccaatcctgataccagagtagatgatgctgaatttgaggagaacgaagtctattcaattgacattgttacaagcactggtgaaggaaagccaaagttgttggatgagaaacaaacaaccatctacaagagagctgtggataaaagctacaacctgaagatgaaagcatcaaggtttatcttcagtgaaatcagtcagaagttccctatcatgccatttacggcaagggatttggaggagaaaagagctcgtttgggactagttgaatgtgttaaccatgatcttttgcagccgtatcccgttctacatgagaaacctggtgatttggttgctcacataaaattcacagtgctattgatgcctaacgggtcagataggatcacttctcatgctctccaagaggtgacacctgcgaagtcaatagacgatgaacctgaaatcaagacctggctagcccttcccgtaaagaccaagaagaaaggtggcggcaagaaaaagaaaggtaagaaaagtgagaaagaagagtcatctcaagctgagcctagggaaggagaatcaaatgttgctgaatcttgatttccaattccaacaactatttggttcattgatatttaatgtagggaaggagaatcaaatgttgctgaatcttgatttccaattccaacaactatttggttcattgatatttaatgtgggattattgaggcggttttggatctttcttgcggccttttgctatgtacaagaaaggcatgggcagttattgtattgtccttgtcctgagacttatgccatgttaaa

SEQ ID NO: 7498 - DNA, 1603 bp, Helianthus annuus
ttacttcgtaacggaccactactaactttatataacccgctatcaccgccgacctcaaaccctaacaccctcaccccccattttcacatccgtaaaccccctctcaatccttcaattgttttctccaattgcttgttgagaaatcatgtcggacgatgaacgagttgaagagaaggagctggatctttcttcaccagaagttgtaaccaaatacaaatcggcagctgagattgttaacaaggcattgcagttggttttgtcagagtgcaaacccaaagccaagattgttgatatatgtgagaaaggggattcatacatcagagagcaaactgggaacatgtacaagaatgttaagaagaagatcgaaaggggtgttgcatttccaacatgtttgtcggtgaacaacacagtctgtcatttctccccccttgccagcgatgaaacagtattggaggaaggtgacattttgaaaattgatatggggtgtcatattgatggtttcattgccgtggtggctcacacacacatgcttcagcaaggacctgtaacgggtcgggcagctgatgtcattgctgctgcaaatactgcagctgaggttgctttaagacttgtgaagcctggaaagaagaaccaagatgtgacaaaggctatccaagaggttgctgctgcgtatgactgcaaaattgtggaaggcgttcttagccatcagctgaaacaatttgtgattgacgggaacaaagttgtattgagcgtctcaaatcccgagacaagagtcgatgatgccgagttcgaggaaaatgaagtttatgcaattgatatcgtcaccagcacaggagatggcaagccaaaattgttggacgaaaaacagacaacgatttacaaacgagcagttgacaagagttatcacctgaaaatgaaagcatctcggtttatatacagtgacatttgtcagaattttccaatcatgccgttttcagctagggctttggaagagaaacgtgcacgattaggattggttgagtgtgttaaccatgagcttttgcagccctaccctgttcttcatgaaaagcctggtgattttgttgcgcatatcaaattcacggttcttctgatgccaaatgggtctgatcgtataacgtctcatggactccaggaactacagcctactaaaacagttgatgaccaccctgaaatcaaagcgtggttatctcttcctgtaaagagcaaaaagaaaggcggtggcaagaagaagaaaggtaagcaagtcgagaaagttgaaggtgaggccaagcccgagccgatggaaacatgaaatggtggtgcctaacaaaaacaaaaaaaatcaattttggtttctacctttttgtatggtgtcagagtttgttgaatgaattatgtctttaaagatgtgttcaaaagcattgttgattcataacctctctctcttacataagtctttttgtgaggctttttttcaagtaccattaaaaacttcatatctttgtttagtttacttattgttaaataacccaaacgtgacaaaattgtgaattaatgtagattgtgagaggagaaacatctttagctatgagaaacacccctc

SEQ ID NO: 7499 - DNA, 1413 bp, Hordeum vulgare
gcgagcccccccgcttccattctaatccgccccctgccgagccaccaacgccccaaacccctcgccctcccaaaccctaaccctaaaacctcggccctcccgccgccgccgcccgattcccctccccagtctccgcatcccctgttcggattgaagcgatgtcgtccgacgaggaggtcagggaggagaaggagctcgacctctcctccaacgaggtcgtcaccaagtacaagaccgccgccgagatcatcaacaaggctctgaagttggtattgtcggagtgcaagccgaaagccaagattgttgacatttgtgagaagggtgacaatttcataacagagcaaactgggaatgtctacaagaacgtgaagaggaagattgaaaggggcattgctttcccgacatgcgtatccgtgaacaacacggtctgtcatttctccccactggcaactgatgattctgtactcgaagaaaatgacatggtgaagattgatatggcttgccatattgatggatttattgctgtggtagctcatacacatgtcatcaaagctggtccggttactggaagagcagctgatgttctggctgctgccaacacagctgcagaagttgcaatgaggcttgttagacctggaaagaagaataaggatgtcactgaagcaattcagaaagttgctgctgcttatgattgcaaaatcgtggaaggagttcttagtcatcagctgaaacaattcgtcatcgatggtaacaaagtggtacttagtgtttccaatgctgataccaaggtggatgatgctgaatttgaagaaaatgaagtgtatgcaattgatattgtcaccagcactggcgagggaaagccaaagctattggatgagaagcagaccactatttataagagagctgtagacaagaactatcacttgaagatgaaggcatcaaggttcatcttcagtgagattagccagaagttcccaatcatgccattcactgctagggcgttggaggagaagcgtgcacgcttaggtttggtagaatgcatgaatcatgagctgttgcagccataccctgttctccatgaaaagcaaggcgatcttgttgcccacatcaaattcaccgtgttgttgatgccaaatgggtctgacaagatcacgtcacatccactacagcagttggagccctcaaaatccattgaggatgatgcggagatcaaggcttggcttgctttgggcacaaagtcaaagaagaagggtggtggcaagaaaaagaaaggcaagaaaggagatgcagcagaagccgcagagcccatggaggtttctaaggacgcaccaagccaggaataattcgtatttttttgaattgcttccgttacgtttgtacctgctcctttgctgcatctgattgtgttatatt

SEQ ID NO: 7500 - DNA, 1697 bp, Hordeum vulgare
acaagcagccgccaccgcctatcccccagtcgcgagcccccccgcttccattctaatccgccccctgccgagccaccaacgccccaaacccctcgccctcccaaaccctaaccctaaaacctcggccctcccgccgccgccgcccgattcccctccccagtctccgcatcccctgttcggattgaagcgatgtcgtccgacgaggaggtcagggaggagaaggagctcgacctctcctccaacgaggtcgtcaccaagtacaagaccgccgccgagatcatcaacaaggctctgaagttggtattgtcggagtgcaagccgaaagccaagattgttgacatttgtgagaagggtgacaatttcataacagagcaaactgggaatgtctacaagaacgtgaagaggaagattgaaaggggcattgctttcccgacatgcgtatccgtgaacaacacggtctgtcatttctccccactggcaactgatgattctgtactcgaagaaaatgacatggtgaagattgatatggcttgccatattgatggatttattgctgtggtagctcatacacatgtcatcaaagctggtccggttactggaagagcagctgatgttctggctgctgccaacacagctgcagaagttgcaatgaggcttgttagacctggaaagaagaataaggatgtcactgaagcaattcagaaagttgctgctgcttatgattgcaaaatcgtggaaggagttcttagtcatcagctgaaacaattcgtcatcgatggtaacaaagtggtacttagtgtttccaatgctgataccaaggtggatgatgctgaatttgaagaaaatgaagtgtatgcaattgatattgtcaccagcactggcgagggaaagccaaagctattggatgagaagcagaccactatttataagagagctgtagacaagaactatcacttgaagatgaaggcatcaaggttcatcttcagtgagattagccagaagttcccaatcatgccattcactgctagggcgttggaggagaagcgtgcacgcttaggtttggtagaatgcatgaatcatgagctgttgcagccataccctgttctccatgaaaagcaaggcgatcttgttgcccacatcaaattcaccgtgttgttgatgccaaatgggtctgacaagatcacgtcacatccactacagcagttggagccctcaaaatccattgaggatgatgcggagatcaaggcttggcttgctttgggcacaaagtcaaagaagaagggtggtggcaagaaaaagaaaggcaagaaaggagatgcagcagaagccgcagagcccatggaggtttctaaggacgcaccaagccaggaataattcgtatttttttgaattgcttccgttacgtttgtacctgctcctttgctgcatctgattgtgttatattacattcagctgtggggatttgagtaccttttttgaagtgtctaatggaaatgatccttctgcacatcacatcaaagctcaagcctgataattatgtacggtgtgcagaatgtttacctgtcagttctgcttataaatctggcttacaactactgtgtgctgttttctgtggcttaacgttttgggtgtggctgattggtgttcacctaatgccgttagcagatggtgtgtatttactgcctagacttgcgtga

SEQ ID NO: 7501 - DNA, 1635 bp, Chrysanthemum coronarium
tggtgacgtcatcatcatcatcctttgaaccctaaaaaagcccaacaacacccacacacaaacttcaaaccaccatttcttaaaccctaattttcacaaaagtctgcgcatcaatttccgaaaaatgtcttctgatgatgaaagaggtgaagagaaggagcttgatctttcttctcctgaagtggtgaccaaatacaaatcagctgctgaaattgttaacaaggctttgcagttggttttgtcgcaatgtaagcctgatatgaagatcgttgacctgtgtgagataggagattcatatatcagagagcaaactggtagcatgtacaagaatgtaaagaagaagatcgaaaggggtgttgctttcccaacgtgtttgtctgttaacaacacgattggtcatttttccccacttgctagtgacgagacagtcttaaaggaaggtgatatcttgaaaattgatatgggatgtcacattgatggttttattgctgtggtggcgcacacacatgttcttcaggaaggccccgtcacaggaagagcagccgatgttattgctgctgcgaataccgctgctgaggttgctttgaggctcgttagacctggaaaaaagaatcaagacgtgacagaggccatccaaaaggttgctgctgcttacgactgcaagatcgttgaaggcgttctaagtcatcaactgaagcaattcgtgattgacggaaacaaggtcgttctaagtgtggcaaatccggaaaacagagtcgatgatgctgagtttgaagagaatgaggtctatgcaattgacatagttacaagcacaggagatggcaagccaaagctcttggacgaaaaacagactaccatctataaaagagctgtggacaagaactatcacttgaaaatgaaagcttcccggtttatcttcagtgaaatcagtcaaaagtttccaatcatgccattctctgctagggctttggaagagaagcgtgctcgtctaggtttggttgaatgtgtcaatcacgagcttttgcaaccataccctgttcttcatgaaaagcctggtgattttgttgcacatatcaagttcactgttcttctaatgccaaatggatccgaccgcatcacctcacattcactacaggagttgcagcccaccaaaaatgttgatgaccctgaggttaaagcttggttagctctacctgtgaagagcaagaagaaaggaggtggcaagaagaagaaagcggccaagaagggtgaagaagcagagccaatggacgaaacaaacgatggtgctcaagcatgaggaaatgaagtttcttgtgtaattttgaattttaatcaggttttggttcccgccttgttacatcagaattttcttgaatgtactgggttctcctaggatgatctttacaaaagagagcatgtacacagcatgatttgtgtttcttttgcttgcgtgcgtataaaacctttaaaagaaatctactctgcaacgcaagtcatgtactcgtttattgcatatttgccagcatgtgctcgagcatatgattttgttttgtcgctttaattgttttgttatctgtgttgccactttgtcatggtgttattatttggaaaaaaatggtcggtaatagtttctca

SEQ ID NO: 7502 - DNA, 1390 bp, Gossypium hirsutum
gcaaccctagccacccttccctgatttcatttcttctgtactcacagtaatcacctctccaaaaccctagctctttcactcactgccgccaatttcaaccaattatttgcttataagcgtcgaaaacgatgtcggacgacgagcgagaggagaaggagttggatctcacctcccctgaagttgttactaaatacaagagtgctgctgagatcgttaacaaggctttgcagttagttgtaaaagaatgcaaaccaaaaactaagattgttgacatttgcgagaagggtgatgcatttatcagagagcaaacaggcaatatgtataagaatgctaagaggaagattgagaggggtgttgccttccccacttgtctttctgttaacaacactgtttgtcatttctctccacttgctagtgacacctccgagctgcaagaaggtgatatggtgaagattgacatgggttgccacattgatgggtttattgctgtagttgcgcacacccatgttgtccaggaaggactagtcaatgacaggaaggctgatgttattgctgctgcaaataccgccgcagaagttgcattgaggcttgttaggcctgggaagaagaataaagatgtaacagatgcaattcagaaggtagctgcagcttatgactgcaaaattgttgaaggtgttcttagccatcaactgaagcagtttgtgatagatggaaacaaagtcatactcagtgtctccaacccggatacgagagttgatgatgcggagtttgaggagaatgaagtttatgcagtagatatagttgcttcaactggtgaaggcaagccaaaactattggatgagaagcaaaccactatttataagagagcagttgacaagaattatcatttaaagatgaagacctctagatttattttcagtgaaataaatcagaaatttcccattctcccattcactgccagggctctggaagagaaacgagctcgtctaggtttagtcgaatgcgtgaatcatgatctgttgcagccatatcccgttcttcatgagaagcctggtgattatgttgctcatataaaattcacggtgttgctaatgcctaatggatcagaccggatcacactgcatccgatgcagaagctgcagccaaccaagacaatagatgatcctgaaatcaagggatggttagctttgggaacgaagacgaagaaaaaaggtggtgggaagaagaagaaaggtaagaagaatgagggtgataaagctgatgcagagcctatggatgcatcaaaaactgatgccgctgcatcttaagaaacaaactcctattcttctactcgaccttttttctttttaaatttcaatttaggtacctgcccgggcggccgctcgaaagc

SEQ ID NO: 7503 - DNA, 1312 bp, Eschscholzia californica
ggaagagaaggagttggatctcacttctcctgaggtcgtcaccaaatacaaatccgctgctgagatagttaacaaggctttacagttgatcatttctgaatgcaaacccaaagctaagattgtagatttatgtgagaaaggagatgcctttatcagagagcaaactggtaacatgtacaagaatatgaagaagaagattgagaggggaatcgcttttccgacatgtatttcggttaacaacacagtttgtcatttctcacctcttgctagtgatgaaactgtagtggaagaaggtgatttgttgaagattgatcttgggtgtcatatagatgggttcattgttgtagtagggcatacccatgttatccatgatgggccgataaccggacgacaagctgatgttattgctgcagcaaatactgctgctgaagtcgctttgaggctggtcagaccaggaaaaaagaataaggatgtaacagaagctattcagaaggtagccgccgcatatgactgcaagattgtcgaaggtgttctgagtcatcagctaaagcagtttgtgattgatgggaacaaggtcatactcagtgtgtccaatcccgaaaccaaagttgatgatgtagagtttgaggagaatgaagtctatgcagtcgatatagtcaccagcacaggggatggcaagcctaagttactagatgagaagcaaacaactatttacaagagagccgtagacaagaactatcacttgaagatgaaagcatctagattcatctttagcgaaataagccagaaattcccaattatgccattttcagccagggctttggaagagaagagggctcgtctgggtttggtagaatgtgttaaccatgatcttttacagccataccctgtacttcatgagaagcctggtgatttcgttgcccaaatcaaatttactgtcttgttaatgccaaatgggtcggacagagtcacaagccatgctgttcaggagctgcagccaacaaaaacaatcgaggatgatgctgaaatcaaggcctggctatcccttggaacaaagaagaagaaaggtggtggcaagaagaagaaaggtaagaaggaagatactaaaattgacgagtctgcagaagccgaacctatggattcaacatcttaatagagtaataaaatggttccatttttggtactttgccttgaaactgttcttgctccgcatttgtttccgaattagagagaatcgagaagttttaacattctaaatctatataactgtgttttttcgtggatggatagattaaaaacagattaaagtcag

SEQ ID NO: 7504 - DNA, 1563 bp, Leymus cinereus x Leymus triticoides
ctaatccgccccctcccgagccaccaaagctccaaagccccaaacccctcgccctcccaaaccctaaccctaaaacctccgccctcccgccgccgccgccgccgccgcccgattcccctccccagcctccgcatcccttgttcggattgaagcgatgtcgtccgacgaggaggtcagggaggagaaggagctcgacctctcctccaacgaggtcgtcaccaagtacaagaccgccgccgagatcatcaacaaggctctgaagttggtattgtcggagtgcaagccgaaagccaagattgttgacatttgtgagaagggtgacaatttcataacagagcaaactgggaatgtctacaagaacgtgaagaggaagattgaaaggggcattgctttcccgacatgcgtatctgtgaacaacacagtctgccatttctccccactggcaactgatgattctgtacttgaagaaaatgacatggtgaagatcgatatggcttgccatatcgatggttttattgctgtggtggcacatacacatgtcatcaaagctgggccggttactggaagagcagctgatgttcttgctgctgcaaacacagcagcagaagttgcaatgaggcttgttagacctggaaagaagaataaggatgtcactgaagcaattcagaaagttgctgctgcttatgattgcaaaattgtggaaggagttcttagccatcagctgaaacaattcgtcatcgatggtaacaaagtggtacttagtgtttccaatgctgataccaaggtggatgatgctgaatttgaagaaaatgaagtgtatgcaattgatattgtcaccagcactggcgagggaaagccgaagctattggatgagaagcagaccactatttataagagagctgtagacaagaactatcacttgaagatgaaggcatcaaggttcatcttcagtgagattagccagaagttcccaatcatgccattcactgctagggcgttggaggagaagcgtgcacgcttaggtttggtagaatgcatgaatcatgagctgttgcagccataccctgttctccatgaaaagcaaggcgacctggttgcccacatcaaattcaccgtgttgttgatgccaaatgggtctgacaagataacgtcacatccactacagcaattggagccctcaaaatccatcgaggacgacgcggagatcaaggcttggcttgctttgggcacaaagtcaaagaagaagggtggtggcaagaaaaagaaaggcaagaaaggagatgcagcagaagcagcagagcccatggaggtttctaaggacgcaccaagccaggaataattcgtatttttttgaattgcttccgttacgttcgtacctgctcctttgctcatccgattgtgttatattacattcagctgtgggaatttgagtaccttttttgaagtgtctaatgaaaatgatcgatcctggcgcacatcacatcaaagcacaagcctgataattatgtatggtgtgccgaatctttacctgtcacctctgcttataaatctggtttaagttga

SEQ ID NO: 7505 - DNA, 1648 bp, Citrullus lanatus
cattcctatataaacaaacgcggccatagaagaaggtaaccctaatttcttcgttgttcttagctgctaaacttgatttcttcatcctaaatcattcgcttcacatagctgaagggtttctgaagctcaaaagcaatgacgttggacgatgagagggaggaggtggagttggatctctcctctccggacgttgttacaaagtacagaagtgctgccgagatcataaacaaggcattgcagctggcaatatcccaatgtaaacctaaagcaaaaatcgttgacatttgcgaaaaaggagatgccttcattagagagcaaacaggcaacatgtacaagaatgttaagaagaagatagaacgaggcgttgcctttccaacttgcatctctgtaaaccacacagctggccacttttcacctctggctagcgatgaaacagtgatggaagaaggagatatactcaagattgatttgggctgtcatattgatgggtttgtcgctgtagttgctcacactcatgttctgcaagaaggaccggtgactggaagggcgtctgacgtcattgcagctgctaacactgctgccgaagttgccttgaggcttgtcaggcctggaaagaagaataaagatgtaacagaagccattcaaaaggttgcagctgcttatgattgcaaaattgttgaaggggtacttagccaccagttgaagcaatttgtgattgatggaaacaatgttattctcagtgtttcaaatccagaaacaagagttgacgatgctgagtttgaaagaatgaaatttatgcaatagacatagttacaaccagaggcgaaggcaagcctaaactgttggacgagaagcagacgactatatataagagagccgtggacaagaattaccacttgaagatgaaagcatctaggtttattttcagtgaaataagtcagaaatttcccattctgcctttcactgctagggctttggaagagaaaagagctaggctgggactagtcgaatgtgttaatcacgatctattgcaactgtatcccgtcctccatgaaaagcctggtgattatgttgcctacatcaaatttacagtcttgttaatgcctaatggatcggatcgaattacctctcatgcactgcaagaacttaagcttacaaaaagtatggatgatcctgaaattaaggcttggttaacacttggaacaaagacaaagaagaagggtggggggaagaagaagaaaggtaagaaaggcgacaacaaacccgatgattcaaaagaggctgagccaatggagtcgacgaagaatgggggtgcatcacaggaatgagtgatccccttttggcctgctgctccttcccacccatcctttcaattttggcactgttttctttttattgtatgtttgactgatcagccttcatatgagtatttttagggcctggttcagtatagtttcttagacatcagaaggaataacctttttattacttcctcatgtatcatcaacatatttttattggcaaagtacataatttagttcaataaacatgtctacttataatattgttctgaaaggaagttttgataattcattacgaagagtgtgtgttgactgctgagggaaaatgaatgacggaagtgcttagc

SEQ ID NO: 7506 - DNA, 1300 bp, Carpinus betulus
tcgtaaccctagcttcaagtgtgccacctttcatttggtactctctttcatcctctctgctaaaccctagctcccaaactagctcaactccgtcgccgtcattttctcccatcgcaggagaattttcgaagttccaagacgatgtcggatgatgaaagggaggagaaggagttagatctcacttctcctgaggtcgtcaccaaatacaaaagcgctgccgagatcgttaataaggctttgcagctagtattatccgaatgcaaaccaaaggctaagattgtggacctttgcgagaagggagattcgtacattagagagcaaactggcaacatgtacaagaatgttaagaagaagatcgaaaggggcgtcgctttcccaacttgcatttccgttaacaatactgtctgtcatttctctccacttgccagcgatgaggcagtgttcgaagaaggtgacatgttgaaaattgatatgggttgccatatcgatggattcatcgcggtagttgcacatactcatgttcttcaggacggtccagttactggaagggcagctgatgttattgcagctgctaatactgctgcagaagttgctttgaggctcgtaaggccgggaaaaaagaacaaagatgtaactgatgcaattcagaaggttgctgctgcttatgactgcaaaattgttgaaggtgttcttagccatcagctgaagcagtttgtgatagatggtaacaaggttgtcttgagtgtagctggtccagagacaagagttgatgatgctgaatttgaggagaatgaagtttatgctgttgatattgtaacaagcacaggtgaaggcaagcctaagctgttggatgagaagcagacgaccatctataaaagagctgttgacaggaactaccacttgaagatgaaagcatctaggtttattttcagcgaaataaatcagaaatttcctatcatgccattcacagctagggcgctggaggagaagagggctcggctgggtttggtggaatgtgttaatcatgaactcttgcagccttatcctgttcttcatgagaagccgggtgattatgttgctcacatcaaattcacagttttgctaatgccaaatgggtcggatagagtcacatctcatcctctgcaggagctgcagcctacaaagacaatagatgatcctgaaatcaagacctggttagccttgggcacgaagacaaagaagaaaggtggtaggaaagaagaagaaagggtaaaagggtagaacaaagctgaggagtcaacagaagccgagcccatggatg

SEQ ID NO: 7507 - DNA, 1541 bp, Brachypodium distachyon
caggtcgggagccccgcttccattctaattcgtccctgtccagagcccaaacccctcgtcctcccaaaccctaaccttaaaacctccaccctaccgccgccgccgccgccccgattccacttccagtctcgcactccctgtccggatcgaagcgatgtcgtcggacgatgaggtcagggaggagaaggagctcgacctttcctccaacgaggtcgtcaccaagtacaaaaccgcagccgaaatcatcaacaaggctctgaagttggtcctgtctgaatgcaagccaaaagccaagattgttgacatttgtgagaagggtgacaattttataacggagcaaacggggaatgtctacaagaacgtgaagaagaagattgaaaggggcattgctttcccaacatgcttatctgtgaacaacacagtctgccatttctcgccccttgccactgacgatgcaatcctggaagaaaatgatatggtgaaaatagatatgggctgtcacattgatggttttattgctgtggtggctcatacgcatgttatcaaagatggaccagttactggaagagcagctgatgttcttgctgccgcaaacacagccgcagaagttgcaatgaggcttgttagacctggaaagaataacaaagatgttacggaagcaattcagaaagttgccactgcttatgattgcaaaattgtggaaggagttcttagccatcagctgaagcaatttgtaattgatggtaacaaagtggtacttagtgtttccaatgctgatactaaagttgatgatgctgaatttgaagaaaatgaagtgtatgcaatcgatattgtcaccagcactggagagggaaagccgaagttattggatgagaagcagactaccatctataagagagctgtagacaagaattatcacttgaagatgaaagcatcgaggttcatcttcagtgagattagccagaagtttccaatcatgcccttcactgctagggtattggaagagaagcgtgctcgcttaggcttggtggagtgcatgaatcatgagcttttgcagccgtaccctgttcttcatgagaagccaggcgatcttgttgcccacataaagttcactgtgttgctgatgccaaatggatcagacagggtaacatcacattcactacaggaattgcagccctcgaaatctattgaagacaatgctgagatcaagggatggcttgctttggggacaaaaacaaagaagaagggtggtggaaagaagaagaaaggtaagaaaggggatgcagcagaagcagagcctatggaggagggttcaaaggatgcaccaagccaagaataattctgatatcttgagttgcttccgctacctttgtacctgctccatcgctgcatctgactgtgttatattacattcagttgtgggaatttgagtactttttttttgaaagtatctggagaaaatgatcgatcttgctgcacaccccttcacatcaaagcacaaaattataactatttataaggtgtactgaatgtttagccgt

SEQ ID NO: 7508 - DNA, 1780 bp, Festuca arundinacea
agacccgagcctccgcttccattctaatccgcccctctcgtgacctcaaagtctccaaacccctcctcccaaaccctaaccctaaaacctccaccctcccgccgccgccgccggattcccctctccagccaccgcgccccctgttcggatcgaaacgatgtcgtcggacgaggaggtcagggaggagaaggagctcgacctctcctccaacgaggtcgtcaccaagtacaagaccgccgccgaaatcatcaacaaggctctgaagttggtcttggccgagtgcaagccgaaagccaagattgtcgatatctgtgagaagggtgacaatttcatcacagagcaaactgggaatgtatacaagaacgtcaagaggaagattgagaggggcattgctttcccaacatgcttgtctgtgaacaacacagtctgccatttctccccacttgccactgatgatacggtgctgcaagaaaatgatatggtcaaaatagatatgggctgccatattgatggttttattgctgtcgtggctcatacacatgtcatcaaggatggcccagttgctggaagagcagctgatgttcttgctgctgcaaacacagctgcagaagttgctatgaggcttgttagacctggaaagaagaataaagatgttactgaagcaattcagaaagttgctgctgcttatgattgcaaaattgtggaaggagtccttagccatcagctcaaacagttcgtcattgatggtaacaaagttgtactcagtgtttccaatgctgacacgaaggttgatgatgctgaatttgaggagaatgaagtctatgctatagatattgtcaccagcactggggaggggaagccgaagttgttggatgagaagcagaccacaatctataagagagccgtggacaagaattatcacttgaagatgaaagcatcgaggttcattttcagtgagatcagccagaagttcccaatcatgccgttcactgctagggcgttggaagagaagcgtgcacgcttaggcttagtggaatgcatgaatcatgagctgttgcagccgtaccctgttctccacgaaaagcaaggcgaccttgttgcacacatcaaattcacagtgttgctgatgcccaatggatcggacaaggtaacatcacattcacttcaggaattgcagcccacaatatctattgaagacaatgctgagatcaaagggtggcttgctctgggtacaaagtcaaagaagaaaggtggtggaaagaaaaagaaaggtaagaaaggagactcagcagaagcagagcctatggatgtttcagagcagagccaagaataattcagtttttttcctttgcttccgctgcttctgtacctgctccttcgctgcatctgattgtgttatattacattcagctgtgggaatttgagtgtactttttttgaagagtctgaagaaaatgatcgtccttctgcacacctggacacttagcacaaattgatcattatctatggtgtgctgaatgtgtacttgtcaattctgcttataagtctgcttaacttgagtttaactctgctgtgatggttgtctgtttgctaacatttataaggtgtgagttgctgaagttacggtagcacttttatgtgtatggccttctagaataacatgcaccatttcaggcgtgaatgtctgggattctgtgtctatttaataatgtctgttgtatgttaatattcattccagtcataatagaatgctagatgcctggtaaaaaaaaaaaaaaaaa

SEQ ID NO: 7509 - DNA, 1729 bp, Panicum virgatum
cccagaacccagccatgacgatctcacctccagacctcctgtcccacccgtcggcgaggtgccaacctcgctaaggccggcacccggccccattcgccagcgagacgcgagcctccactctaagccctagccagacgccgccgcctcaccccagccccgctgccttgcctccatttctaatcccccctcccgaagcccaaaccctaaacctaaacctctcaccccagccgccgccaccaccgctttcgccgccgccgcgactcccctccctgccgccgacgtcccccgcctcggatcgaagcaatgtcgtcggacgatgaggtccgggaggagaaggagctcgacctctcatccaacgacgtcgtcaccaagtataaggccgccgccgaaatcctcaacaacgctctgaagctggttgtatctgagtgcaagccgaaagccaagattgttgacctttgtgagaagggtgatgctttcattagagagcaaactgggaatgtctacaagaatgcaaagaggaagattgaaaggggcattgctttcccaacctgtgtatctgtgaataacacagtctgccatttctcaccgcttgccactgatgaggcagttctggaagaaaatgatatggttaaaatagatatgggctgtcacattgatggttttattgctgtggtggctcatactcatgtaattacgaatgggccggtcactggaagagcagctgatgttcttgctgctgccaacaccgcagcagaagtcgcaatgaggcttgtgagacctgggaagaagaacaaggatgtcactgaagcaatccagaaagtagctgctgcttatgattgcaaaattgtcgaaggtgttcttagccatcagctgaaacaatttgtcattgatggtaacaaagtcgtgctcagtgtctctaatgctgatactaaggtggatgatgctgaatttgaagaaaatgaagtatatgcaattgacattgtcactagcactggggagggaaagcccaagttattggatgagaagcagaccaccatctacaaaagggctgtagacaagaattatcacttaaagatgaaagcatcaaggtttattttcagtgagatcagccagaagttcccgatcatgcctttcaccgctagggcattggaagagaagcgtgcacgcttaggcttggtggaatgcatgaaccatgggctattgcagccatacccagtactccatgagaagccaggtgatcttgttgcgcacataaaattcactgtgctgctgatgcccaatggatcgaataagattacatcacatccgctacaggagttaaagcccacaaaatccattgaagacaatgctgagataaaggcatggcttgctttggggacaaaatccaagaagaagggtggtggaaagaagaagaaaggcaagaaaggagatgcagcagagcctatggaggaggcaacaaatggtgctccaagccaagaataattctgatttttggaattgctacctctagttttgttcatgtttctttgctgcatctgatggtgttatattacattcagttgtggaaaaaattgagtactgtttcaactgtcttaagaaatgacgcatcctgctgcacattatcgcatctaatgacaaagataattatccatgtgccctgctcgcgctagttctctcttcttgcgtaatctcacgttccttgataattctgaggtactcatcgtgaaaa

SEQ ID NO: 7510 - DNA, 1421 bp, Flaveria ramosissima
tcctcaataaccgaacaccaccaactttatataatcaccgccgacctcaaaaccctagcactcgacacacaccctcatcttcatcttcgtctctttaaaccctaatctcccctctaaatccattaattgctttgcgaattcctcctctgaggaagcatgtcggacgatgaagcaagggaagagaaggagctcgatctttcctccccagaagttgtaaccaagtacaaattggctgctgagattgttaacaaggccttgcagttggttttgtcagaatgcaaacccaaagccaagattgttgatatatgtgagaagggagattcgtacatcagagagcaaactgggagtatgtacaagaatgttaagaagaagattgagaggggtgttgcatttcctgcatgtttgtctgtgaacaacacagtttgtcattactctccccttgctagtgatgaaacagtgttggaagaaggtgacattgtgaaaattgatatggggtgtcatatagatggattcattgctgtggtagctcacactcatgttcttcagcaagggcctgtcactggtagagctgccgatgcgattgcagctgctaatactgctgctgaggttgccttaagacttgtgaagcctggaaagaagaaccaagatgttaccgaagccatccaaaaggttgctgctgcttacgactgcaaaattgtggaaggcgttcttagtcatcagttgaagcagtttgtcattgatgggaacaaagttgtattgagtgtctcaaatcccgaaaccagagttgatgatgctgagtttgaggagaatgaggtttatgcaattgatatagtcaccagcacaggagagggcaagccaaaattgttggacgaaaaacagacaacaatatataaaagagcagttgataagagttatcacttaaagctgaaagcatctcggtttatattcagtgagatcagtcaaaatttcccgatcatgccattctcatctagggctttggaagagaagcgtgctcggttaggattagtggaatgtgtcaaccatgagcttttgcagccataccctgttcttcatgaaaagcagggcgactttgtggcacatatcaaattcacggttcttcttatgccgaatgggtcagaccgtataacctctcatgcgctccaggagttgcagccaactaaaactgtcgatgaccctgaaatcaaaggatggttatcccttcctgtaaagtcgaaaaagaaaggtggtggcaagaagaagaaaggtaaaggagttgaaaaaagtgaaggaatggaagaatctgcaaatggtggtgcttaaggatcttgttggatgggagatattgaaacccaattttgttttatttgttgtctccaaatgaatgtgcatgtacttgtacacacttgattcataacctttct

SEQ ID NO: 7511 - DNA, 1579 bp, Tragopogon dubius
ttgaggaaccatttgacgtgtcatcaacgagaaaacccctaataactcagtaaccgaagactacgaactctatataaacacagaacggctgaagcaccgccgacctccaaaccctagcacacgacttttgctagcactctattttcgcttctttaaatcacaatcacccctgttcatcctttaattttttgctaatctgctttccgaggaaacatgtcggacgatgaaagaggggaagagaaagagctagatctttcctctccagaagttgtaacgaaatacaaatcggctgccgagattgttaacaaggctttgcagttggtattgtcagaatgcaagcccaaagccaagattgttgatatttgtgagaagggagattcatatatcagagagcaaacggggaatatgtacaagaatgtcaagaagaagattgaaaggggtgttgcatttcccacatgtttatctgttaacaacacagtctgccattactcaccgcttgccagtgatgagactgtattagaagaaggtgacattttgaaaattgatatggggtgtcatatagatggtttcattgctgtggtggggcacactcatgttcttcaacaaggacctgtaacgggtagagcagcagatgccattgcagctgcaaatactgctgctgaagttgctttaagacttgtgaagcctggaaagaagaaccaagatgtgacggatgcaattcaaaaagttgcagctgcttatgactgcaaaattgtcgaaggtgttcttagtcatcaactaaaacaatttgtgattgatgggaataaagttgtattaagtgtctcaaatcctgaaacgagagtcgatgatgctgagtttgaggaaaatgaagtttatgcaattgacatattcaccagcaccggagatggcaagccgagattgttggatgaaagagagacaacgatttataaaagagcagttgataggaattatcacttgaaaatgaaagcctcccgatttatatttagtgagattaatcaaaagtttccaatcatgccgttttcagctagggctttggaagagaagcgtgctcgattgggtttggtggagtgtgttaaccatgagctactgcaaccataccctgttcttcatgaaaagaatggtgattttgttgcgcatataaagttcacggttcttttgatgccaaatggatcggaccgaataacttctcatacgcttcaagaactacaaccaactaaaacagttgatgaccctgaaatcaaatcatggttatctttgcctgtaaaatctaaaaagaaaggtggtggcaagaaaaagaaaggcaagcgggcggaaaagggtgaaggcgagggggaggcaatggaggaagataccacaaatggtggtggggcagaatgatataataataataataatagtggtatgtaatttgatgatagttgagatccaatttttggtgtatcggagtttgtttctccaaaactaaaaccaaacataatttgtacacagccttaaacttcaatcatatcttttcttttatcaaatttggacttgttagaaaaaaaaaaaaaaaaaagta

SEQ ID NO: 7512 - DNA, 1183 bp, Artemisia annua
gatgaaagaaatgaagagaaggagcttgatctttcctcttcagaagttgtaactaaatataaatctgctgctgagattgttaacaaggctttgcagttggtattgtcagaatgcaaacctaaagcaaagattgttgacatttgcgagaagggtgattcattcattagagagcaaactgggaatatgtacaagaatgttaagaagaagattgaaagaggtgttgcatttcccacctgtttgtctgtcaacaacacagtctgccattattctccgcttgcgagtgacgagagcgttttggaagaaggtgacattttgaaaattgatatggggtgtcatattgacggtttcattgctgtggttggccacacccatgttcttcagcaaggacctgttacgggtagagcagctgatgctattgcagctgccaatactgctgctgaggttgccttaagacttgtgaagcctggaaagaagaaccaagatgtgacagaagccattcaaaaggtagctgctgcatatgactgcaagattgtggaaggtgttcttagtcatcaactgaaacaatttgtgattgatgggaacaaagttgtgttaagcgtctcaaatcctgataccagagttgatgatgccgagtttgaagaaaatgaagtttatgcaatcgatattgtcacaagcacaggagacggcaagccaaaattgttggatgaaaaacagacaacaatctacaaaagagcagttgacaaaaattatcacttaaaaatgaaagcatctcggtttattttcagtgagattagtcaaaagtttccaatcatgcctttttcagctagggctttggaagagaaacgtgctcggttgggattggtggaatgtgttaatcatgagcttttgcagccttaccctgttcttcatgaaaagcctggtgattttgttgcacatatcaagttcacggttcttctgatgccaaatggaaatgatcgcgtaacctcgcatacacttcaagagttgcaaccaagatgacactgaaattaaagcgtggttatctttaccttaaagtccaaaaagaaaggcggtggcaaaaagaagaaagggaagaaagcagataaaggtgaaggaccaatggaagaaacatccaacgatggtgcccaagaatgagaagcttttgtaatttgatagatgttcagat

SEQ ID NO: 7513 - DNA, 1602 bp, Daucus carota
tccaaacgctgccctccagtcccctgaaaagccccaaaccctaactcacctccctgccctttcacccaaacagacccatctctcatctcctcatttctaggttgattagattgattgaacagaatcagaagcagccatgtctgatgatgagaaggagcttgatctcacctcacctgaagttgtgaccaaatacaaacttgccgctgagactgttaacaaggctatgcaattagtattggcagcatgtaagccgaaagcaaaaattgttgatatttgtgagaaaggggatgcttttattaaagagcataccggaaacatgtataagaatgtgaagaagaagattgagaagggtattgcgtttccgacttgtctgtctgtgaataatactgtctgtcatttctcaccgctggctagtgatgaagctgttttggaagagggtgatgttttgaaaattgatatgggatgccatgttgatggattcattgctgtagttgcacacactcatgttcttcaggacggaaaagtgacaggtaaagcagctaatgttatcgctgccgcaaacactgctgctgaagttgctctaaggcttgtcaggcctgggaaaaagaacaaagacgtttctgaagccgttcagaaggttgctgctgcctatgactgtaaaattgttgaaggagttctcagtcatcagcttaaacaatttgtgattgatggaaacaaagttgttctgagtgtctcaaaccctgatacaagagttgatgatgcagagtttgaggaaaatgaagtttatgcaattgatatagttaccagcacaggagaagggaagcccaagttggtggatgaaaagcagacaactgtctataaaagagctgtggacaagaattatcacttaaaaatgaaagcatcaaggttcatatttagtgaaataagtcagaattttccgattatgccgttcacggcaagagctttggaagaaaaacgagctcgccttggattagtcgaatgtgtgaatcatgatcttttgcagccatatcctgttctacatgagaaaccaggcgactatgttgctcatatcaagttcactgttttgctgatgccaaatggatcagaccggatcacttctcaccctttacaggagttggaacctacgaaagccatagaagatcctgaaattaaagcttggttagctttggggatcaagacaaagaagaaaggcggtgggaagaaaaagaaagggaagaagagtgaaaaatgtgatgattcggccgagccagggccagttgatgctcctccaacaaatggcagtgcacctcaagaatgaagacataggttttgttaaccttctgtaatttcagtttttccttttatcttttgtgcccttttaaggccacatcaatgtacctggtactgttgcctatgggttattctagctggtactggaacgccaagtcccaactgtacctggattgcctagttcttagacacaaatgaattattaagccttttggtcttgaaagacatgctttttgaccaataagtagaaagtgagaaatatgaatttgacagaagatggaagtcatctcactggtattaggccctgcttcc

SEQ ID NO: 7514 - DNA, 1559 bp, Coffea canephora
atccaagaattcggcacgaggcactccccccgttcctcaaagaaaccctaaacctcaactctaacctccacacttctccactttcacttccttaccgcccacaagcttcatttcagaggttttcgattaactatgtcggacgacgaaagggaggagcgagagctggatctcaccagtcctgaggtcgtcacaaaatacaaaagcgccgccgaaattgttaacaaggcattgcagttggtattgtctgagtgcaagccagcaacaaagattgttgatttatgtgaaaaaggggatgcattcatcaaagaacaaactgggaatatgtataagaatgtaaagaagaagattgaacgaggtgttgcctttccaacttgcatttcagtgaacaatactgtctgtcatgtttcccccctggctagcgatgaggccgttttgcaacaaggtgacatagttaagattgatatggggtgtcacattgatggttttattgctgtagtggcccatactcatgtactccaggatgggcccgttactggtagagcagctgatgttattgcagcagcaaatacagctgctgaagtggcattaaggcttgttcggccagggaagaagaatcaagaagtagcagaagcaattcaaaaggttgctgcagcttacgactgcaggattgttgagggtgtactgagtcaccaaatgaagcagtttgttattgatggtaataaagttgtgctgaatgtgtccagccctgaaatgagagtagatgatgcggagtttgaggagaatgaggtttatgcaattgatatagttactagcactggtgatggcaaaccaaagctgttggatgagaagcaaacaactatctataagagagctgtggacaagaactataatttgaagatgaaagcatcaagatttattttcagtgaaataagtcagaaattccctatcatgccattcactgcaagagacttggaagagaagagggctaggttagggctggttgaatgtgtcaaccatgatcttctgcaaccatatcctgttttgcacgagaaacctggtgacttggttgctcatattaagttcacagttctgctcatgccaaatggatcagataggatcacatctcattctctacaggagctgaatcccacaaagacagcagacagtgatcctgaaattaaggcctggttatcccttccaattaagacaaagaagaaaggtggtgggaagaaaaagaaaggtaagaaaggagacaaagcagaagactcaatgcagactgaaccagttgatgaagcggcaaatggcgcatctcaataatgagctcctgagagtgagctgctggtctattaaccaaccacctgtttcaagtttgaagttattaagctgtttctgggattgagcatatcagctagtcgtttttccccttgacttgggtgatgtaatacaaaatcatagataaaagatatttgttatcctttcattttgacgcttcaccatggtctctggtttaaattgagcagttggttgtcgaggaacgtagcagagttttgcatcagtcc

SEQ ID NO: 7515 - DNA, 1507 bp, Echinacea purpurea
ctcaaccattcactctcaatcctccttcatttcctcaaaaccctaattacgtctgtcaatcgtctaatcgcttgttaatttcattcggaggaaacatgtcggatgatgaagttagggaagagaaggagctggatctttcatcaccagaagttgtgactaagtacaaattggcggctgagattgttaacaaggccttgcagttggtgttgtcagaatgcaaacctaaagctaagattgttgatatatgtgagaaaggagattcgtacatcagggaccaaactgggagtatgtacaagaatgttaagaagaagattgaaaggggtgttgcatttccaacatgtttgtcagtgaacaattgtgtctgtcattactctcctcttgctagtgatgagacactattggaagaaggtgacattttgaaaattgatatggggtgtcatattgacggttttattgctgtggtggcccacactcatgctcttcaggaagggcctgtaacaggtcgggcagctgatgtccttgctgctgcaaatactgctgctgaggttgccttgagacttgtgaagcctggaaagaagaaccaagatgtgacaaaagctatccaagaggttgctgctgcatacgactgtaaaattgtggaaggcgttcttagccatcaattgaaacaatttgtgattgacgggaataaagttgtattgagcgtctcaaatcctgagacaagagttgatgatgccgagtttgaggaaaatgaagtttatgcaattgatattgtcaccagcgccggagatggcaagccaaaattgttggatgaaaaacagacaacaatttataaacgagcagttgacaagagttatcacttgaaaatgaaagcatctcggtttatatacagtgacatctgtcagaattttccaatcatgccgttttctgctagggctttggaagagaaacgtgctcggttaggattggttgaatgtgttaaccatgagcttttgcagccctaccctgttcttcatgaaaagcctggtgattttgtggcgcatatcaaattcacggttctcttgatgccaaatgggtctgaccgtataacgtctcatggactccaggaactgcagccgactaaaacaattgatgaccacccggaaatcaaagattggctatcgcttcctgtaaagaccaaaaagaaagggggcggcaagaagaagaaaggtaagcaagccgagaaaggtgaaggtgaggccaaggccgagccaatggaagaaacataatgatagtggccatcaaaaacattaaatccaattttggtttttatctatttgtatggttttgaattagattatgacgttaaagatgtgtttaaaagcattgttgattcattgcccttctcttacgtaagtcttttcttcagtagaatgattcatttgttttttgtccaaatttagctagacgttgccgtgttaaccttttgaggtcctcgcagttaaagttgcagctaaaaataattctgatc

SEQ ID NO: 7516 - DNA, 1562 bp, Nicotiana benthamiana
acttttgctcactcaaaaccctagctcaaccctttcttgcccccactttcctttccatcagcaaaacccaattttcgcttcgcagaaattctgtaattgtatttatagacctgtttggtaactatgtctgacgacgagagagaagagagagaattggatctcaccagtcctgaggtcgtcaccaagtacaagagcgccgctgaaatcgttaacaaggctttgcaattggtgttgtccgaatgcaagccaaaagcaaagatagttgatctttgtgaaaaaggggatgcctttatcaaagagcaaagtggaaatatgtacaagaatgtgaagaagaaaattgagagaggtgttgcatttccaacgtgtatttcagttaacaacactgtgtgtcatttctctccattgtctagcgatgagacagtactggaagaaggtgatatattgaagattgatatgggatgtcaaattgatggatttattgctgtagttggacatacacatgttcttcatgaaggaccagttaccggtagagctgctgatgtcattgcagctgctaatacagctgctgaagttgctttgaggcttgtgagaccaggaaagaagaactcggatgtaacagaagctattcagaaagttgctgctgcctatgactgcaagattgttgagggagtcttgagccatcaaatgaagcaatttgttattgatggaaacaaagttgtattgagtgtgaccaatcctgaaacaagagtagatgaagcagaattcgaggagaatgaggtttactcaattgatattgtaacaagcactggtgaaggaaagccaaaattgttggatgagaaacaaacaactatctacaagagagccgtggacaagagctataacctgaagatgaaagcatcaaggtttatcttcagcgaaatcagtcagaagttccctatcatgccatttaccgcaagggatttggaagagaagagggctcgtctgggcctagttgagtgtgttaaccatgagcttctgcagccatatcctgttctacatgagaaacctggtgatttggttgctcacattaaattcacagtgctgttaatgccgaatgggtcggatagggttacatctcatgctctccaggagctgaagactgcaaagacgatagagaatgaacccgaaatcaaagcctggcttgcccttcccgttaaaaccaagaagaaaggcggtgggaagaaaaagaaagggaaaaaaggcgacaagacagaagactcatctcaagcagagccaactgaaggatagtgaattgactccaaatcttgatacatatcaattttgagggtgcttgatcgatcaacttcactgaaactattggttcactgttggtcggcactttcagctgcctttgttcttcctttggggctttgctatacaagggacagacatttattttcctcttgtactatcatgttaagttactcagttttccaatgctattcaacatgctctcatatctgtcttaaaccgtcataagacttacttttcccgtcttaatttgaagtttgatgggaattttg

SEQ ID NO: 7517 - DNA, 1463 bp, Solanum phureja
agtccaaaccctagctcaacccttttcgcctccatttccttcaatcaagaaatcaaagtctgtgtaaaacttgaaccatttgataactatgtcggatgatgagagagaagagaaggagttggatctgacaagttctgaggttgttactaagtataagggtgctgctgaaatcgtcaacaaggctctgcagttggtggtgtctgaatgcaagccaaaagcaaagatagttgatctttgtgaaaaaggagatgcctttatcaaagagcaaacagggaatatgtacaagaatgtgaagaagaaaatcgagagaggtgtggcattcccaacctgcatttcagttaacaataccgtctgccatttttctccactgtctagtgatgagacaatattggaagaaggtgatatggtgaaaattgatatggggtgtcatatagatggctttattgctgttgttgctcatacacatgtggtccagggaggacctgttactggtagagctgctgatgttcttgcggctgctaatacagctgctgaagttgctctgaggcttgtaagaccaggaaggaagaactcagatgtaacagaagctattcagaaagttgctgcagcatatgactgcaagatcgttgagggtgttttgagccatcaaatgaagcagtttgtgattgacggaaacaaagttgtgttaagtgtgtctaatcctgataccagagtagatgatgcagagttcgaggagaatgaggtctattcaattgacattgttacaagcaccggtgatggaaagccaaagttgttggatgagaaacaaacaaccatctacaagagagctgtagataaaagctacaacctgaagatgaaagcatcaaggtttatcttcagtgaaatcagtcagaagttccctatcatgccatttacagcaagggatttggaggagaaaagagctcgtttgggactagttgaatgtgttaaccatgatcttttgcagccgtatcctgttctacatgagaaacctggtgatttggttgctcacataaaattcacagtgctattgatgcctaatgggtcagataggatcacatctcatgctcttcaggagctgacacttgcgaagacaattgaagatgaacctgaaattaagacctggctagctcttcccgtaaagaccaagaagaaaggtggcggcaagaaaaagaaaggcaagaaaggtgaatcatctcaagctgagcctatggaaggcgaaccaaatgttgctgaatcttgatttcaattccaagaactatttggttcattgttatatttgatgttgggattactgaggtggttttggatctttcttgcggcctttctctatatacaagaaaggacaatgggcagcagtagtttgttgttgtcctttgtcctaagacttttgtcatgttaaatggggtttccaatgctataatgctctatgatccaaaccttca

SEQ ID NO: 7518 - DNA, 1717 bp, Triticum aestivum
cccgcttccattctaatccgccccctcccgagacgccaaagccccaaaccccttgccctcccaaaccctaaccctaaaacctccgccctcccgccgccgccgccgcccgattcccctccccagcctccgcatcccgcgtacggcttgaacgatgtcgtccgacgaggaggtcagggaggagaaggagctcgacctctcctccaacgaggtcgtcaccaagtacaagaccgccgccgagatcatcaacaaggctctgaagttggtattgtcggagtgcaagccgaaagccaagattgttgacatttgtgagaagggtgacaatttcataacagagcaaactgggaatgtctacaagaacgtgaagaggaagattgaaaggggcattgctttcccgacatgtgtatctgtgaacaacacagtctgtcatttctccccactggcaactgacgattctgtactcgaagaaaatgacatggtgaagatcgatatggcttgccatattgatggttttattgctgtggtggctcatacacatgtcatcaaagctgggccggttactggaagagcagctaatgttcttgctgctgcaaacacagcagcagaagttgcaatgaggcttgttagacctggcaagaagaataaggatgtcactgaagcaattcagaaagttgctgctgcttatgattgtaaaattgttgaaggagttcttagccatcagctgaaacaattcgtcatcgatggtaacaaagtggtacttagtgtttcaaacgctgatacaaaggtggatgatgctgaatttgaagaaaatgaagtgtatgcaattgatattgtcaccagcactggcgagggaaagccgaagctattggatgagaagcagaccactatttacaagagagctgtagacaagaactatcacttgaagatgaaggcatcaaggttcatcttcagtgagattagccagaagttcccaatcatgccattcactgctagggcgctggaggagaagcgtgcacgcttaggtttggtagaatgcatgaatcatgagctgttgcagccataccctgttctacatgagaagcaaggcgacctggttgcccacatcaagttcaccgtgttgttgatgccaaatgggtctgacaagataacttcacatccactacagcaactggagccctcaaaatccatcgagggcgatgctgagatcaaggcttggcttgctttgggcacaaagtcaaagaagaagggtggtggcaagaaaaagaaaggcaagaaaggagatgcagcagaagtagcagagcccatggaggtttctaaggacgcaccaagccaggaataattctcattttttttgaattgcttccgttacgtttgtacctgctcctttgctgcatctgattgtgttatattacattcagctgtggggatttgagtacctttttttgaagtgtctaatgaaaatggttgatcctggcgcacatcacatcaaagtacaagcctgataattatgtatggtgtgccgaatgtttacctgtcagtaatgcttataaatctggctgaagttcaactactgtgtgatgtttacctgtgctttactgttttaggtgtggctgattggtgttcacctacgttatttgttctgggcaattgctcacgaacgttttggcttttatgtctgttcgaggattctggtgtttctctatacaatcttgctatggtt

SEQ ID NO: 7519 - DNA, 1294 bp, Triticum aestivum
gcttgaacgatgtcgtccgacgaggaggtcagggaggagaaggagctcgacctctcctccaacgaggtcgtcaccaagtacaagaccgccgccgagatcatcaacaaggctctgaagttggtattgtcggagtgcaagccgaaagccaagattgttgacatttgtgagaagggtgacaatttcataacagagcaaactgggaatgtctacaagaacgtgaagaggaagattgaaaggggcattgctttcccgacatgtgtatctgtgaacaacacagtctgtcatttctccccactggcaactgacgattctgtactcgaagaaaatgacatggtgaagatcgatatggcttgccatattgatggttttattgctgtggtggctcatacacatgtcatcaaaggtgggccggttactggaagagcagctaatgttcttgctgctgcaaacacagcagcagaagttgcaatgaggcttgttagacctggcaagaagaataaggatgtcactgaagcaattcagaaagttgctgctgcttatgattgtaaaattgttgaaggagttcttagccatcagctgaaacaattcgtcatcgatggtaacaaagtggtacttagtgtttcaaatgctgatacaaaggtggatgatgctgaatttgaagaaaatgaagtgtatgcaattgatattgtcaccagcactggcgagggaaagccgaagctattggatgagaagcagaccactatttacaagagagctgtagacaagaactatcacttgaagatgaaggcatcaaggttcatcttcagtgagattagccagaagttcccaatcatgccattcactgctagggcgctggaggagaagcgtgcacgcttaggtttggtagaatgcatgaatcatgagctgttgcagccataccctgttctacatgagaagcaaggtgacctggttgcccacatcaagttcaccgtgttgttgatgccaaatgggtctgacaagataacttcacatccactacagcaattggagccctcaaaatccatcgagggcgatgctgagatcaaggcttggctggctttgggcacaaagtcaaagaagaagggtggtggcaagaaaaagaaaggcaagaaaggagatgcagcagaagtagcagagcccatggaggtttctaaggacgcaccaagccaggaataattctcattttttttgaattgcttccgttacgtttgtacctgctcctttgctgcatctgattgttttatattacattcagctgtggggatttgagtacctt

SEQ ID NO: 7520 - DNA, 1379 bp, Triticum aestivum
gcttgaacgatgtcgtccgacgaggaggtcagggaggagaaggagctcgacctctcctccaacgaggtcgtcaccaagtacaagaccgccgccgagatcatcaacaaggctctgaagttggtattgtcggagtgcaagccgaaagccaagattgttgacatttgtgagaagggtgacaatttcataacagagcaaactgggaatgtctacaagaacgtgaagaggaagattgaaaggggcattgctttcccgacatgtgtatctgtgaacaacacagtctgtcatttctccccactggcaactgacgattctgtactcgaagaaaatgacatggtgaagatcgatatggcttgccatattgatggttttattgctgtggtggctcatacacatgtcatcaaaggtgggccggttactggaagagcagctaatgttcttgctgctgcaaacacagcagcagaagttgcaatgaggcttgttagacctggcaagaagaataaggatgtcactgaagcaattcagaaagttgctgctgcttatgattgtaaaattgttgaaggagttcttagccatcagctgaaacaattcgtcatcgatggtaacaaagtggtacttagtgtttcaaatgctgatacaaaggtggatgatgctgaatttgaagaaaatgaagtgtatgcaattgatattgtcaccagcactggcgagggaaagccgaagctattggatgagaagcagaccactatttacaagagagctgtagacaagaactatcacttgaagatgaaggcatcaaggttcatcttcagtgagattagccagaagttcccaatcatgccattcactgctagggcgctggaggagaagcgtgcacgcttaggtttggtagaatgcatgaatcatgagctgttgcagccataccctgttctacatgagaagcaaggtgacctggttgcccacatcaagttcaccgtgttgttgatgccaaatgggtctgacaagataacttcacatccactacagcaattggagccctcaaaatccatcgagggcgatgctgagatcaaggcttggctggctttgggcacaaagtcaaagaagaagggtggtggcaagaaaaagaaaggcaagaaaggagatgcagcagaagtagcagagcccatggaggtttctaaggacgcaccaagccaggaataattctcattttttttgaattgcttccgttacgtttgtacctgctcctttgctgcatctgattgttttatattacattcagctgtggggatttgagtacctttttttgaagtgtctaatgaaaatggttgatcctggcgcacatcacatcgaagtacaagcctgataattatgtatggtgtgctgaa

SEQ ID NO: 7521 - DNA, 1534 bp, Festuca arundinacea
ggcacgaggtccgcttccattctaatccgcccctctcgtgacctcaaagcctccaaacccctcgtcctcccaaaccctaaccctaaaacctccaccctcccgccgccgccgccgccggattcccctctccagcctccgcgccccctgttcggatcgaaacgatgtcgtcggacgaggaggtcagggaggagaaggagctcgacctctcctccaacgaggtcgtcaccaagtacaagaccgccgctgaaatcatcaacaaggctctgaagttggtcttgtccgagtgcaagacaaaagccaagattgttgatatctgtgagaagggtgacaatttcatcacagagcaaactgggaatgtctacaagaacgtgaagaggaagattgaaaggggcattgctttccctacatgcttgtctgtgaacaacactgtctgccatttctccccgcttggcactgatgatacagtcctgcaagaaaatgatatggtcaaaatagatatgggctgccatattgatggttttattgccgtcgtggctcatacacatgtcatcaaagatggcccagttgctggaagagcagctgatgttcttgctgctgcaaacacagctgcggaagttgcaatgaggcttgttagacccggaaagaagaataaagatgttactgaagcaattcagaaagtcgctgctgcttatgattgcaaaattgtggaaggagtccttagccatcagctgaaacagttcgtcattgatggtaacaaagtcgtactcagtgtttccaatgctgatacgaaggttgatgatgctgaatttgaggagaatgaagtctatgctatagatattgtcaccagcactggagaggggaagccgaagttattggatgagaagcagacgaccatttataagagagctgtggacaagaattaccacttgaagatgaaagcatcaaggttcattttcagtgagattagccagaagttcccgatcatgccgttcactgctagggcgttggaagagaagcgtgcacgcttaggcttagtggaatgcatgaatcatgagcttttgcagccatatcctgttctgcatgaaaagcaaggcgaccttgttgcacacatcaagttcactgtgttgctgatgccgaatggatcagacaaggtaacatcacattcagttcaggaattgcagcccataacatctattgaagacaatgccgagatcaaagggtggcttgctctgggtacaaagtcaaagaagaaaggtggtggaaagaagaagaaaggtaagaaaggagacgcagcagaagcagagccaatggatgtttcgacgagccaagaataattcagtttttttatttgcttccgctgcttctgtacctgctccttcgctgcatctgattgtgctatattacattcagctgtgggaatttgagtactttttttgaagagtccgtagaaagtgatcgatctccacaccggttcacttcaaagtacaaattgatgattatctatggtctgctaaatgtgtatttgtcagttctg

SEQ ID NO: 7522 - DNA, 1615 bp, Lolium multiflorum
aatccgcccctcgcgtgacctcaaagcgtccaaacccctcctcatcccaaaccctaaccctaaaacctccaccctcccgccgccgccgccgccgccgccgccgccgccggattcccctctccagcctccgcgccccctgttcggatcgaaacgatgtcgtcggacgaggaggtcagggaggagaaggagctcgacctctcctccaacgaggtcgtcaccaagtacaagaccgccgccgaaatcatcaacaaggctctgaagttggtcttggccgagtgcaagccgaaagccaagattgttgatatctgtgagaagggtgacaatttcatcacagagcaaactgggaatgtctacaagaacgtgaagaggaagattgagaggggcattgctttcccaacatgcttgtctgtgaacaacacagtctgccatttctccccacttgccactgatgatacagtgctgcaagaaaatgatatggtcaaaatagatatgggctgccatattgatggttttattgctgtcgtggctcatacacatgtcatcaaggatggcccagttgccgggagagcagctgatgttcttgctgctgcaagcacagctgcagaagttgctatgaggcttgttaggcctggaaagaagaataaagatgttactgaagcaattcagaaagttgctgctgcttatgattgcaaaattgtggaaggagtccttagccatcagctgaaacagttcgtcattgatggcaacaaagttgtactcagtgtttccaatgctgatacgaaggttgatgatgctgaatttgaggagaatgaagtctatgctatagatattgtcaccagcactggggaggggaagccgaagttgttggatgagaagcagaccaccatctataagagagccgtggacaagaattatcacttgaagatgaaagcatcgaggttcattttcagtgagatcagccagaagttcccaatcatgccgttcactgctagggcgttggaagagaagcgggcacgcttaggcttagtggaatgcatgaatcatgagctgttgcagccgtaccctgttctccacgaaaagcaaggcgaccttgttgcacacattaaattcacagtgttgctgatgcccaatggatcggacaaggtaacatcacattcacttcaggaattgaagcccacgatatctattgaagacaatgctgagatcaaagggtggcttgctctgggtacaaagtcaaagaagaaaggtggtggaaagaaaaagaaaggtaagaaaggagatgcagcagaagcagagcctatggatgtttcagagcagagccaagaataattcagtctttttcctttgcttccgctgcttctgtacctgctccttcgctgcatctgattgtgttatattacattcagctgtgggaatttgagtgtactttttttgaagagtctgaagaaaatgatcgatgcttctgctcacccgttcacttcaaagcacgaattgatcattatctatggtgtgctgaatgtgtacttgtcaattctgcttataagtctgcttaacttgagtttaactctgctgtgatgtttgtctgtttgctaacattcataaggtgtgagttgct

SEQ ID NO: 7523 - DNA, 1482 bp, Zea mays
ccgatctggctgcctcggtcgatttctaattctcctcgcgagcccaaaccctaaacctaaacctttcacccgccgccgccgccaccaccagcactgccactccgccaccaccgtcccgaagccccctcccagcgccatcgacttcatctcggattgaagcaatgtcgtcggacgatgaggtcagggaggagaaggagctcgacctctcctccaacgacgttgtcaccaagtacaaggctgccgccgaaatcctcaacaacgctctgaagattgttgtgtctcagtgcaagccaaaagtcaagattgttgacctttgcgagaagggcgactctttcataagagagcaaactgggaatgtttacaagaacgcaaagaggaagattgaaaggggtattgctttcccaacctgtgtatccgtcaatgacacagtttgccacttctcaccgcttgcaaccgatgatgccgttctggaagaaaatgacatggttaaaattgatatgggctgtcatattgatggctttattgctgtggtggcacatacacatgtaattacaaatgggcctgtcacaggaagggctggtgatgtgcttgctgctgccaacacagcagcagaagtcgcaatgcggcttgtgagacctgggaagaaaaataaggatgttactgaagcaattcagaaagttgctgctgcttatgattgcaaaattgtggaaggtgttcttagccatcaactgaaacaatttgtgattgatggtaacaaagttgtgctcagtgtctccaatgctgatacaaaggttgatgatgctgaatttgaagaaaatgaagtatatgcaatcgatattgtcaccagcactggggaggggaagcccaagttattggatgagaaacagaccaccatctacaaaagggccgtagacaagaattatcacttgaagatgaaagcgtcaaggtttattttcagtgagatcagccagaagttcccaatcatgccttttactgctagggcattagaagagaagcgtgcgcgtttaggcttggtggaatgcatgaaccatgaactattgcagccgtaccctgtacttcatgagaagccaggcgatcttgttgcacacataaagttcactgtgctgctgatgcccaatggatcagataagataacatcacatcctctacaggagttaaagcccaccaaatccattgaagacaatgcagagataaaggcatggcttgctttggggacgaaatcaaagaagaagggtggtgggaagaagaagaaaggcaagaaaggagatgcagcagaagcagatcccatggaggaggcgacaaacggtgctacaagccaagaataattctgatttttggaattactgccaccagcttttttcttgtttcttcgctgcatctgatggtgttatattacattcagttgtggaaaaattgagtactatttctagcttctaagaaatgaagcatcctattatcgca

SEQ ID NO: 7524 - DNA, 1539 bp, Saccharum officinarum
acccggctgcctcactacatttctaatccgcctcccgagcccaaaccctaaacctaaacctctcacccgccgccaccgccgccgccaccaccaccacttcagacgccgccccgaggccccctcccagcgccgccgacttccacctcggattgaaacaatgtcatcggacgatgaggtcagggaggagaaggagctcgacctctcctccaacgacgtcgtcactaagtacaaggctgccgccgaaatcctcaacaatgctctgaagctggttgtgtctgagtgcaagccaaaagcgaagattgttgacctttgtgagaagggcgactctttcataagagagcaaactgggaatgtctacaagaatgcaaagaggaagattgaaaggggcattgctttcccaacctgtgtatccgtgaataacaccgtctgccacttctcaccacttgccacagatgatgcagttctggaagaaaatgatatggttaaaattgatatgggctgtcatattgatggctttattgctgtggtggcacatacacatgtaattgcaaatgggcctgtcacaggaagagcagctgatgttcttgctgctgccaacacagcagcagaagttgctatgcgacttgtaagacctaggatgttactgaagcaattcagaaagttgctgctgcttatgattgcaaaattgtggaaggtgttcttagccatcaactgaagcaatttgtgattgatggtaacaaagttgtactcagtgtctccaatgctgacacaaaggttgatgatgctgactttgaagaaaatgaagtctatgcaatcgatattgtcaccagcactggggaggggaagcccaagttactggatgagaagcagaccaccatctacaaaagggctgtagacaagaattatcacttgaagatgaaagcgtcaaggtttattttcagtgagatcagccagaagttcccaatcatgccttttactgctagggcattagaagagaagcgtgcacgcttaggcttggtggaatgcatgaaccatgagctattgcagccgtaccctgtacttcatgagaagccaggtgatcttgttgcacacataaagttcactgtgcttctgatgcccaatggatcagataagattacatcacatccgctacaggagttaaagcccacaaaatccattgaagacaatgctgagataaaggcatggcttgctttggggacaaaatcaaagaagaagggtggtggaaagaagaagaaaggcaagaaaggagatgcagcagaagcagatcccatggaggcgacaaacggtgcaagccaagaataattctgatttttggaattactgcctccagctttttttcttgtttcttcactgcatctgatggtgttatattacattcagttgtggaaaaaattgagtacttttcctagtgtcttaagaaatgaagcatcctgctgcacattatcgcatctaatggcacaaagataattatctaaaaaaaaaaaaaaaaaaagaccgaggagggacagggcctttcat

SEQ ID NO: 7525 - DNA, 1638 bp, Daucus carota
agggggaggtgagttgtgtgcacagtctatatatacaagaggcaagaccctgccgttcctcaaaccctaacacactgtcgccacctcctcgtcacctcactctatccctctttcataaaaaatctctcattatcttcacaaactctaatttccattcaatttagcagctgaatttgtggtggataattaagctgcaaaacgatgtcggatgaagaaagggaagaggtggagctggatctatcctctcctgaagttgttaccaaatacaagcttgcagccgagactgttaacaaggctttacagttagtgttgtcggaatgcaggcccaatgcaaagattgttgatatttgcgagaaaggggattcatatattagaacgcagaccagtaatatgtacaagaatgtgaagaaaaaggttgaaaagggtatagcatttccgacttgtttatctgttaacaacacagtttgtcatttctcacctctggcaagtgacgagactgttttggaagagggtgatgttttgaaaattgatatgggatgtcatatagatggattcattgctgtagttgcacacactcatgtacttcagcaagggaaagtgacaggaagagttgctgatgttcttgctgcagcaaatactgcagctgaagttgccttgaggcttgtcaggccaggaaagaagaacaaagatgtaactgaagcaattcagaaggttgcagctgcttacgactgcaaagttgttgaaggtgttcttagtcatcaactcaagcaatttgtgattgatgggaacaaagttgtcctgagtgttccaaatgccgatacaagagttgatgaagctgagtttgaggagaatgaagtctatgctgttgatattgttgccagttctggtgatggaaagccaaagatgcttgatgagaagcagacaacagtatacaaaagagctgttgatcagaactatcacttgaaaatgaaagcgtccaggttcatcttcagcgagataagtcagaagttcccaattatgccattcacagcaagggctttggaagagaagagagctcgctttggattggttgaatgtgtcaatcatgaccttttacagccatatcctgttcttcatgaaaaacctggtactattgtcgctcatattaagttcactgttctgctgatgccgaatggatcagaccgggtcacatctcatccagtacaggaattggaaccaaccaaaaccatagatgaccctgaaatcaaagcatggttagctctggggacgaaaacaaagaaaaaaggtggtgggaagaaaaagaaagggaagaaagacaaagttgagggtgcagcagaagagcccatggatgtcacaaacggaggtgctcaagaatgagaagatttaatgtctgttattgtcttggtctcaatttttggcaaatagattgtgtatcttctggtggtactgtgtactagttcttcaatggtacatgaaaatgttgatactatgtagtattaccaagtgcttaaatctgaatgctctgtggaagtaacttaactatgccgtgttttccaacccaaaatagcctggtgcttaaattaaattttctttacgaagttcaatttttgatgtgtactccctccattccaaaataat

SEQ ID NO: 7526 - DNA, 1350 bp, Flaveria ramosissima
cctcgaccctctgaatcgatcatttgctttgcgaatccctcttctgaggaagcatgtcggatgatgaagcaagggaagagaaggagctcgatctttcctccccagaagttgtaaccaagtacaaattggccgctgagatcgttaacaaggctatgcagttggtgttgtcagaatgcaaacccaaagccaagattgttgatatatgtgaaaagggagattcgtacatcagagagcaaactgggagtatgtacaagaatgttaagaagaagattgaaaggggtgttgcatttcctacatgtttgtctgtgaacaacacagtttgtcattactctcctcttgctagtgatgaagcagtgttggaagaaggtgacattgtgaaaattgatatgggttgtcatatagatggattcattgctgtggtggctcacactcatgttctccagcaagggcctgtaactggtagagctgctgatgcgattgcagctgcaaatactgctgctgaagttgccttaagacttgtgaagcctggaaagaagaaccaagatgttactgaagccatccaaaaggttgctgctgcatatgactgtaaaattgtggaaggcgttcttagtcatcaattgaaacagtttgtgattgatgggaacaaagttgtattgagtgtctccaatcctgaaaccagagttgatgatgctgagtttgaggagaatgaggtttatgcaattgatatagtcaccagcacaggagatggcaagccaaaattgttggatgaaaaacagacaacaatatataaaagagcagttgataagagttatcacttgaaactgaaagcatctcggtttatattcagtgagatcagtcaaaatttcccaatcatgccattttcatctagagctttggaagagaagcgtgctcggttaggattagtggaatgtgtcaaccatgagcttttgcagccataccctgttcttcatgaaaagcaaggcgactttgtggcacatataaaattcacggttcttcttatgccgaatgggtcagaccgtataacctctcatacgctccaggagttgcagccaactaaaactgtcgatgaccctgaaatcaaaggatggttatcccttcccgtaaaatcaaaaaagaaaggtggtggcaagaagaagaaaggtaaaggagttgaaaaaagtgaaggaatggaagaatcatcaaatggtggtgcttaaggatcttgttggatgggagatattgaaacccaattttgttttatttgttgtcattaaatgcatgtgcatgtacttgtacacacttgattcataacctttctcttatataaaattgaccaagtagacaggagta

SEQ ID NO: 7527 - DNA, 1735 bp, Elaeis guineensis
caactgtttgagtcctcttcacccccgttttttcctctctctacgggccgaaaccccagatcgataccttgtctccgttcctttttatgcctctaaaccagcggagatcgccgcgatagacttatctgcattgtatttctagcgacgagagtagcttctctcctctccatcgttgctgaagggtttttttagcttggagagatgtcggacgacgaagcaagggaggagaaggagttggacctcacttcccctgacgtcgttaccaagtacaagtgcgctgccgagatcctcaacaaggctcttcagctggttgtatcggagtgtaagccgaaagccaacattgtagacatctgtgagaagggagatgccttcattaaagagcaaactggaaacgtatataaaaacgtgaagaaaaagattgagaagggtatagcattcccgacatgcatctctgtgaacaacactgtttgccatttttcgccactcggcggtgatgagactgttttggaagaaaacgatgtagtaaaaatagatatgggttgtcatatagatggttttattgctatagcggcccatacacatgttcttcgggatgggccgatcactgggagggcagcggatgtgattgcagccgcaaacactgcggcagaggttgctctgaggctcgtgaggcctggaaagaagaataaagatgttgcagaagctattcagaaagtagcttctgcctatgattgcaaagttgttgaaggagtgcttagtcaccagcttaaacagttcgtcattgatggaaacaaagttattcttagtatatccaatcctgagaccagagttgatgatgcagagtttgaggagaatgaagtctatgcaattgatatagtcactagcacaggtgaagggaagccaaaactcttagatgagaaacaaactactatctataaaagagctgtggacaaaagttatcacttaaaaatgaaagcatcgagatttatttttagtgaaataaatcagaagttcccaatcttgccgtttactgcaagagcattggacgagaagcgtgctcggctgggactagtagagtgtgtcaaccatgatctcttgcagccataccctgttctgcatgagaagccaggagaccttgttgctcatattaagttcacagtattgttaatgccaaacgggtctgacaggataacctcccatccattgcaagaattgaaacctaccaagtccattgatgacaatcctgagatcaaggcatggcttgctttgggcacaaaaacaaagaaaaaaggtggaggaaagaagaagaaaggtaaaaaagactgaagctaaagatgatgctgtagaggcagaacccatggatgaagcatcaaatgatgcagcttctcaaggatgagaaattacggttttggtgtttccttcatttgctattagaattttctagttgccttccctgtcatctcaagatttttcatcgtatttggatacaagaattcgggatgttttaaatatgagaaaagatcactgcattgaggaagtcgcccaagctgctgcaggaccatggcatggtggcgcattaaattctttataatacgctgaatctttgaattcttgtgggatgtgctagtttaaaaacaaaaaaaaggaggtgctaattctctattttgtgtgggatgtttcctggatatctctggctgaattcctgttgtatgatgagcaaaagagattgtggagg

SEQ ID NO: 7528 - DNA, 1557 bp, Papaver somniferum
ccttctccttataatcaaacctcagcgcctcctttcctcgtctaaaccctaatttgtgataagattataattgttatttaagaatgtcagatgatgaagtaggaaaggatgagaaagagttggatctttcttctcccgaagttgtaactaaatacaaatctgctgctgagattatcaacaaggcattgcagttggtgttaacagaatgtaaacctaaagttaagattgttgatttatgtgagaaaggagatgcatttatcaaagagcaaactgggaaattgtataagaatacgaagaagaagattgaaagaggtgttgcatttcctacatgtatctcagttaataatactgtatgtcatttctcaccacttgctagtgatggaactcttctggaagaaggtgacatcttaaagattgatatgggttgccatattgatgggtttattgctgttgttgcacatactcatgttcttcaagaaggaccagttactggtagagcagctgatgttattgctgcagccaatactgcagctgaagtagcattgaggcttgttagacctggcaaaaagaataaagaagtaactgaagctattcagaaggttgctgctgcctatgactgcaaaattgttgaaggtgtgctcagccatcagctcaagcagtttgtgatagatggaaacaaggttgtactcagtgttccaggtcccgaaaccagagttgatgatgcagaatttcaggagaatgaagtttacgcaattgatatagttgccagcacaggagaaggcaagcctaggctgttagacgaaaggcaaactactgtctacaagagagcggtgggggagagttatcagttgaagatgaaagcatctaggttcattttcagcgaaattaatcagaacttccccatcatgccgttttcagcaagggctttggaagagaagcgtgcccggctgggattagttgaatgtgtgaaccatgaacttttgcagccataccctgtacttcatgagaagcctggggatcttgttgcacatatcaaatttacagttctgttaatgcccaatggttccgatagaatcacatctcatgctcttcaagaagtgcagccaacaaagacgttggatgaggaacctgaaatcaaggcttggttagctttggccacaaagtcgaaaaagaaaggaggtggaaagaagaagaaaggtaagaagggtgataaggctgaggagtctactgaagctgaacctatggatgcaacaactgcttcccaagaatgatagtttttccaaattttgtaggttccccatgtttaaatgaccagggttttttgcgtttggtactgtgttttagggtgtgatgaatgtttagcttgtccattctaatatttgagtactagatctcaactgtttattctgttgtttgtcaaaagcttcaagtctgtttaagttacattagttcccatacttaaacatcaaatacataactgtgcacccttgacacctccttgattttcatattgttttatgcttatatggaactgttggactggaacagtcaaaataa

SEQ ID NO: 7529 - DNA, 1662 bp, Chenopodium quinoa
cgaaagaaggacaggcaacggagagaagaatagtagtgggccttctctttataaaaccccaacaccaacacaccctctaaaacactcacccccttaaaaccctaactatcttcttctttcttccgctgcacaatccaaatccattttcatttttcccctattcctgttattttcaagcgaaagcgataaacattttgattagattgttgaagaatcatgtcggacgatgagagagaggagaaggagctggatcttagctatcctgaagttgtcaccaaatacaagagcgctgctgacattgtcaacagagctttgcagctagttgtcgcagaatgcaagcccaaagctaaaattgttgacctttgtgagaaaggagataattttatccgagagcaaactgctaacatgtacaagaatgtgaaaaagaagattgaacgaggtgttgctttcccaacttgcttatctgtcaacaatgttgtttgtcatttttcaccccttgcgagtgacgactcagtgctcgaagaaggtgatttagtgaaaattgatatgggttgtcacattgatggctttattgctgttgttgcacacactcatgtcattcaagaaggcccggtaactggcagacaagctgatgttcttgcagcaaccaacactgctgctgaagttgctttgaggcttgtgaggcctggcaagaagaataaagatgtaacagaagcaatccagaaagttgctgccgcgtatgactgtaaaattgttgaaggtgttcttagtcaccaaatgaaacagtttgtgattgatggaaacaaggtggtgttgagtgtatcaaatcctgatatgagagttgatgatgctgaatttgaagagaacgaagtctattctgttgatatagctgctagtacgggtgagggaaagcctagaatgttggatgagaagcaaacaactatttacaaaagagccgtggacaagaactatcatttgaaaatgaaagcatcaagatttatcttaagtgaaatcaatcagaaattcccaataatgccattcacagcaagggcattggaagagaagagggctcgccttggactagtagaatgtgtcaatcatgacctcttgcaaccctaccctgttctgtatgagaagcctggtgattatgttgctcacataaaattcactgttcttctcatgccaaatggatcagaccgtgtaacatcatatcctttgcaagaattgcagccaactaaatcaaccgatgaccctgaaatcaaagcttggttagcattgggaacaaagacaaagaagaaaggtggtggtaaaaagaagaaagccaagaagggtgagaaatctggtgctgaagagtcagctgatgcagagcccatggatgcaaatggcgcaactgctgaaaattgaaaagtcaaaaatgttggttcaaattttgttacttgttgattctcttttgtatttgcttgatgggcaacttaaacatgttagatgttgatcaatatttcatgttgcctctcacctgtgtaaagttctgggtttgggcccacaaaatgaatttttcttgatacacagtgttggggctttttctggttgactttgagcttatgtttagcattctatgttgtttcatttttcagttacatggatttggaagtttttattcag

SEQ ID NO: 7530 - DNA, 1532 bp, Triphysaria pusilla
tttggtaagtaatgcgaaaaacacgttatataaagtacactgcacaccaagctgccgacctgaaaccctaaccattttatttcatttctgcctctgataaaccctaatttcgtacactcactggttcaagagaaggctcgaatttgaaggctgaaacaatgtcggacgaggaacgggaggagaaggagttggatctcacctctcctgaagttgtcaccaaatacaaatccgctgctgaaattgttaacaaggcactgcaattagttttgtcagaatgcaaaccgaatgtcaagattgttgacatttgtgagaagggagatgctttcatcagggagcaatcagggaacacgtacaagaatgtaaagaagaagattgaaaggggcattgcattcccaacttgcatctcggtaaacaatacagtctgccattattcaccattggccagtgatgaatgtgtgttggaatccggagatattgtgaaagttgatatgggttgtcacatagatggctttattgctgtagttgcccacacacatgtaattcagcaaggaccagtaactggcaggggtgctgatgttattgctgctgcaaatacagctgccgaggttgctttgaggcttgttaggccagggaaaaagaataaagatgtcgctgaggcacttcagaaagtcgctgctgcttacgactgcaagattgtcgagggagtgcttagtcatcaaatgaaacaatttgtgatcgatggtaacaaggtcgccttaagtgtctcagcacctgatacaagagttgaagaagctgaattcgaggaaaatgaagtatactctattgacattgttacaagtactggtgaaggcaagccgaaactcttggatgagaaacaaacgactatatataaaagagctgttgacaggaattataaccttaagatgaaggcatctcggttcatatttagtgagataagccaaaagttcccaatcatgccattttctgcaagggctttggaagagaagcgtgctcgattaggccttgtggaatgtgtgaatcatgatcttctacagccatatcctgtactttacgagaaacctggtgactttgttgcacacatcaagtttaccgttttgctaatgccgaatggatcggaccgagtcacttctcatcctctacaggagctgcaaccgacaaaaacaattgatgatcctgagattaaagcctggttagcgttggccacaaagacgaagaagaaaggcggtgggaaaaagaaaaaaggtaagaaaggggacaaagctgaggatgcagcagcagcagcagcagcagcagcaactgcagctgatgcggagccaatggacactgcagctgataattcctaagataaagaatattcttgttctactgtattttctctttgaaattttggcatctcctttgtatttgcatgttacctttgtttagttatcatcaaatgggactcttgtttcagttacttacataaacttgctgaattttctctactttctgtaggtctttttttactaaaa

SEQ ID NO: 7531 - DNA, 1362 bp, Orobanche aegyptiaca
ctgccgacctcaaaccctaacctttttactatcatctgcctccttttctctctttctgttaaaccctaatttcttactctccctggttccggaaagttacaattcgtgaagattcaaacaatgtcggacgaggaaaaggacgagaagaaggagttggatctctcccatcctgaagttgtcaccaaatacaaatccgctgctgaaattgttaacaaggcactgcagttagttttgtcggaatgcaaacgaggggttaaaattgttgacctttgtgagaaaggagatgcttttatcagggagcaaacaggtaacatgtacaagaacgtgaagaagaagattgaaagaggtgttgcgttcccaacttgcatctccgtgaacagtacagtctgccattattcgccactggccagtgatgatactatgttggaagacggagatgttgtgaaaattgatatggggtgtcatatagatggatttattgctgttgttgcgcacacccatgtaattcaggaaggacaagtaacggggagagcagctgatgtcattgctgctgctaatacagctgctgaagttgctttgaggcttgttagacctgggaaaaagaataaagatgtgactgaggcaattcagaaagttgctgctgcgtatgactgcaaaattgtcgagggagtacttagccatcaattgaaacaatttgtgattgatggcaacaaggttgtcttaagcgtgtcatcgcccgacacaagagttgatgaagctgaattcgaggaaaatgaggtgtattccatcgacattgttacaagtactggcgaaggcaagcctaaattgttggatgagaaacaaacaactatatacaaaagagctgttgacaagaactatcaccttaagatgaaagcatctcggttcatatttaatgagataagccagaattccccaatcatgccattttccgcaaggtctttggatgaaaaacgtgctcggttgggcctagtggaatgtgtgaatcatgatctcttacagccatatcctgtccttcatgagaagcctggcgacctagttgcccacatcaagtttaccgttctgctaatgccaaatgggtcagatagaatcacttctcatcctctacaggatctgcaacccacgaaaaccgtagatgatcctgagattaaagcctggttagcattgcccacaaagtcgaaaaagaaaggtggagggaaaaagaagaaagctaagaaagaggaaaaactgaggatgcagccgaagctgagccaatggaggtcgcagcttctcaagattaagagaagaatcttgtttttgtttggtattttcgttttgaagtgttggccgttcaatgtactatta

SEQ ID NO: 7532 - DNA, 1600 bp, Tabernaemontana elegans
acttaccactgtatataaccagtatagcaaatgctcctcagtgccgtcgtttatcaaaaaccctagctccacccccgctcctcgtctccatcactgctgtcgttcttctacctcttctccatagtcagagccccatcgttcctttatcccttttatctctagaagttgtttttggtagttcgtctgaagcggatttgttgaagtttgtgtccagtacaatgtcggatgacgagagggaggagagggagctggatctcacctctcctgaagtcgtcaccaaatacaagagcgctgcggagattgttaacaaggcactgcagttggtagtgtcagaatgcaagccgaaagctaagattgttgacatttgtgagaaaggcgatgcatttatccgagagcaaactgggaatatgtacaagaatgttaaaaagaagattgaaaggggcgtggcatttccaacatgtatctccgtaaacaacacagtctgccatgtttcaccacttgccagtgatgaggctattttggaagaaggtgatgttgtgaaaattgatatggggtgccacatagatggattcatagctgtagttgcgcatacacatgtccttcaagaagggccagtcactggtagagcagctgatgtcattgctgcagccaatactgctgctgaagttgctctaaggcttgttaggccagggaaaaagaacaaagatgtgactgaagcagttcagaaggttgctgctgcttatgattgcaagattgttgaaggcgttcttagtcatcagatgaaacagtttgttattgatggaaacaaggtcatattgagtgtctccaatcctgagacaagagttgacgatgcagaatttgaagagaatgaagtttattccattgatatagtaacaagcactggcgaaggcaagcccaaattgttggatgaaaaacagactaccatctataaaagagctgtagataaaaattatcacctaaagatgaaagcttctaggttcatattcagtgagataagtcagaagttcccaatcatgccctttacagccagggcattggaagagaagcgggctcgtctaggacttgtagaatgtgtcaatcatgatcttctgcagccatatcccgtacttcatgagaagcctggtgatatagtggcacatatcaaatatactgtgttgctaatgccaaacgggtcggatcgcattacatcccattccctccaggagcttcagcccactaaagcagtagatgaccctgagattaaagcatggttagccttgggcacaaagacaaagaagaagggtggtggaagaaaagaaaggtaagaagggggataaagctgagccttcagctgatgctgagcctatggatgtcgctacaaatggatcccaagagtgagagattggttttatgttttcacttggccgattttcgtaactactgtatttggttgctcgagtttttgaattggtcacagcagacttagtgttgctgaattgtacacaaggtgaaccttgtatcatttttgttttaaatagaaaaagtaaatttatcagactcctatttacagcaacctttgtagagcaattgatctcaatat

SEQ ID NO: 7533 - DNA, 1452 bp, Triphysaria pusilla
ttttggagaaaatcacattatataacgcacaccgctcatgtttccaacacccgacctcaaaccctaatttgtactgcttcgttaggtagtacctcttaccagcccctctcactcgctaaaccctaattccatcgccgcaaatagttttccaaaacttacacaatgttggacgaagatagagaggagaaggagctggatctcacctctcccgaagttgtcacgaaatacaaatccgctgccgagattgtgaacaaggctctgcaactggtattgtccgaatgcaacccgggagctgtgattgttgatctttgcgagaaaggcgatgcatttatcagagaacaaactgggaacgtatacaagaatgtgaaaaagaagatagaaaggggcgttgcattcccaacttgcatatcagtgaacaacacagtatgtcattattcccctttggccagtgatgatactcgtttgatgggtggagacattttgaaaattgatatgggatgtcatatagatggctttattgctgtagttgctcatacacatgtacttcaacaaggacctatcacgggcagggcagctgatgttattgctgctgcaaatactgctgctgaggttgccttaagactagtaaggccagggaaaaagaacaaagatgtcacggaagcaatccagaaagttgctgcagcttatgaatgcaagattgttgaaggagttctgagccatcagatgaagcaatttgtgattgatggaaacaaggttgtgctaagtgcgtcgggccccgaaacaaaagttgatgaagcggagtttgaggagaatgaggtctattccattgacattgttacaagtactggtgaaggcaagccaaaattgttggatgagaaacagacgacagtgtataaaagagctgttgacaggaattatcatctaaaaatgaaagcatctaggttcatatttagtgagataagtcagaatttcccaatcatgccgttttctgcgagagctctggaagagaagcgtgctcgtctgggtctagtagaatgcgtgaatcatgaactcttacagccatatcctgtacttcatgagaagcctggtgacctagttgcacacatcaagttcacagttttgctgatgccaaatgggtcggatcgaatcacttctcaccccctacaggagttgcaatcaacaaaaatggtcgacgacccagatatcaaagcatggttagcgctaggcaccaagacaaagaagaaaggtggcggcaagaaaaagaaagctaagaaaactgacaaacccgaggatgcagcagctgtttctgagcctatggacatagcttctcaagaatgagaagagtcattgttttttgtgtaatttaaccatgaaattttggtcgctcctttgtatctggttgccttttatcctcaaatacgtttgatgtttgttagtacacagctttgttaa

SEQ ID NO: 7534 - DNA, 1557 bp, Linum usitatissimum
agcacatccatcacctccgttctccactgctaaaccctagattcattctctccgccgccgtcgtcgtcgttgtctgttcagtagcataagaaccagcttggagaagaaaaatcatccttccataatcatgtcggacgaagagagggaggagaaggagttggatctcacttctcctgaagttgtcaccaaatttaaaggcgccgctgagatcgtcaataaggccttgcagttggtcgtgaaagaatgcaaaccgaaggtgaagatcgttgacctatgtgagaaaggggattcttacatcatagagcaaactggtaacatgtacaagaacgctaagaagaagatcgaaaaaggagtggcatttcctacttgtgtatctgtgaacgatactgttggccatttgtctccgcttgccagtgatgagagggtgttggaagagggtgacattgttaagattgatatgggttgtcatatagatggattcattgcggtggttgcacatactcatgttgttcatgatggagcgattactggtagagctgctgatgtgattgcagctgccaatactgctgctgaagttgctttgaggcttgtgaggcctgggaaaaagaaccaagacgtcacagatgcaattcagaaggttgctgccgcttatgactgcaagatcgtggaaggtgtcctcagccaccagctgaagcagtttgtgatagatgggaacaaagttatactcagtgtttccatccggacacaagagtggatgatatcgaattgaggagaacgaagtttatgcagtagatattataacaagcaccggtgaaggcaagcctaagctgctagacgagaaagagactaccatatacaagagagctgtggacaagaattatcacttgaagttgaaagcatcaagattcattttcagtgaaattagtcagaagttccccatcatgcctttcactgccagggccttggaagagaaaagagctaggttgggactggtggaatgtgtgaatcatgaactgctccagccttatcccgttctgcacgaaaagcccggtgattatgtagctcacatcaagttcaccgtcttgctgatgccaaatggttcggacaggattacatcacatcctctacaggaacttcaatcttcaaagacaatagaagatcctgaaatcaaggcttggttagctctgggtacaaagacaaagaagaagggtggaggaaagaagaagaaaggtaagaaagttgagaaagctgaagatgctgctgaagccgaagccgaagccgaaccaatggacgaaacatccaaagcctaaatctgttaggactccttttttcaggccaatctgttcagttatgtggttggttgagagatcgccaatgtagtgttcccaattgagtaatctctgtatgcatcaagtggcatttctcctaacgttaatccacagtttttaagtgttcaaaatttgaccaggttttgacagtcagtttgtatactgcaagttgcacaaacaactagagtctggcagttgctcaagtttaatttaaaatagacttttgtac

SEQ ID NO: 7535 - DNA, 2155 bp, Amborella trichopoda
taacccttttgataagaaagggagcgcaccaccctcgccctcgcctcttctccttccgctttcagcagtcaccaggacaatctctctctctctctctctctctctctaactctctctctcattgttttctaaaaccccagttttctttctctaaccgttcctgaaaaaccctagttttctctctgcgagcatcactgctactgtgtgcaggagaggagctttgctaagatgtcagacgatgaagcaaaggaggagagggagctcgatctcacttcccctgatgttgtcactaaatacaagacagctgcagagatcctcaataaggctctgcaattggtagtctcagaatgtaaaccaaaggccaaggtggtagacatttgcgagaaaggagatgccttcatcagggagcaaactgggagtgtttacaagaatgcgaagaagaaaattgagcggggtgttgcttttccaacatgcatatcagttaataacactgtctgccatttctctcccctagcaagtgatgagaccactctggtggagaatgatatggtgaaaattgatatggggtgccatatagatggcttcattgctgtggtagcacatactcatgtcctccaagaaggaccagtcactggaagggctgctgatgtcattgcagctgctaacactgccgctgaagttgcacttagacttgttcggcctgggagaaagaacaaggatgtgacggaggccatccaaaaggtcgctgctgcctatgattgcaagattgttgagggtgtgcttagccatcagctaaaacaatttgtgattgatggaaacaaagttatccttaatgtaagtaatccggagactagagttgacgatgctgagtttgaagagaatgaagtttatgctattgatattgtcacaagtacgggtgatgggaagcccaagctactggatgagaagcagaccaccatttataagagagctgttgacaaaaactaccacctgaaaatgaaatcttcaaggtttattttcagtgaaattaatcaaagattcccaatcatgccttttactgcaagggtgttggaagagaagcgtgctaggctaggattggtggaatgtgttaatcatgaacttctgcaaccatatcctgtccttcatgagaagcctggcgatcttgtggctcatatcaaattcacggtgttgttactgccaagtgggtcggataggatcacatcacatccactgcaggacttgcagccttctaagcaaatcgaggacccagagatcaaggcctggttggctctagggaccaagacaaagaagaagccgaagaagaagaaagctggtaagaagggtgaagtggacactgaaatgggggatacgtcagtgaacggtggcggaagcaatgacccagagtgaagagtgttttggataattgttgtatcttccgagggtttttcgtcggtcgtgaatttcctgtcaaaacatgttgattttgatggcgggttctcttcaatgaagatttcgagtttctttttttctctttttgttcttggaagagaaaaagcctagagaatagggatgctgatggtatcgtataatgaatacagttctctagctatattgtcattcttgttgggattacatttagggttttcattctctaaaagaggaaaactcgtatactaataattatcagttatctaaaaaaagattatacacagtagatagtggattagtttgcacttttgcctgtgcccatcttcagtgcaaagcgctgaattgcatgttgcaggtggtagagggatgtgaaatcagccgttagatgtgaaactcaggtggtgggggatgggacattggttgggcacaaacttaaatttctcaaatgttatgttgcatttcactttgttgaatttcacattcaataggcaagagtgattgtgatgttgtctccgcacttaaagtaaatggtctcaatgtaccttcttttttggaaaatttgtttcatgcgggcttgatcgcatttcttttttatgccgtccagagtcctaaagcatccattttgaagattgatgcaaataggtgcaccatctaaaaacaattataactaactgttcaaatgttttataaatataattatatttctagttttcattttttttatatc

SEQ ID NO: 7536 - DNA, 1625 bp, Papaver somniferum
atcctccttataatcaaacctcagcgcctcctttcctcgtctaaaaccctaatatgtgataagattatttttgttatttaagaatgtcagatgatgaagtaggaaaggatgagaaagagttggatctttcttctcctgaagttgttactaaatacaaatctgctgctgagattatcaacaaggcattgcagttggtgttaacagaatgtaaacctaaagttaagattgttgatttatgtgagaaaggagatgcatttatcaaagagcaaactgggaaattgtataagaatacaaagaagaagattgaaagaggagttgcatttcctacatgtatctcagttaataatactgtatgtcatttctcaccactcgctagtgatggaactctcctggaagaaggtgacatcttaaagattgatatgggttgccatattgatgggtttattgctgttgttgcacatactcatgttcttcaagaaggaccagttactggtagagcagctgatgttattgctgccgccaatactgcagctgaagtagcattgaggcttgttagacctggcaagaagaataaagaagtaactgaagctattcagaaggttgctgctgcctatgactgcaaaattgttgaaggtgtgctcagccatcagctcaagcagtttgtgatagatggaagcaaggttgtactcagtgttccaggtcccgaaaccagagtcgatgatgcagaatttcaggagaatgaagtttatgcaattgatatagttgccagcacaggagaaggcaagcctaggctgttagatgaaaggcaaactactgtatacaaaagagcggtgggagagagttatcagttgaagatgaaagcatctaggttcatcttcagtgaaattaatcagaacttccccatcatgccattttcagctagggctttggaagagaagcgtgccaggttgggattagttgaatgtgtgaatcatgaacttttgcagccataccctgtacttcatgagaagcctggggatcttgttgcacatatcaagtttacagttctgttaatgcccaacggttccgatagaatcacatctcacgctcttcaagaagtgcagccaacaaagacgttagatgaagaacctgaaatcaaggcttggttagctttggccacaaagtcgaaaaagaaaggaggtggaaagaagaagaaaggtaagaagggtgataaggctgaggagtctactgaagctgaacctatggatgcaaccactgcttcccaagaatgatagttttttcaaactttctaggttccccatgtttaaatgaccagggttttttgcgtttggtactgtgtttggatgtgatgaatgttgagcttgtccattctaatatttgagtactagatctcaactgttgattttgttatctaacagtctgtttaagttacattagtccccatacttgaacattaaaagacgtaaccagcacccttcacaccttgattttcttacttgttttacctctatatggaactcaatctggaaccaataactatggtgagctcaaatgcctaaatgtgaaaaatgactttgtattggaacattgtatattttggttgatcatcatttttccggccaaaa

SEQ ID NO: 7537 - DNA, 1197 bp, Castanea mollissima
catctctatctctatctctcccttaaaccctagctctcaaagctcgctaccgcttcacttcctcgccgccattttcttcgaaaggagtttttcttaaagctcctaaacgatgtcgtcggacgaagaaagagaagagaaggagttggatctcacttcccctgaagtcgtcaccaaatacaaaagcgctgccgagatcattaacaaggctttgcaattagttgtgtctgaatgcaaaccaaaggctaagattgtagatgtttgcgagattggtgactcgtacattagagagcaaactggcaatatgtacaagaatgttaagaagaagatcgaaaggggtgttgcgttcccaacttgcatttctgtaaacaacactgtgtgtcatttctctccgctcgcgagcgatgagaccgtgatggaagctggtgatgtcctgaaaattgatttgggttgccatatagatgggtttattgcggttgtggcacatactcatgttcttcaggatgggccggttactggaaaggcagctgatgtaattgcggcagctaatacggctgcggaagttgctttgaggcttgtaaggccgggaaagaagaacaaagatgtaactgatgcaattcagaaggttgctgctgcttatgactgcaaaattgttgagggtgttcttagccaccagctgaagcagtttgtgatagatggtaacaaggttgtgctgagtgtgtctaatacagatacaagagttgatgatgcggagtttgaggagaatgaagtttatgctattgatattgtaacaagctcaggtgaaggcaagcctaagttgttggatgagaagcagacaactatttacaagagagctgttgacaagaactaccacctgaagatgaaagcatctaggtttattttcagtgaaataagccagaaattccctatcatgccattcactgctagggctctggaggagaagagagctcgtcttggtttagtggaatgtgttaatcatgagctattgcagccatatcctgttcttcatgagaagcctggtgattatgttgctcacatcaaattcacagttttgctaatgccaaatgggtcagatcgggtcacatctcatcctctgcaggagctgcagcccacaaagacaatagatgatcctgaaatcaaggcttggttagccttggccacaaagacaaagaagaaagg

SEQ ID NO: 7538 - DNA, 1124 bp, Flaveria ramosissima
tcctgaggaagcatgtcggatgatgaagcaagggaagagaaggagctcgatctttcctccccagaagttgtaaccaagtacaaattggccgctgagattgttaacaaggctttgcagttggtgttgtcagaatgcaaacccaaagccaagattgttgatatatgtgaaaagggagattcgtacatcagagagcaaactgggagtatgtacaagaatgttaagaagaagattgaaaggggtgttgcatttcctacatgtttgtctgtgaacaacacagtttgtcattactctcctcttgctagtgatgaagcagtgttggaagaaggtgacattgtgaaaattgatatgggttgtcatatagatggattcattgctgtggtggctcacactcatgttctccagaaagggcctgtaactggtagagctgccgatgcgattgcagctgcaaatactgctgctgaagttgccttaagacttgtgaagcctggaaagaagaaccaagatgtcactgaagccatccaaaaggttgctgctgcatatgactgcaaaattgtggaaggcgttcttagtcatcaattgaaacagtttgtgattgatgggaacaaagttgtattgagtgtctccaatcctgaaaccagagttgatgatgccgagtttgaggagaatgaggtttatgcaattgatatagtcaccagcacaggagatggcaagccaaaattgttggatgaaaaacagacaacaatatataaaagagcagttgataagagttatcacttgaaactgaaagcatctcggtttatattcagtgagatcagtcaaaatttcccaatcatgccattctcatctagggctttggaagagaagcgtgctcggttaggattagtggaatgtgtcaaccatgagcttttgcagccataccctgttcttcatgaaaagcagggtgactttgtggcacatataaaattcacggttcttcttatgccgaatgggtcagaccgtataacctctcatacgctccaggagttgcagccaactaaaactgtcgatgaccctgaaatcaaaggatggttatcccttcctgtaaaatcgaaaaagaaaggtggtggcaagaagaagaaaggtaa

SEQ ID NO: 7539 - DNA, 1488 bp, Oryza sativa
tcgcttcaattctaatcccccccaaaccccctccaaaccctaaccctactacgacctccccttcctccgccgccgccgccaccgccaccgccaccgccacgtccagcctccggtcgcctgttcggatcgaagcgatgtcgtcggacgatgaggtcagagaggagaaggagctcgacctctcctcctccgacgtcgtcaccaagtacaaggacgccgccgatatcatcaacaatgctcttaagttggtagtgtctttgtgcaagccgaaagccaagattgttgacatctgtgagaagggcgattcttacataagagagcaaactggcaacatctacaagaatgtgaagaggaagattgaaagaggtgttgcttttccaacatgtgtatctgtgaacaacacagtctgccatttctctccgctagccactgatgaggcagtcctggaggaaaatgatatggtcaaaattgatatgggatgtcatattgatggttttattgccgtggtggctcatacacatgttatccatgatggagcagtcactgggaaagcagcagatgttcttgctgctgccaacacagcggcagaagttgctctgaggcttgttagacctgggaagaagaacaaggatgtcaccgaagcgattcagaaagttgctgctgcttatgactgcaaaattgtggaaggagttctcagccatcagctgaaacagtttgtcattgacggtaacaaagttgtacttagtgtgtccaatgctgatacgaaggtggatgatgctgaatttgaggaaaatgaagtgtatgcaattgatattgtcaccagcactggagaagggaagcccaagttattggatgagaagcagaccaccatctacaagagagctgtagacaagaattatcacttgaagatgaaagcatctaggttcattttcagtgagataagccagaagtttcctatcatgcccttcactgctagggcattggaagagaagcgtgcacgcttaggtttggtggaatgcatgaatcatgaattattgcagccgtaccctgtccttcacgagaagccaggcgaccttgttgcacacatcaagtttactgtgcttctgctgccatctggttcacagagggtaacatcgcattcacttcaggagttgcagcccactaaatccattgaagacaacgctgagatcaaggcatggcttgctttggggacaaaaacaaagaagaaaagtggtgcaaaaaagaagaaaggtaagaaaggagatgcagcagaagcagtgcctatggaggagggttcaaatgatgcaaacaaagaataactgattgttcttttgaattgcttccgttagttttgtacttgctccactgcatctgatgctattatatcacattcagttgtggaaaatcgagtactttttcaaacttcctgggaaatgatccgtcctgctgcacactcattgtcacatgaaagcacaaaatgatgattaccta

SEQ ID NO: 7540 - DNA, 1653 bp, Oryza sativa
actccccctcgcttcaattctaatcccccccaaaccccctccaaaccctaaccctactacgacctccccttcctccgccgccgccgccaccgccaccgccaccgccacgtccagcctccggtcgcctgttcggatcgaagcgatgtcgtcggacgatgaggtcagagaggagaaggagctcgacctctcctcctccgacgtcgtcaccaagtacaaggacgccgccgatatcatcaacaatgctcttaagttggtagtgtctttgtgcaagccgaaagccaagattgttgacatctgtgagaagggcgattcttacataagagagcaaactggcaacatctacaagaatgtgaagaggaagattgaaagaggtgttgcttttccaacatgtgtatctgtgaacaacacagtctgccatttctctccgctagccactgatgaggcagtcctggaggaaaatgatatggtcaaaattgatatgggatgtcatattgatggttttattgccgtggtggctcatacacatgttatccatgatggagcagtcactgggaaagcagcagatgttcttgctgctgccaacacagcggcagaagttgctctgaggcttgttagacctgggaagaagaacaaggatgtcaccgaagcgattcagaaagttgctgctgcttatgactgcaaaattgtggaaggagttctcagccatcagctgaaacagtttgtcattgacggtaacaaagttgtacttagtgtgtccaatgctgatacgaaggtggatgatgctgaatttgaggaaaatgaagtgtatgcaattgatattgtcaccagcactggagaagggaagcccaagttattggatgagaagcagaccaccatctacaagagagctgtagacaagaattatcacttgaagatgaaagcatctaggttcattttcagtgagataagccagaagtttcctatcatgcccttcactgctagggcattggaagagaagcgtgcacgcttaggtttggtggaatgcatgaatcatgaattattgcagccgtaccctgtccttcacgagaagccaggcgaccttgttgcacacatcaagtttactgtgcttctgctgccatctggttcacagagggtaacatcgcattcacttcaggagttgcagcccactaaatccattgaagacaacgctgagatcaaggcatggcttgctttggggacaaaaacaaagaagaaaagtggtgcaaaaaagaagaaaggtaagaaaggagatgcagcagaagcagtgcctatggaggagggttcaaatgatgcaaacaaagaataactgattgttcttttgaattgcttccgttagttttgtacttgctccactgcatctgatgctattatatcacattcagttgtggaaaatcgagtactttttcaaacttcctgggaaatgatccgtcctgctgcacactcattgtcacatgaaagcacaaaatgatgattacctatgatgtgtgtgattgttggccttctgtgctgcctaactatgagttaaatctactgtcgaggtatggtgcgatgtccggtattttggtacatagaggtggctgcagcttcaaataatgtgatgaagtaattgctaatggtattcgatgcaaatgatag

SEQ ID NO: 7541 - DNA, 1520 bp, Avena sativa
ccgccgccgcccgattcccctctccagcatccgcgccccctgctcggatccaagcgatgtcgtccgacgaggaggtcagggaggagaaggagctcgacctttcctccaacgaggtcgtaaccaagtacaagactgctgcagaaatcatcaacaaggctctgaagttggtcttgtctgagtgcaagccaaaagccaagattgttgacatctgtgagaagggtgacaattacattacagagcaaacgggaaatgtctacaagaatgtgaagaggaagattgaaaggggcattgctttcccaacatgtttatctgtgaacaacacagtctgccatttttccccgcttgccactgatgatacagtcctggaagcgaatgatatggtcaaaatagatatgggttgccatattgatggttttattgctgtggtggctcatacacacgttatcagagatgggcaagttactggaagagcagcagatgttcttgctgctgcaaacacggcagcagaagttgccatgaggctggttagacctggaaagaagaataaagatgttacggaagcaattcagaaagttgctgcagcctacgactgcaaaattgttgagggagtccttagccatcagctaaaacaatttgtgattgatggtaataaagtggtacttagtgtttccaatgctgataccaaggttgatgatgctgagtttgaagagaatgaagtttatgctatagatattgtcaccagcactggcgaggggaagcccaagttattggatgagaagcagaccaccatctataagagagctgtagacaagaattatcacctgaagatgaaggcttctaggttcattttcagtgagattagccagaagttccccatcatgccgttcactgctagggcgttggaggagaagcgtgcacgcttaggcttagtggagtgcatgaatcatgagctgttgcagccgtacccagtccttcatgaaaaacaaggcgaccttgttgcacacattaagttcactgtgttgctgatgccgaatggatcagacaaggtaacatcacatccacttcaggacttgctgcccacgatatccattgaggacaatgctgagatcaaagggtggcttgcgttgggtacaaaatcgaagaagaaaggtggtggcaagaagaagaaaggtaagaaaggagatgcagcagagccaatggaggtttcaaaagatgcgccaggccaagaataattcagatttttatttgcttccgttacttttgtacctgctccttcgctgcatctgactgtgttatattacattcagctgtgggaatttgagtacttttttgaagtctgaagaaaatgatcaatccttctgcacaccctgtcactccactacaaagcacaacttgataaatcacctatggtgtgttgaatgtgtacctgttagttctccttatatatcggccctaacttaagtttaactctgctgtgatgtttatccgtgtttaatatttataaggtttgattttcgcaa

SEQ ID NO: 7542 - DNA, 1661 bp, Catharanthus roseus
cttgcttcctcccataagaaagaaaagaaaaccctacctcaacccttaccttcaatctccatcttcccacaagttccaatttttcttttaaaactcgtgttagtcggagctgttgttcggtaacaatgtcggacgaagaaagagaggagagagagttggatctcacgagccctgaagtcgttactaaatataaaactgctgccgaaattgttaacaaggctcttcaattggtggtatctgaatgcaagcctaaagtaaagattgttcacttatgtgagaaaggggattccttcatcaaagagcaaactggtagcacgtacaagaatgtaaagaagaagattgaaaggggtgttgccttcccaacctgcatttctgtgaacaataccgtttgcctatttttctcctctagctagtgatgagactgtacttgaggagggtgacttggtgaagattgatatggggtgtcacattgatggtttcattgctgttgtagcgcacactcatgtggtacaggaaggtcctgttactggtagggcagctgatgttattgcggcagccaacacagctgctgaagttgctttgagacttgtgcggcctgggaaaaagaatcaagatgtaacagaagctattcaaaaagtagcagctgcatatgattgcaggattgtggagggtgtattgagtcaccaaatgaagcagtttgtcattgatgggaacaaagttgtgctgaatgtgactagccctgagatgcgagttgatgatgctgaatttgaggagaatgaggtttacgcaattgatattgttacaacaactggtgacggcaaaccaaagctgttggatgagaaacaaacaactatatataagagagccgtggacaaaacctataatctgaagatgaaagcatcgagattcatctttagtgagatcagtcaaaaattccctatcatgccatttactgcaagggatttggaagagaaaagggctcgctttgggttggtcgaatgcgtcaaccatgaacttttgcaaccataccctgttctacacgagaaacctggcgatttggttgctcatattaagttcacagttctgcttatgcccaatggatcagatagagtcacatctcatcctctacaggagttgaaacccacaaagacgatagatgatccagacatcaaagcctggttatctcttcccgtgaagacaaagaagaaaggtaggtggaaagaaaaagaaaaggacaagaaaggtgagaaagcagaagattccgcacaaactgaggcaatggatgaagaagcgaacgatgctgcaactcaatcatgagtttatcctcctccccctgttgttggttcctagcccctttcccccattgcgagcttttttgagttatcaaaagaaagtatattatgagatgagcaaatcggttaggttacttacttttggcccttgtgaggtgatgtaatacaaaaaccatatatgcttatcaccctcattatcatacttttcaacatagaagttgcattgttaactgatgatgttctaggttggtttcacaattgcattttttggtgctttatttacaggtgtgattggaatggatttttgtgctaaatttccagtcattgaactattcataactctttaagaaggtccattgccattgattg

SEQ ID NO: 7543 - DNA, 1895 bp, Petroselinum crispum
aaaaccttgttagaaacaacttaaaagaaagtaattcattgattaacgtgcaataagtgcacaagttagtgggcctggagggggtaataacccaaacactggccagaaaagccccaaaccctaaaaccactatctcctgaattttagggtgatctgactatatatatagggataggattgattggatagaagatagaagaaacgccatggctgatgatgagaaggagcttgatctcacctcacctgaagttgtcaataaatacaaactcgctgctgagactgttaacaaggctttgcaattagtattggcagcatgtaagccgaaagcaaagattgttgatatttgtgagaaaggggatgcctttattaaagagcatactgggaacatgtataagaatgtgaagaagaagattgagaagggtattgcatttccgacttgtttgtctgtgaataatactgtctgtcatttctcaccgctggctagtgatgagactgtgttggaagaaggtgatgttttgaaaattgatatgggatgccatgttgatggatttattgctgtagtagcacacactcatgttcttcaggatgggaaagtgacaggtaaagcagctgatgttattgctgccgcaaacactgctgctgaagttgctttgaggcttgtcaggcctgggaagaagaacaaggatgtttctgaagctgttcagaaggttgctgctgcctatgactgtaaaattgttgaaggagttcttagtcatcagctcaaacaatttgtgattgatggaaacaaagtcgtcttgagtgtcccaaaccctgatacaagagttgatgatgcggagtttgaggaaaacgaagtttatgcaattgatatagtcaccagcacaggagaagggaagcccaaattgctggatgaaaagcagacaactgtatataaacgagctgtggacaagaattatcacttaaaaatgaaagcctcaagatttatttttagtgaaataagtcaaaattttccaattatgccattcacagcaagagctttggaagagaaacgagctcgccttggattagtggaatgtgtgaatcatgatcttttgcagccatatcctgttcttcacgagaagccaggcgattatgttgctcatattaaatttactgttttgctgatgtcaaatggatcagaccggatcacttctcaccctttacaggagttgaaacctacaaaagccatagatgatcctgaaatcaaagcctggttagcattagggatcaagacgaagaagaaaggcggtggaaggaaaaagaaagcaaagaagagtgaaaaaggtgaagattcagcagagccagggccagctgatgctccagcagatggcagtgcaccgcaagaatgaagacataagttttgttaatcttttgtaatttctgtttttgtccccaattttaggccacttcactgtaactggtattgttgcctatgggccgttttagttggtaatgaaacaccgagtcccaactgtatttagattgcctagttcttataaacggttaaatttatctgccatgctttttggtcccgaaagatatttaacatagaaaatcacaaaagtcagatgtcatctgaccagaacagaagtaacatggatatcaatcacgaaggcaggcaaaaattgcctttcagatgaagcttgctttatatacgtaaatattttattatttgaagaatttaagttccatggcatgtcttggtaacaaactatagtaattttgaggtttgattggaaggaggaattgcataagatagtaactgtgttgaagccaactcaactactacataggtttgtaggattcgtttataaatacttgggtcacaattattctcctcttcttttttcttcttcttc

SEQ ID NO: 7544 - DNA, 1601 bp, Avena sativa
tctaatccgtccctctcgagacgccaaagtcccaaacccctcgtcctcccaaaccctaaccctaaaacctccatcctcccgccgccgccgcccgattcccctctccagcatccgcgccccctgctcggatccaagcgatgtcgtccgacgaggaggtcagggaggagaaggagctcgacctttcctccaacgaggtcgtaaccaagtacaagactgctgcagaaatcatcaacaaggctctgaagttggtcttgtctgagtgcaagccaaaagccaagattgttgacatctgtgagaagggtgacaattacattacagagcaaacgggaaatgtctacaagaatgtgaagaggaagattgaaaggggcattgctttcccaacatgtttatctgtgaacaacacagtctgccatttttccccgcttgccactgatgatacagtcctggaagcgaatgatatggtcaaaatagatatgggttgccatattgatggttttattgctgtggtggctcatacacacgttatcagagatgggcaagttactggaagagcagcagatgttcttgctgctgcaaacacggcagcagaagttgccatgaggctggttagacctggaaagaagaataaagatgttacggaagcaattcagaaagttgctgcagcctacgactgcaaaattgttgagggagtccttagccatcagctaaaacaatttgtgattgatggtaataaagtggtacttagtgtttccaatgctgataccaaggttgatgatgctgagtttgaagagaatgaagtttatgctatagatattgtcaccagcactggcgaggggaagcccaagttattggatgagaagcagaccaccatctataagagagctgtagacaagaattatcacctgaagatgaaggcttctaggttcattttcagtgagattagccagaagttccccatcatgccgttcactgctagggcgttggaggagaagcgtgcacgcttaggcttagtggagtgcatgaatcatgagctgttgcagccgtacccagtccttcatgaaaaacaaggcgaccttgttgcacacattaagttcactgtgttgctgatgccgaatggatcagacaaggtaacatcacatgcacttcaggatttgttgcccacgatatccatcgaggacaatgctgagatcaaagggtggcttgccctgggtacaaaatcaaagaagaaaggtggtggaaagaagaagaaaggtaagaaaggagatgcagcagagccaatggaggtttcaaaagatgcgccaggccaagaataattcagatttttatttgcttccgttacttttgtacctgctccttcgctgcatctgactgtgctatattacattcagctgtgggaatttgagtacttttttgaagtctgaagaaaatgatcaatccttctgcacaccctgtcactccactacaaagcacaacttgataaatcacctacggtgtgttgaatgtgtacctgttagttctccttatatatcggccctaacttaagtttaactctgctgtgatgtttatccgtgtttaatatttataaggtttgattttcgcaa

SEQ ID NO: 7545 - DNA, 1496 bp, Silene vulgaris
ccgcacaccctttactttaccgtaatttacagctaaagttatcatttttctgggtttaattcgaagaaatcaagacaaaaatgtcggacgatgaacgcgaggagaaggagcttgatcttagctcttctgaagttgtcaccaaatataagagcgctgctgaaatccttaacaaggctttgcaaatagttgtatcagaatgtaagcctaaagctaagatagttgacctctgtgagaagggtgatgcctacattattgagcaaactgggaagatgtacaagaatgtgaagaagaagattgagaggggcattgcttttccaacctgcatatctgtcaataatgttgtatgccattactcaccacttgctactgatgagtcggtgctggtagaaggtgatgtcgtgaaggtggatatgggctgtcatattgatggttttatagctactgtggcgcacactcatgtaattcaagaaggcccaatcactggaagaaaggcagatgttattgcggcaacaaacactgctgctgaagttgctttgaggcttgtgaggccgggaaagaagaacaaagacgtaacagatgccatccagaaagttgctgctgcatatgactgcaaaattgtagaaggtgtactcagtcatcagttaaaacagtttgtaattgatggtaacaaagttgtgttgtctgtctcaagtcctgagatgagagttgatgatgctgagtttgaagagaatgaagtatatgcaattgatatttttgcaagtactggtgaaggaaagcctagaatgttggatgagaagcaaacaactgtttacaagagagccgtggacagaaactatcacttgaaaatgaaagcatcgaggtttattttcagtgaaattagtcagaaatttcccataatgccattcactgctagggcattagaagaaaagcgtgctcggcttggccttctagaatgtgtgaatcatgatcttttgcagccctacccagtcttgcatgaaaaatctggtgattttgttgctcatataaagttcacagtactgctcatgccaaacggctcagatcgtataacttctcactctttgcaagaactgcagccaaccaaaacaattgacgaccctgaaatcaaagcgtggttggcaatgggcaccaagacaaagaagaaaggcggtggcaaaaagaagaaaggcaagaaaggcgacaaacctgagggcgaggagtctacttcagcagagcctatggatgcttcaaacgagagttagaaagatggcgaatgtgtatcgtccgtttttgttacatgtcatcctcttttgtatttgcttatgttgatgggcaattgaacatgtttagatgttgatcttttgtggttacgataactcttgcttaactgtgtaaagtcctgggtttgtgcccatgatatgttctgatatgaacatttgtgtttttgagagcttagtcttttgaagttgctcttttcagttaccctggtggaataagag

SEQ ID NO: 7546 - DNA, 1360 bp, Flaveria ramosissima
ttcctcagtaaccgaacaccaccaactttatataatcaccgccgacctcaaaaccctagcactccacccacaccctcctcttcatcttcatctccttaaaccctaatcccccctctaaatccattaacaacccatcttctgaggaagcatgtcggacgatgaagcaagggaagagaaggagctcgatctttcctccccagaagttgtaaccaagtacaaattggccgctgagatcgttaacaaggccttgcagttggttttgtcagaatgcaaacccaaagcgaagattgttgatatatgtgaaaagggagattcgtacatcagagagcaaactgggagtatgtacaagaatgttaagaagaagattgaaaggggtgttgcatttcctacatgtttgtctgtgaacaacacagtctgtcattactctccccttgctagtgatgaaacagtgttggaagaaggtgacattgtgaaaattgatatggggtgtcacatcgatggattcattgctgtggtggctcatactcatgttcttcagcaagggcctgtaactggtagagctgccgatgcgattgcagctgcaaatactgctgctgaggttgctttaagacttgtaaagcctggaaagaagaaccaagatgttactgaagccatccaaaaggttgctgctgcatatgactgcaaaattgtggaaggcgttcttagtcatcaattgaaacagtttgtgattgatgggaacaaagttgtattgagtgtttccaatcctgaaaccagagttgatgatgctgagtttgaggagaatgaggtttatgcaattgatatagtcaccagcacaggagatggcaagccaaaattgttggatgaaaaacagacaacaatatacaaaagagcagttgataagagttatcacttgaaactgaaagcatctcggtttatattcagtgagatcagtcaaaattttccaatcatgccgttttcatctagggctttggaagagaagcgtgctcggttaggattagtggaatgtgtcaaccatgagcttttgcagccataccctgttcttcatgaaaagcagggtgactttgtggcacatatcaaattcacggttcttcttatgccgaatgggtcagaccgtataacctctcatacactccaggagttgcagccaactaaaactgttgatgatcctgaaatcaaaggatggttatcccttcctgtaaaatcaaaaaagaagggtggtggcaagaagaagaaaggtaaaggagttgaaaaagtgaaggaatggaagaatcatcaaatggtggtgcttaaggatcttgttgaatgggagatattgaaactcaattttgttttatttgtt

SEQ ID NO: 7547 - DNA, 1392 bp, Tabernaemontana elegans
cccatcatccctttcattccttctccgtcgttgtgtcaaaaggaaaaccctacctcaaccctcaccttcaaagtccatcccagcgcaactgacgaatcttaccccgcgttagtcggtgctattcggtaacgatgtcggacgaagaaagagaggagagagagttggatctcacgagtcatgaggtcgtcaccaaatataaaagtgctgctgaaattgttaacaaggcttttcaattggtgttatctgaatgcaagcctaaagtgaagattgtggatttgtgtgaaaaaggggatgccttcatcaaagagcaagctggtaacatgtacaagaatgtgaagaagaagattgagaggggtgttgcctttccaacttgcatttctgtgaacaatactgtgtgccatttctctccactagctagtgatgagacaatacttgaggaaggtgacctagtgaagatcgatatggggtgtcacattgatggttttattgctgtagtggcgcacactcatgtgctgcaggaaggccctgttactggtagagcagctgatgttattgcagcggccaacacagcagctgaagttgctctgcggcttgtgcgacctgggaggaagaatcaagatgtgacagaagctattcaaaaggttgcagcggcatatgactgcaggattgtggagggtgtattgagtcaccaaatgaagcagtttgtcatcgatggaaacaaagtcgtgctgaacgtgtctagccctgaaatgagagtagatgatgcagaatttgaggagaatgaggtttattcaattgatattgttactagcactggcgaaggcaaaccaaagctcttggatgagaaacaaacaactatctataagagagctgtggaaaaaacctataatctgaagatgaaagcatcaagatatatcttcagtgagatcagtcaaaaattccctatcatgccatttactgcaagggatttggaagagaaaagggctcgctttgggttggtcgaatgtgttaaccatgatcttctgcagccataccctgttctgcacgagaaacctggtgatttggttgctcatattaaatttacagttctgcttatgcctaatggatcagataggatcacgtctcatcctctgcaggagttaaagcccacaaagtcaatagaaaatgatcctgaaattaaagcctggttatcgcttcctgtaaagacaaagaagaaaggtggtgggaagaaaaagaaaggtaagaaagttgagaaggcagaagactcatcacaaactgaggcaatggatgaagaaacaaatggagctgctactcaataatgagtctctccccttgttgttggctccctaaacccctcgcattgcgaccttcaagttatcaaagaaagttttt

SEQ ID NO: 7548 - DNA, 1265 bp, Cirsium arvense
taacataagactaccaactctatataaaggcagaagcaccgccgacctccaaaccctagcacaaccattcaactttatacactcacttccatttttctttcctaaaaccctaatcaatactgttgatctttgaacagcttcgttttttcagtttctgaggaaacatgtcggatgatgaaagaggggaagagaaggagctagatcttacctcttcagaagttgtaaccaaatacaaatcggcagctgagattgttaacaaggccttgcagttggtattgtcagaatgcaagcccaaagccaagattgttgatatctgtgagaagggagattcatacatccgagagcaaactgggaatatgtacaaaaatgttaagaagaagattgaaaggggtattgcatttccgacatgtctgtctgtgaacaacacagtatgccattactctccacttgctagtgatgagacggtattggaagaaggtgacattttgaaaatcgatatggggtgtcatatagatggtttcatagctgtggtggggcacactcacgttcttcagcaaggacctgtaacaggtagagcagctgatgctattgctgctgcaaatactgctgctgaggttgccttaagacttgtgaagcctggaaagaagaatcaagatgttacagaagccattcaaaaggttgcagctgcatacgactgcaaaatcgttgaaggtgttcttagtcatcaactgaaacaatttgtgattgatggaaacaaagtggtattaagcgtatcaaatccggaaaccagagtggatgatgctgaatttgaggagaatgaagtttatgcaatcgatatagtaacgagcacaggagatggaaagccaaaattgttggatgaaaagcagacgacaatttataaaagggcggttgataagaattatcacttgaaaatgaaagcatctcggtttatattcagtgagattaatcaaaactatccaatcatgccattctcagctagggctttggaagagaaacgtgctcggctagggttggtggaatgtgttaatcatgagcttttgcagccatacccagttcttcatgaaaagcctggtgattttgttgcacatatcaagttcactgttcttctgatgccaaatggatcggatcggataacctctcatacactgcaggagtttcagccaactaaaactgttgatgaccccgaaattaaagcatggttatctctacctgtaaagaccaaaaagaaaggtggtggaaagaag

SEQ ID NO: 7549 - DNA, 1215 bp, Olea europaea
cacacctccaggctccagtgccgacctcaaccctaacatcgccaaaccacctccactctacttgctaaaccctagttttctcacgatcatatcttctgcagttgttcttggttgaagacaatgtcggatgaggaaagagaggagagggagttggatctcacctctcctgaagtcgtcactaaatataaatctgctgctgaaattgttaacaaggcattgcagttagtgttgtctgaatgcaagccgaaggctaagattgttgatatctgtgagaaaggggattcttttatccgagagcaagcaggaaatatgtacaagaatgtgaagaaaaagattgaaaggggtgtggcattccctacttgcatttcagttaataacacagtctgccatttttcaccactggccagtgatgagaccgtgttggaagaaggtgacgtgttaaaaattgatatggggtgtcacatagatggttttattgcggttgttgcgcacacccatgttcttcagcaaggactggttaccggcagggcagctgatgtcattgctgctgcaaatactgctgcggaggttgctttgagattggtcaggccgggaaaaaataacaaagatgttactgaagcaattcagaaagtcgctgctgcttatgactgcaagattgttgaaggggttctcagtcatcaaatgaaacaatttgtaattgatggaaacaaggttgtattgagtgtttcagcgcctgaaacaagagtagacgatgctgagtttgaggagaatgaggtttatgctatcgatatagttacaagcactggcgaaggcaagcccaagttattggatgagaaacagacaaccatttataagagagctgttgataagaattaccatttaaagatgaaagcatcccgattcatatatagtgagataaaccagaagtttccaatcatgccgtttactgctagggctttggaagaaaaacgcacccgacttggcctagtggaatgtcttaatcatgacctcttggagccatatcctgttctgcatgagaagcctggtgatctagttgcacacatcaaattcactgttttgctaatgccaaatgggtcggaccgcatcacatcccattatctgcaggagttgcagcctgctaaaacagtagatgaccctgagataaaagcctggttatctttaggtacaaagacgaagaagaaaggtggagggaag

SEQ ID NO: 7550 - DNA, 1283 bp, Helianthus annuus
attcatttctataaaccctaatcacctctttcaatcatcatctaatccctcattcatctcacgcaacatgtcggacgatgaaacaagagaggagaaggagctggatctttcgtctccagaagttgtaacaaagtacaaattggccgctgaagttgttaacaaggccttgcagttggttttgtcagaatgcaaacctaaagccaagattgttgatatatgtgacaagggagattcatacatcaaagagcaaacagggagtatgtacaagaatgtcaaaaagaaaattgaaaggggagttgcatttccaacatgtttgtctgtgaacaacacagtttgtcatttctctccacttgccagtgatgaaacagtattggaagaaggtgacattgtgaaaattgatatggggtgtcatatagatggattcatcgctgtggtgggacacactcatgttcttcaacaaggacctgtaacgggtagagcagctgatgcgattgcagctgcgaataccgctgccgaggttgccttaagacttgtgaagcctggaaagaagaaccaagatgttactgaagccattcaaaaagttgctgctgcatacgactgcaaaattgtggaaggcgttttaagtcatcaattgaaacaatttgtgattgacgggaacaaagtcgtattgagcgtctcaaatcccgaaaccagagttgatgatgctgagtttgaggagaacgaagtttattcaattgatatcgtcaccagcaccggagatggcaagccaaaattgtttgatgaaaaacagacaacaatatataaaagagcagttgataagagttatcacttgaaaatgaaagcttctcggtttgtattcagtgagatcagtcaaaatttcccaatcatgccattctcagctagggttttggaagagaagcgtgcaagatttgggttgttggaatgtgttaaccatgagcttttgcaaccataccctgttcttcatgaaaagcctggtgactttgtggcacagatcaagttcacggtcctcctcatgccaaatgggtccgaccgtataacctctcatacacttcaggagttgcagccaactaagactgttgatgatcctgaaatcaaagggtggctatctcttcctgtgaagtccaaaaagaagggtggtggcaagaagaagaaagggaagggagttgaaaaaagtgaagcaatggaagaaacatgaaatggcggtggattttgaagtaaaatttttggttgaattagatagtttgttatgtttctaaaagcat

SEQ ID NO: 7551 - DNA, 1518 bp, Nicotiana benthamiana
agtcatatcatatctataactttagctaaactcagaaccctagctcaaatcccgtttgcctccattttcattccatcaacaaaaacctaagtttatactcagcttgggacatttgataactatgtcggacgacgagagagaagagaaagagttggatctgacaagtcctgaggttgttactaagtacaaaagtgctgctgaaattgttaacaaggctctgcagttggtggtgtctgaatgcaagccaaaagcaaagatagttgatctttgtgaaaaaggagatgccttcatcaaagagcaaactgggaatatgtacaagaatgtgaagaagaaaatcgagaggggtgtggcatttcccacctgcatttcagttaacaataccgtgtgccatttttctccactgtccagtgacgagacagtattggaagaaggtgatatggtgaagattgatatggggtgtcatttagatggctttattgctgtagttggtcacacacatgtgctccaggaaggaccagttactggtagagcagctgacgttgttgcggctgctaatacagctgctgaagttgctctgaggcttgtgagaccaggaaggaagaactcggatgtaacagaagctattcagatagttgctgcggcatatgactgcaagattgttgagggtgttttaagccatcaaatgaagcagtttgtgattgatggaaacaaagttgtgttaagtgtgtccaatcctgaaacgagagtagaggatgcagaatttgaggagaacgaggtctattcaattgacattgtaacaagcactggtgaaggaaagccaaagttgttggatgagaaacaaacaaccatctacaagagagctgtagataaaagctacaacctgaagatgaaagcgtcgaggtttattttcagcgaaatcagtcagaagtttcctgtcatgccatttacagcaagggatttggaggagaagagagctcgtttgggactcgttgaatgtgttaaccatgagcttttgcagccctaccctgttctacatgagaaacctggtgatttggttgctcacataaaattcacagtgctgttaatgcctaacgggtcagataggatcacaactcatactctccaggagctgaaacctgctaagacaatagacgatgaacctgaaagcctaacggacgatgaacctgaaatcaagacctggttagcccttcctgtaaaaagcaagaagaaaggcggcgggaagaaaaagaaagcgaagaaaagtgagaagacagaagaattatcccaagctgaaccaatggaaggagaatcaaatggtgctgaatcttgatatgttgctagaacttaatttgattcaattccaagaactatttgttgattgttagttaaatgtgggatattgaggtagttgtggatctttctttgcggccttttgcaatacaagaatggcatggacagttgttgtccttgtcttgacacttttgtcattttagaattactcagtggggtttccaatgc

SEQ ID NO: 7552 - DNA, 1238 bp, Nicotiana benthamiana
acttttgctccctcaaaaccctagctcaaccctttcttgcctccactttcctttccatcagcaaaacccaattttcgcttagctgaaattctgaactgtatttatagccctgtttggtgactatgtcggacgacgagagagaagagagagaattggatctcaccagtcctgaggtcgtcaccaagtacaagagcgccgctgaaatcgttaacaaggctttgcaattggtgttgtccgaatgcaagccaaaagcaacgatagttgatctttgtgaaaaaggggatgcctttatcaaagagcaaactggaaatatgtacaagaatgtgaagaagaaaattgagagaggtgttgcatttccaacgtgtatttcagttaacagcactgtgtgtcatttctctccattgtctagcgatgagacagtactggaagaaggtgatatattgaagattgatatgggatgtcacattgatggatttattgctgtagttggacatacacatgttcttcacgaaggaccagttactggtagagctgctgatgtcattgcagctgctaatacagccgctgaagttgctttgaggcttgtgagaccaggaaagaagaactcggatgtaacagaagctattcagaaagttgctgctgcctatgactgcaagattgttgagggagtcttgagccatcaaatgaagcaatttgttattgatggaaacaaagttgtattgagtgtgaccaatcctgaaacaagagtagatgaagcagaattcgaggagaatgaggtttactcaattgatattgtaacaagcactggtgaaggaaagccaaaattgttgaatgagaaacaaacaactatctacaagagagccgtggacaagagctataacttgaagatgaaagcctcaaggtttatcttcagcgaaatcagtcagaagttccctatcatgccatttaccgcaagggatttggaggagaagagggctcgtctgggcctagttgagtgtgttaaccatgagcttctgcagccatatcctgttctacatgagaaacctggtgatttggttgctcacattaaattcacagtgctattaatgcctaatgggtcggatagggttacatctcatgctctccaggagctgaagcctgcaaagacgatagagaatgaacctgaaatcaaagcctggcttgcccttcccgttaaaaccaagaagaaaggcggtgggaagaaaaagaaaggtaattca

SEQ ID NO: 7553 - DNA, 1657 bp, Helianthus annuus
ggaatcaccaactttatataaactcacactcaccgccgacctccaaaccctagcactcaactcattcatttctataaaccctaatcacctctttcaatcatctaatccctcattcatctcacgcaacatgtcggacgatgaaaccagagaggagaaggagctggatctttcgtctccagaagttgtaacaaagtacaaattggccgctgaagttgttaacaaggccttgcagttggttttgtcagaatgcaaacctaaagccaagattgttgatatatgtgacaagggagattcatacatcaaagagcaagcagggagtatgtacaagaatgtcaaaaagaagactgaaaggggagttgcatttccaacatgtttgtctgtgaacaacacagtttgtcatttctctccacttgccagtgatgaaacagtattggaagaaggtgacattgtgaaaattgatatggggtgtcatatagatggattcatcgctgtggtgggacacactcatgttcttcaacaaggacctgtaacgggtagagcagctgatgcgattgcagctgcgaataccgctgctgaggttgccttaagacttgtgaagcctggaaagaagaaccaagatgttactgaagccattcaaaaagttgctgctgcctacgactgcaaaattgtggaaggcgttttaagtcatcaattgaaacaatttgtgattgacgggaacaaagtcgtattgagcgtctcaaatcccgaaaccagagttgatgatgccgagtttgaggagaatgaagtttattcaattgatatcgtcaccagcaccggagatggcaagccaaaattgttggatgaaaaacagacaacaatatataaaagagcagttgataagagttatcacttgaaaatgaaagcttctcggtttgtattcagtgagatcagtcaaaatttcccaatcatgccattctcagctagggttttggaagagaagcgtgcacgatttgggttgttggaatgtgttaaccatgagcttttgcaaccataccctgttcttcatgaaaagcctggtgactttgtggcacagatcaagttcacggtcctcctcatgccaaatgggtccgaccgtataacctctcatacacttcaggagttgcagccgactaaaactgttgatgatcctgaaatcaaagggtggctatctcttgctgtgaagtccaaaaagaagggtggtggtaagaagaagaaagggaagggagttgaaaaaagtgaagcaatggaagaaacatgaaatggtgggagattttgaagtcaaaattttggttgaattagatagtttgttatgtttctaaaagcatgtacaaacttgattcataaccttcttcttccttatatacagttgacatgtagcaaagtgagtttgtgtattgtcgtcttcttggatgatgatgagtaataattgactacagttgctagtttgagcaaaaaaaaaaaaaaaaaaaggcggctccggcccatccaattctgaattcaaccaacctaatgcatgcggccccaattccgccaaattgaatgggccgccgtttaacaaggccaatcccaaccaaaatccagggtaaccaacttcaaattcggcctaataaccaaaaaggcccccacgaatggcccttcc

SEQ ID NO: 7554 - DNA, 1239 bp, Ambrosia trifida
taataataataatccctccttaagctaattaggaggaaacatgtcggacgatgaagtaagagaagagaaggagctggacctttcatcccctgaagttgttaccaaatacaaattagccgctgagattcttaacaaggctttgcagttggttgtgtcggaatgcaagccgaaagccaagattgttgatatatgtgacaagggagattcatatataaaagagcaaactgggaatacgtacaagaatgttaagaagaagattgagaagggagttgcgtttccgacatgtttgtctgtgaacaacacagtctgtcattactctccgcttgccagtgatgaaacagtgttggaagaaggcgactttgtgaaaattgatatggggtgtcatatagatgggttcattgctgtggttggacacactcacgttcttcaacaaggacctgttacaggtagagcggctgatgcgattgcagctgcgaatactgctgctgaggttgccctaagacttgtgaagcctggaaagaagaaccaagatgttactgaagccattcaaaaggtggctgctgcatacgactgcaaaatcgtggaaggcgttcttagtcatcagatgaaacaatttgtgattgatggtaacaaagttgtcttgagtgtctcaaatcctgacaccagagttgatgatgccgagtttgaggagaacgaagtttattcaattgatatagtcaccagcaccggagatggcaagccgaagttattggatgaaaaacagacaacaatatataaaagagcagttgataagagttatcacctgaaaatgaaagcgtctcggtttatattcagtgagatcagtcaaaatttcccgattatgccgttcacagctagggctttggaagagaagcgcgctcgattcgggttggtggaatgtgttaaccatgagcttttgcagccataccctgttcttcacgaaaagcctggtgacttcgtggcacatatcaagttcacagtcctccttatgccaaatgggtccgaccgtataacctctcatacgcttcaggagttgcagccgactaaaactgtcgatgaccctgaaatcaaagggtggttatctctcccagtgaagtccaaaaagaagggcggtggcaagaagaagaaaggaaagggagtagaaagagtgaagcaatggaagaaacatgaaatgatggtggctaaggaagattttgaagtaaaattttggttgaattaaat

SEQ ID NO: 7555 - DNA, 1297 bp, Cocos nucifera
gtgcctcacactctttgagtccgctccacccccgttctttcctctctctacgggccgaaaccccaaaatcgacaccgtgtttccgttcctttttatgcctctaaacgagcggagatcgccgcgatagacttatcagcattgtttttctagcgacgggagtagtttctcccctctccatcgtagctgaagggtttatttagcttggagagatgtcggacgacgaagcaagggaggagaaggagttggacctcacttcccctgacgtcgttaccaagtacaagtgtgccgccgagatcctcaacaaggctcttcagctggtcatatcggagtgcaagccgaaagccaaaattgtagacatctgtgagaagggagataccttcattaaagagcaaactggcaacgtatataagaacgtgaagaaaaagattgagaagggtatagcattcccgacttgcatctctgtgaacaacactgtttgccatttttcgccactcggcagtgatgagactgttttggaagaaaacgacgtagtaaaaatagatatgggttgtcatgtagatgggtttattgctatagtggcccatacgcatgtccttcaggatgggccgatcactgggagggcagcggatgtaattgcagccgcaaacactgcagcagaggttgctctgaggctcgtgaggcccggaaagaagaataaagatgttgcggaagccattcagaaagtagctgctgcctatgattgcaaagttgttgaaggagtgcttagtcaccagcttaaacagtttgtcattgatggaaacaaagtcatacttagtttatccaatccagagaccagagttgatgatgcagagtttgaggagaatgaagtctatgcaattgatatagtcactagcacaggtgaagggaagccaaaactcttagacgagaaacaaaccaccatctataaaagagctgtggacaaaagttatcacttaaaaatgaaggcatcgagatttatttttagtgaaataaatcagaagtttccgatcttgccgtttactgcaagagcattggaagagaagcgtgctcggctgggactggtagagtgtgtcaaccatgatctcttgcagccataccctgttctgcatgagaagccaggagaccttgttgctcatattaagttcacagtattgttaatgccaaacgggtctgacaggataacctcgcatccattgcaagagttgaaacctaccaagtccattgatgacaatcctgagatcaaggcatggcttgctttgggcacaaaaacaaagaaaaa

SEQ ID NO: 7556 - DNA, 1752 bp, Cycas rumphii
tgggatccaaagaattcgggacgagggcaaaacaaaaaccccatcgtaactcgtggtaaagctcctctaacacagttatctctttatcatggtctccatcgccgccacctccctcgtacgaaaagaagaagaaacaacaatttgatcattgcattttgtttttgactactgtgtctgtaatttttcctttgtacgagcttctcgtgggggacattgttgtgaaaccctagttgagcttccgctacataccaactcctggattattagtttttaaccaaagataacagaatgtccgacgacgaagccaaagaggagaaggagttggatctcacctcacctgaagtagttacgaagtacaaggttgctgctgaaatcgttaacaaggctttgcaagtggtgctggctgactgcaagccgaaagcgaaggtagttgacctctgcgagaagggagatgcatatattaaagagcaaacaggaaatgtgtataagaatgcaaaaaagaagatagaaaagggcattgcatttcctacttgtgtctcggtcaatagcactgtatgccatttttctcctcttgccagtgacgaaactgttttggaggaaaatgacatcgtgaaaattgatctgggatgccatattgatggcttcattgcagtggtggcccacactcatgtgttgcaagaaggtcctattactggaagggtagcagatgtcattgcagctgctaacactgcagctgaagttgctttgaggctagtcaagcctgggaaaaagaacaaggatgtcacagaagccatacaaaaggttgcaacggcatatgactgtaaaattgcagagggagttctgagtcatcaaatgaagcagtttgttattgatgggaacaaagttatcctgagtgtaagcaatccagaaatgcgagttgatgatgctgagtttgaggaaaatgaagtctattctattgatattgtcacaagcacaggcgagggcaagcccaagttgctggatgaaaaacaaaccactatatacaagagggcagtggataagaactatcatttgaagatgagggcatcaaggtttatcttcagtgaaataaatcagaagtttcccattatgccctttaccgcaagggctttagaagaaaagcgttctcgtttaggtctagtggaatgtgtcaaccatgatctattgcagccttaccctgttcttcatgagaaaccaggtgatcttgtagctcatataaaatttacagttttgttgatgcccaatggttcagacaagatcacagggcatccattgcaagagttgaaaccaaccaaggcaattgaggatcctgatataaaagcatggttagcattggggacaaagtccaaaaagaaaggtggtggaaagaaaaagaaagccaagaaaggtgatactcaagaagaggcggatgcacctgtagatggggctgatggtattgatccattgcaaggatgataggataaagttttgtactttgatgagtctaaaatgcgtggttctatgttaagggtgccctttcttttatgcccattctctttatatggtgatttctgatcggcccccatcctgagtttctttttacctttcagtattaatctagattttcccatttggttcctttaaatgctttttctagatcacatcctaggggcacatttcttgtgtttgttagctgcatgttcttacagaacttaaaaatgcatttctttggtattgaaaagagaaaaaaaaaaa

SEQ ID NO: 7557 - DNA, 1550 bp, Vinca minor
accttcaatctccttcctaaccacaactttatcgatttttaactcttgtaaatcggagctgttaaggtaacaatgtcggacgaagaaagagatgagggagaattggatcttaccagtccggaagtcgttaccaaatataaaagtgctgctgaaattgttaacaaggctcttcaattggtgttatctgaatgcaagcctaaagtaaagattgttgacttatgtgagaaaggagattccttcatcaaagagcaatctggtagcatgtataagaatgtaaagaagaagattgaaaggggtgttgcctttccaacctgcatttctgtgaacaatactgtttgccatttctctccattagctagtgatgagaccctactcgaggaaggtgacatggttaagatcgatattgggtgccacattgatggttttattgctgtagtggctcatactcacgtgatacaagaaggccttgttactggtagggcagctgatgttcttgcagcagccaacacagcagctgaagttgctttgaggcttgtgcggcctgggaagaataatcaagatgtaacagaagcaattcaaaaggtagcagcagcttatgactgcaggattgtggagggtgtattgagtcaccaaatgaaacagttcgtaattgatggtaacaaggtcgtgctgaatgtctctagccctgagatgaaagttgatgatgctgaattcgaggagaatgaggtttacgcaattgatattgttactagcacaggcgatggcaaaccaaagctgttggatgagaaacaaacaactatctataagagagccgtggacaaaagttataatctgaagatgaaagcatcacgatttatctttagtgagatcagtcaaaaattccctatcatgccatttactgcaagggatttggaagagaaaagggctcgctttgggttggtcgaatgtgtcaaccacgaccttttgcagccatatcctgttctccatgagaaacctggtgatttggttgctcatattaaatttaccgttctgctcatgcccaatggatcagatagagtcacatctcatcctctacaggagttgaagccggaaaaaacagtcgacaactatgctgaaattaaagcctggttatcccttcccgtaaagacaaagaagaaaggcggtggaaagaaaaagaaaggtaagaaaggtgacaaggctgaagacttgtcacagactgtggcaatggatgaagaaccgaatggtgctgcaactcaataatgagttcgtctttacctgttgttggtctcgaacgccccctcccatttgcatgattttaagttatattaagaaaaagtgtttctgggattgggcaaatcagttgtaggttcttgtttgtcccttctgaggtgatgtaatacaagtcatatatgcttatagctctcatatctgtcatacttcaccaatgttttctattcccctaaggttcttccatttttaataggattttaaatttcgataagtttaaattgtcatatatagtttactttatctgaattaacacttgctcc

SEQ ID NO: 7558 - DNA, 1618 bp, Phalaenopsis aphrodite
gtttccagtacggctacgcttatccttcttccgtctttgatctgattgagaacttggctggtgggctgatctcatcctatctttgtacctgaaagataaccaaagcaaagctttttttgctgctttcaagcgtctctcctttctgttttccagttgccgatttttctctaggagatgtcggacgatgagacgaaggaggagatagagttggatctctcctcctctgatgtagtcaccaaatacaagagcgccgccgagatcgttaacagggcccttcagttggtggtctcgaattgcaaacctaaggccaagatagttgacatatgtgaaaaaggagatgcctttataagagagcaagctgggagcatgtacaagaatgtaaaaaaaaaaattgagagggggttgccttcccaacttgcatttctgtgaacaataccgtctgtcatttctcacccatgggcagtgacgagactgttttggaggagaatgatgttgtgaagattgatatgggctgccacatagatgggttcattgctgttgttgcacacactcatgtgctgcatgaaggaccagtaggtgggagagcagcggatattattgccgctgcgaatactgctggtgaggttgccttgagacttgtgaggccagggaggaagaacaaagatgttacagaagccattcagaaagttgcagctgcatatgattgcaaggttgttgaaggtgttcttagtcatcagctgaagcagtttgtgattgatggaaacaaagttattttgagtgttggcaatcctgaaaccagagttgacgatgcagaatttgaggaaaatgaagtatattctgtagatatagtcatgagtactggtgatggcaagccgaaattgttggatgagaagcaaacaactatttacaagagagctgtggacaagaattatcatttaaagatgaaggcatcgaggttcatatttagtgaaataagccagaagtttccaatcatgccatttactgcaagggcattggaagagaagagggctcggcttggtctggtagaatgtgtgaaccatgatcttttgcagccataccctgttctccatgagaagcctggtgaccttgttgctcatattaagttcacagttttgttgatgccaaacggtccggataggatcacctcccatcctttgcaacagctacaacctacaaaaggtattgataatgatcccgaaatcaaagcgtggttagctttgggattaaagaccaagaagaaaggcggtggaaaaagaaaaaaggtaaacaaagtgaaattttgactgaagctgagcccatggaagaagaaactgtgaatggcgctgcagctcaagaatgagaaaacatcagttttgactactttgatttactgtggtttgcgctccagccctcctccattgtttgttcaatgtattacatttgtgggagatattgtgcacagaattgctttgagaaatttgtttttttaatggaaatattgagggtaaaaaatgtgcttataggctctattttagcttttgagctgaatatgttctcttagatttgttatggaacatgatgagatggtcaaatgcttttagatgtttgctttatattt

SEQ ID NO: 7559 - DNA, 2632 bp, Spinacia oleracea
gtgatcttcgagtgtgaaatttgaacatttttatttgattgctgaggaatcatgtcggatgatgagagagaggagaaagagttggatcttagctatcctgaagtcgtcaccaaatacaagagcgctgctgacattgtcaacagagctttgcagctagttgtcgctgaatgcaagcccaaagctaaaattgttgacctctgtgagctaagcgataattttatccgagagcaaagtggtaacatgtacaagaatgtgaaaaagaagattgagagaggtgttgctttccctacctgcttatctgtcaacaatgttgtttgtcatttttcgccacttgcaagtgatgaatcagtgctggaagaaggtgatatggtgaaaattgatttgggttgtcatattgatgggttcattgctgttgttgctcacactcttgtaattcaagaaggaccgataacgggtaggaaagctgatgttcttgcggctgtcaacactgctgctgaagttgctttgaggcttgtgaggcctggaaagaagaacaaagatgtaacagaagcaatccagaaagttgcctcggcttatgactgcaaaattgttgaaggagtccttagtcaccaaatgaaacagttcgtgattgatggaaacaaggttgtattgagtgtgacaagtccagatatgagagttgatgatgctgaatttgaggagaatgaagtctattctgtggatatagctgcaagtacgggtgagggaaagcctagaatgttggatgagaagcaaacaactatctacaaaagagcagtggacaagaactatcacttgaagatgaaagcatcaagatttatattcagtgaaattaatcagaaattccctatcatgccatttacagcaagggctttggaggaaaagagggcccgtcttggactagtagagtgtgttaatcacgaccttttgcaaccctatcccgttctttatgagaagcctggtgactttgttgctcacataaaattcactgttcttctcatgccaaacggatcggatcgtgtaacatcacattctttgcaagagatgcagccaaccaattctgtcgatgatcctgaaataaaagcttggttagcgttgggaacaaagacaaagaagaaaggtggtggcaaaaagaagaaaggcaagaagggtgataaggccgaggctgaggagtctgctgacgcagcgcccatggatgcagatgcaagtggcacaactgctgaaaattgagaagataaacaaaatatgacatcaaattttgttacttgttgattttcttttgtattttgcttgatgggcaactcaaacatgtttagatgctgatctttaatatttcgtgttgcctctcacttctgtgtaaagttctgggtttgagcccatgaaatgaatttttcttgatacacagtgttggggcgtgttgattgtgagcttgttcagtgtactacgtatcggctattttttgttagatggtatatggaaggttggtccatgaatgagggccagtgatagatcagctttagtcccgaggaaggtaattatatggttacgccaatgtgactgcaaaactcatggtttgatttctgctggcttggtcagatggacatatggtgaaatcaaggagctaactggaaacttcaaggatcagttagggccacattcatataaatctgtgcttcaaaacaaccaacctgctgtagtcaagcggctagaatcacaaattgaggagaggagatttagggctatggtttcaatgatgggaagcattcatcataaaaatttggttaaggtggagggttattgttgtgagtcaggaaacagatttttggtgtacgagcttttaaagaacggttcactagaagacttcatgcacgatcctgcatcatgcaaaaagctttcttggaaaaatcgaatgttgatttgtctagatgtggcgaaggccatttcttatttgcacacaggttgtagggattttgtaagccatgggaaattgaaatgtggaaatgtgattttggatgaaaacctggaagcaaaagtgacagagtttggcttacagaaacttgatggtattgagacttatgcggagaaagatgtggaagactttggtaagatggtactctatctcatatgtgggcgccaagaagaagtttgtgagtggtcttacaacaaatgggttagtgggtatggatggagggttgtggataagagaattgaaggcgaagtagactttgaagagctagagcgtggccttagaattgctttctggtgcttgcaagttgatgaaagaatgaggccgtcaatgggggaagtcgtgaatgttttagagggtacactgacagttgatccaccaccgcccccgttttctgactcaagaaatttacaggaagacatattagcagaatcagagctggtttgaaacttgttgtcctgcccatgtattatgtatagcagcactaagccactaacattatggtaagctgtaaaattttaaggaatagattggttagattaaccttttgacctaagggctaacaaataaattcctgtgtttggttcaagtgagactgagagtgacattaggttgcctctaagcttctgtaggtcaaacattttattttct

SEQ ID NO: 7560 - DNA, 1516 bp, Silene vulgaris
ctccactgataaagctactttcatcactaacgcaatacattttctgggatttttcgaagaaaaaaaaaagatgtcggatgatgaaagagatgagaaggaattggatctaacatcctctgaagttgttacaaagtataaatgtgctgctgaaattcttaacaaggcattacatttggttgtttcggaatgcaaaccgaaagctaagattgttgacttatgtgagaagggtgatgcctatattagagagcaaaccgggactatgtataagaatgcgaagaaaaagatcgagagaggtgttgcttttcctacctgcatatccgtcaacagtgttgtttgtcattattcaccacttcctaatgatgagtcagtgcttgaagaaggtgatgtcgttaaagtggatatgggttgtcatattgatggttttatcgctactgtggcacacactcatgtaattcaagaaggcccggtaactggaagaaaggcagatgtcattgctgcgaccaacactgctgcagaagttgctctgagacttgtgaggcctggaaagaagaacaaagatgtgactgatgccattcagaaagttgctgcagcatatgactgcaaaattgtagagggtgtccttagtcatcagttaaaacaatttgtgattgacggaaacaaggttgtgttatcagtcgcaagtcctgaaatgagggttgatgaggctgaatttgaagagaatgaagtctatggtattgatatacttgcaactacaggagagggaaagcctagaatgttggatgaaaaacaaacaaccatttacaaaagagctgtggacaaaaactatcacctaaaaatgaaggcgtcaaggtttatattcagtgagataaaccagaagttccccataatgccttttactgctagggcattggaagaaaagcgggcacgacttgggcttgtggaatgtgttatgcacgatctattgcagccttaccccgtcttgcatgagaagaatggtgaatttgttgctcatataaagttcactgttctgctcatgccaaatgggtcggatcgtataacttctcacccattgcaagaattgcaaccaaccaaaacaatcgaggatcctgaaatcaaggcatggttggctttggccactaagaccaagaagaaaggcggcggcaaaaagaagaaaggcaagaaaggtgacaaacccgaggatgagtctgctgcagcggagccaatggatgcctctactaacggtgcaacagctgaggcccgagagttagagaatgtcagttagcgctttctgtcaacttaattttggcgaatctcttttggtatttgcttgctgatgggcaatttgagcatgttagattttgatcttacaaacttaatactggcttacactcacttcctctgtaaaggcgtggatttgtgcatttttcaacccctatttgcactttaaacaaagtaatatgcaaatattagattggtttttgaatttggaaactagtcggaattaattaaattaact

SEQ ID NO: 7561 - DNA, 1127 bp, Flaveria ramosissima
ccctcttctgaggaagcatgtcggacgatgaagcaagggaagagaaggagctcgatctttcctccccagaagttgtaaccaagtacaaattggctgctgagattgttaacaaggccttgcagttggttttgtcagaatgcaaacccaaagccaagattgttgatatatgtgaaaagggagattcgtacatcagagagcaaactgggagtatgtacaagaatgttaagaagaagattgaaaggggtgttgcatttcctacgtgtttgtctgtgaacaacacagtctgtcattactctccccttgcaagtgatgaaacggtgttggaagaaggtgacattgtgaaaattgatatgggttgtcatatagatggattcattgctgtggtggctcacactcatgttctccagcaagggcctgtaactggtagagctgctgatgcgattgcagctgcaaatactgctgctgaagttgccttaagacttgtgaagcctggaaagaagaaccaagatgttactgaagccatccaaaggtttgctgctgcatatgactgcaaaattgtggaaggagttcttagtcatcaattgaaacagtttgtgattgatgggaacaaagttgtattgagtgtctccaatcctgaaaccagagttgatgatgctgagtttgaggagaatgaggtttatgcaattgatatagtcaccagcacaggagatggcaagccaaaattgttggatgaaaaacagacaacaatatataaaagagcagttgataagagttatcacttgaaactgaaagcatctcggtttatattcagtgagatcagtcaaaatttcccaatcatgccattctcatctagggctttggaagagaagcgtgctcggttaggattagtggaatgtgtcaaccatgagcttttgcagccataccctgttcttcatgaaaagcagggtgactttgtggcacatatcaaattcacggttcttcttatgccgaatgggtcagaccgtataacctctcatacgctccaggagttgcagccaactaaaactgttgatgatcctgaatcaaaggatggttatcccttcctgtaaaatccaaaaagaagggtggtggcagaagaagaaaggtaa

SEQ ID NO: 7562 - DNA, 1349 bp, Amaranthus tuberculatus
gaactgaaaatgtggcatttacaaaagaaagacacactacaaatacaatctatctgggcctcctcttctcttctctataaaaaggttaacccggattcacttcttacaccttgaaaccctaattacactcccctttttcttcagtagccggccattcatccatccatccatccatccttgttcttcgctgtgattgaaagtgagaatcgtattgacatttgagtggtattgaatatcggaatcatgtcggacgaagagcgcgaagagagagagttggatcttacttatcctgaagttgttaccaaatacaagagcgctgctgacattgttaacagagctttgcaattagttttatcggaatgtaagcccaaagctaaaatcgttgatgtttgtgaaaagggagattcttttatccaggagcaaactgggaacatgtacaagaatgtgaaaaagaagattgagagaggtgtagcatttccaacttgtatatctgtcaacaacgttgtttgtcattattcgcctcttgcaagtgatgaaactgtgctcgaagaaggtgatttggtcaaaattgatatgggttgccatattgatggttttattgctgtggttgcgcacacacatgtagttcaagatggtcctgtaaccggtagaaaagcagatgttattgctgcagcaaacactgctgctgaagtggctatgaggcttatcaggcctgggaagaagaacaaagatgttacagaagctatccagaaagttgctgcggcttatgactgcaaaattgttgaaggtgtgcttagtcaccagatgaaacagtttgtgattgatggaaacaaggttgtattgagtgtaacaaatccggaagtgagagttgatgatgctgaattcgaggagaatgaagtgtacgctgttgatatagttgcgagtacgggtgagggaaagcctaaaatgttggatgagaagcaaaccaccatctacaaaagagccgtggacaggaattatcacttgaagatgaaaacttcaagatttatattcagtgaaattaatcagaaattccctatcatgccctttacagcaagggctttggaggaaaagaaggctcgccttggtctggtagaatgtgtcaatcacgacttattgcaaccctatcctgttcttcatgagaagcctggtgatctagttgcgcatataaagttcactgttcttctcatgccgaacggatcagatcgtgtgacatcccatcctttacaagagctgcaaccaacaaaaacaattgatgaccctgaaatcaaagcttggttagcattgggaacaaaaactaagaagaaaggtggtgggaagaagaagaaagg

SEQ ID NO: 7563 - DNA, 1195 bp, Centaurea maculosa
aacaaatcggccgctgagattgttaacaaggccttgcagttggttttgtcagaatgcaaacccaacaccaagattgttgacatttgtgagaaaggagactcatatatcagagagcaaactgcgagtatgtacaagaatgtgaaaaagaagatcgaaaggggtgtcgcattcccaacatgtttgtctgtgaacaacacagtctgccatttctctcctcttgccagcgatgagacggttttgaaagaaggtgacattttgaaaattgatatggggtgtcatatagatggtttcatagctgtggtgggccacactcatgttcttcagcaaggtccagtgacaggaagagcagctgatgttattgcggctgcaaatactgctgctgaggttgccttgaggcttgtgagacctggaaagaagaaccaagacgtgacagaagccattcaaaaggttgcagctgcatacgactgcaaaattgtcgaaggtgttcttagtcatcaactgaagcaatttgtgattgatggaaacaaagtcgttttaagtgtcgcaaatcctgacaccagagttgacgatgccgagtttgaggagaatgaagtttatgcaattgatatcgttgcaagcactggagatggcaagccaaagttgttggatgagaaacagaccacaatttacaaaagagctgttgacaagaattatcacttgaaaatgaaagcatcccgtttcatattcagcgagatcaatcaaaagtttccgatcatgccattctcggccagggctctggaagagaagcgtgctcggctaggattggttgaatgtgttaatcacgagcttttgcagccataccctgttcttcatgaaaagcctggtgattttgttgcacacatcaaattcactgttcttctaatgccaaatggatccgatcgcatcacgtcacatactctgcaggagttgcagcctactaaaaccgttgacgacccagaaatcaaagcttggttagctctagctgtgaagagcaagaagaagggtggtggcaagaaaaagaaaggcaagaaaggcgaaaaaggtgaaggcgatgaagcggtagctatggacgaaacaacaaatggtggcaaccaagggtgaagatctgaaggaatatttcttgtgtaattttgacgatttcgaatcaaattttggttccaaccttgttgcatgagag

SEQ ID NO: 7564 - DNA, 1437 bp, Vinca minor
gaaagcccaaccctacctcctcaaccctcactgccttcaatctccatcctcccccacaactcaccaatttttcactcgagtgtaagtcggagctgttaaggtaacaatgtcggacgaagaaggagaggagagagagttggatcttaccagtcccgaagtcgtcaccaaatataaaagtgctgctgaaattgttaacaaggctcttcaattggtgttatctgaatgcaagcctaaagttaagattgttgaattatgtgataaaggagattctttcatcaaagagcaatctggtagcatgtacaagaatgtaaagaagaagattgagaggggtgttgcctttccaacctgcatttctgtgaacagtactgtttgtcatttctctccactagctagtgatgagaccgtactcgaggaaggtgacatggtcaagatagatatggggtgtcacattgatggttttattgctgtagtggcgcacactcatgtgatacaggaaggccctgttactggtagggcagctgatgttcttgcagcagccaacgcagccgctgaagttgctttgaggcttgtgcggcctgggaagaataatcaagatgtaacagaagcaattcaaaaggtagcctcagcttatgactgcaggattgtggagggtgtattgagtcaccagatgaagcagtttgtaattgatggaaacaaagttgtgctgaatgtcactagccctgagatgaaagtagatgatgccgaatttgaggagaacgaggtttatgcaattgatattgttactagcactggcgaaggcaaaccgaagctgttggatgagaaacaaacaactgtctataagagagctgtggacaaaaactataatctcaagatgaaagcatcaagatttatctttagtgagataagtcaaaacttccccatcatgccatttactgcaagggatttggaagagaaaagggctcgctttgggttggtcgaatgtgttaatcacgatcttttgcagccatatcccgttctccatgagaaacctggtgatctggttgctcatattaaatttactgttctgcttatgcccaacggatcagatagagtcacatcacatcctctacaggagttgaagccagaaaagactatcgacaatgaccctgaaattaaagcctggttatctcttcccgtaaagacaaagaagaaaggtggtggaaagaagaagaaaggtaagaaaggcgagaaggcagaagtctcgtcacaaaccgaggcaatggatgaagaaccgaatggtgctgcaactcaataacgagtttctcctcctgttgttggcccgctctaactccccttccatttgcatggtttcaagttatcgaaaggaaaagtgttttgtgggattgcgctaaccagttgtaggttttttttttttgcccttctgaggtgatgtaatac

SEQ ID NO: 7565 - DNA, 2142 bp, Cycas rumphii
caaaatgtgcccttaaaagggagcaatttgacgagaggacaaagtgacaatttctccaaaaacaaaaaccccatcgtaactcgtggtaaatctcctctaacacagttatctcttcatcatgttctccatcgccgccacctcccttgtattgaaagaagaagaaacaacaatttgatcattgcattttgtttttgactactgtgtctgtaatttttcctttgtacgagcttctcgtgggggacattgttgtgaaaccctagtcgagcttccgctacataccaactcctggattattagtttttaaccaaagataacagaatgtccgacgacgaagccaaagaggagaaggagttggatctcacctcacctgaagtagttacgaagtacaaggttgctgctgaaatcgttaacaaggctttgcaagtggttctggctgactgcaagccgaaagcgaaggtagttgacctctgcgagaagggagatgcatatattaaagagcaaacaggaaatgtgtataagaatgcaaaaaagaagatagaaaagggcattgcatttcctacttgtgtctcggtcaatagcactgtatgccatttttctcctcttgccagtgacgaaactgttttggaggaaaatgacatcgtgaaaattgatctgggatgccatattgatggcttcattgcagtggtggcccacactcatgtgttgcaagaaggtcctattactggaagggtagcagatgtcattgcagctgctaacactgcagctgaagttgctttgaggctagtcaagcctgggaaaaagaacaaggatgtcacagaagccatacaaaaggttgcaacggcatatgactgtaaaattgcagagggagttctgagtcatcaaatgaagcagtttgttattgatgggaacaaagttatcctgagtgtaagcaatccagaaatgcgagttgatgatgctgagtttgaggaaaatgaagtctattctattgatattgtcacaagcacaggcgagggcaagcccaagctgctggatgaaaaacaaaccactatatacaagagggcagtggataagaactatcatttgaagatgagggcatcaaggtttatcttcagtgaaataaatcagaagtttcccattatgccctttactgcaagggctttagaagaaaagcgttctcgtttaggtctagtggaatgtgtcaaccatgatctattgcagccttaccctgttcttcatgagaaaccaggtgatcttgtagctcatataaaatttacagttttgttgatgcccaatggttcagacaagatcacagggcatccattgcaagagttgaaaccaaccaaggcaattgaggatcctgatataaaagcatggttagcattggggacaaagtccaaaaagaaaggtggtggaaagaaaaagaaaggcaagaaaggtgatactcaagaagaggcggatgcaactgtagatggggctgatggtattgatacattgcaaggatgataggataaagttttgtactttgatgagtctaaaatgtgtggttctatgttaagggtggcctttcttttatgaacattctctttatatggtgatttctgattgggcaccatgctgagtttcttttaactttcagtattcatctagattttcacatttggttcctttaaatgctttttctagatcacatcctaggggcacatttcttgtgtttcttagctgcatgttcttacagaacttaaaaatgcatttctttgctattgaaataatagcaatatctggaaatgttgcttttcatttttctctgccttgtaagaatcattaggtatattctggcatgatattgataaacttgcctagattttgctttggtaacatggtttggtagtcaattcagacggtggcatagttattttatgaacggtggtgttttgaggttcatcttatggttagtgtgcctaccattagctcaaagtatcgcaaggatacagtgacacctcatgtagacagacatttaaggtagttcacacatatgtgatgaggggggggggggggggggggggggggggggggggggggggggggggggggggggggggggggggggggggggggggggggggggggggggggggggggggg

SEQ ID NO: 7566 - DNA, 1811 bp, Pinus taeda
ccaaaagccgctagatcaagggcaaaccaaaaacccccaactcggattaaaacccctaaaaccccttaacaatcacataagcttagacatctgcttttatcaccacaatcttgctcgccgccaacctgttggatttgagagtccgtcattcgtttgcgctccgcgctttgattcctttacaactccatttgattgttttcgcatttctttcatttttaggctcggaatctgccattgctgggaaaccctagtcgagacgattttcaacagtatagactacttgatatcagttttgtgaacagaaaatgtcagacgacgaagccaaagaggagaaggagttggatctcacctcgcatgatgtagttaccaagtataagctttctgctgaaattgcgaataaagctttacaaatagttttgtctgaatgcaagccaaaggcaaaggtggttgatctgtgtgaaaagggggactcatatattagagaacaaacaggaaatgtatataagaatgccaagaagaagatagagaaaggtgttgcatttcctacttgtatctcgatcaatagcacggtatgccatttctctcctctaactggagatgaaactgtcttggaggaaaatgacattgtgaaaattgatctgggatgccatattgatggcttcatttcagtggtagcccacactcatgtggtacaagaaggacctgttactggaagggcggcggatgttattgcagctgctaacactgcagcagaagttgctttgagacttgtcaagccagggaagaagaataaggatgtgactgaagccatccaaaaagtcgctgcagtgtatgactgcaaaattgcagagggagtactaagtcatcagatgaaacaatttgttattgatggcaataaagttatacttggtgcaagcaatccagaaacaagggttgatgatgctgagtttgaggaaaatgaagtttatgctattgacattgtaacaactacaggtgaaggaaagcttaaactgcttgatgaaaaggaaacaaatatatacaagagggctgttgataaaaactatcagttgaagatgaaagcatcaaggcttatcttcactgaaataaaccagaagtttcctattatgccatttactgcaagggctctggaagacaagcgtgcccgtttaggtctggtggaatgtgtcaaccacgagcttttgcagccttaccctgttcttcacgagaaaccaggtgagctggttgcccatataaaattcacggtcttgttgatgccaaatggatcagacaaaatcacagggcatccattgcaagaactgaatccaaccaagactattgatgatcctgagataaaagcatggctagctttggggaccaagtccaaaaagaaagggggtggaaagaaaaagaaaggcaaaaaagatgctctagaaaattcagctgatgacactggaaatggggctgttagtatggatacatcccaaggttgataggaggaagtttactagtgtccaaagcaaaaaatatgctcaagaagatctagcagttgcccatggaaatggatctgataaggatggatatgttacaaggttgataggacaaagtttactagagtacgaagtgtgttgttacatgattccatgtcaaaggcagcttttcttttgtgaactgtctccgttaatggtcatttcttattgtcaccttgagaagttttttctcttttaattatatatatcgaatttagagtattaatcgataattcacatttggctctttgtgtgccttctctatcacggagatcacttcccctc

SEQ ID NO: 7567 - DNA, 1198 bp, Cirsium arvense
aagcactcttctccttatccaaattcgataacatttcgtgtttttcacccttaatttcatcactgcatgttttgatttctgtttctttttttttgattttgtaacgttgattgtagtaaacatgtcggatgatgaaagagcagaggagaaggagctggatctcacctctccggaagttgtaaccaaatacaaatcggcagctgagattgttaacaaggccttgcagttggtattgtcagaatgcaagcccaaagccaagattgttgatatatgtgagaagggagattcatacatcagagagcaaactgggagcatgtacaagaatgttaagaagaagattgaaaggggtgttgcgtttcccacatgtttgtctgtgaacaacacagtatgccattactctccacttgccagtgatgagacagtattggaagaaggcgacattttgaaaattgatatggggtgtcatatagatggtttcatagctgtggtgggccacactcacgttcttcagcaaggacctgtaacaggtagagcagctgatgccattgcagcggcaaatactgctgctgaggttgccttaagacttgtgaagcctggaaagaagaaccaagatgtaacagaagccattcaaaaggttgctgctgcatacgactgcaaaattgttgaaggtgttcttagtcatcaactgaaacagtttgttattgatgggaacaaagttgtattgagtgtctcaaatccggaaaccagagtggatgatgctgagtttgaggaaaatgaagtttatgcaatcgatatagtcacaagcacaggagatggcaagcctaaattgttggacgaaaagcagacaacaatctataagagagcagtggacaagaattatcacttgaaaatgaaagcatcccggtttatattcagtgagattaatcaaaaatacccaatcatgccgttctcagctagggctttggaagagaagcgtgctcggcttggattggtggaatgtgttaatcatgagctcttacagccatacccagttcttcatgaaaagcctggtgattttgttgcacatatcaagttcactgttcttctgatgccaaatggatcagatcggataacctctcatacactgcaggaattgcagccaactaaaaccgttgatgacccggaaattaaagcatggttatctctacccgtaaagagc

SEQ ID NO: 7568 - DNA, 1388 bp, Nuphar advena
ggatctcacttctccagaggtagtcaccaaatacaagagcgccgcggaaatagtcaacaaggctttgcacttggttttgtcggaatgcaaacccaaagcgaagattgtggacttatgcgagaaaggcgacacttttatcagggagcaaactggaaacatgtacaagagcgtcaagaagaagatagaaaggggtgttgcattcccaacgtgcatatcagtcaataacactgtgtgccatttatctcctcttgcaagcgacgagagcactttggaagaaaatgatatcgtaaaaattgacatgggatgccatatcgatggattcattgcagtggttgcacatacacatgttattatagaaggacctgttaaagggagagctgcagatgtaattgcagctgctaacactgcatccgaggttgcgttaaggctcgttaggcctggaagaaagaataaagatgttacagaagctatccaaaaggttgctgctgcatatgattgcaaaattgttgaaggtgtgctcagtcaccaattgaagcagtttgtcattgatgggaacaaagtcatactaagtgtaagcaatccagagacgagagttgacgatgcagaatttgaagagaatgaagtatatgcagttgatatagttgctagcacaggcgatgggaagcccaaacttcttgatgagaggcaaacaaccatctacaagagggctgtggacaagaactaccacctaaaaatgaaatcatcaagatttatcttcagtgaaattagtcagagatttcctataatgccatttactgcaagagcttttgaagagaagcgggctcgactgggactagtggagtgtgtaaatcatgaacttctgcagccatatcctgttcttcatgaaaagcctggagaccttgttgctcatatcaaattcacagttttgttaatgcccaacggatcagatagaatcacttcacatcctctgcaggagttgcagcctacaaaatcaattgatgactatcaagaaatcaaggcgtggctgtcattggggacaaaaaccaagaagaaaggtggaaagaagaagaaagcaagcaagaagggagacgcttcggaacctgaacttgtcgatggaacctcaaatgttgctactggccaggaagcatctcaagaataaggattccagttccagttttttgtttcttttttaatataatccctttctttatcaaagaagaaaattgttgtttccaacggaaattggtctgctggtagttgtaactggtcgcatggtttgtgttctgttcagaggagctatttagatgacgttgaggaagtgactgttttgtttgttttgctttttatatttaatgatgatagtgaagctctgagaggccgtgattcga

SEQ ID NO: 7569 - DNA, 1411 bp, Euonymus alatus
ggacgatgaaagagaggagaaggagctcgatctcacttctcccgaggtcgtcaccaagtataagagcgcagccgagattgttaacaaggcgttacagttagtgatatcagaatgcaagccaaaagcgaaggttgtggacgtctgtgagaagggtgattcatatatcagagagcaatcaggaaacatgtacaagaatgttaagaagaagattgaacgcggcgttgcttttcctacttgtgtttctgtaaacaacactgtttgccatgtctcaccacttgccagtgatgagacagttttggaagaaggtgatttggtgaaaatagatatggggtgtcatattgatgggttcattgctgtagtcgcacatacccatgttcttcaacaagggccagttacagggaaagctgcagatgttattgcagcttcaaatactgctgctgaagttgccttgaggcttgttaggccagggaagaagaacaaagatgtaacagatgcgattcagaaggttgctgctgcttatgactgcaaaattgttgaaggtgttcttagccaccagttgaagcagtttgtgatagatgggaacaaggtcgtacttagtgtttctagtccagataccagggttgatgatgcagaatttgaggagaatgaagtgtatgctatagatatagttacaagcacaggtgaaggcaagcccaagctgttggatgagaagcagactactatttacaagagggcagttgacaagaactatcacttgaagatgaaagcttccagatttatttttagtgaaattagtcagaaatttccaatcatgccattttctgcaagggctttggaagagaaaagggctcgtttgggattagtggaatgtgtgaatcatgaactcttgcagccatatcctgttcttcatgagaagcctgttgatctagtggcacacatcaaattcacagttttgctaatgccaaacggatcagataggatcacatcccattctctgcaagaggtgcagcccacaaagaccatagatgatcctgaaattaaggcctggttggccttaggcacaaagacgaaaaagaaaggaggcggaaaaagaagagaggtaagaagggcgacaagctcggggagtcggcggaagctgagcctatggatgcaacaacaaatggtgcatcacaagaatgagcctgttttaaatttgtcactgtcttttattcagttttgttactttgttctcctccttgtaacccattactgacaattgaggatgacaaatttagcagtaaatcctcttgtgacgtggtaaatgatttgtacaagttctatggggtttctgtcctgtgctgcaagatgttcttataggcatggaaatgttgataaactccttttgtaattggtcaattagctgtttcatacc

SEQ ID NO: 7570 - DNA, 1920 bp, Elaeis guineensis
ttacaccgttttctttcctctctctccaccaagccgaaaccccaaaccaaaaccctctggtctccattccgttttctttttctcaacaagcagagatcgcctagatagacttatccacattatctgtatcgcgctgagattagcttctctcttctccttcctcgctgaagatttctattgggttggatttgttggatttgcttaccctggagagatgtcggacgacgaggcaaaggaggagaaggagttggatctcagtttccctgatgtcgtcaccaagtacaagtgtgccgccgagatcgtcaacaaggctcttcagctggtcgtatcagagtgcaagccgaaagccaaaattgtcgacatttgtgagaagggagataccttcattaaagagcaaagcggcaacgtgtataagaacgtgaagaaaaagatcgagaggggtgtagcatttccgacatgcatatctgtgaacaacactgtttgccatttttcgccactcagcggcgacgaggctgttttggaagaaaatgatgttgtgaaaatagatatggggtgtcacatagatggctttattgccgtggtggcccacacacatgtccttcaggagggaccgatcaccgggagggcagcggatgtaattgcagctgcaaacactgcagcagatgttgctttgaggcttgtgaggcccggaaggaagaacaaagatgttacagaagctattcagaaagtagctggtgcctatgattgcaaaattgttgaaggagtgcttagtcaccagcttaaacagttcgtcatcgatggcaacaaaatcataattagtgtatctaatcctgagaccagagttgatgatgcagagtttgaagaaaatgaagtctatgcaattgatatagttactagcacgggtgaagggaagccaaagctcttagatgagaaacacactaccatctataaaagagctgtggacaaaaattatcacttaaaaatgaaagcatcaagatttatttttagtgaaataaatcagaagtttccaatcatgccatttactgcaagggcattggaagagaagcgtgctcggctggggcttgtagagtgtgtcaaccatgagcttttgcagccataccctgttctgcatgagaagccaggagatcttgttgctcatatcaagttcacggtattgttaatgccaaatggttctgaccggataacctcccatccgttgcaagagttgaagcctaccaagtccattgataacaatcctgagatcaaggcatggctttctttgggcacaaaaacaaagaaaaaggtggaggaaagaagaagaaaggtaaaaaggtgaagctaaagatgattcagcagaggcagaaccgatggatgaagcatcaaatggagccgcttcccaaggatgagaaattacagttttggtgttttcttcttcatttactgttagaattttctaggtgccttcaggattttcgtcatatatggatacaaaaattcagggtgctttaaatatgagaaagataactgtattgagagtcagcaaagcttctgcaggattatgacatggtggcagaataaaatctttataagatgctgaatctttagagtaagaacaaaaagaaggtgctaatttctgagtagtattttgtgtggatgtttgctggtaatctgttgctgagtttcttctgtatgatgagctaaaagattatggagacagctatttagtttcgttgcttgttttggtttccccctcgccatgcgagtgttggtaaccaggccatgctgtagcagctgcaagcctgtcttctcaatccttcactgatctttgttataattttatgaaaaatgagtggattatctgcggcctaagtgtgctacaattacctggatgttgagcctgctgtcatgcattaatgaatt

SEQ ID NO: 7571 - DNA, 1225 bp, Olea europaea
caatttaacaaaatagcttcaatttattgttagtattactgttgaagattgaaaacgatgtcggatgaggacagagaggagagggagctggatctctcctctcctgaagtcgttaccaaatataaatccgccgccgaaattgttaacaaggcattgcagttagtgttgtcagaatgcaagcccaaggctaaaatagttgacatttgtgagaaaggggatgcttttatcagagagcaatcagggaatatgtacaagaatgcgaagaagaagatcgaaaggggtgtggcattccccacttgcatttcagtgaacaatacagtctgccatttttcaccattagccagtgacgaaactgtgttggaagagggtgatatgttgaaaattgacatgggttgtcacatagatgggtttattgccgtagtagcacacacccatgttctgcagcaaggaccggtgactggcagaacagctgatgtcattgctgctgcaaatacagctgctgaggttgctttgaggcttgtgaggccaggaaaaaagacaaggatgtcactgatgcaattcaaaaagttgctgctgcttatgactgcaagattgttgaaggggttctcagtcatcaaatgaaacgattcgtgatagatgggaacaaggttgtattgagtgtctctagcccggagacaagagttgacgaagctgaatttgaggaaaacgaggtttattctattgatatagttacaagcactggcgaaggcaagcctaagttgttggatgagaaacagactaccatatataaaagagcagttgacaggaattaccacctgaagatgaaagcatctcgattcatatttagcgagataagtgagaaattccggattatgccatttactgctagggctttggaagagaagcgtgctcgattgggcatagtggagtgtatgaatcacgaccttttggagccatatcctgttctttatgagaagcctggtgacttggtggcacacatcaaatttacagtcttgctaatgccaaatggatcagatcggatcacaacccataatctgcaggagctgcagcccactaaaactgtagatgaccctgagataaaaggctggttatcgttgggaacaaagataaagaaaaaaggtggtgggacgaaggagcatctggtgcagtatccatagcctcagcatcaggtaactcctcagctttgttacctttcttacctttc

SEQ ID NO: 7572 - DNA, 1444 bp, Amaranthus tuberculatus
ccctaatttacttctctggagccatccatccttcttcactgtgactgagattgggaatattattgacatttgaattgattatcgagtagaaagaagcatcatgtcggacgatgaaagggatgagaaagagttggatcttagctaccccgatgttgttactaaatacaagagcgctgctgacattgtcaacagagctttgctgctagttatatcagaatgcaagcccaaagctaaaattgttgatgtttgtgaaaagggagattcttttatcaacgagcaaactgcgaacatgtacaagaatgtcaaaaagaagatcgagagaggtgttgcctttccaacttgcatatctgtcaacagtgtcgtttgtcattattcaccacttgcgagtgatgagtcagtgctcgaagaaggtgatatggtcaaaattgatatgggttgtcatattgatggtttcattgctgctgttgcacacacttatgttattcaagaagggcctgtaactggtcggaaggcagatgttatggctgcggcaaacactgctgctgaagttgctctgaggcttatcaggcctgggaaaaagaacaaagatgttacagaagcaatccagaaagttgctgcggcctatgattgtaaaattgttgaaggtgtgcttactcaccagatgaaacagtttgtgattgatggaaacaaggttgtgttgagtgtgacaaatcctgaaacgagagttgatgatgctgaatttgaggagaatgaagtgtatgctgttgatatagttgcaagtacgggtgagggaaagcctagaatgttggatgagaagcaaacgaccatttacaaaagagctgtggagagggcctatcacttgaagatgaaagcttcaagatttatattcagcgagattaatcagaaattcccgatcatgccgtttacagcaagggctttggaggaaaagagggctcgccttggtttgctagaatgtgtcaatcacgatcttttgcaaccatatccggttcttcatgaaaagcctggtgatttagttgcacatattaagttcactgttcttctaatgccaaatggctcggaccgtgtaacatcccagtcgttgcaagagctgcagccaactaaaacagttgatgatcctgaaatcaaagcttggttagcattgggaataaagacaaagaagaaaggtggtgggaaaaagaagaaagtataatcattttcaggcaagaagagtgacaaagccgaaacagaagaatcagcagccatggatgcaagcccaaatgatgctacaactgaaaattaattaaacttgaaacatgtgacatgaaattttgttgtgttgattctcttttgtatttggttgttgatgggcaacttggaacatctattcagatgctgatgttttaaatttcatgttgcctcatttaatgtgtaaatttctgggttt

SEQ ID NO: 7573 - DNA, 2348 bp, Picea glauca
aacccctaattcagaacaaaacccctaaaacctcctaaccatcaaataagctcagacatccggttatatcaccgcaatctttgtcgccgccaccccgttggatacaagaagtccgtcatttctttgttctgggcgctttcatttctttgttttcgcattcctttcatttttccaggcttagaatctgccattgctgggaaaccctagccgagacgattttcaactgtatcgacaccctcatatcagtctagttaacagaaaatgtcagacgacgaagctaaagaggagaaggagttggatctcacctcgcatgatgtcgttaccaagtataagctttctgctgaaattgcgaataaagctttacaaatagttttgtctgagtgcaagccaaaggcaaaggtggttgacttgtgtgaaaagggggactcatatattagagagcaaacaggaaatgtatacaagaatgccaagaagaagatagagaaaggtgttgcatttcctacttgtatctcagttaatagcacggtatgccatttctctcctcttgctggagatgaaaccgtcttggaagaaaatgaccttgtgaaaattgatctgggatgccatatcgatggattcatttcagtggtagcccacactcatgtggtgcaagaaggacctgttactggaagggtagcagatgttattgcagctgctaacactgcagcggaagttgctttgagacttgtcaagccagggaagaagaataaggatgtgactgaagccatccaaaaagttgcagcagcatatgactgtaaaattgcagagggagtactgagtcatcagatgaagcaattcgttattgatgggaataaagttgtacttggtgcaagcaatccagaaacaagggttgatgatgctgagtttgaggaaaatgaagtttatgctattgacattgtaacaagtacaggtgaaggcaagcttaagctgcttgatgaaaaggaaacaactatatacaagagggcggttgataaaaattatcagttgaagatgaaagcatcaaggcttatcttcactgaaataaaccagaagtttcctattatgccatttactgcaagggctctggaagacaaacgtgcccgactaggtctggtggagtgtgtcaaccatgagcttttgcaaccataccccgttcttcatgagaagccaggtgagctggttgcccatataaaatttacagtcttgctgatgccaaatgggtcagacaaaatcacagggcatccactgcaagaattgaatccaaccaaggctattgatgatcctgagataaaaacatggctagctttggcgaccaaggccaaaagagggggtgaagaaaagaaggcaaaaaagatgctctagaaaattcagcagatgacactagaaatggggctgatagtatggatacatcccaaggttgataggaggaagtttactagagtccaaaagcaaaaaatatgctcaagaagatttaacagttgccaatggaaatggagcggtagaatggatacatagacgaagtttactagagtacgaagtgtgttgttacaagattccatgtggaaggcagcttttcttttgtgaactgtctcagttaatggtcatttcttattgtcaccttgagaagtttttttcttttaattatatatattgaatttagagtattaatcgataattcacatttggctccttgtgtgccttcttttgcccgaggtcacttctcacagaattaccttcaatctcatatttgtttttcaagaaactgttgaatttttttttttgaaatgaacgtgcctagattagtttcctttaaagcgattaggaagcaggaacataatttaatccttgtcttggtaaacatgtctaggtattgttgtagtagtttcatggtaatttggcaaattcaaatgatgtaattgagtttatatgacattttgaaccttagtgtcaacctttcacatgagactctcaaattggtttaaggcaataacacctttcaccctatgatgaattccaagttctctaaaacattaaggtatctttttagattcttctcagctgtcatatgcagggtggaattgtctcacgaaaacttggcattatttggaattttaaaaatctgaagggagaacctacatggggaacataacagtcgaattcctaaccattcccttttatgggcaatgtatttttttgacttgggttgataaactgtgtcatgttgcacagtgtgtggaaatcatcatatcatcatggtaaggagtcggatgaattccaactagagatgaatattgctaaatggaatagaactgtattttacagccatggat

SEQ ID NO: 7574 - DNA, 1335 bp, Panicum virgatum
atggtggttcatactagtattggaaaggtaacacttaagttttttgacccttttggaacagatgctctgaagctggttgtatctgagtgcaagccgaaagccaagattgttgatctttgtgagaagggcgatgctttcattagagagcaaactgggaatgtctacaagaatgcaaagaggaagattgaaaggggcattgctttcccaacctgtgtatctgtgaacaacacagtctgccatttctcaccgcttgccactgatgaggcagttctggaagaaaatgatatggttaaaatagatatgggctgtcatattgatggttttattgctgtggtggcccatactcatgtgattacgaacgggccagtcactggaagagcagctgatgttcttgctgctgccaacaccgcagcagaagtcgcaatgaggcttgtcagacctgggaagaagaacaaggatgttactgaagcaatccagaaagtagctgctgcttatgattgcaaaattgtcgaaggtgttcttagccatcagctgaaacaatttgtcattgacggtaacaaagtcgtgctcagtgtctctaatgctgatacaaaggtggatgatgctgaatttgaagaaaatgaagtatatgcaattgacattgtcactagcactggggaaggaaagcccaagttattggatgaaaagcagaccaccatctacaaaagggctgttgacaagaattatcacttaaagatgaaagcatcaaggtttattttcagtgagatcagccagaagttcccgatcatgcctttcaccgctagggcattggaagagaagcgtgcacgcttaggcttggtggaatgcatgaaccatgagctattgcagccatacccagtacttcatgagaagccaggtgatcttgttgcgcacataaaattcactgtgctgctgatgcccaatggatcggataagattacatcacatccgctacaggagttacagcccacaaaatccattgaagacaatgctgagataaaggcatggcttgctttggggacaaagtcgaagaagaagggtggtggaaagaagaagaaaggcaagaaaggagatgcagcagagcctatggaggatgcaacaaatggtgctccaagccaagaataattctgatttttggaattgctacctctagttttgttcatgtttctttgctgcatctgatggtgttatattacattcagttgtggaaaaaattgagtactgtttcaactgtcttaagaaatgacgaatcctgctgcacattatcgcatctaatgacaaagataattatccatgtgccatgtttgtgctagttct

SEQ ID NO: 7575 - DNA, 799 bp, Medicago truncatula
tgcaaaatgaagattatatacttccttgttagcatcttggctttggcatcctctcttgcctttgcttatgaccccagccctctccaagacttttgtgttgcaatcaaagaccccaaagatggtgtattcgtgaatggaaaattctgtaaagaccccgcacttgttaaagctgaagatttcttcaaacatgttgaagctgggaatgcctctaacgcactaggctctcaggtgactccagtcactgtagaccaactattcggacttaacactcttggtatatctttggctcgtgttgattttgcgcctaagggtttaaacccacctcacatccaccctagaggaacagagatccttatagtacttgaaggcactctttatgttggatttgtcacttcaaatcaagacaacaatcgtctctttaccaaagtgctcaacaagggtgatgtgtttgtgttcccaattggtcttattcattttcaactgaatgtgggatatggcaatgccgttgctattgctggacttagcagtcaaaatccaggagttatcaccgttgcaaatgctttgtttaaatcagatcctcttatttccgacgaagttcttaccaaagcttttcaagtggataagagcataattgattatcttcaaaagcagtcttggtatgacaacaactagttagagaacatgattagttgactttagtccttcaatcaccttgtgcaatcaacctctctacttattattattgtattaaataaaatgcatgtgatttatttgaatacatagttgttttgttttgagt

SEQ ID NO: 7576 - DNA, 794 bp, Medicago truncatula
tgcaaaatgaagattatatacttccttgttagcatcttggctttggcatcctcccttgcctttgcttatgaccccagccctctccaagacttttgtgttgcaatcaaagaccccaaagatggtgtatttgtgaatgggaaattctgtaaagaccctgcgcttgttaaagctgaagattttttcaaacatgttgaagctgggaatgcctctaatgccttgggctctcaagtgactccagtcaccgtagaccaactattcggacttaacacacttggtatatctttggctcgcgttgattttgcccctaagggtttaaacccacctcacatccaccctagaggaacagagatccttatagtactcgaaggcactctttatgttggatttgtcacgtccaatcaagacaacaatcgtctcttcaccaaagtgctcaacaagggtgatgtgtttgtgttcccaattggtcttattcattttcaactgaatgtgggatatggcaacgctgttgctattgctggacttagcagtcaaaatccaggagtaatcactgttgcaaacgctttgtttaaatctgatcctcttatttccgacgaagttcttaccaaagcttttcaagtggataagagcataattgattatcttcaaaaacagtcttggtatgacaacaactagttggagaacatgattatgttcttcaatcaccttgtgcaatcaaccctgacatgtttgtttgacttcatagttgttttgttatgaatttaatttggtttaataatggattgttgttgtgattt

SEQ ID NO: 7577 - DNA, 1222 bp, Medicago truncatula
aattctcaccggttatttacataagaagaatattaaagagtagtactgagttgcaaaatgaagattctatacttccttgttagcatcttggctttggcatcctctcttgcctttgcttatgaccccagccctctccaagacttttgtgttgcaatcaaagaccccaaagatggtgtatttgtgaatgggaaattctgtaaagaccctgcacttgttaaagctgaagatttcttcaaacatgttgaagctgggaatgcctctaacgccttgggctctcaagtgactccagtcaccgtagaccaactattcggacttaacacacttggtatatctttggctcgcattgattttgtgcctaggggtttaaacccacctcacattcaccctaggggaacagagatccttatagtactcgaaggcactctttatgttggatttgtcacgtccaatcaagacaacaatcgtctcttcaccaaagtgctaaacaagggtgatgtgtttgtgttcccaattggtcttattcattttcaactaaatgtgggatatggcaacgctgttgctattgctggacttagcagtcaaaacccaggagttatcaccgttgcaaatgctttgtttaaatctaatccgcttatttccgacgaagttcttaccaaagcttttcaagtggataagagcataattgattatcttcaaaagcagtcttggtatgacaacaactagttgaagaacatgatttagtagacggtttactttaggtcttcaatcaccttgtgcaaccaaccctctctacttattattattgtattaaataataaaatacgtgtttgtttgactacatagttgtattgttatgattttaatttggtttaataatggattgttgttgtgatttctgtaaaatgataattttctatatcatgtgtgctttctagttaagtttttatcttcattgacactcttacatcagtttacattactaagtgtgtttatgattctccgcataacaatacaacgtaacataacaaaacatatgagaatgcaagagtagaatttatgcagtcagaatgtgatccaataaagctaggttgattttttgtcttcatttctcatttgcaattgattcgacatagactattgtatttgaaaaaccagttcatatatgtttttccatgtattatcttttgagttagtaactaaaagaatatttgaagacttgttt

SEQ ID NO: 7578 - DNA, 993 bp, Cicer arietinum
cttgttcattatttaataaataataacaacggaaaatatcaaatacaaaccacttttcattgttataaatagcaagctatacatgcaacaaaattcaattctaacaagtaatttacataagcagaatcattaaagaagagcaacatgaaaactctgcacttccttgtaagcatcttggctttggcatcatgtgttgcctttgcttatgaccccagtcctctccaagacttttgtgttgcaatcaaagaccccaaagatggtgtatttgtgaatggaaaattctgtaaagaccctatacttgttaatgctgaagatttcttcaaacatgtggaacctgggaatgcctctaatccattaggctctcaagtgactcctgttactgtagaccaattattcggactaaacacacttggcatatctttggctcgcatagattttgcaccaaagggtttaaatccaccccacattcaccctcgtggcacagagttccttatagtcgtcgaaggcactctttatgttggatttgtcacgtctaatcaagacaacaatcgtctcttcagcaaagttctcaacaagggtgatgtgtttgtgttcccaattggtctcattcattttcaactaaatgtgggatatggcaacgctgttgccattgctggacttagcagtcaaaatcctggagttatcactattgcaaatgccttgttcaaatctaatccacctatttctgacgaggttcttactaaagctttccaagtggataagagcataattgattatcttcaaaagcagtcttggtatgacaacaactagtttgagaacatgatttgtctgcataccaatatttattgtaataaataaagttcatataaattatatttaaatacatatgttttatttggagtttaattaagttgactactatattgttgttgtgacttttgtaaaataatcattcttatcattattcttgagtgatttcttgttgagttgaac

SEQ ID NO: 7579 - DNA, 751 bp, Cicer arietinum
taatttacataagcagaatcattaaagagtaaaaacatgaaaactctgcacttccttgaaagcatcttggctttggcatcatctgttgcttttgcttctgaccccagtcctcttcaagacttttgtgttgcaatcaaagaccccaaagacggtgtatttgtgaatggaaaattctgtaaagaccctatacttgttaatgctgaagatttcttcaaacatgtggaacctgggaatgcctctaatccattaggctctcaagtgactcctgttactgtagaccaattattcggactaaacacacttggcatatctttggctcgcatagattttgcaccaaatggtttaaatccaccccacattcaccctcgtggcacagagttccttatagtcgtcgaaggcactctttatgttggatttgtcacgtctaatcaagacaacaatcgtctcttcaccaaagttctcaacaagggtgatgtgtttgtgttcccaattggtctcattcattttcaactaaatgtgggatatggcaacgccgttgctattgctggacttagcagtcaaaatcctggagttatcactattgcaaatgccttgtttaaatctaatccacctatttctgatgaagttcttacaaaagctttacaagtagataagagcatagttgattatcttcaaaagcaatcttggtatgacaacaactagctggaggtttagttatttcattatgaataaataatcaaatttagtgatg

SEQ ID NO: 7580 - DNA, 949 bp, Vicia sativa
gcaaataataactcccatattaacaagaatcattaaagagtagtagtgagttgcaaaatgaaagttctttacttccttgttagcatcttggctttggcatcagtttcctttgcttatgacccgagccctctccaagatttttgtgttgcaatcaaagaccctaaagatggtgtatttgtaaacggaaagttctgtaaagaccctgcgctagttaaagctgaagattttttcaaacatattgatcctgcaaataccgcaaatgcattgggctctcaagtgactgcagtcacagtagaccaactattcggattaaacacactcggcatttctttggctcgcattgattttgcacccaagggtttaaacccaccccacactcaccctcgaggcacagagatccttatagttctagaaggtactctttatgttggatttgtcacttccaatcaagataataatcgccttttcaccaaagttctcaacaaaggtgatgtgtttgtgtttccaatcggtctaattcactttcaactaaacgtgggatatggtaacgctgttgccatagctggacttagcagtcaaaatccaggagttatcactattgcaaaagctttgtttaaatctgatcctcttatttctgatgaggttcttactaaagcttttcaagttgataagagtatcgttgattatcttcaggggcagacttggtatgacaacaactagttcgaaaacgtgatatgttcttccatcaccttatacagtcaaccttatctacttacttgttagtttgaataataaataaaatgtattggtatgacaacaactttatatgttcttccatcaccttatacaatcaatcttatttctgatgtattggctgtttatttcggatccccttatttctcatgtattggttgtttatttctgatccccttatttctaatgtattggt

SEQ ID NO: 7581 - DNA, 772 bp, Trifolium pratense
tggctttggcatcatctgttgcctttgcttatgaccctagccctctccaagacttttgtgttgcaatcaatgaccccaaagatggtgtgtttgtgaatggaaaattttgtaaggaccctgcacttgttaaagctgaagattttttcaaacatatcgaacaagggaatacctcaaacgcattgggttctgaagtgactccggttgccgtagaccaactattcggacttaacacgcttggaatatctttggctcgcgttgatttcgcacctaagggtttaaacccaccccacattcaccctcgaggcacagagatccttatagtcgtagaaggaactctttatgttggatttgtcacatctaatcaagataaaaatcgtcttttcacgaaagttctcaacaagggtgatgtatttgtgtttccaattggtctcattcattttcaactaaatgttggatatggcaacgccgttgccattgctggacttagcagtcaaaatccaggagtcatcactattgcaaatgctttgtttaaatctaacccgtctatttctgacgaggttcttaccaaagcatttcaagtggacaagagcataattgactatctccaaaagcagtcttggtatgacaacaactagtttacgaacatcgttagtcattttattcttacggataattgactttatagtgcttctcagtcacttagtacaacaagcctcttctacatacttattgtaataaataaaatgcttgtaaactattatgttttattaca

SEQ ID NO: 7582 - DNA, 688 bp, Lotus japonicus
gtactgagagccaaaatggaagttgtctacttccttgttaccatcttggctttggcatcctcttttgcctctgcctatgacccgagccctctacaagatttctgtgtgggaatcaatgacccaaaatatggtgtatttgtgaacggaaaattctgcaaagaccctgcacttgtgaaagctgaagatttcttcaaacatgttgaacctgggaacacctctaatccacttggctctaaagtgacccctgtcacagttgagcaactatttggactaaacacacttggcatatctttggctcgcatagattttgcacctaaaggtttaaaccctccacacactcaccctcgagccacagagatccttatagtccttgaaggaactctctacgttggatttgtcacatccaataacgcaaatggtggtaatcgtctcttcaccaaagtgctcaacaaaggtgatgtgtttgtgttcccaattggtctcattcatttccaattgaacgtgggaaatggaaatgcagttgctattgctggattgagtagtcaaaatcctggagttatcaccattgcaaatgctttgtttaaagctgatccccctatatctaaagaggttcttaccaaagctttccaagtggataagagcataattgattatcttcaaaagcagtcttggtatgataacaactagt

SEQ ID NO: 7583 - DNA, 675 bp, Lotus japonicus
ccaaaatggaagttgtctacttccttgttaccatggctttggcatcctcttttgcctctgcctatgacccgagccctctacaagatttttgtgtgggaatcaatgacccaaaaaatggtgtatttgtgaacggaaaattctgcaaagaccctgcacttgtgaaagctgaagatttcttcaaacatgttgaacctgggaacacctctaatccacttggctctaaagtgacccctgtcacagttgagcaactatttggactaaacacacttggcatatctttggctcgcatagattttgcacctaaaggtttaaaccctccacacactcaccctcgagccacagagatccttatagtccttgaaggaactctctacgttggatttgtcacatccaataacgcaaatggtggtaatcgtctcttcaccaaagtgctcaacaaaggtgatgtgtttgtgttcccaattggtctcattcatttccaattgaacgtgggaaatggaaatgcagttgctattgctggattgagtagtcaaaatcctggagttatcaccattgcaaatgctttgtttaaagctgatccccctatatctaaagaggttcttaccaaagctttccaagtggataagagcataattgattatcttcaaaagcagtcttggtatgataacaactagt

SEQ ID NO: 7584 - DNA, 827 bp, Lotus japonicus
acacaagaaattacatacatacacagaaccattaaggagtaatatagtgagaggcaaaatgaaagttgtgtacttccttgttaccatcttggctttggcatcctcttttgcctctgcctatgaccccagccctctacaagacttttgtgtgggaatcaatgacccaaaagatggtgtgtttgtgaatggaaaattctgcaaagaccctgctcttgtgaaagctgaagatttcttcaaacatgtggaacctgggagcacctctaatccacttggctctaaagtgacccctgtcacagttgagcaactatttggactaaacacacttggcatatctttggctcgcatagattttgcacctaaaggtttaaaccctccacacactcaccctcgagccacagagatccttatagtccttgaaggaactctctacgttggatttgtcacatccaataacgcaaatggtggtaatcgtctcttcactaaagttctcaacaaaggtgatgtttttgtgttcccaattggtctcattcatttccaattgaatgtgggatctggaaatgctgttgctattgctggattgagtagtcaaaatcctggagttattaccattgcaaatgctttgtttaaagctagtcctccaatttctcaagaggttcttaccaaagctttacaggtggataagagcataattgataatcttctaaagaagtcttggtatgacaacaactaatattaatactcgtttcattcagattgtataagaatcttgtactgatgtcacctcatgcaatagccttctctatacaattgctattgtaataaataaa

SEQ ID NO: 7585 - DNA, 924 bp, Glycine max
aattcaattctcacaagcgaaatcatttaagataagagtgcattactactaagaggagaaaaaatgaaagttgtatacttccttgttgctatcttggctttgacatccactgtggtctctgcctatgaccctagtcctctgcaagatttttgtgtggcggccaaagaaaaagatggtgtatttgtgaatggaaaattctgcaaagatcccaagcttgtgaaagctgaagatttcttcaaacatgtggaacctgcgaatactgcgaatccactaggttcacaagtgactccggtctttgttgatcaactacctggactaaacacactgggcatatctttggctcgcatagattatgcaccaaagggtttaaaccctccccacactcatcctcgtggtactgagatccttatagtacttgagggaactctttatgttggatttgtgacttctaatcaagatggaaatcgcctcttcaccaaagtgctgaacaagggtgatgtgtttgtcttcccaattggtctcattcatttccaactcaatgtggggtatggtaatgctgttgccattgctggtcttagtagccaaaatccaggaactatcactattgcaaatgctttgtttaaagctaatcctcctatttctcctgaggttctcaccaaagccttccaggtggacaagagcacaattgattatcttcaaaagcaatcttggtatgacaacaataactagatttgaaatatggacgattatttgacgctaattatggatatttgattacttcaatatgtcaatcaccgtaggcaattgacctacaaatagttattattgtaataagtaaaatgtctgtggtttgtatttctttaccgtgtagttgttctgttttgtgtttgatatagttcaatatattgtttgagtttaatgaaa

SEQ ID NO: 7586 - DNA, 1037 bp, Glycine max
caataaagaattaattagggtatagttaaactgcaaaccaattcaatgcttcatccttatatatagcaagcttcacatgcaggaaaaattcaattctcacaagcgaaatcatttaagataagagtgcattactactaagaggagaaaaaatgaaagttgtatacttccttgttgctatcttggctttgacatccactgtggtctctgcctatgaccctagtcctctgcaagatttttgtgtggcggccaaagaaaaagatggtgtatttgtgaatggaaaattctgcaaagatcccaagcttgtgaaagctgaagatttcttcaaacatgtggaacctgcgaatactgcgaatccactaggttcacaagtgactccggtctttgttgatcaactacctggactaaacacactgggcatatctttggctcgcatagattatgcaccaaagggtttaaaccctccccacactcatcctcgtggtactgagatccttatagtacttgagggaactctttatgttggatttgtgacttctaatcaagatggaaatcgcctcttcaccaaagtgctgaacaagggtgatgtgtttgtcttcccaattggtctcattcatttccaactcaatgtggggtatggtaatgctgttgccattgctggtcttagtagccaaaatccaggaactatcactattgcaaatgctttgtttaaagctaatcctcctatttctcctgaggttctcaccaaagccttccaggtggacaagagcacaattgattatcttcaaaagcaatcttggtatgacaacaataactagatttgaaatatggacgattatttgacgctaattatggatatttgattacttcaatatgtcaatcaccgtaggcaattgacctacaaatagttattattgtaataagtaaaatgtctgtggtttgtatttctttaccgtgtagttgttctgttttgtgtttgatatagttcaatatattgtttgagtttaatgaaagaatcatatgcctccctttcatgctcg

SEQ ID NO: 7587 - DNA, 869 bp, Cajanus cajan
caaatctcacaagtgttacatatatacagtagaatcatttaagactaagaggaaaatatgaaagttgcttacttcgttgttgccatcttggctttgacattctccgttgtctctgcctatgacccaagtcctctgcaagatttttgcgtggcagtgaaagaaactgacggtgtgtttgtgaatggaaagttctgcaaagatcccaagcttgtgaaagctgaagatttcttcaaacacgttgaacctggaaaaactgacaatccattgggttcacaagtgactcctgtgtttgttgatcaactcccagggctaaacacacttggcatatctttggctcgcatagattttgcaccaaagggtttaaaccctcctcacactcaccctcgtggcacagaaatccttatagtccttgagggaactctctacgttggatttgtgtcatccaatcaagatggaaatcgtctctttactaaagtgctaaacaagggtgatgtatttgtgttcccaattggtctcattcattttcaattgaatgtggggtatggaaatgcagttgccattgctggtctcagcagtcaaaatccaggaactatcactattgcaaatgccttgtttaaagctactccacctatttctgtagaggttctaaccaaagctttccaggtggacaagagcacgattgattatcttcaaaaacaatcttggtacgacaacaactaatttggaagcatggatgatcatttgatattagttattggataattgatgattgatgtttcaatagccccaaataatagaactccaaataattactaatgtaattaataaatgtatgtgggtttcttttacatacataattgttctttttg

SEQ ID NO: 7588 - DNA, 943 bp, Cajanus cajan
aaatctcacaagtgttacatatatacagtagaatcatttaagacttaagaggaaaatatgaaagttgcttacttcgttgttgccatcttggctttgacattctccgttgtctctgcctatgacccaagtcctctgcaagatttttgcgtggcagtgaaagaaactgacggtgtgtttgtgaatggaaagttctgcaaagatcccaagcttgtgaaagctgaagatttcttcaaacacgttgaacctggaaaaactgacaatccattgggttcacaagtgactcctgtgtttgttgatcaactcccagggctaaacacacttggcatatctttggctcgcatagattttgcaccaaagggtttaaaccctcctcacactcaccctcgtggcacagaaatccttatagtccttgagggaactctctacgttggatttgtgtcatccaatcaagatggaaatcgtctctttactaaagtgctaaacaagggtgatgtatttgtgttcccaattggtctcattcattttcaattgaatgtggggtatggaaatgcagttgccattgctggtctcagcagtcaaaatccaggaactatcactattgcaaatgccttgtttaaagctactccacctatttctgtagaggttctaaccaaagctttccaggtggacaagagcacgattgattatcttcaaaaacaatcttggtacgacaacaactaataatttagaagcatggatgatcatttgatattagttattggataattgatgattgatgtttcaatagccccaaataatagaactccaaataattacgtactaatgtaattaataaatgtatgtgggtttcttttacataccataattgttctttttttgtagtttgatttggtttaatacaatgtttgtgactttagtaaatgaactgatttttgttggagtt

SEQ ID NO: 7589 - DNA, 747 bp, Glycine max
aagctattacatatatcagaatcattaaagataagattatattgctaagaagaaaaaatatgaaggttgtctacttgcttgttgccctcttggctttgacatcaactgttgtctctgcctatgaccctagtcctctgcaagatttttgtgtggcagccaaagaaaaagatggtgtatttgtgaacgggaaattctgcaaggaccccaagcttgtcaaagcagaagatttcttcagacatgtggaacctgggaaaactgacaacccactaggttcaaacgtgactcaggtgtttgttgatcaactaccgggactaaacacgctcggcataggtttggctcgcatagattttgctccaaagggtttgaacgctccccacactcaccctcgcggcactgagatccttatagtccttgagggtactctttatgttggatttgtgacttccaatcaagatggaaatcgcctcttcaccaaagtgctgaacaagggtgatgtgtttgtgttcccaattggtctcattcatttccaattgaatgtgggatatggcaatgctgttgccattgctggtcttagcagtcaaaatccaggagctatcactattgcaaatgctttgtttaaagctaatccacctatttcttctgaggttctcaccaaagctttccaggtggacaagagcataattgattatcttcaaaagcaatcttggtacgacaacaataactaatttgggagaatggacgatcatt

SEQ ID NO: 7590 - DNA, 945 bp, Glycine max
aatccaattctcacaagctattacatatatcagaatcattaaagataagattatattgctaagaagaaaaaatatgaaggttgtctacttgcttgttgccctcttggctttgacatcaactgttgtctctgcctatgaccctagtcctctgcaagatttttgtgtggcagccaaagaaaaagatggtgtatttgtgaacgggaaattctgcaaggaccccaagcttgtcaaagcagaagatttcttcagacatgtggaacctgggaaaactgacaacccactaggttcaaacgtgactcaggtgtttgttgatcaactaccgggactaaacacgctcggcataggtttggctcgcatagattttgctccaaagggtttgaacgctccccacactcaccctcgcggcactgagatccttatagtccttgagggtactctttatgttggatttgtgacttccaatcaagatggaaatcgtctcttcaccaaagtgctgaacaagggtgatgtgtttgtgttcccaattggtctcattcatttccaattgaatgtgggatatggcaatgctgttgccattgctggtcttagcagtcaaaatccaggagctatcactattgcaaatgctttgtttaaagctaatccacctatttcttctgaggttctcaccaaagctttccaggtggacaagagcataattgattatcttcaaaagcaatcttggtacgacaacaataactaatttgggagaatggacgatcatttcgcactagctagttattggatataattgaccactttatggtttcaatcaccccatacaatagacctaataaataaaatgtatgtgggttatttttatatttcatatttgttcttttggagtttgattaatttggtttaatacactgtttgagtttaataaaagaacctgttcttctttgagtt

SEQ ID NO: 7591 - DNA, 7598 bp, Glycine max
attttatggtttaggtttcagccaaaaaaattgacaatataaaactcaaaggaacctaaactaaacacaattcatggttcaagaacaagaacaaggaatttgaatcatagaaaatcaaatctagcttctatagcaagcttaatcggtggaacttctaaaaaattatgttaacaacattcagcacaacacacgtgaggagatacatggagagaaacgaagaaacaacaacggaggagaaagtaaagctgaaaactaatggagctttaaggagcacctacttgaagctcttgtgctctgataccacttgttggaagcttacttatgaagagaaatggacccaaccttgacctatgggctcagaaatctacctttaggttcatgagaaccctatggtcttcttcagcagctctagtccaaccctcttggaacctcttgctcatggctctggtgactggtcccttcccagggaggattgcatcaaatatgtttagccaaggatcaattccatcatgagaagactcaacacattgacatcagataccactttatccatgttgagaagaggctcgaaatccagaaagttgataccacttcattcatggattatatagtcacgtagaaaggagtgttcagtctagttgttcattaacatagcttgtgttgtaattgtaattgttttctttttcttatttgcttttctaacagttttctagttggacagttagttgttttctcctttataatgagatttatgttttacattcaaagagcttgagagtgtatttaactcttttcattccaaattttgttatttacaataaatttaacaatttatgcgatatcttttctcattctatgatctaaacttccctatctaaatagtatttctcaaatatttcccaacaagaaatatggaaagcacaaaccacaaaccaaaaacagggtagtaaaaacccaaatagaagaggaaatgaaacatagatgttcgaacggtttgatcaagaaacccattaatatgcctaataatagaaacagtaatgcagtcagatttagtgctcatatagatatattagtagttcttccaagataatcacaacatgcaacaacaaacatattatttagattcagtgcttaccaaaatggattcagtgtctccacatctctttttctcctccactttatccgatgtgaaactgcaccatggtcgacgcaccatgatattacgagaaatagagaaataaagaaagagaacaacgaagatgaggttataaaaattaggctgttgaagatagagacacaaacaatgtaatctcttcatcatcgttctctaacccttttactactagttccacgactttagtggccaaatcagtgtgtgagagagaagaattgcggtttgatgcgctgctggtggtttggggcgaggttatggtgggtggaggcacataagataagaatgagaaggggcacaggttcccattcatccaaacccataatacaaaatgggaatgggtgcgagagggttactagagtggagcatgagagtgaaagttggaggcgagagtgggagggggttttgtgatgttgaaggaaacaaaacattttcacattttagagtgactttggtttagtgatatagagggaaagacgaaatgagacggtgtgtatttgtttatggatagtaaaaggggtacatatgatggctgattaattagtctcccttaagggtgaccgcaaaatcagtaactgattaaaatttgcaatacccaacctctaaaatgatatttttacccccaaatctttaaagtcaatttttccatataagaaaaggtgtttttggaaaaaaaatgttggaccaagtccccttgagtacttgtcatgcatttctctcaaagttatatgacatagacatattacaccctgaaatcgggtataaaattcaaaagttatgcttgatcaaataaagcaatggaaacaagattccattttagacaagaaaacaagtatcgaataatgccaagttgacaaagagtaccaggattgagaaaaatccctccttcagttatctttgtatcccttgatttgtatccaggactcattcataaattgagatgaatgaatggctactttcttctctaaagtgtatagcggtgataaataaatatccgaaataacaaaaattctgaattaatttctgaatgtgaaaaaagtgtaataattatgtatcgtcattaagttttgtggatcattctgtccttatgatataatatgcgtaccaatttaacattaaattataaaatttaaggaataatttgacaataagttataaaatttagtggcaaatttaaaaataagttgtatggtaggacgtaatcatcaccttttttatacatttaagactaaaccagaatttttatttttttcaaaaattacattatcgatgtaagaacgaaggtggtcctataaaaaaaaaaaacaaggtgactatttattcaatgacttagttatttcctactacaactatttcctttaaggttgggtttacctatccaaaataaataaaaactaaaatactattctgtttcagtttgaaagttttctatctccacgggaaattatttattaaaactaagccccgaagcaattccagcaggtcgtgcaaagtcaaaagttatatatctaacatttaatatattccgctgtacgttcatatcttcgaacatttctatgtcattggattactttagttgtatatgaaaacaagtcacacgacaccaacaattaatataatttcgggttgcaataatctgagtctttgattaattgtggacaggaccaatcagaaatagtctctaatcccttcataaaatatcaattttccacctactacctctggtgaccatgtttaaacttgtaacagttcctcaagctaaaaaaagattaggcacgcatgtagttgttaaggaatgattcctcatcaaataaataattaattacggtcaagataaaatgcaaaccaattcaatgcttcatacttataaatagcaatcagcaagctctacataaatcacaattcaatcatcacaagcaattacatatagcacaattgtttaagagtgtattactaaggaaaaacaatgaaagttgtgtacttccttgttgccatcttggctttgacatcctctcttgtctctgcctatgatcctagtcctctgcaagatttctgtgtggcagccaaagaaaaagatggtgtgtttgtgaacgggaaattttgcaaggaccctaagcttgtcaaagctgaagatttcttcagacatgtagaaccggggaagactgacaacccagtaggttcaaacgtgactcaggtgtttgttgatcaactaccgggactaaacacgcttggcatagctttggctcgcatagattttgcaccaaagggtttgaacgctccccacactcaccctcgcggcactgagatccttatagtccttgagggtactctttatgttggatttgtgacttccaatcaagatggaaatcgcctcttcaccaaagtgctgaacaagggtgatgtgtttgtgttcccaattggtctgattcatttccaattgaatgtgggatatggcaatgctgttgccattgctggccttagcagtcaaaatccaggagctatcactattgcaaatgctttgtttaaagctaatccgcctatttcttctgaggttctcaccaaagctttccaggtggacaagactataatcgattatcttcaaaagcaatcttggtacgacaacaataactaatttgggagtatggaggatcatttcgcactgtctagttattggataattgatcactttaattattatttcagtcacgccatacattagacctaataaataaaacctttgtggattataattttttacatataatatttgttctgtttggagttcgatttggttaatacttgccctacgcgtctgctaccacgggcatattcagttaggctggttttaggtaacaggtagaagatattttcaggtaacaaacatattaattaataccctaagtcacccataaattgtccctacattgaagtctgcctagtccaccatactacatacccttaaaggccaaagcatttacaacggtgtttacaatttaaacctaaagttcagcaagagaaaggataagtttgaaaattaactgactattaattgtctcatgaagtgagacaaaatcttaacagttagtatttaatttaacgaatagattgttagatattaattagaaaaataataataacaagttttatgagccttaaattgtggaagatgaaagaggcatggctctcgaacgtgatctcatagattacctcaaccaatccaccttggatggccttgacttaaccatctgctactccgagggccctttattgtttgatccaatattgaccggggatgagccctaacttccataggtctttggtgaacgcaagcgacaaatatatatatatatatatatatatatatatatatatatatatatatatatatatatatatatatatatatatatatatatatatatatataaccattctaatccaaaggcttatatgctccacaccttgggttgcccaagagagcccgagggcatgattctatcttagttgtagtggataggttttctaatatgacacattttcttcccaaccgtagctgaacttggtaaccaaactctttctcgacagactggtggaaggggtgactatcaatttcaatatcaatctgtcactgaataaaatatgaatacattagatttcgcttaccatcaccatcaaaaccaaacacaaaaacaagcatttatagaagactaacctttcatcatcgagaatgagaacgagagtgagagcgagaaagagagcacaagagtgagagcaagaacaagagcgcgagagtgagaatgaaagtcagagatgatagcgagagcgagaatggtgtggagataagtgagagcgagaacgagagcgagagagatgagtgagagtgtgaatgagagcgtgaaagatgagtgatagtgagaatgagagcgcgaaagtgagagatggttcagaatgagcacgagaagaggaagaaacagatttaatttaactaacacgatgccgattttccaaaaaaaccaacgttaacataattttgttaatgttggtttttggataaaccgatgttaacatgagttcgttaacattggtttttataaatcgatgttaacgaactcatgttaaaaaacctatgttaatgaactcattttaatatcgattttttcaaaaaccaactttaatgaactcgcgttatttacgaatatgccaccgtgtttttcttagcatcagttttttaaaaagccgatgttaacatagcgatgttatatccattctttccattagtgatgactacaaaaccattcctgtctgttggaatgaattggattatcgagttgagggatgccccatcttcccttcaccgataggaaccttgcttgagtcatcatagtctttctgacttggcattgtcattgttcctaattcttaatagaaaaaccatgttttccccattttttagtttttgatccatagttttgtgattctttttcatggatcaagctatgatccattgtaactaacttgaagttgttggaattaaatgaagtagattcagagtatgcgattctccaatttctaattcatttctcagtttatgcaattattttctacttctttacttgaattcatgcaaaggcgtgatcaaccttgcttaatgagttgagttgtattggaaaacaagttcaattctatatttgaatcaagaatgtgtaggaatctagtttttggaatgaaattaagttgttacattgcattgtttctttgttcatactctaattgctaggttaggtttactaagggatcaggaatctaatttaggaattaagaatcatttacctacgaaattaggatttgattacttgtgttgaaattcagaatatgattggaaatcgaatagcatacaatgaattttatggaattcgaatctaacaccacctttttcaattgatttttgcattcttcactacataactttattctaaaaaccagaaaacattttcttaatcgctacaatgagagcactttttgcttgaatgaaaccatcttttggaattgataaaaaaaacactctactatttcgccacaattgtttcacaacttatttcaccaaaattgctcccttgcttcttatttttcttgctcactaaaaaaaaacatgatttagcgaacaaatagttcggtcgcttaaactgttagcgaccaaaatgacaaccgaatactgtgcatcacaaaaaccctagtcaccaagacattcgcgaccaaataatcattcggttgctatttagaaactgaaatctttagcagctggtccataaaattcagtcgctgcatatttggttgttgttttacttagcactaaatcaacgatcgaagaattctgtagctaaaaaataattaaaattaaaattaaaaattaaaatataactcggtcgccaagtcggtcactatcaaataactttttttaaataaaactatgtggttgctaattaagtcgctaaaaaataattaatttcaaaataaaagtaatgaaatacaattcggtcgctaattcgatagctataaaataataaatttttaaaggttaaatttctcatttgattcctatagtttcacgatttgtaccttttagtccttttagtttaaatgtggattttttagtccatatagtttatattttaattctcttttggtccttatggttttaaagtggtctttttagtccttatagtttgtattttaattctcttttagtccctatagtttgaaagtgatttttttagtccctataatttgtattttaattatcgtttagtccttattacaaaaaaatgttataaatatatttaactacaaattagttataaattatcaactattttttattacaaattatcttgggaaaaattagttatgaattatttgctaatatttttgtagttaattgtaattgataatattactgatattttgatggtaaggactaaaaagaaattaaactataaagtataagaaataaaaagaccactttcaaactatagggactaaaagggaattaagacgcaaattataaatactaaaaaaaccagtttcaaactagatggactaaaagggaattaaaatgtaaactatagggactaaaaaaaccactttaaaattataaggactaaaatgtgcaaatgatgaaactataaggactaaattagtaattaaactattattaaaatacatttataaagaaatgcattcggtcgctaataaataattaattttaaaatataaaataaatcaaaaatgcaattcggtcactgttaaaatatttattttttaaataaaaaaataaattaagtcggtctcaaattaagttgataaataaaaatatggttatttttcatttattatattttggcttgcttaataattatcgactataaat

SEQ ID NO: 7592 - DNA, 13377 bp, Glycine max
tgtatgctagatccatgagccaaggaacaaaaccccattcatggacctccattgcagatctactcagatggaattcgttgaccatgtctcatatttctttgccctctcttttatgctttgccgtatcgtttgttctaaccatggccaataaacatcttcaacgaccatgatttctttgattaactatataagaatattctataaaaaggttgaatatgtgcttgaagattgtaatgaggttctcgtcaaaatcaacaaatttgtcgtcaacaaagaaggcttagtatgtgtggaaacgttgtgtatgcctgttactaaaccagaaagatttgagttggatgcttttgagttagatgaacctgaagatgctggcagaatgccaccatactttacttattgcacactgtgtacagaggcagagagaatctcccattacttactgtgcactatgttgccttgaaattgtggaaactccaaggatgttagatgtacctgaatctcaggattttggcattccaatttttattgagataaaatccttttggaatctcccgaaacaaatgaagtgcctaatttgatggatgaggaaacaaattcatgtggaactatataaccaatcagagttatgtaagaacccttgcaactatataaccagttaagtttcactattttaatagtgcatgatttctttatttttttctctttagtagttggctttggaaatatatggaatgtaagttcaacaaaagaaggagggtttctaactcagaggtgaaaataggagaccatattatccctcaagtcacacggtttaaatatcttgggtctgtaatacaggatgatggggaaattgaaggggatgtgaatcatcgcattcaagcaggatggatgaaatggagaaaagcatcgggggtgttatgtgatgcaaaggtaccgatcaagctaaagggaaagttttatcggactgcggtaagaccggcgattttgtatggaacagaatgttgggcggtcaagagccaacatgagaataaagtaggtgtagcggagatgaggatgttgcggtggatgtgtggtaagactcgacaggataaaattagaaacgaaactattagagagagggttggagtagcgcctattgtagagaagatggtggaaaatagacttaggtggtttgggcatgtagagagaagaccggtagactctgtagtgaggagagtagaccagatggagagaaaataaacaattcgaggcagaggaagacccaaaaagactataagagaggttatcaaaaaggatctcgaaattaatggtttggatagatgtatggtacttgatagaacattatggcggaagttgatccatgtagccgaccccacctagtgggataaggcgttgtttgttgttgttgttgttgttgatgccctttcagttaatggatcaactttgtctgattggaatataagtatataaatctccaatgcaacgtggaacttatgttagtccttttgctctttcttagcaatcatattttgtagcagcagaataattcaagcatgcttaattatgaacttcttatgtgatagcctaccaaaaagtatattcatcttgatgctataatttgtatcaattaattcattttaagttattcttaactgtatattctcatacctgtacagcctcaggatttttctccttccggtgtgattcacttgaggtattacagacatcaagaaaataagaaaataagcagggaatgaaggaagacaaaaagaaagagtgtataatggaaaaagacagggacatcatgataaaacaaaaaaaaaagtagtcattgatatttaaatgaagttaatttatctgacagacacaatatcctttcccatgatgggagacatattacactcttccacgatagccttgatgtacccatggaccaaactcattaaatcagtgagttagccagattaggctaggaaaaaaaccacattgaatgctctacttgttttaaggcttgtggcacatcctgattattggttaaaccaatggtgtacaagctatgacccttacgtacatacctatggttattatatttggtatctagacatttaaaatatcatgatatcggtcctttaatttctttcccctcgttagtcactcaataatttaattttccagtaaattattttgtcaatattttaaaaaggaattcttgttcatatttatcctatttgactcaaatacgattgttttaggtgagagatacaagggatattgaaaaagaaagttaaaaagtaaaagaagactaataacaaaaaagtaagaggcttatttagtaacaaattaaaattttgaaaacttctttaaaagataaatagtttaaaacatctttctagaaatagtttaaacttctttgaatagattctcaagtctactttaggcctaaatgtgcttttggtccctgtaaattaatgtttttttggttcctgtaagttcatttttctaattttagtccttgttcgctctttttcaatttttgtttctgtaagatattgtgctcattttttgttcctactgtaagatattttgttcatttttgaaaaccataaacttacaaggattaaaaatgagcaaagcataaacttattataaggactaaaattagaaaaatgaacacaatgaccaaatatcaaaaaacacaaacttaaaaggaccaagaacatatttaggcctctacttattatatgaattttccataaggaacaaattttgagccaaaacaacaagcacacttccattctcacttctttttatttttcctgtcaacttgtatgatttttttttattttatccaaatcacttggttctttttatataatttttgtctagatgcctagaaaattcagtaaaaagttctgctcaaaattcacagtgacaaattcccagtaatttttataagttcgtatgtccaagctgccagcaccagcgatttcagactttgaattttttaagcatggtatattgatttcctttggttaactttcaactttcctatgtatgttaaattcactaggcctatttaccacagctttaggagttcaacattcacttaggatcaaaatttcagccagcaattcaatcactaaaactcaaattcacaatagacacaatcataaggaaacctaaaagttcaagaaaagcttcacaatcaaagacactctaagaattatgcatgaagatgttaaggactaattaacatgcaagatttgactcaaatcaaattataggttaaaaaaatttcatacactcatgaacaaatgagttagacaaagaaacaagaaaaataaaattcaacacaacataaggaatcttacgtgacaagtttcatgactagacatgacttttatgacaaaactacaataggtgaatatgtcattctagatttttgaggttttcttctactttaatgtttttgtaagaattttatggtttaggtttcagccaaaataattgacaatataaaactcaaaggaacctaaactcaacacaattcatggttcaagaacaagaacaaggaatttgaaccatagaaaatcaaatctagcttctatagcaagcttaatcggtggaacttctaaaaaattatgttaacaacattcagcgcaagacacgtgaggagatacatggagagaaacgaagaaacaacaatggaggagaaagtaaagctgaaaattagtggaggtttaaggagcacctacttgaagctcttgtgctctgataccacttgttggaagcttgcttatgaagcttctatggaggctggatctttgagcttcaataaggtccttcaatggtgatttttagccatggaattgcagcgaaagataaaggagacgaggttagaggagacatcatccactagagaataagccatggaaggagaagcttcaccaccaagagagtggcttggataagaagcttaaagaggaagcttcactggaggaagagaatacgagagagagaggggggggggggggggcgaggtgtgggaattgaaggagattagagtgagaagttgaactttgaagtgtttctcacaagtttttcattcatcaaagttacgacaagtgttacgcatgcttttatttatagcctagcacatgggaagcttccttgagaagcaaggaaggtagcttcctagggaagcaaggaagaaagctttcttgagaagctagaggggggctactcacacccctccaatagctaagctcacccccatgccaaaatacatgaaaatacaaaaaagttcctactacaaagactactcaaaaaagttcctactaaaaagttcctactacatttaagattaaaccagaatttttattttttttcaaaaattacattatcgatgtaagaacgaaggtggtcctataaaaaaaaacaaggtgactatttattcaatgacttagttatttcctactacaactatttcctttaaggttgggtttacctatccaaaataaataaaaactaaaatactattctgtttcagtttgaaagttttctatctccacgggaaattatttattaaaactaagccccgaagcaattccagcaggtcgtgcaaagtgaaaagttatatatctaacatttaatatattccgctgtacgttcatatcttcgaacatttctctgtcattggattactttagttgtatatgaaaacaagtcacacgacaccaacaattaatataatttcgggttgcaataatctgagtctttgattaattgtgggcaggaccaatcagaaatagtctctagtcccttcataaaatatcaattttccacctactacctctggtgaccatgtttaaacttgtaacagttcctcaagctaaaaaaagattagttaataaatgaagtaatattttaaatatttaataaaacagttatcactaagtctatgaaactgagacacagtctaaactgatctgtgattgaattaaaaggcttcccattataaaataataaaatagacgaggtaataccgaaacacttgctttttcctgtagagcgtctactactacgtctacacattgattaggcacgcatgtagttgttaaggaatgattcctcatcaaataaataattaattacggtcaagataaaatgcaaaccaattcaatgcttcatacttataaatagcaatcagcaagctctacataaatcacaattcaatcatcacaagcaattacatatagcacaattgtttaagagtgtattactaaggaaaaacaatgaaagttgtgtacttccttgttgccatcttggctttgacatcctctcttgtctctgcctatgatcctagtcctctgcaagatttctgtgtggcagccaaagaaaaagatggtgtgtttgtgaacgggaaattttgcaaggaccctaagcttgtcaaagctgaagatttcttcagacatgtagaaccggggaagactgacaacccagtaggttcaaacgtgactcaggtgtttgttgatcaactaccgggactaaacacgcttggcatagctttggctcgcatagattttgcaccaaagggtttgaacgctccccacactcaccctcgcggcactgagatccttatagtccttgagggtactctttatgttggatttgtgacttccaatcaagatggaaatcgcctcttcaccaaagtgctgaacaagggtgatgtgtttgtgttcccaattggtctgattcatttccaattgaatgtgggatatggcaatgctgttgccattgctggccttagcagtcaaaatccaggagctatcactattgcaaatgctttgtttaaagctaatccgcctatttcttctgaggttctcaccaaagctttccaggtggacaagactataatcgattatcttcaaaagcaatcttggtacgacaacaataactaatttgggagtatggaggatcatttcgcactgtctagttattggataattgatcactttaattattatttcagtcacgccatacattagacctaataaataaaacctttgtggattataattttttacatataatatttgttctgtttggagttcgatttggttaatacttgccctacgcgtctgctaccacgggcatattcagtttggctggttttaggtaacaggtagaagatattttcaggtaacaaacatattaattaataccctaagtcacccataaattgtccctacattgaagtctgcctagtccaccatactacatacccttaaaggccaaagcatttacaacggtgtttacaatttaaacctaaagttcagcaagagaaaggataagtttgaaaattaactgactattaattgtctcatgaagtgagacaaaatcttaacagttagtatttaatttaacgaatagattccccaacactatgaaaatgatggatttggctcagcagcgatgtactctagtataagattatttttagttattgatatttttttaaaaaaataaaactagaaatttaatttatatataagagatatttcaaatgagaaataaaaagaattaattttaaccatacagttaaaaaaattcaatgattgagattagaaattaattttaacaagtcacctgattttcaatttccatatatctccttccttctttcctttctgacccacttgagaagaatttcaaattaatttttctttgcctttttgcctttttgtttgtcgatcattcggaatctcatttgagaaagatttcaaattaatttatcacacactctctttttgttttgcctttttctttcctagtgtatgctctttctctggaatcaaattcctctgaatcaattctcttactaaaaataaaaaaattaagcactgattatagaacatgccacttaatggatagaagaaaaaggatattgccgaaattcagagtattattctataatttcacagattaaaaactaacactttgaaaattggaaggataattcataattgtttgaaggaaggccaaagaaagttaaacaggaaacggtattgcgtgccaaagaaggtgaagacaaagaagagagaaaaagagtgcatgaatcttaaccctcccatgcttctccaccacaacagaacggtgtttgcgaaaaactacatcggttaagcaaaactgaaatgctataaagattcatatgaaaaaacactcaatgatattagaaaaaattatagaaaaacacatggtaacttgttagagaaaaatgtcctacgttgatttatttttttcttggtagtagttaatttaattatcgaatattacaataagtgtttttaaaagagttaagtagcgataaggtattttaatccttaaaagatattttatcctcgaaatttacttgaaccaaacagttctggacacgacttcctcatcatacactccacctactaatttgcattgaggagtagttcctcctcaaacaatcttcatcaaaggaatcacctcccttctttgccgtctcacctttcaatcttcgacttcaagaagacaacgtttcatcagtcaagttctttttacttgaatatttcccaactcgatcatatgtgatggagaatcatgaacatacttcaaagtttataaaaatgaaagacactatgaatatttaaaagtgacaggagtaaaacaatttggtaggtgtgtgaggaaaagaaatgagatgtgtgtagaagagagggatagaaaagaaaatagtaaaaaacaaaaagaaataggtgatgtaatgagtaatggaattacggtttttttagaaagagagatgaatgataaaaatatttaaatatgataagtaatataaatggacaacatgagagagaagtagagaaaagataaatagagttgatgacaactaacaaggcatgaagaactccttgatatcaattacaacagatttatttcgatcatgctaaaatggtacataggttcaatatttccaaattataataattgaactgatgacaaaggatgctacaccattatatatatatatatatatatatatatatatatatatatataacttttcttttttacagaatatgttttcatctgtaggaggattatgaagatggagatgaattgtgaagctggatttatgtgtgcacaagtctcacgtatagtgcatcaaacaggtggctcgtgcacaggaaccaatacccgggctgcaaaccaaaaataaattttgttgactatgaaaatgaagattatcttatttgtaattcggatttttagacctccattaattgcttcttgatttaatgttaaaggggcgtagagaatattcaatgtatatatgaaaattgtaacaaattaaagggtactaagatctccggatcaattcatctttataaataatttttatagcctgtacatttgtttatttcggttcagttcaatatatgaacctatatttgctcccattaacatgttaattatatttaattatattcaaggttggtaagagtataagagcacatttatatagattgtgtttgatggtgcttacctgaaaaatcttgtaagttttgtttataatctgccttgtggaatccaagttaatgttatgctatgtttttcatttcattttttccttttgcagacaagattttgcaatagagttcttggctatcttatttttggcactattagaatatttttcataaaggttgaatatgtgcttgaagattgcaatgaggtgctcatcaaaatcaacaaatttgtcgtcaacaatgaaggcttattctattgtttgagtaatacactgttaagtgaaacagaatttgtgtgtaaaactaagggaataatttttagccttacgtgaataatgtttcttccattttatctatgcaagtatttttgttattatttatcttcagctcttcactaatactagtgtatgctctttcacttcaatgtatatagttagaaagagcataaagagtgcaaaaggcttagttcgttaacctttcccaagagaatcccatcgtacttcacttactgcacactgtgtaaaaagatagagagaataatatacaatttccattcttcctaatagattctacaagccttccatgtaagttttattttatcactttttctttttgtttataaactcttctatctttactaacattgtttttctccaggttcatcctttgagcttcaattcatattctctaaaaatcaaataaaaatgcctaattccctttagctgctggcactccgctaagcccttctcaatcctcagattcccttaaaattgtggaaactccaaggatgttagatgtacctgaatgcttctagcattccaaactttatagagataaaatctttgtagaatctctagaaatgaacaaagtgcctaatttgatggacgaggtaaagaataactaaatgatgaaaatactctttaactttctaacagacacactgtgagtgggttgcaatatattcataattgtctccacataaacttgcataaagataaaccatattgttgtttgagctaggaactttgaattagtatgaaactttagattctaagttagaggaaacttatcctagtactaaccctttgttttattatgtttgtctcaggaaacaaattcatttggaactaaccaatcagaattatgtaagaactctggcaaatcttcagttaagttttattaaagtctatgttttgcttaatagtgcatgatttctttattttttctttacagtagttggctttggattgtcgacaattcaattattgtttacaatactggcttatgatggtcttctttgatgatgtaccagaaagttgcaagttgcttgcatcagagttttctacgtgcaagaaaacaaagaggggaggacaccacaaacttttcacaagtttttggaggccaggagtggacagaatctgcactactgttttatgaaaagtttggtgacttctgtaaaaaaataaaatgtcgggtgcctatttttctgatggcaatgatgtggaaatctgacttatgttttcttgtcttgctactcttcttgttctgttgatgacatacttttgttaaaggatgaaaaattgttcttaataatagtcaactctacttttatctgagtggatataacatgaaattgtggaattataattgtctagttggttcgtcaaagaaaaatgatgtacatctataacttttttttagggtgattgatgccctttcatgcaatgcatcaactttgtttgattggaatataagtatataaatatgcaatgcaaggcaatggggaacttatgtcaatgacgttggtgaccaatgaatattataccctgaaatcgatcataaaagtcaaaagttatgcctgatcaaatgaagcaatggaaaccaatgaatcatgtttccattgcatttattcagggtggaaaaaaaatacaacggaatgctgtttccgttgcatatatttggggtggaaaaaattaaaatagaaggaaaatatggtttcgttgtatagttttagaaaaaaaatcttgttattgttattgggtcttgattagtcattagtgatattcttgggccttaatggaccttggtcaatcatcatgggttatacttaggctttgttggatcttggtcaatcattagtgttatacttgggccttggtcagtcattagtagtacacattggccatggtcaatcattagggttacacttgggcattattggacattcattaatcataagtgccattgttgggccttgactaatcataagggctacacttgtgctttattgggccttgattagtcattaatgatatacttgggccttggtttgtcattagcgttatatttggatcttattgggccttagtcagtcattagtggtatacctgggccttaattgccttggccaatcatcagtgttacacttgacccttattggaccttcattaatcataagtgttattgttgggccttgattaatcataaatgctatagttgggccttcattagtcattaatgatatacttgggccttggttagtcattaacattatatttgggtcttattaggcctttgattagtcatcagtggtatacttaggtcttggtcaatcattaggattacacttgggccttaataagccttggttaatcatctagattacagtcggtccttattgaactttcatcaatcttaagtgctacacttgggctttattgagccttgactagtcattagtggtatacttgggccttggttatacttgggacatattgggacttgcttaatcatcaatcggtatgcaactacgatgttttgttaactagtgaccaaaataaattcagtcattattcgtaagtattaatgactgaattagaaacagtcgctaatccaattaacgtaatagttgcctaatcaatctccaggttttctagaatacattttaaacaatattgcaattggattagcaactatgcgggttgctaccaaaacattgatcgccaatacaatcactgatttgggcaaataacaaatgatatttttagtctctattggtcacccacttttgttggttgctcattttggtttctattcatcattttctaggagtgaattatgattagtagaatccttcatatgattgtgaaatagaactggatgtagctcagattaagtgaaccaatataaaattgagtgtttttgcttctctcttaaggtatttaaattgtatcctcttatgcatatcctaacacacttagacacacgagtttttgttagagatagggagagctacatgaagataaagctttcaagcttgaagaagtttttcctttttacatgcccaactcattaactgacatttgtattgattgttgtatcttagtctttatctttccatatgtacatcatgcatcataatgtagaggtagggagattgtttctaaagttagaaacttgttcagtgcattaaactctctgttttaattgattaccaagatattcataatagattgcacaagtcttttgagaagcttgcagagagatccttgttttggtttaatcaattaccagctatttataatcgattacttagttcagttgatacaatgtctagttttcatgagtctctgctttaatcaattaccaggtgatcataatcgattactttgttcttggaagtgttcccagaagtgatcaaggtttcacgaagaacattttaatcgattgaaatgataatctaattgattacttctttgaaataatcgattacattagaaatttaatcgattacaagtagttataactgttttctctataaatagtcaccttgtgttctcactttcaatgaatgagaataagtgttttagaatgagtttgtgtgactcacagattctagtattgatttttgaagtgttgaaggtaagagtgagtcgttaacatcttgtgagatcaataagagatccatttaatcaagcattggttcttgcatttgaatgaccaggttgtgtctctccttgacttaagttttcatatgtttttacatgttgtttagcatatgcatgagtatctgaaagatgctagaataagaatttctagtttgggctaagggtaggtgtctcttaggctcttattcaaaaacaaccctagggttgggtaccttagtctctttttctaggtaggaactaagattaattgtgattgcttgtaagaaatcaaagtgcatggtggaaatataattcagattgaattagataactgaagtagcttctctagagatatagaaccagtataaaaattagtgcacttcttctcttgatcttatctttctctcattgtattcttgatcaatttgttgactttaaagaaacttctttttcaaaagaactttaacaataggattttgtgtaagggtgattgattacatgttgatttttgtgaaaactttgtttttgatacgatccttggtatcaaaagtctttttaaaactttgattttaagtttgatttgatttcaaaaccaatttaccccttacccccctcttggtttgtgagttccattattttttttcagtttgcatttggagtacacctttgtgatgatatcctttttatagaattggacaatagtgatttttttttaacaaatttgtttttctgttcattgaataatacacttgaaacttagttcttgacattttttcttgagaaaatcacaccccttgcgatttttttttatttttatctaacacactatttaaccccctgccttctagtgcgatatatgttatttcaaaagagtgtgaagactcaccacaaca

SEQ ID NO: 7593 - DNA, 10433 bp, Glycine max
acaattcaatcatcacaagcaattacatatagcacaattgtttaagagtgtattactaaggaaaaacaatgaaagttgtgtacttccttgttgccatcttggctttgacatcctctcttgtctctgcctatgatcctagtcctctgcaagatttctgtgtggcagccaaagaaaaagatggtgtgtttgtgaacgggaaattttgcaaggaccctaagcttgtcaaagctgaagatttcttcagacatgtagaaccggggaagactgacaacccagtaggttcaaacgtgactcaggtgtttgttgatcaactaccgggactaaacacgcttggcatagctttggctcgcatagattttgcaccaaagggtttgaacgctccccacactcaccctcgcggcactgagatccttatagtccttgagggtactctttatgttggatttgtgacttccaatcaagatggaaatcgcctcttcaccaaagtgctgaacaagggtgatgtgtttgtgttcccaattggtctgattcatttccaattgaatgtgggatatggcaatgctgttgccattgctggccttagcagtcaaaatccaggagctatcactattgcaaatgctttgtttaaagctaatccgcctatttcttctgaggttctcaccaaagctttccaggtggacaagactataatcgattatcttcaaaagcaatcttggtacgacaacaataactaatttgggagtatggaggatcatttcgcactgtctagttattggataattgattactttaattatcatttcagtcacgccatacattagacctaataaataaaacctttgtggattataattttttacatataatatttgttctgtttggagttcgatttggttaatacttgccctacgcgtctgctaccacaggcatattcagttaggctggatttaggtaacaggtagaagatattttcaggtaacaaacatattaattaataccctaagtcacccataaattgtcccttcattgaagtctgcctagtccaccatactacatacccttaaaggccaaagcatttacaacggtgtttacaatttaaacctaaagttcagcaagagaaaggataagtttgaaaattaactgactattaattgtctcatgaagtgagacaaaatcttaacagttagtatttaatttaacgaatagattgttagatattaattagaaaaataataataacaagttttatgagccttaaattgtggaagatgaaagttgtatggttgtaagttacaaagtcttgaataagtaattatgtgagcatttagtattcttgaataagcaaattatgtgagtggtcactctattttagtataaataggggatcatactcttgtattttgtgtgccaaatgaaagaaaatcttcttcttcttccaacaaaggggcatcagagcttgagttctagagtgttgagagagaaacactttgtgagttgagagatgacaagcaatggcttgagtatgtttcaattccctcgtcttaccaaagagaattatgataattggtgtcatcgcatgaaagccttgttaggttctcaagatgcatgggagattgtagagaaaggttatacccaacctcaaaatgaggctattttgtcaccaaatgagaaggagactttgttgaagtcgaagaagaaggatcaacaagcacttactttcattcatcaaggtttggatgaagctatgttcgagttggtgtcaaatgcaaccacatccaaagaagcatgggagattttgaaaacctcccttgaaggtgttgataaggtaaaaaaggtgcgcctacaaactctacgtagagagtttgaatcattgcatatgaaggaatccgaatctatctcagattttggcaacaaggtgttggctattgtgaaccaaatgaagcgttatggagaaaatatggaagatgttcgtgtggtggaaaagatccttcgctccttaatcgctaaatttgattatgtggtttatgctattgaagagtctaaggatttagactcaatgaccgtagaccaattgatgggttctcttcaagcctatgaagaaaggttcaatagaagacatgatgagccattggagcaagtcctcaaagccaaagcttctttgaaagaaaatggaggagaaagtagtcaaaaagcatgtggacgtggaagaggacgtggtcgtggacgtggtcatggccaaggaagaggaggaagaggagatcatgataattttgacaataatgaatggaggagtcatcaatccactagaagtcgtggaagaggaagaggaagaggtagaaacaattatgaaaaagcatatgaaaggaggtatgataaatctattgttgaatgttttaattgtcataaatatggccattactcttgggagtgtagaagaaatgttgaagagaaggtcaatcttgttgatgataaagaagataaagaagttgaagagtcaacactactactatcacttaataatggtaagaaggaagacaaatgcttatggtatcttgacaatggagcaagcaatcacatgtgtggatgcaaagagaaatttgtggaacttgatgagaaggtgaaaggaaatgtttcttttggagattcttccaaggtgcaaatccaaggaaaatgtaccattttaatttctttaaaagatggtgctcacaaattaatcacggatgtttactatgttcctaaactaaaaagcaatattttgagtttgtgacaacttgttgaaaaggggtatgaaattcatatgaaagtttgttgtttatggcttcgagatcaaaattctaatttgattgccaaggtgtttatgtcaagaaatagaatgttcactttgaacattaaaaccaatgaagcaaaatgtttgaaggctagcataaaagatgaatcatggtgttggcatatgagatttgggcacttgaattttgaagcactaaaatccttaggagaggagaagatggtgaaagggatgcctcacatcaaccatcctaatcaattgtgtgaagcatgtctccttggaaagcatgcaagaaggagttttccaaaagaagctaattcaagagcaaaggagcctctccaacttgtttacaccgatgtgtgtggcccaatcaatcctccttcatgtggtaacaataaatatttcttgctttttattgatgattatagtagaaagacttgggtttattttctaaagcaaaaatctgaggcatttgtagcttttaaaaattttaaagctcttgtggaaaaggagagtggttatgtaatcaaagctctaagatctgatagaggtggcgaattcacatcaaaagaatttaatgaattttgtgaaaaatatggaattcgtcgccctctaacggttcctagatctccacaacaaaatggggtagcggagagaaaaaatagaactattcttaatatgactagatgtatgttgaaggctaaaaatatgccaaaggaattttgggccgaagctgttgcatgtaccgtttatttgtccaatcgctccccaacaaagaatgtcaaaaatcaaacaccacaagaagcatggagtggagtgaagccaagagttgatcatttgagagtatttgggagcattgcatatgctcatgtacccgaccaaggaagattcaagcttgatgatcggagtgagaaacatgtgttcattggctatgatgcaagctcaaaaggctacaaattgtacaatccaaacaatggaaagacaattgtgagccaagatgttgagttctatgaagaaggcacatggaattgggaggagaaagaagacacttatgattttttctcgtactttgaagaaatagatgaagaagccttgactccaaatgattcaactccagcactttcaccaacttcttcaaccaatgaagcctcatcatcttccgaagggagttcaagtgaaaggccaagaagaatgagaagtattcaagaattatatgatgaaactgaagttataaatgatttgttttgtctttttgttgacagtgaacccttaaactttgatgaagcaatgaaagacaaaaggtggagacaatccatggaagaagaaatcaaagccattgagaagaacaacacttgggagttatcaagccttcccaaaggtcatgaagcaattggagtcaaatgggtgttcaaaatcaagaagaatgcaaaaggagaggttgagagacacaaagcaagactactaaaggttataagcaacaatatggagttgattatgatgaagtgtttgcaccggttacccgcatggaaaccattcgtcttcttatttccttagcagctcaaatgaattggagaatttttcagcttgatgtaaaatcggcatttctaaatggctatcttgaagaagatgtctatgttgaacaaccaatgggttttgtcatcgaaggtcaagaaggaaaagtcttgaaattaaacaaggcattgtatggtctaaagcaagcaccgagggcatggaatactcgcattgacaagtacttccaagacaatgggtttgttcgttgtcaaaatgagtatgctctttatgttaaaacttttaataatggtgatgtcttatttatttgtctttatttggatgaccttatcttcaccggcaataacccaaatttgtttgaagacttcaaggagtccatgtctcgtgagtttgatatgacagatatgggactcatgtcatattacttgggaatggaagtgaagcaaacggagaatggtatctttgtctcacaagaaaggtacacaaaagaagtgttgaagaaatttaatatgcttgattgcaatcccgtgaacacacctatggaaggtggcttgaagttatcaaagtttgatgaaggagagaaggtagactccacgatcttcaagagtctcgtggggagtttaaggtatctaaccaatacaaggcccgatattctatatgcggtgggagttgtgtgtcgctttacggaggctcctacctctcctcatttaaaagccgcaaaaagaattcttcgttacttgaaaggtacaattgattttggattgttttattctccctccaataactataagcttgtgggattttgtgatagtgattttgccggagatgttgatgatagaaaaagtactaccggatttatattttttatgggtgattgtgtttttacatggagttctaagaagcaaggcattatgacactttctacttgtgaagccgagtatgttgctgcaacttcttgcacatgtcatgccatttggctaagaagattgttggaggaacttcagttgttgcaaaaggaaagcacaaagatctatgttgataatagatctgcacaagagcttgccaagaatccagtgttccatgaacgaagtaagcatatagatacaaggtatcatttcattagagagtgcattacaaagaaagaagtagaattgactcatgtgaaaactcaacatcaagttgcggatattttcaccaagcctctcaaatttgaagattttcgaagattgcgagcaagacttggtgtgcagaagaattttccaattaagggaggatgttagatattaattagaaaaataataataacaagttttatgagcgttaaattgtggaagatgaaagttgtaaggttgtaagttacaaagtcttgaataagcaattatgtgagcatttagtattcttgaataagcaaattatgtgagtggtcactctattttagtataaataggggatcatactcttgtattttgtgtgccaaatgaaataaagtcttattcttcttccaacatagattccccaacactatgaaattaaatgatggatttgttatttttagttattgatatttttaaaaaaaaaataaaaatagaaatttaatttatatataagagatatttcaaatgagaaataaaaagaattaattttaaccatacagttaaaaaatttcaatgattgagattataaattaatattaacaagtcacctgattttcaatttccatatatctccttccttctttcctttctgacccacttgagaagaatttcaaattaatttttctttgcctttttgcctttttgtttgtcgatcaatcggaatctcatttgagaaagatttcaaattaatttatcacacactctctttttgttttccctttttgttttgttttttatttgttctatggctgctgctagttctctggaatcaaattcctctaaatcaattctcttactaaaaataaaaaattaagcactgattatagaacatgccacttaatggatagaagaaaaaggatattgccgaaattcagagtattattctctaatttcacagattaaaaactaacactttgaaaattggaaggataattcataattgtttgaaggaaggcataagaaacttaaacaggaaacggtattgcgtgccaaagaaggtgaagacaaagaagagagaaaaagagtgcatgaatcttaaccctcccatgcttctccaccacaacagaacggtgtttgtaaaaactacatcggttaagcaaaactgaaatgttataaagattcatatcaaaaaacactcaatgatattagaaaaaattctagaaaaacacatggtaacttgttagagaaaaatgtcctgttgatttatttttgtcttggtagtagttaatttaattatcgaatattacaataagtttttttaaaagagttaagtagcgataaggtattttaatccttaaaagatattttatcctcgaaatttacttgaaccaaacagttctggacaagacttcctcatcctacactccacctactaatttgcattgagcagtagttcctcctcaaacaatcttcatcaaaggaatcacctcccctctttgccgtctcacctttcaatcttcgacttcaagaagacaacgtctcatcagtcaagttctttttacttgaatattgcccaactcgatcatatgtgatggagaatcatgaacatacttcaaagtttataaaaatgaaagacactatgaatatttaaaagtgacaggagtaaaacaatttggtaggtgtgtgtgaggaaaagaaatgagatgtgtgtgtagaagagagggatagaaaagaaaatagtaaaaaacaaaaagaaataggtgatgtaatgagtaatggaattacggtttttatagaaagagagatgaatgataaaaatatttaaatatgataagtaatataaatggacaagatgagagagaagtagagaaaagataaatagagttgatgacaactaacaaggcatgaagaactccttgatatcaattacaacagatttatttcgatcatgctaaaatggtacataggctcaatatttccaaattataataattgaactgatgacaaaggatgccacaccatattatatatatatataacttttcgtttttacagaatatgttttcatctgtaggaggattatgaagatggagatgaattgtgaagctggatttatgtgtgcacaagtctcacgtacagtgcatcaaacaggtggctcgtgcacaggaaccaatacccgggctgcaaaccaaaaacaaattttgttgactatgaaaatgaagattatcttatttgtaattcggatttttagacctccattaattgcttcttgatttaatgttaaaggggcgtagagaatattcaatgtatatatgaaaattgtaacaaattaaagggtgctaagatctccggatcaattcatctttataaataatttttatagcctgtacatttgtttatttcggttcagttcaatatatgtacctatatttgctcccattaacatgttaattatatttaattatattcaaggttggtaagagtataagagcacatttatatagattgtgtttgatggtgcttacctgaaaaatcttgtaagttttgtttataatctgccttgtgcaatccaagttaatgttatgctatgtttttcatttcattttttccttctgcagacaagattttgcaatagagttcttggctatcttatttttggcactattagaatatttttcataaaggttgaatatgtgcttgaagattgcaatgaggttctcatcaaaatcaacaaatttgtcgtcaataatgaaggcttattctattgtttgagtaatacactgttaagtgaaacagaatttgtctgtaaaactaagggatttgggttgttttctcaggagaaggcatgcattccataataatttttagccttacgtgaataatgtttcttccattttatctatgcaagtatttttgtttttatttatcttcagctcttcactaatactagtgtatgctctgtcacttcaatgtatatagttagaaagagcataaagagtgcaaaaggcttagttcgtttccctttcccaagagaatcccatcgtacttcacttactgcacactgtgtaaaaagatagagagaatattatacaatttccattcttcctaatagattctacaagccttccatgtaagttttattttatcactttttctttttgtttataaactcttctatctttactaacattgtttttctccaggttcatcctttgagcttcaactcctattctctaaaaatcaaataaaaatgcctaattccctttagctgctggcactccgctaagcccttctcaatcctcagattcccttaaaattgtggaaactccaaggatgttagatgtacctgaatctcaagcttctagcattccaaactttatagagataaaatctttgtagaatctctagaaatgaacaaagtgcctaatttgatggacgaggtaaagaataactaaatgatgaaaatactcttgaactttctaacagacacactgtgagtgggttgcaatatattcataattgtctccacacaaacttgcataaagataaaccatattgttgtttgagctaggaactttgaattagtatgaaactttagattctaagttagaggaaacttatcctagtactaaccctttgttttattatgtttgtctcaggaaaaaaattcatttggaactaaccaatcagaattatgtaagaactctggaaaatcttcagttaagttttattaaagtctatgttttgcttaatagtgcatgatttctttattttttctttacagtagttggctttggattgtcaacaattcaattgtttacaatattggcttatgatggtcttctttgatgatgtaccagaaagttgcaagttgcttgcatcagagttttctacatgcatgaaaacaaagaggggaggacaccgcaaacttttcacaagtttttggaggccaggagtggacagaatccgcactactgttttatgaaaagtttggtgacttctgtaaaaaaaataaaatgtcgggtgcctatttttctgatggcaatgatgtggaaatctgacttatgttttcttgtcttgctactcttcttgttctgttgatgacatacttttgttaaaggatgaaaaattgttcttaataatagtcaactctacttttatctgagtggatataacatgaaattgtggaattataattgtctagttggttcgtcaaagaaaaatgatgtacatctataacttttttttagggtgatcgatgccctttcattcaatgcatcaactttgtctgattggaatataagtatatcaatctgcaatgcaaggcaacggggaacttatgtcaatgacgttggtgaccaatgaatattataccctgaaatcgatcataaaagtcaaaagttatgccttatcaaatgaagcaatggaaacatgattccattttaaaagtatacaacggaaaccaatgaatcatgtttccattgcatttattcagggtggaaaaaaaatacaacggaatgctgtttccgttgcatatatttggggtggaaaaaattaaaatagaaggaaaatatggtttcgttgtatagttttagaaaaaaaatcttgttattgttattggatcttgattagtcattagtgatatacttgggccttaatggaccttggtcaatcatcatggcttatacttaggctttgttggatcttggtcaatcattagtgttatacttgggccttggtcagtcattagtagtatacataggccatggtcaatcatcagggttacacttgggcattattggacattcattaatcataagtgccattgttgggccttgactaatcataagggctacccttgtgctttattgggtcttgattagtcattaatgatatacttaggccttggtttgtcattagcgttatatttggatcttattgggccttagtcagtcattagtggtatacttgggccttaattgaccttggccaatcatcagtgttacacttgacccttgttggac

SEQ ID NO: 7594 - DNA, 6278 bp, Glycine max
ctaatatttacaaagaaaaatggacccaaccttgacccatgggctcagaaatctaccttcaggttcatgagaaccctatggtcttcttcagcagctctagtccaaccctcttggaacctcttgctcatggctctggtgactggtcccttcccaaggaggattgcatcaaatatgtttagtcaaggatcaattccatcatgagaagactcaacacattgacatcagataccactttatccatgttgagaagaggctcgaaatccagaaagttgataccacttcattcatggattatctagtcacgtagaaaagagtgttcagtctagtggttcattaacatagcttgtgtagtaattgcaattgttttctttttcttatttgcttttctaacagttttctagttggacagttagttattttctcctttataatgagatttatgttttacattcaaagagcttgagagtgtatttaactcctttcattccaaatttcgttatttgcaataaatttaacaatttatgcgatatcttttctcattctatgatctaaacttccctatctaaatagtatttctcaaatatttcccaacaagaaatatggaaagcacaaaccacaaaccaaaaacagggtagtaaaaacccaaatagaagaggaaatgaaacatagatgttcgaacggtttgttcaagaaacccattaatatgcctaataatagaaacaataatgcagtcagatttagtgcttatatagatatattagtagttcttccaagataatcacaacatgcaacaacaaacatattatttagattcagtgcttaccaaaatggattcagtgtctccacatctctttttctcctccactttatccgatgtgaaactgcaccatggtcgacgcaccatgatattacgagaaatagagaaataaagaaagagaacaacgaagatgaggttataaaaactaggctgttgaagatagagacacaaacaacgtaatctcttcatcatcattctctaacccttttactactagttccacgactttagtggccaaatcagtgtgtgagagagaagaattgcggtttgatgcgctgctggtggtttggggcgaggttatggtgggtggaggcacataagataagaatgagaaggggcacaggttcccattcatccaaacccagaatacaaaatgggaatgggtgcgagagggttactagagtggagcatgagagtgaaagtgagattcgtgagcttctacggaaacattagacgaaagttggaggcgagagtggaagggggttttgtgatgttgaaggaaacaaaacattttcacattttagagtgactttggtttagtgatttagagggaaagacgaaatgagacggtgtgtatttgtttatggatagtaaaaggggtacatatgatggctgattaattagtctcccttaagggtgaccgcaaaatcagtaactgattaaaatttgcaatacccaacctctaaaatgatatttttacccccaaatctttaaagtcaatttttccatataagaaaaggtgtttttggaaaaaaaatgttggaccaagtccccttgagtacttgtcatgcatttctctcaaagttatatgacatagacatattacaccctgaaatcgggtataaaattcaaaagttatgcttgatcaaataaagcaatggaaacatgattccattttagacaagaaaacaagtatggaataatgccaagttgacaaagagtaccaggattgagaaaaatccctccttcagttatctttgtatcccttgatttgtatccaggactcattcataaattgagatgaatgaatggctactttcttctctaaagtgtaaagcggtgataaataaatatccgaaataacaaaaattctgaattaatttctgaatgtgaaaaaagtgtaataattatgtatcgtcattaagttttgtggatcattttgtccttatgatataatatgcgtaccaatttaacattaaattataaaatttaaggaataatttgacaataagttataaagtttagtggcaaatttaaaaataagttgtatggtaggacgtaatcatcaccttttttatacatttaagactaaaccagaatttttatttttttcaaaaattacattatcgatgtaagaacgaaggtggtcctataaaaaaaaacaaggtgactatttattcaatgacttagttatttcctactacaactatttcctttaaggttgggtttacctatccaaaataaataaaaactaaaatactattctgtttcagtttgaaagttttctatctccacgggaaattatttattaaaactaagccccgaagcaattccagcaggtcgttcaaagtcaaaagttatatatctaacatttaatatattccgctgtacgttcatatcttcgaacatttctatgtcattggattactttagttgtatatgaaaacaagtcacacgacaccaacaattaatataatttcgggttgcaataatctgagtctttgattaattgtgggcaggaccaatcagaaatagtctctaatcccttcataaaatatcaattttccacctactacctctggtgaccatgtttaaacttgtaacagttcctcaagctaaaaaaagattagttaataaatgaagtaatattttaaatatttaataaaacagttatcactaagtctatgaaactgagacacagtctaaactgatctgtgattgaattaaaaggcttcccattataaaataataaaatagacgaggtacgaaacacttgctttttcctgtagagcgtctactactacgtctacacattgattaggcacgcatgtagttgttaaggaatgattcctcatcaaataaataattaattacggtcaagataaaatgcaaaccaattcaatgcttcatacttataaatagcaatcagcaagctctacataaatcacaattcaatcatcacaagcaattacatatagcacaattgtttaagagtgtattactaaggaaaaacaatgaaagttgtgtacttccttgttgccatcttggctttgacatcctctcttgtctctgcctatgatcctagtcctctgcaagatttctgtgtggcagccaaagaaaaagatggtgtgtttgtgaacgggaaattttgcaaggaccctaagcttgtcaaagctgaagatttcttcagacatgtagaaccggggaagactgacaacccagtaggttcaaacgtgactcaggtgtttgttgatcaactaccgggactaaacacgcttggcatagctttggctcgcatagattttgcaccaaagggtttgaacgctccccacactcaccctcgcggcactgagatccttatagtccttgagggtactctttatgttggatttgtgacttccaatcaagatggaaatcgcctcttcaccaaagtgctgaacaagggtgatgtgtttgtgttcccaattggtctgattcatttccaattgaatgtgggatatggcaatgctgttgccattgctggccttagcagtcaaaatccaggagctatcactattgcaaatgctttgtttaaagctaatccgcctatttcttctgaggttctcaccaaagctttccaggtggacaagactataatcgattatcttcaaaagcaatcttggtacgacaacaataactaatttgggagtatggaggatcatttcgcactgtctagttattggataattgatcactttaattattatttcagtcacgccatagattagacctaataaataaaacctttgtggattataattttttacatataatatttgttctgtttggagttcgatttggttaatacttgccctacgcgtctgctaccacgggcatattcagttaggctggttttaggtaacaggtagaagatattttcaggtaacaaacatattaattaataccctaagtcacccataaattgtccctacattgaagtctgcctagtccaccatactacatacccttaaaggccaaagcatttacaacggtgtttacaatttaaacctaaagttcagcaagagaaaggataagtttgaaaattaactgactattaattgtctcatgaagtgagacaaaatcttaacagttagtatttaatttaacgaatagattccccaacactatgaaaatgatggatttggctcagcagcgatgtactctagtataagattatttttagttattgatatttttttaaaaaatataactagaaatttaatttatatataagagatatttcaaatgagaaataaaaagaattaattttaaccatacacttaaaaaatttcaatgattgagattagaaattaattttaacaagtcacctgattttcaatttccatatatctccttccttctttcctttctgacccacttgagaagaatttcaaattaatttttctttgcctttttgcctttttgtttgtcgatcattcggaatctcatttgagaaagatttcaaattaatttatcacacactctctttttgttttgcctttttctttcctagtgtatgctctttctctggaatcaaattcctctgaatcaattctcttactaaaaataaaaaaattaagcactgattatagaacatgccacttaatggatagaagaaaaaggatattgccgaaattcagagtattattctctaatttcacagattaaaaactaacactttgaaaattggaaggataattcataattgtttgaaggaaggccaaagaaagttaaacaggaaacggtattgcgtgccaaagaaggtgaagacaaagaagagagaaaaagagtgcatgaatcttaaccctcccatgcttctccaccacaacagaacggtgtttgcgaaaaactacatcggttaagcaaaactgaaatgctataaagattcatatgaaaaaacactcaatgatattagaaaaaattatagaaaaacacatggtaacttgttagagaaaaatgtgctgttgatttatttttgtcttggtagtagttaatttaattatcgaatattacaataagtttttttaaaacagttaagtagcgataaggtactttaatccttaaaagatattttatcctcgaaatttactcgaaccaaacagttctggacacgacttcctcatcatacactgcacctactaatttgcattgagcagtagttcctcctcaaacaatcttcatcaaaggaatcacctcccctctttgccgtctcacctttcaatcttcgacttcaagaagacaacgtctcatcagtcaagttctttttacttgaatattgcccaactcgatcatatgtgatggagaatcatgaacatacttcaaagtttataaaaatgaaagacactatgaatatttaaaagtgacaggagtaaaacaatttggtaggtgtgtgtgaggaaaggaaatgagatgtgtgtgtagaagagagggatagaaatgaaaatagtaaaaaacaaaaagaaataggtgatgtaatgagtaatggaattacggtttttttagaaagagagatgaatgataaaaatatttaaatatgataagtaatataaatggacaagatgagagagaagtagagaaaagataaatagagttgatgacaactaacaaggcatgaagaactccttgatatcaattacaacagatttatttcgatcatgctaaaatggtacataggctcaatatttccaaattataataattgaactgatgacaaaggatgctacaccattatatatatatatatatatatatatatatatatatatatatatatatatatatataacttttcttttttacagaatatgttttcatctgtaggaggattatgaagatggagatgaattgtgaagctggatttatgtgtgcacaagtctcacgtacagtgcatcaagcaggtggctcgtgcacaggaaccaatacccgggctgcaaaccaaaaacaaattttgttgactatgaaaatgaagattatcttatttgtaatttgggtttttagacctccattaattgcttcttgagttaatgttaaaggggcgtagagaatattcaatgtatatatgaaaattgtaacaaattaaagggtactaagatctccggatcaattcatctttataaataatttttatagcctgtacatttgtttatttcggttcagttcaatatatgtacctatatttgctcccattaacatgttaattata

SEQ ID NO: 7595 - DNA, 842 bp, Glycine max
tcacaagcaattacatatagcacaattgtttaagagtgtattactaaggaaaaacaatgaaagttgtgtacttccttgttgccatcttggctttgacatcctctcttgtctctgcctatgatcctagtcctctgcaagatttctgtgtggcagccaaagaaaaagatggtgtgtttgtgaacgggaaattttgcaaggaccctaagcttgtcaaagctgaagatttcttcagacatgtagaaccggggaagactgacaacccagtaggttcaaacgtgactcaggtgtttgttgatcaactaccgggactaaacacgcttggcatagctttggctcgcatagattttgcaccaaagggtttgaacgctccccacactcaccctcgcggcaccgagatccttatagtccttgagggtactctttatgttggatttgtgacttccaatcaagatggaaatcgcctcttcaccaaagtgctgaacaagggtgatgtgtttgtgttcccaattggtctgattcatttccaattgaatgtgggatatggcaatgctgttgccattgctggccttagcagtcaaaatccaggagctatcactattgcaaatgctttgtttaaagctaatccgcctatttcttctgaggttctcaccaaagctttccaggtggacaagactataatcgattatcttcaaaagcaatcttggtacgacaacaataactaatttgggagtatggaggatcatttcgcactgtctagttattggataattgatcactttaattattatttcagtcacgccatacattagacctaataaataaaacctttgtggattataatt

SEQ ID NO: 7596 - DNA, 676 bp, Glycine max
aaaaacaatgaaagttgtgtacttccttgttgccatcttggctttgacatcctctcttgtctctgcctatgatcctagtcctctgcaagatttctgtgtggcagccaaagaaaaagatggtgtgtttgtgaacgggaaattttgcaaggaccctaagcttgtcaaagctgaagatttcttcagacatgtagaaccggggaagactgacaacccagtaggttcaaacgtgactcaggtgtttgttgatcaactaccgggactaaacacgcttggcatagctttggctcgcatagattttgcaccaaagggtttgaacgctccccacactcaccctcgcggcactgagatccttatagtccttgagggtactctttatgttggatttgtgacttccaatcaagatggaaatcgcctcttcaccaaagtgctgaacaagggtgatgtgtttgtgttcccaattggtctgattcatttccaattgaatgtgggatatggcaatgctgttgccattgctggccttagcagtcaaaatccaggagctatcactattgcaaatgctttgtttaaagctaatccgcctatttcttctgaggttctcaccaaagctttccaggtggacaagactataatcgattatcttcaaaagcaatcttggtacgacaacaataactaattt

SEQ ID NO: 7597 - DNA, 931 bp, Glycine max
acaattcaatcatcacaagcaattacatatagcacaattgtttaagagtgtattactaaggaaaaacaatgaaagttgtgtacttccttgttgccatcttggctttgacatcctctcttgtctctgcctatgatcctagtcctctgcaagatttctgtgtggcagccaaagaaaaagatggtgtgtttgtgaacgggaaattttgcaaggaccctaagcttgtcaaagctgaagatttcttcagacatgtagaaccggggaagactgacaacccagtaggttcaaacgtgactcaggtgtttgttgatcaactaccgggactaaacacgcttggcatagctttggctcgcatagattttgcaccaaagggtttgaacgctccccacactcaccctcgcggcactgagatccttatagtccttgagggtactctttatgttggatttgtgacttccaatcaagatggaaatcgcctcttcaccaaagtgctgaacaagggtgatgtgtttgtgttcccaattggtctgattcatttccaattgaatgtgggatatggcaatgctgttgccattgctggccttagcagtcaaaatccaggagctatcactattgcaaatgctttgtttaaagctaatccgcctatttcttctgaggttctcaccaaagctttccaggtggacaagactataatcgattatcttcaaaagcaatcttggtacgacaacaataactaatttgggagtatggaggatcatttcgcactgtctagttattggataattgatcactttaattattatttcagtcacgccatacattagacctaataaataaaacctttgtggattataattttttacatataatatttgttctgtttggagttcgatttggttaatacttgccctacgcgtctgctaccacgggcata

SEQ ID NO: 7598 - DNA, 899 bp, Glycine max
caattcaatcatcacaagcaattacatatagcacaattgtttaagagtgtattactaaggaaaaacaatgaaagttgtgtacttccttgttgccatcttggctttgacatcctctcttgtctctgcctatgatcctagtcctctgcaagatttctgtgtggcagccaaagaaaaagatggtgtgtttgtgaacgggaaattttgcaaggaccctaagcttgtcaaagctgaagatttcttcagacatgtagaaccggggaagactgacaacccagtaggttcaaacgtgactcaggtgtttgttgatcaactaccgggactaaacacgcttggcatagctttggctcgcatagattttgcaccaaagggtttgaacgctccccacactcaccctcgcggcactgagatccttatagtccttgagggtactctttatgttggatttgtgacttccaatcaagatggaaatcgcctcttcaccaaagtgctgaacaagggtgatgtgtttgtgttcccaattggtctgattcatttccaattgaatgtgggatatggcaatgctgttgccattgctggccttagcagtcaaaatccaggagctatcactattgcaaatgctttgtttaaagctaatccgcctatttcttctgaggttctcaccaaagctttccaggtggacaagactataatcgattatcttcaaaagcaatcttggtacgacaacaataactaatttgggagtatggaggatcatttcgcactgtctagttattggataattgattactttaattatcatttcagtcacgccatacattagacctaataaataaaacctttgtggattataattttttacatataatatttgttctgtttggagttcgatttggttaata

SEQ ID NO: 7599 - DNA, 882 bp, Glycine max
tcacaagcaattacatatagcacaattgtttaagagtgtattactaaggaaaaacaatgaaagttgtgtacttccttgttgccatcttggctttgacatcctctcttgtctctgcctatgatcctagtcctctgcaagatttctgtgtggcagccaaagaaaaagatggtgtgtttgtgaacgggaaattttgcaaggaccctaagcttgtcaaagctgaagatttcttcagacatgtagaaccggggaagactgacaacccagtaggttcaaacgtgactcaggtgtttgttgatcaactaccgggactaaacacgcttggcatagctttggctcgcatagattttgcaccaaagggtttgaacgctccccacactcaccctcgcggcactgagatccttatagtccttgagggtactctttatgttggatttgtgacttccaatcaagatggaaatcgcctcttcaccaaagtgctgaacaagggtgatgtgtttgtgttcccaattggtctgattcatttccaattgaatgtgggatatggcaatgctgttgccattgctggccttagcagtcaaaatccaggagctatcactattgcaaatgctttgtttaaagctaatccgcctatttcttctgaggttctcaccaaagctttccaggtggacaagactataatcgattatcttcaaaagcaatcttggtacgacaacaataactaatttgggagtatggaggatcatttcgcactgtctagttattggataattgatcactttaattattatttcagtcacgccatagattagacctaataaataaaacctttgtggattataattttttacatataatatttgttctgtttggagttcgatttgg

SEQ ID NO: 7600 - DNA, 866 bp, Glycine max
acaattcaatcatcacaagcaattacatatagcacaattgtttaagagtgtattactaaggaaaaacaatgaaagttgtgtacttccttgttgccatcttggctttgacatcctctcttgtctctgcctatgatcctagtcctctgcaagatttctgtgtggcagccaaagaaaaagatggtgtgtttgtgaacgggaaattttgcaaggaccctaagcttgtcaaagctgaagatttcttcagacatgtagaaccggggaagactgacaacccagtaggttcaaacgtgactcaggtgtttgttgatcaactaccgggactaaacacgcttggcatagctttggctcgcatagattttgcaccaaagggtttgaacgctccccacactcaccctcgcggcaccgagatccttatagtccttgagggtactctttatgttggatttgtgacttccaatcaagatggaaatcgcctcttcaccaaagtgctgaacaagggtgatgtgtttgtgttcccaattggtctgattcatttccaattgaatgtgggatatggcaatgctgttgccattgctggccttagcagtcaaaatccaggagctatcactattgcaaatgctttgtttaaagctaatccgcctatttcttctgaggttctcaccaaagctttccaggtggacaagactataatcgattatcttcaaaagcaatcttggtacgacaacaataactaatttgggagtatggaggatcatttcgcactgtctagttattggataattgatcactttaattattatttcagtcacgccatacattagacctaataaataaaacctttgtggattataattttttacatataa

SEQ ID NO: 7601 - DNA, 737 bp, Glycine max
gaagaatcatttaagataagagtgtattactaagaggagaaaaaatgaaagttgtgtacttccttgttgtcatcttggctttaacatcctctgtggtctctgcctatgaccctagtcctctgcaagacttttgtgtggccgccaaagaaaaagatggtgtatttgtgaatggaaagttctgcaaagatcccaaacttgtgaaagctgaagacttcttcagacatgtagaaccggggaagactgacaacccagtaggttcaaacgtgactcaggtgtttgttgatcaactaccgggactaaacacgctgggcatagctttggctcgcatagatttcgcaccaaagggtttgaacgctccccacactcaccctcggggcactgagatccttatagtccttgagggtactctctatgttggatttgtgacttccaatcaagatggaaatcgcctcttcaccaaagtgctgaacaagggtgatgtgtttgtgttcccaattggtctcattcatttccaactcaatgtgggatatggcaatgctgctgccattgctgctcttagcagtcaaaatcctggagccatcaccattgcaaatgctttgtttaaagctaatccacctatttcttctgaggttctcaccaaagctttccaggtggacaagagcataattgattatcttcaaaagcaatcttggtacgacaacaataactaatttgggagtatggacgagcatttcaca

SEQ ID NO: 7602 - DNA, 933 bp, Glycine max
attaaatatagaagaatcatttaagataagagtgtattactaagaggagaaaaaatgaaagttgtgtacttccttgttgtcatcttggctttaacatcctctgtggtctctgcctatgaccctagtcctctgcaagacttttgtgtggccgccaaagaaaaagatggtgtatttgtgaatggaaagttctgcaaagatcccaaacttgtgaaagctgaagacttcttcagacatgtagaaccggggaagactgacaacccagtaggttcaaacgtgactcaggtgtttgttgatcaactaccgggactaaacacgctgggcatagctttggctcgcatagatttcgcaccaaagggtttgaacgctccccacactcaccctcggggcactgagatccttatagtccttgagggtactctctatgttggatttgtgacttccaatcaagatggaaatcgcctcttcaccaaagtgctgaacaagggtgatgtgtttgtgttcccaattggtctcattcatttccaactcaatgtgggatatggcaatgctgctgccattgctgctcttagcagtcaaaatcctggagccatcaccattgcaaatgctttgtttaaagctaatccacctatttcttctgaggttctcaccaaagctttccaggtggacaagagcataattgattatcttcaaaagcaatcttggtacgacaacaataactaatttgggagtatggacgagcatttcacactagctagttactgtataattgatcactttattgtttcaatcaccccatacaacagacctaataaataaaatttaatgtatgggggttattaatttttatacataatatttgttctgtttggagtttgatttgatttaatacatattgcttgagtttaattaataaaagaacctattcttgctgga

SEQ ID NO: 7603 - DNA, 1471 bp, Glycine max
agcgattaaatatagaagagtcagttaagataagagtgtattactaagaggagaaaaatgaaagttgtgtacttccttgttgccatcttggctttgacatcctctgtggtctctgcctatgaccctagtcctctccaagacttttgtgtggcagccaaagaaaaagatggtgtatttgtgaatggaaagttctgcaaagatcccaaacttgtgaaagctgaagacttcttcagacatgtagaaccggggaagactgacaacccagtaggttcaaacgtgactcaggtgtttgttgatcaactaccgggactaaacacgctgggcatagctttggctcgcatagatttcgcaccaaagggtttgaacgctccccacactcaccctcggggcactgagatccttatagtccttgagggtactctctatgttggatttgtgacttccaatcaagatggaaatcgcctcttcaccaaagtgctgaacaagggtgatgtgtttgtgttcccaattggtctcattcatttccaactcaatgtgggatatggcaatgctgctgccattgctgctcttagcagtcaaaatccaggagccatcaccattgcaaatgctttgtttaaagctaatccacctatttcttctgaggttctcaccaaagctttccaggtggacaagagcataattgattatcttcaaaagcaatcttggtacgacaacaataactaatttgggagtatggacgagcatttcacactagctagttactgtattactgaccactttattgtttcaatcaccccatacaacagacctaataaataaaatttaatgtatgcgggttattaatttttatacataatatttgttctgtttggagtttaatttgatttaatacatattgcttgtgagttccattaataaaagaacctattctttctggagttgctgctgttttcgagttattagattgtttgtgtgtcaagagtgagtactatgcatttcaatgtgttaattacttgccttaagtatgctaccacgggcatatttatttaggaaggtctttagtaactggatggtggaagggattttcaggtaacaaaattagcatatcaaggccaaagcaattacaacaggatgcgaaagtcaaaggatatataacaacaatgtaaggaaacaagttcaaatgaacaacgtcattcatttttattctaaagctgataaatcacaaattgtctctatttgttgccttgtgaatatatataagctattaaatgtctctatttatttaggcaggtttttagtaactagaatgtggaagggattttcaggtaacagaattaacatattaacgcctatgggttaccttcagagtaatcatcgattcccccatatgtattgtccctacattatcaaactcagcctagtccaccatagtacttgcctttaaggccaaagcaattaaaaaataaaactt

SEQ ID NO: 7604 - DNA, 751 bp, Cajanus cajan
aaaatatgaaagttacttacctaattgttgccatcttggctttgacatccgttgtctcagcctatgacccaagtcctctgcaagatttttgcgtggcagtaaaagaaactgatggtgtatttgtgaatggaaagttctgcaaagatcccaagcttgtgaaagctgaagatttcttcaaacacgtcgaacctggaaaaactgacaatccattgggttcacaagtgactcctgtgtttgttgatcaacttccagggctaaacacacttggcatatctttggctcgcatagattttgcaccaaagggtttaaaccctcctcacactcacccccgtggcacagaaatccttatagtccttgagggaactctctatgttggatttgtatcatccaatcaagatggaaatcgtctctttactaaagtgctaaacaagggtgatgtatttgtgttcccgattggtctcattcatttccaattgaatgtggggtatggaaatgcagttgccattgctgctctcagcagtcaaaatccaggaactatcactattgcaaatgctttgtttaaagctaccccacctatttctacagaggttttaaccaaagctttccaagtcgaccagaaaacaattgattacctgctaaaacagtcttggtatgacaacaactaatttgggagtgtcaatcattttgattgaataagtgttttcatcatctccaaataattattattgtaataaatatgttataatcgggt

SEQ ID NO: 7605 - DNA, 881 bp, Cajanus cajan
aattcaattctcacaagcgattacatatatacagcacaatcaatcattcaagactaagaggaaaatatgaaagttgcttacctaattgttgccatcttggctttgacatccgttgtctcagcctatgacccaagtcctctgcaagatttttgcgtggcagtaaaagaaactgatggtgtatttgtgaatggaaagttctgcaaagatcccaagtttgtgaaagctgaagatttcttcaaacacgtcgaacctggaaaaactgacaatccattgggttcacaagtgactcctgtgtttgttgatcaacttccagggctaaacacacttggcatatctttggctcgcatagattttgcaccaaagggtttaaaccctcctcacactcaccctcgtggcacagaaatccttatagtccttgagggaactctctatgttggatttgtgtcatccaatcaagatggaaatcgtctctttactaaagtgctaaacaagggtgatgtctttgtattcccaattggtctcattcatttccaattgaatgtggggtatggaaatgcagttgccattgttggtctcagcagtcaaaatccaggaactatcactattgcaaatgctttatttaaagctaacccacctatttctacagaggttttaaccaaagctttccaagtcgacaagaacacaattgattatctgctaaaacagtcttggtatgacaacaacaactaatttgggattgtcaatcattttgattggataagtgttttcatcatctccaaataattatcattgtaataaatatgttataagcgggttatattgatatattcttcctctttgttggatctatttgtttaataaattgatcgatatattgattt

SEQ ID NO: 7606 - DNA, 933 bp, Glycine max
aattctcacaagcgattaaatatagaagaatcatttaagataagagtgtattactaagaggagaaaaaatgaaagttgtgtacttccttgttgtcatcttggctttaacatcctctgtggtctctgcctatgaccctagtcctctgcaagacttttgtgtggccgccaaagaaaaagatggtgtatttgtgaatggaaagttctgcaaagatcccaaacttgtgaaagctgaagacttcttcagacatgtagaaccggggaagactgacaacccagtaggttcaaacgtgactcaggtgtttgttgatcaactaccgggactaaacacgctgggcatagctttggctcgcatagatttcgcaccaaagggtttgaacgctccccacactcaccctcggggcactgagatccttatagtccttgagggtactctctatgttggatttgtgacttccaatcaagatggaaatcgcctcttcaccaaagtgctgaacaagggtgatgtgtttgtgttcccaattggtctcattcatttccaactcaatgtgggatatggcaatgctgctgccattgctgctcttagcagtcaaaatcctggagccatcaccattgcaaatgctttgtttaaagctaatccacctatttcttctgaggttctcaccaaagctttccaggtggacaagagcataattgattatcttcaaaagcaatcttggtacgacaacaataactaatttgggagtatggacgagcatttcacactagctagttactgtataattgatcactttattgtttcaatcaccccatacaacagacctaataaataaaatttaatgtatgggggttattaatttttatacataatatttgttctgtttggagtttgatttgatttaatacatattgcttgagtttaattaataaaagaac

SEQ ID NO: 7607 - DNA, 932 bp, Glycine max
ttaaatatagaagaatcatttaagataagagtgtattactaagaggagaaaaaatgaaagttgtgtacttccttgttgtcatcttggctttaacatcctctgtggtctctgcctatgaccctagtcctctgcaagacttttgtgtggccgccaaagaaaaagatggtgtatttgtgaatggaaagttctgcaaagatcccaaacttgtgaaagctgaagacttcttcagacatgtagaaccggggaagactgacaacccagtaggttcaaacgtgactcaggtgtttgttgatcaactaccgggactaaacacgctgggcatagctttggctcgcatagatttcgcaccaaagggtttgaacgctccccacactcaccctcggggcactgagatccttatagtccttgagggtactctctatgttggatttgtgacttccaatcaagatggaaatcgcctcttcaccaaagtgctgaacaagggtgatgtgtttgtgttcccaattggtctcattcatttccaactcaatgtgggatatggcaatgctgctgccattgctgctcttagcagtcaaaatcctggagccatcaccattgcaaatgctttgtttaaagctaatccacctatttcttctgaggttctcaccaaagctttccaggtggacaagagcataattgattatcttcaaaagcaatcttggtacgacaacaataactaatttgggagtatggacgagcatttcacactagctagttactgtataattgatcactttattgtttcaatcaccccatacaacagacctaataaataaaatttaatgtatgggggttattaatttttatacataatatttgttctgtttggagtttgatttgatttaatacatattgcttgagtttaattaataaaagaacctattcttgctgga

SEQ ID NO: 7608 - DNA, 905 bp, Glycine max
ccgcctgcaggaaaaattctcacaagcgattaaatatagaagagtcagttaagataagagtgtattactaagaggagaaaaatgaaagttgtgtacttccttgttgccatcttggctttgacatcctctgtggtctctgcctatgaccctagtcctctccaagacttttgtgtggcagccaaagaaaaagatggtgtatttgtgaatggaaagttctgcaaagatcccaaacttgtgaaagctgaagacttcttcagacatgtagaaccggggaagactgacaacccagtaggttcaaacgtgactcaggtgtttgttgatcaactaccgggactaaacacgctgggcatagctttggctcgcatagatttcgcaccaaagggtttgaacgctccccacactcaccctcggggcactgagatccttatagtccttgagggtactctctatgttggatttgtgacttccaatcaagatggaaatcgcctcttcaccaaagtgctgaacaagggtgatgtgtttgtgttcccaattggtctcattcatttccaactcaatgtgggatatggcaatgctgctgccattgctgctcttagcagtcaaaatccaggagccatcaccattgcaaatgctttgtttaaagctaatccacctatttcttctgaggttctcaccaaagctttccaggtggacaagagcataattgattatcttcaaaagcaatcttggtacgacaacaataactaatttgggagtatggacgagcatttcacactagctagttactgtattactgaccactttattgtttcaatcaccccatacaacagacctaataaataaaatttaatgtatgcgggttattaatttttatacataatatttgttctgtttggagtttaatt

SEQ ID NO: 7609 - DNA, 708 bp, Vicia sativa
ctctccaagacttttgtgttgcaatccaagatcccaaagatggtgtatttgtgaatggaaagtttgtaaagatccagcgctagtcaaagctgaagatttcttcaaacatgttgaacctgggaatacttcaaatgcattgggctctcaagtgactgcagtcacagtagaccaactattcggattaaacacactcggcatttctttggctcgcattgattttgcacccaagggtttaaatccaccccacactcaccctcgaggcacagagatccttatagttctagaaggtactctttatgttggatttgtcacttccaatcaagataataaccgtctcttcaccaaagtactcaacaagggtgatgtgtttgtgtttccaattggtctcattcactttcaacaaaatgtgggatatggcaatgcagttgctattgctggacttagcagtcaaaatccaggagttatcactattgcaaatgctctgtttaaatctaacccacctatttctgaggaagttcttaccaaagcttttcaagtggataagagtataattgattatcttcaaaaacagtcttggtatgacaacaactagtttgagagcatatgattagtcatttcatttccaatgaattatctacatactttcatattcattgtaataaataaaaaccaggtgaggaatatttaattccatatctccttttattt

SEQ ID NO: 7610 - DNA, 4815 bp, Glycine max
acaaaattcaattctcacaacatatataaaatcaagtaattacatacttgatcgtaatcattaaagagtagcgttgaaagcaaaatgaaagtgatgtacttccttgttgccgtcttagctttggcattctcagttgcctcggcctatgaccccagtcctctccaagatttttgtgtgacagtcaatggcaccaaagatggtgtgtttgtgaatggaaaattctgtaaagaccctaagcttgtgaaagcagaagatttcttcagacatgtggaacctgggaatacctccaacccaaatggtgcacaagtgactcaagtgtttgttgatcagctaccagcattaaacacgcttggcatatctttggctcgcgtagattttgcaccaaagggtttaaaccctccccacactcaccctcgaggcactgaaatccttatagtcactgagggtactctctatgttggatttgttacttccaatcaagatggaaatcgcctcttcaccaaagtgctgaacaagggtgatgtgtttgtgttcccaattggtctcattcatttccaacggaatgtgggatatggcaatgcagttgccattgctgctcttagcagtcaaaatccaggaactatcactattgcaaatgttttgtttaaagccaatcctccaatttcttcagaggttcttactaaagcattccaagttgacaagaaagtaattgattatcttcaaaaacaatcttggtacggcaacaactagtttggataactgaatcattgtttggaccacctcattcaattcacactctccaaattaatatatcgttactatgaatatggataatattaaaatgaacttgggatgtttgttttaatttttggtaggcattgcacttgagatgtatttatatgccaaggctgttgttttgttataatttaattttgttttctacatttgtgacaacctcaataaaatacgatattctgcccttttgttcaagtagactttttacatggtactttcatgggatgcgttaatacatcagttgtggttccaattaataatcacttttttttttgttgaagttaacgattaataaccacttgatacttgaactatttgaggatatttactaacgggtaggtaatgaagtttacgaacgtttgttttaaattttaaattttttatccttattgttccacaaatcttattattctgcgaatcaagtgcaaatatcacaggttaattaatacccacgtttccgtctccataatacatgtgacggtttattactagcggttactacaaacctctgcaaatattttaattcctgactcttggtatcttattaaaactttcctgtttttcacagttgtttgcaactcggctagaattacactgtaccccattccacatgtgagttagggtttcattcgttcccttttttccttgttattatttttactgtgactaagaaaagagagttctgattggttggcaggtaaggcaacatagcatgattgcatttccgaaaatggttttggaggagttaggtgcggctaagattgaaagtggcactaaactctatttatttaacttggatcatggagttgccgacgatgatatcaagattgggagatcaaagggaacaacagaagttgtgttcgtgaggcactctaatgctttagcagccatcaagaaatacaacaatatgagtgatggaaagctattgcaaattgagtttgttggaacatatgcatgttcagctactccggttgtcacgcctctttgtcaaactaacttaatgggaagaccaaatgatgtccatttacggtgtgaaattcttattctgatcgtttgagcttcttagttttatatatttcttctgaattgtgaacttatagtatcctttattctttgaaatactcaataaccttgatttgaaatttgcagttgctcacttgtattacatgaaatcataggttatgttcatttaagattatgagtaaaatttagaaatttagataggaaaatggttaagaattgattccttttaacaccataaccatttccttcggcctaaaaatatttaattttaaatttcaggacagaaatcttgacgtataatattgttcccattgtcaggtgagagttgcactttcaatggtttaatgcttgacatttaacttggtttcaaatttcactatagtaacaccattcttagttgtatcttgcattcaactttactgtcaagtcaattgaatctagatacattagaatacgcaaacacaaaatctcaatttatcgtctagataatcaactgtggttggataataaattctgtaaacagaatttgtgcaccactgctgctagatagctataataagagaggctaaaggaaaaaggtagttattaaatcattaaaagtaatgtaaatcataaactgatcatgatctgtatccaatggaagattattagtatggaagatcatgatctattgctaagtaataaccattttctcttattattattttatagtttcatggttcagtcgttgctccaccaatgtttattgtatggaagcttctggtgtgctgatggtgcaatattattgtgttcaatgaattttagtttcatctaatataatcattctctttccttttaagttgttgcttcttcctgttatttcttgtttttccttctttttttttttatttccaaagctcttgcttatcgttgtatcatttctatcccattatcattcaggagaaatttgtcaaagcctgtgccttgaactattggattttcctttctatagtaatacctagcttaaatttttctttctacatgtgaaataattcattcttgttttctgactacaataccatctgtcaatacccgataatatgaatgaaaatatagtaattgatctaggtgactaggtttataaaatttccctattttgaggtgctctgtggtaagcaatagtcatagtctgctgttattatgttctcgtaatattttgtttggcttttccttgttttttcatacacaactcacatctttgggtttagaaagatgaaactagatcaggtatatattttgcttatatatatatatatatatatatatatatatatatatattagtaattttaatgattatattatattcttgatgtcatttgtggaagctttaatcccatagcatgcaatcaccctttaactcctagagggtattattctttaaggtttgtcaggtcagtgcaagttaattcttctcatctatctcaaagtggtctagagttccaatttcagtagctcaaacaaggtaagtctcaagcacaaattaattttgtttcctacaaaaatatctaatttttatcaagtcaaatatcgatgaaaaaatgtgtgatatcaagagatacttcaaactttgcttcattgtgctagtcattttctaatgtgtcttttggaacagttcttttgttttaaatttaagaacctatattagagatattaaagttgtactatgtagctattatcttaattatctcttattcaaaccagttcacgaaagtttgttaagatatgattttgaagaaaatgaaataaataaatatatctaattaatctatatatacagggtacctttcagcaatgtactctatttctttctacttattttttcctctaacagttatttattacaagtagtgtactctatttctttctacaggcttattaattaagagttgcaaatcatgaggtatccttgagtttattatatactcttcttttctctgtaaatcatattttgataatagagtatgaagttttaagatagtgaagtgttttattattaacgtctttagtgataattatgtgttttattatttgtaactggtgcagtgaggtaattgtagtcatccgaaaactggtgcttctgcagaaggctatgtgatgagatgtggttacttataatatcttattttgagtgttatggtggacgtcgacgctgattttgctgtttttcttctttttttctgcacaaggaggtagattttctatgtgattcactgtaacttgattaattcattgtaaataaattctttaccttgactaatatgcaatttgttcattaagagtttgattggtgaattatgttatatttaaatcaagatttcttacatttaattgtttaatttgataagataacatttttggttgagaaaactcttttgtcttgtctttctttttaattgattaagaattaagaaaacttgtttaattgttaaatttgatttcttttgtttaattgttcgttaattaagttaaatgttaagaatgaatttgttgtggattatgtatcatttttgagcttttgtaagaaaaatgtagtatttgagtaaaataattaataggtgatataatgtatagtaaaatatataatattggttataaaaaataaagataattaatgaataaatattagttatagagaaattttttaaaaaattaaaattaaaaaacactgtttaaaacactcaaaacgagattttaactaaaaacactcaaaatgtttcagaaaatatttttaataaaaaatacttttaaaaattcaaccaaatctatttccatccgtattcctattcctaatggttaatggttgaaaatgtaatttgtaacagttttagctgtcaaacacaactttttcaacgccataaaatgtagttttctttttgtagtgaaaggaaatatatttttgttcatgtgtctaaaacttttactttagttattttatctttgcgttggttctgattgg

SEQ ID NO: 7611 - DNA, 746 bp, Phaseolus vulgaris
tcaaaattcaatatattctcagaagcagaaacatttaagataagaaaaaaatgaaagctgtgtacttggttgttgccatcttgggtttgacatgcttagttgtgtctgcctatgaccctagccctctgcaagatttttgcgtgggagccaaagaaagtgatggtgtatttgtgaatggaaaattctgcaaagatacgaaggtggtgaaagctgaagatttcttcaagcatgtggaacctgcgaagactgagaatccactaggatcacaagtgactcaagtgtttgttgatcaactacctggactaaacacattgggcatatctttggctcgcatagattttgcaccaaagggtttaaaccctccccacactcaccctcggggcacagagatccttattgttgttgagggtactctttatgttggatttgttacttccaatcaagatggaaaccgtctctttaccaaagttttgaacaagggcgatgtctttgtcttcccaattggtctcattcatttccaacttaatgttggatacggcaatgctgttgcaattgctggtcttagcagccaaaatccaggaactatcactattgcaaatgctttgtttaaatctgatccacctatttctcctgaggttctaaccaaggcttttcaggtcgacaagagcacaattgattatcttcaaaagcaatcttggtatgacaacaactaatttctatttttcgactatggaccctcatttctc

SEQ ID NO: 7612 - DNA, 680 bp, Phaseolus vulgaris
aaaaaatgaaagctgtgtacttggttgttgccatcttgggtttgacatgcttagttgtgtctgcctatgaccctagccctctgcaagatttttgcgtgggagccaaagaaagtgatggtgtatttgtgaatggaaaattctgcaaagatacgaaggtggtgaaagctgaagatttcttcaagcatgtggaacctgcgaagactgagaatccactaggatcacaagtgactcaagtgtttgttgatcaactacctggactaaacacattgggcatatctttggctcgcatagattttgcaccaaagggtttaaaccctccccacactcaccctcggggcacagagatccttattgttgttgagggtactctttatgttggatttgttacttccaatcaagatggaaaccgtctctttaccaaagttttgaacaagggcgatgtctttgtcttcccaattggtctcattcatttccaacttaatgttggatacggcaatgctgttgcaattgctggtcttagcagccaaaatccaggaactatcactattgcaaatgctttgtttaaatctgatccacctatttctcctgaggttctaaccaaggcttttcaggtcgacaagagcacaattgattatcttcaaaagcaatcttggtatgacaacaactaatttctatttttc

SEQ ID NO: 7613 - DNA, 765 bp, Trifolium pratense
cctctccaagacttttgtgttgcaatccaagaccctaaagatggtgtatttgtgaacggaaaattctgtaaagaccctgctctggttaaagctgaagatttcttcaaacatattgaacctgggaatacatcaaacccattgggctctcaagtaactccagtcactgtagaccaattgtttggactaaacacactgggtatatctttggctcggattgactttgcacctaagggtttaaacccaccccacactcaccctcgaggctcagagatccttatagtccttgaaggaactctttatgtgggatttgtcacgtcaaatcaagacaaaaatcgtctctttacaaaagtcctcaacaagggtgatgtgtttgtgttcccaattggtctaattcattttcaactaaatgtgggatatggaaatgcagttgccattgctggacttagcagtcaaaatgcaggagttatcactattgcaaatgctctatttaaatctaatccagctatttctgacgaggttcttacccaagctttccaggtggataaaagcataattgattatcttcaacaacagtcttggtatgacaataactagttcaagaacatgattagtcgttttattctaaataaatgattcacctttagtgtttcaatcacctcgtggaattgaacttctctacttacttgtttttattgtaatacataaaataaatgttgttttatttaaacacatggttgttttatttttagtttaatttggttcaat

SEQ ID NO: 7614 - DNA, 934 bp, Cajanus cajan
tatcaacgcagagtacggggaattcagttctcaatcagaagcaattacttacccaaaatcttacaagattaagtttgagaagcaagatgaaagttgtgtatttcctcgtggccatcttggctttgacatcttctgttgcctttgcctacgaccccagccccctgcaagatttttgtgtggcattaaatgacaccaagaatgctgtatttgtgaacgggaaattctgcaaagatcccaagctcgtgaaagcagaagatttcttcacacatgtggaggctggtaatacctcgaacccacttggtgcacaagtgactccggtctttgttgatcagctaccaggattaaacacacttggtatatcattggctcgtatagattttgcacccaagggcttaaatgctcctcacactcacccacgtggcacggaaatccttatagtcattgagggaactctatatgttggatttgtctcatccaatcaagatggaaaccgtctctttaccaaagttctgaacaagggcgatgtgtttgtgtttccaattggcctcattcacttccaattaaatgtgggatatggcaatgctcttgccattgctggtctcagcagtcaaagtccaggaactatcactattggtagtgctttgtttaattctactccacctatttctactgaggttcttaccaaagccttccaagttgataagagcacaattaattaccttcaaaagcaattctggtacaacaacaactagttaggttgaagacacaagtatgatcatttcatttttattgtaatggatttcatgtttagataattaaattattaaattccttcatgcatttgaccttcctacgaataacttatattgtaataaataaaaaggaatgtggtttatattatttatatagtgttgctattctatttatttgaaat

SEQ ID NO: 7615 - DNA, 3883 bp, Glycine max
tataaaatcaagtaattacatacttgatcgtaatcattaaagagtagcgttgaaagcaaaatgaaagtgatgtacttccttgttgccgtcttagctttggcattctcagttgcctcggcctatgaccccagtcctctccaagatttttgtgtgacagtcaatggcaccaaagatggtgtgtttgtgaatggaaaattctgtaaagaccctaagcttgtgaaagcagaagatttcttcagacatgtggaacctgggaatacctccaacccaaatggtgcacaagtgactcaagtgtttgttgatcagctaccagcattaaacacgcttggcatatctttggctcgcgtagattttgcaccaaagggtttaaaccctccccacactcaccctcgaggcactgaaatccttatagtcactgagggtactctctatgttggatttgttacttccaatcaagatggaaatcgcctcttcaccaaagtgctgaacaagggtgatgtgtttgtgttcccaattggtctcattcatttccaacggaatgtgggatatggcaatgcagttgccattgctgctcttagcagtcaaaatccaggaactatcactattgcaaatgttttgtttaaagccaatcctccaatttcttcagaggttcttactaaagcattccaagttgacaagaaagtaattgattatcttcaaaaacaatcttggtacggcaacaactagtttggataactgaatcattgtttggaccacctcattcaattcacactctccaaattaatatatcgttactatgaatatggataatattaaaatgaacttgggatgtttgttttaatttttggtaggcattgcacttgagatgtatttatatgccaaggctgttgttttgttataatttaattttgttttctacatttgtgacaacctcaataaaatacgatattctgcccttttgttcaagtagactttttacatggtactttcatgggatgcgttaatacatcagttgtggttccaattaataatcacttttttttttgttgaagttaacgattaataaccacttgatacttgaactatttgaggatatttactaacgggtaggtaatgaagtttacgaacgtttgttttaaattttaaattttttatccttattgttccacaaatcttattattctgcgaatcaagtgcaaatatcacaggttaattaatacccacgtttccgtctccataatacatgtgacggtttattactagcggttactacaaacctctgcaaatattttaattcctgactcttggtatcttattaaaactttcctgtttttcacagttgtttgcaactcggctagaattacactgtaccccattccacatgtgagttagggtttcattcgttcccttttttccttgttattatttttactgtgactaagaaaagagagttctgattggttggcaggtaaggcaacatagcatgattgcatttccgaaaatggttttggaggagttaggtgcggctaagattgaaagtggcactaaactctatttatttaacttggatcatggagttgccgacgatgatatcaaggtatcatcatcatctacagtagaaaatctgttttgctttattttttctctacttttttattgtttttttaaatgtgttatgatccctttttctttgtatgcctcgtagtggtgatacaatatagtttgaggtgcttcagttttccaatcataattaattttgtctctcgccccaatatctatgtttcatgaagagagaagaaattcacatattataaaaaaatataagaatcaaagtcattgtctttaaagtattggaactaagatcaatttggactgaaaattaaagggcctgaaacaccttttaacctataatttttatcattttgattcttagtagtatttatgtttaccttgtcattttttttcaacttctgttcttattcatgtcatatcctaacttcaactgtgtagcacgcttgaatctctgtattctgaaagtttgtctctgtggagaggtgcagaaaatttcactacttggtactgtttgctacgtattcaattagtttctatatctttgataatgttaaattttatgtcattttttatgacaaccttgtcattcttttggtgagtcaaataatgcaaggaattgaaaatttgtgtcagactttcacaactgctgttctcggaggagggtgaatttaaaagttaccattcattatttaccagattgggagatcaaagggaacaacagaagttgtgttcgtgaggcactctaatgctttagcagccatcaagaaatacaacaatatgagtgatggaaagctattgcaaattgagtttgttggaacatatgcatgttcagctactccggttgtcacgcctctttgtcaaactaacttaatgggaagaccaaatgatgtccatttacggtgtgaaattcttattctgatcgtttgagcttcttagttttatatatttcttctgaattgtgaacttatagtatcctttattctttgaaatactcaataaccttgatttgaaatttgcagttgctcacttgtattacatgaaatcataggttatgttcatttaagattatgagtaaaatttagaaatttagataggaaaatggttaagaattgattccttttaacaccataaccatttccttcggcctaaaaatatttaattttaaatttcaggacagaaatcttgacgtataatattgttcccattgtcaggtgagagttgcactttcaatggtttaatgcttgacatttaacttggtttcaaatttcactatagtaacaccattcttagttgtatcttgcattcaactttactgtcaagtcaattgaatctagatacattagaatacgcaaacacaaaatctcaatttatcgtctagataatcaactgtggttggataataaattctgtaaacagaatttgtgcaccactgctgctagatagctataataagagaggctaaaggaaaaaggtagttattaaatcattaaaagtaatgtaaatcataaactgatcatgatctgtatccaatggaagattattagtatggaagatcatgatctattgctaagtaataaccattttctcttattattattttatagtttcatggttcagtcgttgctccaccaatgtttattgtatggaagcttctggtgtgctgatggtgcaatattattgtgttcaatgaattttagtttcatctaatataatcattctctttccttttaagttgttgcttcttcctgttatttcttgtttttccttctttttttttttatttccaaagctcttgcttatcgttgtatcatttctatcccattatcattcaggagaaatttgtcaaagcctgtgccttgaactatggatttcctttctatagtaatactagcttaaattttctttctacatgtgaaataattcattcttgttttctgactacaataccatctgtcaatacccgataatatgaatgaaaatatagtaattgatctaggtgactaggtttataaaatttccctattttgaggtgctctgtggtaagcaatagtcatagtctgctgttattatgttctcgtaatattttgtttggcttttccttgttttttcatacacaactcacatctttgggtttagaaagatgaaactagatcaggtatatattttgcttatatatatatatatatatatatatatatatatatatattagtaattttaatgattatattatattcttgatgtcatttgcggaagctttaatcccatagcttgcaatcacccttgaactccaagaggatattattctttaa

SEQ ID NO: 7616 - DNA, 713 bp, Pisum sativum
caggatttctgtgtggcaatcaaagaccctaaagatggtgtatttgtgaacggaaagttctgtaaagatcctgcgctagttaaagcagaagatttcttcaaacatattgatcctgggaatcccgtaaatgcattgggctctcaagtgactccagtatttgtagaccaactgtttggactaaacacacttggaatatctttggctcgcattgattttgcacccaaaggtttaaatccaccccacattcaccctcgagggactgagatccttacagttctcgaaggcactctttatgttggatttgtcacttccaatcaagataaaaatcgtctattcaccaaagttctcaacaagggagatgtgtttgtgttcccaatcggtctaattcactttcaactaaatgtgggatatggcaacgccgttgccatcgctggacttagcagtcaaaatccaggagttatcactattgcaaatgctttatttaaatctaatccccctatttctgacgaggttcttactaaagcttttcaagttgataagagcatcattgattatcttcaaggacagacttggtatgacaacaactagtttgaaaacttgatatgttcttcgatcagcttgtgcaattaaccttgatatggttctttatttgattacatagttgttttattttgaatttgatttggttcaataataaatggttgttgtgattt

SEQ ID NO: 7617 - DNA, 777 bp, Cajanus cajan
acggttcatccttataaatagcaaagcttataaaggcagcaaaacaattcagttctcaatcagaagcaattacttacccaaaatcttacaagattaagtttgagaagcaagatgaaagttgtgtatttcctcgtggccatcttggctttgacatcttctgttgcctttgcctacgaccccagccccctgcaagatttttgtgtggcattaaatgacaccaagaatgctgtatttgtgaacgggaaattctgcaaagatcccaagctcgtgaaagcagaagatttcttcacacatgtggaggctggtaatacctcgaacccacttggtgcacaagtgactccggtctttgttgatcagctaccaggattaaacacacttggtatatcattggctcgtatagattttgcacccaagggcttaaatgctcctcacactcacccacgtggcacggaaatccttatagtcattgagggaactctatatgttggatttgtctcatccaatcaagatggaaaccgtctctttaccaaagttctgaacaagggcgatgtgtttgtgtttccaattggcctcattcacttccaattaaatgtgggatatggcaatgctcttgccattgctgatctcagcagtcaaagtccaggaactatcactattggtagtgctttgtttaattctactccacctatttctactgaggttcttaccaaagccttccaagttgataagagcacaattaattaccttcaaaagcaattctggtacaacaacaactag

SEQ ID NO: 7618 - DNA, 752 bp, Cajanus cajan
aattcaattctcacaagcgattacatatatacagcacaatcaatcattcaagactattaggaaaatatgaaggttgcttacttcattgttgccatcttggctttgacatcctccgttgtctcagcctatgacccaagtcctctgcaagatttttgcgtggcagtgaaagaaactgacggtgtgtttgtgaatggaaagttctgcaaagatcccaaacttgtgaaagctgaagatttcttccaacacgttgaacctggaaaaactgacaatccattgggttcacacgtgactcctgtatttgttgatcaacttccagggctaaacacacttggcatatctttggctcgcatagattttgcaccaaagggtttaaaccctcctcacactcaccctcgtggcacagaaattcttatagtccttgagggaactctctacgttggatttgtgtcatccaatcaagatggaaatcgtctctttactaaagtgctaaataagggcgatgtgtttgtgttcccaattggtctcgttcattttcaattgaatgtggggtatggaaatgcagttgccattgctgctcttagcagtcaaaatccaggaactatcactatcgcaaatgctttgtttaaagctactccacctatttctacagaggttttaaccaaagctttccaggtggacaagaagacaattgagtatcttctaaagcaatcttggtatgacaacaacaactaatttcgaagtgtcaattattt

SEQ ID NO: 7619 - DNA, 728 bp, Vigna unguiculata
ggagtgcaaaagaaaaatgaaaggtgtgtatttccttgtggccatcttggctttcacgtcgtccattgcctctgcctatgatccaagtcctctgcaagatttttgtgtagctttgaatgataccaagaatgctgtatttgtgaacggaaaactttgcaaagacccaaaagtagtgaaagcacaagattttttcagacacgtggaagctggtaatacatcgaacccacttggtgcacaagtgagtcaagtgtttgtggatcagctgccaggattgaacacacttggcatatcgatggctcgtatagattttgcaccaaagggtttaaacgctccccacaatcaccctcgcggcacagagatccttattgttgttgagggaagtctttatgttggatttgtgagttccaatcaagatggaaaccgtctctttaccaaagtcttgaacaagggtgatgtctttgtcttcccaattggtctcactcatttccaactgaatgtcggttatggcaatgcagttgccatcgctgctctcaacagtcaaaatccaggaactatcactattgccaatgctttgtttaagtccactccatctatttcttctcaagttcttaccaaagctttccaagtcgacaagagcataattgattaccttcaaaagcaattctggaccgacaacaaccactagtcattctcattcattatccatttcctctttctactgttatgta

SEQ ID NO: 7620 - DNA, 7900 bp, Brachypodium distachyon
gcaaggaaaagataatccaatggtactaccattttcgtctcccttttgtacttcgttgccaacaggtctgtaccagagtttggcttctgctgagtttgaagcccagtggagattggaagatggattctgcatttctgcatcccgtgtcaacatccggatatctgactgactctgctaaaatgacacttggtccattgtttcatctgctatactgaatttgtagcgactgtactgaatttgcagaggctgcagcagtggctcccccgcactcctccgggccaccctctcttcctcccaacccaaaccctctcttcctctgcttccttcccataccgccaccaatggctcccccgcacttctccgggcttccaccctccccgtcctctcccgcctgaagccgcaccctaggactccagccccgccccttaccttccgccaccaccagggccgtcaccaagttccacgtcctattaggtttcgtcctgtagtgctaattgctgttttgaatcttgttgtcttggagcagtagcgctcgctagtacttgacgggaattgatgcatgatggctgctccgcagtcaggtaaatttggccgctgttactcgttagaagaacttctgtatccgccagtttgtttctgccgcgtgaatctatgcttttgtgctgcttcctgcctgctgtcaaattttattcagtttctactggaaacgctcaacgagtcaacgttatggaaatttctgcttctatttcgccgtgttttccttcacatggacaatgttctgtgcgttgtctgaacttctgtctgctgatttgcttggagcaataaattcatgttgccagtatacttgttcgagaatgatgttttttgcatcactggatctctgaaatctttggaactagaagccatgtatattgtctggttattttttagtgctattgtggaacactgaggctttacattttacatttatctgatacccttgcaatgataatctatgttattgctggaagcagtaatgataccattgctatcatacatgcattttgcagttgccacaataatatacatcaatttatctgttaacaaaatgctgactgaaacgacatgcataacttctattattgctggatcacatctttccagcttgttcaatggtttccgaatgtcttcagttgaaccttaactttcttcatgttctcctataagctaaccaccaagcaggaggtacgcgcttctaattgcatgcatctctaccgctgcatctctaatcaatgtccgttctcgaggctgttgctttgagcaggatatgccaagcctaaagacagaaaccaagcattcttggattctggtactcgtagtgctatccagcggttcactgtggagccagattgttgggtctgctatctccaaggttctatctggaagagcatcctctgcaaacttatggagatccaatgaatccctgaacgtgtcgtttgttgggcttcttccggtaaacatctcaagcagcaatatcccaagactgtaaatatcaccacgagttgagactgcatagccctccccatactctacaattattcattaactttgaagttagcaacttagcatgacatgtttatgtgaatagtaaatgacaaaactagaagaatttcagttacctggagcaacatagcctatggtacctctaattccaactgagctatatgagttttgcatcctcttgcatgtactttcttgtaggattcttgatatgccgaagtctccaactcgggctctcatgtcctcagcgagaagaatgttgcttggcttaagatcgcagtggattatcaacggttggcagtggttgtgaagatattctattgcatccacaatatcgactgcaatatcaagcctctgcgcaagattgagtgtgttgcttttagtgagcttttgagatttcgggtgaagccaaccatccaagttaccactgggcatgaactcaaaaaccaatgccttgaactcttgactttgatggttgatgctcgaacaacaagtaatgatctttatgagacattggtgtggtatccttctcatggcatcacattcaacctcaaaactcttggaagacctggattgaccaaggttaaacaccttgacagccaaggttctttcgtcagtgtccaaacacacttataaacagcaccataacttcctctcccaatcaagttaacttctgaaaacccgtcagttcctctgaataatgcatcatatgggattctttcgtagtggtctccagcaattgaatattcaattactgtctgctggtttcgcttgagcttcttgtgaagcacgcaaacaccaagaataactgaaagtgacaaaaagattgctccaattgttgctagagaaattataagagactttgacagcccttttttgttcttgtgtacggggcttgtggagcatggagccaagcgaagttgaggtgtgccgctgcagagattgatattcccagtaactgctatgtaagtgatgtttctgaaaacacctccatctggcacctcaccttgcaagttattgaaggatacatccaattttgacaatgctgtcaaattctgtagaactgcagggattacacctgacaagttgttgtgtgctagatacaattgttgtagatctcgaatgccaccgatggcatcagggatccttccagacaaattattcatggtcagatttaatatattgagtccttttatgttttccagagatttgggtatacttccttcaaaagagttcttgtccagtaagattttctgcagaactatgcaatttcctatagtgctaggtatttgtccggacaactggtttcctgacagaatcaattcattgaggttagtcattgtacctgcttctgacgggaggggtccacaaagtgcattgtatgataaatccaaaatgaatagattcttcaggttcccgagacttgctggtattgatccttccaggttgttccagaatgcaagaaacctagttaactctgtaagatttcctacagattgcggtatgatgcctgtcaagccagtactatacaggccaaggtcaaccaagtttttcagtttccctatgctctctggaatcactcctgacatggaagtattcactatcagtagtatgttcagaccaaccagattgccgatgtctgcagggatactcccagagatcctattgtcatctaatcgtaacatctggagtgatgtcgagagattcacaatcgaacgcggtagttgtcctccaaaagggttgctgctgagtatcaagcgccgcagttggctgcatctaacagtcaagtacaggtcttggagagctcccagcctccccaaagtgggaggaacatacccgctgaatctatttagctcgaggaccagtaccgtgagatcagatagattggacagtgacgaagggatggttcctgtgaactgattagcgcccaaattaagaacttgcaagctgggtacttgttgccgatatcaaccggaatgcttccgttcagcttattgcccccaacctgaaatctttccagcgaggacaagttgtagagagcgtgtggaagcataccagagagcttgttggcggacagttgcaatatctgcatgctctggatgctgccgagctctggtgggatcgagcccacgagctggttatgggagagatcaaggttcttcaggaggcggaggcgcccgaggctcgctgggatctcgccgtggagcgagttgtagctcaggttgagcgtccgcaggaacgtgaggttcccaagaactggggacagtgctccggtgagctccccgcggtgcaagctcagcgccaccaccacctgctttgttctccggtggctgcacgtgacgccctcccagctgcagaagtgggcgctgtcgttccaggaggccagtgcacgggagccgccggcgccgccgctggcctgtgctttgaaagcaagcaacgcggcctcatcgccggcgctcacgacgaccatcatcaggatggcagcaagtgatgatagcaagctcaccagccccattgctgtgagcatactgattccagttttggttgcttcggatactcttaagtctattttcttttctttgagaggatactcttggagtcttggtcatgcgtgcttgcttttcaacaatgccctgctattccttatatgatctatacgtccactgtcttctttttgacttgatcaaatgttcaatgctgcagaattttccagaggtgctgaatgctgatgaccatctgccaatctgtagactgggaagagccttgatggcttccggctgtaccagtatcgacaaggacatgccgtggaggacagtgacatgagccacactctttgatgatgcctctactgtttagcttctattattgacttttgtcaggttgattgatgtggtcaagccagggccaaccgattgtgtttaccttttcaaacttgcccttgtaagagaaagcattccttctttttaggaaaaaaagaaacaagaggttatcatcatctccactgctcctcgaacttgcacggaatatagtgaaactttgcgcatttatcggcaatgtagtgaatttctgccgagacttgagtagtgtctgcgaaggagcacgattccggtctgcgttttcgtggcaattcaattcaaattggttcaggcatcaaagaagtgccatctgtgtgtgatggatatgtatgttctgtggcgccgtatcgaaattcaaagttccgaaggtcaaactcaacaagacaacaagtttaaaggaaggcggattttgtggagtgcgtaaaccgcactggaaggcgtattctatctgctggagtactacttgagagttcagatacccagcagcccatctcttcttcctcatctgcttccttcttctgatcgcctccaatggcgtcctccttcctccgcgcctcgccgctctccctcctctcccgcctgaagccggtcaaccgaaggccccccgcctcgcacctccgccgcctccttctgctctccggctccacctcggtcccctcctgctccccgcccacgctccgaaccctagccaccgatgcggcgaccgcacccgaggaggcggcgcttcccgcggcggaggcgaagctggagaggatgcagccgcttcagtggcctcggcgggacgcgctgtgcggcgacctcggcgcgggcgacgccggccgccgggtgcggctctgcggctgggtcgctctccgccgcacccacgccggcctcactttcctcaccctccgtgattcctccggcatggttcaggtggcaaccttgccagagtaccctgaagtatatgctgttgtgaacaagctgagagtggaatcagtggtttctgttgagggggtggtgcgcccacgcccgacagaagccatcaacacagagatgaagactggggctatagaggttgttgcagatcatatattggtgctgaactctgtaactcgttcactaccttttccagtcactactgctgatactgtaaaagagaaatttccagaagaagtcagattgagatttagggtgcttgacttacgtcgaccacaaatgcagtcaaacttgagattgcgccataaagtaattaagcacgttcgtcgttacttggaggatagacatgattttgttgagattgagactccaattttatccaagtctacaccagaaggtgctcgggactatcttgtaccttcaagagtccagccaggaacatgctttgctcttcctcaaagtcctcagttgttcaagcaaatgttgatggcgtctggctttgaaaaatattttcagatcgcaagatgcttccgggacgaagatctgcgtgcagataggcaaccagaatttacacaactcgatatggagattgcctttacatcaatggaggatatgttgaagttgaatgaagagttgatgatacatatatttcaagaggtgggagatatcaagcttccaaaatgttttccaaggcttacctacgcggaggcaatgaattgttatggcacagacaggcctgaccttcggtttgactgggagctaaaagatgctagtgatgtatttttgggcagtagcttcaaggttttcgcagatacattagaaaatggtggtgtaataaaggcattgtctgtgcctggtggtgccaaagttttttcaaacactgacctgaagaagggaactgtttatgctgaagcatccaaagctggagctaagggcctgcctttcctcaaagttatggataatggggagcttgaaggaattggtccgcttgtgtcaactctgaaacctgaaaagaaagaacagctgttggaacttttagatgcaaaagcaggtgatcttatcctgtttgccctgggcgagcaatcaacagctaatcaaattcttggcaggttaagattatttattgctcataagttggaagtgatagacacgtcagcacactcaattctttgggtgacagactttccaatgtttgaatggaacagtgatgagcagagatatgaggctctacaccatcctttcaccgcaccaaatcctgaagatatgaatgatctaccttcagctcgtgccctggcttatgatatgatttacaatggggttgagatcggaggaggcagtttgaggatctacaaaagtgatgtgcaacaaagaatatttgagatcatcggtatctcacctgaacaggcagaggaaaaatttggttaccttttggagtgtttcgacatgggtgctcctccgcatggaggaattgcttatgggttggatcggttagtgatgcttttggcttgcgaaagttcaatccgggatgtgatagctttcccgaagaccacgactgctcaatgttcactcaccaaagcgccatctcctgtggatcctcagcaattgaaggatctcggcctacatgctccgtgaccaaattgttcatagcttaggggcaaagttatctaggaacagctacagtatactcctggaatttgatctcttccaggacattctctctttacatgtagagaacgaggttttgtttatgagattttcttgagcatggaagatgattggtcgcccttcagatgtcaccagatctgcctgcatcaatgtcacacaaataaatttgggctgccaacaattgtatcattgtagaattagagttgggtgagctaggctctcggcaaatccagctttgccgtgtgcacgaagaaaaggctccggcaaagccgagggcacacgacaaatcacgtctttccggtagtgatttgcagatgatgactgtgtgacatggatcttgagccatattccgtgaaaatcattcaactctgctcctgagtcctgactatatatggaaggttcacctgccctattgtgtttgtaagaaatccgagctagtagtatttggggaagcctcgaaatttattttaggaaatgtagactatacacagaaggtccaaaatttgttaggaattatgtataatattattagacagtgtcattttacggaaggcacaatgaagaaaaacctggagctctatataaagtcatccatcgccattgtgacggcatcgacatggagagccagcagcaagccatcgtcgtcgccgcctacatggtcgaggacgagggccacccttgttccatcccgactctggcacgtctggctgtcctcttgatcgcttacttgttgctggagtcggtagcggtcgcgttcatcatagataaagtcaagcgcacccacgattgaattggcgtcaagacatacgttttcggcacctttctggcgacccttccttcctttgttataattgccgtggtttgctgtattgaaaaaagtgtcgaatcaattttcgatgataatatgtactccagcactcagctct

SEQ ID NO: 7621 - DNA, 2387 bp, Sorghum bicolor
gacatcagtccaaaactgcgcttcccctatctgctatcttctccgtctcgttcccaatggcttcctccctcctccgcgcctcgcccttctccctcctctcccgcctaaagcccaggtcatccgccttgcatctccgccgcctcctcccgctctccaccacctccacctcggcctctgtccccgcgccccagctccgaaccctagcgtccgcggcggccaccgatgcggctgctaccccgccagaggaagcggcggtgcccgccgcggcgggtgcgaaggtagagaggctgcagccgctgcagtggcctccgagggatgcgctgtgcggcgagctcggcgccggggacgccgggcgcagggtaaggctatgcggctgggttgcgctacgccgcgcgcacgccgggctcaccttcctcacccttcgagatcgctccggcatggtgcaggtgacaacgttgccagagtacccagaggtttacaacatagtaaacaagctgagagtggagtcagtggttgctgttgagggggtgatccagccacgccctgtggatgccatcaatgcagatatgaagaccggcgctatagaggttgtggcagatcatgttttagtgctgaactcagtaactcgttcactgccgtttccagttacaattgctgatactgtaaaagagaagtttccagaagaaattagattgaggtttagagtgttggacttgcgtcgtcctcaaatgcagtcaaacttgcggttgcgccataatgttgttaaacttatacgccgctacttggaggatgaacatgaatttgttgagattgagactcctgttttgtccaagtctacacctgaaggtgctcgggactatcttgtaccatcgagagttcagccaggaacattctacgcgctccctcaaagccctcagctgttcaagcaaatgttgatggtttctggttttgaaaaatattatcagattgcaaggtgcttccgggatgaagatctgcgtgcggacaggcaaccagagtttacacaacttgatatggagattgcttttacatctatggaggatatgttgaagctgaatgaagatttaatgagacatgtttttcaagtggtaggagatatcaagctgccaaatccttttccaaggttaacatatgcagaggcaatggatcgctatgggacagataggcctgatcttcgattcgattgggagctgaaagatgttagtgatgtatttttgggcagtaacttcaaggtttttgctgatacattggaaaatggaggtgtgataaaggcactgtgtgttcctggtggtgccgctgtgttttcaaacactgacctgaagaaaggaactgtttacactgaagcttccaaagctggagccaagggactgcctttcctcaaagttatggataccggggagcttgaaggaattggtccacttgtatcaagtctgaaacctgaaaagaaagagcagctcgtggaacttctggacgcaaaggcgggtgatcttatcctgtttgcactgggtgaacaatcatcagctaaccggattcttggacggttaagattatttattgctcataagctggaggtgatagacacgtctgcacattcagttctttgggtgacagattttccaatgtttgaatggaacagcgatgagcaaagatatgaggccctccatcatcctttcactgcaccaaatcctgaggatatgaatgatctaccatcagctcgtgctctggcttatgacatgatttacaacggtgtggagattggagggggaagtttgagaatctacaaaagtgatgtacaacaaagaatttttgagatcattggtatctcgcctgaacaggcagaggagaaatttggctaccttttagaatgcttcgacatgggtgctcctccacatggaggcattgcttatggattggatcggttggtgatgcttttggctggtgagagctcgatccgagatgtgattgctttccccaagacgacgactgctcagtgtgcactcaccaaagcaccatcagctgtagacccacagcagctgaaggatctcgccttccccaactctacttcgtgagacagcagttcaagtgttcatgacaaaagttctgggttctcaagggatagctatagttttttagtgtattgcagcattctatttttgcatggtatagaatgtgcaatttttggaccctgataaatttatacgagatgcataacacgccaaagtcgtggaagagtattgttttaatagctgtgcttatgtgtttgtgcttgtgcacaacagtatcttgtaaattgtttcttgatggtactacttgctagtccccatttatttaacgcccataaattgttagtacatgtgagattgctgcaa

SEQ ID NO: 7622 - DNA, 2595 bp, Panicum virgatum
aatacttaaatattcagtgtaaccgctctaattggtggagaaaattttgactatcactgcatgtttccggtcctcaacttgaagcgcgttctgtaggattggtgcggaggataaggcgcctctctcttcctcgagtccaaaaccccactccccccaatccgctccctccccatctccgatggcgtcctccctgctccgcgcctcgcccctcgccctcctctcgcgcctaaagcccaggccgtccgccttgcacctccgccgcctcctcccactctccaccacctcggcctctgccgcgcccgcgccctccggccccgcgccccagctccgaaccctagcggccgcggcggcgaccgacgcggcagcgaccccggcggaggaggcggcggcggcgcccgcggcgacgggcgagaaggtcgagaggctgcagccgctgcagtggccgccgagggacgcgctgtgcggcgagctcggcgccggggacgccgggcgcagggtgcggctctgcggatgggtcgcgctgcgccgcgcgcacgccgggctcaccttcctcaccctgcgcgaccgctccgggatggtgcaggtgacaacattgccagagtacccagaagtttacaacatagtaaacaagctgagagttgagtcagtggttgctgttgagggggtggtcaggccacgcccagcagatgccatcaatgcagatatgaagactggggctatagaggttgctgcagatcgtgttttagtgctgaactcagtaactcgttcattgccgtttccagttacaactgctgactctgtaaaagagaagtttccagaagaaattagattgaggtttagagtactggatttgcgtcgtcctcaaatgcagtcaaacttgcggttgcgccattatgttgttaaactcatccgacgttacttggaggatgaacatgaatttgttgagattgagactccagttttatccaagtctacaccagaaggtgctcgggactatcttgtaccatcaagagttcagccaggaacattctatgctctccctcaaagccctcagttgttcaagcaaatgttgatggtttctggctttgaaaaatattaccagattgcaaggtgcttccgtgatgaagatttgcgtgcggacaggcaaccagagtttacacaacttgatatggagattgcctttacatcaatggaggatatgttgaagttaaatgaagatttgatgagacatgtttttcaagcggtaggaggtatcaagctgccaaatccatttccgaggttaacatatacagatgcaatgaatcgctatgggacagataggcctgaccttcggtttgattgggagctgaaagatgttagccatgtatttttgggaagtggcttcaaggtttttgctgataccttggaaaatggaggtgtaataaaggcactgtgtgttcctggtggtgccacggtgttttcaaacactgacctaaagaaaggaactgtttacactgaagcttccaaagctggagccaagggcctgcctttcctcaaagttatggagaatggggatcttgaaggaattggcccgctagtatcaagtctgaaacccgaaaagaaagagcagctcgtgaaacttctggatgcaaaggcgggtgatcttatcttgtttgcactgggtgaacaatcatcagctaaccgggttcttggccggttaagattatttattgctcataagctggaagtgatagacacgtcagcgcattcagttctttgggtgacagattttccaatgttcgaatggaacagtgatgagcagagatatgaggccctacaccatccattcactgcgccaaatcctgaagatatgaatgatctaccatcagctcgtgccctggcttatgacatgatttacaacggtgtggagattggaggggggagtttgagaatctacaaaagtgatgtacagcaaagaatttttgagataattggtatctcacctgaacagggggaggagaaatttggctaccttttagaatctttcgatatgggtgctcctccacatggaggcattgcctatggattggatcggttggtgatgctcttggctggtgagagctcaatccgggatgtgatagcattccccaagactacgacagctcagtgtgcactcaccaaagcaccatctgctgtagatcctcagcaactgaaggatcttgccttcccaaagtctactttgtaacactgttgagaattttgggtgggttggttgcttctttatattttgaggcgcattctagttttgcatggtagggaatgcgctttgttcacgagaactttccaaccctggaaaatctatagaagacggttaatacaaagttcaggaaatatggattcgcaagagtttcggcagcgatgctatgcatttgtatacatccgccttgtaaattattcaacataatacgaattgttgtgcaaaatgtgaactgcacggtgctccatttgttgcacctggtagctttttcttcatgcaataaagatttctcccaggcgtatgcttggaaatagctggttgaacaaacagcacagctccaggcgtctggaactcaaaat

SEQ ID NO: 7623 - DNA, 2346 bp, Setaria italica
accatccgattccttccccgtcgtctccaatggcgtcctccctccttcgcgcctcgcccctctccctcctctcccgcctaaagcccaggccatccgccttgcacctccgccgcctcatcccgctctctaccacctcggcctctccctcgcccgccggtccctcgccccagctccgaaccctagcggccgcggcagccaccgacgcggcagcgagcccgccggaggaggcggcagcgcccgcggaagctggtgcgaaggtcgagaggctgcagccgctgcagtggccgccgagggacgcgctgtgcggcgagctcggcgccggggacgccgggcgcagggtgcggctctgcggatgggttgcgctacgccgcgtgcacgccgggctcaccttcctcaccctgcgcgaccgctccggaatggtgcaggtgacaacattgccagagtatccagaagtttacaacatagtaaacaagctgagagtggagtcagtggttgctgttgagggggtggtgcggccacgcccggcagatgccatcaatgcagatatgaagaccggggctatagaggttgctgcagatcgtgttttagtgctgaactcagtaacgcgttcattgccgtttcctgttacaaccgccgagactgtaaaagagaagtttccggaagaaattaggttgaggtttagagtgctggacttgcgtcgtcctcaaatgcagtccaacttgcggttgcgccacaatgttgttaaactcatccgacgttacttggaggatgaacatgaatttgttgagattgagactccagttttatccaaatctacaccagaaggtgctcgggactatcttgtaccatcgagagttcagccaggaacattctacgctctccctcaaagccctcagttgttcaagcaaatgttgatggtttctggctttgaaaaatattatcagattgcaaggtgcttccgggatgaagatttgcgtgcggacaggcaaccggagtttacacaacttgatatggagattgcctttacatcaatggaggatatgttgaagttaaatgaagatttgatgagacatgtttttctagcggcaggaggtatcaagctgccaaatccatttccaaggttaacatatgcagaggcaatggatcgctatgggacagataggcctgaccttcgctttgattgggagctgaaagatgttagcggtgcatttttgggcagtagcttcaaggtttttgctgataccttggaaaatggaggtataataaaggcactgtgtgttcctggtggtgcgacggtgttttcaaacactgacctaaagaaaggaactgtttacactgaagcttccaaagctggagccaagggcctacctttcctcaaagttatggagaatggggatcttgaaggaattggtccgctggtatcaagtatgaaacctgaaaagaaagagcagcttgtggaacttctggatgcaaaggcgggtgatcttatcctgtttgcactgggtgaacaatcatcagctaaccggattcttggctggttaagattatttattgctcataagctggaagtgatagacacgtcaacaaattcagttctttgggtgacagattttccaatgtttgaatggaacagtgatgagcagagatatgaggccctacatcatcctttcaccgcgccaaatcctaaagacatgaatgatctaccatcagctcgtgccctggcttatgacatgatttacaacggtgtggagattggagggggcagtttgagaatctacaaaagtgatgtacagcaaaggatttttgagatcattggtatctcacctgaacaggcggaggagaaatttgggtaccttttagaatctttggacatgggtgctcccccacatggaggcattgcttatggattggatcggctggtgatgctcttggctggtgagagctcaatccgggacgtgatagcattccccaagaccacgacggctcagtgtgcactcaccaaagcaccatctgctgtagatcctcagcaactcaaggatcttgccttccctaagtctacttgaaacaccgttcaaaattttgggggttggagaacagttagagttggttgcttctttatattttgaggcgcattcatagggaatgtgctttgttcacgagaattttccgaccctggaaaatatatagaagatggttatcacgccaaagttccggaaacatggattcatacgagtttcaagtagtgatgctatgcatctgtgtacatctttctcttgtaaattattcaacatcttacgcatttttgtgcaaaatgtgaactgcagagtgctccatttgttgcacaca

SEQ ID NO: 7624 - DNA, 2938 bp, Panicum virgatum
tgtaaacgcttttatttgtcttgttaagtaagaccggggctttgccctctagaattctaaaaaaatgagcacatggctcagtatttggggattttagttggactctagggagaggaagtgaagagcaaacggtaggttctccatgtatagacaatccgtcggtccgttagtttagttaggaatgtatgcttggaatggttccagctggaagtgcatgtttattttcacgccctcaatcagctggattagttccagctctcgttccacgtccggaacgggcgaaccgaaggggccctcagaagtcagaacactcctccggagctgaccggagaagttccttccatcgtcattccgtaagtagtattctgtaagattcgtgcggcggataaggcgagtccagaaccccacttcctcgcatccgctccatccccaatccccatctccccgttgccaatggcggcctccctgctccgcgcctcgcccctctccctcctctcgcgcctaaagcccaggccgtccgccttgcacctccgccgcatcctcccgctctccaccacctcggcctcggcctcgcccgcgccctcgtcctccggccccgcgccccagctccgaaccctagcggccgcggcggcgaccgacgcggcagcgaacccggcggaggaggcggcggccgcggcgcccgccgcggcgggtgagaaggtcgagaggctgcagccgctgcagtggccgccgagggacgcgctgtgcggcgagctcggcgccggggacgccgggcgcagggtgcggctctgcggatgggtcgcgctgcgccgcgcgcacgccgggctcaccttcctcaccctgcgcgaccgctccggcatggtgcaggtgacaacattgccagagtatccagaagtttacaacatagtaaacaagttgagagttgagtcagtggttgctgttgagggggtggtccggccgcgcccagcagatgccatcaatgcagatatgaagactggggctatagaggttgctgcagatcgtgttttagtactgaactcagtaactcgttcactgccgtttccagttacaactgctgactctgtaaaagagaagtttccagaagaaattagactgaggtttagagtgctggacttgcgtcgtcctcaaatgcagtcaaacttgcggttgcggcataatgttgttaaatccgtccggcgttacttggaagatgaacatgaatttgttgaaattgagactccagttttatccaagtctacaccagaaggtgctcgggactatcttgtaccatcaagagttcagccaggaacattctatgctctccctcaaagtcctcagttgttcaagcaaatgttgatggtttctggctttgaaaaatattaccagattgcaaggtgcttccgtgatgaagatttgcgtgcggacaggcaaccagagttcacacaacttgatatggagattgcctttatatcaatggaggatatgttgaagttaaatgaagatttgatgagacatgtttttcaagcggtaggaggtatcaagctgccaaatccatttccaaggttaacatatgcagaggcaatgagtcgctatgggacagataggcctgaccttcggtttgattgggagctgaaagatgttagtgatgtatttttgggaagtggcttcaaggtttttgctgataccatggaaaatggaggtgtaataaaggcactgtgtgttcctggtggtgccacggtgttttcaaacactgacctaaagaaaggaacggtttacactgaagcttccaaagctggagccaagggcctgcctttcctcaaagttatggagaatggggatcttgaaggaattggtccactggtatcaagtctgaaacctgaaaagaaagagcagctcgtgaaacttctggatgcaaaggccggcgaccttatcctgtttgcactaggtgaacaatcatcagctaaccgggttcttggccggttaagattatttattgctcataagctggaagtgatagacacgtcagcacattcagttctttgggtgacagattttccaatgttcgaatggaacagtgatgagcagagatacgaggccctacaccatcctttcactgcgccaaatcctgaagatatgaatgatctaccatcagctcgtgccctggcttatgacatgatttacaatggtgtggagattggagggggcagtttgagaatctacaaaagtgatgtacaacaaagaatttttgagatcattggtatctcacctgaacaggcggaggagaaatttggctaccttttagaatctttcgacatgggtgctcctccacatggaggcattgcctatggattggatcggttggtgatgctcttggctggtgagagctcaatacgggatgtgatagcattccccaagaccacgacagctcagtgtgcactcaccaaagcaccatctgctgtagatcctcagcaactgaaggatcttgcgttcccaaagtctactttgtaatactgttcagaattttgggttggttgcttctctatattttgaggcacattctagttttgcatggtagggaatgcgctttgttcatgagaattttccaacactggaaaatctatagaagatggttaacacaaagatctggaaatctggattcacaagagtttcaacagcgatactatgcatttgtatacatgtcttgtaaatcattcaacatagtacgaattattgtgcaaaatgtgaactgcacggtgctccatttgttgcacacggtagttttttcttcatgcaacaaatatttctcccaggcgtatgcttggaaataacttgtagaacaaacagcacagctccacgtgtttggagctcaaaatcactcaaaccctgtaccagctaccgaagatgcttctacaagtttcattctcaccacaggttttgt

SEQ ID NO: 7625 - DNA, 2214 bp, Avena sativa
tcccacgcctccaatggcgtcctccctcctacgcgcctcgccgctctccctcctctcccgtctgaagcctctcagccgcaggcctcccgctacttcgaacctccgccgtctcctcctgctctcgggccccgccccggccacctcctcccgctccccgcccacgctccgaaccctagccaccgacgcggcgaccacggccgaggaggcggcgctccccgctgcggaggcgaggctggagaggatgcagcccctcagtggcctcagagggacgcgctgtgcggcgagctcggcgcgggcgacgccgggcgacgggtgaggctctgcggctgggtcgccctccgccgcaaccacgccggcctcaccttcctaatcctacgcgactcctccggcatggtccaggtgacaactctgccagaataccctgaagtttacgctgttgttaacaaactgagagtggaatcagtggttgctgtcgagggggtggtgcgccctcgtccaacagatgccatcaatgcagatatgaggactggggccatagaggttgctgcagatagtatattggtgctcaactcagttactcgttccctaccttttccaatcactactgctgatactgtaaaagacaagtttccggaagaagtcagattgagatttagggtgctggacttgcgtcgaccacaaatgcagtcaaacttgagactgcgccataaagttattaagaatgttcgtcgctacttggaggataagcatgattttgttgagattgagactccaatcttatccaagtctacaccagaaggtgcccgggactatcttgtaccttcaagagttcagccaggaacatgctttgctcttcctcaaagccctcagctgttcaagcaaatgttgatggcctctggcttcgaaaaatattttcagattgcaagatgcttccgggatgaagatctgcgtgcagacaggcaaccagaatttacgcaactcgacatggagattgccttcacatcaatggaggatatgttgaagttgaatgaagaactaatgatacatatatttcaagaggtgggagatatcaagctgccaaaatgttttccaaggctcagctatacggaggcgatgaaccgttacgggacagacaggcctgaccttcgatttgattgggagttaaaagatgctggtgatgtatttttgggaagtagcttcaaggtatttgcagatatattagaaaatggtggtgtagtaaaggcattgtgtgtgcctggtggtgccaaagttttttcaaacactgatctaaagaagggaactgtttacactgaagcttccaaagctggagctaagggcttgcctttcctcaaagttatggacaacggggagcttgaaggagttggtccgctggtgtcaagcctgaaacctgaaaagaaagagcagctgttggaacttttagatgcaaaagcaggtgatcttatcctgtttgccctgggcgagcagtcaatagctaatcaaattcttggcaggttaagattatttattgctcagaagctggaagtgatcgatacatcagcacactcaattctttgggtgacggattttccaatgtttgaatggaatagcgatgagcagagatatgaggctctacaccatcctttcactgcaccaaatcctgaagatatgaatgatctaccatcagctcgtgccttggcttatgatatgatttacaatggggtggagatcggaggaggcagtttgaggatatacaaaagtgatgtgcaacaaagaatttttgagatcatcggtatctcacctgaacaggcggaggaaaaattcggataccttttggagtgtttcgacatgggtgctcctccacatggaggtattgcctatgggttggatcggttggtgatgcttctggctcgcgaaagttcgatccgggatgtgatagctttccccaagaccacgactgctcagtgttcgctcaccaaagcaccatcccctgtggatccgcaacaactgaaggatctcggcctacgttcttcatgaggataatgttcataatttaggtgtaaaaccatttaggaacaactacattgtacacatgggactcagattgtctctacacatctctttttgcactacagcgaaaatgagctcttgctcatatttttcttttaccatgtaagatcactggtcaccctagggataaccatgtgaattagtttg

SEQ ID NO: 7626 - DNA, 1751 bp, Setaria italica
ctcccctcctctccgacctccctccctccccttccgcatccgcacgaacaaagccgcgcgagcgaggagcagacgaaccttcacgacttcgaagcctctcccctccgagcagcagccatggcgaccgtcatgcagaagatcaaggacatcgaggatgagatggcaaggacgcagaagaacaaagccactgctcaccatcttggccttttgaaggctaaacttgcaaaattacggcgggagttgctcactccaacatcgaaaggtggtggcggtgcaggtgaaggatttgatgtcacaaaaagtggagatgcacgtgttggtttagttggctttccttctgttgggaaatcaacattgctgaacaagttgacaggaacattttctgaggttgctgcttacgagtttacaactttaacatgtattcctggagtcatcatgtataaaggtgccaaaatccagcttctagatcttcccgggatcattgaaggtgctaaagatggaaagggtagaggaaggcaggttatcagcacggctaggacatgcaatgttattttgattgttcttgatgctataaaaccaataacccacaaacgtctcattgagaaggaacttgagggatttggaattaggttgaacaagacaccacccaatttgacattcagaaaaaaggacaagggtggaatcaactttacatcaacagtgacaaacacacacttggaccttgagacagtaaaagccatctgtagtgagtacaggatccataatgccgatgtctccctgagatatgatgcaacagcagatgatctcatagatgtaattgaaggaagccgcatttacacaccttgcatctatgttgtcaacaagattgatcagataactctcgaagagctggaaatcttggacaaacttccccattactgcccaattagtgctcatcttgagtggaatcttgatggacttctggagaaggtatgggaatacttagatttggttaggatatacacaaaaccgaaagggctgaacccagattacgaggatcctgttattgtgtcatctaagaagaaaacagtggaagacttctgcaacagaatccacaaggatatggtgaaacaatttaaatatgctctggtatggggttccagcgtcaaacataagccacagagagttggcaaggagcatgagcttgaggacgaggatgttgtccagatcattaagaaaatataggtatacggtggaatgacagctgttctgcaaaactggatggagcaatgaggattttgagtagcagcctcatgggaaacaccttgaacaccgcctttgcttgctgtgatggttttatgcccttggtttgcctatactgccttgaacagaagacaatgcagacatgttttcttttgccgctgagtcatgtagctgtgatgttctccattgctgcttgcttggtgccatgtggagtcagtgagtcacagatgtaccaactaccaagtgtcctgccgctatcgttgaacacatggagagatgctctccacatctttagaggatgatgatgataagatgattcctgtactgcaagtgttcctgctttgttaggtgtaacttatttagtgtatcacaagtgtcacagcttcctttgtacttacattttccaatgatatggcggtatgagcttattagtagcgtggattccgtattatccttgcgatgatgaaagaacgttaggatgagttggcacatttattatttattatgat

SEQ ID NO: 7627 - DNA, 1604 bp, Sorghum bicolor
ctaagggaaaccctcaccacgcttctcgaaccttctcctttctccacccgcaacctcacttccctcccccttcgcatccgcacgaacgaagccgcgcgagcgaggagcagacgcgccttcccgacctcgaagcgtctcctctccctcttcgagcggcagccatggcgaccgtcatgcagaagatcaaggacatcgaggacgagatggcaaggacacagaagaataaagccactgctcaccatcttggtcttctgaaggctaaacttgcaaaactgcggcgggagttgctcactccgacatccaaaggtggtggtggtggtgctggtgaaggatttgatgtgacgaagagtggagatgcacgtgttggtttagttggctttccttcggtcggaaaatcaacattgttgaacaagctgacggggacattttcagaggttgctgcctacgagtttacaactttaacatgtatccctggagttatcatgtataagggtgctaaaatccagcttctagatctcccagggatcattgaaggtgctaaagatggaaagggcagaggaagacaggtcatcagcacagctaggacatgcaatgttattttgattgttcttgatgctataaaaccaataactcacaagcgtcttatcgagaaggagcttgaaggatttggcattaggttgaacaagacaccacccaatttgactttcagaagaaaggacaagggcggaatcaacttcacatcaacagttacaaacacacatttggaccttgatacagtaaaagcaatatgcagcgagtacaggatacataatgctgatgtctctctgagatatgatgctacagcagatgatctcatagatgttattgaaggaagccggatttacactccttgcatatatgttgttaacaagattgatcagataacacttgaagagctggaaatcttggacaaacttccccattactgcccggttagtgctcatcttgaatggaatcttgatggacttctggagaaggtatgggaatacttggatttggttaggatatacacaaaacctaaagggctgaacccagattatgaggatcctgttatcgtatcatctaagaagaaaactgtggaagatttctgcaacagaatccacaaggacatggtcaaacaatttaaatacgctctagtatggggttccagcgtcaagcataagccacagagagttggcaaggagcatgaacttgaggatgaggacgttgtccagatcattaagaaaatataggcatatcatatggtggaacaaaacctgcttttctgcaaaactggaaggagcaatgaggattttgagtagtagcctcgtcagaagagcttgaactcggcctttgcttgttggtgatgctcatatgtaatgttccttgttcgcagaaaatttgctttgatataaagacaatgttagttgacatttccttatacaagtcatgtagctgtgatattcttctctctaacttggtgccatatggactggagtcaccgatgtaccaagtgtctgcaacaaccgttgaacacatggagagatgctctccttatctttagaagataatgataagaagattcg

SEQ ID NO: 7628 - DNA, 1634 bp, Saccharum officinarum
cgtaccctgatcttcgaatgcgcacgaacgaagccgtgcgagcgaggagcagacgcgccttcccgacctcggagcccctcctctccctcttcgagcggcagccatggcgaccgtcatgcagaagatcaaggacatcgaggacgagatggcaaggacacagaagaataaagccactgcacaccatcttggtcttctgaaggctaaacttgcaaaattgcggcgggagttgcttactccgacatccaaaggtggcggtggtgcaggtgaaggatttgatgtgacgaagagtggagatgcacgtgttggtttagttggctttccttcggtcgggaaatcaacattgttgaacaagctgacagggacattttcagaggtagctgcctatgagtttacaactttaacatgtatccctggagttatcatgtataagggtgctaaaatccagcttctagatctcccagggatcattgaaggtgctaaagatggaaagggcagaggaagacaggttatcagcacagctaggacatgcaatgttattttgattgttcttgatgctataaaaccaataactcacaagcgtcttatcgagaaggagcttgaaggatttggcattaggttgaacaagacaccacccaatttgactttcagaagaaaggacaagggtggaatcaacttcacatcaacagtgacgaacacacatttggaccttgatacagtaaaagcaatctgtagcgagtacaggatacataatgctgatgtctccctgagatatgatgctacagcagatgatctcatagatgttattgaaggaagcaggatttacactccttgcatatatgttgtcaacaagattgatcagataacacttgaagagctggaaatcttggacaaacttccccattactgcccagttagtgctcatcttgaatggaatcttgatggccttctggagaaggtatgggaatacttggatttggttaggatatacacaaaacctaaagggctgaacccagattatgaggatcctgttatcgtatcatctaagaagaaaactgtggaagatttctgcaacagaatccacaaggacatggtcaaacagtttaaatacgctctggtatggggttccagcgtcaagcataagcctcagagagttggcaaggagcatgagcttgaggatgaggacgttgttcagatcattaagaaaatataggcatgtcatatggtggaacaaaacctgtttttctgcaaaattggaaggagcaatgaggattttgagtagtagcctcgtcagaagagcttgaactcggcctttgcttgttggtgatgctgttcgcagaaaatttgctttgatcgaaagacatgtttagttgacatttccttatacaagccatgtagctgtgatattcatctctctaacttggtgccatgtggactggagtcaccaatgtaccaagtgtctgccccaaccgttgaacacatggaagagatgctctccatatctttagaggatgacgaaaagaagattcggtgaatcctgtaacggattgcaagtgttattcccaagtctggtgcgttttttttagtgatggggaccttacaccggcttttattatagattgcgaaatattcttcgg

SEQ ID NO: 7629 - DNA, 1715 bp, Pennisetum glaucum
ccatctcccctctccccccttccgcatccgcacgaacaaagccgcgcgagcgaggagcaggcgaaccttcccggcttcgaagcctctccccaccgagccgcagccatggcgaccgtcatgcagaagatcaaggatatcgaggatgagatggcaaggacacagaagaacaaagccactgctcaccatcttggccttttgaaggctaaacttgcaaaattacggcgggaattgctcactccaacatccaaaggtggtggcggtgcaggtgaaggatttgatgtcacgaaaagtggagatgcacgtgttggtttagttggctttccttctgttgggaaatcaacactgctgaacaagttgacagggacattttctgaggttgctgcctacgagtttacaactttaacatgcattcctggagtcatcatgtataagggtgccaaaatccagcttctagatcttccagggatcattgaaggtgctaaagatggaaagggtagaggaagacaggttatcagcacggctaggacatgcaatgttattttgattgttcttgatgctataaaaccaataacccacaagcgtctcattgagaaggaacttgagggatttggcattaggttgaacaagacaccacccaatttgacatttagaaaaaaggagaagggtggaatcaactttacatcaacagtgacaaacacacacttggaccttgagacagtaaaagccatctgtagtgagtacaggatccataatgcagatatctcgctgagatatgatgcgacagcagatgatctcatagatgtaattgaaggaagccgcatttacacaccttgtatctatgttgtcaacaagattgattctataactcttgaagagctggaaatcttggacaaacttccccattactgcccaattagcgctcatcttgagtggaatcttgatggacttctggagaaggtatgggaatacttggatttggttaggatatacacaaaaccgaaagggttgaacccggattacgaggatcctgttattgtgtcatctaagaagaaaacagtagaagacttctgcaacagaatccacaaggatatggtcaaacaatttaaatacgctctggtatggggttccagcgtgaaacataagccacagagagttggcaaggagcatgagcttgaggatgaggatgttgtccaaatcattaagaaaatataggcatacggtggaatgacagctgttctgcaaaagtggatgattttgagttgtagcctcatgggaaagatcttgaacactgcctttggttgctgtgatggtcttaaatgtcctttgttcacctatactgccttgaacaaaagacaatgtagacatgtttctttttgccgcaagtccgtgtagccgtgatcttcttctccgttgcttctcgcttggtgccatgtggagtcagtgagtcacagatgtaccgactaccaagtgtgatgctgctaccgctgaacacatggagagatgctcgtcgtatctttagaggatgatgataagatgattcctgtactgcaagtgttcatgctttgtttggtgtaacttttttctagtgcatcacaaattcacaagtgtcccagcttcctttgtacgtactccatttcctaatgatatagtatgagcttattaggatcgtggatttcgtagtatcctggtgataatgaaagaacgtgaggatgagt

SEQ ID NO: 7630 - DNA, 1529 bp, Zea mays
cctcaccacgcttcccgaaacttctcctttctccatcctcaaccctactccccccttcatccgcacgaacgaagcagcgcgagcgaggagcagacgatccttcccgacctcgaagcctaccccccttccagccgcggccatggcgaccgtcatgcagaagatcaaggacatcgaggacgagatggcaaggacacagaagaataaagccactgctcaccatcttggtcttcttaaggctaaacttgcaaaattgcggcgggagttgctcactccaacatccaaaggtggtggtggtgcaggtgaaggatttgatgtgacgaagagtggagatgcacgtgttggtttagttggctttccttcggttgggaaatcaacattgttgaacaagctaacagggacattttcagaggttgcttcctacgagtttacaactttaacatgtattcctggagttatcatgtataagggtgctaaaatccagcttctagatctcccagggatcatcgaaggtgctaaagatggaaagggcagaggaagacaggttatcagcacagctaggacatgcaatgttattttgattgttcttgatgccataaaaccaataactcacaagcgtcttattgagaaggagcttgaaggatttggcattaggttgaacaaaacaccacccaatttgactttcagaagaaaggacaagggtggaatcaacttcacatcaacagtgacgaacacacatttggaccttgatacagtaaaagcaatctgtagcgagtacaggatacataatgctgatgtctccctgagatatgatgctacagcagatgatctcatagatgttattgaaggaagccggatttacactccttgcgtatatgttgtcaacaagattgatcagataacactcgaggagctggaaatcttggacaaacttccccattactgcccggttagtgctcatcttgaatggaatcttgatggacttctggagaaggtatgggaatacttggatttggttaggatatacacaaaacctaaagggctgaacccagattatgaggatcctgttatcgtatcatctaagaagaaaaccgtggaagatttctgcgacagaatccacaaggacatggtcaaacaatttaaatacgctctggtatggggttccagtgtgaaacataagcctcagagagttggcaaggagcatgagcttgacgatgaggacgtcgttcagatcattaagaaaatataggcgtatcatgtggtggaacgaaacctgtttttttctgcaaaactgggagcgttgaggattttgttgagtagtagcctcgcgagaagagcttgaactcggcctttgcttgttggtgaggctcatatgtaatgttccctgttctcagaaaatttgctttgatccaaagacaatgtgagtcggcatttacttatatacaacgagtcatgtagctgtgatgtaacttcctctaacttggtgccatgtggactggagtcaccgatgtgtgctgccaagtgtctggccc

SEQ ID NO: 7631 - DNA, 1507 bp, Musa acuminata
acggctcatcgctaccgacacaatctagccgcatcggagactcgataactcggaagacaggagaaggcgagcgcgagctccacaccgcagaggggcgccatggctaccgtgatgcagaagatcaaggatatcgaagatgagatggcaaggactcagaagaacaaagcgacagcccatcaccttggtctgctgaaggcaaaacttgcaaagctacgtcgggagctcttggcacctacttctaaaggtggtggtggtgctggtgaaggctttgatgttactaaaagtggagatgcacgagttggtcttgtaggttttccatctgttggaaaatcaacactattgaacaaattaacaggcacattttcagaggttgcctcttatgagttcaccaccttaacttgtattccgggtgtgatcgtgtacagaggtgctaaaattcagttattggatctaccggggatcatcgagggtgcaaaggatggaaagggtagaggaaggcaggtgataagtactgctaggacgtgcaactgtattttgattgttcttgatgctatcaaaccaataactcacaagcggcttattgagaaagaacttgaggggtttggcataaggttaaataaggagccccctaatttaactttcagaaaaaaggacaagggtggcatcaacttcacatctacagtcacaaacacacaattggaccttgagacagttaaggcaatatgtagtgaatataggatacataatgctgatatttctctccggtatgatgcgactgcagatgatctgatagatgttattgagggaagcagagtctatatgccatgcatctatgcagtgaacaagatagatcagattacactcgaagaactggaaatcctagataagcttcctcactactgtccagtcagtgctcacctggagtggaatcttgatggtcttttagaaaagatatgggaatatcttgatctggttcgaatttacacaaagccaaagggtctgaacccagattacgaggaccctgtcatcctatcttccaagaggacaaccgttgaagacttctgtaatagaattcataaggacatggtcaaacagttcaaatatgcactagtttggggttcaagtgcgaagcataaaccacagagagttggcaaggaacatgaactcgaagacgaggatgtagttcaaatcatcaagaaggtgtaaatcaagcaaaggatttctgtggttcttgggttgatcctcgatggattgcaagggatggcagctgggtctgagttttgagttgagctctactttattaggagttgttgtcatccttgtattcctgctcgggttagaattaaacatactactgtatgacagtgcttctactggtgaaaagtttgcactgctgtagaactgaaccgagcaacattttgtgattgagatcattcatggagacgttgtttaaactctgaccatgctacattccaggtacatgaaatacatcccacagtgcttttaa

SEQ ID NO: 7632 - DNA, 1751 bp, Citrus clementina
cctcaaaaactctctctgtttctcaaattaacgcagagataatcgtcacagctcaatctgaaccgccggttaaccgttgatctgattacctgtttgataatcctgtctcatctgcgacaatggcgactgtcatgcagaaaatcaaggacatcgaagatgaaatggcgaggactcagaagaacaaagctacagcgcatcatcttggcttgctcaaggctaaacttgcaaagctacgaagggaacttcttacacctacgtccaaaggaggtggtggtggtggtggggaaggttttgatgtcactaaaagtggagattctagagttggtctagtcggtttcccctcagttgggaaatctacacttttgaataagttaacagggacattttcagaggttgcttcatatgaatttactactttaacctgtatcccgggtgtgattacgtatagaggtgccaaaattcagttgttggatcttcctggtatcatcgagggtgctaaggatgggaagggtagaggaagacaggttatcagtactgctaggacatgcaattgtatcttaattgttcttgatgcaataaagccaataactcacaagcgtctgatagagaaagagcttgagggatttggcattaggttaaacaaacaaccacctaatctgacattcaggaagaaagataagggaggtatcaatttcacctcaacagttaccaacacaaatcttgaccttgagactgtgaaggcaatatgcagtgaatacagaattcataatgctgatatcactctgagatacgatgcaacagctgatgaccttattgatgtcatcgaaggcagtaggatatatatgccttgcatctatgtcataaacaaaattgatcagattactcttgaagagctggagattttggataagcttcctcactattgcccagttagtgcgcatctggaatggaaccttgatggtttgctggagaagatatgggaatatcttaatttaactcgtatatacacaaagcccaaagggatgaatccggactatgaagaccctgtgattttgtcatctaaaaagaggacagtcgaggatttctgcgagcgaattcacaaagatatggttaaacaatttaagtatgctctggtatgggggtcaagcgcaaaacacaagccacaaagagttggcaaggagcatgagctcgaggacgaggatgttgttcagattatcaaaaaggtgtgattctcataagaattaaaatttgttggtgttatacgacaaagttgttctgctaaacttcatgcaccgtaaggagtaagagcctgttattagattaggtagacctaggagacagcttgatgtgtaattaagctattttgtggtcaagctctttggttgtgatccactatgttgcctggttaaaatctcctatgctaattttttgtacgacaaagatcgtagtttttgtgcattttgggacttgcctctctccagagtgttttttacgttgtcattaatctatcatgagaagagattgtgtaagatttaaagactgaaagtgcactattacagtatcacttgtattgttctctacacaagacttattaatacactttatatgtctttgatttttttaagagttgaataagtcagaacaaatattttagtgctgcattgcaatgtacaaaattgttcatgcaaaaagtctacatcctcttactattcattctagtgaacttgttaaattttggtgataccaattga

SEQ ID NO: 7633 - DNA, 1540 bp, Gossypium raimondii
aagccctgttgtccgattaatttcgttttctctagtagcttcttcttcatcttcttctccttcacctccccaaagtatccgaaaccaatccccaaaccgccgccgtccgattattgtcatcttaattactattattattttgtaacaatggccactgtcatgcaaaagatcaaagacatcgaagatgagatggcaaggactcaaaagaacaaagcaacagctcatcatctgggcttgctcaaggccaaacttgcaaagctacgaagagaactccttacaccttcatcaaaaggaggaggtggtgcaggtgaaggttttgatgttaccaaaagtggagatgcaagagttggtctagtaggtttcccttctgtggggaaatctacgcttcttaacaagttgacaggaacattttcagaggttgcttcctatgaatttactacattgacttgtatcccaggtgtgatcatgtatagaggggctaaaatccagttgttggatcttccgggtattatcgagggtgctaaagatggcaagggtagagggagacaggttatcagcactgccaggacatgtaattgtatattaatcgttcttgatgcaataaaaccaataactcacaagcgtcttatcgagaaagagcttgaaggctttggtataaggttgaacaaggaaccacctaatttgacattcagaaagaaggacaagggtggtattaatttcacctccactgttactaatactcacctggaccttgacactgtaaaggcaatatgtagtgaataccgaattcacaatgctgatatcactctaaggtatgatgcaactgctgatgatctaatagatgtcattgaaggcagtaggatatatatgccttgcatctatgtggtgaacaagattgatcagattacacttgaagagctggaaatattggataaacttcctcattactgcccaatcagtgctcacctggagtggaacctggatggtctcctggataagatatgggagtatcttgatttaactcgcatatacacaaaaccaaaagggatgaacccagactatgaagatcctgttatcctgtcatcgaagagaaggacagttgaggacttctgcactcgaattcataaagacatgcttaaacaatttaagtatgcacttgtatggggatcaagcgtaaaacacaagcctcaaagagttggcaaggatcatgaacttgaggatgaagatgttgtgcagattatcaagaaagtgtgatttgaggatattggaatttatgccttcatgttttaggaatcccatgaatcatcattgctcaacattgtaagctgctgccatttaggctgtggagctgaaaattaggtgaaaaacgtgacagcttgaacgtgtaattaaaagccattttgttgtcaagctcttttgatctgattatctcgttgctccttttgctttgttgcgatacactactaaaatactgtagaactagttggaaattttcttcttttctaagttatgagagaaatggcattagtcactataataa

SEQ ID NO: 7634 - DNA, 1695 bp, Theobroma cacao
gctcttttcttcttcctcccttaagtagaaaaaacgaaccgtcgcagcccagtcgccgccgtccgatcaccgtgatctgaatcactctttctcttctgtgacaatggcgactgtcatgcaaaaaatcaaagacatcgaagatgagatggcaaggactcaaaagaacaaagcaacagctcatcatctcggtttgctgaaggctaaacttgcaaagctacgaagagaactccttacaccctcatcaaaagggggaggtgctgcgggtgaaggttttgatgttacaaaaagtggagatgcaagagttggtctagtaggtttcccttcagtggggaaatctactcttctaaacaaattgacagggacattttcagaggttgcttcctacgaatttactacattaacttgtatcccaggtgtgatcgtgtatagaggggctaaaattcagttgttggatctccctggtattatcgagggtgctaaagatggaaagggtagaggaagacaggtcatcagcactgctaggacatgcaattgtatattgattgttcttgatgcgataaagccaataactcacaagcgtcttattgagaaagagcttgaaggatttggcataaggttgaacaaggaaccgcctaatttgacattcagaaagaaagacaagggtggtattaatttcacctccacagttgcaaatactctcctggaccttgaaactgtgaaggcaatatgtagtgaatacagaattcacaatgctgatatcactttgagatatgatgcaaccgctgatgatctaatagatgtcattgagggcagtaggatatatatgccttgcatctatgtcgtgaacaagattgatcagattacacttgaagagctggagattttggataaacttccccattactgcccagtcagtgctcacctggagtggaacctagatggtctcctggataagatatgggagtatcttgatttaactcgcatttatacaaagccaaaggggatgaatccagactatgaagatcctgtaatcctgtcatcaaagaagaggacagttgaggacttctgcaaccgaatccataaagacatgcttaaacaatttaagtatgcattggtatggggatcgagcgtgaaacacaagccccaaagggttggcaaggatcatgaacttgaggatgaagatgttgttcagattatcaagaaggtgtgattacagaatatggaattatactggaactctccagtatgccaacattttaggaatccatcgtgcccaattttcagctgccagcgaggtttctgcagctggaaatgaggtggaagagacacctgatgtgtaattttgctgttttgctgtcaagctcatttgctttgattcacttgtatgtttgctttgttatggtagtattatacttgaaatctagaacaagtttgaagtgcaaatggcctcgcgggaaaatttttgttttaacttctgagagattaggcattgatgactttgagagattagcccttgtctcacccgtgcattgccgcaagatgctaaacgaggatacctccacattgcagagtgcggaacagctacgctattagcttttgtttaagagatctacttatttctataagagtaaaggctccttacaacatttgccaaaggtttcctaataagaataagactaatcacttttgtcagag

SEQ ID NO: 7635 - DNA, 1493 bp, Cichorium intybus
agaggagaaaatagggttttcatcaggggcagctgacctgcgactaattttctctagaaccctcgttccttcctctcttgatatcagtaagctgaagctaatacattcgaaaacaacatccaagagctactttctttgcttcaacaatggcgaccgttatgcagaaaatcaaagatatcgaagatgagatggcaaagacccaaaagaataaagcaacagcacatcacttggggttgttaaaggctaagcttgcaaaattgagaagggagcttttgacaccaacatcaaagggaggtggtggtgcaggtgaaggttttgatgttacaaaaagtggagatgcaagagttggtcttgtggggtttccttctgttggaaaatcaacccttttaaataaactaaccggcactttttcagaggttgcttcatatgagtttaccactttgacctgcattccaggtgttatcacatatcgaggagctaaaattcagttgttggatcttcctggtattattgaaggtgctaaagatggaaagggtagaggaaggcaggttatcagcactgccagaacatgcaattgtattctgattgtgctggatgcaattaagccaataacacacaaacgtctcattgaaaaagaacttgaaggctttggaatcaggttaaacaaggagcccccgaatttgacattcaggaaaaaagacaagggcgggattaatttcacatcaacagttgctaacacacatttagacctcgaaacagtgaaagcaatatgtagtgaatacagaatacataatgctgatgtcaccctcaggtttgatgcaacagctgatgacctcatcgatgtaatcgaaggtagtagaatatacactccttgcatctatgttgttaacaaaatagatcagattacactcgaagaactcgagattttggataaacttcctcactactgccctgtcagtgctcacttggaatggaatcttgatggtttgctggagaagatatgggagtatttgagtttgacccgtatttatacaaaaccaaaagggatgaatccggattatgaagaccctgtaattctttcttctaaaagaaaaactgttgaggatttctgcaacaggatccataaggacatgcttaagcaatttaagtatgcacttgtctggggttctagtgcaaaacacaagccacaaagagttggcaaggaacatgagcttgaagatgaagatgttgtgcagatcataaagaaagtctgagttaagtttttttgctgtttgtatgcttgttaaaatattaggacaaaaaaagcataatttaagcatgctaagttttgatttataaccttttgtgtacttttggagtaatgcttgtggtaggtacattatcaaatagataagtgatttgagtgttgagtgttgagatggtttggtttactatacgctctttctttccttaaaccctaaaacgttatttgattttatttcaacattttaccc

SEQ ID NO: 7636 - DNA, 1588 bp, Cichorium intybus
agaggagaaaatagggtttttatcaggggcagctgacctgcgactccttttctctagaaccctcgttccttcctcttgatatcagtcagctgaagctaatacattcgaaaacagcatctaacagctactctctttgcttcaacaatggcgaccgttatgcagaaaatcaaagatatcgaggatgagatggcaaagacccaaaagaataaagcaacagcacatcacttggggttgttaaaggctaagcttgcaaaattgagaagggagcttctgacaccaacatcaaagggaggtggtggtgcaggggaaggttttgatgttacaaaaagtggagatgcaagagttggtcttgtggggtttccttctgttggaaaatcaacccttttaaataaactaaccggcactttttcagaggttgcttcttatgagtttaccactctcacctgcattccaggtgttatcacatatcgaggagctaaaattcagttgttggatcttcctggtattattgaaggcgccaaggatggaaagggtagaggaaggcaggttatcagcactgccagaacttgcaactgtattctgattgtgctggatgcaattaagccaataacacacaaacgtctcattgaaaaagaactcgaaggctttggcatcaggttaaacaaggagccaccaaatctaacattcaggaaaaaagacaagggtggaattaatttcacatcaacagttgctaacacacatctagacctcgaaacagtgaaagcaatatgtagtgaatacagaatacataacgctgatgtcaccctcaggtttgatgcaacagctgatgacctcatcgatgtaatcgaaggtagtagaatatacacaccttgcatctatgttgtcaacaaaatagatcagattacacttgaagagcttgagattttggataaacttcctcactactgtcccgtcagtgctcacttggaatggaaccttgatggtttgctggagaagatatgggagtatttgagtttgacccgtatttatacaaaaccaaaagggatgaatccggattatgaagaccctgtaattctttcttctaaaagaaaaaccgttgaggatttctgcaacaggatccataaggacatgcttaagcaatttaagtatgcacttgtctggggttctagtgcaaaacacaagccacaaagagttggcaaggaacatgagcttgaagatgaagatgttgtgcagatcataaagaaagtctgagttaagttttttgctgtttgtaaccgatatcgatgcttgttaaaatattaggacaaaaaaagcataatttaagcatgctaagttttgatttataaccttttgtgtacttttggagtaatgcttgtggtaggtaacattattaaatagataagtgatttgagtgttgagtgttgagatggtttattatacgctctttctttccttaaaccctgaaacgttatttgattttatttgaacatttaccctgattagcaatggtttgtataggtacgtttctgggggttattttggtccatgcgcctccacatttattatttacgtcattatttgatatatg

SEQ ID NO: 7637 - DNA, 1556 bp, Gossypium hirsutum
gtaagccctattgtccgattaatttcgttttctctagtcgcttcttcttcatcttcttctccttcacctccccaaagtatccgaaaccaatccccaaaccgccgccgtccgattattgtcatcttaattactattattattttgtaacaatggccactgtcatgcaaaagatcaaagacatcgaagatgagatggcaaggactcaaaagaacaaagcaacagctcatcatctgggcttgctcaaggccaaacttgcaaagctacgaagagaactccttacaccttcatcaaaaggaggaggtggtgcaggtgaaggttttgatgttaccaaaagtggagatgcaagagttggtctagtaggttttccttctgtggggaaatctacgcttcttaacaagttgacaggaacattttcagaggttgcttcctatgaatttactacattgacttgtatcccaggtgtgatcatgtatagaggggctaaaatccagttgttggatcttccgggtattatcgagggtgctaaagatggcaagggtagagggagacaggttatcagcactgccaggacatgtaattgtatattaattgttcttgatgcaataaaaccaataactcacaagcgtcttatcgagaaagagcttgaaggctttggtataaggttgaacaaggaaccacctaatttgacattcagaaagaaggacaagggtggtattaatttcacctccactgttactaatactcacctggaccttgacactgtaaaggcaatatgtagtgaataccgaattcacaatgctgatatcactctaaggtatgatgcaactgctgatgatctaatagatgtcattgaaggcagtaggatatatatgccttgcatctatgtggtgaacaagattgatcagattacacttgaagagctggaaatattggataaacttcctcattactgcccaatcagtgctcacctggagtggaacctcgatggtctcctggataagatatgggagtatcttaatttaactcgcatatacacaaaaccaaaagggatgaacccagactatgaagatcctgttatcctgtcatcgaagagaaggacagttgaggacttctgcactcgaattcataaagacatgcttaaacaatttaagtatgcacttgtatggggatcaagcgtaaaacacaagcctcaaagagttggcaaggatcatgaacttgaggatgaagatgttgttcagattatcaagaaagtgtgatttgaggatattggaatttatgccttcatgttttaggaatcccatgaatcatattgctcaacattgtaagctgctgccatttaggttgtggagctggaaattaggtgaaaaacgtgacagcttgaatgtgtaattaaaagccattttgttgtcaagctcttgtgatctgattatctcgttgctccttttgctttgttgcgatacactactaaaatactgtagaactagttggaaattttcttcttttctaagttatgagagaaatggcattagtcactataataatttcatttcatttca

SEQ ID NO: 7638 - DNA, 1475 bp, Secale cereale
ccgcgcgggcgcagagcaggcgaaccttccagaaccctccgagccccctccgcggcccgcagccatggcgaccgtcatgcagaagatcaaggacatcgaggacgagatgtcaaagacgcagaaaaacaaagccacggcacaccatcttggtcttctgaaggctaaacttgcaaaattacgccgagagttgctcactcctacaaccaaaggtggtggtggtgctggtgaggggtttgacgtgacgaaaagtggagatgcacgtgttggtttggtgggttttccttctgttgggaaatcaacattattgaacaagctgacaggaactttttcagaggttgcgtcctatgagtttacaactttaacatgtattcctggagttattatgtacaaaggggctaaagtacagcttctagatcttccgggaatcattgaaggtgctaaagatggaaagggtagagggaggcaggtcatcagcacagccaggacatgtaatgtcattctgattgttcttgacgccataaaaccaataactcacaaacgtctcattgagaaggagcttgagggatttggcatccggttgaacaagacacctcccaatatgacattcaggagaaaggaaaagggtggcatcaattttacatcaacagtagcgaacacacacttggaccttgacacagtaaaagcaatctgtagtgagtacaggattcataatgctgatgtctccctgagatttgatgcaacagcagatgaccttatagatgtcattgagggaagtagaatctacatgccttgcatctacgtcgtcaacaaaattgaccagatcacagttgaagagctggatatcttagacaaacttccccattactgcccaattagtgcacatctggaatggaaccttgatgggcttctagagatggtctgggaatacctagatttgtgcaggctatacacaaaacccaaagggctgaacccagactacgaggatcctgtgatcttatcatccaagaggaaaacagtggaggacttctgcaaccaaatccacaaggacatggcgaagcagtttaaatatgcactggtgtggggttctagcgtgaagcataagcctcagagagtcggcaaggagcatgagcttgaggacgaggacgttgttcagatcattaagaaaatataagctacacaccgtggtgcgagtgattctgttttgcagatcaggaaggagttctcagctatgaaactttttgagaagcagctacattagggcccttgttccttttgctagctctgatgcccatcgtcgggccgctgtttgcataaaaatctggtttcgatcacaaagacaaaatgtggacagtttttttatttactagactgtgccaagtaaccatatgtaattgtgactgatgcctgtcatgccacatccgccgaaccgaacacatggaaagatgcatatctatctcgacaagatgctaagatgg

SEQ ID NO: 7639 - DNA, 1784 bp, Triticum aestivum
gtccttctcctctcccccgacccccccttccgcatccacgcgagcgaagccgcgccggcgaagagcaggcgaaccttctacagccctccgactccgagcccccttccgcggcccgcagccatggcgaccgtcatgcagaagatcaaggacatcgaggacgagatgtcaaagacgcagaaaaacaaagccactgcacaccatcttggtcttctgaaggctaaacttgcaaaattacggcgagagttgctcactcctacaaccaaaggtggtggtggtgctggtgaggggtttgacgtgacgaaaagtggagatgcacgtgttggtttggtgggctttccttcggttgggaaatcaacattgttgaacaagctgacgggaactttttcagaggtcgcgtcctatgagtttacaactttaacatgtattcctggagttattatgtacaaaggagctaaagtacagcttctagatcttccgggaatcattgaaggtgctaaagatggaaagggtagagggaggcaggtcatcagtacagccaggacatgtaatgtcattctgattgttcttgacgccataaaaccaataactcacaaacgtctcattgagaaggagcttgagggatttggcatccggttgaacaagacacctcccaatatgacattcaggagaaaggaaaagggtggcatcaattttacatcaacagtagcgaacacacacttggaccttgacactgtaaaagcaatctgtagtgagtacaggattcataatgctgatgtctccctgagatttgatgcaacagcagatgaccttatagatgtcattgagggaagtagaatctacatgccttgcatctacgtcgtcaacaaaattgaccagatcacagttgaagagctggatatcttggacaaacttccccattactgcccaattagtgcacatctggagtggaaccttgatgggcttctagagatggtctgggaatacctagatttgtgcaggctatacacaaaacccaaagggctgaacccagactacgaggatcctgtgatcttatcatccaagaggaaaacagtggaagacttctgcaaccaaatccacaaggacatggcgaaacagtttaaatatgcactggtgtggggttctagcgtgaagcataagcctcagagagttggcaaggagcatgagcttgaggacgaggacgttgttcagatcattaagaaaatataagctacacaccgtggtgccgagcgattctgttttgcagatcaggaaggagttctcagctatgaaactttttgagaagcagctaacgttagggcccttgttccttttgctagctgtgatgccccgtcgtcgggccgctgtttgcataaaaatctggtttcgatcacaagacaaaatgtggacagtttttttatttattagcttgtgccaagtaaccatatgtaattgtgactgatgcctgtcatgccacaaccgccgaaccgaacacatggaaagatgcatatctatctcgagaagatgctaagatggttcttatagcttgtttaagcgtttcagtttggtttagcttatcgtttctgatctccctgatgatggggctgatgattactttgccaatgatggacaaaaacttgaggataacatggcaagtgtactggttgtgataactattaccagatcccgtatcgtttggttgtatatcgacctgcattatgatccttgaccatctggcagcatccttgtacggggcatcgctgttgtggtgcgagcatgtgacggtg

SEQ ID NO: 7640 - DNA, 1586 bp, Triticum aestivum
ccacgcgagcgaagccgcgccggtgaagagcaggcgacacttctacaaccctccggctccgacccccttccgcggcccgcagccatggcgaccgtcatgcagaagatcaaggacatcgaggacgagatgtcaaagacgcagaaaaacaaagccacggcacaccatcttggtcttctgaaggctaaacttgcaaaattacggcgagagttgctcactcctacaaccaaaggtggtggcggtgctggtgaggggtttgacgtgacgaaaagtggagatgcacgtgttggtttggtgggctttccttcggttgggaaatcaacattgttgaacaagctgacgggaactttttcagaggttgcgtcctatgagtttacaactttaacatgtattcctggagttattatgtacaaaggagctaaagtacagcttctagatcttccgggaatcattgaaggtgctaaagatggaaagggtagagggaggcaggtcatcagtacagccaggacatgtaatgtcattctgattgttcttgacgccataaaaccaataactcacaaacgtctcattgagaaagagcttgagggatttggcatccggttgaacaagacacctcccaatatgacattcaggagaaaggaaaagggtggcatcaattttacatcaacagtagcgaacacacacttggaccttgacacagtaaaagcaatctgtagtgagtacaggattcataatgctgatgtctccctgagatttgatgcaacagcagatgaccttatagatgtcattgagggaagtagaatctacatgccttgcatctatgtcgtcaacaaaatcgaccagatcacagttgaagagctggatatcttggacaaacttccccattactgcccaattagtgcacatctggaatggaaccttgatgggcttctagagatggtctgggaatacctagatttgtgcaggctatacacaaaacccaaagggctgaacccagactatgaggatcctgtgatcttatcatccaagaggaaaacagtggaagacttctgcaaccaaatccacaaggacatggcgaaacagtttaaatatgcactggtgtggggttctagtgtgaagcataagcctcagagagtcggcaaggagcatgagcttgaggacgaggacgttgttcagatcattaagaaaatataagctacacaccgtggggcgagtgattctgttttgcggaccaggaaggagttctcagctatggaactttttgagaagcagctacatttgggcccttgttccttttgctagctctgatgcccattgttgggctgctgtttgcataaaaatccggtttcgatcacaagacaaaatgtggacagttttttatttgttagcttgtgccaagtagccatatgtaattgtgagtttgtgactgatgcctgtcatgccgcaaccgctgaacacatggaaagatgcttatctatcttgacgagatgttcttatagcctggcaagtgtttcagtttggttagtttatcatttccgtttccgatctccccgatgatgggactgcacattgctttgtcaatgatggac

SEQ ID NO: 7641 - DNA, 1652 bp, Amorphophallus konjac
gggggagcagacccaacaagcggaagagaacacgagaggggagcgagaggttgcagcagcgcgaggggaggaggagaaaatggctaccgtgatgcagaagatcaaggacatcgaggatgagatggctaggacgcagaaaaacaaagccactgctcatcaccttggtttgctcaaggctaaacttgcaaagctgcggagggagcttctggagccttcaacaaaaggtggcggtggtgctggtgaaggttttgatgttactaaaagtggagatgcccgagttggactagtaggatttccatcagttggaaagtcaacactgctcaataagctgacaggcaccttttcagaggttgcttcatatgagtttactaccttaacatgcattccaggagtaatcgtgtataaaggcgctaaaattcagttattggatttacctgggattattgaaggtgcaaaggatgggaagggtagaggaagacaggtaatcagtactgccaggacatgcaatatcattttgattgttcttgatgcaataaagccaataacccacaagcggctgattgagaaagagcttgagggatttggtataaggttgaacaaggaacctcccaacttgagcttcagaaagaaagacaagggaggcatcaattttacctctaccgtggcaaacacacacctagaccttgagactgtgaaagcaatttgtggtgaatataggatacataatgctgatatatctcttagatatgatgcgactgctgatgatcttattgatgtcattgagggcagcagaaaatatatgccctgcatctacgctgttaacaagattgatcagataaccctggaggagctggagatactggacaagcttcctcattactgtccaataagtgctcacttggaatggaatcttgatggattactggagaagatatgggattaccttgatctagtccgcatatatacaaaaccaaaagggatgaatccggactatgaagatccagtaattctatcatccaagcagaggacggttgaagacttctgcaatagaatccacaaagacatgatgaagcaattcaaatatgccctggtttggggctcaagtgtgaagcacaagccgcagagagtaggcaaggagcatgagcttgaggacgaagatgtcgttcagataataaagaaagtgtaggccgttgatctgattcaagaatctgaaagtgtgtgtatgtcccaaggatctggtcttgtcgagtcatggaacggagcggtgaagggaagcacttcacctatttgcactcaaatttttctacaagtagaaaggtgctcttctatgtgaacctttttaactcatttccttggatcgggctatagtaattttgtccttctagtcttgtataattatgtaagaaaaggattgctggcgtagcacttgtgactgagttttgcagagctaaaccgaagagaggataaatgatgcatccctggacctactttgaaagattcgccttgtatggtaggattactacagtggacataaagttttgtcgagagaacaatataggatctaaactagataggagcttcaatggacataaagtctgtctgataggaggccgaagagttgtgctctggatagagtatcaagaaggggcttc

SEQ ID NO: 7642 - DNA, 1615 bp, Aristolochia fimbriata
ctcgtagcattttcgcaattcgtctccttcgcgcggcggatcattcatacactcatcggggaaacgaagagcggctctcggacagcttctgatcgttgcaacaatggcgaccatcatgcagaaaataaaagatattgaagatgagatggcaaggacacaaaagaacaaagcaactgctcatcaccttggtttactgaaggctaaacttgcaaagctaagacgggagctccttgatccaccttcaaaaggtggtggtggtggtgccggtcagggatttgatgttactaaaagtggagactctcgtgttggcctagttggattcccttcagttgggaaatcaactcttcttaataagctgacaggaactttctcagaggtcgcttcatatgaatttactactttaacttgcattccaggagtgatagtgtaccgaggtgcaaaaattcagttgttagatcttccaggaattattgagggtgcaaaagatggaaagggtagagggaggcaggtcatcagtactgctagaacatgcaattgtattctaattgttcttgatgcactaaaaccaattacccacaaacgcctgatcgaaaaagagcttgaaggatttggcattaggctgaacaaggaaccaccaaacttgacttttaggaagaaagataagggcgggatcaatttcacatccacagttacaaataatcatctagaccttgaaacagtgaaagcaatatgcagcgaatacagaattcataatgcagatatatcccttcgatatgatgctactgcagatgaccttatagatgtgattgaaggtagtaggatttatatgccctgcatctatgtggtgaacaagattgatcagatcacactcgaagagctagagattttggataaacttcctcactattctcctgtcagtgctcatttggaatggaaccttgatggcctgcttgagaagatatgggagtatcttgaccttactcgtatatacaccaagcccaagggaatgaatcctgactatgaagaccctgtgattctatcatctaagaaaagaacagtcgaagacttctgcaacagaatccacaaagacatgcttaagcagtttaaatatgcattggtatggggctccagtgtgaaacacaagccacagagggtgggaaaggagcatgaactcgaggacgaggacgtggtacagataattaaaaaggtgtgatctaaagttacttgcagttttggcagctcagtgattcagttggggtacaggagagagactcttgagggtggataaagtgaaactaggctattcttcctcgcttgttggtacagagccgttgttgatacccctcccatgtacgtctgtctatgtttacctagccagcagggttgctggtatgtactcgagtaatattatcgagttgttgaacgaggctgattctgtgtttcgctaggtttccattgctctttttagcaattcgtggtcatgaatgaaagaaggctgtttgcgagcattttgtgattgcgttagggtaaccgcctgactagtaccaaaggccctgttatcagtttattggggcagcgtgggagttacggaacttcatttttatatttgttagat

SEQ ID NO: 7643 - DNA, 1590 bp, Centaurea maculosa
gactccagttgctctagaagcctctctttccttcttcccctggttcatataccagtttcgtaaagctatatctatctatctatctatatatacatttcaaaacaacatcaaagcagctactctactcctactcttcaacaatggcgactgttatgcagaaaatcaaagatatcgaagatgagatggccaagacccaaaagaataaagcaactgcacatcacttggggttgctgaaggctaagcttgcgaaattgcgaagggagcttcttacccctacgacaaagggaggtggtggtgctggagaaggatttgatgttacaaaaagtggagatgcaagggttggtcttgtgggtttcccttctgttgggaagtcaacactattaaacaagttaactggcactttttcggaggttgcttcatacgagtttaccactctcacctgcattccaggtgttatcacttatcggggagcaaaaattcagttgttggatcttcctggtattattgagggtgccaaggatggaaagggtagaggaaggcaggttatcagtactgctaggacatgcaactgtatactgattgtgctggatgcaataaagccgataacccacaaacgtctgatagaaaaggagcttgaaggatttggcattaggttaaataaggagcccccaaatctgaccttcaggaaaaaggagaagggtgggattaatttcacgtcaactgttgccaatacacatctggacctcgaaacagtgaaggcaatatgtagtgaatacagaatacataatgccgatgtgactcttaggtttgatgcgactgctgatgatctcatagatgttattgaagggagtaggatatatacgccttgcatctatgttgtcaacaaaatagatcagataacgcttgaagagctcgagatattggataaacttcctcactactgtcccgtcagtgctcacttggaatggaatcttgatggtctgctcgagatgatatgggaatatctcagtttgactcgcatttacaccaaacccaaagggatgaatccagactatgaggatcccgtaattctttcatcgaaacgaaaaaccgtcgaggacttctgcaatcgaatccacaaagacatgcttaagcaatttaaatatgcgctggtgtggggttctagtgcaaaacacaagccacaaagggttggcaaggaacacgagcttgaagatgaagatgtcgtgcagattatcaagaaagtgtgaaagccaaacccgacaaatctccagctctgtttttgtgattgtatcatcttgaaagcaggtatagaaagcgtactcgttagagatgctgtcactgctaccctttttgagtttcgttaagtagtgttaggtttattaaatgcgttgaattgtctccttttagctttggtcttggtaacggatattgatgggtgtctaccctttaggtcgaaaaaagctgtaatttaggcatgctaagatttcgttttataactcttcttggctcctttttgtactttgggaattaaaaaaattcgagtgatgtttgtggtacagtgtcgaatatgcaagattatatgtcgcaacc

SEQ ID NO: 7644 - DNA, 1544 bp, Centaurea maculosa
aaccctctttccttcttcataccagtttcttaaagctatctatatatatacatttcaaagcagctactctactcataaacttcaacaatggcgaccgttatgcagaaaatcaaagatatcgaagatgagatggccaagacccaaaagaataaagcaactgcacatcacttggggttgctgaaggctaagctagcaaaattgcgaagggagctccttacccctacaacaaagggaggtggtggtgctggagaaggttttgatgttacaaaaagtggagatgcaagggtcggtcttgtgggtttcccttctgttgggaaatcaacactgttaaacaagttaactggcactttttcggaggttgcttcatacgagtttaccactctcacctgcattccaggtgttatcacttatcggggagctaaaattcagttgttggatcttcctggtattattgagggtgctaaggatggaaagggtagaggaaggcaggttatcagtactgctaggacatgcaactgtatactgattgtgctggatgcaataaagccaataacccacaaacgtctgatagaaaaagagcttgaaggatttggcataaggttaaataaggagcccccaaatctgaccttcaggaaaaaagagaagggtgggattaatttcacgtcaacagttgctaatacacatctggacctcgaaacagtgaaggcaatatgtagtgaatacagaatacataatgccgatgtgactcttagatttgatgcaactgctgatgatctcatagatgttatcgaagggagtaggatatatacgccttgcatttatgttgtcaacaaaatagatcagataacacttgaagagcttgagatattggataaacttcctcactactgtcccgtcagtgctcatttggaatggaaccttgatggtctgctcgagatgatatgggaatatctcagtttgactcgcatttacaccaaacccaaagggatgaatccagactatgaggatcccgtaattctttcatcgaaacataaaaccgttgaggacttctgcaatcggatccacaaggacatgcttaagcaatttaaatatgcgctggtatggggttctagtgcaaaacacaagccacaaagggttggcaaggaacatgagcttgaagatgaagatgtcgtgcagattatcaagaaagtgtgaaagccaaacccgcctaatctgcagctccgtttttgtgattgtatcatcttaaaagcaggtatagaaagcatactcgttagagatgatgtcactgctaccctttttgagtttcgttaagtagtgtgttaggtttattaaatgcgttgaattgtctccttttagctttggtcttggtaacggatattgatgggtgtctacactttaggtcgaacaaaggtgtaatttaggcatgctaagatttcggtttataacttttcttggctcctttttgtactcggggaactaaaaaatttcgagtgatgtttgtggtacagtgtcgaatatgcaagaatatatgttgcaacctcgat

SEQ ID NO: 7645 - DNA, 1581 bp, Cirsium arvense
ttcaaaaattcataaaattatagtcatcgaaaccttaacatcaaaacacgaaaaatagggtttttgtgagcatctcacctgcgactccagttgctctagaaccctctttccttcttcataccagtttcttaaagctatctatatatacatttcaaagcagctactctactcataaacttcaacaatggcgaccgttatgcagaaaatcaaagatatcgaagatgagatggccaagacccaaaagaataaagcaactgcacatcacttggggttgctgaaggctaagctagcaaaattgcgaagggagctccttacccctacaacaaagggaggtggtggtgctggagaaggttttgatgttacaaaaagtggagatgcaagggtcggtcttgtgggttttccttctgttgggaaatcaacactgttaaacaagttaactggcactttttcggaggttgcttcatacgagtttaccactctcacctgcattccaggtgttatcacttatcggggagctaaaattcagctgttggatcttcctggtattattgagggtgctaaggatggaaagggtagaggaaggcaggttatcagtactgctaggacatgcaactgtatactgattgtgctggatgcaataaagccaataacccacaaacgtctgatagaaaaagagcttgaaggatttggcataaggttaaataaggagcccccaaatctgaccttcaggaaaaaagagaagggtgggattaatttcacgtcaacagttgctaatacacatctggacctcgaaacagtgaaggcaatatgtagtgaatacagaatacataatgccgatgtgactcttagatttgatgcaactgctgatgatctcatagatgttatcgaagggagtaggatatatacgccttgcatctatgttgtcaacaaaatagatcagataacacttgaagagcttgagatattggataaacttcctcactactgtcccgtcagtgctcatttggaatggaaccttgatggtctgctcgagatgatatgggaatatctcagtttgactcgcatttacaccaaacccaaagggatgaatccagactatgaggatcccgtaattctttcatcgaaacataaaaccgttgaggacttctgcaatcggatccacaaggacatgcttaagcaatttaaatatgcgctggtatggggttctagtgcaaaacacaagccacaaagggttggcaaggaacatgagcttgaagatgaagatgtcgtgcagattatcaagaaagtgtgaaagccaaacccgacaaatctccagctccgtttttgtgattgtatcatcttaaaagcaggtatagaaagcatactcgttagagatgctgtcactgctaccctttttgagtttcgttaagtagtgtgttaggttttattaaatgcgttgaattgtctccttttagctttggtcttggtaacggatattgatgggtgtctacactttaggtcgaaaaaaggtgtaatttaggcatgctaagatttcagtttataacttttcttggctcctttttgtactctgggaactaaaaa

SEQ ID NO: 7646 - DNA, 1572 bp, Echinacea purpurea
tttgggggcatctgacccgagacttcatcttctctagaacactctcataccagctatacacttcaaaacaacacctactacctctatctgcttcaaaaatggcgaccgttatgcagaaaatcaaagatatcgaagatgagatggcaaagacccaaaagaataaagcaactgcacatcacttgggattactaaaggctaagcttgcaaaattgagaagagagcttctaacacctacatcaaagggtggtggtggtgctggtgaaggttttgatgttacaaaaagtggtgatgcaagggttggtcttgtggggttcccctctgttgggaaatcgacacttttaaataagctaactggcactttttcggaggttgcttcatatgagtttactactctcacctgcattccaggtgtaatcacatatcggggagctaagattcagttgttggatcttcctggtattattgagggtgctaaggatggaaagggtagaggaaggcaggttatcagcacagctcggacatgcaactgtattctgatcgtgctggatgcaataaagccaataacacacaaacgtctgattgaaaaagagcttgaaggatttggcattaggttaaataaggagcccccaaatctgacatttaggaaaaaggagaagggtgggattaattttacatcaacagtcgctaatacacatctggaccttgaaacagtgaaggcaatatgcagcgaatacaaaatacataacgctgatgtcactcttaggtttgatgcaactgctgatgatctcatagatgttattgaagggagcaggatatacacgccttgcatttatgttgtcaacaaaattgatcagattacacttgaagagcttgaaatattggataaacttcctcactactgccctgttagtgctcatttggaatggaatcttgatggtctgttggagatgatatgggaatatctgaatttgactcgtatttacacaaaacccaaaggcatgaatccagactatgaggaccctgtaattctttcatctaaaaagaaaactgttgaggatttctgctttagaatccacaaggacatgcttaagcagtttaagtatgcactggtctggggttctagtgcaaaacacaagccgcaaagagttggcaaggaacatgagcttgaagatgaagatgttgtgcagatcataaagaaagtttaaaacccaaaacccacaaatcatttactcgccatattatccggaagtgagtacagaagcctattcatgacgctgccctattggcggggaagttgcatgttaagtttatcaaatgcattgggtggtttatttatctcgctttgtgcacttgatactgatgtgtgtctaaatattaggacaatgagatcttgaattaagcagattagtggaggatcattccagtattttggtttagaatcccttgatctttatatttacagtttgaaccaattttttagtaatgttgtgatgatagatatatcaaatatgcaagtgattatatttgggtcgaactcgatgtggatggcgttgtttaggtccaaactgtaca

SEQ ID NO: 7647 - DNA, 1324 bp, Echinacea purpurea
ttttggggcatctgacccgagacttcatcttctctagaacactcttcataccagctaataagctataatacacttcaaaacaatacctactacctctatctgcttctacaatggcgaccgttatgcagaaaatcaaagatatcgaagatgagatggcaaagacccaaaagaataaagcaactgcacatcacttgggattactaaaggctaagcttgcaaaattgagaagagagcttctaacacctacatcaaagggaggtggtggtgctggtgaaggttttgatgttacaaaaagtggtgatgcaagggttggtcttgtggggttcccctccgttgggaaatcgacacttttaaataagctaactggcactttttcggaggttgcttcatatgagtttactactctcacctgcattccaggtgtaatcacatatcggggagctaagattcagttgttggatcttcctggtattattgagggtgctaaggatggaaagggtagaggaaggcaggttatcagcactgccaggacatgcaactgtattttgatcgtcctagatgcaataaagccaataactcacaaacgtttgattgaaaaagaacttgaagggtttggcattaggttaaataaggagcccccaaatctgacatttaggaaaaaggagaagggtgggattaattttacatcaacggttgctaatacacatctggatcttgaaacagtgaaggcaatatgcagtgaatataaaatacataatgctgatgtcacccttaggtttgatgcaactgccgatgatctcatagatgttattgaagggagtaggatatatactccttgcatttatgttgtcaacaaaattgatcagataacgctcgaagaactggaaatattggacaaacttcctcactactgtcctgtcagtgctcacttggaatggaaccttgatggtcttctagaaatgatatgggaatatctcaatttgacccgtatatacacaaaacccaaagggatgaatccagactacgaggaccctgtgattctttcgtctaaaaagaaaactgttgaagatttctgctttagaatccacaaggacatgcttaagcagtttaagtatgcactggtctggggttctagtgcaaaacacaagccacaaagagttggcaaggaacatgagcttgaagatgaagatgttgtgcagatcataaagaaagtttaaaaccccaaacccacaaatcatttactcgccatattatccggaagcgagtacagaagcctattcatgatgctgccctattggcgggacaaagagatcttgaagtaagc

SEQ ID NO: 7648 - DNA, 1404 bp, Euonymus alatus
ttcttctccgtctcaaaccttcagcaatggcgactgtgatgcagaaaatcaaggatatcgaagatgagatggcaaggactcaaaagaacaaggctactgctcatcatttaggtttgctcaaggccaaacttgcaaaacttcggagagaactccttactccttcatccaaaggaggcggtggtggtgctggtgaaggttttgatgttactaagagtggagatgcaagagttggtcttgtgggtttcccttctgtggggaaatctacacttctaaataaattaacggggacattttcagaggttgcttcctacgagtttactaccttgacttgcattcccggtgtgatcatgtatagaggagctaaacttcagttattggatctccctggtatcattgagggtgctaaagacggaaagggtcgaggaaggcaggttatcagcactgctaggacatgcaattgtatcttaattgtgcttgatgcaataaagccaataactcataagcgtttaatagagaaagagcttgagggatttggcataaggttaaacaaggagccgcctaatctaacttttaggaagaaagacaagggtgggatcaatctaacctcgacggtcacaaacacaaatcttgatcttgaaactgtgaaggcaatatgtagtgaatacagaattcataatgctgatattactttgaggtgtgatgcaactgctgatgacctcatagatgtcatagagggtagtaggatatatatgccttgcatctatgttgtgaataagattgatcagattacacttgaagagcttgaaattttggataaactccctcactactgcccagtcagtgctcacctcgaatggaaccttgatgggttgttggagaaaatatgggagtatcttaatttgactcggatatacacaaagcctaaagggatgaacccagactatgaagatcctgtcatcctgtcgtccaaaaagagaacagttgaggacttctgcgttcgaatccacaaggatatgctgaaacaatttaaatttgctctagtatgggggtccagtgcgaagcacaagcctcagagagttggcagggagcatgagcttgaggatgaagatgttgttcagattatcaaaaaggtgtgagactgaaagaattttgttagaagcattaaggaatatctggaaccagctttgagaggattcccaaccatggccaagttcaaggatgaattagattgatatccattggagcacgcgtgtaatggttgctgtataaggtactagctgtcttgtgcctttataaactaaggaaacttagagaagaaaataatattgatatcttgggatggtgtgttaaaatgttgtttctatgtttagtcttttcatgataatcagatacttcaaagtatga

SEQ ID NO: 7649 - DNA, 1360 bp, Flaveria ramosissima
ttagaaccctcttcatactagctacaaccttatatacttcaattcaaacaacagctaccatctatctgcttcaacaatggcgaccgttatgcagaaaatcaaagatatcgaagatgagatggcaaagacccaaaagaataaagcaactgcacatcacttgggattattgaaggctaagcttgcaaaattgagaagggagcttctcacacctacttcaaagggaggtggcggtgctggtgaaggttttgatgtgacaaaaagtggtgatgcaagggttggtcttgtcgggttcccttctgttggaaaatcaacactgttaaataagttaactggcaccttttcggaggttgcttcatatgagtttactactctcacctgcatcccaggtgttatcacataccgaggagctaagattcagttgttggaccttcctggtattattgagggtgctaaggatggaaagggtagaggaaggcaggttatcagtactgccaggacatgcaactgtattctgattgtgctggatgcaataaagccaataacccacaagcgtctaatcgagaaggagcttgaagggtttggcattaggttaaataaggagcccccgaatctcacattcaggaaaaaagagaagggcgggattaattttacatcaacagtagctaatacacatctggaccttgaaacagtgaaagcaatatgcagcgagtacaagatacataacgctgacgtcactcttaggtttgatgcaactgctgatgatctcatagatgttattgaagggagtaggatatatactccttgcatctatgttgtcaacaaaatagatcagatcacgcttgaagagctggaaatattggataaacttcctcactactgccctgttagtgctcacttggaatggaatcttgatggtctgctagagatgatatgggaatatctgaatttgactcgtatttacacaaaacccaaagggatgaatccagactatgaggaccctgtaattctttcatccaaaaagaaaactgttgaggatttctgtataagaatccacaaggacatgcttaagcaatttaagtatgctctggtctggggttctagtgcaaaacacaagccacaaagagttggcaaggaacatgagctcgaggatgaagatgttgtgcagatcataaagaaagtttaaaaataagaccaccaaatctcttactccattttgagtgttgcatcatctggaagcaattatagaagcctatccatgttaccagtgtgttgaggtagttgaagcaggtaaggtttatcaatgaatggtttctttagcttagtgtttgtactggatgctgatgtgtgtctaaacattagt

SEQ ID NO: 7650 - DNA, 1593 bp, Quercus alba
gcctccattttttctagtaccttcttcttcagcctctctctctctgcgaaaaagaaccacttcatagttcataaccgtcacagcccaatctctctctctctctctacgcttctctgcttcaacaatgtcgacggttatgcagaaaatcaaagacatcgaagatgagatggcaaaaactcaaaagaacaaggctactgctcatcacctgggattgctcaaggctaagcttgcaaaactacggagggaactccttgcgcctccctcaaagggaggtggtggtggtgctggtgaaggatttgatgttactaaaagtggagatgcaagagttggtctagtgggtttcccttcagtagggaaatctacactgttaaataaattgacagggaccttttcagaggttgcttcctatgaatttactaccttaacttgcatcccaggtgtgattgtgtatagaggagctaaaattcagttgttggatctccctggaattattgagggtgctaaggatggaaagggtagaggaaggcaggttattagcactgctagaacatgcaattgcattttaattgttctcgatgcaataaagccaataactcacaaacgtctgatagagaaagagcttgagggatttggcataaggttaaacaaggaaccacctaacctgactttcagaaagaaagataagggtggaattaactttacctcaacagttgccaacacacatctggaccttgaaactgtgaaggcaatatgtagcgaatacagaattcataatgctgatattactcttaggtttgatgcaactgcagatgaccttatagatgtcatcgaaggcagtagaatatatatgccttgcatctatgttgttaacaagattgatcagattactctggaagagctggagattttggataaacttcctcactactgtccaatcagtgcgcacctggaatggaatcttgatggcctgctggagaagatatgggaatatcttaatttgactcgcatatacacaaaacctaaagggatgaatcctgactatgaagatcctgtaatcctgtcatctaaacataaaacagttgaggacttctgtgaacgaatccacaaggatatggttaaacaatttaagtatgctttggtatgggggtcaagcgcgaaacacaagccccaaagggttggcaaggagcatgagcttgaggatgaggatgttgttcagataatcaagaaggtttaactgtagagactagagacactgtagtcctggaacagcttctcaatgtctgttaggaagctacctttgaaagaaattttcagcagtaaggctcttgttatgagatttatcttcaatcgtgcctagtttgctagacctaaggattctatgtcttctgccttttcattcaaattaggtagaacaagggggagcttgatttgtaattaagctttttttgtggtggtcaagctttgtttgtaggggttttgcctactgcttggttgtatgggaccgaacatggaatctattaaagaaacggactacatagaacagatggaagttataacttaaaatgacttcactaaatcttggtgcatttgaga

SEQ ID NO: 7651 - DNA, 1658 bp, Avena sativa
tccctcccgtgctcctcccctcccctcccttccgcatccaggcgagcgtagccgcgagcgcgagcgacgagcaggcgaacctccccagtcccctccgcgctccgcagccatggcgaccgtcatgcagaagatcaaggacatcgaggacgagatgtcaaagacgcagaagaacaaagccactgcgcaccatcttggtcttctgaaggctaaacttgcaaagttacggcgggaattgctcactcctacaaccaaaggtggtggtggtgctggtgagggattcgacgtgacaaaaagtggagatgcacgtgttggtttggtgggctttccttctgttgggaaatcaacattgttgaacaagttgacaggaactttttcagaggttgcatcctacgagtttacgactttaacatgcattcctggagttattatgtacaaaggagctaaagtgcagcttctcgatcttccgggaatcattgaaggtgctaaagatggaaagggtagagggaggcaggttatcagcacagctaggacatgtaatgtcattctgattgttcttgatgccataaaaccaataactcataagcgtctcattgagaaggagctcgagggattcggcattcggctgaacaagacaccccccaatatgacgttcaggagaaaagaaaagggtggcatcaatttcacatcaacagtagcgaacacacacttggaccttgatacagtaaaagcaatctgtagcgagtacaggattcataatgctgatgtgtcccttaggtttgatgcaacagcagatgatctcatcgatgtcatcgagggaagtagaatttacatgccttgcatctatgtcgtcaacaaaattgaccagatcacagtcgaagagctgaatatcttagacaaacttcctcattactgcccaatcagtgcccatcttgaatggaaccttgatggacttctagagatggtctgggaatacctagatctggttaggctatacacgaaacccaaagggctaaacccagattatgaggatcctgtgatcttatcaaaaaagaggaaaactgtggaagacttctgcaaccaaatccacaaggacatggcgaagcagttcaaatacgcgctggtgtggggttctagcgttaagcacaagcctcagagggttggcaaggagcatgagctcgaggatgaggatgttattcagatcattaagaagatatagttacaccgtggagcgagcggatctttttttgcaaaccaggaaggagctctcagccatgaagtttcttgagatgtttcttatgcaagctatggtgcctgtagatgtgtcgctgtttgcataaaccttgttgtgatggaaagacagaatgtaggcagttgctttttccctcccgtgaagtagccatgtaatcatgctgttcgtcgcagatgaactgaaagtcccgccacagctgaactcatgaaaagaaagacgcgtgcttatcttctgaagatgttaagacggttcttataatggtgcaagtgtttcggttttgttagtttaccattatccattgtacctaatgaacattgctgttaactgctattgaggctgcgaactttgatgaagaaaggacacatcggaagggtactggttttgattattaaaggagatcaccttatct

SEQ ID NO: 7652 - DNA, 1441 bp, Helianthus annuus
aaccgcagtcatttcatgtaattagatcgatttccccattacacaaaatagggttttggggtgcatttgagctgtgactccatcttttctctagaactctcttcttcataccagctaattacttcaaaacaaacaacacctgctatctatctatctgcttcaacaatggcgaccgttatgcagaaaatcaaagatatcgaagatgagatggcaaagacccaaaagaataaagcaactgcacatcacttgggattactgaaggctaagcttgcaaaattgagaagagaacttctaacacctacatcaaagggaggcggtggtgctggtgaaggttttgatgttacaaaaagcggtgatgcaagggttggtcttgtggggttcccctctgttggaaaatcgacacttttaaacaaattaactggcactttttcggaggttgcttcgtacgagtttactactctcacctgcattccaggtgttatcacatatcgaggagctaagattcagttgttggatcttcctggtatcattgagggtgctaaggatggaaagggtagaggaaggcaggttatcagcacggccaggacatgcaactgtattctgattgtgctggatgcaataaagccaataactcataaacgtctgattgaaaaagaacttgaagggtttggcattaggttaaataaggagcccccaaatctgaccttcaggaaaaaagagaagggtggaattaactttacatcaacggttgctaatacacatctggatcttgaaacagtgaaggcaatatgcagtgaatacaagatacataatgctgatgtcactcttaggtttgatgcaactgctgatgatctcatagacgttattgaagggagtaggatatatactccttgcatctatgttgtcaacaaaatagatcagattacacttgaagagctggagatattggataaacttcctcactattgccctgttagtgctcacttggaatggaatcttgatggtcttctagagatgatatgggaatatctgaatttaactcgtatttacacaaaacccaaagggatgaatccagactatgaggaccctgttattctttcatctaaaaagaaaactgtcgaggatttctgctttagaatccacaaggacatgcttaagcaatttaagtatgcactggtctggggttctagtgcaaaacacaagccacaaagagttggcaaggaacacgagcttgaagatgaagatgttgtgcagatcataaagaaagtttaaaaataaaaccactaaatctcctactccatttttgagttttatgttactgaacaggtaaggttggtttatcagtgggtggcttagtttttgtagtggatgctgatgtgtgtctaaaacattaggacaaagaaatcataaattaagcagatttatgtatgagtgtttcaat

SEQ ID NO: 7653 - DNA, 1656 bp, Triticum aestivum
aacattctcctcctcctcctcacccctgacctcccttccgcatccacgcgagcgaagccgcgccggcgaagagcaggcgaaccttctacaaccctccgactccgagcccccttccgcggcccgcagccatggcgaccgtcatgcagaagatcaaggacatcgaggacgagatgtcaaagacgcagaaaacaaagccactgcacaccatcttggtcttctgaaggctaaacttgcaaaattacggcgagagttgctcactcctacaaccaaaggtggtggtggtgccggtgaggggttcgacgtgacaaaaagtggagatgcacgtgttggtttggtgggctttccttcggttgggaaatcaacattgttgaacaagctgacaggaactttctcagaggttgcgtcctatgagtttacaactttaacatgtattcctggagttattatgtacaaaggggctaaagtacagcttctagatcttccgggaatcattgaaggtgctaaagatggaaagggtagagggaggcaggtcatcagtacagccaggacatgtaatgtcattctgattgttcttgacgccataaaaccaataactcacaaacgtctcattgagaaggagcttgagggatttggcatccggttgaacaagacacctcccaatatgacattcaggagaaaggaaaagggtggcatcaattttacatcaacagtagcgaacacacacttggaccttgacactgtaaaagcaatctgtagtgagtacaggattcataatgctgatgtctccctgagatttgatgcaacagcagatgaccttatagatgtcattgagggaagtagaatctacatgccttgcatctacgtcgtcaacaaaattgaccagatcacagttgaagagctggatatcttggacaaacttccccattactgcccaattagtgcacatctggaatggaaccttgatgggcttctagagatggtctgggaatacctagatttgtgcaggctatacacaaaacccaaagggctgaacccagactacgaggatcctgtgatcttatcatccaagaggaaaacagtggaggacttctgcaaccaaatccacaaggacatggcgaagcagtttaaatatgcactggtgtggggttcaagcgtgaagcataagcctcagagagtcggcaaggagcatgagcttgaggacgaggacgttgttcagatcattaagaaaatataagctacacaccgtggtgcgagcgattctgttttgcggatcaggaaggagttctcagctatgaaactttttgagaagcagctacattagggccggtgttccttttgctagctctgatgcccatcgtcgggctgctgtttgcataaaaatctggtttcgatcacaagacaatgtggacagtttttttattagcttgtgccaagtagccatatgtaattgtgactgatgcctgtcatgccacaaccgctgaacacatgggaagatgcttatctatctcgagaagatgctaagatggttcttatagcttttgaagtgtttcagtttatcgtttctgatctccctgatgatgaggctgctgattatactttgccaatgatgaacaaaacttgaggataacatggcaagtgtactggttgtcattacta

SEQ ID NO: 7654 - DNA, 1658 bp, Brachypodium distachyon
cctcccctccccgaccactctctcccttccgcatccgcgcgagcgaggagcagcccaaccttcccgagccggagccacctccgctgcccgcagccatggcgaccgtcatgcagaagatcaaggacatcgaggacgagatgtcaaagacacagaaaaacaaagccactgcacatcatcttggtcttctgaaggctaaacttgcaaaattaagacgggagttgctcactcctacaaccaaaggtggtggtggtgctggtgagggattcgatgtgacaaaaagtggagatgcacgtgttggcttggtgggctttccttcggttgggaaatcaacattgttgaacaagttgacaggaactttttcagaggttgcatcctacgagttcacgactttaacatgcattcctggagttatcgggtacaaaggggctaaagtgcagcttctagaccttccaggaatcattgaaggtgctaaagatggaaagggtagagggaggcaggttatcagcacagctaggacatgcaatgtcattctgattgttcttgatgccataaaaccgataactcacaagcgtctcattgagaaggagcttgaggggtttggcattcggttgaacaagacaccccccaatatgacattcaggaaaaaggaaaagggtggcatcaattttacatcaacagtagcaaacacacacttggatcttgacacagtaaaagcaatatgtagtgagtacaggattcataatgctgatatctcccttagatttgatgcaacagcagatgatctcatagatgttatcgaggggagcagaatttacatgccttgcatctatgtcgttaacaaaattgaccagatcacagtcgaagagctggatatcttagacaaacttccccattactgtccaatcagtgcacatcttgaatggaaccttgatggacttctagagatggtatgggaatacctagatttggttaggatatacactaaacctaaagggctgaacccagattacgaggatcctgtgatcttatcaaccaagaggaaaacagtggaagacttctgcaaccaaatccacaaggacatggcgaaacagtttaaatatgcactggtgtggggttctagcgtgaaacataagcctcagagagttggcaaggaacatgagcttgaggacgaggatgttgttcagatcattaagaaaatataaccacaaaccatggagtgagggattctattttgcaaatctggaaggagctatgagttttttgagaagcagctacacttgaagaacttgtgtttctatcgctagctatgatgcccacaggcaggcggctgttcgcataaaacctgttttgatctaaagacagaatgtagagttttttttccccttgtgcgaagcagcttgtaattttgatgtttgtcacagatgaaccaaaagcgagccacacagtccacagcccgtcgagcacatggaaagatgcttccttatctttagaatatgataagatggttcttatgcttgttcagtttggttagcttaacattttctatttgcctaatgatgggcgcccttgaccattattagtcctgtaagcacccaaatcatcctgatgatggaaaaacttgaggatagcatgtgaaacctagtggttatgattattca

SEQ ID NO: 7655 - DNA, 1567 bp, Ricinus communis
caaaactgtatcgcagcaagaagtactgcacttggatttgccacacggcgtcgtcgagaaatctcctttaatagtggtttgtaagcttgtaagctgcaaaaatggcgactgttatgcagaaaatcaaagatattgaagatgagatggcaaggactcaaaagaacaaggctacagcacatcaccttggtttgcttaaggctaaacttgcaaagctacgtagagaactccttgaaccttcatcaaaaggaggtggtggtgctggtcaaggttttgatgttactaaaagtggagatgccagagttggcctagtgggttttccttcagttgggaaatcgacactgctaaacaaattaacaggcacgttttcagaggttgcttcctatgaatttaccactttgacttgcatcccaggcgttattgtttatagaggagctaaaattcagttattggaccttcctggtattattgaaggtgctaaggatgggaagggacgaggaaggcaggttatcagtactgctaggacatgcaactgtatcttgattgttcttgatgcaataaagccgataactcacaagcgtctgatagagaaagagcttgagggatttggcataagattaaacaaggaaccacctaatctgacattcaggaagaaagacaagggtgggattaatttcaccacaacagttgccaacacacaccttgatcttgaaactgtgaaggcaatatgtagtgaatacagaattcacaatgctgatattacattgagatatgatgcaactgctgatgacctgattgatgtcattgagggcagtaggatatacatgccctgcatttatgtagtaaacaagattgatcagattaccctggaagagctggagattttggacaaactgcctcactactgcccaatcagtgctcacctagaatggaaccttgatggtttgctggacaagatttgggaatatctagatttgactcgcatatacacgaagccaaaaggaatgaacccagactatgaagatcctgtaattctgtcatctaaaaagcgaacagttgaggatttctgcatccgtatccacaaggatatgttaaaacaatttaagtatgctctggtgtggggatcaagcgctaaacacaagccccagagggttggcaaggaacatgaactagaggatgaagatgtcgtgcaaataataaagaaagtgtgatgaacactcggctccaatcgcgagtcctctatttaagttctgcaggttgcagaagccggtgtgtgaaagattccatccaattttctgcattatgaaagcgatcgagtggaagagaagctcaatttctgagattgtaggtgacagcttgttatgtaattaatctaaattctgatcaagcacttttcgatggtggtataatttttgtttgccatgatatgtacaaccttagtgatgagattggtcaaagagaattagttggttgaataaacctgggcggaaattagagaccgtatccccattaattgtgcttgaaaaacagagttttctaagagatagctcatgcatttccattggtctcc

SEQ ID NO: 7656 - DNA, 1403 bp, Centaurea maculosa
tatttaataatcatcgaatatagctccgaaaccttacgtctaaaacaccaccatcaagaaaatagggtttttatacctgcgactccagttgctctagaagcctctctttccttcttcccctaattcatacccagtttcttaaaagctatctctccatttacacgtaattcaaaacaacatcaaagcagctactctactcctactcttcaacaatggcgactgttatgcagaaaatcaaagatatcgaagatgagatggccaagacccaaaagaataaagcaactgcacatcacttggggttgctgaaggctaagcttgcaaaattgcgaagggagcttctaacccctacgacaaagggaggtggtggtgctggtgaaggttttgatgttacaaaaagtggagatgcaagggttggtcttgtggggttcccttctgttgggaagtcaacactattaaacaagttaaccggcactttttcggaggttgcttcgtatgaatttaccactctcacatgcattccaggtgttatcacttatcggggagctaaaattcagttgttggatcttcctggtattattgagggtgctaaggatggaaagggtagaggaaggcaggttatcagcactgccaggacgtgcaactgtatactgattgtgctggatgcaataaagccaataacccacaaacgtctgatagaaaaagagcttgaagggtttggtataaggttaaataaggagcccccaaatctgaccttcaggaaaaaggagaagggtgggattaattttacgtcaactgttgccaatacacatctggacctcgaaacagtgaaggcaatatgtagtgaatacagaatacataatgccgatgtgactcttaggtttgatgcgactgctgatgatctcatagatgttattgaagggagtaggatatatacgccttgcatctatgttgtcaacaaaatagatcagataacgcttgaagagcttgagatattggataaacttcctcactactgtcccgtcagtgctcacttggaatggaatcttgatggtctgctcgagatgatatgggaatatctcagtttgactcgcatttacaccaaacccaaagggatgaatccagactatgaggatcccgtaattctttcatcgaaacgaaaaaccgtcgaggacttctgcaatcgaatccacaaagacatacttaagcaatttaaatatgcgctggtgtggggttctagtgcaaaacacaagccacaaagggttggcaaggaacacgagcttgaagatgaagatgttgtgcaaattatcaagaaagtgtgaaagccaaacccgacaaatctgcagctctgtttttgtgattgtatcatcttgaaagcaggtatagaaagcgtactcgttagagat

SEQ ID NO: 7657 - DNA, 1589 bp, Festuca arundinacea
cagccttccagagccttccccggcgcccctccgcggccggcagccatggcgaccgtcatgcagaagatcaaggacatcgaggatgagatggcgaagacgcagaagaacaaagccactgcacaccatcttggtggtctgaaggcaaaacttgcaaaattgcggcgggagttgcttactcctacaaccaaaggtggtggcggtgctggtgagagattcgacgtgacaaaaagtggagatgcacgtgttggtttggtgggctttccttcggttgggaaatcaacgttgttgaacaagttgacaggaaccttttcagaggttgcatcctacgagttcacaactttaacatgcattcctggagttattatgtacaaaggagctaaagttcagcttctagatcttccgggaatcattgaaggagctaaagatggaaagggtagaggtaggcaggttatcagcacagctaggacatgcaatgtgattctgatcgttctcgatgccataaaaccaataacccacaagcgtctcattgagaaagagctcgaggggttcggcatccggttgaacaagacgccccccaatatgacgtttaggagaaaagaaaagggtggcatcaatttcacatcaacagtagcaaacactcacttggaccttgacacagtaaaggcgatttgtagtgagtacaggattcataatgctgatgtctcccttaggtttgatgcaacagcagatgatctcattgatgtgatcgagggaagtaggatttacatgccttgcatctatgtcgttaacaaaattgaccagatcacagttgaagagctggatatcttggacaaacttccccattactgcccaatcagtgcccatcttgaatggaaccttgatggacttctagagatggtctgggagtacctagatctggttaggctttacacaaaacccaaaggtctaaacccagactatgaggaccctgtgatcttatcaaccaagaggaaaacagtggaagacttctgcaaccaaatccacaaggacatggcaaaacagttcaaatacgcgctggtgtggggttctagcgttaagcacaagcctcagagggttggcaaggagcatgagcttgaggacgaggatgttattcagatcattaagaagatataatcacactctgtggagcgagcgaatcttttttgcaaaccaggaaggagctatcagttacgaatcttttcgagaaacagctatgttagaagaacttgtgtttctttcactggctgtaagatgcccataggtgggcggctgttggcataaatcctgtttcgatcaaaagacagaatgtagacagtttccttttcccttgtacgaagtagacgtgtaactgtgatgtgtgtgacagatggataaaccaagagtctgccctcaacagccgaacacatgaaaagatgcttgtctatctttagaagatgataagatggttcttataatgcagactatttcattttcgttagtttaccattttccgttgtacctaatgattgactgccaatttttatgatgagaaaaacacatggagaagcttactggtcgaaaaaaaaaaaaaa

SEQ ID NO: 7658 - DNA, 1356 bp, Leymus cinereus x Leymus triticoides
accttccagaaccctccgctccgaggccacctccgcggcccgcagccatggcgaccgtcatgcagaagatcaaggacatcgaggacgagatgtcaaagacgcagaaaaacaaagccactgcacaccatcttggtcttctcaaggctaaacttgcaaaattacggcgagagttgctcactcctacaaccaaaggtggtggtggtgctggtgaggggttcgacgtgacaaaaagtggagatgcacgtgttggtttggtgggctttccttcggttgggaaatcaacattgttgaacaagctgacaggaactttctcagaggttgcgtcctatgagtttacaactttaacatgtattcctggagttattatgtacaaaggggctaaagtacagcttctagatcttccgggaatcattgaaggtgctaaagatggaaagggtagagggaggcaggtcatcagcacagccaggacatgtaatgtcattctgattgttcttgacgccataaaaccaataactcacaaacgtctcattgagaaggagcttgagggatttggcatccggttgaacaagacacctcccaatatgacattcaggagcaaggaaaagggtggcatccattttacatcaacactagcgaacacccacttggaccttgatacagtaaaagcaatctgtagtgagtacaggattcacaatgctgatgtctccctaagatttgatgcaacagcggatgaccttatagatgtcattgagggaagtagaatctacatgccttgcatctacgtcgtcaacaaaattgaccagatcacagttgaagagctggatatcttagacaaacttccccattactgcccaattagtgcacatctggaatggaaccttgatggacttctagagatggtctgggaatacctagatttggtcaggctatacacaaaacccaaagggctgaacccagattacgaggatcctgtgatcttatcatccaagaggaaaacagtggaggacttctgcaaccaaatccacaaggacatggcgaaacagtttaaatatgcactggtgtggggttctagcgtgaagcataagccccagagagtcggcaaggagcatgagcttgaggacgaggatgttgttcagatcattaagaaaatatagctatacagagcaatgattctgttctgcagatcaggaagaagctctcagctatggagctttttgagaagcagctaccctaggacccgtgtttctttaggtgggccgctgtttgcataaaatcccgtttcgatcccaagacagaatgtggacagtttttctttcaccttgtgccaagtagccatatgtaattgtgagtcctgcc

SEQ ID NO: 7659 - DNA, 1504 bp, Avena sativa
tccctcccgtgctcctcccctcccctcccttccgcatccaggcgagcgaagccgcgagcgcgagcgacgagcaggccaaccttcccggtcccctccacgctccgtagccatggcgaccgtcatgcagaagatcaaggacatcgaggacgagatgtcaaagacgcagaagaacaaagccactgcgcaccatcttggtcttctgaaggctaaacttgcaaagttacggcgggaattgctcactcctacaaccaaaggtggtggtggtgctggtgagggattcgacgtgacaaaaagtggagatgcacgtgttggtttggtgggctttccttctgttgggaaatcaacattgttgaacaagttgacaggaactttttcagaggttgcatcctatgagtttacgactttaacatgcattcctggagttattatgtacaaaggagctaaagtgcagcttctcgatcttccgggaatcattgaaggtgctaaagatggaaagggtagagggaggcaggttatcagcacagctaggacatgtaatgtcattctgattgttcttgatgccataaaaccaataactcataagcgtctcattgagaaggagctcgagggattcggcattcggctgaacaagacaccccccaatatgacgttcaggagaaaagaaaagggtggcatcaatttcacatcaacagtagcgaacacacacttggaccttgatacagtaaaagcaatctgtagcgagtacaggattcataatgctgatgtgtcccttaggtttgatgcaacagcagatgatctcatcgatgtcatcgagggaagtagaatttacatgccttgcatctatgtcgtcaacaaaattgaccagatcacagtcgaagagctgaatatcttagacaaacttcctcattactgcccaatcagtgcccatcttgaatggaaccttgatggacttctagagatggtctgggagtacctagatctggtcaggttatacacgaaacccaaaggtctaaacccagattacgaggatcctgtaatcttatcaaaaaggaggaaaacagtggaagacttctgcaaccaaatccacaaggacatggcgaagcagttcaaatacgcgctggtgtggggttctagcgttaagcacaagcctcagagggttggcaaggagcatgagctcgaggacgaggatgttattcagatcattaagaagatatagttacaccgtggagcgagcggatctttttttgcaaaccaggaaggagctctcagctatgaagtttcttgagatgtttcttatgctagctatgatgcccgtagatgtgtaagctgtttgcataaatcttgttgtgatggaaagacagaatgtaatgtaggcagttgattttcctttcgtgaagtagccatgtaatcatgctgatgttcgttgcagatgaaccaaaagtcctgctacagctgcgaaactcatgaaaagatgctaagacggtctataatggtgcaagtgttt

SEQ ID NO: 7660 - DNA, 1513 bp, Helianthus annuus
tagaataagaatcccattctcaaacatccaaaccctgggttttattaacatctaagtatctaacctgcaactccattttctctagaaccctctcactcgcgcaccttctcagcttcaacaatggcgaccgttatgcagaagatcaaagacatcgaagatgagatggcaaagacccaaaagaataaagcaaccgcacatcacttgggattactgaaggctaagcttgcaaaattgagaagggagcttctcacacccacaacaaagggcggtggtggtgctggtgaaggttttgatgttacaaaaagtggtgacgcaagggttggtcttgtgggtttcccttctgttgggaaatcaacgcttttaaataagttaactggcactttctcagaggttgcttcatatgagtttactaccctcacctgcattccaggtgttatcacatatcgaggagctaagattcagttgttggatcttcctggtattattgaaggtgctaaggatggaaagggtagaggaaggcaggttatcagcaccgccaggacatgcaactgtatcctgatcgtactggacgcaataaagccaataacacacaaacgtctgatcgaaaaagagcttgaagggtttggcattcggttaaataaggagcctccgaatctaacattcaggaaaaaagaaaagggtgggattaatttcacatcaacggttgctaacacacatctggatctcgaaacagtgaaggcaatatgcagtgaatataaaatacataatgctgatgtcactcttaggtttgatgcaaccgccgatgacctcatagatgttattgaagggagtaggatatatactccttgcatatatgtcgtcaacaaaatagatcagataacacttgaagagctggaaatattggataaacttcctcactactgccctgttagtgctcacttggaatggaaccttgatggtctgctagaaatgatatgggaatatctcaatttgactcgtatttacacaaaacccaaagggatgaatccggactacgaggaccctgtaattctttcgtctaaaaagaaaaccgttgaggatttctgctttagaattcacaaggacatgcttaagcagtttaagtatgcattggtatggggttctagtgcaaaacacaagccgcaaagagttggcaaggaacatgaacttgaagatgaagatgttgtgcagatcataaagaaggtttaaaactcaaaaccgacaaagcttttagtcaacatattattcggaagtgagtatacaagccaatttaggacactgtcctattgagtcggggaagttgcatgttaggtttatcaaatgcattgagtggtttctttagcttggtttgttcactggatgctgatgtgtgtctaaacattttggtttagaattctttaaactttatttatactctttgaaccaatttttcaagtaatgtttgtggtacagtatcaaatatacaagtgatcatatttgggtcaaacacgttatg

SEQ ID NO: 7661 - DNA, 1559 bp, Avena sativa
ggcgagcgtagccgcgagcgcgagcgacgagcaggcgaacctccccagtcccctccgcgctccgcagccatggcgaccgtcatgcagaagatcaaggacatcgaggacgagatgtcaaagacgcagaagaacaaagccactgcgcaccatcttggtcttctgaaggctaaacttgcaaagttacggcgggaattgctcactcctacaaccaaaggtggtggtggtgctggtgagggatttgacgtgacaaaaagtggagatgcacgtgttggtttggtgggctttccttctgttgggaaatcaacattgttgaacaagttgacaggaactttttcagaggttgcatcctatgagtttacgactttaacatgcattcctggagttattatgtacaaaggagctaaagtgcagcttctcgatcttcctggaatcattgaaggtgctaaagatggaaagggtagaggaaggcaggttatcagcacagctaggacatgcaatgtcattctgattgttcttgacgccataaaaccaataactcacaagcgtctcattgagaaggagcttgagggattcggcatccggttgaacaagacaccccccaatatgacgttcaggagaaaagaaaagggtggcatcaatttcacatcaacagtagcaaacacacacttggaccttgatacagtaaaagcaatctgtagcgagtacaggattcataatgctgatgtctcccttaggtttgatgcaacagcagatgatctcatcgatgtcatcgagggaagtagaatttacatgccctgcatctacgtcgtcaacaaaattgaccagatcacagtcgaagagctgaatatcttagacaaacttcctcattactgcccaatcagtgcccatcttgaatggaaccttgatggacttctagagatggtctgggagtacctagatctggtcaggttatacacgaaacaaaagggctaaacccagattacgaggatcctgtaatcttatcaaaaaggaggaaaacagtggaagacttctgcaaccaaatccacaaggacatggcaaagcagttcaaatacgcactggtgtggggttctagcgttaagcacaagcctcagagggttggcaaggagcatgagcttgaggatgaggatgttattcagatcattaagaagatatagttacaccgtggagcgagcggatctttttttgcaaaccaggaaggagctctcagccatgaagtttcttgagatgtttcttatgctagctatgatgcccgtagatgtgtaagctgtttgcataaatcttgttgtgatggaaagacagaatgtaatgtaggcagttgattttcctcccgtgaagtagccatgtaatcatgctgatgtttgtcgcagatgaaccaaaagtcctgccacagctgcggaactcatgaaaagatgcgtgcctatcttcttaagatgttgagacggttcttataatggtgcaagtgtttcagtttcgttagttcaccattttccattttgtatacctaatgaagattgctgttagctactattgagactgcc

SEQ ID NO: 7662 - DNA, 1427 bp, Ambrosia trifida
gggtggcatctaaattgagaccccatcttctctagaagtctcttcatttcataccagcaaataaccacctatatacttcaatacctactatcttattcttcctgcttcaaccatggcgaccgttatgcagaaaatcaaagacatcgaagatgagatggcaaagacccaaaagaataaagcaactgcacatcacttgggattactgaaggctaagcttgcaaaattaagaagagagcttctaacacctacaacaaagggaggtggtggcgctggtgaaggttttgatgttacaaaaagtggtgacgcaagggttggtcttgtggggtttccctctgttgggaaatcaacacttttaaataagttaactggcactttttcagaggtagcttcatatgagtttactactctcacctgcattccaggtgttatcacatatcgaggagctaagattcagttgttggatcttcctggtattattgagggtgctaaggatggaaagggtagaggaaggcaggttatcagcacggccaggacatgcaactgtattctgattgtgctggatgcaatcaagccaataactcacaaacgtctgattgaaaaagaacttgaagggtttggcattaggttaaataaagagcccccaaatctgaccttcaggaaaaaggagaagggtggaattaattttacatcaacagttgctaatacacatctggacgttgaaacagtgaaggcaatatgcagtgaatacaagatacataatgctgatgtcacgcttaggtttgatgcaactgctgatgatcttatagatgttattgaagggagtcggatatatactccttgcatctatgttgtcaacaaaatagatcagattacactcgaagagctggagatattggataaacttcctcactactgccctgttagtgctcacttggaatggaatcttgatggtctgctagagatgatatgggaatatctgaacttgactcgtatttacacaaaacccaaagggatgaatccagactatgaggaccctgtaatcctttcatctaagaagaaaactgtagaggatttctgctttagaatccacaaggacatgcttaagcaatttaagtatgcactggtctggggttctagtgcaaaacacaagccacaaagagttggcaaggaacatgagcttgaagatgaagatgttgtgcagatcataaagaaagtttaaaaataaaaccactaaatctcctacgcatttttgagtcttgtattccagtgtattgagcaggtaaggtttgtcgatggatgacttagttttgtactggatgctgatgtgtgtgtctaagacattaagagagacatcataaattaagcagatttttgtatgattgttatcaatggtatgaactacatgtcattactaaaaataaaaaaaa

SEQ ID NO: 7663 - DNA, 1760 bp, Nicotiana benthamiana
ctaaacctcaaaagcacacactcgggaaaactcctaaattctcagcgctgtctttaaactttagagtccctcttctctctgcccttttcttccgtcgaaactttctagtgttcgaatccaccaaaccatggcgaccgttatgcagaaaatcaaagatatcgaagacgagatggctaagacccaaaagaacaaagctactgctcatcatctcggtttgttaaaggcaaaactggcaaaacttcgaagggagcttcttacacctacatcaaaaggtggtggtggagctggagaaggttttgatgttacaaaaagcggtgatgcaagagtgggtttagtgggctttccttcagttggaaagtcgacactcttgaacaaattgactggaacattttctgaggttgcttcgtatgaatttaccaccttaacgtgcattcctggtgtcatcatgtatcgtggagctaaaatccagttgttggatctcccaggaattattgagggtgcgaaggatggaaaaggtagaggaaggcaggttatcagtactgcaagaacttgcaattgtatacttattgttcttgatgcaataaaaccaattactcacaaacgtctcattgagaaagaacttgagggatttggcatcaggttgaacaaggaaccacctaatctgacattcaggaagaaagagaagggtggaatcaatttaacatcaacagtgaccaatactcatttggacctcgacaccgtaaaggccatatgcagcgaatacagaatacataatgctgatgttcatcttaggtatgatgcaactgctgatgaccttattgatgtcattgaaggcagtcgagtatatacaccttgcatctatgttgtgaacaaaattgatcaaatcacagtggaagagctagagattctggataaacttccccattattgtccgatcagtgctcatttggaatggaatctcgatggcttgctggagaagatttgggaatatctcagtctaacccgtatatacaccaagccaaagggaatgaatccagactatgaggacccagtaattctatcatcaaagaggaggacagtggaggacttctgcgacagaatccacaaggatatggttaaacaattcaaatatgcgctggtttggggttcaagtgcaaaacacaaacctcagagggtgggcagggaacacgaactagaagatgaagacgtcgtccaaatcatcaagaaggtgtgattgtagaacttgtactttgaatgctgcagttgatgcagatctctagcactaaaggggttcatcgcatgttgaggtttgtcctagattgcatcccttgctttagttgtcctttttgcggtaggtagatctagtttgaacaaagtaaatcttgttgtgcatgttgtcacggacaagttatatggtgaatctgcacgtgtgctggctaatcgtcctctgtatcatctaaagcctgccccagggagcagtaagtggtagttgaaactgcaaaaatttagtttgtttgttcatacactgttgcctccaactggagctaaaattttgccatgagaactttaagtgttttgatgattttatgttgaatctttcttcaaatctccactagataaaccagggctttccatgcgtcggagaaagaatctaggtgttggagttcccaaatctagtttggctcccatctaatttgatgcaacctgtattaaacttttgtcagatttcagaatattctagtaagtaaatatttacaaga

SEQ ID NO: 7664 - DNA, 1596 bp, Phalaenopsis aphrodite
acccacgaactgaaaaaagtttcaaaaaagagatcaacaattagagagcatgatgtcttcttctctctgaggacgattatcaaacaaagccgaggaagggctccttgttctcgttctcgcagaagaaaccatggctacagttatgcagaagatcaaagacatcgaagatgagatggccaggacacagaaaaacaaagctactgctcatcaccttggtcttcttaaggccaaacttgcaaagttgcgccgtgagctcttagtgccttcttcaaaaggcggtggtggagctggtgaaggctttgatgttactaaaagcggagatgcacgtgttggcctggttgggtttccatctgttggaaaatcaacactccttaacaagttaactggcactttttccgaggttgcctcctatgaatttactactttaacatgcattcctggtgtgattatgtaccgaggtgcaaaaattcagttgttggatcttccggggatcattgaaggcgcaaaggatggaaagggaagaggaaggcaggtaatcagcactgctagaacatgtaattgcattttaattgttctggatgctataaagccaataacgcacaaacgtattattgaaaaagagcttgaagggtttggcataaggttgaataaagaaccaccgaatttgacttttagaaagaaggacaagggtggcatcaatcttacatcaacagttacaaacacacacttggaccttgaaactgtgaaagcaatctgtggtgaatataggattcataatgcagacatcaccctccgatatgatgctactgctgacgatcttatagacgttatcgaaggaagtcgaatttatacgccttgtatctatgtagtgaacaagattgaccaaataacacttgaagagctggagattttagacaagcttcctcattattgtccaatcagcgcccatctagaatggaatcttgatggcctgctagagaaaatatgggagtatcttaatctgactcgcatatacaccaagcccaaaggaatgaatccagattacgaggatcctgtaatcttgtcctcaaagaaaagaactgttgaagacttctgcaataagattcacaaagacatgctcaagcagtttaaatatgctctggtatgggggtcaagcgccaaacataaacctcagcgggttgggagggaacatgagttagaggatgaagacgtcgttcaaattataaagaaagtataaaaaaaacttgaagattccaatagagtatgcattgaattagcttgcagcagcagcaatatgagcaagagaccggtgagttctggaatcaaatctgacaatctgggtttccgttgcgtatatatttctggatgtcagcctgatcaggtccagtgtatatttttttaatattgatggtgctttgaatcgtttaggtttgtcctttatttgcgtttatatgaatatttgctatgacgttaatgtttctcctgcaatgcatgagccttgtattgttatagcatatggtggacagtttggagctggtaacagttttggatttgagaataacaagctaacaaaatgtttttggatttaccactttt

SEQ ID NO: 7665 - DNA, 1560 bp, Solanum lycopersicum
gaaaccaaaaattaagcagcagcgtcgcaaaaccttaaaaacacattggagaaaactcctaattctcagcgctgtctttacagtacccctttttgcccttctcttccggcgaaactctccggcgttcaaatcagcaacaatggcgaccgtcatgcagaaaatcaaagatatcgaagatgagatggctaagacccaaaagaacaaagcgactgctcatcatctcggtttgttaaaggcaaaactggcgaaacttcgaagggaacttcttacacctacgtcaaaaggtggtggtggagctggagaaggttttgatgttacaaaaagtggtgatgcaagagttggtttagtaggttttccttcagttggaaaatcgactctcttgaacaaactgacaggaactttttctgaggttgcttcatacgaatttaccaccttaacttgcattcctggtgtcatcatgtatcggggagctaaaattcagttgttggacctcccaggaattattgagggtgccaaggatggaaaaggtagaggaaggcaggttatcagtactgccaggacatgcaattgtatacttattgtcctcgatgcaataaagccaatcactcacaaacgtctcatagagaaagagctcgagggatttggcattaggttgaacaaggaaccacctaatatgacattcaggaagaaggagaagggtggtattaatttgacgtcaacggttaccaatacccatttggacctcgacactgtgaaggccatatgcagcgaatacagaatacataatgctgatgttcatcttaggtatgatgcaactgctgatgacctgattgatgtcattgaaggcagtagagtatacacaccttgcatctatgttgtgaacaaaattgatcaaatcacaatggaagagctggagattctggataaacttccgcactattgtccaatcagtgctcatttggaatggaatcttgatggcctgctggagaagatttgggaatatcttagtctaacccgcatatacacaaagccgaagggaatgaatccagactatgaggatccagttattctatcatcaaagaggaggacagtggaggacttctgtgacagaatccacaaggatatggttaaacaattcaaatatgccctggtttggggttcaagtgcaaaacacaagcctcagagggtgggcaaggaacatgaactagaagatgaagacgtcgtccaaatcatcaagaaagtgtaattgcagaaattgtatcttgattgctgaagttgatgcatatctataacactaaagctttccatcacatgttgaggtttgtcctagcttgcaaagcttggttttgttgttctttttccggtaggtagatctagtttgaacaaagtacagcttgatgtgtatgttgtcactgtcaagctatatcgagtatctgcacgcatgctggctaaatcatcttatgtatcatctaaaaaaattccatgacaactactagtgttttttgaaaattttgagttgaatctttcttcaaaatctgcattacgtaaatgaggacttcc

SEQ ID NO: 7666 - DNA, 1315 bp, Tragopogon dubius
tcaaagcagctactttctttgcttcaacaatggcgaccgttatgcagaaaatcaaagatattgaagatgagatggcaaagacccaaaagaacaaagcaactgcacatcatttgggcttgttgaaggctaagcttgcaaaactgcgtagggagcttctaacaccaacaacaaaaggaggtggtggtgcaggtgaaggttttgatgtcacaaaaagtggagatgcaagagttggtcttgtaggttttccatctgttggaaaatcaaccctcttaaataaattaactggcactttttcagaggttgcttcatatgagtttactactctcacttgcattccaggtgttatcacatatcgaggagctaaaattcagttgttggatcttcctggaattattgaaggtgctaaagatggaaagggtagaggaaggcaggttatcagtactgcaaggacatgcaactgtattctgattgtacttgatgcaattaagccaataacccacaaacgtctgattgaaaaagagcttgaagggtttgggatcaggttaaacaaagagccaccaaatctgacgttcaggaagaaagacaagggtgggattaatttcacttcaacagttgcaaacacgcatttagacctagaaacagtgaaggcaatatgcagtgaatacagaattcataacgctgatgtcacccttaggtttgatgcaactgctgatgacctcatcgatgttattgaagggagtaggatttatacgccttgtatctatgttgtcaacaaaatagatcagattactatcgaagagcttgagattttggataaacttcctcactactgtcctgttagtgctcatttggagtggaatcttgatggtttgttggagaagatatgggagtatttgagtttgactcgtatttatacaaaaccaaaagggatgaatccggattatgaagatcctgtgattctttcgtctaaaagaacaacagttgaggatttttgtaaccgaattcataaggatatgcttaagcaatttaagtatgcattagtgtggggttctagtgcaaaacacaagcctcaaagagttggcaaggaacatgagcttgaagatgaagatgttgtgcagatcataaagaaagtgtgaaagcttctttttttgctatttgtagttggtatcgatgtttgtttaaaagattaggacaaaaaggcataattaagcatttgctaatttttggtttgtaactttttcttgtgtcttttggagtaaaatatcaaatagaaaagtgatttaaggattgtgatggtctactatatatcattcag

SEQ ID NO: 7667 - DNA, 1599 bp, Glycine max
gcatgtgttccagcaccttcttcttcgttcacctcctccccgtcgcaacacaaagctacgctgcagcaatccaccactgcagggttttccaagtccaatctcagttcacttctcgccagggtttaatctgaatttcttttgtgttgccactgaggttattattatttttcttccaaaatggcgacggtgatgcaaaaaatcaaagacatcgaagatgagatggcaaggacccaaaaaaacaaggctactgctcatcatttgggcttgctgaaggctaaactagcaaagctgcggagggaactccttacaccttcatcaaaaggagctggaggtgctggtgaaggttttgatgttactaaaagtggggattcaagagttggtcttgtgggcttcccttcagtcggcaaatctactctactgaataagttgaccgggacattttctgaggttgcttcctatgagtttactaccttaacttgcatcccaggtgtgatcacatatcgtggagctaaaatccagttgttggatctccccggaattatcgagggtgctaaggatggaaagggtagaggaaggcaggttattagtactgcaaggacatgcaattgcattttgattgtccttgatgcaataaagccaataactcacaagcgtcttatagaaaaagagctagagggatttggtataaggttaaacaaagagccaccaaatctgacttttaggaagaaagacaaaggtggacttaatctcacctcaactgtcaccacaacacatctggatctcgagactgtgaaggctatatgtagtgagtacagaattcacaatgctgatatcactctcaggtatgatgccactgctgatgaccttatagatgtcattgagggaagtagagtatatataccttgtatctatgttgtgaacaagattgatcagatcacacttgaggaactggagatcttggataagctacctcattactgcccaatcagtgcacaccttgagtggaaccttgatggtcttctggagaaaatttgggaatatctcgacttaactcgtatttatactaaacctaaagggatgaatcctgattatgaagaccctgtaatattatcatctaagaagaggacagttgaggacttctgcgatcgcattcacaaggacatgcttaaacagtttaagtatgctttggtctggggttcaagtgcgaaacacaagcctcaaagagttggcaaggagcatgaacttgaagatgaggatgtggttcagattatcaagaaagtataatttgttataatcagaagaatccaagatgacgttttctgcgaatcaatcagaatgcctgcactctcgttagattattagaggatgttctgagcagaatcaaagattccttcgtgagactttccccaggatcgttagattacactccaattatttggtcatttttaagttaggggtgaggtagagtatattaaagtttgatgcgttgttaaaccattagttatttcaggggacgccgtttgtcgcgtaagttttggaaattatgtatcttgtggtgggattatccgtatctaaaacaattaatgtgtaggaataatt

SEQ ID NO: 7668 - DNA, 1413 bp, Ambrosia trifida
agaagtctcttcatttcataccaacctatatacttcaaacacaacacatactatcttattcttcctgcttcaaccatggcgaccgttatgcagaaaatcaaagacatcgaagatgagatggcaaagacccaaaagaataaagcaactgcacatcacttgggattactgaaggctaagcttgcaaaattgagaagagagcttctaacacctacaacaaagggaggtggtggtgccggtgaaggttttgatgttacaaaaagtggtgacgcaagggttggtcttgtggggtttccctctgttgggaaatcaacacttttaaataagttaactggcaccttttcagaggtagcttcatatgagtttactactctcacctgcattccaggtgttatcacatatcgaggagctaagattcagttgctggatcttcctggtattattgagggtgctaaggatggaaagggtagaggaaggcaggttatcagcacggccaggacatgcaactgtattctgattgtgctggatgcaatcaagccaataactcacaaacgtctgattgaaaaagaacttgaagggtttggcattaggttaaataaagagcccccaaatctgaccttcaggaaaaaggagaagggtggaattaattttacatcaacagttgctaatacacatctggacgttgaaacagtgaaggcaatatgcagtgaatacaagatacataatgctgatgtcacgcttaggtttgatgcaactgctgatgatcttatagatgttattgaagggagtcggatatatactccttgcatctatgttgtcaacaaaatagatcagattacactcgaagagctggagatattggataaacttcctcactactgccctgttagtgctcacttggaatggaatcttgatggtctgctagagatgatatgggaatatctgaatttgactcgtatttacacaaaacccaaagggatgaatccagactatgaggaccctgtaatcctttcatctaagaagaaaactgtagaggatttctgctttagaatccacaaggacatgcttaagcgatttaagtatgcactggtctggggttctagtgcaaaacacaagccacaaagagttggcaaggaacatgagcttgaagatgaagatgttgtgcagatcattaagaaagtttaaaaataaaaccactaaatcttctacccatttttgagtcttgtattccagtgtattgagcaggtaaggtttgtcgatggattgcttagtttttgtactggatgctgatgtgcgtgtctaagacattaggacaaagaaatcataaattaagcagatttatgtatggttgtttcactatttggtttacaactcgtcaatttctgtttttacatagtgaactgtacactttgtact

SEQ ID NO: 7669 - DNA, 1932 bp, Cicer arietinum
caaatactctaccctaggtcccaccgtaagcgtttctgcatatttgttctagcactttcttcagtctcattctcttccccagtacaagtcgacgctctaaacctgtatccattcaccatcgcagaggtttcaaactccaatttcattttattttttgccagaagtaaactcaatatcttctgctttgcttccgagcttatctttcttcaacaatggcgacggttatgcagaaaatcaaagacatcgaagatgagatggcaaggactcaaaagaacaaggctactgctcatcatttggggttactgaaggctaaacttgcaaagctgcggcgggaactccttacacctacatcaaagggaggtggaggtgctggtgaaggttttgatgttactaaaagtggggatgcaagagttggtctcgtgggcttcccttcagttggcaagtccactctgctgaataaattgactgggacattttcagaggttgcttcctatgagttcactaccttaacttgcatcccaggtgttattacatatcgtggagctaaaattcagttgctggatctccctggaattattgagggtgccaaggatggaaagggtagaggaaggcaggttataagtactgcaaggacttgcaattgcattttaattgttcttgatgcaataaagccaataactcataagcgtcttattgaaaaggagctagaaggatttggtataaggttaaacaaagagccaccaaaccttactttcaggaggaaagaaaagggtgggatcaatttcacctcaactgctacaaacacacatctggatcttgatactgtgaaggctatttgtagcgagtacaggattcataatgctgatattactctaaggtatgatgctactgctgatgaccttatagatgtcattgaaggcagtagagtatatacaccctgcatctatgttgtgaacaagattgatcagatcacacttgaggaactggagattttagataagcttcctcattactgccctgtcagtgcgcacttggagtggaaccttgatgggcttctggataaagtttgggagtatctcaatttaactcgaatttatactaaacctaaaggtatgaatcctgattatgaagaccctgtaatattgtcgtctaagaagaagacaattgaagatttctgtgagcgcattcacaaggacatgcttaaacagtttaagtatgctctggtctggggttcaagtgcaaaacacaagcctcaaagagttggcaaggagcatgaacttgaagacgaagatgttgttcagattatcaagaaagtataactcgcggtcagacttctgcaaaccgaccacagtgcttgcttgcatgagatactgaaggatatcgagcagaatcaaaggtctcttagtgagattttctccaaagttgttggatcatgctccaattattacttgtttcttattcagatgggaattaggtgaaatatacagagtgtgatggatagttacaccatttgttgtcgaggggtgctgttcttgtgaagactaatatgatatgctgattatttggtaagcattgtgttggttataggtggatattccagtatgtttggacatgcttaacgaaatgatggtgtcagtttggtactacattaatgtaaaattttatttatgcttaactaacttaatccccggatcaaaagttcatctagataaatatggtggccctaaaagtgtctcacttggcagcctggaccactggttttggtggacgtaactgattgattccaggtaaaagagttggttgctaagctaatcgattccctcaattagcaatggaagccaagcggcagtacaaatcttaaattgaacaatttgtgtcccctcaaattgcaagaatcgttaaattagttcttcaaatttgcaaaactgcttc

SEQ ID NO: 7670 - DNA, 3754 bp, Vitis vinifera
cattttcactctcatctcgacctcaccagttcagcgtcggcggactcaatcagaccctccccttttctctgtgcttcaaccatggcgaccgtgatgcagaaaatcaaagatatcgaagatgagatggcaagaactcagaagaataaagctacagctcatcatctgggcttgttaaaggctaaacttgcaaaactacgaagggaactccttgcaccctcatcaaaaggtgctggtggtcctggtgaaggttttgatgttactaaaagtggagattcaagagttggtctggttggtttcccttcagttgggaagtccacacttctaaataaattaacaggcactttttctgaggttgcttcctatgaatttactaccttaacttgcattcctggtgtgataacgtatcgaggagctaaaattcagttgttggatctccctggtattattgagggtgctaaggatggaaaaggtagaggaaggcaggttatcagcactgctagaacatgcaattgcattttgattgttcttgatgcaataaagccaattactcacaagcgtctgatagagaaagagctcgagggatttggcataaggttaaacaaggaaccaccaaatctgaccttcaggaagaaagataagggtgggattaatttcacatctacagttaccaacacaaatctggatcttgaaactgtgaaggcaatatgtagcgaatacagaattcacaatgctgatgtttctcttagatacgatgcaactgctgatgacctcatagatgttattgagggtagtagggtatatataccttgcatctatgctgtgaacaagattgatcagataacacttgaagagttggaggttctagataagcttcctcactactgtccagtcagtgctcacctggagtggaaccttgatggtctgctagaaaagatatgggagtatcttgatttaactcgcatatacacaaagcccaagggaatgaatcccgattatgaagatcctgtaattttatcatccaaaaggaggacagttgaggacttctgcagcagaatccacaaggacatgctcaaacaatttaagtatgcattagtctggggatcaagcgtgaaacacaagccccaaagagttggcagggagcatgaactggaagatgaagatgtcgttcagattatcaaaaaggtgtgagtgtagaccttaaaatcagtcacatatccacatttgcgtgtccaaggagattttctcggtgagtagagtttccatgtccagattgctttgcttcaaaactttgcaatagagcatgcagcatcctctctgtttcttggtggattaggtagaagataagacagcttgatgtgtaattaagccattttgttgtcaagcgctttttatctggattatatatcatgtatgatcttgcactgtaaggttaaaaagaggtcggaaaaggacttatataaaccatgggattgatgagaatttaatgttatattggcactagaagaaattattataagccattgccagcttgttggtgaaatgtttcttcaaagttatgatttaggaattgggattgttttcaagtcctaaaaatagttttaaattgttttttgaagtaaacttgtctttgagaacttcagtttttttggacttattttctttgaagttattatgtaaaatgtaaaagcattgaaaatatttttcatattttcaatagtttcttaaaatattcaaaaaataaatgttcactttgtgcttaaaaataatttgtttcaaaatattaaaaaaagaaaaaaaactgatctcaattaaaattttatcacatgttttttaaattaaaaaatttattgaaaacagtttgcaaatggatccctaatcatatttttcatattttcaatagtttctgaaaatgctcaaaataaaaatttgaaaatgcactaaatttattcttaaaaataatttatttcttatttcaaatcataaaaacatattaacaagttattttcaaataggtctaattttagagctcatttaaacataattttgagagggttagaaaagtgccgtaatgtttgaaggaaacacaatggtttgacgaacttctcaagacccgttcttaaatctagaaaatcattgaaaatgattcttgaacaacttttccaaaatttaaagggtgtttgataaataaatttattgagttaataggatttaatgatttagtttaaattattaaatatgtttagtaaaataatttaatttcaaagtttaaaattaaaaagaagcatttcaagatctttatcagcaaggattatagcccttgaagctccttcctttcataatagttgaatttctcaacctttatgataatgatagtcttaaaagaacaaaggtcataactacaatacttttcaaaaacttaacactaatgtttaatgacttaaaatgactataagttaaattatagttaagttattaatttgtactaagtaattaaattgatttactaaaatcatttttaattttaagtcacaatatcatggattgtttagattaatttttaaaaagtcaaaagttcttctctaagctcaataagaacttctatatgtgtttgactagtttagttcaaaaaatttgatatgaaagtaagaaaaatattacttataatagaaatcctattttcgatcgcaatatgttattttatatttaataaaaattttacaatatcaatattacttattaaaaattataactttgttttgggtttgactttaactttcaaccaaatatcgaaagctattctaaatagaaattatatttaatatgcttataacttaaattaagtcattaaattatattaagttgataaatttaaagagtgatttctcctactatgttgtgtaaaattcacatataaaaaaaaatgtgatttatgaccacccaacgaacaatttttttaataaaattgtctaataacaagtttctaaactcccttttaagttggtattgaaggtacaaactacctccacctaattagaaagacctataaagttacgctattccttgctatttgctttaggcctttcacatgcgacttaggtggaggcaaaggcagcctccaccaggacaccaggatgccaggctatcatcagtgagaatggaagcttcttcctctctttccttactaaaattggaagcttctgccaaagtcatctcaaaggatagactaacgtacacctggagcctggaactgacacatctactaatgaataacctagatatcacggagaaagcaagagaggagatggattcagttgttggcagaaacagaagcaacgacggcagctacaacattctagcaggacctggctactggttaacatttgggctattgcaagagacccaaagcaccgcgagaacccacttgagctccagcctgcgaggttcatcgatgagaaatggacttcagaggaggcagatggaagttaagtcagggggagtgttttcatctgctgccatttgggagcggaggaagaagttgccctggaacttcactggcactgcaggttgttcagacaggacttggtgctttgaatggaaggtcggagaaggagaacatggtcccgcatggggacccttagcatgggggaggcgggaccagacatcactgctctcaaggggctcagcctttgatttgtgtgccagtgggcagtggctagactctctgtaggcttaactaacgtatttcctcaactaa

SEQ ID NO: 7671 - DNA, 1598 bp, Lactuca sativa
gaaattttaaatcaatcgacacctctctaacgtgttgagggtaaaatgcttaaatatgaagttgttttgaattaaaataaaacgagagaggaaaaaaatagggttttttaggggcagctgacctgcgactccattttctctagaaccctcttttcatcgtctatcgataccagttaagctcatacattcgaaaacaacatcaaagccagtactttctttacttcagcaatggcgaccgtcatgcagaaaatcaaagatatcgaagatgagatggcaaagacccaaaagaataaagcaactgcacatcatttgggcttgttgaaggctaagcttgcaaaactgagaagggagcttttaacacctacaacaaagggaggtggtggagctggtgaaggttttgatgttacaaaaagtggagatgcaagggttggtcttgtgggttttccctctgttggaaaatcaaccctattaaataagttaactgggactttttcagaggttgcttcatatgagtttaccactctcacatgcattccaggtgttattacatatcgaggagctaaaattcagttgttggatcttcctggtattattgaaggtgctaaggatggaaagggtagaggaaggcaggttatcagcactgcaaggacatgcaactgtattctgattgtgctggatgcaattaagccaataacccacaaacgtctcattgaaaaagagcttgaaggatttgggattaggttaaataaggagcccccaaatctaacattcaggaaaaaagaaaagggtggcattaatttcacatcaacagttgcaaacacacatttagaccttgaaacagtaaaggcaatatgtagtgaatacaaaatacataatgctgatgtcacccttaggtttgatgcaacagctgatgacctcatcgatgtgattgaaggtagtagaatatacactccttgcatctatgttgtcaacaaaatagatcagatcacacttgaagagcttcagattttggataaacttcctcactactgtcctgtcagtgctcatttggaatggaatcttgatggtttgcttgagatgatatgggagtatctgagtttgacccgtatttatacaaaacccaaaggaatgaatccggattatgaagaccctgtaattctttcttctaaaagaaaaactgttgaggatttttgcttcaggattcacaaggacatgcttaagcagtttaagtatgcactggtgtggggttctagtgcaaaacacaagccacaaagggttggcaaggaacatgagcttgaagatgaagatgttgtgcagattattaagaaagtgtgagcttaaattattaaaaaaaaaaaaaactaaattttgttttcgataactatttgtgtactttgtatcgtttgtgccttgtggtgcaatatgaaatagataaatgatttgagtattgagattttgtattatccgttcttatttattttggtccatgttgattatttttatcgttatttgatatataaattaagtcgcactcatattaacacaaagtttgttaagccttctggtgatgatggttgagtcagaatgttttgtcgtcg

SEQ ID NO: 7672 - DNA, 1538 bp, Arachis hypogaea
accgtaagcattggtgcactctgcatatttgttctagcaccttcttccctttcttgcccagcttaagagccaacacgacacatcacaacgcaagagtaaccattaatcattcctgtatacttgaagaggattcatctgaaactattttcttctcttcctctgagctcatccttcaacaatggcgaccgtgatgcagaaaataaaggacatcgaagatgagatggcaagaacgcaaaagaacaaggctactgctcatcatttgggcttgctgaaggctaaactggcaaagctgcggagggaactccttactccttcatcaaaaggtgctggaggtgctggtgaaggttttgatgttactaaaagtggtgattcaagagttggtcttgtgggtttcccttcagttggcaaatctactctactgaataaattgactgggacattttcagaggttgcttcctacgagtttacaaccttaacttgcatccctggcgtgatcacgtatcgtggagctaaaattcagttgctggatctccctggaattattgagggtgctaaagatggaaagggtagaggaagacaggttatcagtactgcaaggacttgcaattgtattttaattgttcttgatgccataaagccaataactcataagcggcttatagaaaaagagctggagggatttggtataaggttaaataaagagccaccaaatctgacttttaggaagaaagataaaggtggaatcaacctcacttcaacggttaccaacacacatttggatcttgacactgtgaaggctatatgtagtgagtacaaaattcacaatgcagatattactctcagatatgatgctactgccgatgaccttatagatgttatcgagggaagtagagtatacatgccttgcatctatgttgtgaacaagattgatcagatcacacttgaggaattagagatattggataagctacctcattactgcccaatcagtgcacacctggagtggaacctcgatggtcttctggagaaaatttgggaatatctcaatttaactcgtatttatactaaacctaaagggatgaatcctgactacgaggacccggtaatattgtcatctaaaagaagaacagttgaggacttctgcaatcgcattcacaaggatatgcttaaacagtttaagtatgctctggtctggggttcaagtgcgaagcacaagcctcaaagagttggcaaggagcatgaacttgaagatgaagacgtggttcagattatcaagaaggtataagaagttataagtgttgttgcaaggtatttaagatgatatcttttggaaacataacaggggcatgagttggaactgagacttccaagcagtgattgaggatctcttcgtgatttccccgaggttaaatcacactcaaattactttcctttttcagttgggagttgagttgagtatttccagtccggagatgtaattaaaaaactctagtttgtgatgtctctttttgactatgccgatacaaatggtggatatt

SEQ ID NO: 7673 - DNA, 1936 bp, Cajanus cajan
aatttggattcgagaatgaatactctaccctaggtcccaccgtaagcttttctgcatatttgttctagcaccttcttcgttcacctcttttccgtcgcaacataacgctacgctgcaataattcgccgctgcagagttgtcgaagttcaatctcacttaacattaacctgaatctctttcgccttgcctctgagttcattgtctttcttccaaaatggcgacggtgatgcagaaaatcaaagatatcgaagacgagatggcaaggacccaaaaaaacaaggctactgctcatcatttgggcttgctgaaggctaaacttgcaaagctgcggagggaactccttacacctacatcaaaaggaggtggaggtgctggtgaaggttttgatgtcactaaaagtggggattcaagagttggtcttgtgggcttcccttcagttggcaaatctactctactaaataagttgactgggacattttctgaggttgcttcctatgagtttactaccttaacttgcatcccaggtgtgatcacatatcgtggagctaaaatccagttgttggatctccctggaattattgagggtgctaaggatggaaagggtagaggaaggcaggttattagtactgcaaggacatgtaattgcattttaatagtccttgatgcaataaagccaataactcacaagcgtcttatagagaaagagctagagggatttggtataaggttaaacaaagagccaccaaatctcacttttaggaagaaagataaaggtggaatcaatctcacctcaactgccaccacaacgcatttggatcttgacactgtgaaggctatatgtagtgagtaccgaattcacaatgcagatattactctaaggtatgatgccactgcagatgaccttattgatgtcattgagggcagtagagtatatatgccttgtatctatgttgtgaacaagattgatcagatcacactcgaggaactggagatcttggataagctaccacattactgcccaattagcgcacacctggaatggaaccttgatggtcttctggataaaatttgggaatatctcagcttaactcgtatctatactaaacctaaagggatgaatcctgactacgaagaccctgtaatattatcctctaagaggaggacagttgaggacttctgcaatcgcattcacaaggacatgcttaaacagtttaagtatgctttggtctggggttcaagtgcgaaacacaagcctcaaagagtgggcaaggagcatgaacttgaagacgaagacgtggttcagattatcaagaaagtataatttgttataatcggaatcaatcaaagatgatattttctgaaaatggatcagaatgcctgcactatcgttagattattagaggatgttctgtgcagaatcgaagatcccttcgtgagactttctacaggatagttagattaccctccaattacttgtcttttttaagttgggggtgaggtagaatttattaaagtttgatgagtcgttaaaccattagttctttgccgtttgtcacgcaagttttggaaatgaagtgtcttgtgggattatccatccgtgtctaaagttgaataatttggcgtgtacttgtaaacattgataggatttgttcggtggatatatattattctggtgtacatgctgctggacatttataacaaaatgatggcatgagtttgatacagcatttacatgatttgtttttaaaatttaggtgagactcactctcaggtcctcctcgacggcacggaggtttgtgacatgacatcaaaggcgcaaagatgaaatcgtaagatttaactttatcatttttaaaaaggagtctttatattaagagttgcaatttcagtaaaagtagatctctccatccttttatatataataattttcatcaaa

SEQ ID NO: 7674 - DNA, 1470 bp, Solanum tuberosum
taattctcagcgctgtctttctgcccctctcttccggcgaaactctccggcgttcgaatcagcaacaatggcgaccgtcatgcagaaaatcaaagatatcgaagatgagatggctaagacccaaaagaacaaagcgacggctcatcatctcggtttgttaaaggcaaaactggcaaaacttcgaagggaacttcttacacctacgtcaaaaggtggtggtggagctggagaaggttttgatgttacaaaaagtggtgatgcaagagttggtttagtgggttttccttcagttggaaaatcgacactcttgaacaaactgacaggaactttttctgaggttgcttcatacgaatttaccaccttaacttgcattcctggtgtcatcatgtatcgaggagctaaaattcagttgttggacctcccaggaattattgagggtgccaaggatggaaaaggtagaggaaggcaggttatcagtactgccaggacatgcaattgtatacttattgtcctcgatgcaataaagccaatcactcacaaacgtctcatagagaaagagctcgagggatttggcattaggttgaacaaggaaccacctaatatgacattcaggaagaaagagaagggtggtattaatttgacatcaacagtgaccaatacccatttggacctcgacactgtgaaggccatatgcagcgaatacagaatacataatgctgatgttcatcttaggtatgatgcaactgctgatgaccttattgatgtcattgaaggcagtagagtatacacaccttgcatctatgttgtgaacaaaattgatcaaatcacaatggaagagctggagattctggataaacttccgcactattgtccaatcagtgctcatttggaatggaatcttgatggcctgctggagaagatttgggaatatcttagtctaacccgcatatacacaaagccgaagggaatgaatccagactatgaggatccagttattttatcatcaaggaggaggacagtggaggacttctgcgaaagaatccacaaggatatggttaaacaattcaaatatgccctggtttggggttcaagtgcaaaacacaagcctcagagggtgggcaaggaacatgaactagaagatgaagacgtcgtccaaatcatcaagaaggtgtaattgcagaaactgtatcttgattgctgcagttgatgcatatctataacactaaagctttccatcacatgttgaggtttgtcctagcttgcaaagcttggttttgttgttctttttccggtaggtagatctagtttgaacaaagtacagcttgatgtgtatgttgtcactgtcaagctatatcgagtatctgcacgcatgctggctaaatcatcttatgtatcatttaaaaaaaattccatgagaactttgtgtttttttgaaaattttgagttgaatctttcttcaaaatctgcatt

SEQ ID NO: 7675 - DNA, 1490 bp, Solanum phureja
acattcgagaaaactcctaattctcagcgctgtctttctgcccctctcttctggcgaaactctccggcgttcgaatcagcaacaatggcgaccgtcatgcagaaaatcaaagatatcgaagatgagatggctaagacccaaaagaacaaagcgacggctcatcatctcggtttgttaaaggcaaaactggcaaaacttcgaagggaacttcttacacctacgtcaaaaggtggtggtggagctggagaaggttttgatgttacaaaaagtggtgatgcaagagttggtttagtgggttttccttcagttggaaaatcgacactcttgaacaaactgacaggaactttttctgaggttgcttcatacgaatttaccaccttaacttgcattcctggtgtcatcatgtatcgaggagctaaaattcagttgttggacctcccaggaattattgagggtgccaaggatggaaaaggtagaggaaggcaggttatcagtactgccaggacatgcaattgtatacttattgtcctcgatgcaataaagccaatcactcacaaacgtctcatagagaaagagctcgagggatttggcattaggttgaacaaggaaccacctaatatgacattcaggaagaaagagaagggtggtattaatttgacatcaacagtgaccaatacccatttggacctcgacactgtgaaggccatatgcagcgaatacagaatacataatgctgatgttcatcttaggtatgatgcaactgctgatgaccttattgatgtcattgaaggcagtagagtatacacaccttgcatctatgttgtgaacaaaattgatcaaatcacaatggaagagctggagattctggataaacttccgcactattgtccaatcagtgctcatttggaatggaatcttgatggcctgctggagaagatttgggaatatcttagtctaacccgcatatacacaaagccgaagggaatgaatccagactatgaggatccagttattttatcatcaaggaggaggacagtggaggacttctgcgaaagaatccacaaggatatggttaaacaattcaaatatgccctggtttggggttcaagtgcaaaacacaagcctcagagggtgggcaaggaacatgaactagaagatgaagacgtcgtccaaatcatcaagaaggtgtaattgcagaaactgtatcttgattgctgcagttgatgcatatctataacactaaagctttccatcacatgttgaggtttgtcctagcttgcaaagcttggttttgttgttctttttccggtaggtagatctagtttgaacaaagtacagcttgatgtgtatgttgtcactgtcaagctatatcgagtatctgcacgcatgctggctaaatcatcttatgtatcatttaaaaaaattccatgagaactttgtgtttttttgaaaattttgagttgaatctttcttcaaaatctgcattacgt

SEQ ID NO: 7676 - DNA, 1840 bp, Glycine max
aatactctaccctaggtcccaccgtaagcatttctgcatgtgttccagcaccttcttcttcgttcacctcctccccgtcgcaacacaaagctacgctgcagcaatccaccactgcagggttttccaagtccaatctcagttcacttctcgccagggtttaatctgaatttcttttgtgttgccactgaggttattattatttttcttccaaaatggcgacggtgatgcaaaaaatcaaagacatcgaagatgagatggcaaggacccaaaaaaacaaggctactgctcatcatttgggcttgctgaaggctaaactagcaaagctgcggagggaactccttacaccttcatcaaaaggagctggaggtgctggtgaaggttttgatgttactaaaagtggggattcaagagttggtcttgtgggcttcccttcagtcggcaaatctactctactgaataagttgaccgggacattttctgaggttgcttcctatgagtttactaccttaacttgcatcccaggtgtgatcacatatcgtggagctaaaatccagttgttggatctccccggaattatcgagggtgctaaggatggaaagggtagaggaaggcaggttattagtactgcaaggacatgcaattgcattttgattgtccttgatgcaataaagccaataactcacaagcgtcttatagaaaaagagctagagggatttggtataaggttaaacaaagagccaccaaatctgacttttaggaagaaagacaaaggtggacttaatctcacctcaactgtcaccacaacacatctggatctcgagactgtgaaggctatatgtagtgagtacagaattcacaatgctgatatcactctcaggtatgatgccactgctgatgaccttatagatgtcattgagggaagtagagtatatataccttgtatctatgttgtgaacaagattgatcagatcacacttgaggaactggagatcttggataagctacctcattactgcccaatcagtgcacaccttgagtggaaccttgatggtcttctggagaaaatttgggaatatctcgacttaactcgtatttatactaaacctaaagggatgaatcctgattatgaagaccctgtaatattatcatctaagaagaggacagttgaggacttctgcgatcgcattcacaaggacatgcttaaacagtttaagtatgctttggtctggggttcaagtgcgaaacacaagcctcaaagagttggcaaggagcatgaacttgaagatgaggatgtggttcagattatcaagaaagtataatttgttataatcagaagaatccaagatgacgttttctgcgaatcaatcagaatgcctgcactctcgttagattattagaggatgttctgagcagaatcaaagattccttcgtgagactttccccaggatcgttagattacactccaattatttggtcatttttaagttaggggtgaggtagagtatattaaagtttgatgcgttgttaaaccattagttatttcaggggacgccgtttgtcgcgtaagttttggaaattatgtatcttgtggtgggattatccgtatctaaaacaattaatgtgtaggaataatttggggtgtactagtaaacattgatatggtttgctggatggatatatattattcaggtggatatgccagtcttgtccatcctgctggacgtttttcacaaaatgatggcctgagcttgatacagcatttactttgtttttaaaaattaattaaaaagtatcgacagtgtaaagctttttaccttgtctatgctgctggacatttttc

SEQ ID NO: 7677 - DNA, 1771 bp, Nicotiana tabacum
ctaaacctcaaaagcacacacccgggaaaactcctaaattctcagcgctgtctttaaagtccctcttctctctgcccctttgttccgacgaaactttccagagagttcgaatccaccaaacaatggcgaccgttatgcagaaaatcaaagatatcgaagatgagatggctaagacccaaaagaacaaagctactgctcatcatctcggtttgttaaaggcaaaactggcaaaacttcgaagggagcttcttacacctacatcaaaaggtggtggtggagctggagaaggttttgatgttacaaaaagcggtgatgcaagagtgggtttagtgggctttccttcagttggaaagtcgacactcttgaacaaattgactggaactttttctgaggttgcttcatatgaatttaccaccttaacgtgcattcctggtgtcatcatgtatcgaggagctaaaatccagttgttggatctcccaggaattattgagggtgccaaggatggaaaaggtagaggaaggcaggttatcagtactgcaaggacttgcaattgtatacttattgttcttgatgcaataaaaccaattactcacaaacgtctcatcgagaaagagcttgagggatttggcatcaggttgaacaaggaaccacctaatctgacattcaggacgaaagagaagggtgggatcaatttaacatcaacagtgaccaacactcatttcgacctcgacaccgtaaaggccatatgcagcgaatacagaatacataatgctgatgttcatcttaggtatgatgcaactgctgatgaccttattgatgtcattgaaggcagtagagtatacacaccttgcatctatgttgtgaacaaaattgatcaaatcacaatggaagagctagagattctggataaacttccccattattgtccgatcagtgctcatttggaatggaatcttgatggcttgctcgagaagatttgggaatatctcagtctaacccgtatatacaccaagccgaagggaatgaatccagactatgaggacccagtaattctatcatcaaagagaaggacagtggaggacttctgcgacagaatccacaaggatatggttaaacaattcaaatatgcgctggtttggggttcaagtgcaaaacacaaacctcagagggtgggcagggaacatgaactagaagatgaagacgtcgtccaaatcatcaagaaggtgtgattgtagaacttgtactttgaatgctgcagttgatgcagatctctagcactaaagggtttcatcgcatgttgaggtttgtcctagattgcatcccttgctttagttgtcctttttcccgtagctagatctagtttgaacaaagtaaatcttgttgtgcctgttgtcacggacaagctatatggtgaatctgcacatgtgctggctaatcgtcctctgtatcatctaaagcctgccccagggagcagttagtggtagttgaaactgcaaaaatttcgtttgtttgttcatacactgttgcctctaactggcgctaaaattttacatgagaactttagtgtttttgatgattttatgtttgaatctttcttcaaatctccattacataaaccagggctttccatgcgtcggaaaaagaatctaggagtaggagtttccaaatctctagtttggctcctatctaatttgatgcaacctgtattaaactttcgtcagatttcagaatatttaggtaagcaaatatttactagagcggccgcatgagg

SEQ ID NO: 7678 - DNA, 1737 bp, Fagus grandifolia
cctccatttttctctagtaccttcttctgtgcctctctggcaagaagaaccacttcattatcgtcacaactctcggtctctctctcacacacagtctctgtctaagccttctctgcttcaacaatggcgacggttatgacaaaaaatcaaagacatcgaagatgagatggcaaagactacaaaagaacaaggctactgctcatcacctgggcttgctcaaggctaaacttgcaaagctacggaggaactccttgctcctcccacaaagggaggtggtggtgctggtgaaggatttgatgttactaaaagtggagatgcaagagttggtcttgtgggtttcccttcagttgggaaatctacactcttaaataaattaacagggactttttcggaggttgcttcctatgaatttactaccttaacttgcatcccaggggtgattgtgtatcgaggagctaaaattcagttgttagatctccctggaattattgagggtgctaaggatggaaagggtagaggaaggcaggttatcagcactgctagaacatgcaattgcattttaattgttcttgatgcaataaagccgataactcacaaacgtttgatagagaaagagcttgagggatttggcataaggttaaacaaggaaccacctaatctgactttcagaaagaaagacaagggtggaattaattttacctcaacagttgccaacacacatctggaccttgaaactgtgaaggcaatatgtagtgaatacagaattcacaatgctgatattactcttaggtttgatgcaactgctgatgaccttatagatgtcattgaaggcagtagaatatatatgccttgcatctatgttgtgaacaagattgatcagattacagtggaagagctggagattttggataaacttcctcactactgtccaattagtgctcacctggaatggaatcttgatggcctgctggagatgatatgggaatatcttaatttgactcgcatatacacaaagcccaaagggatgaatcctgactatgaagatcctgtaatcctgtcatcgaaaaggaggacagttgaggacttctgcgaacgaatccacaaggatatggttaaacaatttaagtatgctttggtatgggggtcaagcgcgaaacacaagccccaaagggttggcaaggagcatgagcttgaggatgaggatgttgttcagataatcaaaaaggtgtgactggagacactatcgtcctggaataacttctctatctcttttaggaagttaccgttgaaagaattttccagcagtgagtaaggctcttgttatgagatatatcatctattttgcctagttttgctagacctaaggattctctctcatctgcttttccattcgcagattaagttagaacaatggagagcttgatttgtaattaggcttttttgtggtcaagcctgtttgtagtggttttgcctactgcttggttgtatgggactaacatggaatggaatccattagagaaaaggactacatggaagttacaacttaaaatattagctaaattttggtgtcattgcgacttaaaacatgtgctttataatttttctagatcatttggtaggttttaaatttctatttttaattctatgtccaaggattccatatcatgatcttcaacacaaaatagtcatttgtagagcagggttggtaattttattgtcctacttaattccggtttt

SEQ ID NO: 7679 - DNA, 1799 bp, Cycas rumphii
atctgccaggatgtttatttatttctagaagctagttttccactctcgaaggcgcacgctgcgatatattggcgctaaaaggtggtcgtacttgatcgatcgcacaaatcattgcagctaaagctattgatcatattcgacagtcaatatggcgactgtgatgcaaaaaatcaaggacattgaagatgagatggcaaaaacccagaaaaacaaggctacagctcatcacttgggattgttgaaggccaaacttgctaaattgcgccgagaaatcttggcccctcctacgaaaggagggggaggtgctggagaaggctttgatgttactaaaagtggagattcacgggttggtcttgtgggtttcccttcggttggcaagtcgactcttctgaataaattaacaggcaccttttctgaggtggcatcatatgagttcaccactctgacatgcattccaggtgttattcgctatcgaggtgccaagattcagttgttagatcttccaggtatcatcgaaggtgcaaaagatggtaaggggagagggcggcaggttattagtactgccagaacgtgcaattgtatactgatagttcttgatgctattaaaccaattacccacaagcgtttgatagaaaaggagcttgaaggctttggaattaggttaaacaaggaaccccctaatttgacctttaggaaaaaagacaagggtggaattaatttcacatcgacagtgaccaacacacacctagaccttgaaactgtgaaggcaatttgtggagaatataggattcataatgctgatatatctcttcgatatgatgcaactgcggatgatctgatagatgtgattgaggggagtcgcgtatatatgccctgcatttatgtcattaataaaattgaccaaataactctagaggagttggagatcttggacaagttgcctcactattgcccagtcagtgctcacttggaatggaatctagatggcttgttggagaagatatgggagtatttagatttgactcggatctatacgaagccaaaggggctgaaccctgattatgaagaccctgtcattctttcatccaaaaaacgaactgtagaagacttttgccttagaattcacaaggatatgttaaagcaatttaagtatgcactagtatggggttccagtgtaaaacacaagccacagagagttgggagggaccatgaattggaagatgaggatgtcgtccagatcataaagaaagtataaattttattgcaagccaaatgttacaatatcaggctgctagcttggggtggggggggggggggggggggggggggggggggggggggggggggggggggggggggggggggggggggggggggggggggggggggggggggggggtttgttctctgttcattttaaagagtcagaacttgggaaaagtttggtatctctttgtaaagtatggcccaggtgtgtcaatgaggtctgtaaagtcttttgagaggattctaaatgctaaggagactgtcctgagtttattgcaactgcaagtaatatcagaggctgggacattgaaactagggccaacttccttccaaatccttctagttctaaacagcagattgataccatgtatataatgagtgaattcagatatgcactctgtttggatatgccttagtctatgtttactgtcagatccttgattgtgcgtactgataatgttttggctcatagtgcatatggtttatcatgatactatttagtgggctaaaattctttaatggtacattcagcc

SEQ ID NO: 7680 - DNA, 1506 bp, Rosmarinus officinalis
ctctctccccttcgtgctccggcgaaagaaaataatttatcactccggttacgggtactcgctccgccgcccaactccatcgttttttagaggtcatcgctatcagcaacaatggcgaccgttatgcagaaaatcaaggacatcgaagatgagatggcaagaacccagaagaataaagcgactgctcatcatcttggcctgctgaaggcaaaactagcaaagcttcggagggaaattctcacacctgcctcaaagggaggtggtggtgctggagaaggttttgatgttacaaaaagtggtgattcaagagttggtcttgtgggctttccttcagttgggaaatcaacactcttaaacaaattaactggcactttttcagaggttgcttcatatgagtttactactttaacttgcattcctggtgtaatcacatatcgaggagctaaaatccagctactggatcttcctggtattattgagggtgccaaagatggaaagggtagaggtaggcaggttatcagtacagctcggacatgtaactgcatcctcattgtcctggatgcaataaaaccaattactcataaacgcctgatagagaaggagcttgagggttttggcataagattaaacaaggagccaccaaatctctctttccggaggaaagataagggtggaatcaatcttacatccacagttaccaacacaaatcttgacctcgacacggtgaaggcgatttgtggagaatatcggatacacaatgctgatatcaatctcagatatgatgcaacagcagatgatctcatagatgtcattgagggcagtagggtatacatgccgtgcatctatgttgtgaacaaaattgatcagattacacttgaagagctggagattttggacaaacttccacattattgcccaatcagtgctcatttggaatggaaccttgatggccttttagagaaaatatgggagtatctcaatttgactcgcatatacacaaagcccaaggggatgaatcccgactatgatgatcctgtcatattgtcatcaaagaaaaggacagttgaggacttctgcattagaatccacaaagacatgcttaaacaatataaatatgcattagtttggggttcaagcgcgaaacacaagccccagagggtggggaaggagcatgaactggaagatgaagatgttgtgcaaatcatcaagaaggtttaacctccgaacttcatcaaatcaatctactacccgatgcatgtggtgagtcctctatcactgaacgtcgagtgttcattaagttgcatagcaagtggaaccgaatggtatgatctgtattttagttgtgccccataatagattctgtcgatgtccccctccttttgagtttaccattatatatagtaaaggaccaccccgagatattaccagataaattttgctactactgtctgaaaatgtttatattttttgagtgtttagcatctactttcccgtgtcttgaagacg

SEQ ID NO: 7681 - DNA, 1213 bp, Arnica chamissonis
tctgcttcaacaatggcgaccgttatgcaaaaaatcaaagacatcgaagatgagatggcaaagacccaaaagaataaagcaactgcacatcacttgggattactgaaggctaagcttgcaaaattgagaagggagcttctcacacctacaacaaagggtggtggtggtgctggtgaaggttttgatgttacaaaaagtggcgatgcaagggttggtcttgtgggtttcccttctgttgggaaatcgacacttttaaataagttaacaggcaccttctcagaggttgcttcatatgagtttactactctcacctgcattccaggtgttatcacatatcgaggagctaagattcagttgttagatcttcctggtattatcgagggtgccaaggatggaaagggtagaggaaggcaggttatcagcactgccaggacatgcaactgtattctgattgtgttggatgcaataaagccaataacccacaaacgtctgattgaaaaggagcttgaagggtttggcattaggttaaataaggagcccccaaatctgacattcaggaaaaaagagaagggtgggattaattttacatcaacagttgccaatacacatctggaccttgaaacagtgaaggcaatatgcagcgaatacaaaatacataacgctgatgtcactcttaggtttgatgcaactgctgatgatctcatagatgttattgaagggagcaggatatatactccttgcatctatgttgtgaacaaaatagatcagattacatttgaagagcttgaaatactggataaacttcctcactactgtcccgttagtgctcacttggagtggaatcttgatggtttgctagagatgatatgggaatatctgaatttgactcgtatttacacaaaacccaaagggatgaatccagactatgaggaccctgttattctttcatctaaaaggaaaactgttgaagatttctgctttagaatccacaaggacatgcttaagcaatttaagtatgcactggtctggggttctagtgcaaaacacaagccacaaagagttggcaaggaacatgagcttgaagatgaagatgttgtgcagatcataaagaaaatttaaaaataaaatcaccaaatctccaactccatttttgagtgttatattatctggaagcaagtatagaagcctatccatgttaccggtgtattgagat

SEQ ID NO: 7682 - DNA, 1386 bp, Beta vulgaris
atttcatgcgctcgccgacctgctgaacatcgaaatcactctcgctctttctttttcctgggtgcacatcaatttcccagtttttctctcttccagaactctcgtttcttcattcttcttttctggggttttgctatcatcaattaacagagaaaaaaggcatcttcatattcaatcgccactaaacagcaaaatcaactctttatttagtcggaatattgttagaagtgctcctttaattcggacaacatggcgactgtgatgcagaaaatcaaagatatcgaagatgagatggcaaggacccagaaaaataaagctactgcccatcatcttggactgcttaaggctaaacttgcaaagctacggagggacctcttgacgccctcagcgaaaggaggtggtggtgctggtgaaggttttgacgttacaaaaagtggagatgcccgggttgggttggttggtttcccatcggttgggaaatcaactttgcttaataagttgactgggactttctctgaggttgcttcgtacgaatttactacattgacttgcattcctggagtgataatgtacagaggagctaaaattcagttattggacttaccaggtatcattgagggtgccaaggacggaaaaggtagaggaaggcaggttatcagtactgcaaggacatgcaattgcatattgattgttcttgatgcaataaagccaattactcacaagcgtcttatagaaaaagagctcgaaggctttggcataaggttgaacaaggaaccacccaatttaaccttccgaaggaaagagaagggtggtattaatttaacctctacagctactaacacacatttggatctggagacagtaaaggccatatgcagtgaatacaggattcacaatgctgatatctcccttagatatgatgcgactgcagatgatctcattgatgttattgaggggagtagggtttatatgccgtgcatttatgttataaacaaaattgatcagattactctcgaagagttggaaattctggataaacttccacattactgcccaatcagtgcgcatctagaatggaatcttgatggtttgctggagaagatctgggagtacctgaaccttactcgtatttacacaaaaccaaaggggatgaatccagattataatgaccctgtcatactttcgtccaggaaaagaactgtggaagatttctgtgaaagaattcacaaggatatggtcaaacaatttaagtctgctcttgtctggggatcaagtgcgaagcacaaacctcaaagagttggcaaggagcatgaacttgaggatgaagatgtagttcagatcatcaagaagatttgattgaagttggcatgctatttttgaatcaag

SEQ ID NO: 7683 - DNA, 1757 bp, Trifolium pratense
ctgtccagttggattcttgacgagaatcgaacactctaccctaagcctcaccgtaaccatttgttctagcaccttcttcgttctcattctcttctccggtgcaacaccacgctttaagcctctaacatttcaccaccgcagaggtttcaaagttcaatctcacttcacttctcaccggaagtaaactgaatcgttttcgctttgcttctgagcttatctttcttcaaaaatggcgacggttatgcagaaaatcaaagacatcgaagatgagatggctaagactcaaaagaacaaggcaactgctcatcatttggggttactgaaggctaaacttgcaaaactgcgaagggaactccttacacctacaaccaagggaggtggaggtgccggcgaaggttttgatgttactaaaagtggggatgcaagagttggtcttgtgggcttcccttcggttggcaagtctactttgctgaataaattgactgggacattttcagaggttgcttcctatgagttcactaccttaacttgcatcccaggtgtgatcacatatcgtggagctaaaattcagttgctggatctccctgggattattgagggtgccaaggatggaaagggaagaggaaggcaggttattagtactgcaaggacatgcaattgtattttaattgttctggatgcaataaagccaataactcacaagcgtctgatagaaaaagagcttgaaggatttggcataaggttaaacaaagagccgccaaacctgactttcaggaggaaagagaagggtgggatcaatttcacttcaactgctacaaacacacatcttgatcttgatactgtgaaggctatatgtagcgagtacagaattcataatgcagatattactctaaggtacgatgccactgccgatgaccttatagatgtcattgaaggcagtagaatatatacaccctgcatctatgttgtgaataagattgatcagatcacccttgaggaactggagatcttggataagcttcctcattactgccctgtcagtgcgcacctggagtggaaccttgatgggcttctggataaagtttgggagtatctcagtttaactcgtatttatactaaacctaaaggtatgaatcctgattatgaagaccctgtaatattgtcgtccaagaagaagacagttgaagacttctgcgatcgcattcacaaggacatgcttaaacagtttaagtatgctctggtctggggttcaagtgcaaaacacaagcctcaaagagtcggcaaggaacatgaacttgaagacgaagacgttgttcagattatcaagaaaatataaactcgcagtcagacttctgaaaatggaccacaatgcctacatgagatactagagggtgtctgagaagaatcaaaggtctctttgtaaagttttctccagggttgttggatcacactacaattacttgtttcttattagcgattaggtgaaatacatagtgtgatggtttagttaaaccatttgctgtcgaggggttctgtttttctgttagttttggaaatgatgcatcttgcgggattatacatgtcttttgtgaagactaatatgatttgctggatatttaattagcattgtgatcgttctaggtgaatattcaggtatgcttatgctgaacattcttattgaaatgaatcaatgatggcatcagtttggtactacatttatgtaaaatttcatttatgcttaactatttaatcccttg

SEQ ID NO: 7684 - DNA, 1462 bp, Trifolium pratense
acatttcaccaccgcataggtttcaaagttcaatctcacttcacttctcgccggaagtaaaccgaatctatttcctgttgctttcgagcttatccttcttcaacaatgtcgacggtaatgcagaaaatcaaagacatcgaagatgagatggcaaagactcaaaagaacaaggcaactgctcatcatttggggttactcaaggctaaacttgcaaaactgcggagggaactccttacacctacaactaagggaggtggaggtgctggcgaaggttttgatgttaccaaaagtggggatgcaagagttgggctcgtgggcttcccttcagttggcaagtctactctgctgaataaattgactgggacattttcagaggttgcttcctatgagttcactaccttaacttgcatcccaggtgtgatcacataccgtggagctaaaattcagttgctggatctccctggaattattgagggtgctaaggatggaaagggcagaggaaggcaggttattagtaccgcaaggacatgcaattgcattttaattgttcttgatgcaataaagccaataactcataagcgtcttatagaaaaagagttagaaggatttggtataaggttaaacaaagagccaccaaacctgactttcaggaggaaagaaaagggtggcatcaatttcacttcaactgctacaaacacacatcttgatcttgatactgtgaaggctatatgtagcgagtacagaattcataatgcagatattactctaaggtacgatgccactgctgatgaccttatagatgtcattgaaggcagcagaatatatacaccctgcatctatgttgtgaataagattgatcagatcacacttgaggaactggagatcttggataagcttcctcattactgccctgtcagtgcgcacctggagtggaaccttgatgggcttctggatatggtttgggagtatctcagtttaactcgtatttatactaaacctaaaggtatgaatcctgattatgaagaccctgtaatattgtcatccaagaagaagacagttgaagacttctgtgatcgcattcacaaggacatgcttaaacagtttaagtatgctctggtctggggttcaagtgcaaaacacaagcctcaaagagtcggcaaggaacatgaacttgaagacgaagatgttgttcagattatcaagaaaatataaactcgtagtcagacttctgaaaatggaccacaatgcctgcatgagatactagagggtgtctgagaagaatcaaaggtctctttgtaaagttttctccagggttgttggatcacactacaattacttgtttcttattagcgattaggtgaaatacatagtgtgatggttagttaaaccatttgctgtcgaggggttctgtttttctgttagttttggaaatgatgcatcttgcgggattatacatgtcttt

SEQ ID NO: 7685 - DNA, 1858 bp, Trifolium pratense
tcaacgcagatacatggggctgtccagttggattcttgacgagaatcgaacactctaccctaagccacaccgtaaccatttgttctagcaccttcttcgttctcattctcttctccggtgcaacaccacgctttaagcctctaacatttcaccaccgcagaggtttcaaagttcaatctcacttcacttctcaccggaagtaaactgaatcgttttcgctttgcttctgagcttatctttcttcaaaaatggcgacggttatgcagaaaatcaaagacatcgaagatgagatggctaagactcaaaagaacaaggcaactgctcatcatttggggttactgaaggctaaacttgcaaaactgcgaagggaactccttacacctacaaccaagggaggtggaggtgccggcgaaggttttgatgttacgaaaagtggggatgcaagagttgggctcgtgggcttcccttcagttggcaagtctactctgctgaataaattgactgggacattttcagaggttgcttcctatgagttcactaccttaacttgcatcccaggtgtgatcacatatcgtggagctaaaattcagttgctggatctccctgggattattgagggtgccaaggatggaaagggaagaggaaggcaggttattagtactgcaaggacatgcaattgtattttaattgttctggatgcaataaagccaataactcacaagcgtctgatagaaaaagagcttgaaggatttggcataaggttaaacaaagagccgccaaacctgactttcaggaggaaagagaagggtgggatcaatttcacttcaactgctacaaacacacatcttgatcttgatactgtgaaggctatatgtagcgagtacagaattcataatgcagatattactctaaggtacgatgccactgccgatgaccttatagatgtcattgaaggcagtagaatatatacaccctgcatctatgttgtgaataagattgatcagatcacccttgaggaactggagatcttggataagcttcctcattactgccctgtcagtgcgcacctggagtggaaccttgatgggcttctggataaagtttgggagtatctcagtttaactcgtatttatactaaacctaaaggtatgaatcctgattatgaagaccctgtaatattgtcgtccaagaagaagacagttgaagacttctgcgatcgcattcacaaggacatgcttaaacagtttaagtatgctctggtctggggttcaagtgcaaaacacaagcctcaaagagtcggcaaggaacatgaacttgaagacgaagacgttgttcagattatcaagaaaatataaactcgcagtcagacttctgaaaatggaccacaatgcctacatgagatactagagggtgtctgagaagaatcaaaggtctctttgtaaagttttctccagggttgttggatcacactacaattacttgtttcttattagcgattaggtgaaatacatagtgtgatggtttagttaaaccatttgctgtcgaggggttctgtttttctgttagttttggaaatgatgcatcttgcgggattatacatgtcttttgtgaagactaatatgatttgctggatatttaattagcattgtgatggttctaggtgaatattcaggtatgcttatgctggacagtttggtattacatttatgtaaaatttcatttatgcttcactatcttggctgatttgactgctgtgattttgttggtagaaaccaatcaataaaagtgttgggatgccatgctaattggttccttcatttagcgatggatgtcaagcagcggtacaagcattgaattg

SEQ ID NO: 7686 - DNA, 1535 bp, Pisum sativum
cggacgcgtgggccaagtccaatctcacttcacttctctccacaactaaactcaatctcttttcctttgcttccgggcttatcttccttcaacaatggcgacggtcatgcagaaaatcaaggatattgaagatgagatggcaaagactcaaaagaacaaggctactgctcatcatttagggttactgaaggctaaacttgcaaaactgcggagagagctccttacccctacaactaagggaggtggaggtgctggtgaaggttttgatgttactaaaagtggagatgcaagagttggtcttgtgggctttccttcggttggcaagtctactctgctgaataaattgactgggacattttcagaggttgcttcctatgagttcactaccttgacatgcatcccaggtgtgatcacataccgtggagctaaaattcagttgctggatcttcctggaattattgagggtgccaaggatggaaagggtagaggaaggcaggttattagtactgcaaggacatgtaattgcattttaattgttctcgatgcaataaaaccaataactcataagcgtcttattgaaaaagagctagaaggatttggtataaggttaaacaaagaacccccaaacctgacttttaggaggaaagagaagggtggaattaatttcacctcaactgctacaaacacccatctggatctcgataccgtgaaggctatctgtagcgagtacagaattcataatgctgatattactctaaggtatgatgctactgctgatgaccttatagatgtcattgagggcagtagaatctatacaccctgcatctatgttgtgaacaagattgatcagatcacacttgaggaactggagatattggataagcttcctcattactgccctgtcagtgcgcacctggagtggaatcttgatgggcttctggataaagtttgggagtatctctgtttaactcgtatttatactaaaccgaaaggtatgaatcctgattatgaagaccctgtaatattgtcgtctaagaagaagacagtcgaagacttctgcgaccgcattcaccaggacatgcttaaacagtttaagtatgctctggtctggggttcaagtgcaaaacacaagcctcaaagagtcggcaaggaacatgaacttgaagacgaagacgttgttcagattatcaagaaagtataaatttatagtcagacttctgaaaaccgaccacaatgcctgcatgagatactatgtctgagcagaatcaaaggtctcttagtgagtttttttccagggttgttggatcacactccaattacttgtttctcattcagacagtgattaggtaaaatatacaaagtgtgatgggtagttaaactattttgttgtgaagaagggtgctgtttttctgttagttttggtaatgatccatattgcgggattatgcatatctataacagaataattggggactgtttttttggatatccaggtatgcttatggtggacattttgatgaaaaaaaaaaaaaaaa

SEQ ID NO: 7687 - DNA, 1602 bp, Sesamum indicum
cctcttctcaggggccatattgctcttcagctccggcgtacgcagaagtgttagctacggtcttgaatccttgcttccgccgcctttacgccgtcgttcaaaggtcctgacattctccatcagcagccatggcgacagtgatgcagaaaattaaagatatcgaagatgagatggcaagaactcagaagaacaaagcgactgcccaccatctgggcttgctgaaggcaaaacttgcaaaactccgaagggaaattcttacaccagcatctaagggaggtggtggtgctggagaaggttttgatgttacaaaaagtggtgatgcgagagttggccttgtgggttttccttcagttgggaaatcaacactcttaaacaaattaactggaactttttcagaggttgcttcatacgagtttactactttaacttgcattcctggtgtaatcacatatcgaggagctaaaattcagttattggaccttcccggtattattgagggtgctaaagatggcaagggtagaggtaggcaggtcatcagtacagctcggacatgcaactgcatcctgattgttctggatgcgataaaaccaattactcataaacgcctaatagagaaagagcttgagggatttggcataagattaaacaaggaaccaccaaatctgacatttcggaggaaagacaagggtggaatcaatctcacatctacagttaccaacacacatcttgaccttgaaacagtgaaggcaatttgtggtgaatacagaatacacaatgctgatattaatcttagatatgatgcaacagcagatgaccttatagatgtcattgagggaagcagggtatatatgccttgcatctatgccatcaacaagattgatcagattacacttgaagagttggagattttggacaaacttccacattattgcccagtcagtgctcatttggaatggaacctcgatggtctactggagaaagtatgggaatatctcaacttaactcgcatatacacgaagccaaaggggatgaatccagactatgaagatcctgtcatattgtcatccaagagacggacggttgaggacttctgcaatagaatccacaaggacatgcttaaacaattcaaatatgcactggtttggggttcaagcgcgaaacacaaaccccagagggtgggcaaggagcacgaactggaagatgaagacgtcgtacaaatcattaagaaggtgtgatttcagaatttaatatatcagatactctccggtccatgtgttatacgaggtaccagccctgaagctcggacttcatttttctcgaattcaatatttattcactgtgctacgtaatgtgtcgacgttatggtcatgatatagctgctgatacccttatatctagtctagtggaattagaggacactgtaactaggcaaaatcagttttatggttagatatctgctagaaagcaatatcactttgttatattttgcatgtatgaagaaggtcgtgtttttctcggtattttcactatgttccgtggtctgtacttacaaggcatcccatgtgaaattgtattaagctccgtttgattattgatttggac

SEQ ID NO: 7688 - DNA, 1590 bp, Trigonella foenum-graecum
cctgtaacatttcaccaccgctcttaggtttcaaagtccaatctcactacacttctcttcagaagtaaccgaatctcctttccatcgcttccgagcttctcgttcttcaaaaatggcgacggtaatgcagaaaatcaaagacatcgaagatgagatggcgaagactcaaaagaacaaggctactgctcatcatttggggttactgaaggctaaacttgcaaaactgcggagggaactccttactcctacaacaaagggaggtggaggtgctggtgaaggttttgatgttactaaaagtggggatgcaagagttggtcttgtgggcttcccttcggttggcaagtctactctgctgaataaattgactgggacattttcagaggttgcttcctacgagttcactaccttaacttgcatcccaggtgtgatcacctatcgtggagctaaaattcagttgctggatctccctggaattattgagggtgccaaggatggaaagggtagaggaaggcaggttattagtactgcaaggacatgcaattgcattttaattgttctcgatgcaataaaaccaataactcacaagcgtcttatagaaaaagagctagaaggctttggtataaggttaaacaaagagccaccaaacctgactttcaggaggaaagaaaagggtgggatcaatttcacttcaactgctacaaacacacatctggatcttgatactgtgaaggctatatgcagcgagtacagaattcataatgcagatattactctaaggtatgatgccactgccgatgaccttatagatgtcattgaaggcagtagagtatatacaccctgcatctatgttgttaacaagattgatcagatcacacttgaggaactcgagatcttggataagcttcctcattactgccctgtcagtgcgcacctggagtggaaccttgatgggcttctggataaagtttgggagtatctcaatttaactcgtatttatactaaacctaaaggtatgaatcctgattatgaagaccctgtaatattgtcctctaagaagaagacagttgaagacttctgtgatcgcattcacaaggacatgcttaagcagtttaaatatgctctggtctggggttcaagtgcaaaacacaagcctcaaagagtcggcaaggaacatgaacttgaagacgaagatgttgttcagattatcaagaaagtataaacttgtagtcagacttccgaaaaccaaccacaacgcctgtgtgagatactggaggatgtctgagcagaatcaaaggtctcttagtgagatcacactccaattccttgtttcttattcagatgagaattaggtgttatatacaaagtgtgatgggtaattaaccatttgttgtcgaggtgtcctgtttttcggttagtttctggaaatgatgcatcttgtgggattatgtgtctagcagaatatatggggcatgttttttgtgaagactactacaattcactttgatattcagtaagcattgttatggttgtaggtggatattctgttaacttattccggacgttcttagtgaaatgatggcatcagtttac

SEQ ID NO: 7689 - DNA, 1270 bp, Amsonia hubrichtii
tggcaaagttcgaagcgcaccaaagcccctatatctttctccccatttacatcgtcgttttcaacaccgagctctccttcaatccttctgctttcagcaatggcgactgttatgcagaaaatcaaagacatcgaagatgagatggcaagaacccagaagaacaaagctactgctcatcatcttggtttgctaaaggctaagcttgcaaagcttcgacgagaactccttactccttcatcaaagggaggtggtggtgcaggagaaggttttgatgtcacaaaaagtggagatgctagagttggtctagttggtttcccttctgtggggaaatcaacgctgttaaataagttgactggaactttttcagaggttgcttcatatgagttcaccactttaacttgcattccaggagttataatgtatcgaggagctaaaatccagttattggatctccctggtattattgagggtgcaaaagatggaaagggtagaggaagacaggtcatcagcactgcaaggacatgcaattgtattctgattgtcctggatgcaataaagcctattactcacaaacgtctgatagaaaaagagttggaggttttggaattagattgaacaaagaacctcctaatttgacattcagaaggaaagacaagggtgggatcaatcttacatcaacagttaacaacacaaatctggaccttgaaacagtgaaggccatatgtagtgaatacaggatacacaatgctgacattaatctcagatgtgatgcgactgctgatgatcttatagatgtcattgagggcagtagagtctatataccttgcatctatgttctcaataagattgatcagattacacttgaggagctggagattctggataaacttccacactattgccccatcagtgctcacctggaatggaaccttgatggtctgctggagaagatttgggagtatctcaatctgacacgtgtttacacaaagccaaagggaatgaatcctgattatgaggaccctgttatactttcatccaggaggaggactgttgaggatttttgcaactgtatccacaaagatatgttaaaacaatttaaatatgcattggtttggggttcaagcgcaaaacacaagcctcagagggtgggcaaggagcatgagctagaagacgaagatgttgtgcagatcatcaaaaaagtgtaacttaggtgcgctattgtggttcgcgttatttgagagagatgtagcagtggagctttgatacgatt

SEQ ID NO: 7690 - DNA, 1795 bp, Cirsium arvense
ttgtgaccgagtccgagttccagtgaactctcgtgggattgtcatccgaactcccgaaattgcttaagctacttgcatgccttcggtttaatattatgaaatatgtggtgtatgaatgtattattattgataataaaatatggaacctatgagtttcatgtctattaattaaaaagaaaaaaataccgactgcgactccagttgctctagaagcctcttttcctcttccattgataccacctaaagctacatatacatttcgaaacaacatcaaagcagttactctactcatacacttcaacaatggcgactgttatgcagaaaatcaaagatatcgaagatgagatggccaaaacccaaaagaataaagcaactgcacatcacttgggattgctgaaggctaagcttgcaaaattgcgaagggagcttctcactcctacaacaaagggaggtggtggtgctggagaaggttttgatgttacaaaaagtggagatgcaagggttggtcttgtgggtttcccttctgttgggaaatcaacactgttaaacaagttaactggcactttttcggaggttgcttcatacgagtttaccactctcacctgcattccaggtgttatcacttatcgaggagctaaaattcagttgttggatcttcctggtattattgagggtgctaaggatggaaagggtagaggaaggcaggttatcagcactgctaggacatgcaactgtatactgattgtgctggatgcaataaagccaataacccacaaacggctgatagaaaaagagcttgaagggtttggcataaggttaaataaggagcccccaaatctgaccttcaggaaaaagaaagggtgggattaatttacgtcaacggttgctaatacacatctggacctcgaaacagtgaaggcaatatgtagtgaatacaaaatacataatgctgatgtgactcttaggttcgatgccactgctgatgatctcatagatgttattgaaggaagtaggatatatacgccttgcatctatgttgtgaacaaaatagatcagataacacttgaagagctcgagatattggataaacttcctcactactgtcctgtcagtgctcatttggaatggaatcttgatggtttgctcgagatgatatgggaatacctcagtttgactcgcatttacaccaaacccaaagggatgaatccagactatgaggaccctgtaattctttcatcaaaaagaaaaactgtcgaggacttctgctttcggatccacaaggacatgcttaagcaatttaaatatgcactggtgtggggttctagtgcaaaacacaagccacaaagggttggcaaggaacatgagcttgaagatgaagatgtcgtgcagatcataaagaaagtgtgagtcaaaacccgacaaatctcctgctccatttttgtgattgtatcattttgaaagcaggtatgaaagcatatactcgttagtgatgctttcactgctacccttttgagttgcattaagtagcatgttaggtttatcacatgcgttcaattatctccttagtatggtcttttttaacggatattaatgtgtctacactttaggacaaaaaagacataatttaggcatgctagaatttgtggtttataacttttcttggatcttttcgtactttgggaactaaatcttatgagtgacgtttgtggtatagtgtcgaatatgtaagtgagcgtatgtcgcaaccttgatttgggatgctgtcatttttgaaatgtgtcgatgttatctaaaa

SEQ ID NO: 7691 - DNA, 1547 bp, Glycine max
cttctcttcaccgtcgcaacacaacgctgagctgcagcaattcaccaccgcagagttttccaagtccaatctcacttcacttatcgccagggtttaatctgaatatctttcgcgttgccactgaggttgttatctttcttccaaaatggcgacggtgatgcagaagatcaaagatatcgaagatgagatggcaaagacccaaaaaaacaaggctactgctcatcatctgggcttgctgaaggctaaattagcaaagttgcggagggaactccttacaccttcatcaaaaggagctggaggtgctggtgaaggttttgatgttactaaaagtggggattcaagagttggtcttgtgggcttcccttcagttggcaaatctactctactaaataagttgaccgggacattttctgaggttgcttcctatgagtttactaccttaacttgcatcccaggtgtgatcacatatcgtggagctaaaatccagttgttggatctccctggaattatcgagggtgctaaggatggaaagggtagaggaaggcaggttattagtactgcaagaacatgcaattgcattttgattgtccttgatgcaattaagccaataactcataagcgtcttatcgaaaaagagctagagggatttggtataaggttaaacaaagagccaccaaatctgacttttaggaagaaagacaaaggtggactcaatctcacctcaactgtcaccacaacacatctagatcttgagactgtgaaggctatatgtagtgagtacagaattcacaatgcagatattactctcaggtatgatgccactgctgatgaccttatagatgtcattgagggaagtagggtgtatataccttgtatctatgttgtgaacaagattgatcagatcacacttgaggaactggagatcttggataagctacctcattactgcccaatcagtgcacatctggagtggaaccttgatggtcttctggagaaaatttgggaatatctcaacttaactcgtatttatactaaacctaaagggatgaatcctgattatgaagaccctgtaatattatcctctaagaagaggacagttgaggacttctgcgatcgcattcacaaggacatgcttaaacagtttaagtatgctttggtctggggttcaagtgcaaaacacaagcctcaaagagttggcaaggagcatgaacttgaagatgaagacgttgttcagattatcaagaaagtataatttgttataatcagaagaatccaagatgacgttttctgcaaatcgatcagaatgccggcactctcattagattaatagaggatattctgagcagaatcaaagatcccttcgtgagactttcaccaggatctttagattacactccaattatttgtcttttttaagttgggggtgaggtagagtatattaaagtttgatgcgttgttaaaccattagttatttcaggggacgccgtttgtcgcggaagttttgaaaatgatgtatcttgtggtgggattatacaattaatgggtag

SEQ ID NO: 7692 - DNA, 1736 bp, Phaseolus vulgaris
tcggattccagaatgaaatactctaccctaggtcccaccgtaagcatttatgcatatttgttctagcactttctgcttcgttcacctcttctccgtcgcaacacaacgctacgccgcagcaattttccgctgcagagttgttcaagtccgttagcacttcacttctcgccagcgttaatctgaatcgcttttgcgttgcctcttaggttcttatctttcttccaaaatggcgacggtgatgcaaaaaatcaaagatatcgaggatgagatggcaaggacccaaaaaaacaaggcaactgctcatcatctgggcttgctgaaggctaaacttgcaaagctgcggagggacctcctcactccttcatcaaaaggaggtggcggtgcaggtgaaggttttgatgttactaaaagtggggattcaagagttggtcttgtgggcttcccttcggttggaaaatctactttacttaataagttgactgggacattttctgaggttgcttcctatgagtttactaccttaacttgcatcccaggagtgataacatatcgcggagctaaactccagttgttggatctccctggaattattgagggtgctaaggatggaaagggtagaggaaggcaggttattagtactgcaaggacatgcaattgcattttgattgtcctagatgcaataaagccaataactcataagcgacttatagaaaaagagctggagggatttggtataaggttgaacaaagagccaccaaatctgacttttaggaagaaagataaaggtggaatcaatctcacctcaactgtcaccacaacacttctggatcttgagactgtgaaggctatatgtagtgagtacagaattcacaatgctgatattactctccggtatgatgccactgctgatgaccttattgatgtcattgagggaagtagagtatatatgccttgtatctatgctgtgaacaagattgatcagattacacttgaagaactggagatcttggataagctacctcattactgcccagtcagtgcacacctggagtggaaccttgatggtcttctggacaaaatctgggaatatctcagcttaactcgtatctatactaaacctaaagggatgaatcctgactatgaagaccctgtaatattatcctcaaagaagaggacagttgaagacttctgtaatcgtattcacaaggacatgcttaaacagtttaagtatgctttggtctggggttcaagtgcgaaacacaagcctcaaagagttggcaaggagcatgaactagaagatgaagatgtggttcagattatcaagaaagtttaatttgttaaaatcagaaggaaacgaagatgaaattttgtgaaagtcgatcagaatgtctgcacgcactctctttagattattaaaggatgttctgaacagaatcaatatccctccgtgacactttctccaggatggttagattagattacactccaaattacttgtcttttttaagttgggggtaaaagagtacattaaagtatggtgcgttgttaaatcattagttttttaggggacgacatttacttaaagttatggaatgatgtatcttgtgggactatccgtgtcaaaagaataatgggtagagtaattttgtgtttacttgtaaacattgatatggtttgctgaatggatattatattattcaggtggatttcactttctccatgcatgctgctggaca

SEQ ID NO: 7693 - DNA, 1597 bp, Humulus lupulus
aataacgaacgcctccagtacttctggtagcttcttcttcctacagtcctaaatcgcatcgagaacactgtaccactccagagattacatactcaaactgatctcatacttcctctgttccaagatctctacttcaatcttcaacaatggcgaccgtgatgcagaagatcaaggatatcgaagatgagatggcacggactcaaaagaataaagcaactgcccatcacttgggcttgctcaaggctaaacttgcgaagttaaggagagatctcctcacaccttcaacgaaaggagccggtggtgctggtgaaggatttgatgttactaaaagtggagatgcaagagttggtctggtgggttttccatcagttgggaaatctactctattgaataaattaacagggaccttttcagaggttgcttcctatgaattcactaccttaacttgcattcctggtgtgatcgggtaccggggtgctaaaattcagcttttggatcttccaggaattattgagggtgcaaaggatgggaagggtagaggaaggcaggtaataagcactgctaggacttgcaattgtattttaattgttcttgatgcaataaagccaataactcataaacgtctaatagagaaagagctcgagggatttggcataaggttgaacaaagaaccacctaatctgacgttcagaaagaaagacaagggtggaatcaattttacctcaacagttaccaacacacatctggaccttgatacagtgaaggcaatttgtagtgaatacaggattcacaacgctgatatcactcttcgatttgatgcaactgctgatgatctcatagacgtaattgagggtagtaggatatatatgccttgcatctatgtggtgaacaagattgatcagattacccttgaagagttggaaattttggataaacttccacactattgtccaatcagtgctcacttggagtggaacctcgatggtttgcttgataaagtatgggaataccttaatttaactcgtatttacacaaaacctaaagggatgaatccagattacgaagaccctgtaattctatcatccaagaggagaacagttgaggatttctgtgagcgaattcacaaggacatgcttaaacaatttaaatatgctctggtttgggggtctagtgcgaaacacaagccccagagagttggcaaggagcacgagctggaagatgaagatgttgtccagatcatcaaaaaggtgtgaaattggcaaaatcagatgacctggatgctgtttcacatttttgctcggaaaccggttttgaagtggtcctaagaatggttaagctttggaagtttcacctctcacgcaatagcacacagcactattctcgtttttgtttttcgttctagttgtagtacaatatggtgacttgcttgatatgtaaatttattagttttatggtcaagcaatcttgtggagagtgtaaccttttgactgactgtatttgatgatgtatgacaacgttaaagaagattgaatgaactatggatgagcattggaaagacaaaacggtacctaggagttcaaattcagatgttttatta

SEQ ID NO: 7694 - DNA, 1607 bp, Lotus japonicus
actctaccctagctcccaccgtaagtgcttttgttctagcaccttcttcgttctccttctcttctcagacgcagcgcaacgctgcaaatttcaccaccggaacgctgcaaaattctcacttccctcatcatttcgactaatctgagcttatcttccttcaaccatggcgaccgtgatgcagaagatcaaagacatcgaagatgagatggcaaagactcaaaagaataaggctactgctcatcatttgggtttgctcaaggctaagcttgcaaagctgcggagggaactccttacacctacaacaaaaggaggtggaggtgctggtgaaggttttgatgttaccaaaagtggggattcaagagttggtctggtgggcttcccttcagttgggaaatccactctgctgaataaattaacggggacgttttcagaggttgcttcgtatgagtttactaccttgacttgcatcccaggtgtgatcacatatcgtggagctaaaattcagttgctggatctccctggaattattgagggtgctaaggatggaaagggtagaggaagacaggttattagtactgcaaggacatgcaattgcattttaattgttcttgatgcaataaagccaataacacataagcgtcttatagaaaaagagctggagggatttggtataaggttaaacaaggagccaccaaatctgacctttagaaagaaagagaagggtggtatcaatttcacatcaactgccgccaatactaatctggatcttgatactgtgaaggctatatgtagtgagtacaaaattcacaacgcagatattactcttaggtatgatgccaccgctgatgaccttatagatgtcattgagggcagtagagtatatattccttgcatctatgttgtgaacaagattgatcagatcacacttgaggaactggagatcttggataagctacctcattactgtccaatcagtgcacatctggagtggaaccttgatgggcttctggagaaaatttgggaatatctcagtttaactcgtatttatactaaacctaaagggatgaatcctgactatgaagaccctgtaatattgtcgtctaagaagaggacagttgaagacttctgtactcgcattcacaaggacatgcttaaacagtttaagtatgctctggtctggggctcaagtgcaaaacacaagcctcaaagagttggcaaggaacatgaactggaagatgaagatgttgttcagattatcaagaaagtataatttgttctaagtcagaaggaatccaagatgtgaacttgtgaaaacagatcacagtgcctgcacaagatattagaggattttacgagccagatctaaggtctcttagtgagaatttcttcattgttgttagatttcactccacttgttttcttttcagttgggggtatgtaaaatatatctaagttcgatgcgtagttaaacctcttgttttcaagggatgacgatttttgtagtgctagatttggaaattatgtcttatatacatgtctgaacataattaatgggtggaattgagttgggggtgtgcttgtgaacatgaatgtgatgttttctggat

SEQ ID NO: 7695 - DNA, 1685 bp, Medicago truncatula
ctagcaccttctttcttcctcgttctcgttttcttctacagttcaacaccacgctctgaacccgtaacatctcaccaccgctcttaggtttcaaactccagtctcagttcacttctctccggaagttaaccgtatctcttttcctttgcttacgagcttctcattcttcaacaatgtcgacggtaatgcagaaaatcaaagacatagaagatgagatggcaaagactcaaaagaacaaggctaccgctcatcatttggggttactgaaggctaaacttgcaaaactgcggagggaactccttacacctacaactaagggaggtggcggtgctggtgaaggttttgatgttactaaaagtggggatgcaagagttggtctcgtgggcttcccgtcagttggaaagtctactctgctgaataaattgactgggacattttcagaggttgcttcctatgagttcactacactaacttgcattccaggtgtgatcacatatcgtggagcaaaaattcagttgctggatctccctggaattattgagggcgccaaggatggaaagggaagaggaaggcaggttattagtactgcaaggacatgcaattgtattttaattgttctcgatgcaataaaaccaattactcacaagcgtcttattgaaaaagagctagaaggatttggtataaggttaaacaaagagccaccaaacctgactttcaggaggaaagaaaagggtgggattaatttcacctcaactgctacaaacacccatctagatcttgataccgtgaaggctatatgtagcgagtacagaattcataatgcagatattactttaaggtacgatgccactgcggatgaccttatagatgtcattgagggcagcagagtatacacaccatgcatctatgttgtgaacaagattgatcagattacacttgaggaactggagatcttggataagcttcctcattactgccctgtcagtgcacacctggagtggaaccttgatgggctcctggataaagtttgggagtatctcaatttaactcgtatttatactaaacctaaaggtatgaatcctgattacgaagaccctgtaatattgtcatctaagaagaagacagttgaagatttctgcgatcgcattcacaaggacatgcttaaacagtttaagtatgctctggtctggggttcaagtgcaaaacacaagcctcagagagtcggcaaggaacatgaacttgaagacgaagacgttgttcagatcatcaagaaagtatgaacacagtcagacttccaaaaaccgacaacattgcctgcatgagatactagaggatgtctgagcaaagggttattggatcacactccaattactcgttactcgtttcttattcagatagggattaggtgaaatatacaaaatttgatgggtagttaaaccatttgttgttgagtggtgctgttttcctgttggttttggaagttatgcgtcttgtgggattatacatgtctctaacagagtaattggggcctgttttttgtgaagactacaacttgctggatatttagtaagcactgtgattgttagttctaggtggatattcgggtatgcatatgcatatgctggacaatcttaatgaaattacgcatcagtttggtactgcattcatgtaaaatttcatttatg

SEQ ID NO: 7696 - DNA, 1810 bp, Glycine max
ggatccgagaactgaatactctaccctaggtcccaccgtaagcgtttctgcatacgagatgttctagtaccttcttcgttcacctcttctcttcaccgtcgcaacacaacgctgagctgcagcaattcaccaccgcagagttttccaagtccaatctcacttcacttatcgccagggtttaatctgaatatctttcgcgttgccactgaggttgttatctttcttccaaaatggcgacggtgatgcagaagatcaaagatatcgaagatgagatggcaaagacccaaaaaaacaaggctactgctcatcatctgggcttgctgaaggctaaattagcaaagttgcggagggaactccttacaccttcatcaaaaggagctggaggtgctggtgaaggttttgatgttactaaaagtggggattcaagagttggtcttgtgggcttcccttcagttggcaaatctactctactaaataagttgaccgggacattttctgaggttgcttcctatgagtttactaccttaacttgcatcccaggtgtgatcacatatcgtggagctaaaatccagttgttggatctccctggaattatcgagggtgctaaggatggaaagggtagaggaaggcaggttattagtactgcaagaacatgcaattgcattttgattgtccttgatgcaattaagccaataactcataagcgtcttatcgaaaaagagctagagggatttggtataaggttaaacaaagagccaccaaatctgacttttaggaagaaagacaaaggtggactcaatctcacctcaactgtcaccacaacacatctagatcttgagactgtgaaggctatatgtagtgagtacagaattcacaatgcagatattactctcaggtatgatgccactgctgatgaccttatagatgtcattgagggaagtagggtgtatataccttgtatctatgttgtgaacaagattgatcagatcacacttgaggaactggagatcttggataagctacctcattactgcccaatcagtgcacatctggagtggaaccttgatggtcttctggagaaaatttgggaatatctcaacttaactcgtatttatactaaacctaaagggatgaatcctgattatgaagaccctgtaatattatcctctaagaagaggacagttgaggacttctgcgatcgcattcacaaggacatgcttaaacagtttaagtatgctttggtctggggttcaagtgcaaaacacaagcctcaaagagttggcaaggagcatgaacttgaagatgaagacgttgttcagattatcaagaaagtataatttgttataatcagaagaatccaagatgacgttttctgcaaatcgatcagaatgccggcactctcattagattaatagaggatattctgagcagaatcaaagatcccttcgtgagactttcaccaggatctttagattacactccaattatttgtcttttttaagttgggggtgaggtagagtatattaaagtttgatgcgttgttaaaccattagttatttcaggggacgccgtttgtcgcggaagttttgaaaatgatgtatcttgtggtgggattatacaattaatgggtagaataatttggtgtctacttagtaaacattgataggctttgctggaaagatatatattattcaggtggatatgtcagactgtccatcctgctggacatttttcacaaaacgatggcatgagcttgatacagcatttacattgtttttaaaatttattgacagtgataaagctttttaca

SEQ ID NO: 7697 - DNA, 1290 bp, Abies balsamea
ttcttctcgactccttcgatacaaacctcaaacagctcgcgcagaccgttacatacgcatcttctgaactcaatcgactgtaaccatggcgactacaatgcagaaaatcaaagatattgaagatgagatggcaaaaacacagaaaaacaaggccacagcccatcatttgggtttgctcaaggccaaacttgctaaattacgacgggaaatccttgctcctcctacgaaaggaggggggggaggtgctggtgaaggctttgatgttactaaaagtggagattcccgtgttggacttgtagggtttccatcagttggaaagtcaactcttctgaacaagttgacaggtaccttctctgaggtggcatcatatgaattcaccactctaacatgcattcctggtgttattcgctatagaggtgcaaagcttcagttactagaccttccaggaattattgaaggtgcaaaaagatggtaaggggagaggaaggcaggttatcagtactgcaagaacatgcaattgtattttaatagttctcgatgctatcaaacccattactcacaagcgcataatagaaaaagagcttgaaggatttggaatcaggttgaacaaggagcctcctaatttgtcatttaggaggaaggacaagggtggaataaatttcacgtctactgtgaccaacacactcctggaccttgagactgttaaggctatttgtggagaatacaggattcataatgctgatatatctcttcgctatgatgcaactgcagatgaccttatagatgtgattgaaggtagtcgcatatatatgccttgcatttatgtcgttaacaagattgaccaaataactctagaggaattggagattttggataaactgcctcactactgccctatcagtgcccacttggaatggaatttggatggcctattggagaagatatgggagtacttaaatttgacccgaatctatacaaagcctaaagggttgaatccggactatgaagatcccgtgattctttcgtccaaatcacgaactgttgaagatttttgtactcgaattcacaaggatatgttgaagcaatttaaatatgcattggtatggggttccagcgcaaaacacaaaccacagagagttgggaaggaccatgaattggaggatgaggatgtagtgcagattataaagaagatataagcatagggagattctcttttcatgaaaatttattgttcctcttttcctgtcttaatatgtaaatgagccagagctagtgggttttgatcattgt

SEQ ID NO: 7698 - DNA, 1553 bp, Carpinus betulus
tttttccagtaccttccttcctcttcttctgaaccaattcacaaaccatttacagctcagtcgccaccgcccgtacatcgtgatcggagacgcacacacgctcatacatacgcactcactctagacttctctgcctcaaaaatgtcgacggttatgcagaaaatcaaagacatcgaagatgagatggcaaagactcaaaagaacaaggctactgctcatcacctgggcttgctcaaggctaaacttgcaaagctacggagggaactccttgcgcctccctcaaagggaggtggtggtgctggtgaaggatttgacgttactaaaagtggagatgcaagagttggtctggtgggcttcccttcagttgggaaatctacactgttaaataaattaacagggaccttttcagaggttgcttcctatgaatttactaccttaacttgcatcccaggtgtgatcatgtatcgaggagctaaaattcagttgttggatctccctggaattattgagggtgctaaggatggaaggtagaggaggcaggttatcagcacttctagaacatgcaattgcattttaattgttcttgatgcaataaagcctatcactcacaaacgtctgatagagaaagagcttgagggatttggcataaggttaaacaaggaaccacctaatctgactttcaggaagaaagataagggtggaattaattttacttcaactgttaccaacacacacctagacctcgaaactgtgaaggcaatatgtagtgaatacagaattcacaatgctgatattactcttaggtatgatgcaactgctgatgacctcatagatgtcattgagggaagtaggatatatatgccttgcatctatgttgtgaacaagattgatcagatcaccctggaagagctggagattttggataaacttcctcactactgcccagttagtgctcacctggaatggaatcttgatggtctgctggataagatatgggaatatctaaatttgactcgcatctacacgaagcctaaagggatgaatcccgactatgaggaccctgtaattctgtcatctaaaaggaagacagttgaggacttctgcgaacgaattcacaaggatatgcttaaacagttttaagtatgctttggtagtggggtcaagcgcgaaacacaagccccaaagggttggcaaggaacatgagcttgaggatgaggatgttgttcagataatcaaaaaggtgtgaccgtaggatcaatagaatcctggaacaactagaagttgttagcaagaaatggttaaaagaatttttgagcaccgagtaagggttttatgagattttatttcatatttttcccaagctttgctaggcctaagcagtccatgtcatctctttttcattttgctgattatgtagaagagggagagcttgatgtgtaattaagcttttattttgtaggtcaagcttgttttcggtgattgtctttccgcttggttgtattgtatgacagtaaacatgaaatctattagagaaaagactatataggaagttt

SEQ ID NO: 7699 - DNA, 1449 bp, Valeriana officinalis
ccacttgcgtcgtcattactcgattcttccaggcagccattcaaaaagtatcgaacaaaataaaaacaaactcacaaacctcaactccgttcctcttcttcgcccttccgaattcaaccatggcgacggtgatgcagaaaatcaaagacatcgaggatgagatggcaaggacgcaaaagaacaaagctactgcccatcatcttggtttattgaaggctaagcttgcaaaattaggagggatttacttgcgccgccgtcgaaaggcggtggtggtggtgccggagaaggctttgatgtcacaaaaagtggagatgcaagagttgggttagtgggttttccttctgttggaaaatcaacccttttgaataaattaactggtactttttcagaggtagcttcgtacgagtttaccactttaacctgcattccaggtgtcatcacatacagaggagctaaaattcagttactggatctccctggtattattgagggtgctaaggacggaaagggtagaggaagacaggtcatcagtactgctaggacatgcaactgtattctgattgttctggatgcaataaagcccataacacacaagcgtctaatagagaaagagctcgagggatttggcataaggttaaacaaagaacctccaaatttaacgttcagacgaaaagataagggagggattaattttacatcgacagttccgaacacgcatctggatatcgaaactgtgaaggcaatatgcagcgaatatagaatacacaatgctgaccttaccctaagattcgatgctacagctgatgaccttattgatgtcattgagggaagtagggtttatacgccgtgtatctatgttgtcaacaagatagatcagattacaatcgaagaactcgagatcctggataagcttcctcattactgtcctgttagtgctcatctggaatggaatctcgatggactgctagaaaaaatatgggaatatctgaatttgactcgcatatatacaaaaccaaagggtattaatcctgattatgaagatcctgttatcctttcctcgaaacggaggactgttgaagatttttgtaaccgtattcataaggacatgcttaaacaatttaaatatgcactggtctggggttcgagtgcaaaacacaagccccaaagagtaggaagggagcatgaacttgaagacgaagatgttgtgcagattatcaagaaagtgtgagtgatattctgaattctttgacaaaatctgtatatttttatatgcatgttttgcatgagaggagttcgcgttgtcatgaactacataggatttgtttagaatatcggtcatgttgtcgaatcaaaaccatttctgtgatcaggttttataaaaccctaattacacgctgtctgatttttgagtaatgttttgtaagataatggttcaagtctgactttttc

SEQ ID NO: 7700 - DNA, 1540 bp, Malus domestica
ggacgtgccctaaccccatttacttctggtaccttctcctctctccctctctctgtggcgtagtaggctagtagcatttgagcagaatcattacaatccgacgaaaaccctttcctctgtttcggagctagcgtgcttcaacaatggcgactctgatgcagaaaatcaaggacatcgaagatgagatggctaggactcaaaagaacaaagctactgcccatcacttgggattgctgaaggctaaacttgcaaagctaaggagagacctacttgagcctccgtcaaaaggcggtggcggtgctggtgagggttttgatgtcactaaaagcggagatgcaagagttggtttggtgggtttcccttcagttgggaaatctacactgctgaataaattaactgggaccttttcagaggttgcttcctacgaattcactactttaacttgcataccaggagtgatcgtgtatcgaggtgcgaaaattcagttgttagatctccctggaattattgagggtgctaaggatggaaagggtagaggaagacaggttatcagcactgctaggacatgcaattgcattttaattgttcttgatgcaataaagccaataactcacaagcgtctaattgaaaaagagctcgagggatttggtataaggttaaacaaggaaccacctaaccttacattccggaagaaagataagggtggtattaatttcacttcaacggttacaaacacacatctggatcttgaaactgtgaaggcaatatgcagtgaatacagaattcacaatgctgatatcactcttaggtttgatgcaacggctgatgacctcatagatgtaattgaaggcagtaggatatatatgccttgcatctatgttgtgaacaagattgatcagattacacttgaagagcttgagattttggataaacttcctcactactgtcctgtcagtgctcatctggagtggaaccttgatggtttgctggagaaaatatgggagtatcttaatttaactcgcatatatacaaaacctaaggggatgaatccagactatgaagaccctgtgatcctgtcttctaagacaaggacggttgaggatttctgcgaacggattcataaagattttatcaaacaatttaagtttgctcttgtttgggggtcaagcgcaaagcacaagccccaaagagttggcaaggaacatctgcttgaagacgaagatgttgttcagattatcaaaaaggtgtgatttggtgcaaagtcggtaagtcttataaacttagcacatcagaatgtcaccgtgcgagagtaaagctttttgagatgaggctttccttttcaaccaactttggatcgttgtaatttgtagaccatacagcactcctccggtgtctgcttattggggtgtaaggctaggcagaacttgaggcagtttgatatttaatatcacactgccctttttttgtgttgtcgttttaaaagttctttagtttgtgaattgtgatagtataataatatcatgtattacgaagttcagag

SEQ ID NO: 7701 - DNA, 1427 bp, Chrysanthemum coronarium
attctagaaccctcttgtttacacagcttcacttctacaacggatatacccatctatctttcaatctatattttaaaaaaaaataacaatcgaatcagagctgataacaaacttgctcaacaatggcgactgttatgcagaaaatcaaagatatcgaagatgagatggcaaagacccaaaagaataaagcgactgcacatcacttgggattgctgaaggctaagcttgcaaaactgagaagagagcttctcacacctacaacaaagggaggtggtggtgctggggaaggttttgatgttacaaaaagtggagatgcgagggttggtcttgtggggtttccttctgttggaaaatcaacactgctgaataagttaactggtactttttcagaggttgcttcatatgagtttaccactctcacatgcattccaggtgttatcacatatagaggagcaaagattcagttgttggatcttcctggtattattgaaggtgcaaaggatggaaagggtagaggaagacaggttatcagtactgccaggacctgcaactgtatcataattgtgctggatgcaataaagccaataacccacaaacgtctgattgaaaaagagcttgaagggtttggcattaggttaaacaaggagcccccaaatctgacgttcaggaaaaaggagaagggtgggattaattttacatcaacagttgctaatacgcatctggaccttgatacggtgaaggcaatatgcagtgaatataaaatacataatgctgatgtcacccttaggttcgatgctactgccgatgacctcatagatgttatcgaaggtagtaggatctatacaccttgcatctatgctgtcaacaaaatagatcagatcacactcgaagagctcgagatattggatagacttcctcactactgccctgttagtgctcacttggaatggaatcttgatggccttcttgagatgatatgggaatatctcaatttgactcgtatttacacaaaaccaaaagggatgaatccggactatgaggaccctgtaattctttcatccaaaagaaaaactgttgaggatttctgcttccgaatccacaaggacatgcttaagcaatttaagtatgcattggtctggggttccagtgcaaaacacaagccacaaagagtcggcaaggaacatgagcttgaagacgaagatgttgtgcagatcattaagaaagtttagaacccaataccaaccagtcttctgctctatttttgcgactgtactatcgatggtaccaccctaatgagtttggtgaagtagcatgttaggtttcaccaaatgtgatgggtggtttcattggtttagttttgtactagatggtgatgtctgtctaaagattgtggcaaagaaagcataagttgaatattatgtttggtc

SEQ ID NO: 7702 - DNA, 1541 bp, Chrysanthemum coronarium
tgtttgtttggggcatttggtctagaaccctcttcttcacttgtatacgcaacacatctatctatctatcataaacaaaatcatcaaatcatcatctactgatcttaagatacttgtttaacaatggcgaccgttatgcagaaaatcaaagatatcgaagatgagatggcaaagacccagaagaataaagcaaccgcacatcatttgggattgctgaaggctaagcttgcaaaattgagaagagagcttctcacacctacaacaaagggaggtggtggtgctggagaaggttttgatgttacaaaaagtggagatgcgcgggttggtcttgtgggttttccttctgttggaaaatcaacactattgaataagttaactggtaccttctcagaggttgcttcatatgagtttacaactctcacatgcattccaggtgttatcacatatcgaggagcaaagattcagttgttggatcttcctggtattattgaaggtgcaaaggatggaaagggtagaggaagacaggttatcagtactgccaggacctgcaactgtatcataattgtgctggatgcaataaagccaataacccacaaacgtctgattgaaaaagaacttgaagggtttggcattaggttaaacaaggagcccccaaatctgacattcaggaaaaaggaaaagggtggaattaattttacatcaacagttgctaatacacatctggaccttgatacggtgaaggcaatatgcagtgaatacaagatacacaatgctgatgtcacccttaggtttgatgccactgctgatgacctcatagatgttatcgaaggtagtaggatatatacaccttgcatctatgctgtcaacaaaatagatcaaatcacacttgaagagctggagatattggatagacttcctcactactgccccgttagtgctcacttggaatggaatcttgatggccttcttgagatgatctgggaatatctcagtttgactcgtatttacacaaaaccaaaagggatgaatccggactatgaggaccctgtcattctctcttcaaaaagaaaaaccgttgaggatttctgcttccggatccataaggacatgcttaagcaatttaagtatgcattggtctggggttccagtgcaaaacacaagccacaaagagtcggcaaggaacatgagcttgaagatgaagatgttgtgcagatcattaagaaagtttagatcccaatggcaacaagtcttctgctctatttttgcgagtgtactatcggtggtaccatcctaatgagtttggtgaagtagcttgttaggttttaccaaaggtgatgggtggtttccttggtttagttttgtactagatggtaatgtgtgtctaaagattgttggcgaaggaagcataaatttaacataaagttggtcatggcagtattttggattttactcttatcttttttactatgtgaacttaactttcaggtaatgtttgtggtatagtatggagtatacaagtgatgaaatgtggtcgatttcgg

SEQ ID NO: 7703 - DNA, 1478 bp, Chrysanthemum coronarium
tctcttaaacacagcttcacttctacacgcatatacccatctactaatcaatctatttcaaacaaaatcatcgaatcagctgatcaacaatggcgaccgttatgcagaaaatcaaagacatcgaagatgagatggcaaagacccaaaagaataaagcgactgcacatcacttgggattgctgaaggctaagcttgcaaaactgagaagagagcttctcacacctacaacaaagggaggtggtggtgctggggaaggttttgatgttacaaaaagtggagatgcgagggttggtcttgtggggtttccttctgttggaaaatcaacactgctgaataagttaactggtactttttcagaggttgcttcatatgagtttaccactctcacatgcattccaggtgttatcacatatagaggagcaaagattcagttgttggatcttcctggtattattgaaggtgcaaaggatggaaagggtagaggaagacaggttatcagtactgccaggacctgcaactgtatcataattgtgctggatgcaataaagccaataacccacaaacgtctgattgaaaaagagcttgaagggtttggcattaggttaaacaaggagcccccaaatctgacgttcaggaaaaaggagaagggtgggattaattttacatcaacagttgctaatacgcatctggaccttgatacggtgaaggcaatatgcagtgaatataaaatacataatgctgatgtcacccttaggttcgatgctactgctgatgatctcatagatgttatcgaaggtagtaggatctatacaccttgcatctatgctgtcaacaaaatagatcagatcacactcgaagagctcgagatattggatagacttcctcactactgccctgttagtgctcacttggaatggaatcttgatggccttcttgagatgatatgggaatatctcaatttgactcgtatttacacaaaaccaaaagggatgaatcctgactatgaggaccctgttattctctcatcaaaaagaaaaactgttgaggatttctgcttccgaatccataaggacatgcttaagcaatttaagtatgcattggtctggggttccagtgcaaaacacaagccacaaagagtcggcaaggaacatgagcttgaagacgaagatgttgtgcagatcattaagaaagtttagaacccaataccaacaagtcttctgctctatttttgcgagtgtactatcgatggttacaccctaatgagtttggtgaagtagcgtgttaggttttaccaaatgtgatgggtggtttccttggtttagttttgtactagatggtgatgtctgtctaaagattgtggcaaagaaagcataagttgaactttatgtttggtcatggccgtattttggtttttactcgtcaatctttttactatgtgaatcaaactttcaggtaatgtttgtggtatagtatggagt

SEQ ID NO: 7704 - DNA, 1407 bp, Euonymus alatus
tgatgcagaaaatcaaggatatcgaagatgagatggcaaggactcaaaaaaacaaggctactgctcatcatttaggtttgctcaaggccaaacttgcaaagcttcggagagaactccttacaccttcatccaaaggaggcggcggtggtgctggtgaaggttttgatgttactaagagtggagatgcaagagtcggtcttgtgggtttcccttctgtcgggaaatctacacttctaaataaattaacggggacattttcagaggttgcttcctacgagtttactaccttgacttgcattcccggtgtgatcatgtatagaggagcgaaacttcagttattggatctccctggtataattgagggtgctaaagacggaaagggtcgaggaaggcaggttatcagcactgctaggacatgcaattgtatcttaattgtgcttgatgcaataaagccgataacacataaacgtctaatagagaaagagcttgagggatttggcataaggttaaacaaggagccgcctaatctaacttttaggaagaaagacaagggtgggatcaatctaacctcgacggtcacaaacacaaatcttgatcttgaaactgtgaaggcaatatgtagtgaatacggaattcataatgctgatattactttgaggtgtgatgcaactgctgatgacctcatagatgtcatagagggtagtaggatatatatgcgttgcatctatgttgtgaataagattgatcagattacacttgaagagcttgaaattttggataaactccctcactactgcccagtcagtgctcacctcgaatggaaccttgatgggttgttggagaaaatatgggagtatcttaatttgactcggatatacacaaagcctaaagggatgaacccagactatgaagatcctgtcatcctgtcgtccaaaaagagaacagttgaggacttctgcattcgaatccacaaggatatgctgaaacaatttaaatttgctctagtatgggggtccagtgcgaagcacaagcctcagagagttggcagggagcatgagcttgaggatgaagatgttgttcagattatcaaaaaggtgtgagactgtgaaagaattttgttagaagcattatagaatatcaggaaccagctttgagaggattccccaccatgaccaagttcaaggatgaattagattgatatccattggagcacgcgtgtaatggttgctgtataaggtactagctgtcttgtgcctttataaactaagggaacttaagagaagaaaataatattgatatcttgggatggtgtgttaaaatgttgtttatatgtttagtcttttcatgataatatgtttagtcttttcatgataatcagatacttcaaagtatgacgttgatatgacc

SEQ ID NO: 7705 - DNA, 1606 bp, Lupinus angustifolius
atcccagcatcatttcttcatctttcttctagcaccttctttctccgctcccatttttctcttctccaacttcactacaagaaacgagtattctgaatctgttttacgttgctactgagattctatcttcattcaaaaatggcgacggttatgcagaaaatcaaagacatcgaagatgagatggcgaagactcagaagaacaaggctactgcacaccatttgggtttgctgaaggctaaacttgcaaagctgcggagagaactccttacaccttcaacaaaaggaggtggaggtgctggtgaaggttttgatgttactaagagtggggattcaagagttggtctagtgggtttcccttcagttggaaaatctactctactgaataaattgactgggacattttcagaggttgcttcctatgagtttactaccttaacttgcatcccaggtgtgatcacatatcgtggagcaaaaattcagttgctggatctccctggaattattgagggtgctaaggatggaaaaggtagaggaaggcaggttatcagtactgcaaggacgtgcaattgtattttaattgttctcgatgcaataaagccaataactcataagcgtcttatagaaaaagagctagagggatttggtataaggttaaacaaagagccgccaaatctgacttttaggaggaaagagaagggtggaattaatttcacctctactgctgccaacacaaatctggatcttgacactgtgaaggctatatgcagcgagtacagaattcacaatgcagatatcactcttaggtatgatgccactgcggatgaccttatagatgttattgagggcagtcgagtatatatcccttgtatctatgttgtgaacaagattgatcagatcacccttgaggaactggagatattggataagctacctcattactgcccaatcagtgcacacctggagtggaatcttgatggtcttctggagaaaatctgggaataccttgatcttactcgtgtttataccaaacctaaagggatgaatcctgactatgaagaccctgtaatattgtcctctaagaagaggacagttgatgacttctgcactcgcatccacaaggatatgcttaaacagttcaagtatgctctggtgtggggttcaagtgcgaaacataaacctcaaagagttggcaaggagcatgaacttgaagatgaagacgtggttcagattatcaagaaaatataatttgtttagtcagaaggaattcaagacagtatctagagtaccaaccaggatggcagcaggagatatctgaggatgttctcagaaaaatcaagaatcaccctgagattttgtccaatgttgttaaattacaacctaattacttgtatcttttcatgtgggagctaggttgaatgcattagagtttgatgaatagttaaactatttgttgtcaatgggcaccgtttttcacgtcagctttgaagatgatgtgttttgaggttatcccatatctaaaagtagtaatggttgtaataattggagttattataaaaaagaacaggttttgctacatatagataattcaggtggtatgcctgtgtac

SEQ ID NO: 7706 - DNA, 1548 bp, Lippia dulcis
ctctcagcaacaatggcgaccgttatgcagaaaatcaaggatatcgaagatgagatggcaagaactcagaagaacaaagcaactgcccatcatttgggtttgttgaaggctaagcttgcaaaacttcggagggagatccttgcacctgcaaccaaagggggtggtggtgctggagaaggctttgatgttacaaaaagtggtgatgcaagagttggccttgtgggttttccttcagttgggaaatcaacgcttttaaacaagttaactggaactttttcagaggttgcttcatatgagtttactactttaacttgcattcctggagtaattacatatcggggagctaaaattcagttattagatcttcctggtattattgaaggtgccaaagatggcaagggtcgtggtaggcaggtcatcagtacagctcggacatgcaactgcatcctgattgttctcgatgcaataaaaccaattactcataaacgtctgatagagaaagagctcgagggatttggtataagattaaacaaagaaccaccaaatctgacgtttaggaggaaagaaaagggtggaatcaatcttacatctaccgttacaaatacgcatcttgatcttgaaactgtgaaggctatttgtggcgaataccgtattcacaatgctgatatcaatcttagatacgatgcaacagctgatgatctcattgatgtcattgagggcagtagggtctacatgccttgcatctatgttgtcaacaagatcgatcagattactcttgaagagcttgagattttggacaaacttccacattattgcccagttagtgctcatttggaatggaatctggatggcctacttgacaaagtatgggaatatctaaatttaactcgcatatacacaaagccgaaggggatgaatccagactacgaagatcctgtcatattatcatcaaagagaaggacggttgaggacttctgcaacagaatccataaggacatgctcaaacaattcaaatatgcgttggtttggggctcaagtgtgaagcacaaaccacaaagagtgggcagggagcacgaattggaagatgaagatgttgtgcaaatcatcaaaaaggtgtaatctttcataactttccatgtcaaagctaagagaaggtttgaatgtatcatttggtcattgagttggtatttacatagcaaagtagaaacgaagaaaaatgatggcttgatttgtaatttatgtgcttttatgctcgggtcatcgtgctgctagtttaggaactagtaggttttgagggtcttctgcgtcgtcgttttcccttacatcatcgagtaactagagaaagttttgttgtttagtagttctcttgaaacaagtcggtttactttgtacccataaattgtccgggtcctgaaccttgtttatgcatttgatggttcagattgtgtgctgaattttatgtaattgaaaagataaatattgtgccatcgacatatctgcgagggttgatgtgattatacaaacttccctttaggcttgacgtaaaag

SEQ ID NO: 7707 - DNA, 1760 bp, Populus trichocarpa
agcatcggaggaagaaaaagggccgcagcagccattgcaaaaccacaaaacaaaacccctccgttctctcgagtaccttctcctcctccactaaacgctatcgcataagccgctgctctctccgattcaccacactcactcacctgccaaaatcttaatcgtcagaacatcctgatttgaaaaggacgccaacgcttttcgtttctctctaagcttcaaagaaatgtcgactgtaatgcagaaaatcaaagacatcgaagatgagatggcaaggactcaaaaaaacaaggctacagctcaccatctcggcctgctcaaggcaaaacttgcaaagctacgaagggaacttcttgagccatcggcgaaaggaggtggtggtgctggtcaaggttttgacgttactaaaagtggagatgctagagttggtcttgtgggttttccttcggttgggaaatccactcttctaaataaattaacagggacattttcggaggttgcttcctatgagtttaccaccctgacttgcatccctggagtgatcgtttataaaggagctaaaattcagttgttggatctccctggtatcatcgagggtgctaaggatggaaaaggtcgaggaaggcaggtgatcagtactgctaggacatgcaactgtatcttaattgtcctcgatgcaataaagccaataactcacaagcgtctgatagagaaagagcttgaaggatttggcataaggttaaataaggaaccgcctaatctgacattcagaaagaaagataaaggtggaattaattttacatcaacagttgccaacacacaccttgatcttgatactgtgaaggcaatatgcagtgaatacaggatgcacaatgctgatattactctgaggtatgatgcaactgctgatgacctcatagatgtcattgaggggagtagaatatacatgccttgcatctatgtggtgaacaaaatcgatcagattacacttgaagagctggagattttggacaaacttcctcactactgccctgtcagtgctcacctggaatggaaccttgatggtttgctggataaagtgtgggagtatctaaatttaactcgcatatatacaaagccaaaagggatgaatccagactatgaggaccctgtgatattgtcatcgaagaagcggacagttgaggacttctgtgaacgaattcacaaggacatgttgaaacaattcaagtatgctctggtatgggggtcaagcgcgaaacacaaaccgcaaagggttggcaaggaacatgaactggaggatgaagatgtcgtgcagattatcaaaaaggtgtgaccatcaacaccaagatttgcaatagtgctccatcgaattttctgcaatatgaaagcagttgtgtgaaagagcatcgaattctctgcattagtaaggtaattgggtttaaaaaagcttgcagacagcatgatgtgtgtaattaatccgttttgacgagggtttcgtgttgtttctcgtgacttagtctataatggtgttgtatgctacctctaatgagattgaacatagcaaagaaaactagttgagataatttggagaaatcttgagggaaagaattatctctcttgtgaactttctttagagaactaatcagacgaattcatggaccttctggaaaccttggtcgcataaacttgttgaatgtcatggcagcatatgtatttaagacttcctactaatcaaacagtcaccgcggtttgagctttgttgc

SEQ ID NO: 7708 - DNA, 1633 bp, Prunus mume
ctaccagtcagtaaacacttcagcagaatcattccgagcccgagcacaagcccttccgtacatctccattctatctctcccactccctctccgagctagtgtgcgtcaagtgcttcaacaatggcgactttgatgcagaaaattaaggacatcgaagatgagatggctaggactcaaaagaacaaggctacagcccatcacttgggcttgctgaaggctaaacttgcaaagctcaggagggacctacttgagcctccatcaaaaggtggtggtggtgcgggtgaaggttttgatgtcactaagagcggagatgcaagagttggtttggtgggtttcccgtcagttgggaaatctacactgctgaacaaattaactgggaccttctcagaggttgcttcctatgaattcacgaccttgacttgcatcccaggtgtgatcgtgtatcgaggtgcaaaaattcagttgttagatctacctggaattattgagggtgctaaggatggaaaaggtagaggaagacaggttatcagcactgctaggacatgcaattgcattttaattgttcttgatgcaataaagccaataactcacaagcgtctaattgagaaagagcttgagggatttggcataaggttaaacaaggaaccacctaacctgaccttcaggaagaaagataagggtgggattaatttcacgtcaacagttaccaacacacatctggatcttgatactgtgaaggcaatatgtagcgaatacagaattcacaatgctgatatcactcttaggtttgatgcaactgctgatgacctcatagatgtaattgaaggcagtaggatatatatgccttgcatctatgttgtgaacaagattgatcagattacacttgaagagcttgagattttggataaacttcctcactactgtccagtcagtgctcacctggaatggaatctcgatggtttgctggagaaaatatgggagtatcttaatttaactcgcatatatactaaacctaaagggatgaatccagactatgaagatcctgtgattctgtcgtctaagacaagaacggttgaggatttctgtgaacggattcataaagattttattaaacaatttaagtatgctctggtttgggggtcaagcgcgaaacacaagccccaaagagttggcaaggagcatctcctcgaagatgaagatgttgttcagattatcaaaaaggtgtgatttggtgggaagtcagaaatccttgtaactttagcatcaggatgtcatttacaagactaaagctttcgagataaggcttttctcccccagctctcagttgtctgtactttgtagtccatacagcactttttctctgttgtcctgctttcataggtgttttaagggtaggcagaacttgaggcagcttgatatttaaacatcatagggcacgtttttttggtaaagctaatttttggtcatctcaacatttgtttagtttgtattagtaatgtcatctgttaccaaattgagtggtcgcatatatcgaaggaacaaatggtaaggcgttgaaatctgcagaacttggaatttaaattcgcacttgcatattgaagttgtaatccaaaatctaacttttcatgtcctt

SEQ ID NO: 7709 - DNA, 1201 bp, Prunus persica
cgagcccgatcagaagcccttccgtacatctccattctatctctcccactccctctccgagctagtgtgcttcaagtgcttcaacaatggcgactttgatgcagaaaattaaggacatcgaagatgagatggctaggactcaaaagaacaaggctactgcccatcacttgggcttgctgaaggctaaacttgcaaagctcaggagagacctacttgagcctccatcaaaaggtggtggtggtgcgggtgaaggttttgatgtcactaaaagcggagatgcaagagttggtttggtgggtttcccttcagttgggaaatctacactgctgaacaaattaacagggaccttctcagaggttgcttcctatgaattcacgaccttgacttgcatcccaggtgtgatcgtgtatagaggtgcaaaaattcagttgttagatctacctggaattattgagggtgctaaggatggaaaaggtagaggaagacaggttatcagcactgctaggacatgcaattgcattttaattgttcttgatgcaataaagccaataactcacaagcgtctaattgagaaagagcttgagggatttggcataaggttaaacaaggaaccacctaatctgaccttcaggaagaaagataagggtgggattaatttcacgtcaacagttaccaacacacatctggatcttgatactgtgaaggcaatatgtagcgaatacagaattcacaatgctgatatcactcttaggtttgatgcaactgctgatgacctcatagatgtaattgaaggcagtaggatatatatgccttgcatctatgttgtgaacaagattgatcagattacacttgaagagcttgagattttggataaacttcctcactactgtccagtcagtgctcacctggaatggaatctcgatggtttgctggagaaaatatgggagtatcttaatttaactcgcatatatacaaaacctaaagggatgaatccagactatgaagatcctgtgattctgtcgtctaagacaagaacggttgaggatttctgtgaacggattcataaagattttattaaacaatttaagtatgctctggtttgggggtcaagcgcgaaacacaagccccaaagagttggcaaggagcatctcctcgaagatgaagatgttgttcagattatcaaaaaggtgtgatttgctgg

SEQ ID NO: 7710 - DNA, 1539 bp, Aquilegia formosa
tacaaagagagagaagagaagtagcgcgaagtcgaaacacgagtcgaagaaactctggtggtcgaaactaagaacactaaaaaaaactttgtcattatcatctcatcttttaaattgatagatattttacttgaaatcaagtagcttcaactcaaaaatggcgactgttatgcagaaaatcaaagatatcgaagatgagatggcaaggactcaaaagaacaaagctactgctcatcatcttggtttgctgaaggctaaactcgcaaaactccgacgggaccttcttgcgccgcctacgaaaggaggtggtggtggtgctggagaaggctttgatgttactaagagtggagattccagagtgggtctagtaggttttccatcagttgggaagtcaacccttctgaataaattgacaggcacattttcagaggttgcttcatatgaatttactaccttgacctgcattccgggtgttatcatgtacagaggagcaaaacttcagttgttggatcttcctggaattattgagggtgcaaaagatggaaagggtagaggaaggcaggtaatcagtactgctaggacatgcaattgtattttaattgttcttgatgcaataaaaccaataacacacaagcgtctgatagagaaggagcttgagggatttggcataagattaaacaaggaacctcctaacctgaccttccgtaagaaagataagggtggaataaattttacgtcaacagtggcaaacacgcacctggatgtggaaacagtgaaggcaatatgtggtgaatacagaattcacaatgctgatgtcacccttcgatttgatgctactgctgatgatctcatagatgtaattgagggtagtagggtatacataccctgcatctatgttgtcaacaagattgatcagattacaattgaggaactggagattctggacaaacttcctcattactgcccggttagtgctcatctggaatggaaccttgatgggctacttgagaagatttgggaatatcttaacttaactcgcatatatacgaagcccaaggggatgaatccagactatgaagaccccgtaatcctgtcatccaagactaggactgttgaggatttctgcaaccgtattcacaaagacatgcttaagcagtttaaatatgcattggtttggggatcaagcgcgaaacacaagcctcagagagtggggaaggaacacgagctagaagacgaggatgtggttcagataataaaaaaggtgtgaacgtgcgattgtgggaaatgaaagttatgttgctttataaaggtgttccagagatgggaactaatggtcattcagaacttcaaattcaagacaaagggacctgacagtaaagaagttttatcattagtaatacttctttcagttttttggtagtgtattatttgctgtactcagtatgttggaaaagtttgaatgttttaaatcagcctatatgaatgagcagagcagattcacctgattgtatgttaaaacttcaaacttagacttcattg

SEQ ID NO: 7711 - DNA, 1630 bp, Eucalyptus grandis
tttctccctgcgttctacactcttcttcttcttcttcttcttcttcgcaatcgcgcataccagggatagctcgagctccgtctccgtctgcccggtaatctcgtagcagcaatggcgaccgtgatgcagaagatcaaggacatcgaggatgagatggctaggactcaaaagaacaaggctactgcccatcatttgggtttgcttaaggctaaacttgcaaagctacggagggaactgcttgaaccttcttccaagggaggtgggggtgccggcgaaggttttgatgtcaccaaaagtggagacgctagagttggtttggtgggtttcccctcagttgggaagtctactctgttgaataagctgacagggacgttctcagaggttgcttcatatgaatttactactctgacttgtatccctggcgtgatcacttaccgtggagctaaaattcagttactagatcttcctggtattattgagggtgccaaggatggaaagggtagaggcagacaggttatcagcactgcgagaacatgcaactgcatcttgattgttcttgatgcgataaagccaattactcacaagcgtctgatagaaaaagagctcgagggatttggaatcaggctgaacaaggagccacctaatttaacatttaggaagaaagataaaggtggcattaatttcacatcaacagtggcaaatactcatctggatcttgatactgtgaaggccatctgcagcgaatatcggatacacaatgctgatattactcttagatgtgatgcgactgcagatgaccttatagatgttattgagggcagtaggaaatatattccatgcatctatgccataaacaagattgatcagatcacactagaagagctagagattttggacaaacttcctcattactgtccagtcagtgctcaccttgagtggaatcttgatggtctgttggagaaaatatgggagtatttgaatttaactcgtatatatacaaagccaaaaggaatgaatccagactatgaagaccccgtgattctatcatcaaggaagaggacagttgaggatttctgcaccaggatacacaaggatatgctcaaacagttcaagtatgccctagtctggggttcaagtgccaaacacaagcctcaaagagttggcaaggaacatgaacttgaagatgaagacgtcgttcagatcatcaagaaggtgtaactttcacagtacaggaacctatgggaaccccgaatggttgattcggtgcagagtaggagctggtgctgatctgatgtctgttgcgagctagttccattggactggaaaacagtgtaatgcgtgcaattttgagtggtcgattagttcaacttgagttagctttttacttacgtgatgtcctccccctatctattagcttgagtttgtaaattgtcgtggcaaggctgttcattcagtggttatcaatgtgatggagtctttgccattgccaattttttaggatacaagatgtgatgataatcccctggccgagggtctaaggataatgaaactggtggtacagtaccggtattggattctgaatattttttcaatatggaagtcttctaatttggtaacaaaaaaaagagga

SEQ ID NO: 7712 - DNA, 1409 bp, Panax ginseng
caggttcattttcctctagaaagctcctcttcttcttctcccgatagtcccaggatcagtttgctctaatcgaataacgtcactttatatacatcggcaacaatgtcgaccgtgatgcagaaaatcaaagatatcgaagatgagatggcaaggacccaaaagaataaagctactgcccatcaccttggcttgctgaaggctaagcttgcaaagctacgaagggagcttcttgagccttcatcaaaaggaggtggtggtgctggagatggttttgatgttacaaaaagtggagacgcaagagttgggttagtgggatttccttcagtcgggaaatcaacacttctgaataagttgaccggcactttttctgaggtggcgtcatatgagtttactaccttaacttgcatccctggtgtgatcacgtatcgaggggctaaaatccagttgttggatctccctggtatcattgagggtgctaaggatgggaagggtagaggaaggcaggtcatcagtactgctagaacatgcaactgtattctaattgttctggacgctataaagccaataactcacaaacgattgattgagaaagagcttgagggatttggcataaggttaaacaaggaaccccctaatctgaccttcaggaagaaagaaaagggtggcattaatttcacatcaacagttgccaacacacatctggaccttgaaactgtgaaagcaatatgtagtgaatacagaatacacaatgccgatgtaacccttaggtttgacgcaactgctgacgatctcatcgatgtcattgagggaagtcgggtgtatatgccttgcatttatgctgtgaacaagatagatcagataacacttgaagagctggagattctggataaacttccccattactgtccagtcagtgctcatttggaatggaatcttgatggtctgctggagaagatatgggaatatctaagtttaactcgcatctacactaagcctaagggaatgaacccagactatgaagatccggtaatcctgtcatcaaagaggagaactgttggggacttttgcaccagaatccacaaggacatgcttaaacaatttaaatatgcactagtttggggatcgagtgcaaagcataagccccagagagtgggcaaggagcatgaacttgaagacgaagatgttgttcaaatcatcaaaaaggtgtgatgttagaattcacaatgcatcttgtgcaaacgtaaatctgggagcgtagccttcttgatttactatcctttctcatgggcaacatagcacccatatgtaggtggagtagatgattgcttgatatgtggttaagctcttttgtgataatcctgcctttacagtttttcaggataatacaatatatatatatatatatatat

SEQ ID NO: 7713 - DNA, 3312 bp, Mimulus guttatus
gggcccgattagctcagtttctctttccccttcgtctccggcgtacgaagaatttgtgctcccgccgcctttacgccgtcgttttggaactcccctactctcagcaacaatggcgactgttatgcagaaaatcaaggacatcgaagatgagatggcaagaacgcagaagaacaaagcaaccgcccatcatctgggcttgctgaaggcgaaacttgcaaaacttcggagagaaattcttacaccagcatcgaagggaggtggtggtgctggagaaggctttgatgtcaccaaaagtggtgatgcaagagtcggccttgtgggttttccttcagttggaaaatccactctcttaaacaaattaactggaactttttcagaggttgcttcttatgagtttactactttaacttgcattcctggtgtgatcacatatcgaggagctaaaattcagttattggatcttcctggtattattgagggtgccaaagatggcaagggtagaggtcggcaggtcatcagtacagctcgcacatgtaactgcattctgattgttctagatgccataaaaccaatcactcacaagcgtttaatagagaaagagctcgagggatttggtataagattgaacaaggaaccaccaaatctgtctttccggaggaaagacaaaggtggaatcaatctcacctctacggttacaaacacgaatcttgacctcgaaacggtgaaggcaatttgcggcgaatatcgaatacacaatgctgacatcaatctgcgatacgatgcaacagctgatgacctcatcgatgttattgagggcagtagagtatatatgccttgcatctatgctgtcaataagattgatcagattacatttgaagaactggagattctcgataaacttccgcattattccccagtcagcgcacatttggaatggaatctcgatgggcttcttgagaaagtatgggaatatctaagtttaactcgtatttacacaaagccaaaggggatgaatcctgattatgacgatcctgtcatattgtcgtcgaagagaagaacagttgaggacttctgtaatagaatccacaaggacatgcttaaacaatataaatatgcattggtttggggctctagcgcaaaacacaaaccccagagagtgggcaaggagcacgaactggaagacgaagatgttgtgcaaatcattaaaaaggtctagtttctcaacttaaatacgtcgaattaatgcatatggtgtgattctacgagcagtgatgcttagagttctttatcgagtgtaagactttcgttcttttactaagttattattgtactcgatcgtgtaattttagtgtgatggattgaagctagttttcgaggactaacggattttgagggtcttttggtcataaattatatatctattaactagagaaaattttgttcttagctattgctatttgaggatgggcagcttttttgctttttaatgattctgcgcattatttggtataatattcgagtttataactcgatgcattaaggccttgtttgtttgtcgaaattggattaatcgtaattaatatgcaatagtattaattaagatatcactactcaaagtttgccaatccagagctatatttagatgccaaaaacaataaaatttgcaatatgcttcaattaattatcgacaaaacaagccgaaacaaacgaaactagcaatacgtctgagaaatcacataaactttttctttctatttattatcaacaaacaagcggacggtaaacgagcaaatggatatcgataaatacctaattttgaatcacatatactcgaacacgtaacattacaaagccgcatgcaccaaccaacattcaggctttggcacagcagttgaagtagctaaatatgctcctcctcacctgtacaacagatcaaaataaaaaaaaaaaatacaattattatttagggtaaattacgggcacactctgaggtaatgtcaaattacgaaaaaaatcctttatgtctgggtaattacaatcgcccccatcaactatgaatcttcttacacgtacacccttgcagtgtgaaatttagtagaatcttatagattatgttgaatattctccagtttgtactaattttaccccattcgatgctgctccacattttgaaaaaaaatctcgaccacatgttttatgtggtcgtagcacatgttactttcttcattgagacacaaattttcagcaagttaatttatagttttcagtattttccatgtggtgcagttcttttcaaaaggaccacctataatgaaacccatgccatttttcgacgactctggaccacatctccgccagcaagcagcgtatttactaacatcattgaaccaatcatgaatcgtattctgacaaaactcacagccttgtcctcaatgtaataacactcggtatttactcaaaatcttgtagtaagttatcgtcttcagtttggtcagctaaaacgaggagaatattcacacaccacatactccaattaatatcggtttctccaaaaacggttgtctcaactgccaacttattaggcccccccctatcccattttcccaactcccaaccacatgtgtgtgtgtgtgtgcgtgtgtgtgtgtgtgtgtgtgttttccttctatttaatagctaggtgcatatttcggcccttcgatcgcacacagtcgtatgtgtgttgtgtgttcgatccaacggccattacatcagatgcacaaagtgttcgatactccacactaaggtggtgtttgcaaaagcttttgaaaagtgattataagctctcccttttttgcttagctttcttggctcgtaatcaaatttcggtggtgtttgcaaaagtttttgcaaagtgattatgattttttttattttttttcgtggctcgtaatcgttttattaatatttggagcactagcttttgcttctgcttctctagaaatatgtagttttaagccataaaaagcgatactctcagaagcaccattggagctacttctccaatttaaaagcacttatgcaactaattaataaatgcatttgaaattttattcctttttttccttatccaaattccatttattaggacaatttagacatttcaccaaaataagctgcagcttaaattttattttgcaaagttgatttttaatgacattttcaaacaccccgaatttttagaaaaaaacaattatttccaacttaactcacaatcaccaacttatcaccaacttctgcttctacataagcttttgcaaacgcccccctaat

SEQ ID NO: 7714 - DNA, 1478 bp, Chenopodium quinoa
ttcgcactcttccagaactctctttcataaaatcgcccttgaagtagaaatatcaaaaacactgttcgaagaaaaactcccttaattcagcaaaaatggcgactgttatgcagaaaatcaaagatatcgaagatgagatggcaaggacccagaagaataaagctactgccaatcatcttggactgttgaaggctaaacttgctaagctacggagggatcttttgacacccacctcgaaaggaggtggtggtgctggtgaaggttttgacgtaacaaaaagtggagatgcacgagttgggttggttggctttccatcggttgggaaatcaacattacttaataagttgactgggactttctctgaggttgcttcttatgagtttactacattgacttgcattcctggagtaataatgtacagaggagctaagattcagctgttggacctaccaggtatcattgagggtgccaaggatggaaaaggtagaggaaggcaggtcatcagcactgcaaggacgtgcaattgcatattaattgttcttgatgcaataaagccaataactcacaagcgtcttatagaaaaggagcttgaaggctttggcattaggttgaacaaggaaccccccaatttaagtttccgaaagaaagaaaagggtggtattaatttgacctcgacagttgccaacacacatttggatctagatacagtgaaggcaatatgcagtgaatacaggattcacaatgctgatatcactcttagatttgatgcaactgcagacgatctcattgatgttattgagggaagtagagtttatatgccgtgcatatatgtcataaacaaaattgatcagatcactcttgaagagttggaaattctggataaacttcctcattactgcccaatcagtgctcatctagaatggaaccttgatggtttgctggagaaggtctgggagtacctgaaccttactcgtatttacacaaaaccaaagggtttgaatccagattataatgaccctgtcatcctttcatctcggaagagaaccgtggaagatttttgtgaacgaattcacaaggatatggtcaaacaattcaagaatgctcttgtctggggatctagtgtgaagcacaagccacaaagagttggcaaggaacatgaactcgaggatgaagacgtggttcaaatcatcaaaaagatctaactgagcctggcatgcataattttaaacaattgacgaccagcataattccgaagaaatttttgtgagggaaatattgtggcaaaaggtacagaggtcatgttattgatgggtacttcagttcttttctgtgatggaggatttggctagcttgtacgttgtgttttctgcagacaaagcagagtgtttcagaatgagcatgttgataggagcgttgttaaacctgatgttggtagcagatttaatgtcataggggtacggcatatgctaccagagttc

SEQ ID NO: 7715 - DNA, 1507 bp, Linum usitatissimum
tcttcagccactaaaacctccacagagttcttcttcagctcgtcgtcttccgttcagagctcgaactctctcatccgccatcgccgcaatctcgaagcaaaccggagctggttaggaaggaaataacaatcaaagcgtccaaagatggcgaccgtgatgcagaagatcaaggacatcgaagatgagatggccaagacgcagaagaataaggccacagctcatcatcttggcttgctcaaggctaagcttgcaaagctccgtagagagctgcttgaacctccatcaaagggaggtggcggtgctggggcaggttttgacgttactaaaagtggagatgctagggttggtctcgtggggtttccatccgttgggaagtccacccttctgaataagctaccgggacgttttcggaggttgcttcttatgaatttacaactttgacttgcatacctggtgttattgtgtatagaggagccaagattcagttgctagatctccctggaattattgagggtgctaaggatggaaagggtcgaggaaggcaggttattagtactgccaggacttgcaactgtatcataattgttcttgatgccataaagccaattactcataagcgtctcattgaaaaagagcttgagggattcggaatcaggctgaacaaggagccaccaaatctaacattcagaaagaaggagaagggtggaatcaattttacatcaacagttaccaacacaaatcttgatctcgaaactgtcaaggcaatatgcagtgaataccgaattcataatgctgatgtcactttgaggtatgatgcgacagccgatgatctgatcgatgtcattgaggggagtagggtgtatataccgtgcatctatgctctgaacaagattgatcagatcactctcgaagagctggagatattggacaaacttccccactactgcccagtcagtgctcacctggagtggaacttggacgggttgctggacaagatatgggagtatctcgacctgactcgtatttatacaaagccgaaaggtatgaatccagattacgaagaccccgtcattctgtcatctaaaagacgcaccgtcgaggacttctgcgaccggattcacaaggacatgtctaaacaattcaagtatgcattagtatggggatcgagcgccaaacacaaacctcaaagagtcggaaaggaacacgagctcgaggacgaagacgtggtgcagatcatcaagaaggtgtgaggatcgcatgatacagcaatttcctcagcacggccttctttttgtatcattaccaagtagaaaccgaattgagccgccttaccggcatgtggattgttgtcttgttagtagtagacagagaagtgagaatgttcgagtttcttttgaacatggtatcatccaagtcatctaggacattgttcatgagtcacatttgttggatttggaggcagaaaccggtttgggttcaggttgttcttctatgaaaatctttacta

SEQ ID NO: 7716 - DNA, 1400 bp, Podocarpus macrophillus
cgactgcaaccatggcgaccgttatgcagaaaatcaaagatattgaagatgagatggcaagaacgcaaaaaataaagctacagctcatcatttgggattgctaaaggccaaacttgccaaattacgtagggaaatccttgctcctcctacaaaaggaggagggggaggtgctggtgaaggctttgatgttactaaaagtggagatgctcgagtaggccttgttggctttccatcagttggaaagtcaacccttcttaacaaattgactggtactttttctgaggtggcatcatatgagttcaccactctaacttgcattcctggtgtaattcgctatcgaggtgcaaggattcagttgctggatcttcctggaattattgaaggtgccaaagatgggaaagggagaggaaggcaggttatcagtacttcccgaacgtgtaattgtattttaatagtacttgatgctattaagcctattactcacaaacgcctaatagaaaaggagcttgaaggttttggaataaggttgaacaaggaacctccaaatctgaccttcaggagaaaggacaagggtggaataaatttcacatctacagtggccaacacaaacctggatcttgatactgttaaggctatttgtggagaatacaggatccataatgcagatatatcgcttcgttatgatgcaactgcagatgatcttatagatgtcattgaaggtagtcgtatatatatgccttgcatttatgtcattaataagattgaccaaatcacttttgaggagttggagattctggacaagctgcctcactattgtccagtcagtgctcatttggaatggaatctggatggtctgctggataagatttgggaatatttaaacttgactcggatatatacaaaacctaaaggacttaatcctgattatgaagatcctgtcattctttcatcaaaaaagcgtaccgttgaagatttttgtactcgaattcacaaggacatgttaaagcagtttaaatatgctttggtatggggttctagtgcaaaacacaaaccacaaagggttgggaaggatcatgaactggaggatgaggatgttgtgcagatcataaagaaaatataaaagtgggtatatatcctgcatgtaaatgtgccttagcatgacaagttttggttatcacatatatatcgtttgcaagtgcggtggtgtctgttggcatttaccagtttttgctgaagatatagtgcatagacatgttttctatattggggttcatggtatcatatagcttttgaaaacttgttgaaagcatttgaaatttgtggtcacaacgtcactgattgtagaggaccttggtttgtggacacaattttctgtcttttgggtcttgttttattaatgg

SEQ ID NO: 7717 - DNA, 1758 bp, Papaver somniferum
ggggttttgggagttctgagtgtatcgaataaaggtcttgaaaacctgtttcttccaccgagcttcaacaatggcgaccgtcatgcagaaaatcaaagacattgaagatgagatggccaaaaacgcaaaagaacaaagctacttctcatcatcttggaacacttaaggctaaactggcaaagctacgacgggatctccttgcacctccatcaaaaggaggtggtggtggtgctggtgaaggctttgatgttactaaaagtggtgattctagagttggtcttgttgggttcccttcagtgggaaaatcaacccttctaaataaattaactggtacattttcagaggtagcatcctatgaatttacaaccttgacttgcattccaggtgttatcacatacagaggggcgaaaattcagttacttgatctccctgggattattgagggagcgaaagatggaaagggtagaggaagacaggttatcagtactgccaggacatgcaactgtattttaattgttcttgatgcaataaaaccaataactcacaagcgtctaattgagaaagagctggagggatttggcataagattaaacaaggaaccacctaatatgaccttcaggaggaaggaaaagggtaggaattaacttcacgtcaactgtagcaaacacacatctggaccttgagacagtgaaggccatatgtggtgaataccgaattcataatgctgatgtctcactgcggtttgatgcaactgctgatgatctcatagatgttattgagggaagtagggtatatataccatgcatctatgttgttaataaaattgatcagattacacttgaagagctggagatcctggacaaacttcctcattactgcccagtcagcgctcaccttgagtggaaccttgacggtcttcttgataagatatgggaatatcttgacctaacccgtatatacaccaaaccaaaggggatgaatccagattatgaagaccctgtaattctatcatccaagaagagaaccgtagaggatttctgcatccgtattcacaaagatatgcttaagcaattcaagtatgcgctggtttggggttcaagtgtgaagcacaagccacaaagagtgggcagggaacacgaacttgaagatgaagacgtcgttcaaattatcaaaaaggtgtgatcatttcaaagaacttggttctttggatcctaaagtgtactgatgaggacattgattagctggaaagttctgaatcatgaaaagaaaacttcctgatgagttttatacttcagtttactctgtttatccaaagtaattttgctaactcgagatctgtattttcccccgttttttttttcccgaaattccagatctttaaatgttgtcttagttgttggacatgtactgaaaaaacttctaatagcagtttaggttgggcgttctgatgtaatatttaaagctttttatgtccgtatttaccggtgacaggtggtgttgtgtatacataggtgtcttttttaacctaaattttgtgcgataggaacttcatgaataagaaaacttgcttaggaggtattgaaatctttatccatatgctgcgttttgatatatacgcaagcaggatttttgttggaagtagtgggttgtgaattctgccgtgtaaaggagaccttgagcattcaaccctggtgtcaaaccacttaaggttattatttccaaaccttattcattttgttggcaaatccattttgaaag

SEQ ID NO: 7718 - DNA, 1430 bp, Cleome spinosa
agtgtcttttctttcctctgcctctaagcggcccccgtgtgagctctttgctgctgcaacaatggcgaccgttatgcagaagataaaagaaatcgaagatgagatggcgaggacccagaagaacaaagccacggcgcatcatctgggtttgctaaaggctaaacttgcgaagttgcggagggaactccttaccccaacttccaaaggtggtgctgctgctggagaaggttttgatgttacgaaaagtggagacgctagagttggtctggttgggtttccttccgttggcaaatccacgctcctaaacaagttgacaggaacgttttctgaggttgcttcatacgagttcaccacattgacatgcattcccggtgttatcatgtaccgtggagctaaaattcagttgttagatctacccggtattattgagggtgctaaggatggaaagggtagaggacggcaggttataagtactgcgaggacgtgcaactgcatcttaatagttcttgatgccataaaaccaataactcacaagcgtctcatcgaaaaagagctcgagggatttggaataaggttgaacaaggagcctccaaatcttacattcaggaagaaagacaaaggtggtatcaatcttacttctactgtcactaccacacaccttgacctagacactgtcaaggcgatttgcagtgagtaccggatgcacaatgctgacatcacccttcggtatgatgcaactgctgatgacctcattgacgtcattgagggcagtcggatatatatgccttgtatctatgttatcaacaagatcgatcaaatcacagttgaagagctcgaaattctggacaaactgcctcactactgccctatcagtgctcatctggaatggaacctggacggtctgctggataagatatgggaatatcttaatctaactcggatttacactaaacctaagggaatgaatccagattacgatgatcccgttatcttatcttccaagaggagaaccgttgaggatttctgcacccggattcacaaggacatgcttaaacagttcaagtatgctcttgtatggggttcaagtgccaaacacaagcctcagagagttggaaaggaacacgagctcgaggacgaggatgtggttcaaatcgtcaaaaaggtatgatctttgacaaggactcgtgatgggcagtgcaaagaaatcgtctttttgctcgtatcttgagaaagtttttctcgagccggaacaaaagatccataggtgaaacctcgaaagaggattttgttacttcctatgcagagaccagagacatttgctttcgtcgttctcgttctacatttgcattgtatatccaaaaaaacctacatctcgtcatgttgtcgtttggtacagagattctctctctttttctagctttgttcatggc

SEQ ID NO: 7719 - DNA, 1554 bp, Allium cepa
ctctcaatttattttttctcctctacagaatagaaacctcgagaaacatctgagacaaaacctcaggctaatctcaaaaatggcgacggtcatgcaaaaaatcaaagatatcgaagatgagatggcaaagactcagaaaaacaaagccacggcccatcaccttggtttacttaaggctaaacttgcaaagctacgtcgagagcttttggaacctcctactaaaggtggtggtggggctggagaagggtttgatgtcactaaaagtggagattctcgaattggtttggttgggttcccttctgttggaaagtcaacactacttaacaagttaactggcacattttctgaggttgcttcatatgagtttactaccctgacatgcattccaggtgttatcatgtatagaggtgccaaacttcagttgttagatcttccagggattatcgagggtgcaaaagatggaaagggtagaggaagacaggttatcagcacagctcgaacttgcaattgtattttaattgtccttgatgcaataaaacccataacacataaacggcttattgagaaagagctggagggatttggaataaggctaaacaaagaacctccaaatctgacatttagaaagaaagaaaaaggtgggataaattttacatcaacggttacaaacacaaatttggaccttgacacggtgaaggcaatttgtggcgaatataagatacacaatgctgatgtttctcttcgatacgatgcaactgccgatgatcttattgatgtaatagagggtagtagggtctatataccatgcatctatgttgtcaacaagattgaccaaattaccctcgaagagcttgagatcctagacaaacttcctcactattgtcctatcagtgctcacctagaatggaatctggatggtttgttggagaaaatatgggagtatctgaacctaacccgtatatacacgaaaccaaaaggtttgaatccagattatgatgatccagtcatcctttcatccaagaggaggactgtagaagatttctgccttcgaatacataaagatatgcttaaacaattcaaatatgctcttgtttggggatcaagcgcaaaacacagacctcaaagagttggaaaggaacatgagcttgaggatgaagatgttgtccagatagtaaagaaagtgtaaactagagtgggtttctccataatgttgagtgatccagataactattaagaataaaattagtagtgtactttgatgagttccgtcatgtagactaacaagtttacattttttctcagcgttctgaaatagttggtattgtttttgaaattaaagctgcattagctcttttaaaattaaacttcaagcatgtataattttattcctttaaactattcttcggaaagaagatttgtatagcaaactctgggttgtgtttgttaaaacatgactgatgctaaacttgtgagttgtgcatgtatgattttaaaaacttgaatcttgttccagattcaaaccttgattgaaccatttatttatcttttggtcta

SEQ ID NO: 7720 - DNA, 1588 bp, Papaver somniferum
aaaaggtaaagggtttgggagttctgagtgtatcgaataaaggtcttgaaaacctgtttcttccaccgagcttcaacaatggcgaccgtcatgcagaaaatcaaagacattgaagatgagatggcgaaaacgcaaaagaacaaagctacttctcatcatcttggaacacttaaggctaaactggcaaagctacgacgggatctccttgcacctccatcgaaaggaggtggtggtggtgctggtgaaggctttgatgttactaaaagtggtgattctagagttggtcttgttgggttcccttcagtgggaaaatcaacccttctaaataaattaactggtacattttcagaggtagcatcctatgaatttacaaccttgacttgcattccaggtgttatcacatacagaggggcgaaaattcagttacttgatctccctgggattatcgagggagcgaaagatggaaagggtagaggaagacaggttatcagtactgccagaacatgcaactgtattttaattgttcttgatgcaataaaaccaataactcacaagcgtctaattgagaaagagctggagggatttggcataagattaaacaaggaaccacctaatatggccttcaggaggaaggaaaagggtggaattaacttcacgtcaactgtagcaaacacacatctggaccttgagacagtgaaggccatatgtggtgaatacagaattcataatgctgatgtctcactgcggtttgatgcaactgctgatgatctcatagatgtcattgagggaagtagggtatatataccatgcatttatgttgttaataagattgatcagattacactcgaagagctggagatcctggacaaactccctcattactgcccagtcagtgctcacctagagtggaaccttgacggccttcttgataagatatgggaatatcttgacctaacccgtatatacaccaaaccaaaggggatgaatccagattatgaagaccctgtaattctatcatccaagaagagaaccgtagaggatttctgcatccgaattcacaaagatatgcttaagcaattcaagtatgcgctggtttggggttcaagtgtgaagcacaagccacaaagagtaggcagggaacacgaactcgaagatgaagatgtcgtccaaattatcaaaaaggtgtgatcatttcaaagaactcggttctttggatcctaccgaagtgtatgatgaggacattgattatacggaaatatctgaatcatgaaaagaaaacttcctgatgagttttatacttcagtttactctgtttatccaaagtaattttgctaactcgaggatctgtatttttcccccgtttttttttcccgaaattccagatctttaaatgttgtcttagttgttggacatgtactgaaaaaaacttctaatagcagtttaggttgggcgttctgatgtaatatttaaagctttttatgtccgtatttaccggttacaggtggtgttctgtatacataggtgtcttttttaacctaaattttgtgcgataggaacttcatgaataagaaaacttgcttaggaaggt

SEQ ID NO: 7721 - DNA, 1650 bp, Chenopodium quinoa
attttctcggggttttttcatttcttttcgttttcgcactcttccagaactctctcttcatacaaccgcccttgaactagaaaaatcaaaaacactcctcgaagaataacttccttaactcagcaaaaatggcgactgttatgcagaaaatcaaagatatcgaagatgagatggcaaggacccagaagaataaggctactgccaatcatcttggactgttgaaggctaaacttgctaagctacggagggatcttttgacacccacctcgaaaggaggtgggggtgctggtgaaggctttgacgtaacaaaaagtggagatgcacgagttgggttggttggctttccatcggttgggaaatcaacattacttaataagttgactgggactttctctgaggttgcttcttatgagtttactacattgacttgcattcctggagtgataatgtacagaggagctaagattcagctgttggacctaccaggtatcattgagggtgccaaggatggaaaaggtagaggaaggcaggtcatcagtactgcaaggacgtgcaattgcatattaattgttcttgatgcaataaagccaataactcacaagcgtcttatagaaaaggagcttgaaggctttggcattaggttgaacaaggaaccccccaatttaagtttccgaaagaaagaaaagggtggtattaatttgacctcaacagttgccaacacacatttggatctagatacagtgaaggcaatatgcagtgaatataggattcacaatgctgatatcactcttagatttgatgcaactgcagacgatctcattgatgttattgagggaagtagagtttatatgccgtgcatatatgtcataaacaaaattgatcagatcactcttgaagagttggaaattctggataaacttcctcattactgcccaatcagtgctcatctagaatggaaccttgatggtttgctggagaaggtctgggagtacctgaaccttactcgtatatacacaaaaccaaagggtttgaatccagattataatgaccctgtcatcctttcatctcggaggagaactgtggaagatttctgtgaacgaattcacaaggatatggttaaacaattcaagaatgctcttgtctggggatctagtgtgaagcacaagcctcaaagagttggcaaggaacatgaactcgaggatgaagacgtggttcaaatcatcaaaaagatctaactgagcctgacatgcataatttaaaagaattgacaaccagcataattccggagaaatttttgttagggaatattgtggcaaaaggtacaaaggtcatgttattgatgcgtacttcagttcttttctgtgatggaggatttggctagcttgtacgttgtgttttctacagacaaagcagagtgtttcagaatgagcatgttgataggagtgttgttaaacctgatgttggtagcagatataatgtcataggggtatggcttatgctactagagttcattgaaaatatgattttactatctttacgtagcgttcctggatattgtatggggtgaaatgttttattgtattttcagtgactgcatagtctattgtattgtcaaactgaatggtatccgtatcccaggtatagattgag

SEQ ID NO: 7722 - DNA, 1516 bp, Rosmarinus officinalis
cggccgggggagggcctgtttggcaaatgttaaaacattctattttcctttgagcttcggcgaaagaaaataatttatcattccggtcacggattctcgccgcccaactccgtcgattttttagagttcatctctctcagcaacaatggcgaccgttatgcagaaaatcaaggacatcgaagatgagatggcaagaacccagaagaataaagcgactgctcatcatcttggcctgttgaaggcaaaattagcaaagcttcggagggaaattctcacaccagcctcaaagggaggtggtggtgctggagaaggttttgatgttacaaaaagtggtgattcaagagttgggctcgtgggctttccttcagttgggaaatcaacactcttaaacaaattaactggcactttttcagaggttgcttcatatgaatttactactttaacttgcattcctggtgtaatcacatatcgaggagctaaaattcagctactggatcttcctggtattattgagggtgccaaagatggaaagggtagaggtaggcaggttatcagtacagctcggacatgtaactgcatcctcattgtcctggatgcaataaaaccaattactcataaacgcctgatagagaaggagcttgagggttttggcataagattaaacaaggagccaccaaatctctctttccggaggaaagataagggtggaatcaatcttacatctacagttaccaacacaactcttgacctcgacacagtgaaggcaattgtggagaatatcggatacaaaatgctgatatcaatctccgatatgatgcaacagaagatgatctcatagatgtcattgagggcagtagggtatacatgccgtgcatctatgtcgtgaacaagattgatcagattacacttgaagagctggagattttggacaaacttccacattattgcccaatcagtgctcatttggaatggaaccttgatggccttttagagaaaatatgggagtatctcaatttgactcgcatatacacaaagcccaaggggatgaatcccgactatgatgatcctgtcatattgtcatcaaagaaaaggacagttgaggacttctgcattaggatccacaaggacatgcttaaacaatataaatatgcattggtttggggttcaagcgcgaaacacaagccccagagggtggggaaggagcatgaactggaagatgaagatgttgtgcaaatcatcaagaaggtttaacctccgaacttcatcaaatcaaattactccggatacatgtagtgagtcctccagcagagaaattatattgcatagccatagcaagtggaactggatgatagatggtgtaattttagttgtgcctcatgatagattctaagggtctttcctatcgatgggtttaccattatatactgttactataggactctgccctgagatatcatataaccagataaattttgttactactgtcttaaaacatttctattgagtgttaagcatc

SEQ ID NO: 7723 - DNA, 1102 bp, Vinca minor
tcctttcttcttttagcaattggcgactgtttatgcagaaaatcaaagattatcgaagatgagatggcaagaacccaaaaaaacaagctacagcccatcatcttggtttgctaaaggcaaagcttgcaaaacttcgacgagaactccttactccttcttcaaagggaggtggtaggtgcaggagaaggctttgatgtcacaaagagtggagatgctagagtcggtctagttggttttccttctgttggaaaatccacactgttaaataagttgactggaaccttttctgaggttgcttcctatgagtttaccacccttacttgcattcctggagtgattgtgtatcgaggagctaaaatccagttgttggatctgcctggtattattgagggtgccaaggatggaaaaggtagaggaagacaggtcatcagcactgcaaggacatgcaatgttattcttattgtcctggacgcaataaagcctattactcacaagcgtctgatagaaaaagagttggagggtttcgggataagattaaacaaagaacctccaaacttgtcattcagaaggaaagagaagggtggaatcaatcttacatcaacagttaccaacacaaatttggaccttgaaacagtgaaggccatatgtagtgaatacagaatacataatgctgacattaatctcagatatgatgcgactgctgatgaccttatagatgtaattgagggcagtagagtctatatgccttgcatatacgtcctcaataagattgatcagattacacttgaggagctggagattctggataaacttccacattattgccccatcagtgctcacctggaatggaacctcgatggtctgctggagatgatctgggaatatctgtgtctgacgcgtgtttacacgaagccaaagggaatgaatccagattatgaggaccccgttatattatcatctaagaggagaactgttgaggatttttgcgagcgaatccacaaagatatggtcaaacagtttaaatatgcactagtttggggttcaagcgcgaaacacaagcctcagagggtgggcaaggagcacgagctagaagacgaagatg

SEQ ID NO: 7724 - DNA, 1700 bp, Spinacia oleracea
tctctctccgcatacaatcgcccctgaacacagaaatcaaacactctggtacaaaaagcttccttaattcgaaaaaatggcgactgtcatgcagaaaatcaaagatatcgaagatgagatggcaaagacccaaaagaataaggctacttcacaacatcttggactgttgaaggctaaacttgcaaagttacggagggatcttttgacgcccacaacgaaaggaggtggtggggctggtgaaggttttgacgtcacaaaaagtggagatgcgcgagttgggttggttggctttccatctgttgggaaatcaacattgcttaacaagttgactgggactttctctgaggttgcttcttatgaatttactacattgacttgcattcctggagtgataatgtatagaggagccaaaattcagctgttggacctgccaggtatcatcgagggtgccaaggatggaaaaggtagaggaaggcaggtcatcagtactgcaaggacatgcaattgcatattgattgttcttgatgcaataaagccaataactcacaaacgtcttatagaaaaggagcttgaaggatttggcataaggttgaacaaggagccgcccaatttatccttccggaagaaagaaaagggtggtatcaatttgacctcaacagttactaatacacatttggatctggatacggtgaaggcagtatgcagtgaatacagaattcacaatgctgatatcactcttagatttgatgcaactgcagacgatctcattgacgttattgagggaagtagagtttatatgccgtgcatatatgtcataaacaaaattgatcagattacgcttgaagagttagaaattctggataaacttcctcattactgcccaatcagtgctcatctagaatggaaccttgatggtttgctggagaagatctgggagtacctgaaccttactcgtatatacacaaaaccgaaggggttgaatccagattataatgaccctgtcatcctttcatccaggaagagaactgtggaagatttctgtgaacggattcacaaggatatggtcaaacaatttaagaatgctctcgtctggggatcgagtgtgaagcacaagcctcaaagagttggcaaggaacatgaactcgaggatgaagacgtggttcaaattatcaaaaagatttgattgagcatcttttaaatgaaatgatgaccagcacacaatcctgtagaaaacgttatttagagaaacattttggcaaaaggtacggaggtcatgtttttgatgcaaacttcaggtctcttctgtctgtcatggaggttttggctagcatgtacgtttgtgtttcctgcgatacaaagcggagtgtttcaggatgtacgtgtagaacggttaataaacttgatgttggtatcaggtattatgtcctcaatgtaccaagagttaaaacaccatgggcgactatagttctccgtggaacgtatgatcttactatcatcaccttgttctgtttctggaacttttttgggtttggaatgttttcttggatattaattatcacttcatagccatatgtgatcaatagtgatacataactgattgcaggcacgaaaaattcgttaatgtgccacattcgatgttattcgggtcaaaagtcaatgtatggactcggtaattatttgaccgtcaattaaaattgatt

SEQ ID NO: 7725 - DNA, 1283 bp, Chrysanthemum coronarium
cgttatgcagaaaatcaaagatatcgaagatgagatggcaaagacccagaagaataaagcaaccgcacatcatttgggattgctgaaggctaagcttgcaaaattgagaagagagcttctcacacctacaacaaagggaggtggtggtgctggagaaggttttgatgttacaaaaagtggagatgcgcgggttggtcttgtgggttttccttctgttggaaaatcaacactattgaataagttaactggtaccttctcagaggttgcttcatatgagtttacaactctcacatgcattccaggtgttatcacatatcgaggagcaaagattcagttgttggatcttcctggtattattgaaggtgcaaaggatggaaagggtagaggaagacaggttatcagtactgccaggacctgcaactgtatcataattgtgctggatgcaataaagccaataacccacaaacgtctgattgaaaaagaacttgaagggtttggcattaggttaaacaaggagcccccaaatctgacattcaggaaaaaggaaaagggtggaattaattttacatcaacagttgctaatacacatctggaccttgatacggtgaaggcaatatgcagtgaatacaagatacacaatgctgatgtcacccttaggtttgatgccactgctgatgacctcatagatgttatcgaaggtagtaggatatatacaccttgcatctatgctgtcaacaaaatagatcaaatcacacttgaagagctggagatattggatagacttcctcactactgccccgttagtgctcacttggaatggaatcttgatggccttcttgagatgatctgggaatatctcagtttgactcgtatttacacaaaaccaaaagggatgaatccggactatgaggaccctgtcattctctcttcaaaaagaaaaaccgttgaggatttctgcttccggatccataaggacatgcttaagcaatttaagtatgcattggtctggggttccagtgcaaaacacaagccacaaagagtcggcaaggaacatgagcttgaagacgaagatgttgtgcagatcattaagaaagtttagaacccaataccaacaagtcttctgctctatttttgcgagtgtactatcgatggttacaccctaatgagtttgttgaagtagcgtgttaggttttaccaaatgtgatgggtggtttccttggtttagttttgtactagatggtgatgtctgtctaaagattgtggcaaagaaagcataagttgaa

SEQ ID NO: 7726 - DNA, 1657 bp, Picea glauca
ggagctgtgccaaaaccctgtacgtcttcttctcaactccttccataaaacccttaaactgctcgcatagacccgttacatacggagcttctgaactcaatcgactgtaaccatggcgactacaatgcagaaaatcaaggatattgaagatgagatggcaaaaacacagaaaaacaaggctacagcccatcatttgggtttgctaaaggccaaacttgctaaattacgacgagaaatccttgctcctcctacaaaaggaggggggggaggtgctggtgaaggctttgatgttactaaaagtggagattcccgtgttggacttgtggggtttccatcagttggaaagtcaactcttctgaacaagttgacaggtaccttctctgaggtagcatcatatgaattcaccactctaacatgtattcctggcgttattcgctatagaggtgcaaagctgcagttactagaccttccaggaatcattgaaggtgcaaaagatggcaaggggagaggaaggcaggttatcagtactgcaagaacttgcaattgtattttgatagttcttgatgctatcaagcccattactcacaagcgcattatagaaaaagagcttgaaggatttggaatcaggttgaacaaggaacctcctaatttgtcctttaggaggaaggacaagggtggaataaatttcacgtctactgtggccaacacactcctggaccttgagactgttaaggctatttgtggagaatacaggattcataatgctgatatatctcttcgctatgatgcaagtgcagatgaccttatagatgtgattgaaggtagtcgcatatatatgccttgcatttatgttgttaacaagattgaccaaataactctcgaggaattggagattttggataaattgcctcactactgcccaatcagtgcccacttggaatggaatatggatggcctattggagaagatatgggagtacttaaatttgacccggatctatacaaagcctaaggggttgaatccagactatgaagatcccgttattctttcttctaaatcacgaactgttgaagatttttgtactcgaatccacaaggatatgttgaagcaatttaaatatgcgttggtatggggttccagcgcaaaacacaaaccacaaagagttgggaaggaccatgaattggaggatgaagatgtagtgcagattataaagaagatataaacctggggagattctctgcttcatgaaaatttattgttccccttatcctgtcttaatatgtaaatgagccatagcaagggggttttaatcattgttgtgtaacataagatctggaaatgttggagatgttgacaagctctgttgggcagtcttcacttgagagattgtcacaaggactattttgtatttcaaaggtttccgcattatggaagcatagccacattgcatgcgtaaagttcgttcattgtgatgtacttgttgcagaaaccagacttgcctagattgctttaaatatgtgcttaccttaagattatacgtacatttttaaatgcgcatggctcaagcgatgacgaaaatttccattttctaagtatttttaatttttttcataaccactaggctgggtaggtcttgctccgaaaaaaaaaaaaaaaa

SEQ ID NO: 7727 - DNA, 1571 bp, Triphysaria pusilla
ttgggctctagaaccatcttttcaagggaaatttgcttttgtcccaaccccttcgttgctccttctcccttttcgacaatacccttgcaagaatttgctagctaactcctctccgccggcgacgggatttaagtgttctcgcgtctaccaacaatggcgactgttatgcaaaagattaaggacatcgaagatgagatggcaagaacccagaaaaacaaagcgacggcccatcatctcggcttgctgaaggcgaaacttgcaaaacttcgaagggaaattcttacaccagcatctaagggaggtggtggtgctggggaagggtttgatgttacaaaaagcggtgactcaagagttggccttgtcggattcccttcagttgggaaatcaacactcctaaacaaattaactggaactttttctgaggttgcttcatatgaatttactactctaacttgcattcctggcgtgataacatatagaggcgctaaaattcagttacttgatcttcctggaattattgagggtgccaaagatggcaaaggtagaggtagacaggttatcagtacagctcggacatgtaactgcatcttgattgttctggatgcgataaaaccaatcactcataaacgtctaatagagaaagagctcgagggttttggtataagattaaacaaagagccaccaaatctgacgttccggaggaaagaaaagggaggactcaatcttacatctacggtggccaacacacaccttgaccttgatactgtgaaggcaatttgtggtgaatatcggatacacaacgctgatatcagtcttaggtatgatgcaacagccgatgaccttatagatgtcatcgagggcagtagggtatacataccttgcatctacgtcgtcaataaagttgatcagattactctcgaagagcttgaaattttggacaaacttccacattattgcccaatcagtgcgcatctggaatggaaccttgatggtcttttggaaaaagtatgggaatatctcgatctaactcgtatatacacaaagcccaaggggatgaatccagactatgatgatcctgttatattgtcatcaaagacaaggagtgttgaggacttctgtactagaatccacaaggacatgctaaaacaatttaaatatgcattggtgtggggttcgagcgtgaaacacaaaccccagagggtcggccgggaacacgaacttgaagacgaagatgttgtccaaatcatcaagaaggtataatccccagacgaaattactacatggctgttagaaatgcacaacacagttgttttatggtgatacacatttttatttccttcttcctttttggtcttaaatggtgcgatttggaatttctatgtgtgtgcaaattttgctttatctactattcagaagagatagttatattggtttgtttgactcttacaattaaaaagaacttaaaacagctttttgatagattctcagttaattatcaacgaatcaatttgcacaagaatttgcaaacacctcattgaaggtactgctttaatgaaagctttataattacc

SEQ ID NO: 7728 - DNA, 1551 bp, Citrullus lanatus
atcgcgcagttgcttttggtgcacctacacaatcctctgaacgcggaagaactctcgtttgacgttactctgcaaaatttctctctgaactgcaacaatggcgactgttatgcagaaaattaaggatatcgaagatgagatggcaaggactcagaagaacaaagctactgctcatcacttgggcttgctcaaggctaagcttgcaaagttacggagggaactcatatcacctgcatcaaaaggaggtggtggtgctggtgaaggtttcgatgtcaccaaaagtggtgatgcaagagttggtttggttggtttcccttctgttggaaaatctaccttactcaataaattgactggtactttttcagaggttgcttcatatgaattcactactctaacttgcataccaggtgtaatcgggtacagaggagctaaaattcagttacttgatctccctggtattattgagggtgccaaggacggaaagggaagaggaaggcaggttatcagcacagccaggacatgcaattgcattataattgttcttgatgcaataaagcctataacacacaaacgtctaatagagaaagagcttgagggatttggcatcaggttgaacaaggagcctccaaatctgtcattcaggaagaaagacaagggtgggataaatttaacttcaactgtaactactacccatctggaccttgacacagtgaaggctatctgtagcgagtacagaattcataatgctgatatcactcttaaatacgatgctactgctgatgatctcatagatgtgattgagggtagtagaatatacatgccttgtatctatgctgttaacaaaatcgatcagattaccttagaggagctggagattctggacagacttcctcactactgcccagtcagtgctcatcttgagtggaaccttgatggtttactggacaaggtatgggagtaccttgatttaactcgtatctacacgaagcccaaaggaatgaatccagattatgaagatcccgtaattctatcatctaagaggaggactgtcgaggacttttgcagccgtatccacaaagacatgctaaagcaatttaagtatgctttggtttggggatcaagcgtcaagcacaagccccaacgagtgggaaaggaacacgagcttgaagatgaagatgttgttcagatcattaaaaaggtgtgatcctgggaatgtttgtagcttttccaactaatcggatatccatagatgcgaataccttcatgatcatgagtttagctttcggtgacgacatgtcacatcctatgctttttgttaggctacacagtgctttcttggtactactagcatcagtcggaacattgaacaatacgtagtaggaagtgagcttgatatgtaattgtgccattttgtagtcaagctaagatcggttatgttcctgttttgttcatcagattgcaactgtttgagtgttcaactgaatgttgttagattgaacatcactgtgcaagtataagtaagttgtgtaacgccaagtctttgtattttgc

SEQ ID NO: 7729 - DNA, 1647 bp, Amaranthus tuberculatus
ggtctctggaaccttccaccatttgcagccttgagtagctcgccgacctgccgaacattcaaactttttcattgttccagtcgcgagatcagtttccgtttgatcatcctttatattctttgactaagagcttccccaatcgcaaaacccccccccccccccccccccccccccccccccccccccccccccccccccccccccccccccccctggcgactgtgatgcagaaaatcaaagatattgaagatgagatggcaaggactcagaaaaacaaagctactgcacatcaccttggactgcttaaggctaaacttgcaaagttacggagggaactgttgacgcccacatcaaaaggaggtggtcctgttggtgaaggttttgatgtcacaaaaagtggagatgctcgagttgggttagttggctttccatctgttggaaaatcgacactgcttaataagttgactgggactttttctgaggttgcttcttatgaatttactaccttgacttgcattcctggagtaataatgtatagaggagcaaaaattcagttgcttgacttaccaggtatcattgagggtgccaaggatggcaaaggtagaggaaggcaggtcatcagtaccgcaaggacttgtaattgtattttaattgttttagacgcaataaagccaataactcacaagcgtctcatagaaaaagagctcgaaggctttgggataaggttgaacaaggaaccgcccaatttaaccttccggaagaaagaaaagggtggcattaatttgacctctacagttacaaacacacatttggatctggagactgtgaaggcaatatgtagtgaatacagaattcacaacgctgatatcacgcttcgttatgacgcaactgccgatgatctcattgatgttattgagggaagtagggtttatatgccatgcttatatgtcataaacaaaattgatcagattacccttgaagagttggagattctggatagacttcctcattattgcccaatcagtgctcatctggaatggaaccttgatggcttgctggagaagatctgggagtacctaaatcttactcgtatttatacaaaacccaagggaatgaatccagattataatgatcctgtcatcctttcctccagaaagagaactgtagaagatttctgtgatcgaattcacaaggatatggtgaaacaatttaagaatgctctagtttggggatcaagtgtgaagcacaagccgcaaaaagttggcaaggaacacgaacttgaggatgaagatgtcgttcaaatcatcaaaaagatctgattgaggctgtggcattcatattttgactcgagttcgttagagacactggctaagttatagaggtcatgtttttaatgcaaacgtcgggactgttttgtgatgaaggctttggctatggctaccatgtcatttgatgtttctagtattgcaatgtggattgtttaaagatgttttagatgtacatgtagaaaagcgattacaccaacttgttggctatggattggatatgttcacgataaataatgcggtttcattaaaaagggaaaagtaaaatctattatgcaagggcataatttcactaaatccttgtcacttaaacatcactgta

SEQ ID NO: 7730 - DNA, 1702 bp, Taxus baccata
gttattttactttttcgtcgatggttgcccctgttaggtacaacactcgaacaatagaatctgtcattttctctaaacccttgcgtgccacggccataaagtcctaagcttggtaactcactcaactgcaacaatggcgactgtaatgatgaaaattaaagacatcgaagatgagatggcaagaactcaaaaaaataaagccacagcccatcacttgggattgctaaaggccaaacttgctaaattgcgacgagaaattcttgctcctcctacgaaaggagggggaggtgctggtgaaggctttgatgttactaaaagcggagatgctcgagttggccttgtgggatttccatcagttggaaagtcaactcttcttaacaagttgactggtacattttctgaggtggcatcatatgagttcaccactctaacatgcattcctggtgtcattcggtatcgaggtgcaaggattcagttactggatcttccaggtattattgaaggtgcaaaagatggaaaagggagaggaaggcaggtgatcagtactgcccgaacatgcaattgcatcttaatagtacttgatgctattaagccaattactcacaaacgcctgatagaaaaagagcttgaaggttttgggataaggctgaacaaagaacctcctaatctgacatttaggaagaaggacaagggtggaataaattttacatctactgcagcgaacacaaaccttgaccttgaaactgttaaggccatttgtggagaatacaggattcataacgctgatatatctcttcgttatgatgctactgcagacgatcttatagatgtgattgaaggtagtcgtatatatatgccttgcatttatgtcattaataaggttgaccaaatcagccttgaggagttggagatcttggacaggctgccgcactattgtccagtcagtgctcacttggaatggaatttggatggcctgctggagaaagtgtgggaatatttggatttgactcgaatatatacaaagcctaaggggcttaatcctgattatgaagatccagtcattctttcatcaaaaaggcggactgttgaagacttctgcacccgaattcataaggatatgttaaagcagtttaagtatgctttggtatggggttccagtgcgaagcacaaaccacaaagagttgggaaggatcacgaattggaggatgaagatgtagtgcagatcataaagaaaatataaaagtgggcatattttctgctttgcaattgtaaatttgccaaggaaaggagttttagctctcacgtatacatgatctggaagtgctgccgatgttcattagtattgatagtcagattttactggagattcttccattgagcatcttcatggattacaagtatttaaaagttatagaaggagaatggcaccacaaatatttatctcagataaatatgctatcatattagcagtttatgacattgtatggcatttagaagtgttcttcgattcatttgataattgtggtcacatggcccttgattggaaggggtctgcaaaaatgtgtgcgcctctgatttgtctgtgaaaagtctcgtggtctccacttgtttttttaggcgcatgttttcttttactctatctaaatgtttctgtatggtgttagatttggagcacaatgtagacatttcatgaacgtaattg

SEQ ID NO: 7731 - DNA, 1541 bp, Artemisia annua
gaccctcattcaaaatagggtttggtctagaaccctcgtttgtttacacatacagcttcagttgtacacgcatatacccgcatctatctatctatcaaaatctatttcaaacaaaatcatcttcgaatcagagctgatcaacaatggcgaccgttatgcagaaaatcaaagatatcgaagatgagatggcaaagacccaaaagaataaagcaactgcacatcacttgggattgctgaaggctaagcttgcaaaactgagaagagagcttctcacacctacaacaaagggaggtggtggtgctggggaaggttttgatgttacaaaaagtggagatgcgagggttggtcttgtggggtttccttctgttggaaaatcaacactactgaataagttaactggtactttttcagaggttgcttcatacgagtttaccactctcacatgcattccaggtgttatcacatatcgaggagcaaagattcagttgttggatcttcctggtattattgaaggtgcaaaggatggaaagggtagaggaagacaggttatcagtactgccaggacatgcaactgtattataattgtgctggatgcaataaagccaataactcacaaacgtctgattgaaaaagagctcgaagggtttggcattaggttaaacaaggagccaccaaatctgacattcaggaaaaaggagaagggtggaattaattttacatcaacagttgctaatacacatctggaccttgatacggtgaaggcaatatgcagtgaatataaaatacataatgctgatgtcacccttaggttcgatgccactgccgatgacctcatagatgttatcgaaggtagtaggatctatacaccttgcatctatgctgtcaacaaaatagatcagatcacacttgaagagctagagatattggatagacttcctcactactgccccgttagtgctcacttggaatggaatctcgatggccttcttgagatgatatgggaatatctcaatttgacccgtatttaaaagggatgaatccggactatgaggaccctgtaattctttcatccaaaagaaaaactgttgaggatttctgcttccgaatccataaggacatgcttaagcaatttaagtatgcattggtctggggttccagtgcaaaacacaagccacaaagagtcggcaaggaacatgagcttgaagatgaagatgttgtgcagatcattaagaaggtttagaacccaataccaacaagtcttctgctctatttttgcgagtgtactatcgatggtaccatcctaatgaattcggtgaagtagcatgttaggttttaccaaatgtgatgggtggtttccttggtttagttttgtactagatggtgatatctgtctaaaagattgtggcaaagaaagcataagttaaacattatgtttgtggtcatggcagtattttggtttttactcttgtctttctactatgtgaactaaactttcaggtaatgtttgtggtacagtatggagtatacaagtgattgaatgt

SEQ ID NO: 7732 - DNA, 1599 bp, Panax ginseng
ttttaatacaaaatcttaaacagaactcgctggttcattttcctctagaaagacctcttcttcttctccctatagtcccaggttcagtttgctctaatcgaataccgtcactttatatacatccgcaacaatgtcgaccgtgatgcagaaaatcaaagatatcgaagatgagatggcaaggacccaaaagaataaagctactgcccatcaccttggcttgctgaaggctaagcttgcaaagctacgaagggagcttcttgagccttcatcaaaaggaggtggtggtgctggagatggttttgatgttacaaaaagtggagatgcaagagttgggttagtgggatttccttcagtcgggaaatctacacttctgaataagttgaccggcactttctctgaggtggcgtcatatgagtttactaccttaacttgcatcccgggtgtgataacgtaccgaggggctaaaatccagttgttggatctccctggtatcattgagggtgctaaggatgggaagggtagaggaaggcaggtcatcagtactgctagaacatgcaactgtattctaattgttctggacgctataaagccaataactcacaaacgattgattgagaaagagctcgagggatttggaataaggttaaacaaggaaccccctaatctgacattcaggaagaaagaaaagggtggcattaatttcacatcaacagttgccaacacacatctggaccttgaaactgtgaaagcaatatgtagtgaatacagaatacacaatgccgatttaacccttaggtttgacgcaactgctgacgatctcatagatgtcattgagggaagtcgggtgtatatgccttgcatttatgctgtgaacaagatagatcagataacacttgaagagctggagattctggataaacttccccattactgcccagtcagtgctcatttggaatggaatcttgatggtctgctggagaagatatgggaatatctaagtttaactcgcatctacacaaagcctaagggaatgaacccagactatgaagacccggtaatcctgtcatcaaagaggagaactgttggggtacttttgcaccagaatccacaaggacatgcttaaacaatttaaatatgcactagttggggatcgagtgcaaagcataagccccagagagtgggcaaggagcatgaacttgaagacgaagatgttgttcaaatcatcaaaaaggtgtgatgttagaattcacaatgcatcttgtgcaaacgtaaatctagggagcgtagccttcttgatttactatcctttctcatgggcaacatagcacccatatgtaggtggagtaatgattgcttgatatgtggttaagctcttttgtgataatcctgcctttacagtttttcatatatatatatatatatatatatatatatatatatatatactcttatagtagagtaataaaagttaagttaagtagttaatagttacgacaacgaccaagaacagagagaagacgtagtactgttagtttctctagttgtttagtttacgttaggtccgtagtcaatacaactaacaacgtatgttgcgtgcgc

SEQ ID NO: 7733 - DNA, 1676 bp, Pinus pinaster
atgccgactgtctcgaaagacctcaccaattctacaagctcgtttcattaaatctataaactcatttcattatttctgctatagcgctcgccaaaaccttgtacagtttcttctcgattccttccgtaaaacccttaaacaactcgcatagatcgttacagacggagcttctgaactgaatcaaccgtaaccatggcgactacattgcagaaaatcaaggatattgaagatgagatggcaaaaacacagaaaaacaaggctacagctcatcatttgggtttgctaaaggccaagcttgctaaattacgacgagaaattcttgctcctcctacgaaaggagggggaggtgctggtgaaggctttgatgttactaaaagtggagattcccgtgttggacttgtggggtttccatcagttggaaagtctactcttctgaacaagttgacaggtactttctctgaggtggcatcatatgaattcaccactctaacatgcattcctggtgttattcgttatagaggtgcgaagctgcagttactagaccttccaggaatcattgaaggtgcaaaagatggcaaggggagaggaaggcaggttatcagtactgcaagaacttgcaattgtattttgatagttcttgatgctatcaaacccattactcacaagcgcattatagaaaaagagcttgaaggatttggaatcaggttgaacaaggaacctcctaatttgacatttaggaagaaggacaagggtggaataaatttcacatctactgtgtccaacacactcctggaccttgagactgttaaggcgatttgtggagaatacaagattcataatgctgatatttctcttcgctatgatgcaactgcagatgaccttatagatgtgattgaaggtagtcgcatatatatgccttgcatatatgttgttaacaagattgaccagataactctcgaggaattggagattttggataaattgcctcactactgcccagtcagtgcccacctggaatggaatttggatggcctattggagaagatatgggagtacttaaatttgacccgaatatatacaaagcccaagggattgaatccggactatgaagatcctgttattctttcatctaaatcacgaactgttgaagatttttgtactcgaatccacaaggatatgttgaagcaatttaaatatgcattggtatggggttctagcgcaaaacacaaacctcagagggttgggaaggatcatgaattagaggatgaggatgtagtgcagattataaagaagatataaacatggggtattctctgcttcatgaaaatttattgtttcccttttcgtgtcttaatatgtaaatgagccatagcaagggggttttgattattgttgtgtaacataagatctggaaatgttggagatgttgacaggctttgttgggcagtcttcagttgagagactgtcacaaggactactttgtatttcaaaggtttctgcattatatagcatagccacattgcatgtatgcaaagtttgttcattgtgatgtattggttatgttgtcgcagaaaactgacttacctagattgctttaaatgtgtttgctttaagattatacattaccagacttacctagattgctttaacaatgtgcttgccttaggattatacat

SEQ ID NO: 7734 - DNA, 1601 bp, Pinus taeda
ctcaccaaatctacaatctcctttcattaatctataaactcatttcattatttctgctatagcgctcgtcaaaaccctgtacattttcttttcaattccttgcgtaaaacccttaaacaactcgcatagatcgttacagacggagcttctgaactgaatcaaccgtaaccatggcgactacattgcagaaaatcaaggatattgaagatgagatggcaaaaacacagaaaaacaaggctacagctcatcatttgggtttgctaaaggccaagcttgctaaattacgacgagaaattcttgctcctcctacgaaaggagggggaggtgctggtgaaggctttgatgttactaaaagtggagattcccgtgttgggcttgtggggtttccatcagtcggaaagtctactcttctgaacaagttgacaggtactttctctgaggtggcatcatatgaattcaccactctaacatgcattcctggtgttattcgttatagaggtgcaaagctgcagttactagaccttccaggaatcattgaaggtgcaaaagatggcaaggggagaggaaggcaggttatcagtactgcaagaacttgcaattgtattttgatagttcttgatgctatcaaacccattactcacaagcgcattatagaaaaagagcttgaaggatttggaatcaggttgaacaaggaacctcctaatttgacatttaggaagaaggacaagggtggaataaatttcacatctactgtggccaacacactcctggaccttgagactgttaaggcaatttgtggagaatacaagattcataatgctgatatttctcttcgctatgatgcaactgctgatgaccttatagatgtgattgaaggtagtcgcatatatatgccttgcatatatgttgttaacaagattgaccagataactctcgaggaattggagattttggataaattgcctcactactgcccagtcagtgcccacctggaatggaatttggatggcctattggagaagatatgggagtacttaaatttgacccgaatatatacaaagcccaagggattgaatccggactatgaagatcctgttattctttcatctaaatcacgaactgttgaagatttttgtactcgaatccacaaggatatgttgaagcaatttaaatatgcattggtatggggttctagcgcaaaacacaaacctcaaagggttgggaaggatcatgaattagaggatgaggatgtagtgcagattataaagaagatataaacataggggggttctctgcttcatgaaaatttattgttccccttttcgggtcttaatatgtaaatgagccatagcaagggggttttaatcattgttgtgtaacataagatctggaaatgttggagatgttgacaggctttgttgggcagtcttcagttgagagactgtcacaaggactacttcgtatttcaaaggtttctgcattatataagcatagccacattgtatgtgtgcaaagtttgttcattgtgatgtattggtttatgttgtcgcagaaaactgacttacctagattgctttaaatatgtgtttgctttaagatta

SEQ ID NO: 7735 - DNA, 1552 bp, Cucurbita pepo
ggaatcgcgcagtagctgtgggggcacgtacagaatcctctgaacgcggaagaattcttgttcgacattcgtctacacaaatttctctctgaactgcgacaatggcgactgttatgcagaaaattaaggatatcgaagatgagatggcaaagactcaaaagaacaaagctactgctcatcacctgggcttgctcaaggctaaacttgcaaagttaaggagggaactcattgcacctgcatcaaaaggaggtggtggtgctggtgaaggtttcgatgtcaccaaaagtggtgatgcaagagttggtttggtggtttccttcggttggaaaatctaccttactcaataaattgactggtactttttcagaggttgcttcatatgaattcactactctaacttgcatccctggtgtaatcgggtatagaggagctaaaattcagttgcttgatctccctggtattattgagggtgctaaggacggaaagggaagaggaagacaggttatcagcacagccaggacatgcaattgcattataattgttctggatgcaataaagcctatcacgcacaaacgtttaatagagaaagaactagagggatttggcatcaggttgaacaaggaggctcctaatctgtcgttcaggaggaaagacaagggtgggataaatttaacttcaactgtaactaccacccatctggaccttgacacggtgaaggctatctgtagtgagtacagaatccataatgctgatatcactcttaaatacgatgcaactgctgatgatctcatagacgtgattgagggtagtagaatatacatgccttgtatctatgctgttaacaaaatcgatcagattaccctagaggagctggagattctggatagacttccacactattgcccagtcagtgcacatcttgaatggaatcttgatggtttactggataaagtatgggagtatcttgatttaactcgcatctacacgaaacccaaaggaatgaatccagattatgatgatcccgtaattctatcttctaagaaaaggactgtcgaggatttttgcagccgtatccacaaagatatgctgaagcaatttaagtatgctttggtttggggatcaagcgtcaagcacaagccccaacgagtgggaaaggaacatgagcttgaagatgaagatgttgttcagatcattaaaaaggtgtgatccttgaagtcaatggtttgtcactattccaacttatcggtaatcctttgatgtcaatgcctttacgatctcgagtttagctttcagtcatgacatgtcccatccaaagctttttgttaggctacacagtgctttgttgatattaccaccatcagttggagcactgaacaactagtagtaggaactgaacttgatgtgtgattgtgccattttgtagtcatgctaagaacggttgttttcctatttcgttcaacagatttatactgtttttgagtgttcaactgaatgttgttcgactgaacatcactgtacaagtaagagtaaattatgtatggccgtcttggta

SEQ ID NO: 7736 - DNA, 1508 bp, Pseudotsuga menziesii
cctcaaaacagctcgcatagaccattacatacggatcttctgagctccttcgataaaaccctcaaaacagctcgcatagaccattacatacggatcttctgaattcaattatctgtaaccatggcgacaacaatgcagaaaatcaaagatatcgaagatgagatggcaaaaacacagaaaaacaaggctacagcccatcatctgggtttgctaaaggccaaacttgccaaattacgacgagaaatccttgctcctcctacgaaaggaggcggggaggtgctggtgaaggctttgatgttactaaaagtggagattcccgtgttggacttgtggggttcccatcagttggcaagtcaactcttctgaacaagttgacaggtaccttctctgaggtggcatcatatgaattcaccactctaacatgcattcctggtgttattcgctatagaggtgcaaagctgcagttactagaccttccaggaatcattgaaggtgcaaaagatggcaaggggagaggaaggcaggttatcagtactgctagaacttgcaattgtattttgatagttcttgatgccatcaagcccattactcacaagcggattatagaaaaagagcttgaaggatttggaatcaggttgaacaaggaacctcctaatatgtcatttaggaagaaggacaagggtggaataaatttcacgtctactgtggccaacacgcttctggacctcgagactgtgaaggctatttgtggagaatacaggattcataatgctgatatatctctccgctatgatgcaactgcagatgaccttatagatgtgatagaaggcagtcgcatatatatgccttgcatttatgtcgttaacaagattgaccaaataactcttgaggaattggagattttggataaactgcctcactactgcccagtcagtgcccacttggaatggaatttggatggcctgttggagaagatatgggagtacttaaatttaactcgaatctatacaaagcctaaagggttgaatccagactatgaagatcctgtgattctttcgtctaaatcacgaaccgttgaagatttttgtattcgaattcacaaagatatgttgaagcaatttaaatatgcgttggtatggggttccagcgcaaaacacaaaccacaaagagttgggaaggaccatgaattagaggatgaagatgtagtacagattataaagaagatatagacatggggagattctctgcttcatgaaaatttatcgttcctcttttcctgtcttaatatgtaaatgagccatggcaagggggttttagcttttaattattgttgtgtaacataagatctggaaatgttggagatattgagaagctctgttgggcactcttcacttgagagattgtcacaaggactactgactttttatttcaaaggtttctgcattatggaagcatagccacattgcatgtggtaatatgcctaggttcataagttatgtgcttgccgc

SEQ ID NO: 7737 - DNA, 1507 bp, Zostera marina
cagaagtcgtgccggatccccagtataaattgcttcctattctcttcccagggtctcattttctcccatctgtcgtgccggatcactcacaagccacccacagaagtcggctgaagatcgtacgattccgaaacaagaaaagtgttaacgatgtcgaccgtgatgcagaagatcaaggacatcgaagatgagatggccaagactcagaagaataaagcaacagcacatcatcttggattacttaaggcaaaacttgctaagctccgaagagagcttcttgaacctacaaccaaaggaggtggtggcgctggtgaaggttttgatgtcactaagagtggagatgcacgggttggtcttgttggatttccttcagttggaaaatccacattactaaataaattgaccggtacattttccgaggttgcttcatacgagtttactactttgacgtgcattcctggggttattacatatagaggtgctagaattcagttattagatttaccaggaattatcgaaggtgcaaaagatggaaagggtaggggtcggcaggtaattagtactgctaggacatgcaattgcattttgattgttcttgatgcgattaaaccaatcactcacaaacgattaattgagaaagagcttgaggggtttggaataaggttgaacaaggaacctcctaatatgacttttaggaagaaagaaaaggaggaattaatttcacttccacagtggccaataccaatttggatcttgataccgtgaaggctatctgcagtgaatataagatacacaatgctgatgtatccctcagatttgacgcaacagcagatgatctgattgatgtgatagagggtagtagaaaatatattccttgtatctatgctgtcaacaagatcgatcaaatatcacttgaagaattggaaatacttgataagcttcctcactactctccagtaagtgctcacctggaatggaatcttgatggtctgctggataaaatttgggagtatcttaaccttacacgcatatacactaaacctaaaggattgaatcctgattacgaagaccctgtgattctctcctccaggaggaaaacagtagaagatttttgctgtagaatccacaaagacatgctaaagcagttcaaatatgccttagtctggggttcaagcgcaaagcacaagccacaaagggttggcaaggaacatgagcttgaggatgaagacgtggttcagattataaagaaagtttagttatatgtcgtaaattatttacaccttttttgacatcagtgaaaatttgttccatcttagataaaaggtatgcttttgttctacgtggtttcccctgcttgcctatttatattttatagcctaaatagttaatcctttttgcgaacttagtgaatttagtcatgttgattgactatttgctgtaaacttgtatttgcatggctgaatgaactgggtaaaaaactcggctcagtgtaccgaacatcgatatt

SEQ ID NO: 7738 - DNA, 1652 bp, Daucus carota
aaaacccatcttaaaaccagcgttgtttctcttctccacagctgctcatccttcttcttcgtcttgaatcaacaccaacaaaggtctgttaggttaccgtacaaccagcaaccatgtcgacggtcatgcagaaaatcaaagatatcgaagatgagatggcacggacccagaagaataaagctactgcccaccatttaggtttgctgaaggctaaacttgcaaagctacgacgggagcttcttgagccttcaactaaaggaggtggtggtgcaggtgaagggtttgatgttaccaaaagtggagatgcgagggttggtttagtgggttttccgtcagtagggaaatcaacgcttttaaacaagttgaccggaactttctcagaggttgcgtcgtatgagtttaccaccttaacctgcattccaggtgtgataacatatcgaggggctaaaatccagttgttggatctccctggtatcattgagggtgcgaaggatggtaagggtagaggaagacaggttatcagtacagccagaacgtgcaattgtattttaattgtcctggatgcaataaagccaataactcacaaacgtttgattgagaaagaacttgagggatttggcattaggttgaacaaggaaccccctaacctgacatttagaaaaaagaaaagggtggcataaacttcacatctacagtacccaatacacatctggacctcgacactgtgaaagcaatttgcagcgaatacaaaatacacaatgctgatcttaccctgaggaatgatgcaactgctgacgatctcattgacgtcattgaagggagtcgggtgtatatgccctgcatatatgctgtcaacaagatagatcagataacacttgaagagctagaaattctcgatagacttcctcactactgtcctgtcagtgctcacttggaatggaatcttgatggcttgctggacatggtttgggagtatctatgtttaactcgcatatacaccaagccaaaagggatgaatccagattacgaggaccctgtaatcttgtcatcaaagagaagaacagtcggggacttctgcaccagaatccacaaggacatgcttaaacaatttaagtatgcattggtttggggatcaagcgcaaagcacaaaccacaaagagtgggcaaggagcatgaacttgaagacgaagatgttgtgcaaattataaaaaaggtgtgaggttacaattcagaacgcatgttctgaagtgtattaaaactcgtagagtgctgggttggtttactgcgttctctgtcctggacatggcacccagctagtattagttttggtaatgatggcttgatgttgttaagcagcttgttccagctttttgtcccaaagtagtattacaaattaaaagaagcaaagcatgtttaagctctgttattctagtatgtgtcaagagcctgtcttgtgaaccaaatgtctggagggatgttgggtgttatatcacaagaaatgtgtgagctatttgttaaacactttacaacttgagtttattggatgttgaacttttaattttatcagcaatttacattggctatgcacaaatttaagactgatcttgaaggtaattcagtcaaatttaaatgatcttgcaagtgtactaggt

SEQ ID NO: 7739 - DNA, 2059 bp, Petroselinum crispum
cagagctgctcttcttcttcttcctcttcaatcaacactacagaacacagctggttaggtttccacacaatcagtaaccatgtcgaccgttatgcagaaaatcaaagatatcgaagatgagatggcaagaacgcagaagaacaaagctactgcccatcatttaggcttgctgaaggctaaacttgcaaagctacgacgggagcttcttgagccttcaactaaaggaggtggtggtgccggggaaggttttgatgtaaccaaaagcggagatgcgagggttgggttagtgggttttccgtccgtcgggaaatcaacacttttaaacaagttgaccggcactttctcagaggttgcatcatatgagtttaccaccttaacttgtattccaggtgtgataacgtatcgaggggctaaaattcagttgttggatcttcctggtattattgagggtgccaaggatggaaagggtagaggaagacaggttatcagtacagcaagaacatgcaactgtattataattgtcctggatgcaatcaagccaataactcacaaacgtttgattgagaaagaactcgagggatttggcataaggttgaacaaggaaccccctaacctgacatttagaaaaaagaaaagggtggcataaacttcacatctacagtacccaacacacatctggacctcgacactgtgaaagcaatttgcagtgaatataaaatacacaatgctgatcttacccttaggtatgatgcaactgctgacgatctcatagatgtcattgaaggtagtagggtgtatatgccctgcgtttatgctgtcaacaagatagatcagataacacttgaagagctggaaattctagatagacttcctcattactgtcctgtcagtgctcatttggagtggaatcttgatggtttgctggacatggtgtgggagtatctatgtttaactcgcatatacacaaagccgaaggggatgaatccagactatgaggatccagtaatcttgtcatcaaagagaagaactgtcggggacttctgcacaagaatccacaaggacatgcttaaacaatttaaatatgcattggtttggggatcaagtgcaaagcacaaaccacaaagagtgggcaaggagcatgaacttgaagacgaagatgttgtgcaaattataaagaaggtgtgatgtcacaatccagaactcatgttgcgaagtgtattaaactccgagagtgttggcttggattactctccactgtaatagacatggtaccaatatgtagctagtattagatttagtatatgatggcttgatgttgtcaagcagcttgttctagctttttgtcccccatggcattacagaaagagagatgcaaagcacgatttagctctgttattacattatgtgtcgagagcctgtcttctgaatcaaacatcctgaggatatcgggtttgttatataacaagaaatgtgtgagatgctttgttaaatgcttgacacttaagtttattgaatcttatcttctgttttgttagcaaattgcactgaccatgcatgaatttcagcttgacctcgacaatacttcaggtaaatttaaatgatggtgttcaatactgtgggatggggggggggggggggggggggggggggggggaattgagcataatacttctagtttcgacattctagttggaagtttttgaaaaacggagtgtctaaataactagtttttcttcaattggtacaactcggaataacaaaaaagttgggtgctgatttttgagaaggaatgcaagtttttctagttggactagcagtcctacaaaaagcatctggtagtcagtctttagtgaaggcaatatagtggtagtgttttcgtgattgaataaataaattggttgccgatttttatatcctattttgatgtattctttgtccatttcacattttttgtaaccagcttaataggagcaaatagtgctgtgctaaactttgatggaatgcatcattttaaattgtcaagtgacttttcagtcagaaagcaatatgcaacttctca

SEQ ID NO: 7740 - DNA, 1401 bp, Silene vulgaris
cggtttaatttttcgggcacatctatttccccaaattcccttgaaacttccagaattctccgatcaattgccctaattcactaaaattaatcaatcaccttcgaaagctaaaactagagcaaaatgtcgaccgttatgcagaaaatcaaagatatcgaagatgagatggctaagacccagaaaaacaaagctactgcccatcatcttggtctattaaaggctaaacttgcaaagctacggagggagcttttgacacccactacaaaggggggtgctggtgctggtgaaggttttgatgttacaaaaagtggtgatgcccgagtcggattggttggctttccatctgtggggaaatcaaccctgctaaataagctgactggcaccttctctgaggttgcttcatatgaattcactaccttgacttgcattcctggggttataatgtatcgaggagcaaaaattcagctgctggacttgccaggtatcattgagggtgcaaaggatggtaaaggtagaggaagacaggttatcagcactgcacgaacttgcaactgcattttaattgttcttgatgcaataaaaccaattactcacaagcgtctgattgaaaaagagctggaaggatttggcattcggctgaataaggaacctccaaatttaaccttcgccggaaagaaaagggtggtattaatttcacatcgaccgtgcctaatactcatctagatctggaaacagtgaaggcaatttgtagcgaatacagaattcacaacgctgatatcactcttcgaatggatgcaacggcggatgatcttattgatgtgattgagggaagtagagtttatattccatgcgtttacgtactaaacaaaattgatcagattactctggaggaattggagattctagataggcttccgcattattgccctatcagtgctcatctagagtggaaccttgatggtctgctggagaagatctgggaatacctaaatcttactcgtatttacacaaaaccaaagggaatgaatccagattataatgaccctgtcatcctttcatctaggacaagaactatagaagacttctgttgtcgaattcacaaagacttcatcaaacaattcaagtatgcacttgtgtggggatcaagtgtgaagcacaagccacaaaaagtcggcaaggaacatgaacttgaggatgaagatgtggttcaaattatcaagaagatctaattataagacacttcaaacggagcagtgttgttctgttattgtcaactgtcaagctgaagcttgtttgtgatatttaaaagactagttgtagaagtgtttcatgtgcattgtccagttcgagttgctagtattagctattactatgttaaccagactttgttagatgtgttgt

SEQ ID NO: 7741 - DNA, 1432 bp, Castanea mollissima
atggcaaagactcaaaagaacaaggctactgctcatcacctgggattgctcaaggctaagcttgcaaaactacggagggaactccttgcgcctccctcaaagggaggtggtggtggtgctggtgaaggatttgatgttactaaaagtggagatgcaagagttggtctagtgggtttcccttcagtagggaaatctacactgttaaataaattgacagggaccttttcagaggttgcttcctatgaatttactaccttaacttgcatcccaggtgtgattgtgtatcgaggagctaaaattcagttgttggatctccctggaattattgagggtgctaaggatggaaagggtagaggaaggcaggttattagcactgctagaacatgcaattgcattttaattgttcttgatgcaataaagccaataactcacaaacgtctcatagagaaagagcttgagggatttggcataaggttaaacaaggaaccacctaacctgactttcagaaagaaagataagggtggaattaactttacctcaacagttgccaacacacatctggaccttgaaactgtgaaggcaatatgtagtgaatacagaattcataatgctgatattactcttaggtatgatgcaactgcagatgaccttatagatgtcattgaaggcagtagaatatatatgccttgcatctatgttgtgaacaagattgatcagattactctggaagagctagagattttggataaacttcctcactactgtccaatcagtgcgcacctggaatggaatcttgatggcctgctggagaagatatgggaatatcttaatttgactcgcatatacacaaaacctaaagggatgaatcctgactatgaagatcctgtaatcctgtcatctaaacatacaacagttgaggacttctgtgaacgaatccacaaggatatggttaaacaatttaagtatgctttggtatggggttcaagcgcaaaacacaagccccaaagggttggcaaggagcatgagcttgaggatgaggatgttgttcagataatcaagaaggtgtaactgtagagacactatagtcctggaacagcttctcaatatctgttagaaagcctcctttgaaagaaattttcggcagtaaggctcttgttatgagattctgtctagtttgctagacctaaggattctgtcttccgctttttcattcaaattaggtagaacaagggggagcttgatttgtaattaagctgttttttggtggtcaagctttgtttgttgtggttttgcctactgcttggttgtatgggactgaacatggaatctgttaagaaagggactacatagaacagatggaagttacaacttaaaataacttcactaaatcttggcgtatttgagactttaaacatgtgcttttaatgtttag

SEQ ID NO: 7742 - DNA, 1542 bp, Euphorbia peplus
caaatatataaaaaagaactccctccgtagctgctgctgaatctgcacctaagatttatcgctgcttattttgaaactaccctttttcttctaaacctcaacaatgtcgacagtgatgcagaaaatcaaagacatcgaagatgagatggcaaagactcaaaagaacaaggccacagcccatcatctggggttgcttaaggctaaacttgcaaaattgcgtagagaactgcttgagccttcaacaaaaggtggtgctgctactggtcaaggttttgatgtaactaaaagtggagatgccagggtagggctagtgggttttccttcagttgggaagtctacactgctaaataaattaactgggactttctctgaggttgcatcatatgaatttactaccttgacttgcattcctggtgtgatcatctacaggggagccaaaattcagttgttggatcttcctggtatcattgagggtgctaaggatgggaagggaagaggaaggcaggttatcagtactgctagaacatgcaactgtatcttaattgttcttgatgcaataaagccaattactcacaagcgtttgatagagaaagagcttgagggatttggcataagattaaacaaggaaccacctaatctgacattcaggaagaaggacaagggtggaattaatttcacttcaactgttgcaaacactcaccttgatcttgataccgtgaaggcgatatgtagtgaatatagaatccataatgctgacatcacactgaggtttgatgcaactgctgatgatcttatagatgtgattgaaggaagtagagtttacatgccttgcatctacgttgtaaacaagattgatcagattactattgaagagctcgaggtcctggacaatttacctcactactgccctgtcagtgctcacttggaatggaatcttgatggtttgctggatatggtatgggaatatctggatttgactcgcatatacacaaagccaaaaggaatgaatccagattatgaagatcctgttattctttcatccaagaagcggacagttgaggatttctgtgacagaatccacaaagatatgttgaaacaatttaagtatgctctggtatggggatcaagcgcgaaacacaaaccccagagggttggcaaggagcatgaacttgaagatgaagatgtagtccagatcatcaagaaagtgtaatatatatctaccccaatttgcaagagctcttcaaatagctgcactagagaagctgatatgtggacgagtccttcaatttttctgctcatatgaaggaaaacgagtcgacaaaaagcttaattaatgggggtatgtaattagcaagtgtgtgtttgcagtggcttgtatgacatctttaatggtagaaatagtcaagtgatcttagcaagaaagagttcaaaagagaatttttctttgatttgtgtatcttcttccgttaagtagtcccctcttaaagacattatccttcatgtttggtatttggggatccgtttgatctgttataaattgtt

SEQ ID NO: 7743 - DNA, 1567 bp, Eutrema halophilum
gtcgaaaaaaaatcaggtgaaacgaaaaccctcagattcctctggttcttcctcgtccgtcgtcactttcgacctctgattccggtcttcatccttttaacttctttccttaaggctgtagctgtgagctctttaatttgactgcaaccatgtcgactattatgcagaagatcaaagaaatcgaagatgagatggctaggacacagaagaataaagctactgcgcatcatctgggtttgttaaaggccaaacttgctaagctacgaagggaccttcttgcaccacctaccaaaggtggtggtggtgctggtgaaggttttgatgtgacgaaaagtggagattctagagttggacttgttgggtttccttcggttggaaaatccacgctcttgaacaagcttactggaacattctccgaggttgcttcttatgagttcacaacattgacatgcattcccggagttattacataccgtggagctaaaatccagttattagatcttcctggtattattgagggtgctaaggacggaaagggtagagggcgacaggttataagtactgctaggacttgcaactgcatcttgattgttcttgatgccataaaaccaataactcacaagcgtctcatcgaaaaagagctcgaaggattcggaataaggttgaacaaggagccacctaatcttacattcaggaaaaaagacaaaggtggtatcaatctaacttctacagtcacttccacacaccttgacctcgacactgtcaaggcgatttgcagtgagtacaggattcacaacgctgacatcactctgcgctacgatgcaactgctgatgacctcatcgatgtcatcgagggcagccggatctatatgccctgtatctacgctgtcaacaagattgatcaaatcacactcgaggaacttgaaattttggacaaacttcctcattactgtcctatcagtgcacatttggagtggaatcttgacggtcttctggataagatatgggaatacttggatctaactcgaatctacacgaaaccaaaggcaatgaatccggactatgatgaccccgttatcttatcttccaagaagagaacagttgaggacttctgcatccggattcacaaagacatgcttaaacagttcaagtacgctctggtttggggttcgagtgccaaacacaagccacaaagagttggaagggaacacgagcttgaggacgaggatgttgttcagatcgttaaaaagatatgatttttgttccagttcgtagagaagtcaaaagaccaaaatgagatagctatatagaagaaggttatgtatcttcgtctggtttatcgagcttatcctttgtactgtaatagtatattcagagaaaatttgtgtctgcaaccctttttttaatgttatcttttttccggtaatagcatgcatgtgattgatgttttgtcggaccaccgtagatttttttttgggatatatggttatgcctagatattcttcttgtttttatgtatgcaacttgactattttttttttttgaatttaaaagctgaaatttatcg

SEQ ID NO: 7744 - DNA, 1231 bp, Echinochloa colona
gggcccaacccattcagaataaaccggcccataagcctgcctgtggcgactggcgacccccaaacctaaaccctcaccacgcttctggatccttctttccccggctctcccgacctccctccctcagctccccttccgcatccgcacgaacgaagccgcgcgagcgaggagcagacgaaccttcccgacctcgaagcccctctcctccgagccgcagccatggcgaccgtcatgcagaagattaaggacatcgaggatgagatggcaaggacacagaagaacaaagccactgctcaccatcttggtcttctgaaggctaaacttgcaaagttacgacgggagttgctaactccggcatccaaaggtggtggtggtgcaggagaaggatttgatgtcacaaagagtggagatgcacgtgttggtttagttggctttccttctgtcggaaaatcaacattgctgaacaagttgacaggaacattttctgaggttgctgcctacgagtttacaactttgacatgtattcctggagtcatcatgtataaaggtgccaaaatccagcttctagatcttccagggatcattgaaggtgctaaagatggaaagggtagaggaaggcaggttatcagcacggccaggacatgcaatgttattttgattgttcttgatgctataaaaccaataactcacaaacgtctcattgaaaaggaacttgagggatttggcattcggttgaacaagacaccccccaatttgacattcagaagaaaggataagggtggaatcaattttacatcaacagtgacaaacacacacttggaccttgagacagtaaaagccatctgtagtgagtacaggatccataatgctgatgtctccctgagatatgatgcaacagcagatgatctcatagatgtaattgaaggaagccgcatttacactccttgcatctatgttgtcaacaagattgatcagataacgcttgaagagctggaaatcttggacaagcttccccattactgcccgattagcgctcatcttgagtggaatctcgatggacttctagagaaggtatgggaatacttggatttggttaggatatacacaaaaccaaaagggctgaacccagactatgaggatcctgttattgtatcatctaagaagaaaacagtggaagatttctgcaacagaatccataaggatatggtgaaacaatttaaatatgctctcg

SEQ ID NO: 7745 - DNA, 1422 bp, Tropaeolum majus
gaatcgaatatctctatattgctgaaacctgcttcttttcttcttctttaccattcgatcaaagccctcctctctgtctcactgtttctgcgtggaaatttcaattctgctgctaaaagatggcgactgtaatgcaaaagattaaagacattgaagatgagatggctaggactcagaagaacaaagctacagcccatcatctgggattgctcaaggccaaattagccaagctaaggagagacctccttgcacctccgacaaaaggggctggtgccggtgctggagaaggttttgatgttactaaaagtggagatgcacgggttggtcttgtcggttttccttcagtgggtaaatcaacccttctgaacaaattaacagggacattttcagaggttgcttcttatgagttcactactttaacatgcattcctggtgtgatcacttatagaggagcaaaaattcagctgttggatcttcctggtattatagagggtgctaaggacggaaagggtagaggaaggcaggttatcagcactgctcggacatgcaattgcattttaatagtccttgatgcaataaagccaataactcacaagcgcctaattgaaaaggagcttgaggggtttggaataaggttgaacaaggaaccacctaatcttactttcaggaagaaagaaaaaggtggtattaatttcacctctacagttgccaacacacatattgatttggatactgtgaaggcaatatgcagtgaatacaaaattcacaatgctgatattaccctgaggtttgatgctactgctgatgacctcattgatgtcattgagggaagtaggatatatatgccttgcatttatgtgattaacaaaattgatcagattacacttgaagaactggaaatattggataaactccctcactattgccctgtcagtgctcacctggaatggaatctggatggtctgcttgataaggtttgggaataccttcgattaacccgcatatacacaaagccaaaggggatgaacccagactatgaagaccctgttatattgtctactaagagcacaacagtggaggatttctgctttagaatccacaaggatatgcttaaacagttcaagtatgctctggtatggggttcgagcgcaaaacacaagccccaacgagtcggaaaggagcatgtactcgaggatgaagacgttgtccagatcatcaaaaaagtgtgatctcaagaagatgtagggatgatattagtatcatcggttaagttttgatatcttggagagtaaggagtgaagttctaagataagaatagaagaagaaactgcgtgatgtgtaactacataaaccagtttttgctaaattaagagtttaatgtgtaattcttattatcaccttgtacacccagtcgtattatta

SEQ ID NO: 7746 - DNA, 3555 bp, Amborella trichopoda
atgcctcaaagaaatatcatcacgtggtcagctttaatttctggttacagtcagcatggccatgggcatcgagccctgctgctcttctcccagtttcacaggttctctgaaacgccaccaaatcagtacataatagccagtgttttgagggcttgtgctaatctgagagctctaaatcaggcatctcaggtccacaatcttgttgttaaattgggtttagggaacgatgtctttgtgggtacgtcactcattgattcttattcaaaaagtgggtatttagaatttgcaaatttggttttcaatgaattaccggttagaaatgaagttacatggactacgataatcactgcatattcccagtcaggaaaaagtgagatttctttggaacttttccatgagatgaggcaaaccaatgtccgggctgatcgatatgtgatttctagtgtgctaagtgcctgttcagcaatggaatatattgaaggtggtaagcaaatccattcttacatagttcgcaacgaaccccaagtcgatgtttcagttaataatgtgttaatggacatgtactcaaagtgtggagagttgggttatgcgcggcgtgttttttatctgatgagtgttaggaatgttgtttcatggaccaccatgattgccgggttaatgcaaaatttttgcaatagtgaggctctgcatatgttcatggagatgcatgcgcaagggtgggaacctgatgggtatacctgcacgagtgcgctaagctcttgtggtgctctaatgggtttggaacaaggaaaacaagtgcattcttatgctgtaaaaaccaatcttgaaagtgatgagtttgttaagaatggtctggtagatatgtactgtaaatgtgattctttacttgatgcaaggcgtgtttttgatgttatggttatgcgtaatgttgtttcatataatgctatgattgaaggttacgcggcgcatggtgatctttggggggcagttattttatttgaacagatgaggtctcactatgtgtcaccaagcttattgacatttgtgagcctccttggggtatcagcaaccttttcagccgagcacttgagcaaacagattcatgcccatatgataaaactgggtatttcattggatctttatgcaggtagtgctctggttgatgtttactcaaaatgttttggtgtagatgatgctaggcttgtgtttgaggagatggaggaaagagatattgtcgtgtggaatgctatggtttcagggtatgcacaaaatgggcaaggggaggacgccttcaagctttatcaaaaaatgcagctaaaggaaatgaaacccaatgatttcacttttgttggattgatcacatcagccagtaaccttgctgccctgttccatggccaacagctgcataaccagaccataaaaatgggtatcgagtctgatccatttgttggaaatgcactcgtggacatgtatgcaaagtgcgggaatattggagaagcttggaggctttttgagagtatgccaactagagatatcgtgtgttggaactctatgatctcaagatatgcacagcatggccacgccaaagaggctgttaatctttttgagcaattaatcaaagtagaagtagaacccaactcctttattgcacaagagaaagaaataaagcccaattatgtcacatttgttggggttctatcggcttgcagccacgtggggctggttgataaagggttccagtactttaatttaatgaaaacagtttttaacattaaagcaggggttgaacattatgcttgtatgattgaccttcttggccgggcaggaaaactaagtgaggctaaagagtttatagaaacgatgcctattgaaccaacatcaatggtgtggagaagtctgctcagtgcatgtagaacctttggggatatcaatataggaaagtatgcagccgatagggccatctcaatcgatccaaaggatagtgggtcatacgtgttattgtccaacatttatgcttcaaagggaatgtgggttgatgtggcaaatgtgaggaagggaatgagttgcaatggcgttgtgaaggagcctggacacagttggattgaaatggcaaggacgcagaaaaataaagctacagctcatcaccttgggttgcttaaggcgaaactggcaaaattacgacgagaacttctggaaccttcatcaaaagggggagggggtggtgctggggaagggtttgatgttacaaaaagtggtgactctcgagttggtttagtggggtttccttcagttgggaagtcaacgctgcttaataagttaactggtaccttctcagaggttgcttcatatgaattcactacattgacttgcattcctggcgtaattggatacaggggggctaaaattcagttactggatcttccaggaattattgagggtgcaaaggatggtaaaggcagagggcgacaggttatcagcactgctaggacctgcaattgtattttaattgttcttgatgccataaaaccgataactcacaaacgtctgattgagaaagagcttgagggatttggtataaggttaaacaaggaaccacctaatttaactttcaggaagaaagacaagggtgggatcaatttcacttccactgttgcaaacacacatctggaccttgaaaccattaaggcaatatgtagtgaatatcggattcataatgctgatatctcacttcgatatgatgcaactgctgatgacctcatagacgttatcgagggaagtagaaaatatatcccctgcatctatgttgtcaacaagatcgaccaaataacaattgaggagctggagatcctggacaaacttcctcactattgcccaataagtgcccacttggaatggaaccttgatggtctattggagaagatatgggaatatctaaacctcactcgaatttacacaaaaccaaagggaatgaacccagactacgatgatccggtaatcctatcgtccaagagaaggacagtcgaggatttctgcaacagaatccacaaagacatgttaaagcaattcaagtatgctttggtatggggctccagtgtgaaacacaagccgcagagagttggaaaggaacacgagcttgaagatgaggatgtggttcagatcatcaagaaggtgtgattagtttagaggtgagtttgttaaccttagaaggcaattttcaactgagaaaggaaaaatctatagaatatggaaggctatttattttggagtttgaaggatccttacagagagaaaatagatggggtgctgcccttagattacctggtcctgttcagttggtatgtcggtttcttccccatttgaggataggtatgcttctgagattttctgtatgaaactctattactctactaatgttttgatgtatgattatgtagacaaaaaagaaaaaacgtgaaacaatttatgacaaaaagtccatgaagaacattagctgtttgaggctgtgaaatcactttgttctcaccttttccttcttggaaatttgatgcatttttt

SEQ ID NO: 7747 - DNA, 1626 bp, Panicum virgatum
tgttgttcatttgaccaggctaaacttgcaaaattacggcgggagttgctcactccaacatccaaaggtggtggtggtgcaggtgaaggatttgatgtcacgaagagtggagatgcacgtgttggtttagttggttttccctctgttgggaaatcaacattgctgaacaagttgacaggaacattttctgaggttgctgcctacgagtttacaactttaacatgcattcctggagtcatcatgtataaaggtgccaagattcagcttctagatcttccagggatcattgaaggtgctaaagatggaaagggtagaggaaggcaggttatcagcacggctaggacatgcaatgttattttgattgttcttgatgctataaaaccaataacacacaagcgtctcattgagaaggaacttgaggggtttggcattaggttgaacaagacaccacccaatttgacattcagaaaaaaggacaagggcggaatcaactttacatcaacagtgacaaacacacacttggaccttgagacagtaaaagccatctgtagtgagtacaggatccataatgctgatgtgtccctgagatatgatgcaacagcagatgatctcatagatgtcattgaaggaagccgcatttacacaccgtgcatctatgttgtgaacaagattgatcagataacacttgaagagctagaaatcttggacaagcttccccattactgcccgattagtgctcacctcgagtggaatctcgacggacttctggagaagatatgggaatacttggatttggttaggatatacacaaaaccgaaagggctgaacccagattacgaggatcctgttattgtgtcatcgaagaagaaaacagtggaagacttctgcaacagaatccacaaggatatggtgaaacaatttaaatatgctctggtatggggttccagtgtcaaacataagccacagagagttggcaaggagcatgagcttgaggacgaggatgttgtccagatcattaagaaaatataggtatacagtggaatgacagctgtttacaaaactgaaggagagatgaggattttgagtagttgcctcatgggttgctgtgatggtcatatgcccttggttcacctatactgcgttgaacaaaagacaatgtagacatgttttcttttgccgcaaatcatgtcctccgttgcttggtgccatgtggagtcagtgagtcatcaatgtaccaagtgtcctaccagtaccgtcgaacacatggagagatgctctccatatctttagaggataatgataagatgattcttgtactgcgagtgttccttctttgttaggtgtacctttttctagtgtatcacaagtgtcacaccttttgtacgtacattttctaatgaaatggctgtaggagcttattagtagcgtagattccttattatcctgatgatgatgaaagaatgtgaggatgagttggtacatttatttaggttctggtcgtaattgcagataacatgcttgagttgttttgttgcatgcctgatggcgattgtcttagtgctagttgctagcagtaatttatattattataattgttaatgttttgactctgatcctaatcctgtg

SEQ ID NO: 7748 - DNA, 1820 bp, Cephalotaxus harringtonia
actcggttacagcactgaagtctgaaaccatagaaattatattttctcaaaccctcgcggacgccactattaaatcctaagccagcgagctcattcatctgcaaccatggcgactgtaatgcagaagattaaagacatcgaagatgagataggcaaaaactcaaaaaaataaagccacagcccatcatttgggattgctaaaggccaaacttgctaaattacgacgagaaatccttgctcctcctacaaaggagggggaggtgctggtgaaggctttgatgttactaaaagtggggatgctcgagttggccttgtgggttttccgtcagttggaaagtcaacccttcttaacaagttgacaggtacattttctgaggtggcatcatatgagttcacgactctaacttgcattcctggtgtcattcgctatcgaggtgcaaggattcagttactggatcttccaggtattattgaaggcgcaaaagatggaaaggggagaggaaggcaggtgatcagtactgcccgaacatgcaattgcattttaatagtacttgatgctattaagccaattacacacaaacgcctgatagaaaaagagcttgaaggttttgggataaggctgaacaaggaacctcctaatctgacatttaggaagaaggaaaagggtggaataaattttacatctactgcagccaacacaaacgtggaccttgaaactgttaaggccatttgtggagaatacagaattcataatgctgatatatctcttcgttttgatgctactgcagatgatcttatagatgtgattgaaggtagtcgtatatatatgccttgcatttatgtcattaataaggttgaccaaatcagccttgaggagttggagattttggacaagctgccacactattgtccagtcagtgctcacttggaatggaatttggatggcctactggagaaagtgtgggaatacttgaatttgactcggatatttacaaagcctaaggggcttaatcctgattatgaagatccggtcattctttcatcaaaaaacggaccgtcgaagacttttgcatccgaattcataaggatatgttaaagcagtttaagtatgctttggtatggggttccagtgcaaagcacaaaccacaaagagttgggaaggatcatgaattggaggatgaggatgtggtgcagatcataaagaaaatgtagaagtgggcatattttatgctttgcaattgtaaaattgcgaaaggaaggaggagctttagttgtcacttatacatgatctagaagtgctgctgatgttcattagtattgatcctcagtttttactgaagaattcttccatcgactgtcttcatggattataattatttacaatctatagaagcagattgacactgcaaatatttatctcagaaaaatatagtcatgtaagaggtttatgacattgtatagctcttagaagctttcttggattcatttgaaaattgggttacatagcccttgattgtagggataaatatttttgtcatgtatgaggtttatgacattgtatagctcttaaaagcttgcttggattcatttgataattgtggtcacatggcccctggtcgtaggggggactgcaaaaaatgtttgtgccgctgatgtttctgcagaaagtctcttgtggtctccactctcaatttggtataagttttcagggcatgtttctttaactctatctttactttctgtctgccattagatttggaacaccatgtagacattcaagaacataattattgtatagggagcaaaacaatataatttcc

SEQ ID NO: 7749 - DNA, 3402 bp, Brassica oleracea
tttatttgggccgagaggatgatgttggatcaggcccagttctagacacttcggagagactgctcactgtcgtaggtaatcaggaaggtgggtggagaaaacgaaaaccctcgagtgtcttcttcttgattcattccggtgttctctctgcctttcactcgcgtttaagctcttacactcgacgctctctgctgtaactgcaaccatgtcgactattatgcagaagatcaaagaaatcgaagatgagatggctaggactcagaagaacaaagccaccgctcatcatctgggtttgttaaaggccaaacttgccaagctacgaagggaccttcttgcaccgcctactaaaggtggtggtgctgctgctggcgaaggttttgatgtcaccaaaagtggagattctagagttggacttgttgggtttccttccgttgggaaatccacgctcttgaacaagctcactggaacgttttccgaggttgcttcttatgagttcacaacattgacatgcattcccggtgttattacataccgtggagctaaaattcagttattggatcttcctggtattattgagggtgctaaagacggaaaaggtagaggacgacaggttataagtactgctaggacttgcaactgcatcataattgttcttgatgccataaagccaataactcacaagcgtctcattgaaaaggagcttgaaggattcggaatcaggttgaacaaggagccacctaatctgacattcaggaaaaaagacaaaggtggtatcaatctaacgtctacagtcactgcgacccaccttgacctcgacactgtcaaggcgatttgcagtgaatacaggatgcacaacgctgacatcactctgcgctacgatgcaaccgctgatgacctcatcgatgttatcgagggcagtcggatctacatgccctgtatctatgccgtcaacaagatcgatcaaatcaccctcgaggaacttgaaattttggacaaacttcctcattactgtcctatcagtgcgcatctggagtggaatctcgatggtcttcttgataagatatgggaatatttggatctaactcgaatctacacaaaaccaaaggcaatgaatccggattatgatgaccctgtcatcttatcttccaagaagagaacagttgaggacttctgcatccggattcacaaagacatgcttaagcaattcaagtacgctttagtatggggttcgagtgcaaagcataagccacaaagagttggaagggaacacgagctcgaggatgaggatgttgttcagatcgttaaaaagatatgatatctctacacatggaagaagtggctggattggttgacattaaaatggcaatttaaagattgtgacattgacacgtacgtggcaacactttagagttcgaagagtggattatttaagagaacttactaaaaaaacgaactcaattgcagtgactaggaccagtgatctttgatgcacttctcgaatggtctattctatcctttattttatgtgaaactgataagagtatgcttatatccatttgtttaagctcagattatggatcctttagatattctctacatgtttttgtggttagtaattagtaccgacactaacatatacgtgaatgggatgggcacggttggagagcagtcagatcttatgtcctaaatcatccaataattacgacaacctttaatggtaccctattgattaatagagcattgtaatcattgtgctctatataaatcaatgaaaaccatcacaacagtgtatctagagttcccaacattatctgatggcttcactaagcttgcttgaagcttccgtagctctcctttgttttctcatcttccatcacttgctcttcaagaaacctcatgaccggttcctcaaaaactggccagttctcgggatgcttcctggtttcctcatagtgctccaccgcatctacgacttcagcgtggaggttctcgagcaaaccaacttaacattcccattcaagggaccgtggttcactggaatggatatattagtcacggttgatccagctaacatccactacatattaagctcaaacttctccaactacaccaagggagctgacttcaaagaagtctttgatgttttcggagaaatgatctttaactcggacggtgacctgtggaggaatcaaagaagagctgctcagtacatgcttaaccaccaagggtttcaaaagctttccatgagtgcaacaagaactaaactcgacgacggtcttgttcctcttttcgatcgtttttcaaaggaggagatggtcgttgatttgcaaaacttgtttcaacgtttcacgtttgatacgacttttgttcttgtaaccggttttgatcccaagactctctctgttgaaatgccggaagacgagtatgctgaagctcttgacgttcttggagaagggattttctttaggcatgttataccaaagttcttgtggaagctgcaaaagtggattgggtttggacaagagaagaggacgatggaagctgatgccacttttgatcgtgtttccgccaaatacatattagctaagagacatgaggtactatcacaaggtattcatgatcaacaacaatcaaatggtgaatgtcatgaagatcttttgacgtctcacatgaagcttgatacaactaagtacgagctcttgaacccgagtgatgataagttcctcagagacaccatcttggctttcaatctagctgggagagacacaacggcttcagctctgtcttggttcttctggcttttatctgaaaaccctcgagtggtaaccaagattcgccaagagatcattaccaacataagtcttcatggccaagacaacttagacaagttggtgtatttacaagctgcgttgtatgagtcaatgaggctttatccaccagttcccttccaacgcaagtcacctataaaaccagacttgcttccaagtgggcacaaagtggaggcaaactcaacgatcatgatctttctttacgcgttggggaggatgagagcggtttggggagaagacgcaatggagttcaagccagagagatgggtttcacagtcaggatgcttgagacatgagccttctttcaagttcttatcatttaacgccggtccaagaacatgtcctggtaagcaattagctctgactctaatcaagacagtggcagtggagatattacaaaactatgatattaaggttatcaaaggacagaagattgagccagatcctggtcttatattgtacatgaagcatgggcttagagtcacaattactaagagatgttcagcttgaattaattgatgtaccattcccttattttccaatgtattaatatctatcacaaaattatggtatg

SEQ ID NO: 7750 - DNA, 1622 bp, Arabidopsis lyrata
ctagacaattctgcttagttttctcttttgtcgtaatcaggtggcaaaacgaaaaccctcggattcctctgcttccttctcgtccgtcgtcactttctctacatcagagagattccggtgtccttcttcctttcactcgcgtttaacctctttgccttgacgttgtccccgtgagctctctctgctttgactgcaaccatgtcgactattatgcagaagatcaaagaaattgaagatgagatggctaaaacacagaagaataaagctacttctcatcatctgggtttgttaaaggccaaacttgctaagctacggagggaccttcttgcaccgcctaccaaaggtggcggtggtggtgctggtgaaggttttgatgtgactaaaagtggagattctagagttggacttgttggctttccttcggttggaaaatctacgctattgaacaagctgactgggacattttctgaggttgcttcttatgagttcacgactttgacatgcattcctggtgttattacatatcgtggagctaaaatccagttattagatcttcctggtattattgagggcgctaaagatggaaaaggtagaggaagacaggttataagtactgctaggacatgtaactgcatcttaatagttcttgatgccataaaaccaattactcacaagcgtctcattgagaaagagctcgaaggattcggaataaggttgaacaaggagccaccaaatttaacatttaggaaaaaagacaaaggtggtatcaatctaacttctacagtcactgtcacacaccttgacctcgacacggtcaaggcgatttgcggtgagtacaggattcacaacgctgatatcaccctgcgctatgatgcaaccgctgatgacctcattgatgtcatcgagggcagtcggatatatatgccctgtatctatgctgtcaacaagatcgattcaatcacacttgaggaacttgaaattttggacaaacttcctcattactgtcctgtcagtgcgcatctggagtggaatcttgatggtcttctggacaagatatgggaatacttggatctaactcgaatctacacaaaaccgaaggcaatgaatccggattatgatgatcccgtaatcttatcttccaagaagagaacagtagaggacttctgcatccggattcacaaagacatgcttaaacaattcaagtacgctctggtttggggttcaagtgccaaacacaagccacaaagagttggaaaggaacacgagctcgaggatgaggatgttgttcagatcgttaaaaagatatgattattccagataatggagagagtaaagagaccaatcaaagtagccataatgagatctctctataaggttaggatttcttttggtttctcagcttatcttctgtattgtattattatatccagacgaaatctgtctgcacccttttgttttttttttggtcttattggagatacttttgtcttcttccaattatatcatgtgattgatgttgtcggaacccctcattattatctcgaatatgggttttgcctggattttctcctcccttgtttttatgaatggaactagactattttttttttaaaattcgattc

SEQ ID NO: 7751 - DNA, 1776 bp, Brassica rapa
gggccgagaggatgatgttggatcaggcccagttctagacacttcggagatagttttctcagtgtcgtagtaatcaggaagaagctggagaaacgaaaaccctcggatttcctctgattcgtgaatcgtgtttaagctcttacctcgacgctgcctccgtgagctctctctctctgctctgctgtaactgcaaccatgtcgactattatgcagaagatcaaagaaatcgaagatgagatggctaggactcagaagaacaaagccaccgctcatcatctgggtttgttgaaggccaaacttgccaagctaagaagagaccttcttgcaccgcctactaaaggtggtggtgctgctgctggcgaaggttttgatgtcaccaaaagtggagattctagagttggacttgttgggtttccttccgttggaaaatccacgctcttgaacaagcttactggaaccttttccgaggttgcttcttatgagttcacaactttgacatgcattcccggtgttattacataccgtggagctaaaattcagttattggatcttcctggtattattgagggtgctaaagacggaaaaggtagaggacgacaggttataagtactgctaggacttgcaactgcatcataattgttcttgatgccataaagccaataactcacaagcgtctcattgaaaaggagcttgaaggattcggaatcaggttgaacaaggagccacctaatctgacattcaggaaaaaagacaaaggtggtatcaatctaacgtctacagtcactgcgacccaccttgacctcgacactgtcaaggcgatttgcagtgaatacaggatgcacaacgctgacatcactctgcgctacgatgcaaccgctgatgacctcatcgatgttatcgagggcagtcggatctacatgccctgtatctatgccgtcaacaagatcgatcaaatcactctcgaggaacttgagattttggacaaacttcctcattactgtcctatcagtgcgcatctggagtggaatcttgatggtctgctcgataagatatgggagtacttggatctaactcgaatctacaccaaaccaaaggcaatgaatccggattatgatgaccctgtcatcttatcttccaagaagagaacagttgaggacttctgcatccggattcacaaagacatgcttaagcaattcaagtacgctttagtatggggttcgagtgcaaagcataagccacaaagagttggaagggaacacgagctcgaggatgaggatgttgttcagatcgttaaaaagatatgatatatctacacatggaagaaggttaggatcttcttttggattctcagcttatctttttgtactcctttctgtgtattattatgtcagataaaacaaactgtgtcttcactttttggtttgtcctgttggataatcttatcttttaccaatgatagcatctcatgtgatgaatgttttgtcggaacacttccatataaaaaaactacagatatggttttgcctagatatcgttcttgtttttatgtatgcaacttgtttaatttcgaatttaaaagctgaaatttatagatttgccattgcactacagttgctggattggttgacattaaaatggcaatttaaagattgtgacattgacacgtacgtggcaacactttagagttcgaagagtggattatttaagagaacttactaaaaaaacgaactcaattgcggtgactaggaccagtgatctttgatgcacttctcgaa

SEQ ID NO: 7752 - DNA, 1613 bp, Brassica napus
gaggctcagttctagacacttcggagatagactgctcactgtcgtaggtaatcaggaaggcgggtggagaaaacgaaaaccctcgagtgtcttcttcttgattcattccggtgttctctcggcctttcactcgcgtttaagctcttacactcgacgctgcctccgtgagctctccctctctctcctgtaactgcaaccatgtcgactattatgcagaagatcaaagaaatcgaagatgagatggcgaggactcagaagaacaaagcaaccgcgcatcatctgggtttgttaaaggccaaacttgccaagctacgaagggaccttcttgcaccgcctactaaaggtggtggcgctgctgctggcgaaggttttgatgtcaccaaaagtggagattctagagttggacttgttgggtttccttccgttgggaaatccacgctcttgaacaagctcactggaacgttttccgaggttgcttcttatgagttcacaacattgacatgcattcccggtgttattacataccgtggagctaaaattcagctattggatcttcctggtattattgagggtgccaaagacggaaaaggtagaggacgacaggttataagtactgctaggacttgcaattgcatcataatagttcttgatgccataaagccaataactcacaagcgtctcattgaaaaggagcttgaaggattcggaattaggttgaacaaggagccacctaatctcacgttcaggaaaaaagacaaaggtggtatcaatctaacgtccacagtcactgcgacccaccttgacctcgacactgtcaaggcgatttgcagtgaatacaggatgcacaacgctgacattactctgcgctacgatgcaaccgctgatgacctcatcgatgttatcgagggcagtcggatctacatgccctgtatctatgccgtcaacaagatcgatcaaatcaccctcgaggaacttgaaattttggacaaacttcctcattactgtcctatcagtgcgcatctggagtggaatcttgatggtcttcttgataagatatgggaatatttggatctaactcgaatctacacaaaaccaaaggcaatgaatccggattatgatgaccctgtcatcttatcttccaagaagagaacagttgaggacttctgcatccggattcacaaagacatgcttaagcaattcaagtacgctttagtatggggttcgagtgcaaagcataagccacagagagttggaagggaacacgagctcgaggacgaggatgttgttcagatcgttaaaaagatatgatatctctacacatagaagaaggttaggatcttcttttggattctcagcttatctttttgtactcctttctgtgtattattatgtcagataaagcaaactgtgtcttcactctttggtttgtcttgttggataatcttatcttttaccaatgatagcatctcatgtgatgaatgatttgtcgggaacacttccatataaaaaaaactacagatattgttttgcgtagataccgttcttgtttttatgtatgcaacttgtttaatttcgatttaaagctgaattttatagatttgctattgcactac

SEQ ID NO: 7753 - DNA, 1406 bp, Brassica napus
ggaaaaccctcggatttcctctgattcgtgaatcgtgtttaagctcttacctcgacgctgcctccgtgagctctctctctctgctctgctgtaactgcaaccatgtcgactattatgcagaagatcaaagaaatcgaagatgagatggctaggactcagaagaacaaagccaccgctcatcatctgggtttgttaaaggccaaacttgccaagctaagaagagaccttcttgcaccgcctactaaaggtggtggtgctgctgctggcgaaggttttgatgtcaccaaaagtggagattctagagttggacttgttgggtttccttctgttggaaaatccacgctcttgaacaagcttactggaaccttttccgaggttgcttcttatgagttcacaactttgacatgcattcccggtgttattacataccgtggagctaaaattcagttattggatcttcctggtattattgagggtgctaaagacggaaaaggtagaggacgacaggttataagtactgctaggacttgcaactgcatcataattgttcttgatgccataaagccaataactcacaagcgtctcattgaaaaggagcttgaaggattcggaatcaggttgaacaaggagccacctaatctgacattcaggaaaaaagacaaaggtggtatcaatctaacgtctacagtcactgcgacccaccttgacctcgacactgtcaaggcgatttgcagtgaatacaggatgcacaacgctgacatcactctgcgctacgatgcaactgctgatgacctcatcgatgttatcgagggcagtcggatctacatgccctgtatctatgccgtcaacaagatcgatcaaatcactctcgaggaacttgagattttggacaaacttcctcattactgtcctatcagtgcgcatctggagtggaatcttgatgggctgctcgataagatatgggagtacttggatctaactcgaatctacaccaaaccaaaggcaatgaatccggattatgatgaccctgtcatcttatcttccaagaagagaacagttgaggacttctgcatccggattcacaaagacatgcttaagcaattcaagtacgctttagtatggggttcgagtgcaaagcataagccacaaagagttggaagggaacacgagctcgaggatgaggatgttgttcagatcgttaaaaagatatgatatatctacacatggaagaaggttaggatcttcttttggattctcagcttatctttttgtactcctttctgtgtattattatgtcagataaaacaaactgtgtcttcactttttggtttgtcctgttggataatcttatcttttaccaatgatagcatctcatgtgatgaatgttttgtcggaacacttccata

SEQ ID NO: 7754 - DNA, 1471 bp, Tabernaemontana elegans
agcgcagcaggcgaactccgaagtacggactattatcgcaccaaaagccctatttttctctacgcgtttataatcacattccatcgtcgtccttatcaccgagctattcttcaattcttctgctttcagcaatggcgactgttatgcagaaaatcaaagacatcgaagatgagatggcaagaacccaaaagaacaaagctactgcccatcatcttggtttgctaaaggctaagcttgcaaaacttcgaagagaactccttgctccttcatcaaagggtggtggtggtgcgggcgaaggttttgatgtcacaaaaagtggagatgctagagttggtctagttggtttcccttctgttgggaaatcaacactgttaaataagttaactggaactttttcagaggttgcttcatatgaattcaccactttaacttgcattcctggagtaatagtgtaccgaggagctaaaatccagttgttggatctccctggtattattgagggtgccaaagatggaaagggtagaggaagacaggtcatcagtactgcaaggacgtgcaactgtattctgattgtcctggatgcaataaagcctattactcacaaacgtttgatagagaaagagttggagggctttgggattagattgaacaaagaacctcctaatttgacattcagaaggaaagacaagggtggaatcaatctgacgtcaacagttaacaacacaaatctggaccttgaaacagtgaaggtcatatgcagtgaatacagaatacacaatgctgacattaatctcagatatgatgcgactgctgatgaccttatagatgtcattgagggcagtagagtctatatgccttgcatctatgttgtcaataagattgatcagattacacttgaggagctggagatactggataaacttccacactattgccccatcagtgcacacctagaatggaacctcgatggtctgctggagaagatctgggaatatctcaatctgacacgtgtttacacaaagccaaagggaatgaatcctgattatgaggaccctgttatattgtcatccaaaaggaggactgttgaggatttctgcacccgaatccacaaagatatggtcaaacaatttaaatatgcactggtttggggttcaagtgcaaaacacaagcctcagagggtggggaagggagcatgagctagaagacgaggatgttgtgcagatcattaaaaaagtgtaacttatataacatcatttggtacactatgatggttcacattatttgagagagatctagcagcggagcttctaggcttgcagtttgctttgtgttacttaacagatgggataaacgaagagatggcttgatgtgtaattaggccctttggtatcgagctgttttatagtaatcacatcctttctggtgtagtttgagggtagttgttatctgtgacacaataaactgtagttat

SEQ ID NO: 7755 - DNA, 1499 bp, Arabidopsis thaliana
aaaaccctcgggattcctctgcttctgtctcgtccgtcgtcgtcaatttctctgcatcagagattccggtgtccttcttcctttcactcgcgtataacctcttttccttgacgttgtctccgtgagctctctgtgctttgactgcaaccatgtcgactattatgcagaagatcaaagaaattgaagatgagatggctaaaacacagaagaataaagctacttctcatcatctgggtttgttaaaggccaagcttgctaagcttcggagggaccttcttgcaccgcctaccaaaggtggcggtggtggtgctggagaaggttttgatgtgactaaaagtggagattctagagttggactggtcggatttccttcggttggaaaatctacgctattaaacaagctgactgggacattttccgaggttgcttcttatgagttcacgactttgacatgcattcctggtgttatcacatatcgtggagctaaaatccagttattagatcttcctggtattattgagggtgctaaagatggaaaaggtagaggaagacaggttataagtacggctaggacatgcaactgcatcttaatagttcttgatgccataaaaccaattactcacaagcgtctcattgaaaaagagctcgaaggattcggaataaggttgaacaaggagccaccaaatttaacatttaggaaaaaagacaaaggtggtatcaatctaacttctacagtcgctgtcacacaccttgaccttgacaccgtcaaggcgatttgcggtgagtacaggatgcacaatgctgacatcaccctgcgctacgatgcaaccgctgatgacctcattgatgtcatcgagggcagtcggatttatatgccctgtatctatgctgtcaacaagatcgattcaatcacacttgaggaacttgaaattttggacaaacttcctcattactgtcctgtcagtgcgcatctggagtggaatcttgatggacttctggacaagatatgggaatacttggatctaactcgaatctacacaaaaccaaaggcaatgaatccggattatgatgatcccgtaatcttatcatccaagaagagaacagtagaggacttctgcatccggattcacaaagacatgcttaaacaattcaagtacgctctggtttggggttcaagtgccaaacacaagccacaaagagttggaaaggaacacgagcttgaggacgaggatgttgttcagatcgttaaaaagatatgatttttgcagataatggagagcagtcaagagaccaaccaaagtagccataatgagatctcctataggaaggtcaggatttcttttggtttctcagctttatctttcttttgtaattgtattattatatccagacgaaatctgtgtctacacccttttttatgtcttattagatacttttgtcttcttccaataatactattaagcatgtgattgatgttgtcggaacacctcctattatct

SEQ ID NO: 7756 - DNA, 1451 bp, Brassica juncea
cttccctttcgacatctgataccggtgttctgtttctccctcgcgctcgcgtttaaactcttgccttgacactgtctccgtgagggagctctcactgcaaccatgtcgactattatgcagaagatcaaagaaatcgaagatgagatgggtaggacacagaagaataaagccaccgctcatcatctcggtttgttaaaggccaaacttgctaagctacgaagggaccttcttgcaccacctactaaaggtggtggtgctgctgctggcgaaggttttgatgtcaccaaaagtggagattctagagttggacttgttggttttccttccgttggaaaatccacgctcttgaataagctcactggaacgttttccgaggttgcttcttatgagttcacaacattgacatgcattcccggtgttattacataccgtggagctaaaattcagttattagatcttcctggtattattgagggtgccaaggacggaaaaggtagaggacgacaggttataagtactgctaggacttgcaactgcatcttaatagttctcgatgccataaagccaattactcacaagcgtctcattgaaaaggagcttgaaggattcggaatcaggttgaacaaggagccacctaatctgacattcaggaaaaaagacaaaggtggaatcaatttaacttccacagtcacctgcacgcaccttgacctcgacactgtcaaggccatatgcagtgagtacaggatgcacaacgccgatatcactctgcgctacgatgcaaccgctgatgacctcatcgatgtcatcgagggcagtcggatctacatgccctgtatctatgccgtcaacaagatcgatcaaatcaccctcgaggaacttgaaattttggacagacttcctcattactgtcctgtcagtgcacatctggagtggaatcttgatggtctgctcgataagatatgggagtacttggatctaactcgaatctacaccaaaccaaaggcaatgaatccggattatgatgaccctgtcatcttatcttccaagaagagaacagttgaggacttctgcatccggattcataaagacatgcttaaacaattcaagtacgctttagtatggggttcgagtgctaaacacaagccacagagagttggaagggaacacgagctggaggacgaggacgttgttcagatcgttaaaaagatatgaatttaccccagttcatggagaaggcaagagaccaatgcacagccacaatgtgatctgtacacgtggttaggatcttcttttggattctcatcttatcgttttggactctttctgtgtattattattatcggatataaaacaaactgtgtcttcacttttttggtttgtcttattggataatcttatcttttcccaatgatagcatgtcatgtgatgaaaaatgttttgtcgggaacacc

SEQ ID NO: 7757 - DNA, 1559 bp, Brassica rapa
aaccctgggaggatttgtctgctttcttctcgtccttccgtccgtcgtcgtcactctcgacatctgattgccggtgttctctctcgcgttaaactgttgccttcacgctatctccgtgtgagctctcccagcaaaaatgtcgactattatgcagaagatcaaagaaatcgaagatgagatggggaggacacagaagaataaagccaccgctcatcatctcggtttgttaaaggccaaacttgctaagctacgaagggacctacttgcaccacctaccaaaggtggtggcgctgctgctggcgaaggttttgatgtcactaaaagcggagattctagagttggacttgttggttttccttccgttggcaaatctaccctcttgaacaagctcaccggaacgttttctgaggttgcttcgtatgagttcacaacattgacttgcattcccggtgttattacataccgtggagctaaaattcagttattagatcttcctggtattatagagggtgccaaggacggaaaaggtagaggacgacaggttataagtactgctaggacttgcaactgcatcttaatagttcttgatgccataaagcccataactcacaagcgtctcattgaaaaagagctcgaaggattcggaataaggttgaacaaggagccacctaaccttacgttcaggaaaaaggacaaaggtggtatcaatcttacgtctacagtcactgccacccaccttgacctcgacactgtaaaggctatctgcagtgaatacaggatgcacaacgcagacatcactctgcgctacgatgcaaccgctgatgacctcatcgatgtcatcgagggcagtcggatctatatgccctgtatctatactatcaacaagatcgatcaaatcaccctcgaggaacttgaaattttggacaagcttcctcattactgtcctatcagtgcgcatctggagtggaatcttgatggtcttctcgataagatatgggaatacttgaatctaacaagaatctacaccaagccaaaggcaatgaatccggattatgatgaccctgttatcttatcttccaagaagaggactgtcgaggacttctgcatccggattcacaaggacatgcttaaacaattcaagtacgctttagtatggggttccagtgccaaacacaagccccagagagttggaagggaacacgagctggaggacgaggatgttgttcagatcgttaaaaagatatgatttccctaatagttcatggagaagttgaaagaccaaagttagccataatgagctcattacaaataggaagaaggtttggtttctctgcttatcttcttcttgtactcctgtgtgtattattttctgatccagataaaaacggtctgcaccttattgtcttattggataatctttttttctttttccaacgatagcatgtgatgtgaggtcttgagacatttagaaaattggtttggttcggttgtgctagttcagaatattaaggtattttggtggcaaattgcaataaataacatgaaagcttaaaatcttg

SEQ ID NO: 7758 - DNA, 1698 bp, Raphanus sativus
ggggagaaacgaaaaccctcggggctcctctgattcattctggtcttctctctctctctctctgcccttccttcactcactcactcactcacgtttaagctctttacctcgacgacgctgcatctgtgaggctcgctctttctgctgtaactgcaatcatgtcgactattatgcagaagatcaaagaaatcgaagatgagatggcaaggactcagaagaacaaagccaccgctcaccatctcggtttgttaaaggccaaacttgccaagctacgaagggaccttcttgcaccacctactaaaggtggtggtgctgctgctggcgaaggttttgatgtcaccaaaagtggtgattctagagttggacttgttggctttccttccgttggcaaatccaccctcttgaacaagctcactggaaccttttccgaggttgcttcttatgagttcacaacactgacatgcattcccggtgttattacataccgtggagctaaaattcagttattggatcttcctggtattattgagggtgccaaagacggaaaaggtagaggacgacaggttataagtactgctaggacttgcaactgcatcataatagttcttgatgccataaagccaataactcacaagcgtctcattgaaaaggagcttgaaggattcggaattaggttgaacaaggagccacctaatctcacattcaggaaaaaagacaaaggtggtatcaatttaacttccacagtcacctgcacgcaccttgacctcgacactgtcaaggccatatgcagtgagtacaggatgcacaacgccgatatcactctgcgctacgatgcaactgctgatgacctcatcgatgtcattgagggcagtcgcatctatatgccctgtatctatgctgtcaacaagatcgaccaaataactctcgaggaacttgaaattttggacagacttcctcattactgtcctgtcagtgcgcatctggagtggaatcttgatggtcttctcgataagatatgggaatacttggatcttactagaatctacaccaaaccaaaggcaatgaatccggattacgatgaccctgtcatcttatcttccaagaagagaacagttgaggacttctgcattcggattcacaaagacatgcttaagcaattcaagtacgctttagtatggggttcgagtgcaaaacataagccacaaagagttggaagggagcacgagctcgaggacgaggatgttgttcagatcgttaaaaagatatgagttcgccagtagttcatggagaaggcaagagaccaaagcacagccccattatgtgatctgtacacgtggtagaaggttaggatcttcttttggattctctgcttatcttttggactccttttctgtgtattgtcatcatcagataaaacaaactgtcttcactttttgggttgtcttgttggataatcttatcgtttaccaatgactatgagagtatgtcatgtgatgaacgttttgtcggagccccattatgtgatctgtacacgtggtagaaggttaggatcttcttttggattctctgcttatcttttggactccttttctgtgtattgtcatcatcagataaaacaaactgtcttcactttttgggttgtcttgttggataatcttatcgtttaccaatgactatgagagtatgtcatgtgacgta

SEQ ID NO: 7759 - DNA, 7560 bp, Brassica oleracea
attttggtaaacggagcccacaactgatacacggtgtaacctatgtttcaggcccattaagcccataaactgaaccaccccctcacagttttctgtagctccgaaagagacagtgcggagtttgatcgattgttctttccgacaatgtcgtctcccgaggagaagaagaagaggaagaggatgagtacaaccaagaagaagaagccgacgccgcaatctaccccaaacccttcgcttcccgatgatttgttactcagctgctttgcacgcgtctcgagattgtactacccgactctctcactcgtctcgaagacctttcaatctatcctcgcttcgcctgagctttacaagacccgctcctctttaggccgcaaggagagttgtctctatgtgtgcctactttccgatcccgaccctatccctcgctggtacaccctctgccggaaacctgaccgaaccctaaccacaaatggcgacaccatgaagctgaagaagaagaagaagaagtcaagtgggtatgttttagctaagctcccaactccccattctggtcctgcgaactggtcgggtctcgtgacgcttggttcagatatctacaactttggcggatcagaggaaccctcgtctagcgtcttgatcctggactctcggtccaacacttggcgcgagggtccaagcatgctggtgaagcgaaactacccagtggccgttgtccttgatggaaagatatatgtagcaggaggctgcatagactgcagcagtttctctgattggatggaggttttcgatccaaagaaacaaacttgggagcttgtgccaggccctggcgctgagatatgtggctgtgaatatctaagtaatagtgcaggggttgatgggaaagtatacatctttggaggcgataatggtttggcttacagacctaaggaaggtcaatgggaaagggtgggatgggagatggatacggattggccatggttttcttttgcggtgattgacaacgtgctctgcaattacattgaaggagggttcagatggtatgacactaatgcaagactctggaagggtttgaaaggtgtgaaaggactgcctaagttccctcgttatcgtgctagattggcggattatggtgggaagatggctgttttgtgggagagggttttggcttccactggatttaaggacaagatggttttgtgtgcagtcattgctcttgaaaggcgcaacaacgatgaagagctttggggcaaggtggaatggcatgacactgtgcttacagtccccaagtcattcgtcgttgactttgctcttgctactaccgtttgatgaatgacatataagaccgacttgaatgtgatgaatctttttgtagtcgtgggcaatagacatcatcccacttgtaatggttttgtcgccatgaataacgaggaggcatcaccgcatgagcagaacaagatggtctctcctccgaccacggatctgtcgcttcccaatgacatacttttgagcttcctaagccgcgtttcaagactctactacccaactttctctctcgtctccaagagcttccgcactcttatcgcttcacctgaactataccagacccggtctttcctcaaccgcacagagagttgtctttacgtgtgcttgcgatcactcaccgactctaacctccgatggttcaccctctgccgtgtaccagatcgtaaactaacaaacttctcaggtggccatttactggtcccggtttcatctagccatgctcctccccctcctgctcattggtcgagtgtggtcactgttgactcgaacatatacgctatcggaggtcctatcaacgatgcgccttcctccagagtctccttcttggattgtcggtctgacacgtggcgcatggctcctcccatgcgtgtggctcgtaactaccccactgctagtgttcttgatgggaaaatatacgtagcgggaggctgcgaagattgcgattcgctgaactgtatagaggtgttcgacccaaatactcaaacttgggagtcagtggcaagtcatggcactggtggatgcgagagacttgtatacaaaggcatagggatcgaaggaaagtttcacttgttaggaggtgcgagtcatgtagcttacgaccctagagaaggtagatgggactcggtaggaacggaaatggatatgggtcgagcgtgggtttcttattgtgtgataaagaacatattgttgtattatcacgaaagggatagagagttcaaatggtatgactataaaggaagattctggaggaagttgatgggtttggaaaggttggttaagtttctatgttacagccgtgttaacttggcggattatggtggtaagatggctgttttgtgggatacttttgtgcctgggagtggttctaagaacaagatgatttggtgcgcagaggttagccttgaaagccatgacgtatatgatatttgtggtgagattgagtggtttgatgttgttcttagagtttccaagtcatatactgtttaattagctggattttttctcttgtaaagagtaagactcttctcctacttcagaattgcatttgtagtccaaagctattagaacatggaaggtgaagagacgatttaaagcctatgtgaagtaacaaatgttcaaaaaccaaagagaaagataaaacattttttttcaaaagtaacaatcatagagcattaccagtgtatgtatctcctgattcatcatcaagccaaatgctagtacgtggagcagagtgtcatcctacaatggtcttgtgacttttccatgagttggtagataactgtgtgccgtttttggctatcgtatccaccgtcctttcttcacttaaaatatcaaacggcagaatgtttattttatgaaattatggtttctcaacaatgttctttcttcctctctctctcagtaaaatgagaaaccatggctactcctggcgcaaagtgcaagaagcgatacgtttctactcttcgtcatcctcttctgcttcacgtctcctggagtttatagacattgattttccttctacattaggaatccgcggaaggcgcgaattcgctcgtctcttgcagcttcgtgcatcagatgatccattgctccatcacaatgcagttcatggtcagtttatcgtttccggttttgattcagacacgtatctaaacaacattctgatgaaatcgtattcaaaaggcggtgatatggtttatgctcgcaaggtgttcgacagaatgtctgacagaaacttagttacttggtctaccatggtttcagcttgtaaccatcatgggctttacgaagagtctttggaggttttcttagagttctggagaagtagaaaaaatagccccaacgagtatatcttgtcgagtttcatccaagcttgcttacatgttagtagtggacgttcggatggtgtttcagttgcaaagttttatctttaagagtgggtttgatcgggatgtttacgttggtaccttgttgattggtttttatctcaaggaaggtgatatcgattgtgcaaggcttgtgtttgatgctttaccagagaaatctacagtgacttggacgactatgatcaaagggtatgccaaaatgggaagaagctatgtgtcgttgcagctcttttaccaactaatggagagtaacgttgttcctgatggttacatcctttcgacggttctaagcgcgtgtacaatactttcttttgtggaaggtgggaagcagattcatgctcacatcttgagacatggacatgagatggacgcctcactgatgaatgtgcttatggattcttatgtgaagtctggcagagttacatgtgctcgtaagttattcgatgggatgtggaatgcagacatcacatcgtggaccacgatactgtctggttataagcagaactctcttcataaggaagcaatggaattgttttctggaatttcgaagtttggtttgaagccagatgtctatgcttgctctagcatactcacatcttgtgcctcacttcatgctctggagtatggaagacatgttcatgcatacactatcaaagctaaccttggcgatgatagctatgtgaccaacagcttgatcgacatgtacgcaaaatgcgattgtttgaacgatgccagaaaagtttttgatcttttcggcggtgatgatgtggttttatataatgcaatgattgaaggttactcgagacttgggacgcaaggtgagctacatgatgcattcaacatctttggtgatatgaggtcacgactgattcgacctagcctattgacttttgttagccttctacgtgcatctgcttctttatcaggcttggaacttagcagacaaatccatggactcatgttcaaatatagtgtaaacttagatatattcgctgcaagtgctttgattgatggttactcaaattgctactccatcgaggattctaggcttgtgtttgatgagatggaagagaaagatcttgttgtctggaactcaatgttttcaggttatgttcaacactcagagaatgaagaagctctccatctgttttcggaactacagttatcaagggaaagacctgacgagtttactttcgccgacatggttacagcagctggtaacctggctagtcttcaattaggtcaagagttccactgccagattatgaaaagaggcttggaacgtaactcgtatattacaaatgctctactagatatgtattccaaatgtggaagtccggaggatgcttataaggcttttagttcagcatcttcgagagatgtggtttgttggaactctgttatctcatcttatgcgaatcacggagaaggcagaaaagctcttcagatgctggagagaatgatgaatgaaggaatagagcctaactacatcaccttcgtgggagttttatcagcgtgcagccatggtggtctcgtggaagatgggcttgagcagtttgaggttatgctccgacttgggattgaaccagaaacagaacactatgtttgtatggtatctctattaagccgtgctggtagattagaagaagcaaggcagttaattgagaaaatgccagaaaaaccaccagctatagtatggaggagcttgctgagtggatgcgcaaagactggtaacatcaagttagccgagcatgctgctgaaatggctattgcgtctgatccaacggacagtggatcttttactttgctttctaatatctacgcgtcaaagggtatgtgggctgatgcaaagaaggtaagagaaagaatgaagtttgatggtgtggtgaaagaaccgggacgtagttggattctgattgataacgaggttcatatctttttgtccaaggataaatctcaccgcaaggcgaatcagatttatgaagtgttagacgatttgctcctgcagataaaatggtttagttaagtaaccatacaatagttcattttctgttgagtgattggctctatatgattaacagaccaatagtagaattgtggggaatttcgatgagtgattggtcatggtgaggcaatcaggagaggtatcaagcctgattggatcaatgaagaaagagttagtctctgcgttgatgaagttgcaggagatgaagctaagcagcaatgataaaaagaagcagaaacagtaagacgagactgtgatgttctgaatcatacttttgtcctagattgaaccagaagtggagaagcctagaaagtaagtgatacacaatacaagttcaatccgatgaagaaagaagcagcaatggccaatctcaagaagaaactggtttacgaggggagatgctgcccgcctgaaaacgttatgttgtataataaattcattagaattgtttaacctgacttttaattcagctagactaaaaaaaaaaccataacagtgtttaaccaaactaatgttctcttttatcatatagttattatatgggcccaaaatcgtgttggatcaggcccagttatagttactttcggttctaagaaaaccctgggaggatttgtctgcttcctctcgtccgtcgtcgtcactttcgacatctgataccggtgttctgtctccctctcagtcgcgtttaaactgttgccttgacgctgtatccgtgagctctcccagcaaaaatgtcgactattatgcagaagatcaaagaaatcgaagatgagatggggaggacacagaagaataaagccaccgctcatcatctcggtttgttaaaggccaaacttgctaagctacgaagggacctacttgcaccacctaccaaaggtggtggcgctgctgctggtgaaggttttgatgtcactaaaagcggagattctagagttggacttgttggttttccttccgttggcaaatctaccctcttgaacaagctcaccggaacgttttctgaggttgcttcttatgagttcacaacattgacttgcattcccggtgttattacataccgtggagctaaaattcagttattagatcttcctggtattatcgagggtgccaaggacggaaaaggtagaggacgacaggttataagtactgctagaacttgcaactgcatcttaatcgttcttgatgccataaagccaattactcacaagcgtctcattgaaaaagagctcgaaggattcggaataaggttgaacaaggagccacctaaccttacattcaggaaaaaagacaaaggtggtatcaatctaacttctacagtcactgccacccaccttgaccacgacactgtaaaggctatctgcagtgaatacaggatgcacaacgctgacatcactctgcgctacgatgcaaccgctgatgacctcatcgatgtcatcgagggcagtcggatctatatgccctgtatctatactatcaacaagatcgatcaaatcaccctcgaggaacttgagattttggacaaacttcctcattactgtcctatcagtgcgcatctggagtggaatcttgatggtctgctcgataagatatgggagtacttggatctaactcgaatctacaccaaaccaaaggcaatgaatccggattatgatgaccctgttatcttatcttccaagaagaggactgttgaggacttctgcatccggattcacaaagacatgcttaaacaattcaagtacgctttggtatggggttcgagtgccaaacacaagccacagagagttggaagggaacacgagctcgaggacgaggatgttgttcagatcgttaaaaagatatgatttccccagtagttcatggagacgttgaaagaccagagttagccataatgagctcactacacatagaaagaaggtttcgtttctcttcttgtactcctgtgtattattgtctgatccagacaaaaaggtgtcaaaaactgtctgcacctttttgtattggataatctttttccaacgataacatgtgatgtgaggtcttgagacatttagaaaattggtttggttttgctagttcacaacattaagttatttgggtggcaataaataacatgaaagtttaaccgag

SEQ ID NO: 7760 - DNA, 1976 bp, Physcomitrella patens
gtgtcgatgccgttatttttgcggcgattgctctcatttcgtctctgcccttgtttcttctgaatccccttgcaggtcaggatccagagaggcttgttcgcttcacatccagctcttctttttgtgggtaatcaccatgtcgaccgtcatgcagaaaatcaaggatatcgaagatgagatggcaaggactcaaaagaacaaagcaactgctcaccatttgggtctccttaaggcaaaattggctaagttgcgacgagaaattctggcgccaccgtcttccaaaggtggaggagcaggcgaaggttttgatgtcactaaaagtggagattcacgagttgggcttgttggttttccatctgttggcaaatctacccttctcaacaagctcacaggaaccttttctgaggttgcttcctacgagtttacaacattgacatgcgttccaggtgttatcaaataccgaggatccaaaatacagctgctagatcttcctggaattattgaaggtgcgaaagatgggaaaggtcgtggtcggcaggtcatcagtactgcccgaacgtgcaactgtatattgatcgtcttggatgccattaaacctattacccacaaacggctgattgagaaagagctggaaggctttggcatcagattaaacaaggaacccccaaatatgggtttcagaaggaaagacaaaggtggaatcaattttacatcaaccgtcgctaatactcatctggatctggaaacggtcaaggctatatgtggggagtacaagattcacaatgcagacatatccctgcgatttgatgccaccgcagatgatttgattgacgtgattgaagggaaccgtatctacatgccgtgcatttatgttgtcaacaagatcgatcaaattactgttgaagagcttgaagtgcttgacagattaccccactactgtccaatcagtgcccatcttgagtggaacctggatggactcttggacaagatttgggaatacttgaatcttatccgagtatacaccaaacccaagggcaacagccccgattatgaagaccctgtcatcctgtcagccaacaagtgtacagttgaggatttttgtgaacgcatccacaaagatatggtgaagcagttcaagtttgctttggtgtggggttcaagcgcaaaacacaagccacagagagtgggaaaggaacatactttggaggacgaggacgttgtccagattattaaaaaagtgtgacatcttatggctgctgaaggatgggtcattcaatacttgttcggttcgtcatagaggttttagaagattctcagatgtttgacggtgagtgatctgccatccaagatcaagtttctctacttcaagctagttgaccgatgctctaataatttaagtacaaagtgtgcaccagttgctgcttttggagtttgaggaatggatctttagcaagagcgttgtgtaaagatggcatccagggtcagttcagatcatcaatccagaaatcatcaagttctggtctgatccgatggagtatggcattacctaaacttaagatagatgggctggtagatgatttcgggttttagatcagaaaaggtgtcaatcgactcctcagagttccagatttgattacaattagttgctcggtgtgggtttgtggctattcaacgggtattagtcaagcaagagggttatggtaaattggatggcaaggcctccgtagcttcgtcaccctagaattttgcagcttaagtgaaactcgcatggaagagttggttcaatagaacaaggatggtgctttcaggagaaagatgcttgcattgtttctgagaaaaccttatattgatgttgatcatcagctaaacgttatgtcgctattgggtttgtacgttgcgttcttcttcagtcagaagtaacaatccgtatcagccttctaagaaatatatgaagctccttattgtatttgtatgac

SEQ ID NO: 7761 - DNA, 1750 bp, Citrus sinensis
cctcaaaaactctctgtttctcaaattaacgcagagataatcgtcacagctcaatctgaaccgccggttaaccgttgatctgattacctgtttgataatcctgtctcatctgcgacaatggcgactgtcatgcagaaaatcaaggacatcgaagatgaaatggcgaggactcagaagaacaaagctacagcgcatcatcttggcttgctcaaggctaaacttgcaaagctacgaagggaacttcttacacctacgtccaaaggaggtggtggtggtggtggggaaggttttgatgtcactaaaagtggagattctagagttggtctagtcggtttcccctcagttgggaaatctacacttttgaataagttaacagggacattttcagaggttgcttcatatgaatttactactttaacctgtatcccgggtgtgattacgtatagaggtgccaaaattcagttgttggatcttcctggtatcatcgagggtgctaaggatgggaagggtagaggaagacaggttatcagtactgctaggacatgcaattgtatcttaattgttcttgatgcaataaagccaataactcacaagcgtctgatagagaaagagcttgagggatttggcattaggttaaacaaacaaccacctaatctgacattcaggaagaaagataagggaggtatcaattttacctcaacagttaccaacacaaatcttgaccttgacactgtgaaggcaatatgcagtgaatacagaattcataatgctgatatcactctgagatacgatgcaacagctgatgaccttattgatgtcatcgaaggcagtaggatatatatgccttgcatctatgtcataaacaaaattgatcagattactcttgaagagctggagattttggataagcttcctcactattgcccagttagtgcgcatctggaatggaacctggatggtttgctggagaagatatgggaatatcttaatttaactcgtatatacacaaagcccaaagggatgaatccggactatgaagaccctgtgattttgtcatctaaaaagaggacagtcgaggatttctgcgagcgaattcacaaagatatggttaaacaatttaagtatgctctggtatgggggtcaagcgcaaaacacaagccacaaagagttggcaaggagcatgagctcgaggacgaggactgttgttcagattatcaaaaaggtgtgattctcataagaattaaaatttgttggtgttatacgacaaagttgttctgctaaacttcatgcaccgtaaggagtaagagcctgttattagattaggtagacctaggagacagcttgatgtgtaattaagctattttgtggtcaagctctttggttgtgatccactatgttgcctggttaaaatctcctatgctaattttttgtacgacaaagatcgtagtttttgtgcattttgggacttgcctctctccagagtgttttttacgttgtcattaatctatcatgagaagagattgtgtaagatttaaagactgaaagtgcactattacagtatcacttgtattgttctctacacaagacttattaatacactttatatgtctttgatttttttaagagttgaataagtcagaacaaatattttagtgctgcattgcaatgtacaaaattgttcatgcaaaaagtctacatcctcttactattcattctagtgaacttgttaaattttggtgataccaattga

SEQ ID NO: 7762 - DNA, 1498 bp, Catharanthus roseus
ctctagaattctcccttcaagctctcttctttctttcccccttcaaaccgaaccgcagataaagctcgaaccgtcatcggacaaagccctatttcttcctctgcattacaccttcgtcttcatcattcgagctcccattcggtccttcttctttcagcaatggcgactgttatgcagaaaatcaaagacatcgaagatgagatggcaagaacccaaaagaacaaagctactgctcatcatcttggtttgctaaaggctaagcttgcaaaacttcgacgagaactccttactccttcatcaaagggaggtggtggtgctggagaaggttttgatgtcacaaagagtggagattctagagttggtctagttggttttccctctgttggtaaatcaacgctgctaaataagttgacaggaactttttctgaggttgcttcatatgaattcaccacattaacttgcattccaggagtgataatgtatcgaggagctaaactccagttgttggatctgcctggtattattgagggtgccaaagatggaaaaggtagaggaagacaggtcatcagtactgcaaggacatgcaattgcattctcattgtgctggatgcaataaagcctattactcataaacgtctgatagagaaagagttggagggttttgggataagattaaacaaagaacctcctaatttgacattcagaaggaaagacaagggtgggatcaatcttacatcaacagtcaacaatacaaatctggaccttgagacagtaaaggctatatgtagtgaataccgaatacataatgctgatatcaatcttagatatgatgcaactgctgatgaccttatagatgtcattgagggcagtagagtctatatcccttgcatatatgtcgtcaataagattgatcagattacacttgaggagctggagattctggacaaacttccccactattgccctatcagtgcccacctggaatggaaccttgatggtctgctggagaagatctgggaatatctcagtctgacacgtgtttacacaaagccgaagggaatgaatccagattatgaggaccctgttatattgtcatccaagaggaggaccgttgaggatttctgcgaccgaatccacaaagatatggtcaaacaatttaaatatgcattggtttggggctcaagtgcaaaacacaagacctcagagggtgggcaaggagcatgagctggaagacgaagatgtcgtgcagatcattaaaaaagtataacttaattgaacatcatcattaggtacgctattgccataattcatcgatgtccagagcttccttgtgactagctaagccttgcagtttgttttttttcttgacagatagataggatagacaaatgacttatatgtaattatatgcccttataagaattgtatcgtttttacattgtgaggtttccagattattgttatcttgagacaataaagaccataatattatgtatcg

SEQ ID NO: 7763 - DNA, 1119 bp, Pinus taeda
tgaagatgagatggaaaaaaaacacagaaaaacaaggctacagctcatcatttgtgtttgctaaaggccaagcttgctaaattacgacgagaaattcttgctcctcctacgaaaggagggggaggtgctggcgaaggctttgatgtaactaaaagtggagattcccgtgttggccttgtggggtttccatcagttggaaagtctactcttctgaacaagttgacaggtactttctctgaggtggcatcatatgaattcaccactctaacatgcattcctggtgttattcgttatagaggtgcaaagctgcagttactagaccttccaggaatcattgaaggtgcaaaagatggcaaggggagaggaaggcaggttatcagtactgcaagaacttgcaattgtattttgatagttcttgatgctatcaaacccattactcacaagcgcattatagaaaaagagcttgaaggatttggaatcaggttgaacaaggaacctcctaatttgacatttaggaagaaggacaagggtggaataaatttcacatctactgtggccaacacactcctggaccttgagactgttaaggcaatttgtggagaatacaagattcataatgctgatatttctcttcgctatgatgcaactgcagatgaccttatagatgtgattgaaggtagtcgcatatatatgccttgcatatatgttgttaacaagattgaccagataactctcgaggaattggagattttggataaattgcctcactactgcccagtcagtgcccacctggaatggaatttggatggcctattggagaagatatgggagtacttaaatttgacccgaatatatacaaagcccaagggattgaatccggactatgaagatcctgttattctttcatctaaatcacgaactgttgaagatttttgtactcgaatccacaaggatatgttgaagcaatttaaatatgcattggtatggggttctagcgcaaaacacaaacctcaaagggttgggaaggatcatgaattagaggatgaggatgtagtgcagattataaagaagatataaacatggagagaatcctgcattggataacgagattgttgccct

SEQ ID NO: 7764 - DNA, 1471 bp, Ambrosia trifida
taaactgagactccatcttcttctctagaagtctcttcatttcataccagctattaaccacctatatacttcaaacacaacacaactactgatcttattcttcctgctttaaccatggcgaccgttatgcagaaaatcaaagacatcgaagatgagatggcaaagacccaaaagaataaagcaactgcacatcacttgggattactgaaggctaagcttgcaaaattgagaagagagcttctaacacctacaacaaagggaggtggtggtgctggtgaaggttttgatgttacaaaaagtggtgacgcaagggttggtcttgtggggtttccctctgttgggaaatcaacacttctaaacaagttaactggcactttctcagaggttgcttcatatgagtttactactctcacgtgcattccaggtgttatcacctatcgaggagctaagattcagttattggatcttcctggtattattgagggtgctaaggatggaaagggtagaggaaggcaggttatcagcacggccaggacatgcaactgtattctgattgtgctggatgcaatcaagccaataactcacaaacgtctgattgaaaaagaacttgaagggtttggcattaggttaaataaagagcccccaaatctgaccttcaggaaaaaggagaagggtggaattaattttacatcaacagttgctaatacacatctggacgttgaaacagtgaaggcaatatgcagtgaatacaagatacataatgctgatgtcacgcttaggtttgatgcaactgctgatgatcttatagatgttattgaagggagtcggatatatactccttgcatctatgttgtcaacaaaatagatcagattacactcgaagagctggagatattggataaacttcctcactactgccctgttagtgctcacttggaatggaatcttgatggtctgctagagatgatatgggaatatctgaacttgactcgtatttacacaaaacccaaagggatgaatccagactatgaggaccctgtaatcctttcatctaagaagaaaactgtagaggatttctgctttagaatccacaaggacatgcttaagcaatttaagtatgcactggtctggggttctagtgcaaaacacaagccaacaaagagttggcaaggaacatgagcttgaagatgaagatgttgtgcagatcattaagaaagtttaaaaataaaaccactaaattttctacccatttttgagtcttgtattccagtgtattgagcaggtaaggtttgtcaatggattgcttagtttttgtactggatgctgatgtgcgtgtctaagacattaggacaaggaaatcataaattaagcagatttatgtatggttgtttcactattttggtttacaactcgtcaatttctgttttttacattgtgaactgtacactttgtctcatttacggaaccataa

SEQ ID NO: 7765 - DNA, 1817 bp, Ceratodon purpureus
gcttgcctgtgttttgcaagccaagttgttcctcgctttcgtcttgccaacttgctcttctctttcgcagtgttcgtagctttgcgctgcagcatcgccattccaaccattccatttctcattacctacactacgttactactgctttgtactactactctcactccatctcttgcccactcatctccccctgcccctgccgctcatctcaccatggcgaccgtcatgatgaagatcaaggacatcgaggatgagatggccaggactcaaaagaataaagcaactgctcatcatttgggtcttctgaaggccaaattggcgaagttgcgacgagagattttggcacctccgtcctccaaaggtggaggagcgggcgagggttttgatgtcactaaaagcggagattcacgagttggacttgttggttttccctctgtcggcaagtccaccctccttaacaagctcacaggaaccttttctgaggttgcttcctatgaatttacaacgttgacgtgcgttccgggtgttatcaaatatagaggatctaaaattcagcttctggatcttcctggaattattgaaggtgcaaaggatggaaaaggtcgaggtcggcaggttatcagtactgctcgaacatgcaactgtatcttgattgtattagatgctattaaacctattacgcataaacgactgattgagaaagagctagaaggcttcggcatcaggttaaacaagggaccaccaaatatgggatttaaaaggaaagacaaaggcggaatcagtttcacatcgacggtcgctaacactcacttggacctggagactgtcaaggctatctgtggggagtacaagatccacaatgcagatatatccctacgttttgatgccactgcagatgatttgattgatgtgatcgaaggaaaccgcatctacatgccctgcgtctatgttgttaataaaattgatcaaatcacagttgaagagcttgaagttcttgacagattgcctcactattgtcctgtcagtgctcatcttgaatggaacctggatggacttttagataagatttgggagtacttgaatcttattcgagtatataccaaaccaaagggcaacagccctgattatgaagatcctgtcattctgtcagcagagcattgcacagttgaggatttttgcgagcggattcataaggatatggtgaagcaattcaagtttgccttggtctggggttcaagtgcaaaacataaaccgcagagagttggaaaggagcacacactggaggatgaggatgttgtccagattatcaagaaggtgtaacatatttcctcgagttggatgtactagtcagaaatttaacagtttgccttaacagtctcaggaaggttccagaagatctaccatcgtgagatacctgccactcgaagaattattatcttgcagttaggaaggggagattaccgaaatcagttggggcttatttcggtaccaaatagaaatcgctgagttttcagaatgatcttgaaggtagcatagggttgattagtgctttcacgattgcagtcttattggcacactggtttcgtgtctgctcaacggttattagtcaaacaaaatagttgtgagtattaggatagatggcaagacatcaccttacttttctctccctacagttttgtagcttaggtgaaatgtgcattgaatagttggtttggtcggataaagttggtgtctcttagggaaaaggtgctgatattgactgttcctttgtggaggcaaagtgactacgttgggacaatcttgtgttgttaattatc

SEQ ID NO: 7766 - DNA, 1211 bp, Festuca arundinacea
catcttggcggtctgaaggctaaacttgcaaaattgcgacgggagttgcttactcctacaaccaaaggtggtggcggtgctggtgagggattcgacgtgacaaaaagtggagatgcacgtgttggtttggtgggctttccttctgttgggaaatcaacgttgttgaacaagttgacaggaactttttcagaggttgcatcctacgagttcacaactttaacatgcattcctggagttattatgtacaaaggagctaaagttcagcttctagatcttccgggaatcattgaaggagctaaagatggaaagggtagaggtaggcaggttatcagcacagctaggacatgcaatgtgattctgattgttcttgatgccataaaaccaattacccacaagcgtctcattgagaaagagctcgaggggtttggcatccggttgaacaagacaccccccaatatgacgtttaggagaaaagaaaagggtggcatcaatttcacatcaacagtagcgaacactcacttggaccttgacacagtaaaagcgatctgtagtgagtacaggattcataatgctgatgtctcccttaggtttgatgcaacagcagatgatctcattgatgtgatcgagggaagtagaatttacatgccttgcatctatgtcgttaacaaaattgaccagatcacagttgaagagctggatatcttggacaaacttccccattactgcccaatcagtgcccatcttgaatggaaccttgatggacttctagagatggtctgggaatacctagatcttgttaggctgtacacaaaacccaaaggtctaaacccagactatgaggaccctgtgatcttatcaaccaagaggaaaacagtggaagacttctgcaaccaaatccacaaggacatggcgaaacagttcaaatacgcgctggtgtggggttctagcgttaagcacaagcctcagagggttggcaaggagcatgagcttgaggacgaggatgttattcagatcattaagaagatatagtcacactccgtggagcgagcgaatcttttttgcaaaccaggaaggagctatcagctatgaatctttttgagaagcagctatgttagaagaacttgtgtttctttcgctggctatatgatgcccataggtggcggctgttcgcataaatcctgtttcgatgaaaagacaattgtagacagttt

SEQ ID NO: 7767 - DNA, 1219 bp, Flaveria ramosissima
cacttgggattattgaaggctaagcttgcaaaattgagaagggagcttctcacacctacttcaaagggaggtggcggtgctggtgaaggttttgatgtgacaaaaagtggtgatgcaagggttggtcttgtcgggttcccttctgttgggaaatcaacactgttaaataagctaactggcactttttcggaggttgcttcatatgagtttactactctcacctgcatcccaggcgttatcacataccgaggagctaagattcagttgttggatcttcctggtattattgagggtgctaaagatggaaagggtagaggaaggcaggttatcagtactgccaggacatgcaactgtattctgattgtgctggatgcaataaagccaataacccacaagcgtctaatcgagaaggagcttgaagggtttggcattaggttaaataaggagcccccaaatctcacattcaggaaaaaagagaagggcgggattaattttacatcaacagtagctaatacacatctggaccttgaaacagtgaaagcaatatgcagcgagtacaagatacataacgctgatgtcactcttaggtttgatgcaactgctgatgatctcatagatgttattgaagggagtaggatatatactccttgcatctatgttgtcaacaaaatagatcagatcacacttgaagagctggaaatattggataaacttcctcactactgccctgttagtgctcacttggaatggaatcttgatggcctgctagagatgatatgggaatatctgaatttgactcgtatttacacaaaacccaaagggatgaatccagactatgaggaccctgtaattctttcatccaaaaagaaaactgttgaggatttctgtataagaatccacaaggacatgcttaagcaatttaagtatgctctggtctggggttctagtgcaaaacacaagccacaaagagttggcaaggaacatgagcttgaggatgaagatgttgtgcagatcattaagaaagtttaaaaataagaccaccaaatctcttgctccatttttgagtgttgaatcatctggtagcaattatagaagtctatccatgttaccaatgtgttgaggtggctaagaagcaggtaaggtttatcaatgaatggtttctttagcttagtgtttgtactggatgctgatgtgtgtctaaacattagtagtgcaaaga

SEQ ID NO: 7768 - DNA, 1520 bp, Chenopodium quinoa
tccagaactctctcttcatacaatcgccttgaactaggattatcaaacacattctttgaagaaaaaactcccttgattcagcaaaaatggcgactgttatgcagaaaatcaaagatatcgaagatgagatggcaaggacccagaagaataaagctactgccaatcatcttggattgttgaaggctaaacttgctaagctacggagggatcttttgacacccacctcgaaaggaggtgggggtgctggtgaaggctttgacgtaacaaaaagtggagatgcacgagttgggttggttggctttccatcggttgggaaatcaacattacttaataagttgactgggactttctctgaggttgcttcttatgagtttactacattgacttgcattcctggagtgataatgtacagaggagctaagattcagctgttggacctaccaggtatcattgagggtgccaaggatggaaaaggtagaggaaggcaggtcatcagcactgcaaggacgtgcaattgcatattaattgttcttgatgcaataaagccaataactcacaagcgtcttatagaaaaggagcttgaaggctttggcattaggttgaacaaggaaccccccaatttaagtttccgaaagaaagaaaagggtggtattaatttgacctcaacagttaccaacacacatttggatctagatacagtgaaggcaatatgcagtgaatacagaattcacaatgctgatatcactcttagatttgatgcaactgcagacgatcttattgatgttattgagggaagtagagtttatatgccgtgcatatatgtcataaacaaaattgatcagatcactctggaagagttggaaattctggataaacttcctcattactgcccaattagtgctcatctagaatggaaccttgatggtttgctggagaaggtctgggagtacctgaaccttactcgtatttacacaaaaccaaagggtttgaatccagattataatgaccctgtcatcctttcatctcggaagagaactgtggaagatttctgtgagcgaattcacaaggatatggtcaaacaattcaagaatgctcttgtctggggatctagcgtgaagcacaagcctcaaagagttggcaaggaacatgaactcgaggatgaagacgtggttcaaatcatcaaaaaagatctaactgagcctggcattcataattttaaacaattgacgaccagcataattccgaagaaatttttgtgagagaaatattgtggcaaaaggtacagaggtgttattgatgcgtatttcagttcttttctgtgatggaggatttggctagcttgtacgttgtgttttctgcagacaaagcagagtgtttcagaatgagcatgttgataggagcgtcgttaaacctgatgttggtggcagaataatgtcataggggtacggcatatgctaccagagttcgtagaaaaatatgattttactatcattacccagcgttcctggattttgtatggg

SEQ ID NO: 7769 - DNA, 1394 bp, Cucumis sativus
atgaatggctgatagaaatggtaaatttatacaattcgtttgctttgcagatggcaagaactcagaagaacaaagctactgctcatcacttgggcttgctcaaggctaaacttgcgaagttacggagggaaatcattgcgccttcatcaaaaggaggtggtggtgctggtgaaggttttgatgtcaccaaaagtggggatgcaagggttggtttggttggtttcccttccgtcggaaaatctacattgctcaataaattgactggtactttttcagaggttgcttcatatgaattcactactctaacttgcataccgggtgtaattgggtatagaggagctaaaattcagttacttgatcttcctggtattattgagggtgctaaggacggaaagggaagaggaagacaggttatcagcacggccaggacatgcaattgcattataattgttcttgatgcaataaagcctattacacacaaacgtctaatagagaaagagctagagggatttggcatcaggttgaacaaggagcctcctaatctgtcgttcaggaagaaagacaagggtgggttaaatttaacttcaactgtaactactacccatctggaccttgacacggtgaaggctatctgtagtgagtacagaatccataatgctgatatcactcttaaatacgatgcaactgctgatgatctcatagatgtaattgagggtagtagaatatacatgccttgtatctatgctgttaacaaaatcgatcaaatcactgtcgaagagctggagattctggacagacttcctcactactgccctgtcagtgctcatcttgaatggaaccttgacggtttactagacaaggtatgggagtatcttgatttaactcgcatctacacgaagcccaaaggaatgaatccagattatgaagatcccgtaattctatcatctaaaagaagaaccgttgaggatttttgcagccgtatccacaaagatatgctgaagcaattcaagtatgccttggtttggggatcaagcgtcaagcacaagcctcaacgagtgggaaaggaacacgagcttgaagatgaagatgttgttcagatcattaaaaaggtgtgatccttgaattgtttatagcttcccaacttatcgggaacccttgggtgcgaatgccttcacagtctcgagtttagctttcaacaacgacatgtcacatccaaagctttttgttaggctacagtgttttattggtgatactagtactacaatcagtcagagctttgaacaatacgtagtaggaattgagcttgatatgtaattgtgccgttttttagtcaagctgagatcggtcattttcttgttttctttaatagattataaccatttcgagtgttaaaa

SEQ ID NO: 7770 - DNA, 1966 bp, Ceratodon purpureus
ctttgccatctcatcttcgatatccttgattttcatcatgacggtgccatggtgacgagctggaggagagaagcgcaaggtgggtggagtaagtggagctcatcactccttctccccactcctcttcacgcatctctcaccttcatcatctctccatctctagctccacttactccacccaccttgcgcttctctcctccagctcgtcaccatggcgaccgtcatgatgaaaatcaaggatatcgaagatgagatggcaaagactcaaaagaataaagccacctcccatcatttgggtctcctgaaggcaaaattggctaagttgcgacgagagatcctggcaccgccgtcttcgaaaggtggaggggcaggcgagggttttgatgtcactaaaagtggggattcacgggttgggctcgttggttttccctctgttggcaaatccacccttcttaacaagctcacaggaaccttttctgaggttgcttcctatgagtttacaacattgacatgtgttccaggtgttatcaaataccgagggtccaaaattcagcttctggatctcccgggaattattgaaggtgctaaggacggaaagggtcgaggtcggcaggttattagtactgcccgaacatgtaactgtattctgatcgttttggatgccatcaaacccattacgcacaaacgactgatcgagaaagagctggagggctttggcattaggttaaacaaggaaccaccaaatatgggttttaagaagaaagataaaggtggaatcagttttacatcaacagtcgcaaacactcatttggatttggaaactgtcaaagctatatgtggggagtacaagattcacaatgcagatatatccctacgtttcgatgccactgcggatgacttgattgatgtgatagaaggaaaccgcatttacatgccgtgcgtctatgttgtcaacaaaatcgatcaaatcactgttgaagagcttgaagtgctcgatagactaccccactactgtcctgtcagtgctcatcttgagtggaacctggacggtctcttggataagatctgggagtatttgaatctaacccgagtctacaccaaaccaaagggaaatagccctgattatgaagatcctgttatcctctctactggcaagactacagttggggatttttgcgagcgcatccacaaggatatggtgaagcagttcaagtttgctttggtctggggctcaagtgcaaaacataaaccacagagagtgggaaaggaacacgtattggaagatgaggatgttgttcagatcatcaagaaggtgtgatacatcacagctgatttagatgggctcgtcaaaaaatttactgattgcaattaaagtttcagaatggttctcgaagatctggcattgtaacaattaaggaggtaagattccccttcttcaagcgagcggactgaggctccaaaaaagtgtgcaccagttcctgattttggagttgcggaaacagggattcaacaagagtgtagacgagagaggtgagtatgggccggtttaggccatcggttctagattcaatccggcattgatggctgcgatctgagtgactgcggctttactcgaggtgacgcaaagagatatgagttgtgagtttactttagaagcaatatccttggggctagcacagggctggtcagtaaggaaattgtgagtattagaatggatggcagggcttcaccttagttttcccaccctacatttttgtagtctaagtgaaacgttcactgagtagttggttaaaacacaggtagttgtttttatctggagaaaggtgcttccatggagccttcctgagaaaggtaaggggtccaagttcagatgccattcaggcaatcttgtgttgatgttgaacattagcaaagcgttatgctactaatgaatttgtaaaattgtgcgagtgaattattcattctg

SEQ ID NO: 7771 - DNA, 1318 bp, Lolium multiflorum
ggtctgaaggctaaacttgcaaaattgcggcgggagttgcttactcctacaaccaaaggtggtggcggtgctggtgagggattcgacgtgacaaaaagtggagatgcacgtgttggtttggtgggctttccttctgttgggaaatcaacgttgctgaacaagttgacagggactttttcagaggttgcttcctacgagttcacaactttaacatgcattcctggagttattatgtacaaaggagctaaagttcagcttctagatcttccgggaatcattgaaggagctaaagacggaaagggtagaggtaggcaggttatcagcacagctaggacatgcaatgtgattctgattgttcttgatgccataaaaccaataacccacaagcgtctcattgagaaagagctagaggggtttggcatccggttgaacaagacaccccccaatatgacgtttaggagaaaagaaaagggtggcatcaatttcacatcaacagtagcaaacactcacttggaccttgacacagtaaaagcgatctgtagtgagtacaggattcataatgctgatgtctcccttaggtttgatgcaacagcagatgatctcattgatgtgatcgagggaagtagaatttacatgccttgcatctatgtcgttaacaaaattgatcagattacagtcgaagagctggatatcttggacaaacttccccactactgcccaatcagtgcccatcttgaatggaaccttgatggacttctagagatggtctgggaatacctagatctggttaggctgtacacaaaacccaaaggtctaaacccagactatgaggaccctgtgatcttatcaaccaagaggaaaacagtggaagacttctgcaaccaaatccacaaagacatggcgaaacagttcaaatacgcgctggtgtggggttctagcgttaagcacaagcctcagagggttggcaaggagcatgagcttgaggacgaggatgttattcagatcattaagaagatatagtcacactgggtggagagagcgatcttttttgcaaaccaggaaggagctatcagttgcagatattttcgagaagcggctatgttagaagaacttgtgtttctttcgctggctgtaagatgcccataggtgggcggctgttcgcataaatcctgtttcgatcaaaagacagaatgtagacagtttccttttcccttgtacgaagtagacgtgtaactgtgatgtgtgtgacagatggataaaccaagagtcttgccctcaacggccgaacacatgaaaagatgattgtctatctttagaa

SEQ ID NO: 7772 - DNA, 1284 bp, Brassica napus
gagatggggaggacacagaagaataaagccaccgctcatcatctcggtttgttaaaggccaaacttgctaagctacgaagggacctacttgcaccacctaccaaaggtggtggcgctgctgctggcgaaggttttgatgtcactaaaagcggagattctagagttggacttgttggttttccttccgttggcaaatctaccctcttgaacaagctcaccggaactttttccgaggttgcttcttatgagttcacaacattaacatgcattcccggtgttattacataccgtggagctaaaattcagttattagatcttcctggtattatcgagggtgccaaggacggaaaaggtagaggacgacaggttataagtactgctaggacttgcaactgcatcttaatagttcttgatgccataaagccaattactcacaagcgtctcattgaaaaagagctcgaaggtttcggaataaggttgaacaaggagccacctaaccttacattcaggaaaaaagacaaaggtggtatcaatctaacgtctacagtcactgccacccaccttgacctcgacactgtaaaggcgatctgcagtgagtacaggatgcacaacgctgacatcactctgcgctacgatgccaccgctgatgacctcatcgatgtcatcgagggcagtcggatctatatgccctgtatctatactatcaacaagatcgatcaaatcaccctcgaggaacttgaaattttggacaaacttcctcattactgtcctatcagtgcgcatctggagtggaatcttgatggtcttctcgataagatatgggaatacttgaatctaacccgaatctacacaaaaccaaaggcaatgaatccggattatgatgaccctgttatcttgtcttccaagaagcggactgttgaggacttctgcatccggattcacaaagacatgcttaaacaattcaagtacgctttggtatggggttcgagtgccaaacacaagccacagagagttggaagggaacacgagctcgaggacgaggatgttgttcagatcgttaaaaagatttgatttcaccagccgttcatggagacgttgaaaaaccaaagttagccataatgagcgagctcattacacatagaaagaaggtttcgtttctcttcttgtacttttgtgtattattgtcttgatccagacaaaactgtctgctacttttgtcttattggataatctttttatctttttccaacgtattaactatgtgattgtgaggttcttagaaag

SEQ ID NO: 7773 - DNA, 1401 bp, Brassica napus
gggaggacacagaagaataaagccaccgctcatcatctcggtttgttaaaggccaaacttgctaagctacgaagggacctacttgcaccacctaccaaaggtggtggcgctgctgctggcgaaggttttgatgtcactaaaagcggagattctagagttggacttgttggttttccttccgttggcaaatctaccctcttgaacaagctcaccggaacgttttctgaggttgcttcgtatgagttcacaacattgacttgcattcccggtgttattacataccgtggagctaaaattcagttattagatcttcctggtattatagagggtgccaaggacggaaaaggtagaggacgacaggttataagtactgctaggacttgcaactgcatcttaatagttcttgatgccataaagcccataactcacaagcgtctcattgaaaaagagctcgaaggattcggaataaggttgaacaaggagccacctaaccttacgttcaggaaaaaggacaaaggtggtatcaatcttacgtctacagtcactgccacccaccttgacctcgacactgtaaaggcgatttgcagtgaatacaggatgcacaacgcagacatcactctgcgctacgatgcaaccgctgatgacctcatcgatgtcatcgagggcagtcggatctatatgccctgtatctatactatcaacaagatcgatcaaatcaccctcgaggaacttgaaattttggacaaacttcctcattactgtcctatcagtgcgcatctggagtggaatcttgatggtcttctcgataagatatgggaatacttgaatctaacaagaatctacaccaagccaaaggcaatgaatccggattatgatgaccctgttatcttatcttccaagaagaggactgtcgaggacttctgcatccggattcacaaagacatgcttaaacaattcaagtacgctttagtatggggttccagtgccaaacacaagccccagagagttggaagggaacacgagctggaggacgaggatgttgttcagatcgttaaaaagatatgatttccctaatagttcatggagaagttgaaagaccaaagttagccataatgagctcattacaaataggaagaaggtttggtttctctgcttatcttcttcttgtactcctgtgtgtattattttctgatccagataaaaacggtctgcaccttattgtcttattggataatctttttttctttttccaacgatagcatgtgatgtgaggtcttgagacatttagaaaattggtttggttcggttgtgctagttcagaatattaaggtattttggtggcaaattgcaataaataacatgaaagcttaaaatcttagaattacggtttagaattacgaa

SEQ ID NO: 7774 - DNA, 1406 bp, Eschscholzia californica
ggtttgcttaaggcaaaacttgcaaagctgcgacgggatctccttgctcctccaacaaaaggaggtggaggtggtgctggtgaaggctttgatgttactaagagtggggattcaagagttggtcttgtaggattcccttcagttggaaaatcgacgcttctgaataagttaactggaactttctcagaggttgcgtcatatgaatttactaccttaacttgcattcctggtgtaatcacgtatagaggagctaaaattcagttactagatctccctgggattattgagggtgcaaaagatggaaagggtagaggaaggcaggttatcagtactgctaggacatgcaactgtattttgattgtcctggatgcaataaaaccaataacacacaagcgtctaattgagaaagagctcgaggggtttggcataagattaaacaaggaaccacccaatctatccttccgcaggaaagacaaaggtggaataaatttcacatcaacagcaacaaacacacatcttgatcttgaaactgtaaaggctatatgtggtgaataccgtattcataatgctgatatctcccttcggtatgatgcaaccgctgatgatctcatcgatgttattgagggtagtagggtttatataccctgcatctatgttgtcaataagatagaccagattacacttgaagagctggagattttggacaaacttcctcactactgcccaatcagtgctcacctggagtggaatctggatgggctactagataagatatgggaatatcttgacctaactcgtatatacacaaaaccaaaggggatgaatccagattatgaagatccagtaattctatcatccaagaagagaactgtagaggatttctgtactcggattcacaaagatatgctcaaacaattcaagtatgcattggtttggggttcaagtgcaaaacacaagccacaaagagtgggaagggaacatgaactcgaagacgaggacgttgttcaaatcatcaaaaaggtgtgagtattaaacgacgaggaaaattcaaggaccccacaaaaggtattagtataagtgaaggaaactctgttgctgagtcaggaagatgaacaatttgagttcagcatccatacaactactattttcccaaacttaagtaatgttgaagcaggttccgtgtttgtttagtttaaaaacattacaaaacgaaaactgagtgatgatgtataagctagttagatggtttttgtgtatacttgcatgtgttaagccctaaattttagtgtggtgagaaaaatcattaataagttgaattttgtaggacttgaaattatgctagtttcggcatgggttcttgtgatttatcaagtagttacttggggctttagtgctacgagtacgtg

SEQ ID NO: 7775 - DNA, 1351 bp, Orobanche aegyptiaca
ctgggattgctgaaggcgaaacttgcaaaacttcggagggaaattctcacaccagcatcgaagggaggtggtggtgctggagaaggctttgatgttacaaaaagtggtgattcaagagttggcctggttggtttcccttcagttgggaaatcaacactcttaaacaaattaactggaactttttcagaggttgcttcatatgaattcactactctaacttgcattcctggtgtaatcacatatcgaggcgcgaaaattcagttgctggatcttcctggaattatcgagggtgccaaagatggcaagggtcgaggtagacaggttatcagtacagctcggacatgtaactgcatcctgattgttctggacgctataaaaccaattactcataaacgtttaatagagaaagagctcgagggatttggtataagattaaacaaggaaccaccgaatctcagtttccggaggaaagataaaggaggaatcagtcttacatctacagtggctaacacccatcttgacctcgagacagtaaaagcaatttgtggtgaatatcggatacacaatgctgatatcaatttaagattcgatgcaacagctgatgacctcatagatgtcattgagggcagtagggtatatatcccttgcatttatgtcgtcaataagattgatcagatcacgctcgaggagctggagattttggacaaacttccacattattgcccaatcagcgctcacttggaatggaatcttgatggtcttctggagaaagtatgggaatatcttgatttaactcgtatatacacaaagcccaagggattgaatccagactacgaagatcctgttatattgtcatcgaagagaaggacagttgaggaattctgtaatagaatccacaaggacatgctaaaacagtttaaatatgctttggtatggggttcaagcgtgaaacacaagccccaaagggttggtaaggaacacgaactggaagatgaagatgttgtccaaatcatcaaaaaggtgtaaatccggaactccaatccatcaggtcactacctaatgcaggtggtttgagtattgaagcagtgaagctcagaaatttatcacgcgtgcatgatttgtttaccgagtttatggctgttggatatgagaagtagacggtgtgatgtgtattttaatgcttgatggtatttttatgctagttcaaccactaatagattttgagggtctcttgtgtcattgtttaacaattttggttttaaatatggtgtggtggaataactagggatatcttgtttgtatgaaggcaattcatcaaagttccgcctagcaagtatgaaaaatgttgcct

SEQ ID NO: 7776 - DNA, 1078 bp, Malus domestica
aagcatttgagcagaatccattacaggccgactaaacctttcctctgtttcggagctagcgtgcttcaacaatggcgactctgatgcagaaaatcaaggatatcgaagatgagatggctaggactcaaaagaacaaagctactgcccatcacttgggtttgctgaaggctaaacttgcaaagctaaggagagatctacttgagcctccatcaaaaggcggtggcggtgctggtgaaggttttgatgtcactaaaagcggagatgcaagagttggtttggtgggtttcccttcagttgggaaatctacactgctgaataaattaactgggaccttttcagaggttgcttcctatgaattcactactttaacttgcataccaggagtgattgtgtatcgaggtgcgaaaattcagttgttagatctccctggaattattgagggtgctaaggatggaaagggtagaggaagacaggttatcagcactgctaggacgtgcaattgcattttaattgttcttgatgcaataaagccaataactcacaagcgtctaattgaaaaagagctcgagggatttggcataaggttaaacaaggaaccacctaaccttacattccggaagaaagataaaggtggtatcaatttcacttcaacggtacaaacacacatctggatcttgaaactgtgaaggcaatatgcagtgaatacagaattcacaatgctgatatcactcttaggtttgatgcaactgccgatgatctcattgatgttattgaaggcagtaggatatatatgccttgcatctatgttgtgaacaagattgatcagattacacttgaagagcttgagattttggataaacttcctcactactgtcctgtcagtgctcacctggagtggaaccttgatggtttgctggagaaaatatgggagtatcttaatttaactcgcatatatacaaaacctaaagggatgaatccagactatgaagaccctgtgatcctatcatctaagacaaggaccgttgaggatttctgcgaacggattcataaagattttatcaaacaatttaagtagcaa

SEQ ID NO: 7777 - DNA, 990 bp, Platanus occidentalis
ggattgcttaaggctaaacttgcaaagctaagacgggagctccttgcactccatcaaaaggaggtggtggtgctggtgaagggtttgatgttactaaaagtggagattcaagagttggtcttgtgggattcccatcagttggaaaatcaactcttcttaataagttaactggaactttttcagaggttgcttcttatgaatttactaccttaacttgcattccgggtgtgataacatatagaggagctaaaattcagttattggatctccctgggatcattgagggtgcaaaggatggaaagggtagaggaaggcaggttatcagcacttctaggacatgcaattgtattttaattgttcttgatgcaataaaaccgataacccacaagcgtctgatagagaaagaacttgagggatttggcatcaggttaaacaaggaaccacctaatctgtcttttaggaagaaagataaagggggaattaattttacatcaacagtgacaaacacacaccttgaccttgaaacagtgaaggccatatgtagtgaatacaggattcataacgctgatatctctcttcggtatgatgcaactgccgatgatctcatagatgttattgagggtagtagggtatatatgccctgtatttatgttgtgaacaagattgatcagataacatttgaggagctcgagattctggacaaacttcctcactactgtccaatcagtgctcacctggaatggaaccttgatggcttgctggaaaagatatgggaatatcttgacctaactcgcatatacacgaagcccaaggggatgaatccagactatgaagacccagtaatcttgtcttccaagaagaggactgttgaggacttctgcgagcgtattcataaagatatgctgaaacaattcaagtatgcattggtttggggatcaagcgtgaaacacaagccccagagagtgggcaaggagcatgaacttgaagacg

SEQ ID NO: 7778 - DNA, 1575 bp, Momordica charantia
aagaacgaagctactgctcatcacctgggcttgctcaaggctaaacttgcaaagttacggaggggaactcattgcgcctgcgtcaaaaggaggtggtggtgctggtgaaggatttgatgtcaccaaaagtggtgatgcaagagttggtttggttggtttcccttcagtcggaaaatctacactactaaataaattgactggtactttttcagaggttgcttcatatgaattcactactctaacttgcatccctggtgtaattgggtacagaggagctaaaattcagttactggatctccctggtattatcgagggtgcgaaggacggaaagggaagaggaaggcaggttatcagcactgccaggacatgcaattgcattataattgttcttgatgcaataaagcctattacgcacaagcgattaatagagaaagagcttgagggttttggtatcaggttgaacaaggagcctcctaatctatccttcaggagaaaggacaagggtgggattaatttgacgtcaactgtagctaatacccatctggaccttgacacggtgaaggcaatctgtagtgaatacagaatccataatgctgatatcactcttaaatatgacgcaacagctgatgacctcatagacgtgattgagggtagtagaatatacatgccttgtatttacgctgttaacaaaattgatcagattaccctagaggagctggagattctggatagacttcctcactactgcccagtgagtgctcatcttgaatggaacctagatggtttactggataaggtatgggagtatcttgatttaactcgcatctacacgaagcccaaaggaatgaatccagattatgaagaccctgtaatattgtcatctaagagaaggactgttgaggatttttgcagccgtatccacaaagacatgctgaagcagtttaagtatgctttggtttggggatcaagtgtcaagcacaagccccaacgagtgggaaaggaacatgagcttgaagatgaagatgttgtccagatcattaaaaaggtgtgatcgttgaagtaaaaaatgtttgtaatcttttccagcctacaggaaatccttagatgcgaatggcctatttacgaacacacgagcgaagctttccatgatggcatatcacatccaaagcttttggttaggatacggggtgctttagttcaagtactaccttcagttggagcattggacattcagtaggaactgagcttgacatgtaagttgcgtcgttttgttgtcgagctaagaacagttcattttgctttatatattattttttcgttcaagagattataactgattgagtgttcaactgaatgttgttagattgcacatttatgttccagtaatagtaagctgtacaacaccgcgtcgcagtgttacaagagttagagcagttagtactgctacttcgtccataataacctcctacttttcggacatttgctgggttttgattttgttgattttgttaggagaaactgggatttcattgatgaatgaaatatataaagcttgggaaagcattaggtagggac

SEQ ID NO: 7779 - DNA, 1377 bp, Gnetum gnemon
gagaagagagatacttgctcctcctaacaaaaggaggggtggtggaggagagggttttgatgttacaaaagtggggatgctcgtgttggtcttgtgggctttccctctgttggaaaatcaactcttttaaacaagttgacgggaactttttctgaggttgcttcgtatgaattcaccactctaacatgcattcctggtgttattcgctacagaggtgcaagaattcagttgttagatcttccaggaatcattgaaggtgcaaaggatggcaaaggaagaggaaggcaggtgatcagtaccgcaaggacttgcaactgtattttaattgttctagatgccattaagccaattacccacaagcgtcttatagaaaaggaacttgaaggctttggcattaggttgaacaaagagcctcctaatttgacatttaggaagaaggataagggtggaataaatttcacttcaactgttgccaatacaaacctggaccttgagacagtgaaagcaatctgcggagagtatagaatgcataatgctgatatatcgcttcggtatgatgccactgcagatgatctcattgatgtgattgaaggtagccgaatatacacgccttgtatttatgtggtcaataagattgaccagatcacacttgaggagttggagatcttggacaaactacctcattattgccctgtcagtgcccaccttgaatggaacttggatggtcttttagaaaagatatgggagtatttagatcttactcgcatctacacaaagccaaagggaatgaatccagattatgaagatcctgtgatactctcatccaaaaagcgaactgttgaagacttttgtgctcgtattcataaggatatgttgaaacaatttaagtatgccttagtgtggggatccagtgcaaagcacaagccacagagagtaggaaaggaccatgaactggaagatgaggacgtggtacagatcattaaaaaaatatgagtttttattttatcaagtttagcagttatgtgcatctgagctgtctggacgtacttctgtatatgttacataggaatttacttaaactggtttgattatatgttcaaacaatttcagaaactatatagaaaagtccattgtatgttctatattttgaaacagtggatatggtttctgatggtagctaatttagaacagttattagttttaagtagatgttcaaaggatttcagatattctgtagaaatctatcgatgtcattgattttgactgaacttcagaataccatcaaacttccatgactggagcttcatacaatggatgtttctgcagcaaaattttggtagttttggcagatatgcaatgtaacttattaagattcag

SEQ ID NO: 7780 - DNA, 1355 bp, Cedrus atlantica
gagaaatccttgctcctcctacaaaaggaggggaggtgctggtgaaggctttgatgttactaaaagtggagattcccgagttggacttgtggggtttccatcagttggaaagtcaactcttctgaacaagttgacaggtaccttctctgaggtggcatcatatgaattcaccactctaacttgcattcctggtgttattcgctacagaggtgcaaagcttcagttactagaccttccaggaatcattgaaggtgcaaaagatgggaagggaagaggaaggcaggttatcagtactgcaagaacatgtaattgtattttaatagttctggatgctatcaagcccattactcacaagcgcataatagaaaaagagcttgaagggtttggaatcaggttgaacaaggaacctcctaatttgacatttaggaagaaggacaagggtggaataaatttcacgtctactgtggccaacacacacctggaccttgagactgtcaaggctatttgtggagaatacagaattcataatgctgatatatcccttcgttatgatgcaactgcagatgaccttatagatgtgattgaaggtagtcgcatatatatgcctggcatttatgttgtcaacaagattgaccaaataactctagaggaattggagattttggataaactgcctcactactgcccaatcagtgctcacttggaatggaatttggatggtctactggagatgatatgggagtacttaaatttgacccgaatctatacaaagcctaaggggttgaatccagactatgaagatcctgtgattctttcatccaaatcacgaactgttgaagatttttgtactcgaattcacaaggatatgttgaagcaatttaaatatgcattggtatggggttccagcgcaaagcacaaaccacagagagttggaaaggatcatgaattagaggatgaggatgtagtgcagattataaagaagatataacataggggtattctctgcttcatgaaatctagtgttcctcttttccccatcttaatatatgtcaatgagccagagctgggggttttgatcattgttgtgtaacataagattctggaaatgctgtagatgttgacaagctctgttgggcggtcttcacttgagagattgtcacaaggactactgactttgtatttcaaaggttactatgttatggaagcttatccatattgcatgtgtgtaaagtttgttcattgagatatactggcttacgttgttgcagaaaccagtctcgcctagattgctttaaaatatgtgcttgccttaagaattttacatattttaaatgtgcatggctcaagtgattatg

SEQ ID NO: 7781 - DNA, 3224 bp, Brachypodium distachyon
cctcataaaccctaactcccaggtgcaaaaccacccgcttcgccctctcacgccgccggcgccgcccggccgccatggtgaaggcctacctccgctacgagccggccatatccttcggcgtggtcgcctccccggagtccaacgtcgtctacgacccctccggccgccgcctcctcgccgccgccctcgatcgcttcgccgcctgggaccccaagcgcggcctcccttcctccatcttcacccctgcttcctcctccccctcactcgccgtctcctgcatcgcgtcctccccctccgccgcctccgcctccgcttcctcgattgcgagtggccatgcggatgggagcatcaggctgtgggacgcggagactggcgcctgcgaggcgacgctccatggccaccgctctgctgcttccgccctccgcttcagtccctcgggtgccgtgcttgcctccggtagcaaagactgtgatgtcatcctctgggacgtcgttgcacaggccggcctcttcagactccgtggccaccgtgatcaggtaacggatttgttgttcctggattcgggtaagaagctagcgacctgctccaaggacaagttcatccgggtctgggacctcgacacgcagcactgccttcagattgtaggtggccaccacagtgaggtatggtcgatggatgttgatcccagcgagaagtttttggtgtctgggtcggctgatccagagctacgggtgtttagagtcaggcaatcagctgaagatggtgaagattggaacaagtgggatgtgctgaagctatttggcgagattccgaggcagaccaaagaaagggttcagaccattaggtttaataaggacggcagccttgtagcgtgccaggtggcagggaaaactgcagatatttatcggattcttgatgaaacagaggcgatacgaaaggccaagaggcggatgcacaggaagaaggagaaggctttggcaaaagctgtgactgcggaagggaatggtactgttatagatcctttgccagctcaagattcgcagaatcccactgttgtcgtcactgatgtatttaagcttctccaagttttgcgtgcgagcaagaaaatttgctctgttgcattttctccaagcaacccaccaaaaggctgccttgcgtctttgtctttatctctgaacaataatgtgctcgagacatactcagtggataacgagaaggtctctaagacgcactcaattgagatacacgggcatcgttctgacattaggagtctcgcgcttaactcagaggacaacctcttgatgtcaacaagtcacaatgctgtgaaaatttggaatcctagtaccggggactgtcttcgaaccattgactctgattatgggttgtgcagtgcatttgttcccgggaatcggtacggccttattggtacaaagagtggtactctggagattattgatatcaacagtggtaacttaattgatgtaatagaagctcatgctggttccatacggtcgattgtactcatcccagatgaggatggaactgttagtgcacggggtttcgtcactgggagtgctgatcatgatgtgaagttctgggaataccaattggtgcagaaatctgatacggactctaagcacctgagtgtaacaaatgtgagaaccttgaaaatgaacgatgatgtccttgcagtgtccattggtccaactggaaagcatattgccgttgctcttttggattgcacagtgaaggtcttctttgtggacacactaaagttttgtctttccctttatggccacaagcttccagttctctgcatggacatatcgtctgatggagctctaatagttactggttcagcagacaaaaatctgaagatttggggcatggatttcggtgactgccataaatctatctttgctcatacagatagcgtgatggatgttaagtttgtttatagaactcattatatgttcagtgtggggaaagaccgcactgtcaagtactgggatgctgataaattcgagttgttgttaacacttgaggggcaccatgctgaagtttggtgccttgcgattagcagtcgtggtgattttattgtaactggctcacatgatcgttctattcggcgttgggatcgtactgaagaacaacttttcattgaggaagagagggagaaaagattagaggaaacttttgaggccgatctagacaatgcaatcgaacataggcatgggcagaaagatgatgctcccgatgagggttctgtgggtgttcctggtaggaaaacaaaagagacagtaactgctgctgatgcaattattgacgctcttgacactgccgaggaagaagaaaagcgcctaaatgagctcaaggaagagcaaagcaacgctgagcgagctaaatcgcaacctaatgttataatgcaagggcagtcaccatccgattatgttctgaatgcagtttcaaatgtccgcccaaatgacttggaacaagccctcctctcattgccattctcagatgcattaaagctcatggcttacttgaaggagtggtctctgattcctttgaaggtggagctcacctgtagggtttgcctagttctgcttcaaacacatcataaccagttaactagtacaccagcggcaagatccatattgacagaactgaagggcatcctttacggcagagtaaagggctgcaaggatactataggtttcaatctggccgccatggatcacataaaagaactgttggccatgagatcggacgcgccgttccgagacgccaaggcgaagctcatggagatcaggcaggagcaatcgaagcggtcagataggtcggacgggaccgagaggaggaaaaagaagaaaccgaaagcgtccacgcagagctgagcgcttgggctagtgccagagcaaaattttgtacgttttggctcaattgttgtagcatacatacactctgttaacgtgctcatttcgtgctgtcatgagcacagcagaattttgacagctgagtgttaaaataggaatgcgccttcgctccagagccgcgtgtgctctccgattgcacgtgaaatgacgtgaatcctatcaattttagcacacattcttgtcactactcggcctaactcgttagacggctcggggacatgagaacaaggaatttacagatgtgcgaaggtgagaattatattaaatgcaagtattataatgttagta

SEQ ID NO: 7782 - DNA, 3151 bp, Setaria italica
ccaagagctgtgcgcccactccaccccaccccacgccgccggcggccgccgcccgccatggtgaaggcctacctccgctacgagccggccgtcaccttcggggtgattgcctcaccggagtccaacgtctgctacgacccctccggccgcctactcctcgccgctgccctcgaccgcctcgccgcctgggacctcaagcgcggtctcccctctgtctcctttgcaccctcctcctcctccccctcgctcgccgtctcctgcatcgcctcctcccaatccgccgccgtctcctcctcaattgcgagcgggcacgcggatgggagcatcaggctgtgggacgcggagaaaggagcctgcgaggcaaccctccacggccaccgttccgctgcctccgccctccgctttgccccctccggcgctgttctcgcctccggcagcaaagactgcgatgtcatcctctgggacgtcgttgctcaggccgggctcttccgcttgcgtggccaccgggatcaggtcaccgatttggtgttcctggattctggtaagaagctggtgagctgctccaaggacaagtttatcagggtttgggaccttgaaacacagcactgtctccaaatcgttggtggtcaccgcagtgagatttggtctatggatgtggatcctagtgagagatttttagtgtctggctctgctgatccagaattgcgagtgtttagaatccggcaatcagtagaggagggtgaggattggagcaagtgggatgtgctgaagctgttcggtgagattccgaggcagagcaaggaacgagtggcaactgttaggtttaataggaacggtagtcttgtggcatgccaggtggctgggaagacagcagatatttatagggttcttgatgaaacagaagctacaaggaaggccaaaaggcggatgcataggaagaaggagaaagcatcggcgaaatccatgatagccgaagggaacggtactgtcattgatcctttaccagctcaagacttgcaaaatccagctgttatcgtcaccgatgtatttaagctccttcaagttttgcgggcaagcaagaaaatatgttcgatttcattttctccaagtaatccaccaaaaggctgccttgccaccttgtctctatctctcaacaataacacgcttgagacatattcagtggatagtgagaaggtctcgaaaatgtactcaattgagatgcacggacaccgttccgacattaggagtgtctcccttaattctgaggacaacctcctgatgtcgactagccacaatgctgtcaaaatttggaatcctagtacaggggactgccttcggaccattgactctggatatgggttgtgcagtgctttcgttggaaatcggtttgctcttgttggtacaaaaagtggtactttggagattattaatattgctagtggcagcttaactgaggtgatagaagcgcatgcgggttcaatacgatcaattgtacctattccagatgaagatggaactgtcggtgcacggggatttgtcactgggagtgctgatcatgatgtcaagttctgggaataccaactgttgcagaagtctgataatgactccaagcagctgactgtgactaatgtgagaaccttgaaaatgactgaagacgtccttgctgtctccatcagtccacaaggaaagcatattgctgttgctctcttggattgcaatgtcaaggtctttcacatggacacactgaaacattttctaaacctttatgggcacaaacttccagttctctgtatggacatatcatctgatggggctttgatagttactggctctgcagacaaaaatttaaagatttggggtatggattttggggactgccacaggtctatatttgctcattcggacagcgtgatggatgttaagtttgtatatagaacacattatatgttcagcgtgggaaaagatcgcactgtgaagtactgggatgctgataaatttgagttgttgttaacacttgaaggacatcatgctgaagtatggtgcctcacaatcagcagtcgtggtgattttattgtaacaggttcccatgatcgctccattcggcgctgggatcgtactgaagaacaactgttcattgaggaagagaaggagaaaagattggaagaaacctttgaggctgatttagacaatgataatgagtatagatacgggcagaaagatgatgctcctgatgaaggttctgtgggtgttcctggtaggaaaacaaaagagacagttacttctgctgatgcaattatggatgcccttgacactgctgaggaagaagtaaaacgccttaatcagcataaactggaagagcaaaataatgggagggcagctagatttcaacctaatgtcataatgcaagggcattcaccctcagattatgttctgaatgtagtttcaagcatccgcccaaatgatttggaacaggccctcctggcattgcctttctcagatgcactaaagctcatgtcttacttgaaggagtggtctctggttccttcaaaggttgagcttgtttgtagggtttgcttagtgctccttcagacacatcataatcaactaactactacgccagctgcaagatccttgttgacagaactgaaggatattctttactgcagagtaaaggaatgcaaggatactataggcttcaaccttgccgcgatggatcatttgaaagaattgttggcaatgagatcagatgcacctttccgtgatgcaaaagcgaaactcatggagatcaggcaggagctgtcgaagcggtcagataggcctgatgggaacgagagaaggaaaaagaagagaaagaaggcttctggagaaagttgagccttgggcatggcaaagcagaaaaagaatattgtattgttgtgctctagtgttgaacgtgctcgtttccttggttcacgagtgcgcagtttttttgatagacgagtgtaatcagacagaacgtgctcgtttccttggttcacgagcatggacataaagatcgttttatgagcaatcagttttggtcattcatgttcaatttagtcctagaccttacaaagggtaaggttcatctaatctcgtccattccatctaactacgaccacgtgtgatcctt

SEQ ID NO: 7783 - DNA, 3213 bp, Hordeum vulgare
actcgccctcactaaaccctaacccccacaactactcccccctcccacgccgccggcggccgggagccatggtgaaggcctacctccgctacgagccggcgctctccttcggcgtggtcgcctccccggagtccaacgtcgtctacgacccctccggccgccgcctcctcgccgccgcgctcgaccgcttcgccgcctgggacctcaagcgcggcctcccctccgccaccttcaccccctcctcctcctccgcctccctcgccgtctcctgcgtcgcctcctcccccgccgctgcttccgcctccgcttcctcgattgcgagtggccatgcggatgggagcatcaggctgtgggatgctgagacgggcgcctgcgaggcgacgctccacggccaccgctctgctgcttccgccctacgtttcgctccctcgggcgccgtcctcgcctccggcagcaaggactgcgatgtcatcctctgggacgtcgttgcacaggccggcctcttccgactccgtggccaccgtgatcaggtaactgatttactgttcctggattcgggtaagaagctggtgacctgctccaaggacaagttcatccgggtctgggacctcgacacgcagcactgccttcaaattgtaggtggccaccacagcgagatatggtccatggatgttgatcctagcgagaagtttttagtgtctggctcagccgatccagagcttcgggtgtttagaatcaggcaatcagtcgaagagggtgaagattggaacaaatgggatgcactcaagctgtttggcgaaattccaaggcagagcaaagaaaggattcagaccattaggttcaataaagacggcagtcttgtggcatgccaggtggcagggaaaactgctgatatctataggattcttgatgaaacagaggcgacacggaaggccaagaggcggctgcacaggaagaaggagaaggctgcggcaaaagctgcggcagcggaagggaatggtactgttatagatcctttgccagctcaagactctcagaatcccactgttgtggtcaccgatgtgtttaagcttctccaagttttgcggaccagcaagaaaatttgctctgttgcattttctccaaacaatccaccaaaaggctgccttgcgaccttgtctttgtctctgaacaataacgtgcttgagacatactcggtggataacgagaaggtgtctaagatgtactcagttgagatacatgggcatcgttctgacatcaggagtcttgcacttaactcagaggacaacctcctgatgtcaactagtcataatgctgttaaaatctggaatcctagtacaggagactgtcttcggaccgttgactctgggtatgggttgtgcagtgcatttgttcccgggaatcggtatggccttatcggtacaaagactggtactttggagatcattgatattaatagtgggaactcaattgatgtaatcgaagctcacgctggttccatacgatcgattgtactcattccagatgaggatggaactgttaatgcacggggttttgtcactggaagtgctgatcacgatgtcaagttctgggaataccagttagtgcagaaatctgattcagacacaaagcatctgagtgtaacaaacgtgagaaccttgaaaatgaacgatgatgtccttgcagtgtctatcggtccaactgggaagcatattgctgttgctcttttggattgcacagtgaaggtcttctttctggacacactaaagttttgtctttcactttacggacacaagcttccagttctctgcatggacatatcatccgatggaggtctaatagttactggttccgcagacaaaaatctgaagatttggggtatggattttggtgactgccataaatcaatctttgcccacggagacagtgtcatggatgttaagtttgttcctaaaactcattacatgttcagtgtggggaaagatcgtaccgtgaagtattgggatgctgataaatttgagcttttgttaacacttgaaggacaccatgctgaagtttggtgccttgcgattagcagccgtggtgattttattgtaacaggctctcatgatcgctctattcggcgttgggatcgtactgaagaacaacttttcattgaggaagagagggagaaaagattggaggaaacttttgaggctgatttggacaatgcggttgaagatagatatgggcagaaagatgatgctcctgatgagggttctgtgggtgttcctggtaagaaaacaaaagaaacagtaactgctactgatgcaattattgacgcacttgacactgccgaggaagaagaaaaacgtcttaatgagcagaaggagttgcaaaacaatggggagggctctaaatctaagcctaatgttataatgcaagggcattcaccatcagaatatgttctgaatgcagtgtcaagtgtccgcccaaatgacttggaacaagtccttctgtcattgccattctcagatgcactaaagcttatggcttacttgaaggagtggtctgtgatccctttgaaggttgagcttgtctgtagggtttgccttgtgctgcttcaaacacatcacaaccagttaactactacaccagctgcaagatccatactgacagaactgaaggatattctttatggtagagtgaaggactgcaaggacactataggtttcaatctcgcagcaatggatcatataaaggaactgttgacgatgagatcagatgcgccgttccgggacgccaaggcgaagctcatggagatcaggcaggagcagtcgaagcggtcggataggtcgggtgggggcgagagaaggaaaaagaagaagcccaagccgtctgtacagagctgagcaaggatctgtctgtttttactcaactgttgtagcgtatacgcaccacactgggttatcgcgttcatttcatgctgtcatgagcacagcacaattttgagagatgtgtgtgtgggccagtgttaatcggcggtttcctactagagaaacatggcgtacctccctctttttagatagtcaagatttggtcaaaccttcccttttttatgctttcagaaattgcagcatccctagctttcagaattcacctcatttagaaaaaaaatcaaagattcaaagcatttgaagtatcgaacttctggaaaggaattcaaaattttag

SEQ ID NO: 7784 - DNA, 3280 bp, Panicum virgatum
actcctacccgccgccataaaccctaacgcccggagctgcgcgcccaccccacccctcccacgccgccggcggccgctcgccatggtgaaggcctacctacgctacgagccggccctcaccttcggggtgattgcctcgccggagtctaacgtctgctacgacccctccggccgcctactcctcgccgccgccctcgaccgcctcgccgcctgggacctcaagcgcggtctcccctctgtctccttcgcaccctcgtcctcgtccccctcgctcgccgtctcctgcatcgcctcctccccctccgccgccgtctcctccttgattgcgagcgggcacgcggatgggagcatcaggctgtgggacgcggaaacaggcacctgcgaggcaaccctccacggccaccgttcagctgcctccgccctccgctttgcgccctctggtgctgttctcgcctcgggcagcaaagactgcgatgtcatcctctgggacgtcgttgctcaggatgggctcttccgcttgcgtggccaccgtgatcaggtcaccgatttggtgttcctggattctggtaagaagctggtgagctgctccaaggacaagtttatcagggtttgggaccttgaaacacagcactgtctccaaattgttggtggtcaccgcagtgagatttggtctatggatgtggatcctagcgagagatttttagtgtctgggtctgctgatccagagatgcgggtgtttagaatccggcaatcagtgcaggagggtgaggattggagcaagtgggatgtgttgaagctgtttggggagattctgaggcagagcaaggaacgagtggcaaccgttaggttcaataggaatggtagtcttgtggcatgccaggtggctgggaagacagcagatatttatagggttcttgatgaaagtgaagctatacggaaggccaaaaggcggatgcataggaagaaggaaaaagcatcggcgaaatccatgattgctaaagggaatggcactgtcattgatcctttaccagcttcagacttgcaaaatcctgctgttattgtcactgatgtatttaagctcctacaagttttgcgggctagcaagaaaatatgttcaatttcattttctccaggcagtccaagaggctgccttgccaccttgtctctatctctcaacaataacacgctcgagacatattcggtggatagtgagaaggtctcaaagatgtactcaattgagatgcacggacaccgttctgacattaggagtgtctcccttaattcagaggacaacctcctgatgtcgactagccacaatgctgtcaagatctggaatcctagtacaggggactgccttcggaccattgaatctgggtatgggctatgcagtgctttcgtcggaaatcggtttgctcttgttggtacaaaaagtggtactttggagattattgatattgctagtgggagcttaactgaggtcatagaagcacatgctggttccatacgatcaattgtaccaattccagatgaagatggcactgccggtgcacggggatttgtcactgggagtgccgatcatgatgtcaagttctgggaataccaacaggtgcagaagtctgataatgactctaagcagttgactgtaactaacatgaggaccttgaaaatgaccgaagacgtccttgctgtctcaatcagtccactaggaaagcatattgctgttgctctcttggattgcaatgtcaaggtataccacatggacacactgaaacattttctgaacctttatgggcacaaacttccagttctgtgtatggacatatcatctgatggggctttgatagttactggctccgcagacaaaaatttgaagatttggggtatggattttggggactgccacaggtccatatttgctcattcagacagcgtgatggatgttaagttcgtgtacagaactcattatatcttcagtgtggggaaagatcgcactgtgaagtactgggatgctgataaatttgagttgttgttgacacttgaaggacatcatgctgaagtttggtgtctcacaatcagcagtcgtggtgactttattgtaacaggttcccatgatcgctctatccggcgttgggaccgtactgaagaacaactgttcattgaggaagagaaggagaaaagattggaagaaaccttcgaggctgatttagacaatgataatgagtatagatatgggcagaaagatgatgctcctgaagaaggttccgttggcgttcctggtaggaaaacaaaagagacagttacttctgctgatgcaattatggatgcacttgacactgctgaggaagaactaaaacgccttaatcagcataaacaggaagagcaaaataatgggacggcagctaaatttcaacctaatgttataatgcaagggcaatcaccctcagattatgttctaaatgtagtttcaagtatccgcccaaatgatctggaacaggccctcctggcattaccattctcagatgcactaaagctcatgtcttacttgaaggagtggtctatggttccttcaaaggttgagcttgtctgtagggtttgcttagtgctccttcagacacatcataaccaattgactactacaccagctgcaagatccgtattgacagagctgaaggatattctgtactcaagagtaaaggaatgcaaggatactataggcttcaaccttgccgcaatggatcatataaaagaattgttggcaatgagatcagatgcacctttccgtgacgctaaaacaaaactcatggagatcaggcaggagctgtcgaaacggtcagataggcctgacgggaatgagaaaagtaaaaagaagaaaaagaaagcatcaggagaaagttgagccttgggcaagggcaaagcaggacaagaatgtggttttgttgacctcttgtgtagttgtgttgaacgtgctcgtttccttggttaacgagggcacagaatttttgatagatgagtgtgatcagaaaaatgcgtttacatcaagttcgttttttttaagcaatcagtctggtcattcttgttcaatttagtcctaccttacaaaaagtaaggtccatcttatctcggccatcgatctaaaagccgtggctatgtgtaagatacttctagatatgtatttcgtcgagtccgttcctgagtgccgcgcggcgggaaggtgggcttgtaatgatttggatgatagaagatgagaatgatgctaaaaggccgttctgttctctcactg

SEQ ID NO: 7785 - DNA, 4656 bp, Sorghum bicolor
cctaaagttacgctcggcaaagactgaattaaaataaaactaactacaaagaccggcaccagccgcagcccctaacatcacgaacgcactcacccaggcagcacacacgcactctaccgcacgctgctcgcacccaggcacgaaggcactctacagcacgcacgcacgcacgcacaggatgccccaccgccgcaactaaccacagacgctcgccccgctgccgcagaagctccgcagccatgccgttcgccggaaccagatcggcagcctctaaatcatccgcacctctgtaagctcctcgccggcctccgccaccgatttggcatcctcactctccccagcctgccggcggcggcgccccctgaccatcgctgtccgacgacgacctcctcgagcccaacgtgctccggtcgacaacgccgtcgtccgcggtagggctcagcctcctcgccgcgatcatgggggtcgggggcccatccaatccgccgcgcgccccgtcccggagaccgccgcaggatcctgttccgcgatggcggcgaggtcggcgccggtgcggataccgtcggattggcagcctccagatccgcgcctctgtaagcttctcgccggcctccgccaccgatttggcatcctcgcagtcccatgaaccatcgctgtcccgcccacccctgcccgtcccgacccatgtcgcggccgctgcgggcgccgacggcgacctcctcgagctcgacgtgccacgtcgtcgtctgcggtagggctcagcctccccgccacgctctcggggtcgggggccgtgtccaatccgtcgtgcgccccgtcccggagaccgcggtgagatctttttctgcgatggcggcgaggtcggcgccgatgcggataccgtcgtgccccgtgcggaggtggaggtgggtccacgcgggcgcgtggtcatccgctccggttttatctccgtctcacccgcccagctcttcgtctgcggcttgctcttggttccgtatgaatagacgcgtggagatgtacagcacgcggaagcattccgaggcagacatggatttgaactgggcggatagaacagatatggtggcagaaaaattattgggcagactaaaattttggctctttatagataggtatagatatgactgaaaattagtagttgagatgattcttatattattaggggagttatatctccccttttctttgacaagagatgagagaaatattggtaaccactaaaaaaagagaggtattagagactactgaagatgctctagcctcttcgttttctatgaagcaaaaaatttaaaattaaagtttttaaaagattcaagtttaacttatagtaactttttttttgagattataaaaattagtatcagaatttatgtctaaaagaatttatctatatataaaaatacatcaaataaaaccccggggtccgggccccttctactcgccgccataaaccctaacacacaacacaagtgcgctgcccgaaccacacagcccacgccgccggcggccgcccgccatggtgaaggcttacctccgctacgagccggccctcaccttcggtgtgattgcgtcgccggagtccaacgtcgtctacgacccctccggccgccgcctcctcgccgccgccctcgaccgcctcgtcgcctgggacctcaagcgtggtctcccctctgtctccttcgcaccttcctcctcctccttctcgctcgccgtctcctgcatcgcttcctccccctccgccgccgtctcctcttcgattgcgagcgggcacgcggatgggagcatcaggctgtgggacgcggaaacaggtggctgcgaggcaaccctccacgggcaccgctccgctgcctccgccctccgcttcggcccctctggcgccgtcctcgcttctggcagcaaggactgcgatgtcatcctctgggacgtggttgcgcaggctgggctcttccgtttgcgtgggcaccgtgatcaggtcaccgatttggtgtttctcgattctggtaagaagctggtgagctgctccaaggacaagtttatcagggtttgggaccttgaaacacagcactgtctacaaatcgttggtggtcaccgcagtgagatttggtcaatggatgtggatcctagcgagaggtttttagtgtctgggtctgctgatccagagctgcaggtgtttagaatccgacaatcagtggaggagggtgaggattggagcaagtgggatgtgctcaagctatttggtgagattccacggcagagcaaggaacgagtggcaaatgttaggtttaatagggatggtagtcttgtggtatgccaggtggctgggaagacagcagatatttatagggttcttgatgaaacagaggctgcacgtaaggccaaaaggcgggtgaacagaaagaaggagaaagcatctgcgaaatccatgattgccgaagataatggcactatcattgatcctttaccagctaaaaacttacaaaatcccactgttatcgtcaccgatgtatttaagctatttcaagttttacgggcaagcaaaaaaatatgctcggttgcattctctccaagtaatcctccaagaggatgccttgccattttgtctctatcactcaacaataacatgcttgagacgtactcagtggatagcgagaaggtatcgaagatgtactcggttgagatgcatggacaccgttctgacatcaggagcatctcccttaattctgaggacaaccttctgatgtcgactagccacaatgctgtcaagatatggaatcctagtacaggggaatgccttcggaccattgactctggatatgggctgtgcagtactttcgttggaaatcggtttgctcttgttggtacacaaagtggtgctttggagattgtggatattgctagtgggagcttaactgaggccatagaagctcatgctggctccatacgatcaattgtacctattccagatgaggatggaactgttggtgcgcgaggctttgtcactggaagtgctgatcatgatgtcaagttctgggaataccaattggtgcagaagtctgataatgactctaagcagctgactgtaactaatgtgaggaccttgaagatgaccgaagatgtccttgctgtctcgatcagtcccgaaggaaagcacattgctgttgctctcttggattgccatgtcaaggtctaccacatggacacactgaaaccttctctaaacctttatgggcacaaacttccagttctctgtatggacatatcatctgatggggctttgctagttactggctccgcggacaaaaatttgaagatttggggtatggatttcggggactgccacagatctatatttgctcattcagacagcgtgatggatgttaagtttgtgtatagaactcattatatgttcagtgtggggaaagatcgcactgtgaagtactgggatgctgataaatttgagttgttgttaacacttgaaggacatcatgctgaagtttggtgcctcacaatcagcagtcgtggtgattttattgtaacaggttcgcatgatcgctccattcggcgttgggatcgtactgaagaacaactgttcattgaggaagagaaggagaaaagattggaagaaacctttgaggctgatttagaaaatgatgagtatagatatgggcagaaagatgatgcccctgatgaaggttctgtgggtgttcctggtaggaaaacaaaagagacagtaacctctgctgacgcaatcatggatgcacttgacactgctgaggaggaactaaaacgcattaatcagcataaaatggaagagcaaattaatgcgaaggcagctaaatttcaacctaatgttataatgcaagggcattcaccttcagattatgttctgaatgtagtttcaaacatccgtccaaatgatttggagcaggccctcttggcattgccattctcggatgcactaaagctcatgtcctacttgaaggagtggtctctagttccttcaaaggttgagcttgtttgtagggtttgcttagtgctccttcagacacatcataatcaattaactgctaccccagctgcaagatccttgttgacagaacttaaggatattctttactgtagagtaaaggaatgcaaggatactataggcttcaaccttgccgcaatggatcatgtaaaagaattgttggcgatgagatcagatgcacctttccgtgatgccaaggcgaaactcatggaaatcaagcaggaactgtcgaagcggtcaagtagggtcgatggggatgaaaaaaggaaaaagaagagaaagaaaacgtccgcagaaagctgagccaacaaacaaagaatgttgtattgttgtgctctacttttgtaactacacatggacgtgctcatttgacatttccttggttcacgagcacgcagaatttttgatagatgagtgtaatcacaaggtgcgtggacataaagtgagagtagcatggcccgtcacattcagtttagtgttttttttttttgccgattcacattcagtttagtcctagaccttacagaaggttcatattcaaactttctggatgcccatagatgttcgacttgcgtatctgatgaaatcgtggatgcatgtgacattgtgac

SEQ ID NO: 7786 - DNA, 3131 bp, Zea mays
acccagcccacgcgccggcggccgcccgccatggtgaaggcttacctccgctacgagccggccctcaccttcggtgtgattgcgtcgccggagtccaacgtcgtctacgacccctcgggccgccgcctcctcgccgccgccctcgaccgcctcgccgcctgggacatcaagcgtggtcttccctctgtctccttcgcaccttcctcctcctccccttcgctcgccgtctcctgcatcgcttcctcccactccgccgccgtctcctcttcgattgcgagcgggcacgcagatgggagcatcaggctgtgggacgcggaaacaggtgcttgcgaggcaaccctccacggccaccgctccgctgcctccgccctccgcttcggcccctctggcgccgtcctcgcttctggcagcaaggactgcgatgtcatcctctgggacgtcgttgcgcaggctgggctcttccgtctgcgtggccaccgtgaccaggtcaccgatttggtgtttctggattctggtaagaagctgatgagctgctccaaggacaagtttattagggtttgggaccttgaaacacagcactgtcttcaaatcgttggtggtcaccgcagtgagatttggtcaatggatgttgatcctagcgagagatttttagtgtctgggtctgctgatccagagctgcaagtgtttagaatccggcaatcagtggaggaaggcgaggattggagcaagtgggatgtgctcaagctatttggtgagattccacggcagagcaaggaacgagtggcaaatgttaggtttaatagggacggcagtcttgtggtatgccaggtggctgggaagacagcagatatttatagggttcttgatgaaacagaggctgcacgtaaggccaaaaggcgggtgagcagaaagaaggagaaagcatctgcgaaatccatgattgctgaagagaatggcactatcattgatcctttaccagttcaaaacttacaaaatcctactgttattgtcaccgatgtatttaagctatttcaagttttacgtgcaagcaaaaaaatatgttcgattacattctctccaagtaatcctccaagaggatgccttgccactttgtctctatcactcaacaataacatgcttgagacatattcagtggataaggagaaggtatcaaagatgtactcagttgagatgcatggacaccgttctgacatcaggagtgtctcccttaattcggaggacaacctccttatgtcgactagtcataacgctgtcaagatatggaaccctagtacaggggaatgccttcggaccattgactctggatatgggttgtcaagtgctttcgttggaaatcggtatgctcttgttggtacaaaaagtggtacgttggagattatggatattgctagtgggagcttaactgaggccatagaagctcatgctggctccatacggtcaattgtacctattccagatgaagatggaactgttggtgcacgaggctttgtcactggaagtgctgatcatgatgtcaagttctgggaataccaattggtgcagaagtctgataacgactctaagcagctgactgtaactaatgtgaggaccttgaaaatgacagaagatgttcttgctgtctcgatcagtcccgaaggaaagcacattgctgttgctctcttggattgccatgtcaaggtcttccacatggacacactgaaaccatctttaaacctttatgggcacaaacttccagttctctgtatggacatatcatcagatggagctttgctagttactggctctgcggacaaaaatttgaagatatggggtatggattttggggactgccacaggtctatatttgctcactcagacagtgtgatggatgttaagtttgtgtatagaactcattatatgttcagtgtggggaaagatcgcactatgaagtactgggatgctgataaatttgagttattgttaacacttgaaggacatcatgctgaagtttggtgcctcacactcagcagtcgcggtgattttgttgtaacaggttcacatgatcgttccattcggcgttgggatcgtactgaagaacaactgttcattgaggaagagaaggagaaaagattggaagaaacctttgaggctgatttagaaaacgataatgactatagatatgggcagaaagatgatgcccctgatgaaggttctgtgggtgttcctggtaggaaaacaaaagagacagtaacttctgctgatgcaatcatggatgcacttgacactgctgaggaggaactaaaacgcattaatcaacataaaatggaagagcaaattactgcgaaggcagctaaatttcaacctaatgttataatgcaagggcattcaccttcagattatgttctgaatgtagtttcaagcatccgtccaaatgatctggagcaggccctcttggcattgccgttctcggatgcactaaagctcatgtcttacttgaaggagtggtctttggttccttcaaaggttgagcttgtttgtagggtttgcttagtgctccttcagacacatcacaatcaattaactgccacgccagctgcaagatccttgttgacagaactgaaggatattctttactgtagagtaaaggaatgcaaggatactataggcttcaacctcgccgcaatggatcatataaaagaattgttggcgttgagatcagatgcacctttccgtgatgccaaggcgaaactcatggaaatcaagaaggagcagtcgaagcggtcaagtagtaggcttgacggagatgaaaaaaggaaaaagaagagaaagaaagcgtccgctgaaagctgagccaacaaacaaaaacaaaagaatgttgtattgttgttcttaccttctgcaactactacatggacgtgctcgtttccttggttcacgagcacgcagaatttttgttagatgggtgtaatcggaaagtgcgtggacataaagatttctagaggttcgtcttgcgtatctgatgaaagggaatatatcaggtggaacatatacattggtgtagtcgtgtaactaaggtcccgtctggtaggactttagcttgcccaaacacggttttagctctagtttttttt

SEQ ID NO: 7787 - DNA, 3339 bp, Hordeum vulgare
actcgccctcactaaaccctaacccccacaactactcccccctcccacgccgccggcggccgggagccatggtgaaggcctacctccgctacgagccggcgctctccttcggcgtggtcgcctccccggagtccaacgtcgtctacgacccctccggccgccgcctcctcgccgccgcgctcgaccgcttcgccgcctgggacctcaagcgcggcctcccctccgccaccttcaccccctcctcctcctccgcctccctcgccgtctcctgcgtcgcctcctcccccgccgctgcttccgcctccgcttcctcgattgcgagtggccatgcggatgggagcatcaggctgtgggatgctgagacgggcgcctgcgaggcgacgctccacggccaccgctctgctgcttccgccctacgtttcgctccctcgggcgccgtcctcgcctccggcagcaaggactgcgatgtcatcctctgggacgtcgttgcacaggccggcctcttccgactccgtggccaccgtgatcaggtaactgatttactgttcctggattcgggtaagaagctggtgacctgctccaaggacaagttcatccgggtctgggacctcgacacgcagcactgccttcaaattgtaggtggccaccacagcgagatatggtccatggatgttgatcctagcgagaagtttttagtgtctggctcagccgatccagagcttcgggtgtttagaatcaggcaatcagtcgaagagggtgaagattggaacaaatgggatgcactcaagctgtttggcgaaattccaaggcagagcaaagaaaggattcagaccattaggttcaataaagacggcagtcttgtggcatgccaggtggcagggaaaactgctgatatctataggattcttgatgaaacagaggcgacacggaaggccaagaggcggctgcacaggaagaaggagaaggctgcggcaaaagctgcggcagcggaagggaatggtactgttatagatcctttgccagctcaagactctcagaatcccactgttgtggtcaccgatgtgtttaagcttctccaagttttgcggaccagcaagaaaatttgctctgttgcattttctccaaacaatccaccaaaaggctgccttgcgaccttgtctttgtctctgaacaataacgtgcttgagacatactcggtggataacgagaaggtgtctaagatgtactcagttgagatacatgggcatcgttctgacatcaggagtcttgcacttaactcagaggacaacctcctgatgtcaactagtcataatgctgttaaaatctggaatcctagtacaggagactgtcttcggaccgttgactctgggtatgggttgtgcagtgcatttgttcccgggaatcggtatggccttatcggtacaaagactggtactttggagatcattgatattaatagtgggaactcaattgatgtaatcgaagctcacgctggttccatacgatcgattgtactcattccagatgaggatggaactgttaatgcacggggttttgtcactggaagtgctgatcacgatgtcaagttctgggaataccagttagtgcagaaatctgattcagacacaaagcatctgagtgtaacaaacgtgagaaccttgaaaatgaacgatgatgtccttgcagtgtctatcggtccaactgggaagcatattgctgttgctcttttggattgcacagtgaaggtcttctttctggacacactaaagttttgtctttcactttacggacacaagcttccagttctctgcatggacatatcatccgatggaggtctaatagttactggttccgcagacaaaaatctgaagatttggggtatggattttggtgactgccataaatcaatctttgcccacggagacagtgtcatggatgttaagtttgttcctaaaactcattacatgttcagtgtggggaaagatcgtaccgtgaagtattgggatgctgataaatttgagcttttgttaacacttgaaggacaccatgctgaagtttggtgccttgcgattagcagccgtggtgattttattgtaacaggctctcatgatcgctctattcggcgttgggatcgtactgaagaacaacttttcattgaggaagagagggagaaaagattggaggaaacttttgaggctgatttggacaatgcggttgaagatagatatgggcagaaagatgatgctcctgatgagggttctgtgggtgttcctggtaagaaaacaaaagaaacagtaactgctactgatgcaattattgacgcacttgacactgccgaggaagaagaaaaacgtcttaatgagcagaaggagttgcaaaacaatggggagggctctaaatctaagcctaatgttataatgcaagggcattcaccatcagaatatgttctgaatgcagtgtcaagtgtccgcccaaatgacttggaacaagtccttctgtcattgccattctcagatgcactaaagcttatggcttacttgaaggagtggtctgtgatccctttgaaggttgagcttgtctgtagggtttgccttgtgctgcttcaaacacatcacaaccagttaactactacaccagctgcaagatccatactgacagaactgaaggatattctttatggtagagtgaaggactgcaaggacactataggtttcaatctcgcagcaatggatcatataaaggtaagatgccatcttccttcctttttagcattttggtgcgaccatgccttagagaacattttctgttgcccgctaggccaggccatgactttttttgtgatttgttgcacgcacattgtctttcaggaactgttgacgatgagatcagatgcgccgttccgggacgccaaggcgaagctcatggagatcaggcaggagcagtcgaagcggtcggataggtcgggtgggggcgagagaaggaaaaagaagaagcccaagccgtctgtacagagctgagcaaggatctgtctgtttttactcaactgttgtagcgtatacgcaccacactgggttatcgcgttcatttcatgctgtcatgagcacagcacaattttgagagatgtgtgtgtgggccagtgttaatcggcggtttcctactagagaaacatggcgtacctccctctttttagatagtcaagatttggtcaaaccttcccttttttatgctttcagaaattgcagcatccctagctttcagaattcacctcatttagaaaaaaaatcaaagattcaaagcatttgaagtatcgaacttctggaaaggaattcaaaattttag

SEQ ID NO: 7788 - DNA, 3002 bp, Secale cereale
ggcctacctccgctacgagccggcgctctccttcggcgtggtcgcctccccggagtccaacgtcgtctacgacccctccggccgccgcctcctcgccgccgccctcgaccgcttcgccgcctgggacctcaagcgcggcctcccctccgccaccttcaccccctctcctcctccgcctccctcgccgtctcctgcgtcgcctcctcccccgcgccgcgtccgcctccgcttcctcggttgcgagtggccatgccgacgggagcatcaggctgtgggacgccgagaccggcgcctgcgaggcgacgctccacggccaccgctctgctgcttctgccatacgcttcgctccctcgggcgccgtcctcgcctccggcagcaaggactgcgatgtcatcctctgggacgtcgttgcacaggccggcctcttccgactccgtggccaccgtgatcaggtaacggatttagtgttcctggattcgggtaagaagctggtgacctgctccaaggacaagttcatccgggtctgggacctcgacacgcagcactgccttcaaattgtaggtggccaccacagcgagatatggtccatggatgttgatcctagcgagaagtttttggtgtctggctcggccgatccagagctccgggtgtttagaatcaggcaatcagctgaagagggtgaagattggaacaaatgggatgcactcaagctgtttggcgaaattccgaggcagagcaaagaaagaattcagaccattaggttcaataaggatggcagtcttgtggcatgccaggtggcggggaaaactgctgatatctataggattcttgatgaaacagaggccacaaggaaggccaagaggcggctgcacaggaagaaggagaaggcttcagcgaaagctgctgcggcggaagggaatggcactgttatagatcctttgccagctcaagactctcagaatcccactgttgtggtcaccgatgtatttaagctcctccaagttttgcggaccagcaagaaaatttgctctgttgcattttctccaagcaatccaccaaaaggctgccttgcgaccttgtctttgtctctgaacaataacgtgcttgagacatactcggtggataacgagaaggtgtctaagatgtactcagttgagatacatgggcatcgttctgacatcaggagtcttgcacttaactcagaggacaacctcctgatgtcaactagtcacaatgctgttaaaatctggaatcctagtacaggtgactgtcttcggactgttgactctggatatgggttgtgcagtgcatttgttcctgggaatcggtatggccttatcggcacaaagactggtaccttggagattattgatattaacagtgggaactcgattgatgtaatagaagctcacgctggttccatacgatcgattgtcctcattccagatgaggatggaactgttaatgcacggggttttgtcactggaagtgctgatcacgatgtcaagttctgggaataccagttagtgcagaaatctgattcagacgcaaagtatctgagtgtaacaaatgtgaaaactttgaaaatgaatgacgatgtccttgcagtgtccatcggtccaactgggaagcatattgctgttgctcttttggattgcacagtgaaggtcttctttctggacacactaaagttttgtctttcactttatgggcacaagcttccagttctctgcatggacatatcatccgatggagctctaatagttactggttctgcagacaaaaatctgaagatttggggtatggatttcggtgactgccataagtccatctttgcccacacagacagtgtgatggatgttaagtttgttcctaaaactcattacatgttcagtgtggggaaagatcgtactgtgaagtactgggatgctgataaatttgagcttttgttaacacttgaaggacaccatgctgaagtctggtgccttgcgattagcagtcgtggtgattttatcgtaacaggctctcatgatcgctctattcggcgttgggatcgtactgaagaacaacttttcattgaggaagagagggagaaaagattggaggaaacttttgaggctgatttagacaatgcggttgaagatagatatgggcagaaagatgatgctcctgacgagggttctgtgggcgttcctggtaagaaaacaaaagagacagtaactgctgctgatgcaattattgacgcacttgacactgctgaggaagaagaaaaacgtcttcatgagcagaaggagttacaaaatgttggggagggaaccaaatctaagcctaatgttataatgcaagggcattcaccgtcagaatatgttctgaatgcagtgtcaagtgttcgaccgaatgacttggaacaagcccttctgtcgttgccattctcagatgcactaaagctcatggcttacttgaaggagtggtctctgatcccattgaaggttgagcttgtttgtagggtttgccttgtgctgcttcaaacgcatcacaaccagctaactaccacaccggctgcaagatccatactgacagcactgaaggatattctttacggcagagtaaaggactgcaaggataccataggtttcaatctcgctgcgatggatcatataaaggaactgttgacgatgagatcagatgcgccattccgggacgccaaggcgaagctcatggagatcaggcaggagcagtcgaagcggtcagataggtcggaaggcggcgagaaaaggaaaaagaagaaacccaaggcgtctgtacagatctgagcaaggacttatttggctgtttttactcaactgttgtagcatgtacacgccacactgtattattattgtgttcatttcatgctgtcatgagcacagcagaattttgagaggtgggtgtgtgggccattgttacttggcggttgcctgctaggggaacaaggtgtacctctctcttttaggaagtcaatg

SEQ ID NO: 7789 - DNA, 3008 bp, Brachypodium distachyon
cttaaacccttcctctctcgcgccgccgccaccgcaaaaccctaggctccgacgacccgccgccgctgcctacccgccatggcttcttcgcaggggcctaagaagaattaccgctgtgaccggtcgttgcagcagttctacaccggcggtccgttcgccgtcgggagcgctgcccctggcggcgaaggcgacgccgaggcgttcctcgcgtgcgcctgcggcagcgagctgcgtgtggtgtccgccgccgatgcctccgccataggggaaccgatcgacggggactccgaggccgtcacggggctcgcgctgtccccagactcccgcctcctcttcgccgctgggcacagtaggcttattagggtctgggacctcgcgtcccgcacttgcatccgcagctggaagggacatgatggtcctgttatggccatggcatgccatgcttctggtggtttgcttgcaactgctggagcagacaagaaagtgtgcgtgtgggatgtagatggtggattttgcacgcatttctttagaggtcacacaggtgttgtgacaaccattatgttccacaaagatccaaagcgtcttctgttattttcaggaagtgatgacggcactgtacgagtctggaaccttgaaagcaaaaaatgtgttgctgtgcttaaagcgcatttttctacagtgacttcattggcattatcagaagatgggcaaacattgctcagtgctgggagggataaggttgtgaatgtgtgggatgttcggaagtacagttcaaagaagacaataccaacatatgaaatgatagaagctgtttccttcattggaccaggaagtggcttcttggcttgtttgggtgttgaaccggcaaatttgaagaaaagaacagattcttattttcttacagttggtgaacgtggggtcgtgcgcatctggtgcttggaaagcactgtttgcgtatatgagcagcaatcatccgatgtaaccataaactcagagaacgaggagtctagaaggggctttaccgctactattatgttgccagatgatcgtgggttgctatgtgtaaccgctgatcaacaatttttgttctattgttgcacgagaactgatgaaggggccttccagttgaacctatataaacgactaataggctataacgatgagattcttgatttgaagtttgttggggaagaggagcaatatcttgccgtagctacgaacttggagcaggtccgtgtttatgacgttgcatcaatgtcatgttcttatgtgctggctggccacactgaaattgttgtttgccttgacacttgcgtttctgcttctggaaagacactcgttgtaactggaagcaaagataatactgtgaggttgtgggatatggaaaagagaagctgtattggtactggtaaaggccatctaggagctattggttgtgttgctttctcaaaaaaatcgaagaacttttttgttagtggcagcagtgaccggaccatcaaggtatggagctgggatgatactctcattgatgctgatggtgaagtatctctcaaagctaaggctggtgtagctgcacatgataaagacattaattctctgtctgtctctcctaatgatggccttgtttgcagtggttctgaggaccgaactgcatgtatatggaaactccctaacctagtgtcctctgttgtccttaaagggcataaaaggggcatttggtcagttgagttttctcctgtcgagcaatgtgtcataacatcatctggtgacagaacggtcaaaatatggcacgttactgatggctcatgcttgaagacatttgagggtcatacatcaagtgttttgaaggcttctttcctttcacgtggaactcagtttgtttcttgtggaagtgatggcctagttaaactatggacgataaaaacaagtgaatgcattgctacttatgacaagcatgatgggaaggtttgggcattggctgttggcaggaaaactgaaatgcttgctactggaggaactgattctgatctaaatctttggcatgattgcacgacggaagataagcaggaagatttccgtaaaaaggaggaggaagctttgagaggccaggaattggataatgctgtgtcagattctgactacaaaagggcgatacaacttgcatttgagcttagaagaccacgcaggcttcttgagttattttcacagctttgcaggaaagatgatccagaggaccctatagaaaaggcccttgttggtctcccaaaggaggggcttcgcttgcttcttgagtacattcgggaatggaatacaaagcccaagttttgtcatgttgcgcagtttgtgcttttccgggtgttgaagagctttcctcccactgatatcttggagataaaaggcatcagtgagctccttgaaggcctcattccatattcgcagaggcacttcagcagagttgatagactagtgcgcagcacatttttgttggactacaccttgacccggatgtctgttgtagacccagatgttgatacggccacaaccagagatgttacaaacagctcatcagtggagaatggtgaaattgtgctggcggagccggatttaggggtatcacaggagagcccagaaaagccaggcaagaaaagaaaatctagcaaatcaagcaagaaagttagtaagaaggtgaaggcctcttcaaatggggacagtaagactatttcagttgaggcttaaactgtaaagtctggcctgttcactcttcacaccaccaattttgtagccgctgttgtaacttccattgtgcaacacgaatcatatttatcgtgcttcgtgatgaacattgtatagaatgtattctttacctagttaaggacctgtatgcctgaggcatttacgagtgctctgttagaaatttctgttggagttcacagtaaaactttggtttataaaacaaatgtcttcatttatgagccgggttaggttaccttattgttttccaccgaggg

SEQ ID NO: 7790 - DNA, 3091 bp, Setaria italica
gccgccgccgccgccgcaaaaccctagctccgacgacccaccgccgttgccgcggccgccgaaattagctatggcgtcgacgcaggcgcttaagaagaactaccgctgcgaccgctcgctgcagcagttctacacgggcgggccgttcgcggtcgggcgcccccccgccggcgagggcgagggcgaaggcggcgccgaggccgatccgttcctcgcgtgcgcatgcggcggggaggtgcgcgtggtgtcggccgcggacgcctccgcgataggggagcccgtcgacggcgactcggaggccatcaccgcgctgacgctgtcccccgactcccgcctcctctttgctgcggggcacagcaggcttatcagggtctgggacctcgccacccgcacttgcatacgcagctggaagggacatgatggtcctattatggccatggcgtgccatgcttctggtgggttgcttgcaactgccggagcagacaagaaggtgtgcatatgggatgtggatggtggattttgcacacatttcttaagaggtcatacaggcattgtgacgaccattatgttccacaaagatccaaagcgccttctgttgttttcaggaagcgaagatggcactgtgcgagtatggaaccttgaaaccaaaaaatgtgttgctgtgctgaaagagcatttttcaacggtcacttcattgacattgtctgatgatggacaaacattgctcagtgctgggagggataaggttgttactgtgtgggatgttcgtaagtacagctcgaagaagacaataccaacgtatgaaatgatagaagctgtttccttcattggatcaggaagtgagctactagcttgtttgggcatagaactggtaaacatgaaggggggatcggatggttattttcttacagtaggtgaacgtggggttgtgcgcatctggtgcttggagagtggtcgttgcgtgttcgagcagcaatcatctgatgtaactgttaactcagagaatgaggaaaccagaagggggtttacttctgctgttatgttgccaaatgatcaaggattgctatgtgttactgctgatcagcagtttttgttctattgtcccaaaaaaactgatgaagggaccttccaactgtccctatatagacgtctagtaggttataatgatgagattcttgacttgaagtttgtcggggatgaggaacaatatcttgctgtagctactaacttggagcaggtccgtgtttatgatgttgcatcgatgtcatgttcttatgtactggctggccacacagaaattattgtttgcatcgacacctgtgtctcttcttctgggaagacgcttgttgtaactgggagcaaggacaatactgtgaggttatgggatgctgaaaggagaagatgtattggtactggtaaaggccatctgggagctgttggttctgttgcattctcaaagaaatcgaagaacttttttgttagtggcagcagtgatcgaaccatcaagatttggacctgggatgatacgcttgatgatgctgatgatgaagttcctctcagagctaaggctgttgtagctgcacatgataaagatattaattctctgtctgtttcacctaatgatggccttgtttgcagtggttctgaggaccgaactgcttgcatatggaaactccctaacctggtgtcctctgttgtccttaaggggcacaagagaggaatctggtcggttgagttttctcttgttgagcaatgtgtcatgacatcctctggtgatagaacaatcaaaatatggtccgttgcagatggcacgtgcttgaagacatttgagggtcatacatcaagtgtcctgcgagcttctttcctttcacgtggaactcaagttatttcttgcggaagtgatggtctagtgaagctatggacaatcaaaacaaatgagtgcattgctacttatgataagcatgatggaaaggtttgggcattggctgttggcagaaaaactgaaatgcttgctactggtggaactgattctattctaaacctgtggcatgattgcaccatggaagataagcaagaagatttccgtaaaaaggaggaagaagtcttaagaggccaggaattggaaaatgcagtgtcagatgctgactatacaaaagcaatacaacttgcatttgagcttaggagaccacacaggcttctagagttattctcacagcttgccaggagggctgattcggaggatccaatagaaaaggctcttcttggacttccaaaggatggcctccgtgtgcttcttgagtacatccgtgaatggaatacaaagcccaagttctgtcatgttgcacagtttgtgctttttcgggtattgaggactttgcctcccaccgatatcttggagataaagggtatcagtgagctccttgagggcctaattccgtattcgcagaggcatttcaacagagtcgatagactagtgcgaagtacatttctgttggactatacattgatgcgaatggccgtggtagatccagatgttgatgcgggcacaaccaaagatgacatgaacggttcatcagtggagaacaatgaaaccgcagaggctcagcctgcttcgcccataacagagaagtcgagcaagaagagaaaacagggcaaatcaagcaaaaagggcaaagagaagaaagtgaagcttgcttcgaaggatgtttcagttgaggcctgaatacctagctaagaaaattgcttacgctcaccaccaattttgtagctgctgttgtgagttataactgacattgcccaacgacacaaatcctttctgatgtactccctccgttccaaattataggtcgttatagtttttctagatgcataaatattattatgcatctgtctaagtgcataacaaaatctatgaatctaaaaaagtcaaaacaatctataatttgggaccgagggagtaaatgcattctttgctgagttcagaagatccccggtgcttaaggcacgcgcgggtatctgatccaaatttcctgatgaacctattacagtgaaaccccagatgagttctcaaaagtttcagtccttattgttg

SEQ ID NO: 7791 - DNA, 3199 bp, Sorghum bicolor
caagccccttcgctttccctgctcggtccggccacttgactttgcttaaaccctcctcctctccatctcctcccgcgccgccgtccccgctcccgccgcaaaaccctagctccgacgacccccccgccgttgccgcggctaccggaaccagtcatggcttcgacgcatgctctaaagaagaactaccgctgcgaccgctccctgcagcagttctacactggcgggccccttgcggtcgggctcgcccccggcggcgatggcgagggcgagggcggcgcccaggctgaggccttcctcgcgtgcgcatgcggtggggaggtgcgcgtggtgtccgccgcggacgcctccgccataggggagcccgtcgacggcgactcggaggccatcaccgcgctggcgctgtcccccgactcacggctcatcttcgccgcgggccacagcaggcttattagggtctgggacctcgcgtcccgaacttgcatacgcagctggaaggggcatgatggtcctatcatggccatggcatgccatgcttctggtggtttgcttgcaactgccggagcagacaagaaggtctgcgtatgggatgtcgatggtggattttgcacccatttccttagaggccatacaggtgttgtgacgaccattatgttccacaaagatccaaagcgccttctgttgttttcaggaagtgaagatggcaccgtgcgagtgtggaaccttgaaaccaaaaaatgtgttgctgtgcttaaagagcatttttcggcagtcacttcattgacattgtctgatgatggacaaacattgctcagtgctggaagggataagattgttactgcatgggatattcgtaagtacagctcaaagaagacaataccgacatatgaaatgatagaagctgtttccttcattggatcaggaagtgagctcttggcttgtttgggcatagaactggcaaatataaaggagaaagcggccagttattttcttacagttggtgaacgtggggtcgtgcgcatctggtgcttggagagttcgctttgcgtgttcgagcagcaaacatctgatgtaactgttaactcagagaacgaggaaaccaggaggggctttacatctgctgttatgttgccaaatgatcaaggattactatgtgttactgccgatcagcagtttttgttctattgtcccaaaagaactgatgatgggacctttgaactgtctctatatagacgactaataggttataatgatgagattcttgacttgaagtttgttggggaggaggaacaatatcttgctgtagctaccaacttggagcaggtccgtgtttatgatgttgcgtcgatgtcatgttcttatgtacttgctggccacaccgaaatagttgtttgcattgacacctgtgtctctgcttctgggaagacacttgttgtaactgggagcaaggataatactgtgaggttatgggatgttgaaagaaaaagctgtattggcattggcaaaggccatctgggtgctgttggttctgttgccttctcaaagaaaacaaagaacttctttgttagtggcagcagcgatcggaccatcaaggtatggacctgggacgatgcacttggtgatgctgaggatgaagtctctcttaaagcaaaggctgttgtagctgcacatgataaagatattaattctctggcaatttcacctaatgatggccttgtttgcagtggttctgaggaccgaactgcctgcatatggaaactccctaacctagtgtcctctattgtccttaagggacacaaaagaggaatctggtcagttgagttttctcccattgaacaatgtgtcatgacatcctctggtgatagaacaatcaaaatatggtctgttgctgatggctcatgcttgaagacatttgagggccatacatcaagtgttctgcgagcttctttcctttcacgtggaactcaaattgtttcttgtggaagtgatggtctagtgaagttatggacaatcaagacaaatgaatgcattgctacttatgataagcatgatgggaaggtctgggcattggctgttggcatgaaaactgaaatggttgcaactggtggaaccgattctgtcctcaacctatggcatgattgtaccaaggaagataagcaggaagatttccgtaagaaggaggaagaagttttaagaggccaggaattggaaaatgctgtgtcagattctgactatgcaaaggcaatacaacttgcatttgagcttagaagaccacacaggcttctagatttattctcacagcttgccaggagagctgatgcagaggatccaatagaaaaggctcttcttggtcttccaaaggatggcctccgcgtgcttcttgagtatgttcgtgaatggaatacgaagcccaagttctgtcatgttgcacagtttgtgctttttcgggtattgaggagtttctctcccactgatatcctggagataaagggcatcagtgagctccttgagggccttattccgtattcgcagaggcatttcagcagagtcgacagactagttcgaagcacgtttctgttggactatacactgatgcgaatgtccgtggtagattcagatgtagatgcgggcacaatcaaagatgaaatgaatggttcatctgtggagaatggtgaacttgcagagcctcggcctgcttcacctgtaccagagaagtcaagcaagaagagaaagtccagcaaatcaagtaaaaagggtaaggagaagaaggtgaaggttgcctcgagtggacacagcaatgatgtttctgttgaagcctgaatatctagctgagaatctgatttttgctgatgcatgacgccaattttgtagctgctgttgtaacttacgctgcccaatgacaacgaatcgcatctgatgtaaatgcatttttgtgctgcgtttatttagaccacagagcctttaaggcatcgcctctctgttccaaattcccttcgcaacttactggccaaatttccttctcaacttactggagtatgtttttgcaaattttgcatgccaaaggttttggtaagcaaaagttgcgaaaatagtttacatagatttggccaggcaaatgggagattggcaaaggtttgctagcaaaccaaatggatttggcaaccaaattatgaccgttaactagtcaagctcaagatttcag

SEQ ID NO: 7792 - DNA, 2908 bp, Panicum virgatum
ctctcgcgccgccgccgcaaaaccctagctccggcgacccgccgcggccgccgaaactagctatggcgtcgacgcaggcgcttaagaagaactaccgctgcgaccgttcgctgcagcagttctacacgggcggcccgttcgcggtcgggcgcgcccccgccggcgaggccgagggcgaggccgagcctttcctcgcctgcgcatgcggcggggaggtgcgcgtggtgtccacagcggacgcctccgcgataggcgagcccgtcgagtgcgattcggaggccatcaccgcgctgaccgtgtccccggactcccgcctcctttttgctgcggggcacagcagacttatcagggtctgggacctcgcgacccgcacttgcatacgcagctggaagggacatgatggtcctattatggccatggcatgccatgcttctggtgggttgctagcaactgctggagcagacaagaaggtgtgcgtatgggatgtggatggtggattttgcacacatttcttaagaggtcatacaggtgttgtgacgaccattatgttccacaaagatccaaagcgccttctgttattttcgggaagcgaagatggcaccgtgcgagtatggaaccttgaaaccaaaaaatgtgttacagtgctgaaagagcatttttcaacagtcacttcattggcattgtctgatgatggacaaacattgctcagtgctgggagggataaggttgttactgtgtgggatgttcgtaagtacagctcgaagaagacaataccaacatatgaaatgatagaagctatttccttcattggatcaggaagtgaggtactggcttgtttgggcatagaactggcaaatatgaaggggaaaatggatggttattttcttacagtaggtgaacgtggggttgtgcgcatctggtgcctggagagtggtcattgcatattcgagcagcaatcatctgatgtaactgtaaactcagagaatgaggaaaccagaaggggttttacatcttctgttatgttgccaaatgatcaagggttgctatgtgttactgccgatcagcagtttttgttctattgtcccaaaaaaactgatgaagggatcttccaactgtctctatatagacgtctagtgggttataatgatgagattcttgacttgaagtttgttggagatgaggaacaataccttgctgtagctactaacttggagcaggtccgtgtttatgatgttgcttcgatgtcatgttcttatgtactggctggccacacggaaattgttgtttgcatcgacacctgtgtctcttcttctgggaagacacttattgtaactgggagcaaggacaatactgtgaggttatgggatgctgaaaggagaagctgtattggtactggtaaaggccatctgggggctgtaggttctgttgcattctcaaagaaatcgaagaacttttttgttagtggcagcagtgatcgaaccatcaagatatggacctgggatgatgcgcttggtgatgttgatgatgaagttcctcttagagctaaggctgttgtagctgcacatgataaagatattaattatctggctgtttcacctaatgatggccttgtttgcagcggctctgaggaccggactgcttgcatatggaaactccctaacctggtgtcctctgttgtccttaaggggcacaaaagaggaatctggtcggttgagttttctcctgttgagcaatgtgtcatgacatcgtctggtgatagaacaatcaagatttggtcagttgcagatggctcgtgcttgaagacatttgagggtcatacatcaagtgtcttgcgagcttctttcctttcacgtggaactcaagttatttcttgcggaagtgatggtctagtgaagctatggacaatcaaaactaatgaatgcattgctacttatgataagcatgatgggaaggtttgggcattggctgttggcagaaaaactgaaatgcttgctaccggtggaacggatgctattctaaacctgtggcatgattgcaccatggaagataagcaagaagatttccgtaaaaaggaggaagaagtcttaagaggccaggaattggaaaatgcagtatcagattctgactatacaaaagcaatacaacttgcatttgagcttagaagaccacacaggctcctagagttattctcacagcttgccaggagagctgattcagaggatccaatagaaaaggctcttcttggacttccaaaagatggccttcgtgtgcttcttgagtatatccgtgaatggaatacgaagcctaagttctgtcatgtttcacagtttgtgctttttcgggtattgaggtgtttgcctcccactgatatcctggagataaagggcatcagcgagctccttgagggtcttattccgtattcgcagaggcatttcagcagagtcgatagactagtgcgcagcacatttctgttggactatacattgatgcgaatgtccgtggtagatccagatgtagatgcgggcacagccaaagatgacatgaacggttcatcagtggagaacgatgaaaccgcagaggcttgtcctgcttcgcctgtaacagagaaaccgagcaagaagagaaaacagggcaaatcaagcaaaaagggcaaggagaagaaggtgaaggttctttcaaagtatgtttcagttgaggcctgaatagctagctaagaaaatagcccacttccaattttgtagctgttgtaattgtaattgtcattgtccaccaacacgaatagcttctggtgtaaatgcattctttgacgagttcagatgaccccggtgcttaaggcacacgtggctatctgttctgattttctggtgaacttatttacaggaacaacccagatgagatttcagaagtt

SEQ ID NO: 7793 - DNA, 2917 bp, Zea mays
ccgccgttgccgcggccgccagaaccagccatggcttcgacgcatgtttataagaagaactaccgctgcgaccgctccctgcagcagttctacacgggcgggccctttgcggtcgggctcgcccccggcggcgatggcgagggcggcgccgaggctgaggccttcctcgcgtgcgcgtgcggtggagaggtacgcgtggtgtccgccgcggacgcctccgccataggggagcccgtcgacggagactcggaggccatcaccgcgctagcgctgtcccccgactcacggctcatattcgccgcgggccacagcaggcttattagggtctgggacctcgcgtcccgaacttgcatacgcagctggaagggacatgatggtcctatcatggccatggcatgccatgcttctggtggtttgcttgcaactgccggagcagacaagaaggtctgcgtatgggatgtggatggtggattttgcacccattttcttagaggtcatatgggcgttgtgacaaccattatgtttcacaaagatccaaagcgccttttgttgttttcaggaagtgaagatggcactgtgcgagtgtggaaccttgaaaccaaaaaatgtgttgctgttcttaaagagcatttttcagcagtcacttcattggcattgtctgatgatggacaaacattgctcagcgctgggagggataagattgttaccgcatgggatattcgtaagtacagctcaaagaagacaataccgacatatgaaatgatagaagctgtttccttcattggatcaggaagtgagctcttggcttgtttgggcatagaactggcaaatataaaggagaaatctgctggttattttcttacagttggtgaacgtggggtcgtgcgtgtctggtgcttggagagttgtgtttgcgtgttcgagcagcaaacatctgatgtaactgttaactcagagaacgaggaaaccaggaggggctttacatctgctgttatgttgccaaatgatcaaggattgctatgtgttactgctgatcagcagtttttgttctattgtcccaaaagaactgatgatggggactttgaactgtctctatatagacgactaataggttataatgatgagattcttgacttgaagtttatcggggaggaggaacaataccttgccgtggctaccaacttggagcaggtccgtgtttacgatgttgcgtcgatgtcatgttcttatgtactcgctggccacactgaaatagttgtttgcattgacacctgtgtctctgcttccgggaagacacttgtcgtaactgggagcaaggatcatactgtaaggttatgggatgccgaaagaaaaggctgtattggcattggcaaaggccatctgggagctgttggttctgttgccttctcaaagaaaacaaataacttttttgttagtggcagcagtgatcgaaccatcaaggtatggacctgggacgatgcacttggtgatgctgaggatgaagtccctcttaaagcaaaggctgttgtagctgcacatgataaagatattaattctctggcaatttcacctaatgatggccttgtttgcagtggttctgaggaccgaactgcttgcatatggaagctccctaacctagtgttatctgttgtccttaagggacacaaaagaggaatctggtcagttgagttttcttctgttgaacaatgtgtaatgacgtcctctggtgatagaacaatcaaaatatggtccgttgctgatggctcatgcttgaagacatttgaaggtcatacatcaagtgttctgcgagcttctttcctttcacgtggaactcaagttatttcttgcggaagtgatggtctagtgaagctatggacaatcaagacaaatgaatgtattgctacttatgataagcatgatgggaaggtctgggcattggctgttggcatgaaaactgaaatggttgctactggtggaaccgatgctgtcctcaacctgtggcatgattccaccatggaagataagcaggaagattttcgtaagaaggaggaagaagttttaagaggccaggaattggaaaatgctgtgtcagattctgactacgcaaaggcaatacaacttgcatttgagcttagaagaccacacagacttctagatttattctcaaagcttgcaaggagagctgatgcagaggatccaatagaaaaggctcttcttggtcttccaacggatggccttcgcgtgcttcttgaatacgtccgtgaatggaatacgaagcccaagttctgtcatgttgcacagtttgtgctttttcggttattgaggagtttctctcccactgatatcctggagatcaagggcatcagtgagctccttgagggccttattccgtattcgcagaggcatttcagccgagtcgatagactagtccgaagcacgtttctgttggactatacgctgatgcgaatgtccgtggtagatccagatgtagatgcgggaacaatcaaagatgaaatgaacggttcgtctgtggagaacggtgaacttgcagagcctcggcctgcttcacctgtaccacagaagtcaagcaagaagagaaaatctggcaaatcaggtaaaaagggcaaggagaagaaggtgaaggttgcctcaagcggactactcagcaaggatgtttctgttgaaccctaaatatctagctgagaatctgttttttttatgcatgccgccaattttgtagctgctgttgcaacggacgttgcccaacacacgaatcccatatgatgtaaatgcatttttgctgatttattaggagggcgaagtgttatcaaaatctgccatgccaaatgttctggtaagcaaaagttgccaaaagttggatggaataatttttacatagatttggtaagccaagtat

SEQ ID NO: 7794 - DNA, 3036 bp, Triticum aestivum
ccgcgcggccacgccgccgacttaaaccctgctccccccttctcgcgccgccaccactgcaaaaccctagctccgacgacccgccgccgacgcgcaacgccatggctctgtcgcaggggcccaagaacaactaccgctgcgaccgctcgctgcagcagttctacacgggcgggcccttcgccgtcgggcgcgccccccgcggcgagggcgagggcgacgccgaggaggcgttcctcgcgtgcgcctgcggcagcgagctgcgcgtggtgtccgccgccgacgcctccgccataggggagcccatcgacggcgactccgaggccgtcacggggatcgcgctgtcccccgactcccgcctgctctttgctgctggccacagcaagcttatcagggtctgggacctcgcgtctcgcacttgcatccgcagctggaagggacatgatggtcctgttatggccatgtcatgccatgcttctggtgggttgcttgcaaccgccggagcagacaagaaggtttgcgtgtgggatgtggatggtgggttttgcacacatttctttagaggtcatacaggtgttgtgacgaccataatgttccacagagatccaaagcgccttctgttattttcaggaagtgatgatggcacagtgcgcgtttggaaccttgaaagcaaaaaatgcattgcggtgcttaacgcacatttttcaacagtgacttcgttggcattatcagaagacgggctaacattgctcagtgcaggaagggataaggttgtgaatgtgtgggatcttcggaagtacgcctcaaagaagacaataccagcatatgaaatgatagaaggtgtttccttcattggaccagggagcggcatcttggcttgtttgggtgtcgaagcggcaaagttgaaggaaaaaacggatggttattttcttacggttggtgaacgtggaatcgtgcgcatatggtgcttggaaagcgctgtctgcgtgtttgagcagcagtcatctgatgtaaccatcaactcagaaaacgaggaatctagaaggggctttacagctactaatatgttgccagatgatcaaggaattctatgtgtcactgctgatcaacaatttttgttctattcttgtacaagaactgatgaagggactttccagttgaacctatataaacgtctaataggttataatgacgagattcttgatttgaagtttgttggggaagatgaacaatatcttgccgtagccactaacttggagcaggtccgtgtttatgacgttgcatcaatgtcatgttcttatgtgctggcgggtcacactgaaattgttgtttgccttgatacctgtgtgtctgcttctgggaagacacttgttgtaactgggagcaaagataatactgtaagattgtgggatatggaaaagagaagctgtattggtactggtaaaggccatctaggagctattggttgtgttgctttctcaaagaagtcaaagaacttttttgttagtggtagcagtgaccgaacaatcaaggtttggacctgggatgatacactcattgatgctggcggtgaagttcctctcaaagcaaaggctggtgtagctgcacatgataaagatattaattctctgtctgtctcacctaatgacggccttgtttgcagtggttcggaggaccgaactgcaagcatatggaaactccctaacctagtgtcatcggttgtccttaaagggcataaaaggggcatttggtcagttgagttttcccctgttgaacaatgtgtcataacatcatctggtgacaaaactgtcaaaatatggcatgttgctgatggctcatgcctgaagacatttgagggtcatacatcaagtgttttaagagcttcattcctttcacgtggaactcagtttgtttcttgtggaagcgatggtctagtgaagctatggacgataaagacgaatgagtgcattgctacgtatgacaagcacgatgggaagatttgggcactggctgttggcaagagaactgaaatgcttgctactggcggaactgattctgatcttaacctttggcacgattgcacgatggaagataagcaggaggatttccttaagaaggaggaggaagttttaagaggccaggaattggaaaatgcagtgtcagattctgactatacaagagcaatacaactcgcatttgagcttagaagaccacgcaggcttcttgagttattctcacagctttgcaggaaagctgatccagaggaccctatagaaaaagcccttgttggtctcccaaaggaagggcttcgcgtgcttcttgagtatatacgtgaatggaacacaaagcccaagttttgtcatgttgcacagtttgtactttttcgggtgttgaggagcttgcctcccactgatatcctggagataaaaggcatcagtgagctcctcgagggcctcattccatattcgcaaaggcacttcagcagagtcgatagactagtacgcagcacgtttttattggactacaccttggcccgaatgtctgtcgtagacccagacgtagatgcgggcacaaccaaagactcgtcaatgaacaatgttgagatggcgccagcagagcctgcacaggacaccccggagaagccgggcaggaagagaaaatccagcaaaacaacaagccaatcaagcaagaaaagtagtaagaaggtgaaggcttcttcgagcgctgttgtttctgttgaggcgtaaacagttaacactgaccggttctctcttcgcaccaccaattttgtagctgctgcctgtggaatcatgtttattttgcttcatgacaaaccctgtacagaatgtattatttgccgagtcgaaaagacatcaggcgtgtacgagtaatccgttaaatttttccgatggaattcatagctaagcttttgtttcagaaatcgacgcgggccatcttatccgctgggttggttcgcctccacggaggcagtgcgtgccccagtcataaagtcgcttgctccacttgcaattgttggat

SEQ ID NO: 7795 - DNA, 3040 bp, Zea mays
cgacagtcgtcaccccgctttcccctactggatccagccacttgacttcgcttaaaccctgatcctcttcctccctctcctccggtcctcccgcgccgccacccccatctcccaccgcaaaaccttaggtccgacgagcccccgccgttgccgtgggcgccagaagcagccatggcttcgagttcgacgtgtgttcttaagaagaactaccgctgcgaccgctccctgcagcagttttacactggtgggccctttgcggtcgggcttgcccccggcggcgatggcgagggcggcgccgaggctgaggccttcctcgcatgcgcctgcggtggagaggtgcgcgtggtgtcctccgcggacgcctctgccataggggagcccgtcgacggcgactcggaggccatcaccgcgctggcgctgtcccccgactcacggctcctctttgccgcggggcacagcaggcttattagggcctgggacctcgcgtcccgagcttgcatacgcagctggaagggacatgatggtcctatcatggccatggcatgccatgtttctggtggtttgcttgcaactgccggagcagacaagaaggtctgcgtatgggatgtggatggtggattttgcacccatttccttagaggccatacaggggttgtgacatccgttatgttccacaaagatccaaagcgccttctgttgttttcaggaagtgaagatggcaccgtgcgagtgtggaaccttgaaactaaaaaatgtgttgctgtgcttaaagagcatttttcagcagttacttcattggcattgtctgatgatggacaaacattgctgagcgctgggagggataagattgttaccgcgtgggatattcgtaaatacagctcaaagaagacaataccgacatatgaaatgatagaagctgtttccttcattggaccaggaagtgagtttttggcttgtttgggcatagaactggcaaacaaaaaggagaaagatactgcttatttccttacagttggtgaacgtggggtcgtgcgcatctggtgcttggagagttgtctttgcgtatttgagcagcaaacatctgatgtaactgttaactcagagaacaaggaaacaaggaggggctttacatctgctgttatgttgccaaatgaacaaggattgctatgtgttactgctgatcagcagtttttgttctattgtcccaaaaggactgatgatgggacctttgaactgtccctatatagacgactaataggttataatgatgagattcttgacttaaagtttattggggaggaggaacaatatcttgctgtagctaccaacttggagcaggtccgtgtttatgatgttgcgtcaatgtcatgttcttatgtgcttgctggccacaccgaaataattgtttgcattgacacatgtgtctctgcttccgggaagacacttgttgtaactgggagcaaggataacactgtgaggttatgggatgctgaaagaaaaagctgtattggcattggcaaaggccatctgggagctgttggttctgttgccttctcgaagaaaacaaaggacttttttgttagtggcagcagcgatcgaaccatcaaggtatggacctgggacaacacacttggtgatgctgaggatgaagtccctcttaaagcaaaggctgttgtagctgcacatgataaagatattaattatctgacagtttcacctaatgatggtcttgtttgcagtggttctgaggaccggactgcttgcatatggaaactccctaatctagtgttctctgttgcccttaaggggcacaaaagaggaatctggtcagttgagttttctcctgttgaacaatgtgtcatgacatcctcgggtgatagaacaatcaaaatatggtccgttgctgatggctcttgtttgaagacatttgagggtcatacatcaagtgttctgcgagcgtctttcctttcacgtggaactcaagttgtttcttgtggaagtgatggtctagtgaagctatggacaattaagacaaatgaatgcattgctacttatgataagcatgatgggaaggtctgggcattggctgttggcaggaaaactgaaatggttgctactggtggaaccgatgctgtcctcaatctgtggcatgattgcaccatggaagataagcaggaagatttccgtaagaaggagcaagaagttttaagaggccaggaattggaaaatgctgtgtcagattctgactatgcaaaggcaatacaacttgcatttgagcttagaagaccacacaagcttctagatttattctcacagcttgccaggcgagctgacgcagaggatccaatagaaaaggctcttcttggtcttccaaaggatggccttcgtgtgcttctagagtacgcccgtgaatggaatacgaagcccaagttctgtcatgttgcgcagtttgtgctttttcgggtattgaggagtttctctcccactgatatcctggagataaagggcatcagtgagctccttgagggccttattccgtattcgcagaggcatttcagcagagtggacagactagtccgaagcacgtttctgttggactatacgctgacgcgaatgtccgtggtagacccagatgtggatgcggggtcaatcaaagacgaaatgaatggttcgtctgtggagaacggtgaacttgcagagcctcggcctgcttcacctgtgccagagaagtcaagcaagaagagaaaatctggcaaatcaagtaaaaagggaaaggagaaggtgatgaagcttgcctcgagtggacttggcaagggtgtttctgttgaagcctgaaaatctagctgagaatctggttttgcttatgcatgcatgcatccaattttgtagcagctgttgaaactgacgttgcccaacgcacgaatcacatttgatgtaaatgcagttttttgctgcgtttattagaaggccgcagcgcatttaatgcattggagtgtatgatttgctatcaaaatttggcacgccaaaggttttgataagc

SEQ ID NO: 7796 - DNA, 2806 bp, Panicum virgatum
cgcgccgccaccgccgccgccgccgcaaaaccctagctccgacgatacgccgccgccgccgcaaaaccctagctccgacgacacgccgccgccgttgccgcggccgccgaaactagctatggcgtcgactcaggcgcttaagaagaactaccgctgcgaccgctcgctgcagcagttctacacgggcgggccgttcgcggtcgggcgcggccccgccggcgaggccgaggccgaggccgagccgttcctcgcgtgcgcatgcggcggggaggtgcgcgtggtgtccgcagcggacgcctccgcgataggcgagcccgtcgagtgcgactcggaggccatcaccgcgctgaccctgtccccggactcccgcctcctttttgctgcggggcacagcaggctcatcagggtctgggacctcgcgacccgcacttgcatacgcagctggaagggacatgatggtcctattatggccatggcatgccatgcttctggtgggttgcttgcaactgccggagcagacaagaaggtctgcgtgtgggatgtggatggtggattctgcacgcatttcttaagaggtcatacaggtgttgtgacgaccattatgttccacaaagatccaaagcgccttctgttattttcaggaagcgaagatggcaccgtgcgagtatggaaccttgaaaccaaaaaatgtgttgctgtgctgaaagagcatttttcaacagtcacttcattgtcattgtctgatgatggacaaacattgctcagtgctgggagggataaggttgttactgcgtgggatgttcgtaagtacagctcaaagaagacaataccaacgtatgaaatgatagaagctatttccttcattggatcaggaagtgaggtactggcttgtttgggcatagaactggcaaatatgaagggaaaaatggatggttattttcttacagtaggtgaacgtggggttgtgcgcatctggtgcttggagagtggtcattgcatattcgagcagcaatcatctgatgtaactgtaaactcagagaatgaggaaaccagaaggggttttacatctgctgttatattgccaaatgatcaagggttgctatgtgttactgctgatcagcagtttttgttctattgtcccaaaaaaactgatgaagggatcttccaactgtccctatatagacgtctagtgggttataatgatgagattcttgacttgaagtttgttggagatgacgaacaataccttgctgtagctactaacttggagcagctgttaccaccacatgcaggtccgtgtttatatacgtctgaaatttcttacgccgtgtacctccatatgcaggtccgtgtttatgatgttgcttcgatgtcatgttcttatgtactggctggccacatggaaattgttgtttgcatcgacacctgtgtctcttcttctgggaagacgcttattgtaactgggagcaaggacaatactgtgaagttatgggatgctgaaaggagaagctgtattggtactggtaaaggccatctgggagctgttggttctgttgcattctcaaagaaatcgaagaacttttttgttagtggcagcagtgatcgaaccatcaagatatggacctgggatgatacgcttgatgatgatgaagttcctcttaaagctaaggctgttgtagctgcacatgataaagatattaattctctggctgtttcacctaatgatggccttgtttgcagcggctctgaggaccggactgcttgcatatggaaactccctaacctggtgtcctctgttgtccttaaggggcacaaaagaggaatctggtcggttgagttttctcctgttgagcaatgtgtcatgacatcttctggtgacagaacaatcaagatttggtcagttgcagatggctcgtgcttgaagacgtttgagggtcatacgtcaagtatcttgcgagcttctttcctttcacgtggaactcaagttatttcttgcggaagtgatggtctagtgaagctatggacaatcaaaacaaatgaatgcattgctacttatgataagcatgatgggaaggtttgggcattggctgttggcagaaaaactgaaatgcttgctactggtggaacggatgctattctaaacctgtggcatgattgcaccatggaagataagcaagaagatttccgtaaaaaggaggaagaagtcttaagaggccaggaattggaaaatgcagtatcagattctgactatacaaaagcaatacaacttgcatttgagcttagaagaccacacaggctcctagagttattctcacagcttgccaggagagctgattcagaggatccaatagaaaaggctcttcttggacttccaaaagatggccttcgtgtgcttcttgagtacatccgtgaatggaatacgaagcctaagttctgtcatgtttcacagtttgtgctttttcgggtattgaggtgtttgcctcccactgatatcctggagataaagggcatcagcgagctccttgagggtcttattccgtattcgcagaggcatttcagcagagtcgatagactagtgcgcagcacatttctgttggactatacattgatgcgaatgtccgtggtagatccagatgtagatgcaggcacagccaaagatgacatgaacggttcatcagtggagaacgatgaaaccgcagaggcttgtcctgcttcgcctgtaacagagaaaccgagcaagaagagaaaacagggcaaatcaagcaaaaagggcaaggagaagaaggtgaaggttctttcaaagtat

SEQ ID NO: 7797 - DNA, 2107 bp, Brachypodium distachyon
tcgcctttgctttcttttctcccagctgcaaaagcggggcaccagcggagattgaggaagaggggcgccatggagatcgggggccagtaccctgggagcagctgctccaaggagcaccagaagatctaccaggagtggtttgccttcgcggactcagatggcgacggccgcatcacgggccctgacgccatcaagttcttcgccatgtccaagctcccccgcgccgacctcaagcaggtctgggccattgcggactccaagcggctggggtacctcggtttcggcgagttcgtcacggcgatgcagctcgtctctctggcgcaagcggggaatgagattactcaagacagccttaagcgtgacgatcttagtagcttgaatcctccagtgatggagggtttggatgttctgcttgctaaatccaagcatttggcaaagagggtcgatccggatattgatggatttcctcaggcacaaccaccttcaacaaaccattggttcagctcaaagtcatcaaagaagatacctctgactgctgttacttctgtcatcgatggtttaaaaaaactatatgtcgaaaaattgaagcctttggaagttacatacaaattcaatgactttgtttccccgttactgacaaacagcgattttgatgcaaagccaatggttatgctcttaggtcaatactctacggggaaaacaacttttatcaagcatctgctaaaaactagctatccaggtgcccatattgggccagagccaacaaccgacagatttgttgttgtcatgtcaggacctgatgaaaggactattcctgggaatactttagctgttcaagcagacatgccttttagtggtcttacaacatttggaacatcatttttatccaagtttgaatgctctcagatgccacatccactgttagaacatatcacgtttgtcgacacacctggtgttctttctggtgaaaagcaacggactcaacgcagctacgaattcactggtgttacatcatggtttgctgccaagtgtgaccttatccttcttttgtttgatccccataagcttgatatcagtgacgagtttaaacgtgtcattggatctttacgtggacatgatgacaaaatacgtgtagtcctgaacaaggcagaccaaatcgacactcaacagcttatgagggtgtatggcgcactgatgtggtctcttggtaaagtattgaacacccctgaggtgtcgcgagtttatatcggatcattcaatgacaaaccagtaaatgaatcagctgttggtccaatcggaaaggaactatttgagagagagcaggatgatctcctttctgatctaaaagatataccaaaaaaagcttgtgaccgccggatcaatgaatttgttaaacgtgcaagagcggctaagatacatgcttatataattggtcatctaaagaatcagatgcctacaatgatgggcaaagctaaagctcaacagcgacttatagacaatttgcaggatgagtttgcaaaggtgcaaagggaacatcatcttcctgccggagatttcccttacgtggagcacttcaaagatgtattgggtggctatagcattgacaagttcgagaaggtcaagcccaagatgatacaggcagtggacgatatgcttggatatgacatcccagagcttctcaagaacttcagaaacccttacgagtgaacaaacttcttgatcggaagatggctctggtttgcaccagcattcctatccccagattgtggaggttgcgattgtctgaccatgcccaaatggtctgtgtttcatgtcctgtagggtgttgctccgacattctaccattgttgtacaattgtatgcataggaaccggaagcgattgctcagcttttccctagagacctgtcatgtggaatgccatgtaaagaatcggatgatagccacattgtttcttcaaatgagtatctattccgcatgttgaacactttatggtgtaatcctaaccattccaaaacgcatggtcttttagtcatggccaggtcttcagatgcatcgctgtcttataatttttgcaagattgtgttaataaaaaattgcagaattatg

SEQ ID NO: 7798 - DNA, 2184 bp, Setaria italica
agcccatttgaaaacgctgctctgtttccacacagtgcggccacgtcgtagggttttgcttcccccggcggtaaagcggaggaggcgggggcggaggggcgcggcgaccgaccgccgcccggccatggagatcgggcagtaccccgcgagcggctgctccaaggagcaccagaagatctaccaggagtggttcgcgctcgcggactcagatggggatggccgcatcacgggccccgacgccatcaagttcttcggcatgtccaagctctcccgccccgacctcaagcaggtctgggctatcgcggactccaggcggcaggggtacctgggtttccccgaattcgtcgcggcaatgcagctagtctctttggcgcaagcggggaatgagatcactcaggatagccttaagcgcgatgatttgagcagtttgaatccacctgtgatggaaggtttggatgctctactcgcgaaatctaagcatgtggtgaagcgggttgatccggaaatggatggatttcctcaggaacaatcacctttaacaaacaaatggttcagctcaaagtcatcaaagaagataccgctgacagctgttacttctgtcattgatggcttgaaaaaattatatatcgaaaagctgaagcctttggaagttacatacaaattcaatgattttgtttcccctttgctgacgagtagtgattttgatgcaaagccaatggttatgctcttaggtcaatattctactggtaaaacaacttttatcaagcatctgctaagaacaagctatccaggtgcccatattggaccagagccaacaacggacagatttgttgttgtcatgtcaggatctgacgaaaggactattcctgggaatactattgctgttcaagccgacatgccttttagtggtcttacaacatttgggactgcatttttatccaagtttgagtgctctcagatgcgacatccactgctagagcatatcacatttgtcgacacacctggtgttctttctggtgagaagcaacgcacacaacgtagctatgatttcactggtgtgacatcatggtttgctgcgaagtgtgatcttattcttcttctgtttgatcctcataagcttgatatcagtgatgagttcaaacgtgtcatcggatctttacgtgggcatgatgataaaatacgtgtagttttgaacaaagctgatcaagtagacactcaacagcttatgagagtttatggtgcattgatgtggtctcttggcaaagtattgaatacacctgaggtttcacgtgtttatattgggtcattcaatgacaaaccagtaaatgaatcagctgttggtccacttggaaaggaactatttgagagagagcaagatgatctcctttctgatctcaaagatatccccaagaaagcatgtgatcgtcggatcaatgaatttgttaaacgtgctagagctgctaagatccatgcttatataattggccatctaaagaaggagatgcctacaatgatgggcaaagcaaaagcccaacaacgactcatagacaatttgcaggatgagtttgcaaaggtgcaacgggaataccatcttccggcaggggatttcccttatgtggagcacttcaaagaggtcttgagcgggtatagcttcgacaagtttgagaaagtcaagcccaagatgatacaggcggtggatgatatgcttggatatgacattccagaacttctcaagaacttcaggaatccctacgagtgaacccatacaggcagttcaaagatgacttttgtctgcaccataatgagggactgagcatgggggcacagattgctgctgcctcccgtagcgctggaattgtcaggcaacgtgaatcatccggtcaaggtcatgtggggcgttatttgccattcattgttgtaatgcataagaatcggagagccattgctcaagctttcacggaacatgtggtcatgtaaaatcgactaaatagtgatctttagtgttatacagctgcactcattgtttctcccaatgagtatttattcctttttttgggaacaactggaataacgcagttctctcgaagtgtcaattatcagtgcgtgaagaatcttggaccagcgtggggcgttgccctggtcatggctccttgttttgttgtatgtgaatgcgactgttgattg

SEQ ID NO: 7799 - DNA, 1990 bp, Zea mays
tttccaacacagcgaggcccacgttgtagggttttgcttgcttcgcccggcggtaaagctgagcgcggcgagagccggagaccgaagaagcgccgcgcgcccggtcatggagatcggacagtaccccgcgagcggctgctccaaggagcaccagaagatctaccaggagtggttcgcgctcgcggacgcagatggggatggccgcatcacgggccccgatgcgatcaagttttttggcatgtccaagctctcccgccctgacctcaagcaggtctgggctatcgcggacaccagaaggcaggggtatctgggtttctctgaattcgtcaccgcgatgcagctagtctctctggcacaagcaggcaacgagattactcaagatagccttaagcgagatgatttgagcagtttgaatccacctgtgatggaaggtttggatgccctacttgcgaaatctaagcatttggtgaagcgtgttgatccagaaatggatggatatcctcaggaacaatctcctttaacaaacaaatggtttagctcaaagtcatcaaagaagatacctctgacagccgtcacttctgttatcgatggcttgaaaaaactttacatcgaaaagttgaagcctttggaagttacatacaagttcaatgatttcgtttcccctttgctgacaagtagtgattttgatgcaaagccaatggttatgctcttaggtcaatattctactggtaaaacaacttttatcaagcatctgctaagaacaagttatccaggtgcccatatcggaccagagccaacaacagacagatttgtagttgtcatgtcaggatctgatgaaaggactattcctgggaatactattgctgttcaagctgacatgccttttagcggtcttacaacatttgggactgcatttttatccaagtttgagtgctctcagatgcgacatccactgctagagcatatcacatttgttgacacacctggtgttctttctggtgaaaagcaacgcacacagcgcagctatgatttcactggtgtgacatcatggtttgctgcgaagtgtgatcttatccttctcctgtttgatcctcataagctcgatatcagtgatgagttcaaacgtgtcattggatcattacgtggccatgatgacaaaatacgcgtagttttgaacaaggcagaccaagtagacactcaacagcttatgagagtttatggtgcattgatgtggtctctcgggaaagtattgaatacacctgaggtttcacgtgtttatattggatcattcaatgacaaaccagtaaatgaatcagctgttggtccacttggaaaggaactatttgagagagagcaagatgatcttctttctgatctcaaagatatccccaagaaagcctgtgaccgccggatcaatgaatttgttaaacgtgctagagctgccaagatccatgcttatataataggtcatctaaagaaggagatgcctacaatgatgggcaaagcaaaagcccaacaacgactcatagacaatctgcctgatgagtttgcaaaggtgcaacgggaataccatcttccgtcgggagattttccttatgtggagcacttcaaagaggtcttgagcgggtacagctttgacaagtttgagaaggtgaagcccaagatgatacaggccgtggatgatatgcttggatatgacattcctgaacttctcaagaacttcagaaacccatacgagtgaacccatacaggcggttgaaagatgacttcgatctgcaacagaatgagggattgattgtcaggcgatgtgaatcatagtggtcaatgtctcttggggcgttcattgccatccatgcttagccattgttatataactttatgcataagaatcatagagccattgctcaagctttcaccagacatctgattatgtaaaatccacaaaatagtgatgttagtgttaaagaatatactgtgatgttgtttcttc

SEQ ID NO: 7800 - DNA, 2031 bp, Pennisetum glaucum
tttccacagtgcggccacgtcgtagggttttgcttcccccggcggtaaagcggaggaggcgcgcgcggcgagcgaccgaccgccgccccggccatggagatcgggcagaaccccgcgagcggctgctccaaggagcaccagaagatctaccaggagtggttcgcgctcgcggactcagatggggacggccgcatcacgggccccgacgccatcaagttcttcggcatgtccaagctctcgcgccccgacctcaagcaggtctgggctatcgcggactccaggcggcaggggtacctgggtttccccgaattcgtcgcggcaatgcagctagtctctttggcgcaagcggggaatgagatcactcaggatagccttaagcgcgatgatttgagcagtttgaatccacctgtgatggaaggtttggatgctctactcgcgaaatctaagcatgtggtcaagcgggttgatccagaaatggatggatttcctcaggaacaatcacctataacaaacaaatggtttagctcaaagtcatcaaagaagataccgctgacagctgttacttctgtcatcgatggcttgaaaaaattatatatcgaaaagctgaagcctctggaagttacatacaaattcaatgattttgtttcccctttgctgacaagtagtgattttgatgcaaagccaatggttatgctcttaggtcaatattctactggtaaaacaacttttatcaagcatcttctaagaacaagctatccaggtgcccatattggaccagagccaacaacggacagatttgttgttgtcatgtcaggatctgatgaaaggactattcctgggaatactattgctgttcaagccgacatgccttatagtggtcttacaacatttgggactgcatttttatccaagtttgagtgctctcagatgcgacatccactgctagagcatatcacattcgtcgacacacctggtgttctttctggtgaaaagcaacgcacacaacgtagctatgatttcactggtgtgacatcatggtttgctgcgaagtgtgatcttattcttcttctgtttgatcctcacaagcttgatatcagtgatgagttcaaacgtgtcatcggatctttacgtgggcatgatgataaaatacgtgtagttttgaacaaagccgatcaagtagacactcaacagcttatgagagtttatggtgcattgatgtggtctcttgggaaagtattgaatacacctgaggtttcacgtgtttatattgggtcattcaatgacaaaccagtaaatgaatcagctgttggtccacttggaaaggaactatttgagagagagcaagatgatctcctttctgatctcaaagatatccccaagaaagcttgtgaccgtcggatcaatgaatttgttaaacgtgctagagctgccaagatccatgcttatataattggccatctaaagaaggagatgcctacaatgatgggcaaagcgaaagcccaacaacgactcatagacaatttgccggatgagtttgcaaaggtgcaacgggaataccatcttccggcaggggatttcccttatgtggatcacttcaaagaggtcttgagtgggtatagcttcgacaagtttgagaaagtcaagcccaagatgatacaggcggtggatgatatgcttggatatgacattccagaacttctcaagaacttcaggaatccctacgagtgaacccatacaggaggttaaaagatgagttttgtctgcaccagaatgtgggactgtgggggcacacagattgatgctgcctccggtagcgctggaattgcgaggcaacgtgaatcattcggtcattatttgccattcattgtttaactgtacgcataagaatcggggagacattgcagtgaagctttcacggaacatctggtcttgtaaaatcgattaaagtgatctttagtgttatacagctgcactcattgtttctcccaatgagtatttattcattgttgggaacaactggaatatcgtcga

SEQ ID NO: 7801 - DNA, 2273 bp, Saccharum officinarum
gaaaactctgttcctgtttccactcagtgaggccacgtcgtagggttttgcttgcttcgcccggcggtaaagcggagcgcggcggtggtaaagcggagcgcggccaccgccgcgcgcccggccatggagatcgggcagtaccccgcgagcagctgctccaaggagcaccagaagatctaccaggagtggttcgcgctcgcggacgcagatggggatggtcgcatcacgggccccgacgcgatcaagtttttcggcatgtccaagctctcccgccccgacctcaagcaggtctgggctatcgcggacaccagacggcaggggtacctgggtttccctgaattcgtcacggcgatgcagctagtctctctggcacaagcggggaatgagattactcaagatagccttaaacgagatgatttggtcagtttgaatccacctgtgatggaaggtttggatgctctacttgcgaaatctaagcatttggtgaagcgtgttgatccagaaatggatggatatcctcaggaacaatctactttaacaaacaaatggttcagctcaaagtcatcaaagaagatacctctgactgctgttacttctgtcattgatggcttgaaaaaactttatatcgaaaagttgaagcctttggaagttacatacaagttcaatgatttcgtctcccctttgctgacaagtagtgattttgatgcaaagccaatggttatgctcttaggtcaatattctactggtaaaacaacttttatcaagcatcttctaagaacaagctatccaggtgcccatattggaccagagccaacaacagacagatttgtagttgtcatgtcaggacctgacgaaaggactattcctggaaatactattgctgttcaagctgacatgccttttagcggtcttacaacatttgggactgcatttttatccaagtttgagtgctctcagatgcgacatccactgctagagcatatcacatttgttgacacacctggtgttctttctggtgaaaagcaacgcacgcaacgcagctacgatttcactggcgtgacatcatggtttgctgcgaagtgtgatcttattcttcttctgtttgatcctcataagcttgatatcagcgatgagttcaaacgtgtcattggatcattacgtggacatgatgacaaaatacgtgtagttttgaacaaggcagatcaagtagacactcaacagcttatgagagtttatggtgcattgatgtggtctcttgggaaagtactgaatacacctgaggtttcacgtgtttatatcggatcattcaatgacaaaccagtaaatgaatcagctgttggcccacttggaaaggaactatttgagagagagcaagatgatctcctttctgatctcaaagatatccccaagaaagcctgtgatcgtcggatcaatgaatttgttaaacgtgctagagctgccaagatccatgcttatataataggccatctaaagaaggagatgcctacaatgatgggcaaagcaaaagctcaacagcgactcatagacaatctgcctgatgagtttgcaaaggtgcaacgggaataccatcttccgttgggagattttccttatgtggaacacttcaaagaggtcttgagcgggtatagcttcgacaagtttgagaaggtcaagcccaagatgatacaggccgtggatgatatgcttggatatgacattccagaacttctcaagaacttcagaaacccatacgagtgaacccatacaggcggttgagagatgactttgatctgcaccaaaatgagggattgagcggggcatggattgatgctgccgtccatagctttggaattgtcaggcgacgatgaatcatcgcgatcaaggtcccgtggggcgttcattgccatccatgcttcaccattgttatataactttatgcataagcatcatagagccattgctcaaactttcaccagacatctggtcatgtaaaatcgactaaatagtgatcttagcattaaagaatatactgcgatgctcattgtttcctcaaatgagtatttattcgtttggaacagctggataatgcggtcctgtcaattatcagcccatgaagaatatttggaccaccgtggggtgttgtcctgagcatggctccttgttttgcttttatgtgaatttgttcatgaatgtcatgtatgttatggcactgcaaaatctgatatgatatgttgcaaatatatttttgatatgaaccattgagaaattaactc

SEQ ID NO: 7802 - DNA, 1861 bp, Echinochloa colona
acagtgcggccacgtcgtagggttttgcttccaccggcggtaaagcggagcgccgcgaggggcggaggagcgcggcgaccgccgcccggccggccatggagatcgggcagtaccccgcgagcggctgctccaaggagcaccagaagatctaccaggagtggttcgcgctcgcggactcagatggggatggccgcatcacgggccccgacgccatcaagttcttcggcatgtccaagctctcccgccccgacctcaagcaggtctgggctatcgcggactccagacggcaggggtacctgggtttcgccgaattcgtagcggcaatgcagctagtctctctggcacaagcggggaatgagatcactcaagacagccttaagcgagatgatttaagcagtttgaatccacctgtgatggaaggtttagatgctctgcttgcgaaatctaagcatgtggtgaagcgggttgatccagaaatggatggatttcctcaggaacaatcaactataacaaacaaatggttcagctcaaagtcatcaaagaagatacctctgactgctgttacttctgtcattgatggcttgaaaaaactgtatattgaaaagctgaagcctttggaagttacctacaaattcaatgatttcgtttcccctttgctgacaagtagtgattttgatgcaaaaccaatggttatgctcttaggtcaatattctactggcaaaacaacttttatcaagcatctgctaaaaacaagctatccaggtgcccatattggaccagagccaacaaccgacagatttgtcgttgtcatgtcaggatctgatgaaaggaccattcctgggaacactattgctgttcaagccgacatgccttttagtggtcttacaacatttgggactgcatttttatccaagtttgagtgctctcagatgcgacatccactgctagagcatatcacatttgttgacacacctggtgttctttctggtgaaaagcaacgcacacaacgtagctatgatttcactggtgtgacatcatggttcgcggcgaagtgtgatcttattcttcttctgtttgatcctcataagcttgatatcagtgatgagttcaaacgtgtcatcggatctttacgtgggcatgatgacaaaatacgtgtagttctgaacaaggcagaccaagtagacacgcaacagcttatgagagtttatggtgcattgatgtggtctctcgggaaagtattgaatactcctgaggtttcacgtgtttatattggatcattcaatgacaaaccagtaaatgaatcagctgttggtccacttggaaaggaactatttgagagagagcaagatgatctcctttctgatctaaaagatattcccaagaaagcttgtgatcgtaggatcaatgaatttgtcaaacgtgctagagctgccaagatccatgcttatataattggccatctaaagaaggagatgcctacaatgatgggcaaagcgaaagcccaacaacgactcacagacaatttgcaggatgagtttgcaaaggtgcaaagggaacaccatcttccagcaggagatttcccttacgtggagcacttcaaagaggtcttgagcgggtatagctttgataagtttgaaaaggtcaagcccaagatgatacaagcagtggatgaaatgcttggatacgacattccggaacttctcaataacttcaggaacccgtacgagtgaacccatacaggtggttgaaagatgacttttgctctggactggaatgagggatgagtcaggcgcagatagatgctgccttccgtagtgttgcaattgtcaggctacgtgaatcattgtggtcaaaggtcctg

SEQ ID NO: 7803 - DNA, 1997 bp, Sorghum bicolor
ttccacacagtgaggccacgtcgtagggttttgcttgcttcgcccggcggtaaagcggagcgcggcgaccgccggcgcccggccatggagatcgggcagtaccccgtgagcagctgctccaaggagcaccagaagatctaccaggagtggttcgcgctcgcggacgcagatggggatggccgcatcacaggacccgacgcgatcaagtttttcggcatgtccaagctctcccgccccgacctcaagcaggtctgggctatctcggacaccagacggcaggggtacctgggtttccctgaattcgtcacggcgatgcagctagtctctctggcacaagcagggaatgagattactcaagatagccttaagcgagatgatttgataagtttgaatccacctgttatggaaggtttggatgccctacttgcgaaatctaagcatttggtgaagcgtgttgatccagaaatggatggatatcctcaagaacaatctactttaacgaacaaatggttcagctcaaagtcatcaaagaagatacctctgactgctgttacctctgtcatcgatggcttgaaaaaactttatatcgaaaaactgaagcctttggaagttacatacaagttcaatgattttgtctcccctttgctgacaagtagtgattttgatgcaaagccaatggttatgctcttaggtcaatattctactggtaaaacaacttttattaagcatctgctaagaacaagctatccaggtgcccatattggaccagagccaacaacagacagatttgtagttgtcatgtcaggacctgatgaaaggactattcctggaaatactattgctgttcaagctgacatgccttttagtggtcttacaacatttgggactgcatttttgtccaagtttgagtgctctcagatgcgacatccactgctagagcatatcacatttgttgacacacctggtgttctttctggtgagaagcaacgcacgcaacgcagctatgatttcactggcgtgacatcatggtttgctgcgaaatgtgatcttattcttcttctgtttgatcctcataagcttgatatcagcgatgagttcaaacgtgtcattggatcattacgtggacatgatgacaaaattcgtgtagttttgaacaaggcagatcaagtagacactcaacagcttatgagagtttatggtgcattgatgtggtctcttgggaaagtattgaatacacctgaggtttcacgtgtttatattggatcattcaatgacaaaccagtaaatgaatcagctgttggtccacttggaaaggaactatttgagagagagcaagatgatctcctttctgatctcaaagatatccccaagaaagcctgtgaccgtcggatcaatgaatttgttaaacgtgctagagctgccaagatccatgcttatataataggccatctgaagaaggagatgcctacaatgatgggcaaagcaaaagcccaacaacgactcatagacaatctgcccgatgagtttgcaaaggtgcaacgggaataccaccttccgtcgggagattttccttatgtggagcacttcaaagaagtcttgagtgggtatagctttgacaagtttgagaaggtcaagcccaagatgatacaggccgtggatgatatgcttggatatgacattccagaacttctcaagaacttcagaaacccatacgagtgaacccatacaggcagctgaaagatgacttcgatctgcaccaggatgagggattgagtggggcatggattgatgctgcattccataactttggaattgtctggcaacgtgaatcatcgcagtgaaggtcgtggggcgttcattgtcatccatgcttcaccattatataactgtatgcataagaatcgtagatccattgctcaagctttcaccagacatctggtcatgtaaaatcgactaaacagtgatattagtgttaaagaatatactatttattctca

SEQ ID NO: 7804 - DNA, 2082 bp, Avena sativa
gctgctacctctcacagtgtggccacgtcccggcgtctctcgccgcgtcgtagggttttacttccttttgcttctcccagctgcaaaggccgcgcccgcggagaccgaggtcgggttggtcggccatggagatcggggcggcgaccagctgctccaaggagcaccagaagatctaccacgagtggttcgccttcgccgactcagatggcgacggccgcatcacgggccccgacgccatcaagttcttcggcatgtccaggctcccccgcgccgacctcaagcaggtctgggccatcgcggactccaagcggctggggtacctcggtttcggcgaattcatcacttcgatgcagctcgtctctctggcgcaagcggggaatgagatcacccaggacagcctcaagagcggcgatctaagtagcttaaatcccccagtgatggagggtttggatgctctgcttgcgaaatccaagcatctggtaaagagggtcgatcaggatattgatggatttcctcaggcacaaggaccttcaacaaaccattggttcacatccaaatcgtcaaagaagatacctctgacagctgttacttctgtcattgatggcttaaaaaggctatacatcgaaaaattgaagcctttggaagttacatacaaattcaatgattttgtgtccccgttactgacaaacagtgattttgatgcaaagccgatggttatgctcttaggtcaatattctacagggaaaactacttttatcaaacatctgctaaaaacaagctatccaggtgcccatattggaccagagccaacaaccgacagatttgttgttgtgatgtcaggacctgatgaaaggactattcctgggaatactttagctgttcaagcagatatgccttttagtggtcttacaacatttgggacttcgtttttatccaaatttgaatgctcccagatgccacatccactactagagcatatcacgttcgttgacacacctggtgttctttctggcgaaaagcaacggacgcaacgcagctacgaattcactggtgttacgtcatggtttgctgctaagtgtgaccttattcttcttctgtttgatccccataagcttgatatcagtgatgagtttaaacgtgtcatcggatctttacgtggacatgatgacaaaatacgtgtagttctaaacaaggcagaccaaattgacactcaacagcttatgagagtgtatggtgcacttatgtggtctcttggtaaagtattgaatacccctgaggtgtcacgcgtttatattggatcattcaatgacaaaccagtaaaggaatctgctgttggtccaattgggaaggaactctttgagaaagagcaggatgatctgctttctgatctaaaagatataccaaagaaagcttgtgaccgccggatcaatgaatttgttaaacgtgctagagctgccaagatacatgcttatataattggccacctaaagaaccagatgcctacaatgatggggaaagctaaagctcaacaacgacttatagacaatttggaggatgagtttgcaaaggtacaaagggagcatcatcttccggcaggagacttcccttatgttgagcacttcaaagatgtgttgggtggttacagcatcgacaagtttgagaaggtcaagcccaagatgatccaggcggtggattacatgctcgggtacgacatcccggagcttctcaagaacttcaggaacccttacgagtgaacaaaacatcttgattggaagatggctttggttcatgttagacgtggatggatggacgctgcttactgtagtgttgagatcgtcaggcagtgccaacattgccagtgtttcatgtgtcgcgagatgtttattgccagtacattcttcccattgttgtacaactgtattgcataagaatcagaagcaattgctcaatttgtaccctggatatctgtcctgtcggattggcatgtaaagaatggaacagcagttgcattcatttctaggaacatcttgaatgcttgttggtgcgatccagtctattaactacccgtgaagaatattgggc

SEQ ID NO: 7805 - DNA, 1953 bp, Triticum aestivum
gaggggagccatggagatcggggggcagcacccggcgagcagctgctccaaggagcaccagaagatctaccgcgactggttcgccctcgccgactcagatggcgacggccgcatcaccggccccgacgccatcaagttcttcgccatgtccagcctcccccgcgccgacctcaagcaggtctgggccatcgccgactccaagcggctggggtacctcggcttcggcgagttcatcaccgccatgcagctcgtctctctggcgcaagcggggaatgagatatcccaggacagccttcagcgggaagatctaatcagcttcaatcccccagtgatggagggtttggatgctctgcttgcgaaatccaagcatttggcaaagagggtcgatcaggatatggatggatttcctcaggcacaaggaccttctactaaccattggttcaactctaagtcatccaagaagatacccctgactgctgttacttctgtcattgatggattaaaaagactatacattgaaaaattgaagcctttggaagttacatacaaattcaatgattttgtgtccccgttactgacaaacagtgattttgatgcaaagccaatggttatgctcttaggtcaatattctacagggaaaactactttcatcaaacatctgctaaaaacaagctatccaggtgcccatattggaccagagccgacaaccgacagatttgttgttgtcatgtcaggacctgatgaaagaactattcccgggaatactttagctgttcaagcagatatgcctttcagtggtctcacaacatttgggacttcgtttttatcaaagttcgaatgttctcagatgccacatccactactagagcatatcacgtttgtcgacacacctggtgttctttctggtgaaaagcaacggacacaacgtagctatgaattcacaggcgttacatcatggtttgctgccaagtgtgaccttatcctgcttctgtttgatcctcataagcttgatatcagcgatgagtttaaacgtgtcattggatctttacgtggacatgatgacaaaatacgtgtagttctgaacaaggccgaccaaattgacactcaacagcttatgagagtgtatggtgcccttatgtggtctcttggtaaagtattgaatacccctgaggtgtcgcgcgtttatattggatcgttcaatgataaaccagtaaaggaatcagctgttggcccgatcggaaaggaactatttgagaaagagcaggatgatctcctttctgatctaaaagatataccaaagaaagcttgtgaccgcaggatcaatgaattcgtcaaacgtgctagagctgctaagatacatgcttacataattgggcatctaaagaatcagatgcctacgatgatggggaaagctaaagcccagcagaaacttatagacaatttggagggcgagtttgcaaaggtgcaaagggaacatcatctccccgcgggggatttcccttacgtggagcacttcagagaagcattgggcgggtacagcatcgacaggttcgagaaggtgaagcccaagatgatccaggcggtggacgacatgctcgggtacgacatcccggagctgctcaagaacttcaggaacccttacgagtgagcagacatcatgatcggaagacggctttggttcgcagttcgacatgtcaggcatggatggcggtggctgcccatagggttttggctgccagtgtagtagggtgttcattgctactgctacattatacccattgttgtataactgtattatgcataataagagccagaagcaattgctcagttgttcgctggagaacggcctttattgtaatggcatggaagtcggaatatgggatggtggttgcatttatccttcagatgatcatctattcgttccgaggaacagcttgaatgaatgcttggttg

SEQ ID NO: 7806 - DNA, 2192 bp, Triticum aestivum
cgtcgtcgccgcgtgggttcgagccaaactccactccagtcaatcaatcgcaacccctgcgagcagtaaaagccatttttgaactcgctgtttgtgccacctcacctcacagcagccgccacgtccccggcgtggcggtagcctcgcgtcgcagtagggttttacctttgcttcccctttccccaagctgcagaggccgcggcgaccgaggcgggaagaggggagccatggagatcggggggcagcacccggcgagcagctgctccaaggagcaccagaagatctaccgcgactggttcgccctcgccgactcagatggcgacggccgcatcaccggccccgacgccatcaagttcttcgccatgtccagcctcccccgcgccgacctcaagcaggtctgggccatcgccgactccaagcggctggggtacctcggcttcggcgaattcatcaccgcgatgcagctcgtctctctggcgcaagcggggaacgagatatcccaggacagccttcagcgcgaagatctaatcagcttcaaccccccagtgatggagggtttggatgctcaacttgccaaatccaagcatctggcaaagagggtcgatcaggatatggatggatttcctcaggcacagggaccttctactaaccattggttcaactcgaagtcatccaagaagatacccctgactgctgttacttctgtcattgatggtttaaaaagactatacatcgaaaaattgaagcctttggaagttacatacaaattcaatgattttgtgtcccctttactgacaaacagtgattttgatgcaaagccaatggttatgctcttaggtcaatattctacagggaaaactactttcatcaagcatctgctaaaaacaagctatccaggtgcccatattggaccggagccgacaaccgacagatttgttgttgtcatgtcaggacctgatgaaaggactatccctgggaatactttagctgttcaagcagatatgccttttagtggtctcacaacatttgggacttcgtttttgtccaagttcgaatgctctcagatgccacatccactactagagcatatcacatttgtcgacacacctggtgttctttctggtgaaaagcaacggacacaacgtagctatgaattcacaggtgttacatcatggtttgctgccaagtgtgaccttatcctgcttctgtttgatcctcataagcttgatatcagcgatgagtttaaacgtgtcatcggatctttacgtggacatgatgacaaaatacgtgtagttctaaacaaggccgaccaaattgacactcaacagcttatgagagtgtatggtgcacttatgtggtctcttggtaaagtattgaatacccctgaggtgtctcgcgtttatattggatcgttcaatgataaaccagtaaaggaatcagctgttggcccgatcggaaaggaactatttgagaaagagcaggatgatctcctttctgatctaaaagatataccaaagaaagcttgtgaccgcaggatcaatgaattcgtcaaacgtgctagagctgccaagatacatgcttatataattgggcatctaaagaatcagatgcctacgatgatggggaaagctaaagcccagcagaaacttatagacaatttggagggcgagtttgcaaaggtgcaaagggagcatcatcttccagcaggggatttcccttacgtggagcacttcagagaagcattgggcgggtacagcatcgacaggttcgagaaggtgaagcccaagatgatccaggcggtggacgacatgctcgggtacgacatcccggagctgctcaagaacttcaggaacccttacgagtgagcagacatcatgatggaaagaccggcttcggtctcaggcgtagatggtggtagccagtctagtagggtattttattgctatattgtacccattgctgtgtaactgtatgcataagagccagaagcaattgctcaattgttggctggagaacggccttgttgtaatggcatggaaagaattcggaatatggtatggtggggtggtcgcgttgatccttgagatgattatctattcgttcggaagagcagcttgaatgcttgttggtgcgatccagtcaactggctacccatgaagagtgctggaccaccgtgtgtgtcgtctgccaga

SEQ ID NO: 7807 - DNA, 2016 bp, Triticum aestivum
caacccctgcgagcagtaaaagccatttttgaactcgctgttgtgccacctcacagcgcgtcgccacgtccccggcgtggtggtagcctcgcagtagggttttacctttgcttcccctttccccaagctgcagaggccgcggcgaccgaggcgggaagaggggagccatggagatcggggggcagcacccggcgagcagctgctccaaggagcaccagaagatctaccgcgactggttcgccctcgccgactcagatggcgacggccgcatcaccggccccgacgccatcaggttcttcgccatgtccagcctcccccgcgccgacctcaagcaggtctgggccatcgccgactccaagcggctggggtacctcggcttcggcgaattcatcaccgcgatgcagctcgtctctctggcgcaagcggggaacgagatatcccaggacagccttcagcgcgaagatctaatcagcttcaatcccccagtgatggagggtttggatgctcaacttgccaaatccaagcatctggcaaagagggtcgatcaggatatggatggatttcctcaggcacaaggaccttctactaaccattggttcaactctaagtcatccaagaagatacccctgactgctgttacttctgtcattgatggtttaaaaagactatacatcgaaaaattgaagcctttggaagttacatacaaattcaatgattttgtgtccccgttactgacaaacagtgattttgatgcaaagccaatggttatgctcttaggtcaatattctacagggaaaactactttcatcaagcatctgctaaaaacaagctatccaggtgcccatattggaccggagccgacaaccgacagatttgttgttgtcatgtcaggacctgatgaaaggactatccctgggaatactttagctgttcaagcagatatgccttttagtggtctcacaacatttgggacttcgtttttgtccaagttcgaatgctctcagatgccacatccactactagagcatatcacgtttgtcgacacacctggtgttctttctggtgaaaagcaacggacacaacgtagctatgaattcacaggtgttacatcatggtttgctgccaagtgtgaccttatcctgcttctgtttgatcctcataagcttgatatcagcgatgagtttaaacgtgtcatcggatctttacgtggacatgatgacaaaatacgtgtagttctaaacaaggccgaccaaattgacactcaacagcttatgagagtgtatggtgcacttatgtggtctcttggtaaagtattgaatacccctgaggtgtcgcgcgtttatattggatcgttcaatgataaaccagtaaaggaatcagctgttggcccgatcggaaaggaactatttgagaaagagcaggatgatctcctttctgatctaaaagatataccaaagaaagcttgtgaccgcaggatcaatgaattcgtcaaacgtgctagagctgccaagatacatgcttatataattgggcatctaaagaatcagatgcctacgatgatggggaaagctaaagcccagcagaaacttatagacaatttggagggcgagtttgcaaaggtgcaaagggaacatcatctccccgcgggggatttcccttacgtggagcacttcagagaagcattgggcgggtacagcatcgacaggttcgagaaggtgaagcccaagatgatccaggcggtggacgacatgctcgggtacgacatcccggagctgctcaagaacttcaggaacccttacgagtgagcagacatcatgatcggaagactggcttcggtatgtcaggcgtggatggtggtggctgcccatagagttgcggctgccagtctagctagcagggtatttatttctactacactgtacccattgttgtataactgtattatgcataagagccagaagcagttgttcactggagaacgcccttgttgtaatggcatggaaagaattgggaaat

SEQ ID NO: 7808 - DNA, 2301 bp, Triticum aestivum
ggcggtagcctcgcgtcgcagtagggttttacctttgctttcccctttccccaagctgcagaggccgcggcgaccgaggcgggaggggaggggaggggagccatggagatcggggggcagcacccggcgagcagctgctccaaggagcaccagaagatctaccgcgactggttcgccctcgccgactcagatggcgacggccgcatcaccggccccgacgccatcaggttcttcgccatgtccagcctcccccgcgccgacctcaagcaggtctgggccatcgccgactccaagcggctggggtacctcggcttcggcgagttcatcacggcaatgcagctcgtctctctggcgcaggcggggaacgagatatcccaggacagccttcagcgcgaagatctaatcagcttcaatcccccagtgatggagggtttggatgctcaacttgccaaatccaagcatctggcaaagagggtcgatcaggatatggatggatttcctcaggcacaaggaccttctactaaccattggttcaactctaagtcatccaagaagatacccctgactgctgttacttctgtcattgatggtttaaaaaggctgtacatcgaaaaattgaagcctttggaagttacatacaaattcaatgattttgtgtccccgttactgacaaatagtgattttgatgcaaagccaatggttatgctcttaggtcaatattctacaggaaaaactactttcatcaagcatctgctcaaaacaagctatccaggtgcccatattggtccggagccgacaaccgacagatttgttgttgtcatgtcaggacctgatgaaaggactatccctgggaatactttagctgttcaagcagatatgccttttagtggtctcacaacatttgggacttcgtttttgtccaagttcgaatgctctcagatgccacatccactactagagcatatcacgtttgtcgacacacctggtgttctttctggtgaaaagcaacggacacaacgtagttatgaattcacaggtgttacatcatggtttgctgccaagtgtgaccttatcctgcttctgtttgatcctcataagcttgatatcagcgatgagtttaaacgtgtcatcggatctttacgtggacatgatgacaaaatacgtgtagttctaaacaaggccgaccaaattgacactcaacagcttatgagagtgtatggtgcacttatgtggtctcttggtaaagtattgaatacccctgaggtgtcgcgcgtttatattggatcgttcaatgataagccagtaaaggaatcagctgttggcccgatcggaaaggaactatttgagaaagagcaggatgatctcctttctgatctaaaagatataccaaagaaagcttgtgaccgcaggatcaatgaattcgtcaaacgtgctagggctgccaagatacatgcttatataattgggcatctaaagaatcaaatgcctacgatgatggggaaagctaaagcccagcagaaacttatagacaatttggagggcgagtttgcaaaggtgcaaagggaacatcatctccccgcgggggatttcccttacgtcgagcacttcagagaagcattgggcgggtacagcatcgacaggttcgagaaggtgaagcccaagatgatccaggcggtggacgacatgctcgggtacgacatcccggagctgctcaagaacttcaggaacccttacgagtgagcagacatcatgatccgaagaccggcttcggcgtgtcaggcgtggatggtggtgggtgcccatagagttgcggctgccagtctactagggtatttattgctacactgtacccattgttgtgtaactgtatgaataagagccagaagcaattgctcagttgttcgctggagaacgcccttgttgtaatggcatggagagagttcggaatatgggatggatggtatggtggccgtactgatccttgagatgattgtctattcgttccgaggaacagcttgaatgctttgctggtgcgatccagtcaactggctaccaatgaagagtgctggaccaccgtgcgtgccgtgtgcttgaggcccctttctgggcagcagccctcctgttttgctccatgtggaagtgggtattaatttagtgttggtggttcagagattacctttcatgggtacagtttggggacaggcatgtttttcacttatggggtttattatctgcagcgagcgatgcagaaatgtgtttcacagttgtagatagaggttaaatgcagcttcatgtttaacc

SEQ ID NO: 7809 - DNA, 2055 bp, Avena sativa
gctacctctcacagtgtggccacgtcccggcgtgtctcgccgcgtcgtagggttttacttccttttgcttctcccagctgcaaaggccgcgcccgcggagaccgaggtcgggttggtcggccatggagatcggggcggcgaccagctgctccaaggagcaccagaagatctaccgcgactggttcgccttcgccgactcagatggcgacggccgcatcacgggccccgacgccatcaagttcttcgccatgtccagcctcccccgcgccgacctcaagcaggtctgggccatcgccgactccaagcggctggggtacctcggcttcggcgaattcatcaccgcgatgcagctcgtctctttggcgcaggcggggaatgagatatcccaggacagccttcagcgggaagatctaatcagcttcaatcccccagtgatggagggtttggatgctcagcttgcgaaatccaagcatctggtaaagagggtcgatcaggatattgatggatttcctcaggcacaaggaccttcaacaaaccattggttcacatccaaatcgtcaaagaagatacctctgacagctgttacttctgtcattgatggcttaaaaaggctatacatcgaaaaattgaagcctttggaagttacatacaaattcaatgattttgtgtccccgttactgacaaacagtgattttgatgcaaagccgatggttatgctcttaggtcaatattctacagggaaaactacttttatcaagcatctgctaaaacaagctatccaggtgcccatattggaccagagccaacaaccgacagatttgttgttgtcatgtcaggacctgatgaaaggactattcctgggaatactttagctgttcaagcagatatgccttttagtgtcttacaactatttgggactttcgtttttatcctaaatttgaatgctcccagatgccacatccactactagagcatatcacgttcgtcgacacacctggtgttctttctggcgaaaagcaacggacgcaacgcagctacgaattcactggtgttacatcatggtttgctgctaagtgtgaccttattcttcttctgtttgatccccataagcttgatatcagtgatgaatttaaacgtgtcatcggatctttacgtggacatgatgacaaaatacgtgtagttctaaacaaggcagaccaaattgacactcaacagcttatgagggtgtatggtgcacttatgtggtctcttggtaaagtattgaatacccctgaggtgtcacgcgtttatattggatcattcaatgacaaaccagtaaaagaatctgctgttggtccaatcgggaaggaactctttgagaaagagcaggatgatctgctttctgatctaaaagatataccaaagaaagcttgtgaccgccggatcaatgaattcgttaaacgtgctagagctgccaagatacatgcttatataattggccacctaaagaaccagatgcctacaatgatggggaaagctaaagctcaacaacgacttatagacaatttggaggatgagtttgcaaaggtgcaaagggagcatcatcttccggcaggagacttcccttatgttgagcacttcaaagatgtgttgggtggttacagcatcgacaagtttgagaaggtcaagcccaagatgatccaggcggtggatgacatgctcgggtacgacatcccggagcttctcaagaacttcaggaacccttacgagtgaagaaacatcttgactggaagatggctttggtccatgtcaggcgtggatggacgctgtttaccgtagtgttgagatcgtcaggcagcgccaacgtccgcagtgtttcatgtgtcctacattctccccattgttgtacaactgtatgcataagaatcagaagcaattgctcaactgtacgctggatatctgtcctgttggattggcatgtaaagaatggaacagcagttgcattcatttctaggaacatcttgaatgcttgttggtgcgatccagtctattaactacccgtgaagaatattgggc

SEQ ID NO: 7810 - DNA, 2122 bp, Secale cereale
gactcgtcgtcaccgcgtgggctcgagccaaactccactccagtcaatcaatctcaacccctacgagcagtaaaagccatttttgaactcgctgttgtgccacctcacagcagccgccacgtccccggcgtggtggtagcctcgcagcgcagtagggttttacctttgctttccctttccccaagctgcatagggccgcggcgaccgaggcgggaggaggggagccatggagatcggggggcagcacccggcgagcagctgctccaaggagcaccagaagatctaccgcgactggttcgcgctcgccgactcagatggcgacggccgcatcaccggccccgacgccatcaggttcttcgccatgtccagcctcccccgcgccgacctcaagcaggtctgggccatcgccgactccaagcggctggggtacctcggcttcggcgagttcatcaccgcgatgcagctcgtctctctggcgcaagcggggaatgagatatcccaggacagccttcagcgcgaagatctaatcagcttcaatcccccagtgatggagggtttggatgctcaacttgcaaaatccaagcatttggcaaagagggccgatcaggatatggatggatttcctcaggcacaaggaccttctactaaccattggttcaattctaagtcatccaagaagataccgctgactgctgttacttctgtcattgatggattaaaaagactatacatcgaaaaattgaagcctttggaagttacatacaaattcaatgattttgtgtccccgttactgacaaacagtgattttgatgcaaagccaatggttatgctcttaggtcaatattctacagggaaaactactttcatcaaacatctgctaaaaacaagctatccaggtgcccatattggaccagagccgacaaccgacagatttgttgttgtcatgtcaggacctgatgaaagaactattcccgggaatactttagctgttcaagcagatatgcctttcagtggtctcacaacatttgggacttcgtttttatcaaagttcgaatgttctcagatgccacatccactactagagcatatcacgtttgtcgacacacctggtgttctttctggtgaaaagcaacggacacagcgtagctatgaattcacaggcgttacatcatggtttgctgccaagtgtgaccttatcctgcttctatttgatcctcataagcttgatatcagcgatgagtttaaacgtgtcatcggatctttacgtggacatgatgacaaaatacgtgtagttctgaacaaggccgaccaaattgacactcaacagcttatgagagtgtatggtgcacttatgtggtcccttggtaaagtattgaatacccctgaggtgtcgcgtgtttatattggatcgttcaatgataaaccagtaaaggaatcagctgttggcccgatcggaaaggaactatttgagaaagagcaggatgatctcctttctgatctaaaagatataccaaagaaagcttgtgaccgcaggatcaatgaattcgtcaaacgtgctagagctgccaagatacatgcttatctaattgggcatctaaagaatcagatgcctacgatgatggggaaagctaaagcccagcagaaacttatagacaatttggagggcgagtttgcaaaggtgcaaagggaacaccatcttccggcgggggatttcccttacgtggatcacttcagagaagcattgggcgggtacagcatcgacaagttcgagaaggtgaaacccaagatgatccaggcggtggatgacatgctcgggtacgacatcccggagctgctcaagaacttcaggaacccttacgagtgagcagacgtcatgaccgacagtccggcttcggtatgtccggcgtggatggtggtggctgcccatagagttgcggccgccagtctagctagcagggtgttttattgctactacactgtacccattgttgtataactgtattatgcataagagccagaagcaattgctgctcaattgttcactggagaacggccttgttgtaatggcatggaaagaattcggaatatggggatggatgttgtggtggtcgcattgatcctt

SEQ ID NO: 7811 - DNA, 2100 bp, Secale cereale
gtcgtcaccgcgtgggctcgagccaaactccactccagtcaatcaatctcaacccctaccgagcagtaaagccatttttgaactcgctgttgtgccacctcacagcacagcagccgccacgtccccggcgtggtggtagcctcgcagcgcagtagggttttacctttgctttccctttccccaagctgcagaggccgcggcgaccgaggcgggaggaggggagccatggagatcggggggcagcacccggcgagcagctgctccaaggagcaccagaagatctaccgcgactggttcgccctcgccgactcagatggcgacggccgcatcaccggccccgacgccatcaggttcttcgccatgtccagcctcccccgcgccgacctcaagcaggtctgggccatcgccgactccaagcggctggggtacctcggcttcggcgagttcatcaccgcgatgcagctcgtctctctggcgcaagcggggaatgagatatcccaggacagccttcagcgtgaagatctaatcagcttcaatcccccagtgatggagggtttggatgctcaacttgcaaaatccaagcatttggcaaagagggccgatcaggatatggatggatttcctcaggcacaaggaccttctaccaaccattggttcaactctaaatcatccaagaagatacccctgactgctgttacttctgtcattgatggattaaaaagactatacatcgaaaaattgaagcctttggaagttacatacaaattcaatgattttgtgtccccgttactgacaaatagtgattttgatgcgaagccaatggttatgctcttaggtcaatattctacagggaaaactactttcatcaaacatctgctaaaaacaagctatccaggtgcccatattggaccagagccgacaaccgacagatttgttgttgtcatgtcaggacctgatgaaagaactattcccgggaatactttagctgttcaagcagatatgcctttcagtggtctcacaacatttgggacttcgtttttatcaaagttcgaatgttctcagatgccacatccactactagagcatatcacgtttgtcgacacacctggtgttctttctggtgaaaagcaacggacacaacgtagctatgaattcacaggcgttacatcatggtttgctgccaagtgtgaccttatcctgcttctatttgatcctcataagcttgatatcagtgatgagtttaaacgtgtcatcggatctttacgtggacatgatgacaaaatacgtgtagttctgaacaaggccgaccaaattgacactcaacagcttatgagagtgtatggtgcgcttatgtggtcccttggtaaagtattgaatacccctgaggtgtcgcgtgtttatattggatcattcaatgataaaccagtaaaggaatcagctgttggcccgatcgggaaggaactatttgagaaagagcaggatgatctcctttctgatctaaaagatataccaaagaaagcttgtgaccgcaggatcaatgaattcgtcaaacgtgctagagctgccaagatacatgcttatctaattgggcatctaaagaatcagatgcctacgatgatggggaaagctaaagcccagcagaaacttatagacaatttggagggcgagtttgcaaaggtgcaaagggaacaccatcttccggcgggggatttcccttatgtggatcacttcagagaagcattgggcgggtacagcatcgacaagttcgagaaggtgaaacccaagatgatccaggcggtggatgacatgctcgggtacgacatcccggagctgctcaagaacttcaggaacccttacgagtgagcagacgtcatgaccgaaagtctggcttcggtatgtccggcgtggatggtggtggctgcccatagagttgcggccgccagtctagctagcagggtgtttattgctactacactgtacccattgttgtataactgtatttatgcataagagccagaagcaattgctgctcaattgttcactggagaacggccttgttgtaatggcatggaaagaattcggaatatggggatggatgtt

SEQ ID NO: 7812 - DNA, 1857 bp, Secale cereale
agcaccagaagatctaccgcgactggttcgccctcgccgactcagatggcgacggccgcatcaccggccccgacgccatcaggttcttcgccatgtccagcctcccccgcgccgacctcaagcaggtctgggccatcgccgactccaagcggctggggtacctcggcttcggcgagttcatcaccgcgatgcagctcgtctctctggcgcaagcggggaatgaaatatcccaggacagccttcagcgcgaagatctaatcagcttcaatcccccagtgatggagggtttggatgctcaacttgcaaaatccaagcatttggcaaagagggccgatcaggatatggatggatttcctcaggcacaaggaccttctactaaccattggttcaattctaaatcatccaagaagatacccctgactgctgttacttctgtcattgatggattaaaaagactatacatcgaaaaattgaagcctttggaagttacatacaaattcaatgattttgtgtccccgttactgacaaatagtgattttgatgcgaagccaatggttatgctcttaggtcaatattctacagggaaaactactttcatcaaacatctgctaaaaacaagctatccaggtgcccatattggaccagagccgacaaccgacagatttgttgttgtcatgtcaggacctgatgaaagaactattcccgggaatactttagctgttcaagcagatatgcctttcagtggtctcacaacatttgggacttcgtttttatcgaagttcgaatgttctcagatgccacatccactactagagcatatcacgtttgtcgacacacctggtgttctttctggtgaaaagcaacggacacagcgtagctatgaattcacaggcgttacatcatggtttgctgccaagtgtgaccttatcctacttctgtttgatcctcataagcttgatatcagcgatgagtttaaacgcgtcatcggatctttacgtggacatgatgacaaaatacgtgttgttctaaacaaagccgaccagattgacactcaacagcttatgagagtgtatggggcacttatgtggtctcttggtaaagtattgaatacccctgaggtgtcgcgcgtttatattggatcgttcaatgataaaccagtaaaggaatcagctgttggcccaattggaaaggaactatttgagaaagagcaggatgatctcctttctgatctaaaagatataccaaagaaagcttgtgaccgcaggatcaatgaattcgtcaaacgcgctagagctgccaagatacatgcttatctaattgggcatctaaagaatcagatgcctacgatgatggggaaagctaaagcacagcagaaacttatagacaatttggagggcgagtttgcaaaggtgcaaagggaacaccatcttccggcgggggatttcccttatgtggatcacttcagagaagcattgggcgggtacagcatcgacaagttcgagaaggtgaaacccaagatgatccaggcggtggatgacatgctcgggtacgacatcccggagctgctcaagaacttcaggaacccttacgagtgagcagacgtcatgaccgaaagtctggcttcggtatgtccggcgtggatggtggtggctgcccatagagttgcggccgccagtctagctagcagggtgtttattgctactacactgtacccattgttgtatacctgtatttatgcataagagccagaagcaattgctgctcaattgttcactggagaacggccttgttgtaatggcatggaaagaattcggaatatggggatggatgttgtggtggtcgcattgatccttgaga

SEQ ID NO: 7813 - DNA, 1990 bp, Ananas comosus
agttcttgattttctctctctaaagatccccaccgccatggacatcggatcgtctccggtgagtacgtgctcgagagaggaccaaaagatctaccaggaatggttctccttcgccgattcagatggggatgggcgaatcacagggcccgatgcgatcaagttcttcgggatgtcgaagttgtcgcggccggagctcaaacaggtgtgggcaattgcagactccaaacgacagggttttcttggcttcaacgaattcattactgcaatgcagcttgttacgcttgcacaggcagggaatgagattacccaagacacccttcatcatgcagatttgagtaaattgagtccgcccataatggaaggattagatgttctactagcaaaatctaagccctcaccaaagaaaagtgatcctgatctggatggtagttctcagccccaaataccttcaacagtacagtggtttagctcaaaatcaacaaagaagatccctctgagctcggttacttcaatcattgacggattaaagagactatatattgaaaagttgaagcctttggaagttacataccgattcaacgattttgtttctcctttgttgacaaatagtgattttgatgccaagcccatggttatgctgttgggtcaatattctacaggaaaaacaacatttattaagcatctgctaagatgtggctatccaggtgctcatattggaccagagcctacaactgacagatttgtagttgtcatgtctggacctgatgaaaggagtattcctgggaatactattgctgttcaagcagacatgcctttcagtggtcttacgacatttggaactgcatttctatcaaagtttgagtgttcccagatgcctcatgcgctactggaacacatcacatttgttgatactcctggcgtactctccggagaaaagcaacgcacacaacgtagctatgattttactggtgttacatcatggtttgctgctaagtgcgaccttattcttcttctctttgatccacataagcttgatatcagtgatgagttcaaacgtgtcatcggatctctgcgtggtcatgatgacaagatacgtgtggttttaaataaggccgatcaggttgatactcagcagcttatgagagtatatggtgcattaatgtggtcgctgggtaaagttctaaataccccagaagttgtgcgtgtttacattggatcgttcaatgacaaaccagtaaacgaagcagctgtcggtccaattgggaaggagctgtttgagagagaacaagatgatctcctttcggatttgaaagacattcccaagaaggcttgtgaccgccggataaatgaatttgtcaaacgtgcaagagcagccaagattcatgcttacatagtcagccacctaaggaaggagatgccagccatgatgggcaaggctaaggctcaacagcgactcatagataacctagaagatgaattcgcaaaggttcagagggaatatcatctgcctgccggggatttccccaatgtcgatcacttcagagaggtgttgggcggctacaatatcgacaagtttgagaagctcaagccgaagatgatacaaactgtggacgatatgctgggatacgacataccggaacttctacggagcttcagaaacccctacgagtgaatcaaaagagttcactatcaaatttctcgtcatcaatagtaggagagagagagagagagagagagagagagactacaacaacagggggatgtatgtatagccgagcattttcgctcatgtattgttgccgatttgttgtcggatattctgttcggagcctgcgagcgaacaatttgttcattcgtgggtatgcgacggtacgtaaagttcgaatactaaacagctggtggggaaccgtgtccacccccccaaggaaattttctttgaagaactataagttgagattatgattatcatgtgatgtttatatgatctgca

SEQ ID NO: 7814 - DNA, 2105 bp, Ananas comosus
caaaagagttcactatcaaatctctctctctagttcttgattttctctctctaaagatccccactgccatggacatcggatcgtctccggtgagtacgtgctcgagagaggaccaaaagatctaccaggaatggttctccttcgccgattcagatggggatgggcgaatcacagggcccgatgcgatcaagttcttcgggatgtcgaagttgtcgcggccggagctcaaacaggtgtgggcaattgcagactccaaacgacagggttttcttggcttcaacgaattcattactgcaatgcagcttgttacgcttgcacaggcagggaatgagattacccaagacacccttcatcatgcagatttgagtaaattgagtccgcccataatggaaggattagatgttctactagcaaaatctaagccctcaccaaagaaaagtgatcctgatctggatggtagttctcagccccaaataccttcaacagtacagtggtttagctcaaaatcaacaaagaagatccctctgagctcggttacttcaatcattgacggattaaagagactatatattgaaaagttgaagcctttggaagttacataccgattcaacgattttgtttctcctttgttgacaaatagtgattttgatgccaagcccatggttatgctgttgggtcaatattctacaggaaaaacaacatttattaagcatctgctaagatgtggctatccaggtgctcatattggaccagagcctacaactgacagatttgtagttgtcatgtctggacctgatgaaaggagtattcctgggaatactattgctgttcaagcagacatgcctttcagtggtcttacgacatttggaactgcatttctatcaaagtttgagtgttcccagatgcctcatgcgctactggaacacatcacatttgttgatactcctggcgtactctccggagaaaagcaacgcacacaacgtagctatgattttactggtgttacatcatggtttgctgctaagtgcgaccttattcttcttctctttgatccacataagcttgatatcagtgatgagttcaaacgtgtcatcggatctctgcgtggtcatgatgacaagatacgtgtggttttaaataaggccgatcaggttgatactcagcagcttatgagagtatatggtgcattaatgtggtcgctgggtaaagttctaaataccccagaagttgtgcgtgtttacattggatcgttcaatgacaaaccagtaaacgaagcagctgtcggtccaattgggaaggagctgtttgagagagaacaagatgatctcctttcggatttgaaagacattcccaagaaggcttgtgaccgccggataaatgaatttgtcaaacgtgcaagagcagccaagattcatgcttacatagtcagccacctaaggaaggagatgccagccatgatgggcaaggctaaggctcaacagcgactcatagataacctagaagatgaattcgcaaaggttcagagggaatatcatctgcctgccggggatttccccaatgtcgatcacttcagagaggtgttgggcggctacaatatcgacaagtttgagaagctcaagccgaagatgatacaaactgtggacgatatgctgggatacgacataccggaacttctacggagcttcagaaacccctacgagtgaatcgaaagggttcacaactaaaattctcctcatcagtagtaggagagagagagagagagagagagagagactacaacaacagggggatgtatgtatagccgagcattttcgctcatgtattgttgccgatttgttgtcggatattctgttcggagcctgcgagcgaacaatttgttcattcgtgggtatgcgacggtaggtatagttcggttactaaacagctggtggggaaccgtgtccacccccccaaggaaattttctctgaagaactataagttgagatgatgattatcatgtgatgtttatatgatctgcaataactcatttggtttcgttttctactttgttcttattttgattgttttttgcaatgtgaacatattctttttacataatccgtga

SEQ ID NO: 7815 - DNA, 1968 bp, Elaeis guineensis
tgttgatctaatggatatcgtctcgtctccgatgagtacttgttcgagagagcatcagaagatctacaaggagtggttctctgccgccgattcagatggggatgggcggatcacgggaaccgatgccatcaaattcttcgccatgtccaaactatcccgccccgaacttaaacaggtgtgggccattgcagactctaaacggcaaggtttccttggattaaatgagtttattacagcaatgcagcttgtttcactagcacaggcagggaatgagattacccaggatgccctcactcattcagaattggatctcctgaaacctccagtgatggagggtttggatattctgttagctaaaactacttcacccaagaaaagcaatcctgatcttgatgtaagttctcagcccccagtttcattaacaactcagtggtttagctcgaaatcaacaaagaagatacctctgagctcagttacttcaattattgatgggttgaagagattgtatattgaaaagctgaagcctttggaagttacctaccgattcaatgattttgtttccccattattgacaaatagtgattttgatgcaaagcccatggttatgctattgggacaatattctactggaaaaacaacattcattaaacatttattaagatccagctacccaggtgctcatattggaccagagcctacaactgatcgatttgttgttgtcatgtcaggacctgatgaacggagtattcctggaaatactgttgctgttcaagcagacatgcctttcagtggtctgactacatttggaactgcatttttatcgaagtttgagtgctcacagatgccccacccgctactggaacacatcacatttgtcgatacacctggggttctttctggagaaaaacaacgaacccaacgaagctatgattttactggtgttacatcgtggtttgcagcaaagtgcgatctcattcttcttctgtttgaccctcataaactggatatcagtgatgagttcaagcgtgtcattggatctctgcgtggccatgatgacaaaatacgtgtagttttgaataagtcagaccaggttgacacccagcagctaatgcgagtttatggtgcattaatgtggtcgcttgggaaagttttgaacacccctgaagttatgcgtgtgtatattggttcattcaatgacaaaccaataaacgaagcagctgttggtccaattggaaaggaactttttgaaagggaacaagatgacctcctttctgatttgaaagatattcccaagaaggcttgtgatcgccgtatcaatgaatttgttaagcgtgcaagagcagccaagattcatgcctatataattagccacctgaggaaggagatgccggcaatgataggaaaggccaaagcacaacaaagactcattgataacctggaggatgagtttcctaaggttcaaagggagtttcatctaccggctggggatttccctaatgtcgaacacttcaaggaggtattgagtggttacagtatcgataagtttgagaagttgaagcctaaaatgatacagactgtggatgacatgttgggatatgacattccagaactcttgaggagcttcagaaacccatatgaataatggcaagtaatcattctgatagattggtatcatcttcatgagaaaagcagaagatagtgaatagtgaaattgatgatggtattttcatgctataagagccatgtatagctctggccttctcttcatgtcattgttgattattgttgtaaggctgtccaattcacagattttgacctctgatgggttggcagggatggtatcaaatgtaaggattttgtcaaaatcagttaggggacctgtttgcttggaaaatcttctggtgatctgtattacatgtttgtattggacctatatatgcactcttcatatgcattgttgcacatgct

SEQ ID NO: 7816 - DNA, 1910 bp, Oryza sativa
ccccgcatcacccccacctcgtcaggtttccgttccgcctccgcctctgctgctcctcctcctcctcgccgccgccgccgccgcgacgaggcatggagctcgcgcgatcggcctgctccaaggagcaccacaagatctacgccggctggttcgccgtcgccgacccagatggagatgggcgtgtcacgggtgctgatgctaccaagttcttcgccatgtccggcctgtcccgcgccgacctcaagcaggtctgggcgatcgcggacaccaagcggcaggggttcctcggcttcggcgagttcgtcgccgcgatgcagctcgtgtcactggcgcaagcgggggaggagatcactcaggacagtctgaagcgcgaagacctgagtagtttggatccacctgtgatggaaggtcttgacgaactacttgcgagatcaaaggctggggtaaagagagtacacccagaagaaaatggcgcccctcaggttcaagtgcattctgctaatagctggttcagttcaaaatcagcaaagaagatgcaggtccccctgactgctgttacttctgtaattgatggcttaaaaagactatacgtagaaaaactgaagcctctggaagttgcataccggttcaacgattttgcttccccgttattgacaagcagtgattttgatgcaaaaccaatggttatgctcttgggtcaatattctacagggaaaacaactttcattaagcatctgctgcaaacaagttatccaggagctcatgttggaccagagcccactactgaccgatttgttgttgtcatgtctggatctgatgaaaggactattcctggcaatactattgctgttcaagctgatatgccattcactggtcttacgacatttggcggtgcttttctgtcaaagttcgagtgctctcagatgccacatccgctgctcgatcatatcacctttgtggacacccccggtgtcctgtctggtgaaaagcagcggacgcagcgtagctatgatttcaccggcataacttcatggtttgctgctaagtgtgaccttattcttcttctgtttgatcctcataagcttgatatcagtgatgagttcaaacgtgtgattgcatctttacgtggccatgatgacaaaatacgtgtagtgctgaataaggcagaccaagttgacactcagcagcttatgagagtgtatggtgcactgatgtggtctcttgggaaagtactcaatacccctgaggtcgcgcgtgtttatatcgggtcattcaatgacaaaccagtgaatgaatcagctgttggaccaattggaaaggacttgtttgagaaagagcaagatgatctcctctgtgatctgaaagacatacccaagaaggcctgtgatcgtcgggtcaacgagtttgttaaacgtgctagagctgctaagattcatgcttacataattggccatctaaagaaggagatgcctgcaatgatggggaaagctaaggctcaacagcgactcatagacaacctgggtgatgagtttgcaaaggtccaaagggagtaccatcttccagccggagacttccctgacgttgagcacttcaaggaggtgttgggtgggtacaacatcgacaagttcgagaagatgaagcccaagctggtgcaggccgtggacgacatgctcgcgtacgacatcccggagctcctcaagaacttcaggaacccttacgagtgagcccgctgacctctcgtcagttgtaagataaagatgaccccgctcggtcgtgagtcgtgacactgtatgtgagtgacacctgatgatgaaggaatatgttgtcaaggcgagacatggacggttttctactttacctgcccatcttttgcaaatgctctgtgaatgtctccaaattcagagacgcta

SEQ ID NO: 7817 - DNA, 1883 bp, Cocos nucifera
tctctctctctgttgatctaatggatatcgtctcgtccccgatgagtacctgttcgagagagcatcagaagatctacaaggagtggttctctgccgccgattcagatggggatgggcggatcacgggaaatgatgccatcaaattcttcgccatgtccaaactatcccgccccgaacttaaacaggtgtgggcccttgcggactctaaacggcaaggtttccttggattaaatgagttcattacagcaatgcagcttgtttcactagcacaggcagggaacaagattatccaggatgccctcactcattcagatttggattgcctgaaacctccagtcatggagggtttggatattctgttggctaaaactacttcacccaagaaaagcaatcccgatcttgatgtaagttctcagccccaagtttcatcaacaactcagtggtttagctcgaaatcaacaaagaagatacctctgagctcagttacttcaattattgatggtttgaagagattatatattgaaaagctgaagcctttggaagttacctaccgattcaatgattttgtttccccattattgacaaacagtgattttgatgcaaagcccatggttatgctattaggacaatattctactggaaaaacgacattcattaaacatttattaagatccagctacccaggtgctcatatcggaccagagcctacaactgatcgatttgttgttgtcatgtcaggacctgatgaacggagtattcctggaaatactgttgctgttcaagcagacatgcctttcagtggtctgactacatttggaactgcatttttatcaaagtttgagtgctcacagatgccccacccgctactggaacacatcacatttgtcgatacacctggggttctttctggagaaaaacaacgaacccaacgaagctatgattttactggtgttacatcgtggtttgcagcaaagtgcgatctcattcttcttctgtttgaccctcacaaactggatatcagtgatgagttcaagcgtgtcattggatctctgcgtggccatgatgacaaaatacgtgtagttctgaataagtcagaccaggttgacacccagcagctaatgcgagtttatggtgcattaatgtggtcgcttgggaaagttttgaacacccctgaagtaatgcgtgtgtatattggttcattcaacgacaaaccaataaacgaagcagctgttggtccaattggaaaggaactttttgaaagggaacaagatgacctcctttctgatttgaaagatattcccaagaaggcttgtgatcgccgtatcaatgaatttgttaagcgtgcaagagcagccaagattcatgcctatataattagccacctgaggaaggagatgccggcaatgataggaaaggctaaaacacaacaaagactcattgataacctggaggatgagtttgctaaggttcaaagggagtttcatctaccggctggggatttccctaatgtcgaacatttcaaggaggtattgagtggttacagcatcgataagtttgagaagttgaagcctaaaatgatacaggttgtggatgacatgttgggatatgacattccagaactcttgaggagcttcagaaacccatacgaataatggcaagtaatcattctgatagattggtatcatcttcatgagaaaagcagaaggtagtgaatagtgaaatgatgatggtatactcatgctataagagctatgtatagctctggccttctcttcatgtcattgttgattattgttgtaaggctgtccaattcacagattttgacctctgatgggttggcaaggatggtatcaaatgtaaggattttgtcaaaatcagttagg

SEQ ID NO: 7818 - DNA, 1866 bp, Manihot esculenta
caaaaagtttgcttgactgataatttgtgatcatggaaatatcttcgggaccaatcggttcttgctccaaagagaaccagaagacctaccttgagtggtttaacttcgctgattcagatggtgatggtcggatcaccggtagtgatgcaataaagttctttggaatgtctaatttatctcgacaggatctcaagcaggtgtgggcgatttcagattctaagcgacagggatatcttggcttcaatgagttcatcggtgctatgcagttagtttccctggcacaagctggacatgaaatcacaagtgatctcttaaaaagcgatgttgactttgaaaatctgaagcctccatccatggaaggtctggatgccctgattgctaaaaagcgcacttcaaaatcaagtgaccctgatataaatgttagtcctccagtggaaacatcgccttcagtcagttggttttcctcaaaatcatcgaaaaaggtacctctatcctccgttacatccatctttgatgggttaaagagattgtatattcagaagctcaagccgttggaagttacttatcgttttaatgattttgtatctccactgttgacaaacagtgattttgatgccaaaccaatggtcatgctgttgggccaatattccacaggaaaaacaacattcatcaaacatttacttaagagtggttatcctggagctcatattggacctgagccaacaactgacagatttgttgttgttatgtctggtactgatgaaaggagtatacccggcaacacagtggcagtccaagcagatatgccctttaatggactgacaacttttggaactgcatttttatcaaaatttgaatgttctcaaatgcctcatcctttgctggagcatattacatttgtggacacgcctggagttttatcaggggaaaaacaacgaacacaacgagcttatgattttactggtgtaacttcatggtttgctgcaaagtgtgacctcattctgcttctgtttgatcctcacaaacttgatatcagtgatgagttcaagcgtgtcatttcatctttgcgtggtcatgatgataagattagggtggttctgaacaaggcagaccaagttgatactcaacaactaatgagagtttatggtgcattaatgtggtcactagggaaagttctaaacactcctgaagtcatgcgtgtttatattggctcattcaatgataaacctgtaaatgaagctgctgttggtccaattgggaaagaactttttgagaaagaacaggatgaccttctgttagatctaaaagatataccaaagaaggcttgtgatcgtcggatcaatgaatttgtgaaacgagctagagctgctaagatacatgcttacattattagtcatctgaaaaaggagatgcctgcaatgatgggtaaagcaaaggctcaacagagacttgtagataatttggtagatgagtttcgaaaggttcaaagggagttccacttgcctccaggtgatttcccaaatgttgagcacttcagagaggttttgaccggttacagcatcgacaagtttgaaaagttgaagcctaaaatgatacaagctgtagatgacatgcttggttatgacattccagagctcttgaagaacttcagaaatccctacgactaagaaaccatatattagcaatgtatagggtatgtaatctagatcaagactatatagacttcaaatcatttacatattgtaggatcattggacaaatcgattttgggtcatcagagggcttgagccttgaatccattgagttatccagaaaatatataaccaattcataatatttgatttgaatggattgaattattcagag

SEQ ID NO: 7819 - DNA, 2346 bp, Sorghum bicolor
aagccgaagcgagtgcgagtcggcccgtcaggctcctcctgtctcatctgtgctgctgcagttgctcctgctcctctctgcggcggcggcggcggctgtctagcacctgggcggggcggcgagaggggacggagatggagatcgcgcgagcggctgctggcgtggcctgctccaaggagcaccagaggatctacgccgagtggttcgccctcgcagacccagatggcgatggccgcgtcacgggcgccgatgccaccagcttcttcggaatgtccgcgctctcacgcgccgatctcaagcaggtatgggcgatcgcggattccaagcggcaggggtacctcggattcgccgagttcgtcacagcaatgcagctcgtgtctctggcccaagcagggaacgagatcacagaggacagtctgaaacgtgaagacctgagcaccttggatccgcctgtgatggaaggtgtcgatggactactggctagatccaaggctgttgtgaagagaattcacccagatgacaatggcaccgctcaggtccaagcaccttccatgtatcactggtttggttcaaaagcagcacagaaggtgcagatgcctctgactgctgttacctctgtaattgatggcttgaaaagactatatgttgaaaaactgaagccattggaagtcgcttacagatacaatgattttgcttccccattattgacaaacagtgattttgatgcaaagccaatggttatgctcttgggtcagtattcaacagggaaaacaacattcattaagcatctgctgaagacaagctacccaggagctcacgtcggaccagagccaaccactgatagattcgtagttgtcatgtcaggatctgatggaaggaccattccaggcaatactattgctgttcaagccgacatgccattcactggtcttacaacatttgggggagcatttctgtcaaagtttgaatgctctcagatgccacatccgcttctagagcatatcacctttgtggacactcctggtgtcctctctggggaaaagcaacggacgcaacgtagctatgatttcactggtgtaacctcatggtttgctgctaagtgtgaccttattcttcttctgtttgaccctcacaagcttgatataagtgatgagttcaaacgtgtcatttcatccttacgtggtcatgatgacaaaatacgcgtagtgttgaacaaggctgaccaagtggacacacagcagcttatgagagtatacggtgcattgatgtggtctcttgggaaagtgctaaatactcctgaggttgtgcgtgtgtatatcgggtccttcaacgataagccagtgaatgattcagctgttggaccaattggaaaagacttgtttgagagggagcaagatgacctactgtgtgacctgaaagacattcctaagaaagcttgtgatcgacgggtcaatgagtttgttaagcgtgctcgagctgccaagatccatgcttacataattggccatctgaagaaggagatgcctgcaatgatgggaaaagctaaggctcagcagcgactcatagacaacttaggggaggagtttgccaaggtgcagagggaataccatctccccgccggagacttccccgacgtggagcacttcaaacaggtgctgggtgggtacagcatcgacaagttcgagaagctgaagcccaagatggtgcaggcggtggacgacatgcttgctcacgacatcccggagctcctcaagaacttcaggaacccgtacgagtgaactgacctgacctgcctctcgtcggttgtttgtaagatttccttagctgtcacgcctggtgatggcggagggacgtcggtccagggagatgtagacggtcacgggtcactactcactagctgtccgcagctgtgccaaaaaccgagaggatgcatgaggattcagatcagagagccacagcgcgttgcctagtttcagcgtcagtgctctgtcgtggttgccgcacgccggcacgcgaaggagcagctgtagtaccgttaccgtctcgctgtgacacattttctccatcttgatgagataaaggccctgtttggttccccttgctaaattttagctagctaaattttagtcactttagtagctaaagtaccaaacacattgactagaaggtgctaaaatagtttagtcccattagtcaaccaagagtagctaaaataattttagctagctaaagtttagcaaggggaaccaaacaggtccaaagagttgcaggcaggcggcaaagcgatacggtgtgcaatgataacttgcgaccatgtgatgttgctggtcctgagcggcacacgat

SEQ ID NO: 7820 - DNA, 2124 bp, Setaria italica
gcggacgagagggagagggaaaaccgaagggaggcggcccgtcacgttcctgtgtcacctgtgctgctgcagctgctcctgctccaatccgcggcggcggcggcggcctagcaccggggcgtggcggcgagagatggagatcgcgcgagctgcggccggcgtcgcctgctccaaggagcaccagaggatctacgcagagtggttcgcgctcgccgacccagatggcgacggccgcgtcacgggcgccgacgccaccagcttcttcgtcatgtccgggctctcgcgcgccgatctcaagcaggtatgggcgatcgcggattccaagcggcaggggtacctcggattcgccgagttcgtcactgcaatgcagctcgtgtctctggcccaagcggggaacgagatcacccaggacagtctcaaccgggaagacctgagcaccttggatccacctgtgatggaaggtgtggatgaactagtggctagatccaaggctgttgtgaagagagttcacccagaagacaatggcacccctcaggtccaagcttcatccatttatcactggtttggttcaaaatcagcacagaaggcgcagatgcctctgactgctgttacctctgtaattgatggcttaaaaagactataccttgaaaaactgaagcctttggaagtcgcatacagattcaacgattttgcttccccattattgacaagcagtgattttgatgcaaagccaatggttatgctcttgggtcaatattctacagggaaaacaacattcattaagcatctgctgaagacaagctacccaggagctcatgtcggaccagagcctactactgacagattcgtagttgtcatgtcaggaccagatggaaggactattccaggcaatactattgctgttcaagctgacatgccattcactggtcttacaacatttgggggagcatttctatcgaagtttgaatgctctcagatgccacatccgctactagagcatatcacatttgtagatagtcctggtgttctctcaggtgaaaagcaacggacccaacgcagctatgatttcactggtgtaacttcatggtttgctgccaagtgtgaccttattcttcttctgtttgaccctcacaagcttgatataagtgatgagttcaaacgtgtcatttcatccttacgtgggcatgatgacaaaatacgcgtagtgttgaacaaggcagaccaagttgacactcagcagcttatgagagtgtatggtgcgctgatgtggtctcttggaaaagtgctaaatactcctgaggttgtgcgtgtgtacattgggtcattcaatgataaaccagtgaatgagacagctgtaggcccaattggaaaagacttgtttgagagggagcaagatgacctcctctgtgacctgaaagatattccgaagaaggcttgtgaccgccaggtcaatgagtttgtcaagcgcgctagagctgccaagatccatgcttacataattggccatctgaagaaggagatgcctgcaatgatgggaaaagctaaggctcaacagcgactcatagacaacttagaagacgagtttgcaaaggtgcagagggagtaccatctccccgccggcgacttcccagacgtcgagcacttcaagcaggtgctgggtgggtacaacatcgacaagttcgagaagctcaagcccaagatggtgcaggcggtggacgacatgctcgcgtacgacatcccggagctcctcaagaacttcaagaacccctacgagtgaactgagctgacctctcgtcggttgtaaaagaagagtaccttgagccgtcaccttccgatggttggttactagcagtcccccgtcgtgtcaaaaccgagaggatgcatgaagattcagagaggcatagcgcataggctgttcagtctcagcgccagtgctctatggcgcaggattgtagtaccgttactcgtggtggtgtcgtcgccgtcttgctgtgatacgtcttttcccccttgtgagtgttacaggtggcgacgcgatagcacgttgcaatgataagtttgcgaccatgtggtgttgctgggcgtgggcggcacacggcgcgtgaatgatgcagcagcgccgca

SEQ ID NO: 7821 - DNA, 2099 bp, Zea mays
ggaaagccgaagcgagtgcgagtgcggccctcagctgctgcagttgctcctgctcgtttctgcctgctcgtttctgcggcggcggcggcggcggcggcctagcacctgagcggggcggcgagaggggacggagatggatatcgcgcgggcggctgctggcgtggcctgctgcaaggagcaccagaggatctacgccgagtggttcgccctcgccgacccagatggcgacggccgcgtcacgggcgccgatgccaccagcttcttcgccatgtccgcgctttcacgcgccgatctcaagcaggtgtgggcgatcgcggattccaggcggcaggggtacctcggattcgccgagttcgtcacagcaatgcagctcgtgtctctggcccaagcagggaacgagatcacacaggacagtctgaaacgtgaagacctgagcaccttggatccgcctgtgatggaaggtgttgatgagctactggctagatccaaggctgttgtgaagagagttcacccagatgacaatggcaccactcaggcccaagcaccttccatatatcactggtttggttcaaaatcagcacagaaggtgcagatgcctctgactgctgttacctctgtaattgatggcttgaaaagactctatgttgaaaaactgaagcctttggaagtcgcctacagatacaatgatttttctcacccattattgacaaacagtgattttgaagcaaagccaatggttatgctcttgggtcagtattcaacagggaaaacaacattcattaagcatctgctaaagacaagctacccaggagctcacgtcggaccagagccaacaactgatagattcgtagttgtcatgtcaggatctgatggaaggaccattcctggcaatactattgccgttcaagccgacatgccattcactggtcttacaacctttgggggagcgtttctgtcgaagtttgaatgctctcagatgccacatcccctgctagagcatatcacctttgtggacactcctggtgttctctctggggaaaagcaacggacccaacgtagctatgatttcactggtgtgacctcatggtttgctgccaagtgtgaccttatccttcttctgtttgaccctcacaagcttgatataagtgatgagttcaaacgtgtcatttcatctttacgtgggcatgatgacaaaatacgcgtagtgttgaacaaggccgaccaagttgacacacaacagcttatgagagtgtatggtgcattgatgtggtctcttgggaaagtgctaaatactcctgaggttgtgcgtgtgtatatcggatcatttaatgataagccagtgaatgattcagctgttgggccaattggaaaagacttgtttgagagggagcaagatgacctcctctgtgacctgaaggacattcctaagaaggcttgtgatcgacgggtcaatgagtttgttaagcgtgcccgagctgccaagatccatgcttacataattggccatctgaagaaggagatgcctgcaatgatgggaaaagccaaggctcagcagcgactcatagacaacttagacgaggagtttgcaaaggtgcagagggaataccatctccccgccggagacttccccgacgtcgagcacttcaagcaggtgctgggcgggtacagcatcgacaagttcgagaagctgaagccgaagatggtgcaggcggtggacgacatgctcgctcacgacatcccggagctcctcaagaacttgcggaacccgtacgagtgaactgatctgacctctcgcgtccgtcggttgtaaaaagattatcttagctgtcacgtccggtgatggcggacggacgaggcagacgttcctgggagggagatgcctagacggttacgggtcactacttctagctgtccgcagctgtgccaaaaccgagaggacacatgagggttcagatcggacagccacagcgcatagcctgtgttggtttcggcgtcagtgctctctgcacgcgaaggagctgctgcggcaccgttgccgtgccgtctcgctgtgatacattttccctcgtgacgagatgaaaagagagttgcaggcggca

SEQ ID NO: 7822 - DNA, 1746 bp, Echinochloa colona
ccaaggagcaccagaagatctacgccgagtggttcgccctcgccgacccagatggcgacggccgcgtcacgggcgccgacgccaccagcttcttcggcatgtccgggctctcacgcgccgatctcaagcaggtatgggcgatcgcggattcgaagcggcaggggtacctcggattcgcagagttcgtcacagcaatgcagctcgtgtctctggcccaagcggggaacgagatcacacaggacagtctcaaacgtgaagacctgagcaccttggatccgccagcgatggaaggtgttgatgaactagtggctagatccaaggctattgtgaagagagttcacccagatgacaacggcacccctcaggttcaagcatcttccatataccactggtttggctcaaaatcagcacagaaggtgcagatgcctctgactgctgttacctctgtaattgatggcttaaaaagactatacgtcgaaaaactgaagcctttggaagtcgcatacagattcaatgattttgctaacccattattgacaagcagtgatttcgatgcaaagccaatggttatgctcttgggtcaatattctacagggaaaacaacattcattaagcatctgctgaagacaagctacccaggagctcatgttggaccagagccaactactgatagattcgtagttgtcatgtcgggatctgatggaaggaccattcctggaaatactattgcagttcaagccgacatgccattcactggtcttacaacatttgggggagcattcctgtcaaagtttgaatgttctcagatgccccatccgctactagagcatatcacctttgtagacactcctggtgttctctctggggaaaagcaacggacccaacgtagctatgatttcactggtgtaacctcatggtttgctgctaagtgtgaccttattcttcttctatttgaccctcacaagcttgatataagtgatgagttcaagcgtgtcatttcatcattgcgtgggcatgatgacaaaatacgcgtagtgttgaacaaggcagaccaagttgacactcagcagcttatgagagtgtatggtgcgctgatgtggtctcttgggaaagtgctaaatactcctgaagttgtgcgcgtgtatatcgggtcattcaatgataaaccagtgaatgactcagctgttggaccgattggaaaagacttgtttgagagagagcaagatgacctcctctgtgacctgaaagacattcctaagaaggcttgtgatcgccgggtcaatgagtttgttaagcgtgctcgatctgccaagattcatgcttacataattggccatctgaagaaggagatgcctgcaatgatgggaaaagctaaggctcaacagcgactgatagacaacttagaagatgagtttgcaaaggtgcagagggagtaccatctccccgcaggcgacttcccggacgtcgagcacttcaaacaggtgttgggtgggtacagcatcgacaagttcgagaagctcaagcccaagatggtgcaggcggtggacgacatgctcgcgtacgacatcccggagctcctcaagaacttcaggaacccctacgagtgaactgaaactgacgtctcgtcggttgtaagattaccctgagcacgtctgatggtggtggaggcaggggggcggcaaaaggcctctgtgtagtagcagtccgccgtagttgtcaaccgtcaagactcagagagatacgcga

SEQ ID NO: 7823 - DNA, 2147 bp, Hordeum vulgare
gcctccccattccacgcctaagagggggagaagagacgagcatccgcatccgcacccgcaccccgtgaggtttccgtttgtccactcctgctgccgctgctgctcgcgtcagccgccgccgccgccgacgcgaggagggagaccgtggatggagatcgcgcggtccgtcgcctccctgggctgctccaaggagcaccagaggatctacgccgactggttcgccctcgccgacccagatggagacgggcgcgtcacgggcgccgacgccaccaagttcttcgccatgtccggcctctcccgcgccgacctcaagcaggtttgggcgattgctgactccaagcgtcaggggtacctcggcttcggcgagttcgcggccgcgatgcagctcgtgtctctggctcaagcgggcaacgagatcacccaggacagtctcaagcgtgaagatctgagtagcttcgatcctcctgtgatgaaaggtcttgatgaactgcttgctagatcaatggctattgtgaatgtagttcgcccacaagaaaatggcacctctcaggtgcaagcaccttctacaaacagctggttcagttccaaatcatcaaagaagattcaaacgcccctgactgctgttacttctgtaattgatggcttgaaaagactgtacatcgaaaaactgaagcctttagaagttgcataccggttcaatgattttgcctctccattgctgacaaacagtgacttcgatgcgaagccaatggttatgctcttgggtcaatattctacagggaaaacaacattcattaagcacctgttaaaaacaaacttcccaggagctcatatcggaccagagcccactactgacagatttgtagttgtgatgtcaggatctgatgaaaggactgttcctggcaatacaattgcagtccaagccgatatgcctttcaatggtcttacgacatttgggggtgcattcctatcaaagtttgaatgctctcagatgccacatcctctactagatcatatcacgtttgttgacactcctggtgttctctctggtgaaaagcaaaggacccagcgtagttatgatttcactggtgtaacttcatggtttgctgcaaagtgcgatgttattcttctactgtttgatcctcacaagcttgatatcagcgatgaattcaagcgtgtcatttcttctttacgtgggaatgaagacaaaatacgtgtggtgctgaacaaggcagaccaagttgacactcagcagcttatgagagtgtacggtgcactgatgtggtcccttgggaaagttctaaatactcctgaggttatgcgtgtctacattgggtcgtttaatgacaaacctgtgaatgaatcagctgttgggccaattggaaaggaattgtttgagaaagagcaagaggatctccttgctgacctgaaagacatacctaagaaggcttgtgatcgtcgggtcaatgagtttgtcaagcgtgccagagctgcaaagatccatgcttacataattggccagctgaagaaggagatgcctgcaatgattgggaaagccaaggctcaacagcgactcatcgacaacttgcaagatgagtttgcaaaggtccagagggagtaccaccttccggcgggcgacttccccgacgtggagcacttcaagcaggtgctggccgggtacagcatcgacaagttcgagaagataaagcccaagatggtgcaggccgtggatgacatgctcgcgcacgacatcccggacctcctcaagaacttcagcaacccttaccagtgaacctgttgctgacctctcgtcagtggcaactcgttcctcaagtgctgttcggctgccatgactcatgatggaagtaggcaagcgtgagagggtcatgccggcccttgtgtgtgggaatagtgagaaacgtgtaacacaatgttcagagatgcattggcattttcgttttgtcttcagtgctgcactgccgtggcctatgcatgtttgaccactgttcggaatagatgcttggttggagaattcaggatgcatggacagcatagtagaacttgcgatttttcgggcaattttggcaaaacatatatatggattggccagtttcagaattgcagaaatgaagtttatcagaaggaag

SEQ ID NO: 7824 - DNA, 1824 bp, Hordeum vulgare
agggcagggtgggggggtccccgatttcaaatgcctccccattccacgcctaagagggggagaagagacgagcatccgcatccgcacccgcaccccgtgaggtttccgtttgtccactcctgctgccgctgctgctcgcgtcagccgccgccgccgccgacgcgaggagggagaccgtggatggagatcgcgcggtccgtcgcctccctgggctgctccaaggagcaccagaggatctacgccgactggttcgccctcgccgacccagatggagacgggcgcgtcacgggcgccgacgccaccaagttcttcgccatgtccggcctctcccgcgccgacctcaagcaggtttgggcgattgctgactccaagcgtcaggggtacctcggcttcggcgagttcgcggccgcgatgcagctcgtgtctctggctcaagcgggcaacgagatcacccaggacagtctcaagcgtgaagatctgagtagcttcgatcctcctgtgatgaaaggtcttgatgaactgcttgctagatcaatggctattgtgaatgtagttcgcccacaagaaaatggcacctctcaggtgcaagcaccttctacaaacagctggttcagttccaaatcatcaaagaagattcaaacgcccctgactgctgttacttctgtaattgatggcttgaaaagactgtacatcgaaaaactgaagcctttagaagttgcataccggttcaatgattttgcctctccattgctgacaaacagtgacttcgatgcgaagccaatggttatgctcttgggtcaatattctacagggaaaacaacattcattaagcacctgttaaaaacaaacttcccaggagctcatatcggaccagagcccactactgacagatttgtagttgtgatgtcaggatctgatgaaaggactgttcctggcaatacaattgcagtccaagccgatatgcctttcaatggtcttacgacatttgggggtgcattcctatcaaagtttgaatgctctcagatgccacatcctctactagatcatatcacgtttgttgacactcctggtgttctctctggtgaaaagcaaaggacccagcgtagttatgatttcactggtgtaacttcatggtttgctgcaaagtgcgatgttattcttctactgtttgatcctcacaagcttgatatcagcgatgaattcaagcgtgtcatttcttctttacgtgggaatgaagacaaaatacgtgtggtgctgaacaaggcagaccaagttgacactcagcagcttatgagagtgtacggtgcactgatgtggtcccttgggaaagttctaaatactcctgaggttatgcgtgtctacattgggtcgtttaatgacaaacctgtgaatgaatcagctgttggaccaattggaaaggaattgtttgagaaagagcaagaggatctccttgctgacctgaaagacatacctaagaaggcttgtgatcgtcgggtcaatgagtttgtcaagcgtgccagagctgcaaagatccatgcttacataattggccagctgaagaaggagatgcctgcaatgattgggaaagccaaggctcaacagcgactcatcgacaacttgcaagatgagtttgcaaaggtccagagggagtaccaccttccggcgggcgacttccccgacgtggagcacttcaagcaggtgctggccgggtacagcatcgacaagttcgagaagataaagcccaagatggtgcaggccgtggatgacatgctcgcgcacgacatcccggacctcctcaagaacttcagcaacccttaccagtga

SEQ ID NO: 7825 - DNA, 1852 bp, Tabernaemontana elegans
gcttcagagcggtttgaaaatggaaattgattctgctccaattagtcgatgctccaaagacaattcaaaagatctatcaagattggtttgcttttgctgattcagacggagatgggcgcctcactggacctgatgccatcaagtttttgccttctccaacttgcctcgccaagatctcaagcaggtctgggctatcgcagattctaaaaggcaaggctttctcggttttaaagagtttattacagcaatgcagttagtgtctttagcacaagctgggcatgcagtaaatagcgatatcctaaatgctgaagttgactatgaaagtttaaatcccccagcaatggaaggattggatgcaatgatagctaagaaaaagcatgcttctagaagtgaacctgaacaaaatggtgatcctcaggtgcagagttcaccatctgctggttggttttcctcgtcaaagtctgcaaagaaggtatctttatcctctgtcacgtcaattattgatggcctgaaaaagttgtatattcagaagttgaagccattagaggtcacatatcgcttcaatgattttgtttccccgctgttggcgaacagtgattttgatgctaagcctatggtgatgcttttgggtcaatattccacgggaaaaacaactttcatcaaacatctgctcaaaagtagttatccaggagctcacattggaccagagcctacaactgacagatttgttgttgttatgaacggtcctgatgagagaagtattccaggaaacaccattgctgttcaagcagacatgccattcagtggtctgacaacatttggaactgcgtttttgtcgaaatttgagtgctctcaaatgccacacccgcttctggaacatattacttttgtggatacccctggagttttatcgggagaaaagcaacgcacacagagaagctatgactttaccggtgtgatatcatggttcgccgcaaagtgcgacctcattctgcttttgtttgatcctcataaacttgacataagtgatgaattcaaacgtgtgatttcttcactacgagggcatgatgataagataagggtggtattgaacaaagctgatcaagttgatacccaacagcttatgagggtttatggtgcgctaatgtggtctcttggcaaagtgctaaatactcctgaggttactcgtgtttatatcggttccttcaatgacaaacctataaatgaggctgctgctggtccaattgggagagagctttttgagaaagagcaagacgaccttctttctgatctgaaggacatacccaagaaagcttgtgatcgtcgtataaatgaatttgtaaaacgtgccagggctgcaaagatacatgcttacattatcagtcatctgaaaaaggagatgcctgccatgatgggcaaagctaagacccaacagaggcttatagataatcttgaaacagaatttgggaaggttcaaagggagtatcacctgccagcaggggatttcccaaatattgaacacttccgggatgccttgagtggttatagcattgataagtttgagaaattgaagcctaaaatgatacaatatgtggatgatatgcttggatatgacatcccgggactgttaaagaacttccggaatccttacgagtagatacacttggatgaacgataacacaacttcatcatctgctcaagaattgggaaaagttgagtatggctcatatgcttgcagattgtgggggaaccatacatccatgtgcctggtgcttcatgatatccgatcatgcagaggggggcctgtattattgtgacaagtacacaatgattcattcctggataccaggac

SEQ ID NO: 7826 - DNA, 2024 bp, Vitis vinifera
gcaaaatcaaaacaaaaaacaatttcaaataaaaaaaaacgtttttttgaatctttttgttctccgaaattccgaatcgccctacaacaagccgatccgtccgatcctttccaatggagatcgactcgggtccgattagttcgtgttctaaacagaaccagatgatctatcaggagtggttcaatttcgctgattcagattccgatggccgcattactggaaatgacgccataaagttcttcgctatgtccaatttgcctcgcccggatctcaaacaggtgtgggcaattgcagataccaaacgacagggttttcttggtttaaaagagttcattactgccatgcagctagtttccctggcacaagctggacatgcaatcacacaggatctcctgcacagtgaagttgacttgggaaacttaaatccccctcaaatggaaggcttggctgcgttactagctaagaaaaagcgtgcacacaaaacaagtgatcctgatataaatggtagttctcaaccacagccatcaccaactgctagttggttcacttcaaaatcttcgaagaaggtacctctatcttccgttacatcaataattgatggcttgaagaggttgtacattcagaagctcaagccattagaggttacatatcgttttaacgattttgcatcccccttgttgacaaatagcgattttgatgccaaacctatggttatgcttttgggtcaatactcaactggaaaaactactttcattaaacatttgctgaagagtagttatccaggagcacacattggacctgaacctactactgacagattcgttgtcgttatgtctggacctgatgaaagaagtattcctggaaacacaattgctgttcaagcagacatgccttacagtggtctgacaacttttggaacggcatttttgtccaaattcgagtgttctcaaatgccgcattctctactggagcacatcacgtttgtggatactcctggagttctatcaggagaaaagcaacgaacacagcgagcctacgattttactggtgtaacatcatggtttgctgcaaagtgtgacctcattctactgctgtttgatcctcataaacttgatgttagtgatgaattcaagcgtgtgatttcatctcttcatggccatgatgacaagatacgtgtggttctgaacaaggcggaccaagtggatactcagcaacttatgagggtttatggagcactgatgtggtcacttgggaaggttctaaatactcctgaggttatgcgtgtttatattggctctttcaacgacaaacctgtaaatgaagctgctgttggtccaattgggaaagaactttttgaaaaagagcaggaaaaccttctttctgatttaaaagatatccccaagaaggcttgtgatcgccgaatcaatgaatttgtaaaacgggcccgagctgccaagattcatgcctacatcatcagccatctaaagaaggagatgcctactatgatgggcaaagccaagactcagcagaggcttatcgacaatctggaagatgaatttgcaaaggtccagagggagttccatctgccggcgggggatttcccgaacgttgaccatttcagggaggtattgagtggttacagcatagacaaatttgagaggttgaagcctaaaatgatacaaaccgtagatgacatgttgggttatgacatcccggagctcctgaagagtttcagaaatccatacgattaaatggatgcgggcagttctatgagatacatatcttggatgaagacccaagtgactggaggcatgtacagagccacccttcttcccttccattgatattttgagacttgtctgagcagttccttggctcctccatgatgtcagtcagtatcatataaattatcactcctttccctttcatcagaggattaagttgtagtagatattgttttcttttattttgtcagacacaggcagtggaataattgttcatcttcataatatcatgaattcaaa

SEQ ID NO: 7827 - DNA, 2091 bp, Secale cereale
tcagccgatttcaaatgcctccccattccacgccgaaaagggggagaagagacgagcacccgcacccaccccgtgaggtttccgttgtccactcctgctgccgctgctgctcgcgtcagccgccgccgccgccgccgccgacgcgaggagggagaccgtggatggagatcgcgcggtccgctgccgccgtgggctgctccaaggagcaccagaggatctacgccgactggttcgccatcgccgacccagatggagacgggcgcgtcacgggcgccgacgccaccaagttcttcgccatgtccggcctctcccgcgccgacctcaagcaggtctgggcgattgctgactccaagcggcaggggtacctcggcttcggcgagttcgcggccgcgatgcagctcgtttccctcgctcaagcgggcaatgagatcacccaggacagtctcaagcgtgaagatctgagtagcctcgatcctcctgtgatgaaaggtcttgatgaactacttgctagatcaatggctatcgtgaacgtagttcgcccacaagaaaatggcacctctcaggtgcaagcaccttctacaaacagctggttcagttccaaatcagcaaagaagattcaaacgcctctgactgctgttacttctgtaattgatggcttgaaaagactgtacatcgaaaaactgaagcctctagaagttgcataccggttcaatgattttgcctccccattgctgacgaacagtgacttcgatgccaagccgatggttatgctcttgggtcaatattctacagggaaaacaacattcattaagcacctgttgaaatctaacttcccaggagctcatatcggaccagagcccactactgacagatttgtagttgtgatgtcaggatctgatgaaaggactgttcctggcaatacaattgcagtccaagcggatatgcctttcaatggtcttaccacatttgggggtgcattcctatcaaagtttgaatgctctcagatgccacatcctctgctagatcatatcacttttgttgacactcctggtgttctctctggtgaaaagcaaaggacccagcgtagttatgatttcactggtgtaacttcttggtttgctgcaaagtgcgatgttattcttctactgtttgatcctcacaagcttgatatcagtgatgaattcaagcgtgtcatttcttctttacgtgggaatgaagacaaaatacgtgtggtgctgaacaaggcagaccaagttgacactcagcagcttatgagagtgtatggcgcactgatgtggtcccttgggaaagttctaaatactcctgaggttatgcgtgtctacattgggtcatttaatgacaaacctgtgaatgaatcagctgttgggccaattggaaaggaattgtttgagaaagagcaagaggatctccttgctgacctgaaagacatacctaagaaggcttgtgatcgccgggtcaatgagtttgtcaagcgtgctagagctgcaaagatccatgcttacataattggccaactgaagaaggagatgcctgcaatgatggggaaagccaaggctcaacagcgactcatcgacaacttacaagatgagtttgcaaaggtccagagggagtaccaccttccagcgggcgacttccccgacgtggagcacttcaagcaggtgctggccgggtacagcatcgacaagtttgagaagatcaagcccaagatggtgcaggccgtggacgacatgctcgcgcacgacatcccggacctcctcaagaacttcagcaacccttaccagtgaactttgttgctgacctctcgtcagtcgcaacttattcctcaagtgttgttcgtctgccatgactcatgatggaagtaggcaagcgcgagagacccatggcatgtgcaaggttatgcctgcccttttgtgtgggaaaagtgataaacgtgtaacacaatgttcagagatgcattggctctttcgttttgtcttcactcttcagtgctgtactgccgtagcctatgcatctttgaccactgttcggaatatatgtagaacttgggtgggagaattcaagatgtagaac

SEQ ID NO: 7828 - DNA, 2067 bp, Brachypodium distachyon
ccattccacctctcaaaggagccgaggacgagactcagccgagcaccccgtgaggtttccgtttgcccaccactgctgctgctgcctctcgcgtccgccgccgccgaggcgaggaggaaggagaccggggatggagatcgcggccgccgccgtgggctgctccaaggagcaccagaagatctacgccgactggttcgcgctcgccgacccagatggagacggccgcgtcacgggctccgacgccaccaagttcttcgccatgtccggcctctcccgctccgacctcaagcaggtttgggcgattgctgactccaagcggcaggggtacctcggtttcggcgagttcgccgccgcgatgcagctcgtttctctggcgcaagcggggaaggagatcacccagaacagtctcaagctcgaagatctgagtagcctagacccgccagttatgaaaggtcttgatgaactacttgctagatcaatggcgattgtaaatgtggttcgcaaagaagaaaattatacccctcaggtccaagcaccttttgcaaacaactggttcggctcaaaatcagcaaagaagatgcaaacccctctgactgctgttacttctgtagttgatggcttaaaaagactatacgtcgagaaactgaagcctttagaggttgcataccggtttaatgatttcgcttccccattgctgacgaacagtgacttcgacgcaaaaccaatggttatgctcttgggtcaatattctacagggaaaacaaccttcattaagcacctgctgaaaacaagctacccaggagctcatgtcggaccagagccaactactgacagatttgtagttgtcatgtcaggacctgatgagaggactgttcctggcaacactattgctgttcaagccgatatgcctttcaatggtctcactacatttgggggcgcatttctatcaaagtttgaatgctctcagatgccacatccattactggagcatatcacgtttgttgacactcccggtgttctctctggtgaaaagcaaaggacccaacgaagctatgatttcaccggtgtaacctcctggtttgctgctaaatgtgaccttattcttcttctgtttgatcctcacaagcttgatatcagtgatgagttcaaacgtgtcatttcatctttacgtgggcatgatgacaaaatacgtgtggtactgaacaaggcagaccaagttgacactcagcagcttatgagagtgtatggtgcactgatgtggtcgcttggcaaagtactgaatacgcctgaggttatgcgtgtttatattgggtcgttcaatgacaaaccagtgaatgaatcagctgttgggccaattggaaaggacttgtttgagaaagagcaagaggatctccttgctgacctgaaagacatacctaagaaagcctgtgatcgccgggtcaatgagtttgtcaagcgtgctagagctgccaagatccatgcttacataattggccatctgaagaaggagatgcctgcagtgatggggaaagccaaggctcaacagcgactcatagacaacctacaagatgagtttgcaaaggtccagagggaataccatcttccagccggcgacttcccagacgcggagcatttcaaggaggtgctgggcgggtacagcatcgacaagttcgagaagatgaagcccaagatggttcaggcggtggacgacatgctggcctacgacatcccggagctcctcaagaacttgagcaacccttaccagtgagcgagcttgctgacctctcgtcagctgcaaagtgtcgcccggctgtcgtccttccggaccctggtggtgatggttcttgagggggcgatagccctcgtgtgccaaaacatggacaacgtgtcgcaaagagtcgcaatgttcagagatgcataggctgtttctcttcgtctccagctctccgttgagactctgcttgtgctaggtgtttggtagggaagagttttgaatgaattgtaggaaccgtcaagagtaaaagaatttcgagtttcgaaaatctatcgaatttgtgtaaaagaccc

SEQ ID NO: 7829 - DNA, 1899 bp, Lippia dulcis
tctaggtcctcagttcgaagaaaaatggagatagattcggtcccgattagtcgttgctccaaggagcaccagaagatctatcaagagtggttttctttcgctgattcggatggagatgggcgtcttacgggtggtgatgctaccaaattcttttcgatgtctaacttgcctcgtcaagatctcaaactggtgtgggcgattgctgattcgaaaaggcaaggctttcttggatttaaagagttcgttacagctatgcagttggtctctttggcacaaactgggaatgttctcaccagtgatgttttgaactctactgttgactatgagaacttgcaaccgccaaccatggaagatctggatgcacttcttgttaagaaaaaacgttcatcaatcgaacctgaacagaatggcagtcctcaagtgcagtcttctcctgcagctggttggtttacttcgacaaaatccgcaaagaaggtatctttgagctcggtcacttcgattattgatggtttgaagaagttgtatgttcagaagctgaagcctctggaatcaacgtatcggtttaatgattttgtttctccattgctgaccaatagtgattttgacgccaaacctatggtgatgctactgggacagtattccactgggaagacaacatttatcaaacatttgcttagaacaagttacccaggtgctcatattggaccagagcccacaacagatagatttgttgtcgttatgaatggacctgatgagagaagtattccagggaatacagttgctgttcaagcagatatgcccttcagtggcctgacaactttcggaactgcttttttgtcaaaatttgagtgttcacagatgccacatcctctgctggagcatattacatttgtggacactcctggtgttttatcaggagaaaaacaacgaacacagagaagctatgacttcactggtgtaacttcttggtttgctgcaaagtgtgatctgatcctgcttctgtttgatcctcacaaacttgacataagtgatgaatttaagcgagtcattggatctctacgaggccatgatgataagatacgtgtggttttgaacaaggctgaccaagttgatacacagcaacttatgcgggtatatggagcactgatgtggtcccttgggaaagtgctgaacacacctgaagttatgcgtgtttatattggttcatttaatgacaagcctattaacgaagctgcttctggtccaattggtaaagagctctttgagaaagaacaggatgaccttcttactgatttaaaagacattccaaagaaggcttgtgatcgtcgaataaacgaatttgtaaaacgtgctagggctgctaagattcatgcttacattatcagtcatttgaaaaaggaaatgcctgcaatgatgggcaaagctaagacacagcagagactcattgataacctgcctgatgaatttgcaaaggttcagagggagcaccatctgccagctggggacttccctaatgttgaacactttagggaggctttaagtgggtacaatctagataaatttgagaagctcaaacctaaaatgatacaggcggttgatgacatgcttggctacgacattcccgaccttctcaagaattttcgcaatccttatgattagaaatcccaatgtttttctagagtggaagcaattatttctttgctgatactatcagatgtcattaccttttccactagaatcatagtcgagcgggatatattttgattgcggatatgtatatgtatattccttgcttgtgcattatcaccggtatttcgctcttaaattatacaagttgtaatcgatgatcggacgcattcgaatcaaataatgaaataatacatctgctgtaattgttgg

SEQ ID NO: 7830 - DNA, 2039 bp, Papaver somniferum
tagggatatatcatctggatcaataaactgtctctgaatctatcaatcgatttagatggagatagattcaggtccgattagtacatgttcgaaagagcatcaaaagatctaccagacatggtttaatcacgctgatacagatggagatggtcgagttaccggaaatgacgcaactaagttcttcgctttatcgaacttatcccgacctgaacttaaacaggtatgggctatttctgattccaaacgactagggttccttgggttcaaagaatttgttactgcaatgcagcttgtctctttggcacaagctggacatgaaataacagagggacttctcaccgctgaacttgatttggaaagcttaaaccctccagtgatggaagggttggatgcattgttagctaaaaaacgttcaccaaagaaagtagagcctgatctctcaatctctccccaaccatcaatatcggctaattggtttacctctaagtctacaaagaaggttcctttaagctcagtcacatcaataattgacgggttgaagaggctgtacatcgaaaagctgaagccgttagaggtggcatacaaatttaacgattttgtatctcccctattgacgaacagtgactttgatgctagaccaatggtcatgcttttgggccagtattctactggaaaaaccacattcatcaagcatctattgaaaagtagttatccaggagctcacattggaccagagcctacaacggacagatttgttgttgttatgtcgggacctgatggaaggagtattcctgggaacacaattgccgttcaagcagacatgccattcagtggcctcacaacttttggaactgcatttttatcaaaatttcagtgttcccaaatgccacatccgctgctagagcatatcacatttgtagatactccaggagttttatctggagaaaagcagcggacacaacgaagctatgattttactggagttacatcttggtttgcagctaagtgtgatcttattcttcttctatttgatcctcataaactggatatcagtgatgaattcaagcgagtgattggatctctacgtggtcatgatgacaagatacgtgtggttctgaacaaggcagatcaagttgatacgcaacagctgatgagagtttatggggcattgatgtggtcactgggaaaggttctgaatactcctgaagttatgcgtgtttatattggctcattcaatgacaaacctgtaaatgaagcagcaattggtccacttggaaaagagctttttgagaaggagcaggaagaccttcttgctgatctgaaagatatccctaagaaggcttgtgatcgccgaatcaatgaatttgtaaagcgtgccagagctgctaagattcacgcttacataattagtcatcttagaaaggagatgcctgcaatgatgggcaaggctaaggcacaacagagactcatagataatttggaagatgaatttgctaaggtccagagagagttccatctaccagctggggacttcccaaatgttgatcattttagagaagtactcagcggttacagcatcgataagtttgagaagttaaagccgaaattgatacaaacagtcgatgacatgcttggttatgacatccctgacctcttgaagaacttcaagaatccgtacgagtgaaaacagttacctcttgaaaaagcagacattgtatgtaccatgactagctataattgtgggatttttcttataatcagtgactggtgagtgctcaagtgtcctgttcagcttattagtatatcaaggaagtgttaagagatttgatttcatctgagaagtgtgtaagatacaattttcaatcatgaatagttgagctcggtactttgttagataagagattaagagtataccttttagcttctgaggtgatgaaaataatgtctgtataatccgttagttaatgatgtataactgccttgttatgaatcttattatttttgctataatgtctgggttcaaatgagcatttgcccat

SEQ ID NO: 7831 - DNA, 2287 bp, Panax ginseng
aagcagtggtatcaacgcagagtacatgggaaaaaccaaagcacataaaggaagaactgtttcgctctcggaattggtaataaagcatcttcaatcatttgaaatttgttcgaacctgatagccaaatccaatcaattccactcataacaaaaagctttggattctgaatgaatggagattagttcggctccgattagtcagtgctccaaagagcatcaaaagatctatcaggaatggtttaattccgccgattctgatagcgatgagcgcattacgggaggtgatgctatcaaattcttttccatgtctaacttaccccgtccggatcttaagcaggtgtgggcaattgcagattccaagcgacaaggctttcttggttttaaagagttcattactgcaatgcagttagtttctttagcacaagctggaaaagccataactaccgatctcttaaactctgaagttgactttgaaaatctgaatcctccaatcatggacggattggatgtattattagctaagcaaaagtgcacacctaaaacaagtgagactgagcgaaatggtacttctccagtgcaaccttcaccagctgctagttggttttcatcttcaaaatcatcgaagaagctatctttagcatctgttacatcaattgttgatggcttgaagaagttgtacattcagaagctgaagccgctagaagtcacataccgttttaatgattttgtttctcccttattgacaaacagtgattttgacgccaagcctatggtgatgcttttgggtcaatattccacagggaaaacaacatttattaaacatttgctcagaactagttatccaggagctcacattggacctgagcctacaacagacagatttgttgttgttatgaatggaccagatgaaagaagtataccagggaataccattgctgttcaagcagacatgccatatagcggtcttactactttcggaactgcatttttgtcaaaatttgagtgctctcaaatgccacatccactgctggagcacattacatttgtggatactcctggagttttatcaggagaaaagcaacggacacaacgaagttatgattttactggtgtaacatcatggtttgctgcgaagtgtgacctcattttacttctctttgatccacacaaacttgatatcagtgatgagtttaagcgtgtgatttcatccctacgaggacatgatgacaagatacgtgtggtgttgaacaaggctgaccaagttgatacccagcaactgatgagggtgtatggggcattgatgtggtcccttgggaaagttttgaatactcctgaggttatgcgtgtttacatcggttcattcaacgacaaacctgtaaatgtggctgcggcgggtccacttgggagagaactatttgagaaagaacaggaggaccttctcactgatctaaaagacataccaaagaaggcttgtgatcgtcgtatcaatgaatttgttaaacgtgcaagggctgctaaaattcattcgtacattatcagtcatcttaaaagggagatgcctgctatgatgggcaaagcaaaggctcagcaaagacttattgataatttggcagaagaatttggaaaggttcaaagggagcaccatttaccagcaggagattttccaaatgttgagcacttccgggagatcctgaatggttacaacatcgataagttcgagaagtttaagcctaaaatgatacaagctgttgatgacatgcttgggtatgacatcccagatctcctaaagaatttccggaatccatatgattaaaggttgcagcagtttgggagggatatccaaatgacagcagttagaaacggtgaagtgaaggtatggttgctgaggcgtcagatgtattattttcttctgaatcaatatataatcatcctctcaagcttacaggtttagatgggtctatgatgaagagcttaacatcaattcctatattcatcttccaaaggtgtaaattggaaattatagccattggcccagacattctaattactttacccttctttgtaggatagaagttattttgaatgaaggaaatctgtttgtgctggttcttagttcggtgtatacgttgacattaccatgattgagattcattgtcataaatgaaatcttatgtgatgctaatagtgtaatacatagttgcacacattcttctatatagattgtattcacttgttctcgtcatagtcatattatcataaacttctcttggaggttaggtttcgtctg

SEQ ID NO: 7832 - DNA, 2381 bp, Panax ginseng
acataaaggaagaactgtttcgctctcggaattggtaataaagcatcttcaaacatttgaaatttgttcgaacctaatagccaaatccaatcaattcgactccataacaaaaagctttggtttctgaatgaatggatattagttcggctccgattagtcagtgctccaaagagcatcaaaagatctatcaggaatggtttaattacgccgattctgatagcgatgggcgcattacgggaggtgatgccatcaaattcttttccatgtctaacttaccccgtccggatcttaagcaggtgtgggcaattgcagattccaagcgacaaggctttcttggttttaaagagttcattactgcaatgcagttagtttctttagcacaagctggaaaagccataactaacgatctcttaaactctgaagttgactttgaaaatctgaatcctccaaccatggatggattggatgttttactagctaagcaaaagcgcacacctaaaacaagtgagactgagacgaatggtacttctccagtgcaaccttcaccagctgctagttggttttcctcttcaaaatcatcgaagaagctatctttagcatctgttacatcaattgttgatggtttgaagaagttgtacattcagaagctgaagccgctagaagtcacataccgttttaatgattttgtttctcccttattgacaaacagtgattttgacgccaagcctatggtgatgcttttgggtcaatattccacagggaaaacaacatttattaaacatttgctcagaactagttatccaggcgctcacattggacctgagcctacaacagacagattcgttgttgttatgaatggaccagatgaaagaagtataccagggaataccattgctgttcaagcagacatgccatatagcggtcttactactttcggaactgcatttttgtcaaaatttgagtgctctcaaatgccacatccactgctggagcacattacatttgtggatactcctggagttttatcaggagaaaagcaacggacacaacgaagttatgattttactggtgtaacatcatggtttgctgcgaagtgtgacctcattttacttctctttgatccacacaaacttgatatcagtgatgagtttaagcgtgtgatttcatccctacgaggacatgatgacaagatacgtgtggtgttgaacaaggctgaccaagttgatacccagcaactgatgagggtgtatggggcattgatgtggtcccttgggaaagttttgaatactcctgaggttatgcgtgtttacatcggttcattcaacgacaaacctgtaaatgtggctgcggcgggtccacttgggagagaactatttgagaaagaacaggaggaccttctcactgatctaaaagacataccaaagaaggcttgtgatcgtcgtatcaatgaatttgttaaacgtgcaagggctgctaaaattcattcgtacattatcagtcatcttaaaagggagatgcctgctatgatgggcaaagcaaaggctcagcaaagacttattgataatttggcagaagaatttggaaaggttcaaagggagcaccatttaccagcaggagattttccaaatgttgagcacttccgggagatcctgaatggttacaacatcgataagttcgagaagtttaagcctaaaatgatacaaactgttgatgacatgcttgggtatgacatcccagatctcctaaagaatttccggaatccatatgattaaaggttgcagcagtttgggagggatatccaaatgacagcagttagaaacggtgaagtgaaggtatggttgctgaggcgtcagatgtattatttttcttctgaatcaatatataatcatcctctcaagcttacaggtttagatgggtctatgatgaagagcttaacatcaattcctatattcatcttccaaaggtgtaaattggaaattatagccattggcccagacattctaattactttacccttctttgtaggatagaagttattttgaatgaaggaaatctgtttgtgctggttcttagttcggtgtatacgttgacattaccatgattgagattcattgtcataaatgaaatcttatgtgatgctaatagtgtaatacatagttgcacacattcttctatatagattgtattcacttgttctcgtcatagtcatattatcataaacttctcttggaggttaggtttcgtctgcttttatttttgccattgagtggcaacttgagttgtgaatgtattttgtaattgggactgatcagagaatgagcaggtccatgagatattcatcttggatggatggataatagaaagggtttacctttttgtta

SEQ ID NO: 7833 - DNA, 1706 bp, Chenopodium quinoa
aaaaatatggagatatctactggcccaatttctacatgttctaaagaacaccagaaaatttatcagcaatggtttccagttgctgattcagatggagatggtcgaattactggaaatgatgcaaccaagttttttgccatgtctaatttgtctcgatctgaccttaagcaggtatgggcactagcagataccaagagacaaggttacttgggctttaaagagtttgttgctgcgatgcagcttatatctttggctcaagcgggaaaggagctgacttctgatcttctgagtaatgcagctatggaggacattcaactccctataatggaagggctggatgcgttacttgctaaaaagaagaagaccacgacaacatatgttgaacctgaattaaatggatctcctcaacagtcaccacctacatcaaattggtttagttcaaagccctcaaagaagataccactcagtgcagtaacttctatagttgatggtttgaagagattatacattgaaaagctgaagccactggagactacctaccgctttcatgactttgtttcacctccactgacaaacagtgattttgatgccaaacctatggttatgctgttgggacaatattctactgggaaaactaccttcataaaacatttgctgaaatgtgaatatccaggagctcatattggaccagagcctactacagatcgttttgttgtcgtcatgtctggacctgatgagaggagcattcctgggaacacgattgctgtccaagcagacatgccattcagtggtctcacaaactttggcggggcattcttatcaaaattccagtgttcgcaaatgccacatcctctgttggagcacataacttttgttgacacgcctggagttctgtctggagagaagcagagaactcagagaagctatgactttactggagtgatctcatggtttgctgcaaagtgcgaccttatccttttgttgtttgatcctcacaagcttgacataagtgatgaattcaagcgggtaatttcatctctgcgcggtcatgatgacaaaatccgtgttgttctgaataaagctgaccaagtcgatacccagcagttgatgagagtatatggcgcattgatgtggtcgcttggaaaggtcctaaatacccctgaggtctctcgtgtttatattggttcattcaatgacaagcctattgactctgaagcagttggtcccatgggaaaggatctttttgagagagagcagaatgaccttcttactgatctgaaggacattccaaagaaagcttgtgatagaagaataaatgaatttgtgaaacgtgcccgagcagctaagattcacgcttacattatcagtcacctgaagaaagagatgccttcaatgatggggaaagctaaaactcaacaacgattaattgataatcttgaagatgaatttctcaaggttcagagggaattccatttgccagcaggcgattttccatatgtggagcatttcagggaagttctaggtggctatagtattgacaaatttgaaaagttgaaacctaagatgattcaagctgttgatgacatgcttggctatgatattccagagttactcaagaattttagaaacccatatgagtaaatttgaacgaaaccccagaatctgaacttgatggctacgacgcgtagcttttgtagatagttttg

SEQ ID NO: 7834 - DNA, 1655 bp, Manihot esculenta
ccgccttatcctttgcgatcatggaaatatctacaggaccaatctgttcttgctcaaaagagaaccagaagatctaccttgagtggtttaacttcgctgattcagatggtgacggtcgaatcactggtagtgacgctataaaattctttggcatctctaatttatctcgacaggatcttaagcaggtgtgggcgattgcagattctaagcgacagggatttctaggtttcaatgagttcgtcagtgctatgcagttagtttccctggcacaagcagggcatgaaatcagaaatgatatcttaaatagcaatgttgactttggaaatttgaagcctgcatccatggaaggtctggatgccctgatcgcgaaaaaacgttcttcaaaattaagtgaccctgatacaaatggtagtcctccagtgcaaacatcaccttcagttaattggttttcttcaaaatcatcaaaaaaggtgcctctatcctcggttacatccatcattgatggcttgaagagactgtacattcagaagctgaagccgcttgaagttacttaccgttttaatgattttgtatctccgttgttgacaaacagtgattttgatgccaaaccaatggttatgctattgggtcaatattccactggaaaaacaacattcatcaaacatttactcaaaagtggttatcctggagctcatattggacctgagccaacaaccgacagatttgttgttgtcatgtctggtactgatgaaaggagcatccccggcaacacagtggcagtccaagcagatatgccctttaatgggctcacaacttttggaactgcttttttgtcaaaatttgaatgttctcaaatgcctcatcctttactggagcatattacatttgtggacacacctggagttctatcaggggagaaacaacgaacacaacgagcttatgattttactggtgtaacttcatggtttgctgctaagtgtgatctcattctgcttctgtttgatcctcacaaacttgatgtcagcgatgagttcaaacgtgtgatttcatccttacgtggtcatgatgataagatccgtgtggttctcaacaaggcagaccaagttggtactcaacaactaatgagggtttatggggcgctaatgtggtcacttggcaaagttctaaatactcctgaagttgtgcgtgtttatattggctccttcaatgataaaccagtaaatgaagctgctgttggtccaattgggaaagaactttttgagaaagaacaggacgaccttctggctgatctaaaagatataccaaagaaggcttgtgatcgccgaataaatgaatttgtgaaacgagctagagcagcaaagatacatgcttacattattagtcatcttaaaaaggagatgccggcaatgatggggaaagcaaaggctcaacagcgtcttattgataatttggcagatgagtttggaaaggtccaaagggagttccatttgcctccaggtgattttccaaatgttgaatacttcagagaggttttgagtggttacaacattgacaagtttgaaaagttaaagcctaaaatgatacaagctgttgatgacatgcttggttatgacatcccagagctcttgaagaacttcagaaatccatatgactaa

SEQ ID NO: 7835 - DNA, 2061 bp, Papaver somniferum
tttctctttcctaaatttcgaaatttcaaatcgaaaccaacagggatatcatctcgatcaatataatctgtctctggatctatcaatcgtttttgatggagatagattcaggtccgattagttcatgttcgaaagagcatcagaagatctaccaggcatggtttaatcacgctgatacagatggagatggtcgagttaccggaaatgacgcaactaagttcttcgctttatctaacttatcccgacctgaacttaaacaggtatgggctatttctgattccaaacgactagggttccttgggttcaaagaattcgttactgcaatgcagcttgtctctttggcacaagctggacatgaaataacagagggacttctcaccgctgaacttgatttggaaagcttaaaccctccagtgatggaagggttggatgcattattagctaaaaaacgttcaccaaagaaagtagagcccgatctctcaatctctccccaaccatccatatcggctaattggtttacctctaagtctcaaaaaaggttcctttaagctcagtcacatcaataattgacgggttgaagaggctatacatcgaaaagctaaagccgttggaagttgcctacaaatttaatgattttgtatctccattattgacaaacagtgactttgatgctagaccaatggtcatgcttttgggccagtattctactggaaaaaccacattcatcaagcatctactgaaaagtacttatccaggagctcacattggaccagaacctacaacggacagatttgtagttgttatgtcgggacctgatggaaggagtattcctgggaacacaattgctgttcaagcagacatgccatacagtggcctcacaacttttggaactgcatttttatcaaaatttcagtgttcccaaatgccgcatccgctgctagagcatatcacatttgtagatactcctggagttctatccggagaaaagcaacggacacaacgaagctatgattttactggagttacatcttggtttgcagctaagtgtgatcttattcttcttctatttgatcctcataaactggatatcagtgatgaattcaagcgcgtcattggatctctacgtggtcatgatgacaagatacgcgtggttctgaacaaggcagatcaagttgatacacaacagctgatgagagtttatggggcattgatgtggtcactgggaaaggttcttaatactcctgaagttatgcgtgtttatattggctcatttaatgacaaacctgtaaatgaagcagcaattggtccacttggaaaagagctttttgagaaggagcaggaagacctgcttgctgatctgaaagatattcccaagaaagcttgtgatcgccgaatcaatgaatttgtaaagcgtgcaagagctgctaagatccacgcttacataattagtcatcttagaaaggagatgcctgcaatgatgggcaaggctaaggcacaacagagactcatagataatctagaagatgaatttgcaaaggtccagagagagttccatctaccagctggggacttcccaaatgtcgagcattttagagaagtactcagcggttacagcatcgataagtttgagaagctaaagccgaagttgatacaaacggtcgatgacatgcttggttatgacatccctgacctcttgaagaacttcaagaatccgtacgagtgaaaacacatcttgaaggcagacattgtatgtaccatgactagctatagttgtgggatttttcttatttaaatcttataatcagtgactggtgagtgctgaagtgtcctgttcgacttattagtatatcaaggaagtgttcagagatttgatttcatctgagaagtgtgtaagatacaattttcaatcatgaatagttgagctcggtactttgttagataagagattaagagtataccttttagcttccgaggtgatgacaataatgtctgtataatccgttagttaatgatgtataactgccttgttatgtgaatcttattattctatttttgctataa

SEQ ID NO: 7836 - DNA, 2139 bp, Eucalyptus grandis
atgatgatttgtcccgccgcatccaccgagcgaagggaccgtcctccccacgaggcgcggtgcaagtgccaggaaaacggaaaacacaagcaaatcggggattttctcttcttttttttttttgaaatcgcttcccttctcctgctttcatcgtcgcgtcctgatttgatttcaaactcgcggcggaataaggtcgcggtttccatggagatttctccggttccgatcagtacgtgctccaaagagaaccagcaaatctaccaggaatggttcgattacgctgattccgatggggacggacgcatcacggggagcgacgccactaagttcttcgccatgtcgaacttgcctcgaccagacctcaagcaggtgtgggcaattgcagattccaagcgacagggtttccttggttttggggagttcattactgcaatgcagttagtgtctcttgcacaagctggccaatcgatcacacaagatctttcgagcagcgaagttgacttggtaaatttgggacctcctaaaatgacaggtctagattccttgctagcaaagaaaaggccttcgccaaggacaaatgagtctgattctaatggcagttctcactcacaaccatcaccagcttccggttggttttcttcgaaaccatcaaaaaagatatctctttcctccgttacatcaattgttgatggcttgaagagactgtatattcagaagctgaagccactggaagtcacttatcgtttcaatgactttgtgtcgccattattgacaaatagtgattttgatgccaaaccaatggttatgcttttgggtcaatactccactgggaaaacaactttcatcaagcatttgctacaaagtagttatccaggagctcatattggacctgaaccaacgacagataggtttgtggttgtaatgtctgggccggatgaaagaagcatccctggaaacactgttgcagtccaagcagacatgccatatagtggcctgacaacatttggaactgcatttttgtcaaaatttgagtgttcccaaatgcctcatcctctactggagcacatcacttttgttgacactcccggagttttgtcgggcgagaagcaacggacgcagcgtgcctatgattttactggtgtaacttcatggtttgctgcaaagtgtgacctcattttgctcctattcgatcctcacaagcttgatgtaagtgatgaattcaagcgtgtgatttcttctctacgtggtcatgacgacaagattcgtgtggttttgaacaaagctgaccaagtggatacccaacaactgatgagagtttatggagcattaatgtggtctcttggtaaagtcataaatactccagaagttatgcgagtctacattggctcatttaatgacaaacctgtgaatgaggctgctacgggtcccattggaaaagaactttttgagaaagaacaggaggaccttttatcagacctaaaggatatcccaaagaaagcatgtgatcgtaggatcaatgaatttgtgaaacgtgctcgagctgctaagattcatgcatacatcatcagccatcttaaaaaggagatgcctgctatgatgggcaaagctaagacccaacagagactcattgataatttggaagacgaatttgccaaggttcagagagagttccatctacctccgggggattttccgaatgtggagcactttagggagagattaagtggttacaacttagataaattcgagaagctaaagccaaaaatgatacaagctgtagatgatatgctgggttatgacattccagatctcttgaagcattttaggaatccttatgattaaggatatgttacaacaagttgagcttttgaatgtatgtttgagcgattgttcacatttatgaaccccacgtatagaaatatattctggccgtgtatgatattagtattttttttagaagcatgtaaatgtagaggcaaattgtatgattattttagtactcaatgcactcggtcctctctttcttgcaaactaatggtcatggaatcgatagatttccttctgcaactatctctattatcttgataatgctattgccattgtcgttgatactgaaatgtttttttttttttttttttt

SEQ ID NO: 7837 - DNA, 2013 bp, Ocimum basilicum
catgtgcgtcggcttctatctcgctcataccagctgcaacttgcgtagttaatggccggagagatacagagagagatattgaaacagtaagttgaggttttggaagaaggcatctgagcaagaagctgtattaggggggaagaaatggagatagattacgcaccgattagtcggtgctccaaggaacaccagaagatctatcaggagtggtttgcttgcgctgattccgacggagatgggcgtctcactggaggtgatgctatcaagttcttttctatgtctagcttgcctcgccaagatctcaaacaggtatgggctatcgctgatacgaaaaggcaagggttccttggatttaaagagttcattacagcaatgcagctgatctctttggcacaagctggacaaactctcacaagtgatattttaagctctcaagttgactttgaaagcatacaacctccaactatggaaggtctggatgtgctccttacacagaagaagaagcgtttatcaagtgaacctgatcagaatgggagttctcaagtgcaatcttcaccttcagctagttggtttacttctacaaaatctgctaagaaggtatctctaagctctgtcacgtcaattattgatggcttgaagaagttgtatgttcagaagctgaagcccctggaaacaacctatcgatttaatgattttgtttctccttttctgagcaatagtgattttgatgctaaacccatggtgatgctgctgggtcagtactcgactgggaagacaacatttatcaaacatttgctgaggacaagctatccaggtgctcacattgggcccgagccaaccacggatagatttgttgttgtcatgaatgggccagatgagagaagcattccaggaaacactgtcgctgttcaagcagatatgccgttcagtggcctaacaacctttggaactgcattcttatcaaaatttgaatgttctcaaatgccacatcctctgctggagcatatcacatttgtggatacacctggagtcttatccggagaaaaacaacgcacacagagaagttatgactttactggtgtgacctcttggtttgccgcaaagtgtgatctcatcctacttctgtttgatcctcacaagcttgatataagtgatgaatttaaacgagtaattggatctttaagaggccatgatgataagatacgtgtagttttgaacaaggccgaccaagttgatacacagcagcttatgcgggtctatggagcattgatgtggtcccttggtaaagtgcttaatactcctgaagtcatgcgtgtttatattggttcatttaatgacaaacccataaatgaggcatctgttggtcccattggtaaggagctctttgagaaagagcaggaagaccttctgagtgatttgaaagacataccaaagaaggcttgtgaccgtaggataaatgaatttgtgaaacgcgctagggctgctaagattcatgcttacattatcagccatctgaaaaaggagatgccagcaatgatgggtaaagctaaaactcagcagaggctcatcgataacctgccagatgaatttgcaaaggttcagagagaacaccatctaccggcaggggatttccctcacatcgagcattttagggagacgttgagtgggtacagcatagataagtttgagaagctgaagcctaaactgatacagtgtgttgatgacatgcttggatacgacatacctgaacttttgaagaatttccgcaatccatatgattaattagtaaagaggaacattgtctgtatagattgtcttcttgggtgtaagagtaatcattcagattgagtattgcatttcatgtaatggttaatacattagctcaaaaccataaatagtttatcttcttttggaaaagctcgttcagtaaattaattcgagcttcaagtttgagattgtttaatcacaaaagggagctgaataatctaatctaaacggttgtttctagcaggc

SEQ ID NO: 7838 - DNA, 2107 bp, Papaver somniferum
tcgaaaccaacagggacatcatctcgatcaatataatctgtctctgaatctatcaatcgttttgatggagatagattcaggtccgattagttcatgttcgaaagagcatcaaaagatttaccagacatggttaatcacgctgatacagatggagatggtcgagttaccggaaatgacgcaactaagttcttcgctttatcgaacttatcccgacctgaacttaacaggtatgggctatttctgattccaaacgactagggttccttgggttcaaagaattcgttactgcaatgcagcttgtctctttggtacaagctggacatgagataacagagggacttctcaccgctgaacttgatttggaaagcttgaaccctccagtgatggaagggttggatgcattgttagctaaaaaacgttcaccaaagaaagtagagcctgacctctcaatctctccccaaccatcaatatcggctaattggtttacctctaagtctacaaagaaggttcctttaagctcggtcacatcaataattgatgggttgaagaggctatacatcgaaaagctgaagccgttagaagttgcatacaaatttaacgattttgtatctccactattggcaaacagtgactttgatgctagaccaatggtcatgcttttgggccagtattctactggaaaaaccacattcatcaagcatctattgaaaagtagttatccaggagctcacattggaccagagcctacaacggacagatttgttgttgttatgtcgggacctgatggaaggagtattcccggaaacacaattgccgttcaagcagacatgccattcagtggcctcacaacctttggaactgcatttttatcaaaatttcagtgctcccaaatgccacatccgctgctagagcatatcacatttgtagatactcctggagttttatccggagaaaagcaacggacacaacggagctatgattttactggagttacatcttggtttgcagctaaatgtgatcttattcttcttctatttgatcctcataaactggatatcagtgatgaattcaagcgtgtaattggatctctacgtggtcatgatgacaagatacgtgtggttctgaacaaggcagatcaagttgatacgcaacagctgatgagagtttatggggcattgatgtggtcactgggaaaggttctgaatactcccgaggttatgcgtgtttatattggctcattcaatgacaaacctgtaaatgaagcagcaattggtcctcttggaaaagagctttttgagaaggagcaggaagaccttcttgctgatctaaaagatatccctaagaaggcttgtgatcgccggatcaatgaatttgtaaagcgtgccagagctgctaagattcacgcttacataattagtcatcttagaaaggagatgcctgcaatgatgggcaaggccaaggcacaacagagactcatagataacttggaagatgaatttgcaaaggtccagagagagttccatctaccagctggggatttcccaaatgttgagcattttagagaagtactcagcggttacagcatcgataagtttgagaagttaaagccgaaattgatacaaacagtcgatgacatgcttggttatgacatccccgacctcttgaagaacttcaagaatccgtatgagtgaaaacagttacctcttgaaaaagcagacattgtatgtaccatgcatgactagctataattgtgggatttttcttatttgaatcttataatcagtgactggtgtgtgctcatgtgtcctgttcaacttgttagtatatcaagtaagtgttgagaggtttggtttcatctgagaagtgcctaagatacaattttcaatcatgaatagttgagctcggtactttgttagataagagattaagattataccttttagcttctgaggtgatgaaaataatgtctgtataatccgttagttaatgatgtataactgccttgttatgtgaatcttataattctattttcctataatgtctggattcaaatgagcatttgcccattttgggttcaaatgtaacaaaaagtaacaattcgcgaaaa

SEQ ID NO: 7839 - DNA, 1777 bp, Leymus cinereus x Leymus triticoides
ccgacctcaagcaggtctgggccatcgctgactccaagcggctggggtacctcggcttcagcgaattcatcacggcgatgcagctcgtctctctggcgcaggcggggaatgagattgctcaggacagccttcagcgtgacgatctaatcagcttcaatcccccagtgatggagggtttggatgctctactcgcaaaatccaagcatttggcaaagagggtcgatcaggatatggatggatttcctcaggcacaaggaccttctactaaccattggttcaactctaagtcatccaagaagatacctctgactgctgttacttctgtcattgatggtttaaaaagactatacatcgaaaaactgaagcctttggaagttacatacaaattcaatgattttgtgtccccattacttacaaacagtgattttgatgcaaagccgatggttatgctcttaggtcaatattctacggggaaaactactttcatcaagcatctgctaaaaacaagctatccaggtgcccatattggaccggagcccacaaccgacagatttgttgttgtcatgtcaggacctgatgaaaggactattcccgggaatactttagctgttcaagcagatatgcctttcagtggtctcacaacatttgggacttcgtttttatccaagttcgaatgctctcagatgccacacccactactagagcacatcacctttgtcgacacacctggtgttctttctggtgaaaagcaacggacacaacgtagctacgaattcactggtgttacatcatggtttgctgccaagtgtgaccttatcctgcttctgtttgatcctcataagcttgatatcagtgatgagtttaaacgtgtcatcggatctttacgtggacatgatgacaaaatacgtgtggttctaaacaaggcagaccaaattgacactcaacagctcatgagagtgtatggtgcacttatgtggtctcttggtaaagtattgaatacccccgaggtgtcgcgcgtttatattggatcattcaatgataaaccagtaaaggaatcagccgttggcccgatcggaaaggaactatttgagaaagagcaggatgatctcctttctgatctaaaagatataccaaagaaagcttgtgaccgtcggatcaatgaattcgttaagcgtgctagagctgccaagatacatgcttatataattgggcatctaaagaatcagatgcctacgatgatggggaaagctaaagcccaacacaaacttatagacaatttggaggatgagtttgcaaaggtgcaaagggaccatcatctcccagcaggagatttcccttacgtcgagcacttcagagacgcattcggtgggtacagcatcgacaagttcgagaaggtcaagcccaagatgatccaggcggtggacgacatgctcggctacgacatccccgagctgctcaagaacttcaggaacccttacgagtgagcacccatcctgatcggcagacggcttcggtacgccatgcgcggatggcgctcgctgcccatagcgttctggctgccagtctagtagcgtgtttattgctacattgcacccgttgtatcactgtattatgcataagagccagcagcaattgctcacttgttcgctggagaacgcccttgttgtaatggcatggaaagaatcggaatatggaatggtggtcgcactgatccttcagatgattatctcttcgttccgcggaaccgcttgaatgcttgtcgattgactatccatga

SEQ ID NO: 7840 - DNA, 1954 bp, Phalaenopsis aphrodite
aaagaattgaacccgattgctctcatctaattccttttttgaattgagggccagtcaaaaacagctagagaccatcgtccttcttcttccctcctccaaattaggttttcgacagcaagcagtgctgctctctccccctctctctctcttgcattaactggttctggttctgttcttaatcctcgaaccatcgcccgtgcatccacaatggatattcttgcgcccgttatcagctcctgctcgcgagagcaccagaagatttaccaggaatggttcgcttttgcggattcagacggagacggacgcatcacggggaatgatgccatcaggttatttggaatgtccaagctttcgcgcgcggagctcaaacaggtttgggcgatagctgattctaagcggcagggctttcttggtttcagtgagtttattactgcaatgcagcttatttcattggcacaggctggaaatgagattacacctgatatgcttaataacatagatttgcgaagcttaaaacctccagatatggatggtttggacgtattaattgctaaaaacaggccatcacctaggaaaagcagtccggatttagatgttgcacctgcaacccaagtatcattatcaactcaatggttcaactcaaaatcaacaaagaagattccgttaagctctgtcacttccattattgatggtttgaagagattgtatattgaaaaattaaagccactggaagttacctatcacttcaatgaatttgtttctccttcactgacaaacagcgactttgatgccaagcccatggttatgctcttgggtcaatattcaactggaaagaccacatttattaagcatctactgggaactacttatccaggtgctcacattggacctgagcctacaactgatagatttgttgtcgttatggctgggcctgatgagagaagtattcctggaaatactatagctgttcaagcagacatgcctttcagtggtctcacaacatatggaactgcatttttatcaaaatttcagtgctcacaaatgccacatccgctcctagagcaaatcacctttgtggatactcctggtgttctttctggagagaaacagcgtacccaacgaagctatgatttcacaggtgttacctcttggtttgcagcaaaatgtgatcttattcttcttctgtttgatcctcacaaacttgatattagtgacgagttcaagcgtgttataagttctttacgtggccatgatgataaagtacgtgttgtacttaacaaggcagatcaaattgacacccaacagcttatgagagtttatggagcattaatgtggtcacttggcaaagtcttgaatacacctgaagttatgcgtgtttatatagggtcattcaatgataaaccagtgaatgaagcagctgttggtccaattgggaaagacctctttgaaagagaacaggatgatcttctttctgatttaaaagatgttcccaagaaagcttgtgaccgcaagatcaatgaatttgtaaagcgtgcaagggcagcaaagattcatgcttacataatcagccacctcaaaaaggagatgccttcaatgatgggcaaggctaaaactcaacaaagactttgtgacaacctggaagatgagttcatgaaggttcaaagggagcaccatcttccggcaggagatttcccaagtgtcgagcattacagggggatgctcggtggctataacatcgacaagtttgaaaggctaaagtctaagatgattcaatctgtcgatgatatgctaggatatgacatcccagaacttctgaagaatttcagaaacccatatgagtaatctgtatgcaactttgatctgaattgcctgtattctgttctcttctatgtggcctgtataattttggccacctctgtatttgttttttggcattctttggtagaagggtagc

SEQ ID NO: 7841 - DNA, 1741 bp, Secale cereale
gcctcccccgcgccgacctcaagcaggtctgggccatcgccgactccaagcggctggggtacctcggcttcggcgagttcatcaccgcgatgcagctcgtctctctggcgcaagcggggaatgagatatcccaggacagccttcagcgcgaagatctaatcagcttcaatcccccagtgatggagggtttggatgctcaacttgcaaaatccaagcatctggcaaagagggccgatcaggatatggatggatttcctcaggcacaaggaccttctactaaccattggttcaactctaagtcatccaagaagatacccctgactgctgttacttctgtcattgatggattaaaaagactatacatcgaaaaattgaagcctttggaagttacatacaaattcaatgattttgtgtccccgttactgacaaacagtgattttgatgcaaagccaatggttatgctcttaggtcaatattctacagggaaaactactttcatcaaacatctgctaaaaacaagctatccaggtgcccatattggaccagagccgacaaccgacagatttgttgttgtcatgtcaggacctgatgaaagaactattcccgggaatactttagctgttcaagcagatatgcctttcagtggtctcacaacatttgggacttcgtttttatcaaagttcgaatgttctcaaatgccacatccactactagagcatatcacgtttgtcgacacacctggtgttctttctggtgaaaagcaacggacacaacgtagctatgaattcacaggcgttacatcatggtttgctgccaagtgtgaccttatcctacttctgtttgatcctcataagcttgatatcagcgatgagtttaaacgcgtcatcggatctttacgtggacatgatgacaaaatacgtgttgttctaaacaaagccgaccagattgacactcaacagcttatgagagtgtatggggcacttatgtggtctcttggtaaagtattgaatacccctgaggtgtcgcgcgtttatattggatcgttcaatgataaaccagtaaaggaatcagctgttggcccaattggaaaggaactatttgagaaagagcaggatgatctcctttctgatctaaaagatataccaaagaaagcttgtgaccgcaggatcaatgaattcgtcaaacgcgctagagctgccaagatacatgcttatctaattgggcatctaaagaatcagatgcctacgatgatggggaaagctaaagcacagcagaaacttatagacaatttggagggcgagtttgcaaaggtgcaaagggaacaccatcttccggcgggggatttcccttacgtggatcacttcagagaagcattgggcgggtacagcatcgacaagttcgagaaggtgaagcccaaaatgatccaggcggtggatgacatgctcgggtacgacatcccggagctgctcaagaacttcaggaacccttacgagtgagcagacgtcatgaccgacagtccggcttcggtatgtccggcgtggatggtggtggctgcccatagagttgcggccgccagtctagctagcagggtgttttattgctactacactgtactcattgttgtataactgtattatgcataagagccagaagcaattgctgctcagtcgttcactggagaacggccttgttgtaatggcatggaaagaattcggaatatggggatggatggtgtggtggt

SEQ ID NO: 7842 - DNA, 2171 bp, Ananas comosus
attttactttttgtctctcttctcctccatcataattcacaacaacgtgctgaaactcctcccgtgaatggatttggtctcctctcccaaatcctcctgctcgagggagcttcaacagacctaccagcagtggttctccgttgccgattctgatggagatggacgcatcacggggaaggatgcactcaagttctttgccatgtccaagctttcccggcccgaactcaaacaggtgtgggctattgctgattctaaaagacaaggatttctgggtttccaagagtttattggtgcaatgcagcttgtttccctagcacaagaagggcacgaaattaatcaagatattcttagtaatgcagatttggagagcttgaaacctccagctatggaaggtttggatatattactagctaaaaagaagcggtcagaaaagaagtcagatccgaatctcgatgcacctcgtcagcccgaggcaccaccttcagctcgttggtttagttcaaaatcatcaaaaaagatacctctaaaatcagtaacttcaattgttgatgggttaaagaaattatacattgaaaaactgaagcctttggaagtgacctatcaattcaatgatttcgtttctcctctattgacgaatagtgattttgatgccaggccaatggtcatgctcttgggtcaatattctactggaaaaacaacatttataaagcatttgctgaaatctacatacccaggtgctcatattggacctgaaccgacaactgacagatttgttgtaattacttcgggaccggacgaaagaagcattcctgggaacacaattgctgtgcaagccgacatgccatatggtggccttacggcatttggaagtgcattcctatcaaaatttgagtgctcgcagatgccacatcctctgttggagcacataacatttgtggatactcctggtgttctatctggcgaaaaacaaaggacacaacgtagctacgattttactggtgtcacgtcatggtttgcagcaaaatgtgacctcgtgcttcttttgtttgatcctcacaagctcgacatcagtgatgagttcaaacgggtaattggatctctgcgtgggcatgatgacaaaattcgtgttgttcttaataaggcagaccaagttgacacccaacagctaatgagagtctatggagcattgttgtggtcgcttggaaaagtacttaacacccctgaagtcatgcgtgtttatattggttcctttaatgacaaaccagtaaatgaagctgccattggtccaattgggaaggaactgtttgagagagaacaagaggacctgctttctgatctgaaagatattcctaagaaggcttgcgaccgccgtatcaatgaatttgtcaagcgtgcaagagcggccaaaattcatgcttatataatcagccacttgaagaaggaaatgcctgcaatgatgggcaaggccaagactcagcagagactcatagataacctcgaggatgagtttgcgaaggttcaaaaggagttccatctaccaccaggggattttccaaatgtcgagcagttcagagaggttttaagtggctacaacatcgacaagttcgagaagctaaagccaaagatggtgcaggctgtggatgatatgctcgcatttgacatcccagaactcctcagaaaattcagaaatccttatgaatgaaaaggcatcgcaaatgcctaaccgtgtattttctttatattcttctttcaccaagaaattattgaaaacaggttccatgggtagatgtatttgcatcatgagaacatacaaagtttaagctctgtctcaatcaaatattaattcttttttatgctgttgtaaagttgattaaaatttgaggccatgatagttttgtacacatacctcaaaggtaatttgtagttactgaacacacggagttatactgtgatcttaatatttctgcttctgctgtaaatgttgtaatgtaaattgtgattactggtttgtaagttttagtcatgtgttcttggtagcttataattgcaatttaactgaatttttaattaatttgtcaaatatgtgctcttcagttctagggttgtggcctccctagggaaaggcccatttgacgaaactctattcgcattcatgtatactagtgtagaga

SEQ ID NO: 7843 - DNA, 2101 bp, Aquilegia formosa
aactttctctctctctttctctttttctctctctctctccttcgatcaaattcaaaatctctttctctttctctttctctctcttgaaattgaatttgaaattgatttgaatggagatagtttcaggtccgattagttcatgttctaaagaaaatcaaaagatctatcaagaatggtttaattacgctgattcagatggagatggacgcattactggaaatgatgcaatcaagttctttgctatatctaacttatctcgccctgaactcaaacaggtgtgggctattgcagattccaaaagacaaggatttcttggtttcaaagagttcattgctgcaatgcagttaatttctctggcgcaagatggacatgagataacagaaggcctccttaactctactgttgacttggaagatgtaaaacctccagcaatggagaatttggatgcattgttagcaaaaaaacgctcacccaaaaaggagtctgaatttaaagttacttctccgcccaaatcatcggtatcagctcaatggtttaccacgaaatctgtaaagaaggtatccttgagctctgttacatcaattgttgatggtttaaaaaggttatatcttgaaaagctaaagccgttagagatggcatatcgtttcaatgattttgtctctcctaccctgacaaacagtgattttgactcaaagcctatggttatgctattaggccagtattctacggggaaaacaaccttcatcaagcatttattgagaagcagttatccaggagctcacattggtccggagcctacaactgacagatttgtggttgttatgtcaggaccagatgaaagaagtattcctggcaacactatagctgttcaagcagacatgccattcagtggacttacaacatttggaactgcatttttatccaaatttcagtgttcccaaatgccacatccacttctagagcacatcacatttgtggacactcctggagtgttatccggtgaaaaacaaaggacacagcgaagctatgatttcactggggtgacgtcatggtttgctgcaaaatgtgatcttattctccttttatttgatcctcataaactggacatcagtgatgagttcaagcgtgtcattggatctctacgtggtcatgatgacaagatacgtgtggttcttaataaggctgatcaagtggacacacagcaactgatgagagtttatggagcgttgatgtggtcactcggaaaagttttgaatactcctgaggtcatgcgtgtctatattggctccttcaatgacaaacctgtaaatgaagcactaattggtccaattggaaaagagctatttgagaaagaacaagatgaccttctgtccgatctgaaagatattccaaagaaggcttgtgatcgtcgaataaatgaatttgtgaaacgtgctagagctgctaagattcatgcctatataatgagccatcttaaaaaggagatgcctgcaatgatgggcaaagctaaggcccaacaaagactcattgataatcttgaagatgagtttgcaaaggtccagagggagcatcatctaccaataggcgacttcccaaatgttgaacacttcagagaggttttgagtggttacagcatcgacaaatttgagaagctgaagccaaagatggtacaagctgttgatgatatgttgggttatgatataccagagctcctgaaaaactttaagaatccatatgagtgatacaagtgatagatcgacagatgatctaccaatataaagaataaaatgaatggccaatatatacttgttataggaggaacgtcgcgtcgcacaattcggaagtttccagttcataatctcttcatcttctttggccatcatttttatatattttgtactattatagctatgactcatagcttatgtaaacccaacatcaaacattatgcacatgacatcagtaagtccccccaggttgagtaacaagatattggaagctccggagttatatgttcagacttattgtttacctttaagtatagctgaagtcgaaattatattcatcagttgcagtcttgtagattgttcagagtttcaga

SEQ ID NO: 7844 - DNA, 2019 bp, Theobroma cacao
tttcggattatttgctcgcgttttctttttcactgtttgggaaacgtttttttttccttttttcggaaggtttttaaagtgaagattaacaaaagccgaccagattgatagttttctcgtcagcaatggagatcggagccggtcggatcggttcatgctctaaagaacaccagcagatttatcaagagtggtttagctttgttgattcagataatgatggccgcattaccggaactgatgcaataaagttcttcggtatgtcaaatttatcgcgacaagatcttaagcaggtgtgggcgatcgcggattctaagagacagggatatcttggtttcaaagaatttgtctttgctatgcagctggtttctctggcacaagatggtcatgaaatatcacatgatctcctgaatggtgatgttgactttgagaatgcgaaacctcctgtaatggaaggtttggatgcattaatcatgaagaagaaacactcttcaaagtcaactagtcctgctagcaatgccaatggtagttctccaatgcaatcatcacctgccgctcaatggttttcttcaaaatcatcaaagaagatatctatgtcctctgtgacttcaatcatagatggcttaaagagactgtacattcaaaagttgaagcctttagaagttacatatcgttttaatgattttgtatccccattgttgacaaatagtgattttgatgccaaaccaatggtcatgcttttgggtcaatattctactgggaaaacaaccttcattaaacatttgcttaaaagtagttatccaggagctcacattggacctgaaccaacgactgacagatttgttgttgttatgtcgggaactgatgaaagaagtgttccagggaacactattgctgtccaagcggacatgccattcagtggtctcactaccttcggaactgcatttttgtcaaagtttgagtgttctcaaatgccacatcctctgttggagcacataacatttgtagatactcctggagtgttatcaggagaaaaacaacgaacacaacgagcctatgattttacaggtgtaacatcatggtttgctgcaaaatgtgatctcattcttcttttgtttgatcctcacaagctagatgtaagtgatgagttcaagcgtgtaatttattctttgcgtggtcatgatgacaagattcgtgtggttttgaacaaggcagaccaagttgatactcaacaattgatgagggtttatggagccttaatgtggtcacttgggaaagtccttaatacccctgaggttgtgcgcgtatatatcggttcgttcaatgacaaacctgtaaacgaagctgccacaggtccaattgggaaagagttgttcgaaaaagaacaagaagaccttcttgctgacttgaaagatattccaaaaaaagcttgtgatcgtcgaataaatgagtttgttaaacgtgctagagctgccaagatacatgctcatattattggtcatcttagaaaggaaatgcctactatgatgggaaaagcgaagactcaacagagactaatcgataatttggccgatgaatttggaaaagttcaaagagatcatcacctacctccaggggactttccaaatgtagaacattttagggaggttttgagtggttacaacttcgacaaattcgagaagctaaagcctaaaatgattcaagctgttgatgacatgctgggttatgatatcccagagctgttgaagacattcaggaatccttacgattaacagccagagactaattaaattgcgtaagtgtatggaacatgatgatcataaaactgggttgtagagagctgttcaattcaatcaaacaaaaatctgaattctacttgaacaatattgtgtcaaacttgtttgtagatcatttgtaatagctcctagagtagttcttccatgtttactagagagttcattcggatttagatgataccatggttatatcaatccgatttttctatagtttcttcttctccaa

SEQ ID NO: 7845 - DNA, 1919 bp, Nicotiana benthamiana
gtgcacttaccccaaaagtgtgttttgagtaatttgtagcagtagcgtagtacgtaaattaataatggaaaagtgatccgtgttatgagcacatcattttcaatagttgaggaattatacaaaaggtagatcttggagaatttatttgttcagttctctgcatttcaaaagaagaagagattatttaagaaatggagtttgatacaagtcccattaatcgatgttccaaagagcatgagaagatctatcaagaatggttcaatttcgcggattcagatggagatggacgtctcactggaagagatgccacaaagttctttgccatgtccaatttgcctcgtcctgagctcaagcaggtgtgggcaattgcagattccaagcgacaaggttttcttagttttagagaatttgttattgcaatgcagttggtctctctggcgcaagctggccatgcagtaaccaatgatcttttaaatgctgatgttgattttgaaaatttgctaccccctgcaatggacggtctggatgtctttcttgctaagaagaagcccatgccgaaaaacgaacctgaacagaatggtagtgctcctgtcccgtctgcaccagcaactagttggttttcttcatcaaaatctgcaaagaaggtctctttaacctctgtcacatcaatagttgatggactgaagaagttgtacatccaaaagctaaagccgctagaagtcgcatatcactttaatgattttgtctctccattgttggcgaatagtgattttgatgccaagccgatggtcatgcttttgggtcaatactccactggcaaaaccacattcattaaacatttactcaaaaccagttatccaggcgctcacattggtccggagcctacaacagatagatttgtggttgtcatgaacgggccggatgaaagaagtattccaggaaatacaattgctgttcaagcggatatgccatttagcggtctgacaactttcggaactgcatttttgtctaagtttgagtgttctcaaatgccgcatcctttgttggagcatattactctggtggatactcctggagttttatctggggaaaagcagagaacacaaaggagctatgactttactggtgtgacgtcctggtttgctgccaagtgcgatctcatccttcttttgtttgatccccacaagcttgatataagcgatgagttcaaacgtgtgattgcttctcttcgaggccatgatgataagatacgtgtggttttgaacaaggctgaccaagttgatactcaacaacttatgagggtttatggagcattgatgtggtctttggggaaagttctaaatactcctgaagttgctcgcgtttacataggatcattcaatgacaaaccaatgaatgaagctgctacaggaccactcgggaaagaactttttgaaaaggaacaagatgatctccttacagacttgaaaaatataccaaagaaggcttgtgaccgtcgtatcaatgaatttgtaaaacgtgctagagctgcgaagatacatgcatacataataggtcatctcagaaaggagatgcctgctatgattggcaaagccaagacacagcagagactcattgatgaattggaaaatgaatttggaaaggttcaaagggaattccatctgcctgctggggattttccaaatgttgaacatttcagagaaggtctcggtggttatagctttgataggtttgagaagttgaagcccaagatgatacaagatgttgacgatatgcttggttatgacatccctgaacttctcaagaatttcaggaatccttatgactaacgaggtctagtgctgttaacgtttgcagttatatttgcctgaattttgtttattatataactaattctcagaattttgaatacaggaaga

SEQ ID NO: 7846 - DNA, 1648 bp, Amsonia hubrichtii
ttccgctccaattagtcgatgctctaaagagaatcaaaagatctatcaagaatggtttgctttgccgattcagatggagatggccgcctcactggacctgatgccatcaagtttttgcattctccaacttgcctcgccaagatctcaagcaggtctgggctattgcagattctaaaaggcaaggctttcttggttttaaagagttcattactgcaatgcagttagtgtcgttagcacaagctgggcatgaagtaaatagtgatctcctaaatgctgaagttgactttgaagttttaaaaaccttccagcaatggaaggattggatgcaatgatagctaagaaaaagcatccttctagaagcgagcctgagcaaaatggtgatcctcaggtgcaaagttcaccatctgctggttggttttcctctacaaagtctgcaaagaaggtatctttaaattctgtcacgtcaattattgatggcctgaaaaagttgtatattcagaagttgaagccattggaagtcacatatcgcttcaatgattttgtttccccctgttggcaaacagtgattttgatgctaagccaatggtgatgcttttgggtcaatattccacggggaaaacaacattcatcaaacatctgctcaaaagtagttatccaggagctcatattggaccagagcctacaaccgacagatttgttgttgttatgaatggacctgatgagagaagtattccagggaacaccattgctgttcaagcagacatgccatacagtggtctgacaacttttggaactgcctttttatcaaaatttgagtgctcccaaatgccacaccctcttctggaacatattacttttgttgatacccctggagttttatcgggagaaaagcaacggacacagagaagctatgactttactggtgtgatatcatggttcgcagcaaaatgtgacctcattttgctttttttcgatcctcataaacttgatataagtgatgaattcaaacgtgtgatttcttcactacgaggacatgatgataagataagggtggtattgaacaaagctgatcaagttgatacccaacagcttatgagggtttatggagcattaatgtggtctcttggcaaagtgctaaatactcctgaggttacccgtgtttacattggttccttcaatgacaaacctataaatcaggctgctggtcccatcgggagtgagctttttgagaaagaacaagatgaccttcttgcagatcttaaggatatacccaaaaaagcttgtgaccgacgaataaatgaatttgtaaaacgtgccagggctgcaaagatacatgcttacattattagtcatttgaaaagggagatgcctgccatgatgggcaaagctaagacccaacagagacttatagataatctcgaaacagaatttgggaaggttcaaagggagtatcatctgccagcaggggatttcccaaatgttgaacacttccgggatgtattgagtggttataacattgataagtttgagaagttgaagcctaaaatgattcaatccgtggacgatatgcttggatatgacatcccagaagtcttgaagaacttccggaatccgtatgagtaggcatgctgagattgatgataataca

SEQ ID NO: 7847 - DNA, 1757 bp, Spinacia oleracea
tggagatatctactggcccgatttcttcatgttcgaaagaacaccagaaaatttatcagcaatggtttccagttgcagattcagatggagatggtcggattactggaaatgatgcaacaaagttcttttcaatgtccaatttatctcgatctgaccttaaacaggtatgggcatttgcagataccaagagacaaggttatttgggctttaaagagtttgttgctgcgatgcagcttatttctttggctcaagctggaaatgagctgacttctgatcttcttagtaatgcagttatggaggacattcaactccctgtaatggaagggctcgatgtgttactagctaagaagaagaagaccatggcaacatatgtcgaacctgaaataaacggatctcctcaacagtcaccgcctacatcaagttggtttagttcaaagtcttcaaagaagataccccttagtgctgtgacttctatagttgatggtttgaaaaggctgtacctagaaaagttgaagccactggagactacctatcgctttcatgactttgtatcacctgcactggcaaacagtgactttgatgccaaaccgatggttatgctgttgggacaatattccactgggaaaacgacatttataaagcatttgctgaaatgtgaatatccaggagctcatattggaccggagcctacaacagatcgctttgttgtcgtcatgtccggacctgatgagaggagcattcctgggaacacaattgctgtccaagcggacatgccattcagtggcctcacaaactttggcggggcattcttatcaaaattccagtgttcacaaatgccacatcctctgttggagcacattacttttgttgacacacctggagttctgtctggggagaagcagagaactcaaagaagctacgactttactggagttatatcatggtttgctgcaaagtgtgacctcatccttcttttgtttgatcctcacaaacttgacatcagtgatgaattcaaacgtgtcatttcatctctgcgcggtcatgatgacaagatccgtgttgttctgaataaatctgatcaagttgatacccagcagttaatgagagtatatggtgcgttaatgtggtctcttgggaaagtcctaaatacccctgaggtttctcgtgtttatattggttcatttaacgacaagcctatcgacacagaagtaattggtcccatgggaagagatctttttgagaaagaacagaatgatcttcttaatgatctgaaggatatcccaaagaaagcttgtgatagacgaataaatgaatttgtgaaacgggccagagcagctaagattcacgcttacataattagtcacctgaagaaggagatgccttcaatgatggggaagagtaaagctcaacaacgattaattgataaccttgaagatgaatttcttaaggttcaaagggaattccatttaccggcaggtgattttccatatgtggagcattttagggaagttctaggtggttatagtattgataaatttgagaagttgaaacctaagatgatccaggctgtcgatgatatgctcggctatgatattccagagttactcaagaatttcagaaacccatatgagtgaatttgaataaaatcgcacaatctcagagaaacaaacttcatgagcttttgtagatagatttgtggtatgcttaaatcgccatttttggtctttgtgaggtggaaatccctacctaatttttcc

SEQ ID NO: 7848 - DNA, 2343 bp, Mimulus guttatus
agtaacccaaatatttgaaaagaggatccggtggagccaaaaaatggagatagattccgccccgattagtcggtgctccaaggagcaccagaagatctaccaggactggttttctttcgccgattcagatggagacggccgactcacgggagccgacgccaccaaattcttttccttgtctaatttgcctcgtcaagatctcaaactggtctgggcaattgctgattcgaaaaggcaagggtttcttggatttaaagaattcattacagcaatgcagttagtttctttggcacaagctgggcatgcccttactagcgatattttgagctctgaagttgactttgaaaacttgcaaacaccggctctggatggtctgggtgcgcttctcactaagaaaaagcgtttatcaaatgaacccgaacaaaatggtagtcctcaagttcaatcttcacttgcagctagctggttttcttcttcaaaatctgcaaagaagatatctctgagctctgtcacttcgattgttgatggattaaagaggctgtacattcagaagctgaagcccctggaaacaacctatcagtttaacgactttgtttctccctcactgaccaacagtgatttcgatgctaaacctatggtgatgcttctgggtcaatattcaactggaaagacgacatttatcaaacatttgctcagaacaagttatccaggtgctcatatcggaccagagcctactacagacagattcgtggttgtgatgaatggacctgatgagagaagtgttccagggaacactattgccgttcaagcagatatgcctttcagcggtctgacaacattcggaagtgcgtttttgtctaaattcgagtgttcacaaatgccacatcccctgctggagcatattacttttgtggacactcctggagttttgtctggtgaaaagcaacgaacacagagaagctacgatttcaccggtgtgacatcatggtttgcctcaaagtgtgatctaatcctccttcttttcgaccctcacaaacttgatataagcgatgaattcaaacgagtaattggatctttaagagggcacgatgataagatacgtgtggttttgaacaaggccgaccaagttgatacacaacaacttatgcgtgtgtatggagctttgatgtggtccctcgggaaggtattaaatactcctgaagttaatcgtgtttatattggttcatttaatgacaagcctataaacgaggctgcagcgggtcctcttggcagagagctatttgagaaagaacaggacgatcttctctccgatctgaaagacattcctaaaaaggcctgtgaccgtcggataaacgaatttgtgaaacgtgctagggctgctaagattcatgcttatatcatcagtcatctgaagaaggagatgcctgcaatgatgggcaaagctaaggcacaacaaaaactcatcgataacctccctgatgaattcgctaaggttcagagggagcaccatctgccagctggggatttcccgaatgtagaacactttagggaggtattgagtgggtacagtttagacaggtttgagaagcttaaacctaaaatgatacaatctgttgacgacatgcttggctacgacatccctgatctcttgaagaatttccgtaatccctacgattaaaactaaaaatcggatgaatgctttcttgatagctcctactcttttttttttttttttcctttcgatttgaatgatgttatagtcagaaaggacatacgcaacataggctgcggattatatatatgtatgtacaagttcttgtggtcaataattatatatgtttgtcttctgttgtaatggttggaaaacttcacatatgtgatgaaaatgtgggctgatcaaattctttagtattgtcaattaaatttacaagcagttgtgatgaagtgtgatattttatgaaataaataaattattttatatgcattgtaaagaagtgctgataggcttaattaaatgtaattcttaaatcattccaccaagcacaaaatcattaaaaagtaataataaaaagaaaatgggctgataggctttatttatactgttaaaatgtattttaaatcattccaccaagcaaaatcattaaaaaaaaaaaaaagaaaaagagaaaaaggaaattggagggctcagatgcgcatatttcgtctgaaagatcagaacagagtgggtaacccaatatccacttggagcgcacaattaatcatcacagcacaaccaacaatttaaattgcaccagccgggaatcgaagccgggtctgtaccgtggcagggtactattctaccac

SEQ ID NO: 7849 - DNA, 2242 bp, Citrullus lanatus
ctcccgattcccgtttccccctcgccttctctctctccgcttccgttccagttccttctcccttctctctctctctcccctcaaaagagggacgaaccgaaagggagagaactccggaatcagttcttctgtgcttcgcattccattcaccttcaaccactgtttcttcttttcgtgatctcggaattcgcctggaactggaagaacggaataaagcggagtaggaagcaattgaggggaggtatacgtatcaccgctcttctctgatcagcttttatggaaatcgcttcttatcctatcggttcctgctcccgagaacatcagaagatctatcaagaatggtttgattacgctgattctgatggagacgggcgtattacggggaatgatgctattaagttcttttccatgtcgaccttgcctcgccaagatctcaagcaggtgtgggcaattgcagattccaagcggcaaggatatcttgggttcaaggagttcattactgcaatgcagcttgtttctttggcgcaatctggaggggaagtaactcatgatgtattgacttcaaatagcgaagttgatttgaagagtttgaatcctcctagaatggagggtctggatgtcatattagctaagaaagcccgtaaacagaagtcaaatgaccatgagacaaatggtagctctaaggggcagtcacctgtttcagctagttggttttcatcgaagtcatctaaaaagatacctctttcttccgttacatctattgttgatggtttgaaaaggctgtatattcagaagttgaagcccttagaagttagttaccgatttaatgattttgtttccccattactgacaaatagtgacttcgatgctaaaccaatggttatgcttttgggtcaatactctactggcaaaacgacatttatcaaacatctgctgaaaagcagttatccaggagcccatattggaccggaacctacaactgacagatttgttgttgttatgtccggacctgatgaaagaagcattcctggaaatacgattgccgtccaagcagacatgccatttaatggtctcacaacatttggaacttcttttctatcaaaatttgagtgttcacaaatgccacatcctctgctagaacatattacgtttgtggatactcctggagttttgtctggagaaaaacaacgaacacagcgagcttatgaatttacatctgtaacatcatggtttgctgccaagtgcgatctcattctgcttctatttgatccccataaactcgatattagtgacgaattcaaacgggttatagcttcattacgtgggcatgatgacaaaattcgagtagtcttgaacaaggcagaccaagttgacacacaacaattgatgagggtttatggagcattaatgtggtcgctcgggaaggttctgaatacacctgaggttgtacgtgtttatattggctcgtttaatgacaaaccggttaatgaagctgctacaggtccactcggaaaagagctctttgaaaaagaacaggaagatcttctttctgatttgaaggatatcccaaagaaggcgtgtgatcgaagaattaatgaattcgtcaagcgtgcaagagctgctaaaattcatgcctacatcataagccatcttcggaaggaaatgcctgccatgatcggcaaagccaagacccaacagcgactcatcgataatttggaagatgagtttggaaaggtacaaagggaacatcacttgcccgctggagatttcccaaatgtcgatcaattccgagagatattaggtggttacaacttcgacaaatttgagaagttgaaaccaaaaatgattcagtctgtcgatgacatgttgggatatgatgtcccagaacttttgaagaactttagaaatccctatgactgaatgagccagtaatttcgagcttggactttcaggtatacacggctgctttaacattcattcaaggtcttcttgaactttaaatgttttaaccccaatatcaagttttaatgtaatgtataatgataagtatagtctactggaagcatagttagcgttattttgtcaatcagcattcattctttaaattaataaaacagttcatacgtattattttgtatttattcgagcttggctttcaggtatacacggctgcctttaacattcagtttcatatatacggtcagtctccatgcatagaattttgttttattggtaaattgag

SEQ ID NO: 7850 - DNA, 2114 bp, Olea europaea
tcaattttttggaatgaaaattcagttcaaacggatccatatgtccacaaaacggctgggtttttcccccaaaaccgaaggcagagtgactaaaaaataatttcacaaattttaaacttcaaaaacttccaacgttctgaaattcaaatcagaataaggtaattttggggaatttttcagatcgaaaatggagattgattcggcttcgattagtcggtgctcgaaagagcaccagaagatctatcaagaatggttttctttcgctgattcagatggagatgggcgtctgactggagccgatgctacaaatttctttgccatgtccaacgtgtctcgtcaagatctcaagcaggtgtgggcaattgcagattcgaaaaggcaaggttttcttggttttaaagagtttatcacttcaatgcagctggtctccttggcacaagctgggcatgcgataactggtgatattctaaacactgaagttgaatttgaaaatttacaacctccagccatggaaggactggatgttctcctagctaagagaaagcatatacctaaaagtgaacccgaacagaatggtaatcctcaagtgcaatcatccccatcagctagttggtttacttcttcaaaatctgcaaagaaggtatccttggcctctgttacatcgataattgatggtttgaaaagattgtatgttcagaagctgaagccactggaagttacttaccaatttaatgattttgtttcgcccttactggcaaatagtgactttgatgctaaaccaatggtgatgcttttgggtcagtactccactgggaagacaacatttattaaacatttgctcaaaactagttatccaggagctcacattggaccagagcctacaacagatagatttgtcgttgtcatgaatggaccagatgaaagaagtgttccagggaatacaattgctgttcaagcagatatgccttttagtggtctgacaacttttggaactgcatttctgtcaaaatttgagtgttctcaaatgccacatcctctgctggaacatattactttcgtggatactcctggagtgttatcaggagaaaaacaacgaactcaaagaagctatgactttactggtgtaacatcctggtttgctgcaaagtgcgacctcatcctgcttttgtttgatccccacaaacttgatataagtgatgaattcagacgtgtcattgcatctttacggggtcatgatgataaaatacgcgtggttttgaacaaggctgaccaagttgatacgcagcaacttatgcgggtatatggagcgttaatgtggtccctaggcaaagtgctgaatactcctgaggtcatgcgtgtttatattggatcttttaatgacaagcctattaacgacgctgctgctggtccaattgggaaagaacttttgagaaagaacaggacaaccttcttacagatttgaaagacataccaaagaaggcttgtgatcgtcgtataaatgaatttgtaaagcgtgctagggccgccaagatacatgcttatattatcagtcacctgagaagggaaatgcctgcgatgatgggcaaagctaagactcagcagagactcatcgataatctggctgatgaatttgctaaggttcaaagggaacaccatctaccggctggggatttccctcacgtcgaacactttaaggaggttttgagcggatatagcatcgataagtttgagaaattgaaacctaaaatgatacaagctgtcgatgacatgctcggatatgacatccctgaacttttaaacaatttccggaatccgtacgattagggatgaaccaatgcttttcagagccaaggcagacattttgaaaccaaaaaatgatacaagctgttgatgaaatgcttggatatgacatccctgaactttaaggaatttctggaatccatactgttagggatgaaccaatgcttttcagggagtgtagctcattatatatacgttctcgtttgaattctataccatgagttaattatattatttgaggctcctagtgagcaaatttgtacaatattaaggctgtgctgtacaaatggaactttgggttttttcaaaatgcg

SEQ ID NO: 7851 - DNA, 1923 bp, Ricinus communis
gctttcgacaaattcgaaattcgaagttcacattttatcaaattacataagaatttaaggaaacacagaagatttttctgattataccatatcgttattagctgagtgagtgatcatggaaatatctgctggtccagttggttcttgctctaaagagaaccaaaagatctatcttgaatggtttgcttttgctgattcagatggtgatggtagaatcaccggtaatgatgctataaaattctttggaatgtccaatttatctcggcaggatctcaagcaggtatgggcaattgcagattctaaacgacagggttatctcggcttcaatgagttcattacttctatgcagttaatttctttagctcaagctggacatcaaatagcacatgatcttctaagtagccaggttgattttgaaaatttgagacctccaactatggaaggtcttgacgagttgctagaacagaaaaaaaggcgtcggtctagatcaagagactttgatgtaaatggtactccaccagtcgaaacgtcgccttcagtgaattggttttctccaaaatcctcttcaaaatcgtcgaaaaaggtacctctatcctctgttacatccatcattgatggcctaaagagactgtacattcagaagctgaagcccttagaagttacttatcgctttaatgattttgtatctccactgctgacaaacagtgattttgatgccaaaccaatggttatgctattgggtcaatattccaccggaaaaacaacatttattaaacatttacttaaaagtagttatcctggagctcatattggacccgagccaactactgacagatttgttgttgttatgtctggtaccgatgaaaggagtattccgggcaatactgtggcagtccaagcagatatgcctttcaatggactaacaacttttggaactgcatttctatcgaaatttgaatgttctcaaatgccgcatcctttgctggagcatattacatttgtggatacacctggagttttatcgggagagaaacaacgaactcaacggtcttatgattttactggtgtaacctcatggtttgctgcaaagtgtgatctcattttgcttctatttgatcctcacaaacttgatgtcagtgatgagttcaagcgtgtgatttcatcattacggggtcatgatgataaaattcgtgttgttctcaacaaggcagatcaagttgatactcaacaactgatgagggtttatggagcattgatgtggtcgcttgggaaggttcttaatactcctgaagttgtgcgtgtttatattggctcgttcaatgacaaaccaataaatgaagatgctattggtcctattgggaaagaactttttgagaaagaacaggaagaccttctatctgatctaaaggacataccaaagaaggcttgtgatcgtcgaatcaatgaattcgtgaaacgggcaagagctgccaagatacatgcatatattattagccatcttaaaaaggcaatgccaacaatggtgggtaaagcaaaggcccaacagcgacttattgataatttgggagaagagtttggaaaggttcaaagggagtttcatctgcccccaggtgactttccaaatgttgagcaattcagagaggttttgagcggctacagcatcgacaagttcgagaagttgaagcccaaaatgatacaagctgttgatgacatgcttggttatgacattccagagctgttgaagaacttcaggaatccctatggctaaaaaggtcacttgatttggcagtttataggggcaaaatattttggccaagactaggtagtagagtttaaattcctctgttacatattataggagaggcatttcttagcttattatcttcaacattacataggtatatatcgatccttgagttgctc

SEQ ID NO: 7852 - DNA, 1712 bp, Allium cepa
cgaaagagcatcaaaagatctatcaacaatggttctcggtagcagacgccgatggagatggccgagtgactggaactgatgctatcaagttcttttccatgtccaatctatctcggcccgaacttaagcaggtgtgggccttagctgattctaagcgacaaggctttcttggtctcggagagtttgtcatagcaatgcagcttatttcatacatccaagctggaaatgaaatcactcaagatgctcttacaagcacagagctgaagaatatggaacctccagtcatggaggggttagatgcgctgattgcaagaaccaaggctttggccaagaagcattcaccagagaaagaagcggtgcctccagtaaatacatcacttcagtggtttacatcaaaaccaacaaagaagataccgatgtcttctgtcacttcaatcattgatggcttgaagagattatatattgaaaaactaaagccgcttgaagtaacctatcgctttaatgattttgtgtccccattattgacaagtagtgattttgatgctaaaccaatggtgatgctcctaggtcaatattcaactggaaaaactacattcatcaaacatttattgaaatccagctatccaggtgcccacattggacctgagcctacgactgatagatttgttgtcgttatgtcaggaccagatgaaaggaatatacctggaaacaccatagctgtacaagctgatatgccatatagtgggttaactacctttggcactgctttcttatcaaaatttgagtgttcacaaatgccacatccattgctggaacatatcacatttgtcgatacacctggagtactatctggagagaagcagcgaactcaaagaagctatgatttcactggagtgacatcatggtttgctgctaaatgcgatcttattcttcttctatttgacccccataaactggatatcagcgatgaatttaaacgtgtcattggatctttgcgtggccatgatgataaaatacgtgttgttttaaacaaggcagatcaaatcgatacccaacagcttatgagagtgtatggagcactgatgtggtcacttggaaaagttttgaatactcctgaagttatgcgtgtttatatcggttcatttaatgacaaaccagtaaatggaaatatggttggtccaataggaaaagatctgtttgagaaagaacaagatgatcttctttctgacttgaaagacataccaaagaaagcctgtgatcgtcgtataaatgaatttgtgaagcgtgcaagagcagcaaaaattcatgcttatattataagccagttgaaaaaggagatgcctgcaatgatgggcaaagctaaagctcagcaacggctaattgataatttggaggatgaatttgcaaaggttcaaagagagtatcaccttcctgctggagattttcccaacgttgaacgttttagagaagtattaggtggttacagcattgacaagtttgagaaactaaagccaaaattggtacaagctgtagatgacatgcttggatatgatatccccgaactcttgaagaactttagaaatccctatgagtaaatttacagaatattttttgggcacattttgagttattgttgatgattataatatttcttctcagcataccttcttggtagcatcaataatatgcatatgtagctaaaaatctccatg

SEQ ID NO: 7853 - DNA, 1953 bp, Vitis vinifera
caaaactgttataaatgggggcagaacagagcaactctatctgttaattcatctttcaaaatttgaatatcctgaagttccgagaacccgccgatcatcaaccgttctgtgttgatcgatggagatagcatccgttccgatcagttcgtgttccaaacacaaccaaaagatctaccaagaatggttcaactacgccgattcagataacgatggacgcattactggaaatgatgctacaaagttcttcgcaatgtccaacctttcccgttcggaactcaaacaggtttgggctattgcagattccaaacgacaaggatttcttggtttcagggagttcatcactgcaatgcagctggtttctctggcgcaagcaggaaatgagattacttcggacatccttaaaactacagtggatttggagaatttagaacctccatcaatggaaggtttgaatgccttactagctaaaaataaggcctcaacaaataatggcgagcttgaattaaatggagattctaggccacagccatcaccatcagctccttggttcacctcaaaatctgtaaagaaagcacctcttaattccgttacatcaataatagatggcttgaagagactatacaatgaaaagttaaagccattggaagtcacctaccgctataatgattttgtttctcccttattgacacatagtgactttgatgccaaacccatggttatgcttttgggtcagtattcaactgggaaaactacattcataaaacatttactcggatgtaatttcccaggagctcacattggaccagagcctacaaccgatcgttttgttgttgtcatgtctggacctgatgaaaggagcattcctggaaataccattgcagttaatgcagagatgccattcaatggactgacaacttttggaggggcatttttatcaaaatttgagtgttcccagataccacattctcttctagaacacatcacctttgtggacactccaggggtcctatctggagaaaagcaaagaacacaaagaagctatgatttcactggtgtaatatcttggtttgcagcaaaatgtgatctcattcttcttctttttgatccccacaaacttgatatcagtgatgaatttaagcgtgtgattgcatctctacgtggtaatgatgacaagatacgtgtagttttgaacaaagctgatcaagtcgatacacaacaactaatgagggtctatggtgcattgatgtggtcacttgggaaagttttgaatactcccgaggttgtgcgagtttatattggttcattcaatgacaagcctgtgaatgaagcagccgtgggtccaatagggaaggatctttttgagaaagagcaggatgatcttcttgcagacttgatagatattccaaaaaaagcttgtgatcgtcggatcaatgaatttgtaaaacgagctagagctgccaagattcatgcctatataatcagtcacctcaaaaaggagatgcctgcaatgatgggcaaagctaaagcacaacagcgactaaccgataatcttgaagatgaatttgcaaagatccatagggagttccatcttccagctggtgacttcccaaatgtggagcactttagggaggttctgaacggctacagcatcgataaatttgagaagctgaagcctaaaatgatacaagctgtggatgacatgcttggctatgatattccggagctcctgaagaatttcagaaacccctatgagtgaacatgttgttgcagctgaatacaccactataagctggaagaaaggtggaatggttttccacaacatatatatatatgtagcagtttttatgcttttatacatatttttgtttttattgttattagacccttccaatttcaaatgtgtaatctgtgagcatttgaagatcctttcttggacttttgctatttgtagag

SEQ ID NO: 7854 - DNA, 2128 bp, Solanum lycopersicum
gtaaactgtcactttgttgagtactaatgaagtgatctgtgttgatagttaagcaaataaggtagatcttgcaggcatttgaagaagaagaagaagtaattaaagaatttaaaaatggagtttgatacaagccccattaatcgatgttcaaaagaacacgagaagatctatcaacaatggttcaattttgctgattctgatggagatggacgtcttactggtggagatgccatcaagttctttgccatgtccaatttgcctcgaccagaactcaagcaggtgtgggcaattgcagattccaaacgacaagggtttctcaattttagagattttgttgttggaatgcagttggtcgctttggcgcaagctggccatgcagtaaccagtgatcttttaaatgctgatgttgactttgaaaatttgccacctcctgcgatggaaggtctggatgttcttcttgctaagaagaagctgatgcctaaaagcgaacaggatcagaatggcagtgctcctgtcccggctgcaccaacaactagttggttttcatcatcaaaatcttcaaagaagatctctttaacctccgtcacatcaatagttgatggactgaagaagttgtacatccaaaaactaaagccgctagaagtcgcatatcactttaatgattttgtctctcctttgttgacgaatagtgattttgatgccaagccaatggtgatgcttctgggtcaatactccactggcaaaacaacattcattaaacatttactcaaaatgagttatccaggtgctcacattggaccagagcctacaacagacagatttgtagttgtcatgaatgggcctgatgaaagaagtattccaggaaacacaattgctgttcaagcagatatgccatttagcggtctgacaacttttggaactgcgtttttgtcaaagtttgagtgttctcaaatggcgcatcctttgttggagcattttacactggtggacacgcctggagttttatctggggaaaagcagagaacacaaaggagctatgactttactggtgtgacttcctggtttgctgccaagtgcgatctcatccttctattgtttgatcctcacaagcttgatataagtgatgaattcaaacgtgtcattgcttctcttcgaggccatgatgataagatacgtgtggttctgaacaaagctgaccaaattgatactcaacaacttatgagggtttatggagcattaatgtggtctttggggaaagttctaaatactcctgaggtcgctcgcgtttacattggatcatttaatgacaaaccaatgagagaagctgcagcagggccacttgggaaagaactgtttgaaaaggagcaagatgatctccttacagacttaaaagacataccaaagaaggcttgtgatcgtcgtatcaatgaatttgttaaacgtgctagagctgccaagatacatgcttacataatcagtcatctcagaaaagagatgcctgctatgataggaaaagccaagactcaacagagactcatcgacgaattggaaaacgaatttggaaaggttcaaagggaattccatctgcctgctggggattttccaaatgtcgaacacttcagggaagttctcggtggttatagctttgacagattcgagaagttgaagccaaaaatgatacaagatgttgacgatatgcttggttatgacatccctgaacttctcaagaatttcaggaatccttatgactaatcgcgacctagagctggtagaatttgaagtttattactgcctgaatctggtttgttatatcttgtaaccttattcctttttggtcctcacattgagaatttctacattcaacaaaatttgggttcaacaaggattaatgaacacatactatcagctggaaattatggtggcacatataaacatattttcttcagaattttgaatacatgaagatctttatttctgtgttggcatgatttcactataaaaaccaaagacaaaatgtgcaataattaattatattatgtgttatgtgatgttagcatatgtaaaaacactcaatgtattcattgaatggtgcaaacatcactggtatgaagtggactcataatgtaaa

SEQ ID NO: 7855 - DNA, 1855 bp, Triphysaria pusilla
actcggagcaggcatatgccaaactcgggagcgacgtcgttttgacgctgcataaaacggctcttcgctccctgaacaaaatcttgttatagtaatataatcatcacagttacagagcaacaataattcgagaatttaaaaaaggagaatggagatagattcggccccaattagccggtgctctaaggagcaccaaaagatctatcagaaatggttttcttattttgattcagatggagatggtcgtctcacgggagccgatgcaaccaagtttttttctatgtctaatttgtctcgtcaagaccttaaacaggtgtgggcaatagctgattcaaagaggcaaggttaccttggattgaaagaattcattacagcaatgcagatagtctccttggcacaatctgggcatggtatcaccagtgatcttttagcctctgaagatgttgactttgaaaacttgcaacctccaaccatggaaggtctggatgtgctcctcgctaagaaaaagcgttcatctggtgagcataacggaactcttcaaacacaaacttcagcttcagctggttggtttacttctacaaaatcggcaaagaaggtacctttgaactccgtcacttcaattattgatggcttgaagaagttgtatgttcagaagctgaagcccctggaagtaacctatcggtttaatgattttgtttctcccgtattgggaaatagtgacttcgatgctaaacctatggtgatgttactgggtcagtactctacagggaagacgacatttatcaaacatttgctcagatcaagttatccaggtgctcacattggaccagagcctaccacagatagatttgttgttgtgatgaatggtcctgatgaaagaagtattcctgggaataccattgctgtacaagcagatatgccttacagcggtttgacaacttttggaagtgcatttttgtcaaaatttgagtgttcacaaatgccgcatcctctgctggaacatattacatttgtggacacccctggagttttgtccggagaaaagcaacgaacacaaagaagttatgactttactggcgtgacatcttggtttgcagcaaaatgcgatctcatcttgcttctgtttgatcctcacaaacttgatataagtgacgaatttaaacgagtcattggatctttgcgaggtcatgatgataaaatacgtgtagttttgaacaaggccgatcaagttgatacacaacaacttatgcgggtgtatggagcattgatgtggtccctcgggaaagtgctgaatacacccgaagttaaccgtgtttatattggttcatttaacgacaagcccataaacgaggctgctgctggtccacttggcaaggagctgtttgagaaagaacaggatgatcttcttacggatttgaaagacataccaaagaaggcttgtgatcgtcgtataaacgaatttgtgaaacgggctagggctgcaaagatacatgcttacatcatcagtcatctgaaaaaggagatgcctgcaatgatgggcaaagctaagacacaacagagacttattgataacctggctgatgagtttgcaaaggttcagagggaataccatctaccagctggggatttcccgaaccccgagcagtttaaggaggttttgagtggctacaacatagataagtttgagaagctgaaaccaaaaatgatacaaaatgtcgatgacatgctgggatatgacattcctgatcttttgaagaatttccgcaacccgtatgattagaaatgccgatatatcgaacatacggggaattggaggagaataaagcttttttctctgatcttgaaatgcattttt

SEQ ID NO: 7856 - DNA, 1963 bp, Castanea mollissima
ttcatgttaaatttccatatatagtagacgaagtatatctcccattttcaaaatttggaaaaatccagaaagtaaaaatctactttaccatggagatcgcttcgattccaatcactacgtgttccaaagagcaccagcagatctatcaggaatggttcaattacgctgatgcagataccgatggccgcattactggtaatgatgcaaccaagttcttcgccatgtccaatctgtccaggcaagatctcaagcaggtgtgggcaattgcagattcgaagcgacagggataccttggtttcaaggagtttattgctgctatgcagctagtgtctctggcacaagctggtcatgcagtaacacaagatttcctgaatagtgatgttgacctgagcagtttgaaacctcctgtaatggagggtttggatgcactaatagcaaagaaaaagcgcaaggaaaagacaagtgaacacgaatcaaatggtagttcacatgggccatcaccttcagctaattggttttcatcaaaatcagcaaaaaatgtaccactttcctcggttacatcaattgttgatggattgaagagattgtaccttcagaagttgaaaccactagaagttacttatcgttttaatgactttgtatccccgttgctggctaatagtgattttgacgcaaaaccaatggttatgcttttgggtcaatattccactgggaaaacaacattcattaagcatctgctcaagagtggttatccaggagcccacattggaccggagcctacaactgacagatttgttgttgtcatgtctggtcctgatgaaagaagtattcctgggaacaccatagcggttcaagctgacatgccgttcagtggtctgacaacatttggaactgcttttttgtcaaaatttgagtgttctcaaatgccacatcctctgctggagcacatcacttttgtggatactcctggtgttctgtctggggagaagcaacgaacgcaaagagcgtatgattttacgggcgtaacgtcatggtttgctgcaaagtgtgacctcattctacttttgtttgatcctcacaagcttgatgtcagcgatgaattcaagagagtgatatcatctttacgtggtcatgatgacaagattagagtggttttaaacaaggcagatcaaattgatacccaacaactgatgcgtgtttatggagcattaatgtggtctcttgggaaagttataaacactcctgaggttatgcgtgtttatattggatcattcaatgacaaacccgtaaatgaatctgctactggtccaattggtaaagaactttttgaaaaagaacaggaggaccttctttctgacctaaaagatattccaaagaaagcctgtgatcgtaggattaatgaatttgtgaaacgtgcccgagctgcaaagatacatgcttacattattagtcatcttaaaaaggagatgccagctatgattggaaaagctaaaactcagcagagactcattgataatttgttagatgaatttggaaaggttcaaagggagttccatttacctccgggagatttcccaaatgttgatcacttcaaggagatcttgagtggctacaatattgataagtttgagaagttaaagccgaaaatgatacaagctgtggatgacatgctaggttatgatatcccagacctattgaagaattttagaaatccgtacgattaaagaatgccagtattttccaagataactggacaggttaaatattgagtggagttcatgccataaatcaatggtgcggaagccttgtcaagtatgggcactttaatcttcgctgtttagatcaaattttgattttccaggtcccaaacaatgtccattgttatagataaatttattagctaccccttcaatagctctgttttcgtattaagaccctgaaatggaagttagtataataaatt

SEQ ID NO: 7857 - DNA, 2196 bp, Cicer arietinum
aaaagttgaaactattatttccaaaaataaaaattcagcaaacactagttaaatattttcccaactctaaatagattgcttccattactaaaacttgtaagtagtagtcgtcgtttaaatgctctcgtaaaaaagaacactacgaacgacatcacaaattccgcgttttggaaacgtagcagagtattgttctgctatcaatggagttcgatccggttccaatcggttcgtgctccaaagaacaccagaacatttaccagaactggttcagttacgctgattcagacggtgatggccgcataacggggaatgatgccaccaagtttttctccatgtccaatttgtctcgtcaagatcttaaacaggtgtgggctattgcagattcaaagcgacaaggatatcttggtttccaagagtttatcattgctatgcagctagtttctttggcacaatctgggcacccaataacacatgatctgctgagtagtgatgttgatttgaaagatctgaaacctcctacattggagggtttggatgtattattagctaagaacaagcataaacaaaaagatgtggatgtaaatggtagttctcaattacagccatcactatcaagtagttggttttcttcaaagtccacaaaaaaggtgccgctttcctctgtgacatcaataattgatggcttgaagagactctacatccagaagttgaagcctttagaagttacttaccgctttaatgattttgtctccccattattgacaaatagtgattttgatgccaaaccaatggttatgcttttgggtcaatactcaactggtaaaacaacattcatcaaacatctgcttaaatgtagttatccaggtgcacatattggtcctgagcctactactgataggtttgttgttgtcatgtctggatctgatgcgagaagcattcctggaaatactgttgctgtccaagctgacatgccatttagtggtcttacaacttttggcacagcttttttgtcaaaatttgagtgttcacaaatgcctcatcctctactggagcacattacatttgtggacagtcctggagttctatctggagaaaagcaacgaacgcagcgagcatatgattttacgggtgtaacatcttggtttgctgccaagtgtgatttgatactcctcttgtttgatcctcacaaacttgatattagtgatgaattcaatcgcgtaatatcatccttacggggacatgatgacaaaattcgagtggttttgaacaaggcagatcaagttgatactcagcaactaatgagggtttatggagccttaatgtggtctcttgggaaggtgctgaacacaccagaagtcattcgtgtgtatattggctcctttaacgacaagcctgtaaataatgctgtcagtggtccaattggaaaggaactgtttgaaaaagaacaggaagaccttctttcagatctgaaagatataccaaaggcggcttgtgatcgaagaatcaatgaatttgtaaaacgagcccgagctgccaagatacatgcttacattatcagtcatcttaagaaggagatgcctgcaatgatgggcaaagctaaagctcagcaaaaactcattgataacttggcgggtgaatttggaaaggtacagagggagttccatttacctcctggcgactttccaaatgttgagcatttcagagagagcttgcgtggttataatattgacaagtttgagaaattgaagccaaaaatgatacaagtagttgatgacatgcttgcttatgacattcctaacctcttgaagaattttaagaatccttatgattaaatttatgagcacttgatccagtaaggggttgatttggttggagtgacatttgtagcatactaatattacggattattcatgtaattaatgtaagttcattttggatctttatgtaataatcccaagcccattcttctgaagtagtagagagttctaacgatcgaatatgaacttttttctctatcatcatcgacaacaaagtttcaaaacaaaaaagtaaagtgaaaacacaattatttgttgggttaaacatggtttaatatttataatatcagtgatttccagttttagtttgtaaatttgagtattttctagtctttgttgttaatgaatctctgacttttgaggagggctgttaaataat

SEQ ID NO: 7858 - DNA, 2208 bp, Medicago truncatula
aaagcaagtgtgtgtagtgtgcaaatctaactacaaaaagattaattaaaaaaatatttcaacttaacaaacaaaattaaagttttaattttgtggcaactatattttgcttttcacgaacgacataagaaatcggcgttttggaagaagcgtgaagtgctgcaacagagagtattctatcaatggagttcgatccgatcccaatcggttcgtgctccaaagatcaccaaaacatttatcaacaatggttcaatcacgctgattcagatggtgatggtcgcataacgggaaatgatgccacaaagtttttcgccatgtctaatttgtctcgtcaacatcttaaacaggtgtgggctattgcagattcaaagcgacaaggttatctaggtttccaagagtttatcattgctatgcagctagtttctttggcacaatctgggcacccaataacacatgatctgctgaatagtgatgttgatttgaaaaatctgaaacctcccatattggaaggtttggatgcattactagctaaaaaaaagcataaacaaagcgaactggatgtaaatggtagttctcaattacagccatcaccatcaagtagttggttttcttcgaagtccacaaaaaaggtgccactttcctccgtgacatcaataattgatggcttgaagagactctacattcagaagttgaagcctttagaagttacttaccgctttaatgattttgtctccccattattgacaaatagtgattttgatgccaaacctatggttatgcttttgggtcaatactcaactggtaaaacaacatttatcaaacatctgcttaaatgtagctatccaggtgcacatattggacctgagcctacaactgataggtttgttgttgtcatgtctggacctgacgagagaagcattcctggaaatactgttgctgtccaagcagacatgccgtttagtggacttacaacttttggcacagcttttttgtcaaaatttgagtgttcacaaatgcctcatcctctactggagcacattacatttgtggacagtcctggagttttatctggagaaaaacaacgaacacaacgagcatatgattttacgggtgtaacatcatggtttgctgctaagtgtgatttgatactcctactgtttgatcctcacaagcttgatattagcgatgagttcaatcgcgtgatatcatccttacggggacatgatgacaaaattcgagtggttttgaacaaggcagatcaagttgatactcagcaactgatgagggtttatggagccttaatgtggtcactcgggaaggtactgaacacacctgaagtcactcgtgtgtatattggctcctttaacgacaagcctgtaaatgatgctgtcagtggtccaattggaaaggaactgtttgaaaaagaacaggaagaccttctttcagatcttaaagatataccaaaggcggcttgtgatcgaagaatcaatgaatttgtaaaacgagcccgggcagccaagatacatgcttacattatcagtcatcttaaaaaggagatgcctgcaatgatgggaaaagctaaagctcagcaaaaactaattgataatttggcaggtgaatttggaaaggtacaaagggagttccatttacctcctggtgactttccaaatgttgagcatttcagagagagcttgagtggttacaacattgacaagtttgagaaattgaagccgaaaatgttacaagtagttgatgacatgcttgcctatgacattcctaacctcttaaagaattttaagaatccctatgattaaatttattagcacttgatccagtgatgagatgatttagttggagtgacatttgtagcatgctaatatcaaaggaatgactaaaatagctactgataataatgatccacataaaagagctgcatagcccaatatcatcatacttacgtgcatcattagccaatgggattgtagagcgggtactaatattacagattgatgcattttggttaaaatatcctgtcaaataaatatatgatgggttattgatgtaattagtgtaagttcgtattggatctttatgtattacaccccgaactcattcttctgtaatagagttgtaatagagttttaatgttcaaacttcaaatatgaacttggaaacacaattattgctgggttaaacatgttctaataa

SEQ ID NO: 7859 - DNA, 2372 bp, Quercus alba
gaaaaaaaaattcatgtttaaatttccatatatagtagacgaagtatatctcccattttcgaaatttggaaaaatccagaaagtaaaaaatctactttaccatggagatcgcttcgattccaatcactacgtgttccaaagagcaccagcagatctatcaggaatggttcaattacgctgatgcagataccgatggccgcattactggtaatgatgctaccaagttcttcgccatgtcgaatctatccaggcaagatctcaagcaggtgtgggcaatcgcagattcgaagcgacagggataccttggtttcaaggagtttatcgctgctatgcagctagtgtctctggcacaagctggtcatgcagtaacacatgatctcctgaatagtgacgttgacttgagcagtttgaaacctcctgtaatggagggtttggatgcactaatagcaaagaaaaagcgcaaggaaaagactagtgaactcgaatcaaatggtagtttgcatgggccatcaccttcagctaattggttttcatcaaaatcagcaaaaaatgtaccactttcctcggttacatcaatcgttgatggattgaagagactgtaccttcagaagctgaaaccactagaagttacttatcgttttaatgactttgtatccccgttgctggctaatagtgattttgatgcaaaaccaatggttatgcttttgggtcaatattccactgggaaaacaacattcattaagcatctgctcaagagtggttatccaggagcccacattggaccggagcctacaactgacagatttgttgttgtcatgtctggtcctgatgaaagaagtattcctgggaacaccatagctgttcaagctgacatgccgttcagtggtctgacaacatttggaactgcttttttgtcaaaatttgagtgttctcaaatgccacatcctctgctggagcacatcacttttgtggatactcctggtgttctgtctggagagaagcaacgaacgcaaagagcgtatgattttacaggcgtaacatcatggtttgctgcaaagtgtgacctcattctacttttgttcgatcctcacaagcttgatgtcagcgatgaattcaagagagtgatatcatctttacgtggtcatgatgacaagattagagtggttctaaacaaggcagatcaaattgatacccaacaactgatgcgtgtttatggagcattaatgtggtctcttgggaaagttataaacactcctgaggttatgcgtgtttatattggatcattcaatgacaaacccgtaaatgaatctgctactggtccaattggtaaagaactttttgaaaaagaacaggaggaccttctttctgacctaaaagatattccaaagaaagcctgtgatcgtaggattaatgaatttgtgaaacgtgcccgagctgcaaagatacatgcttacattattagtcatcttaaaaaggagatgccagctatgattggaaaagctaaaactcagcagagactcattgataatttgttagatgaatttggaaaggttcaaagggagttccatttacctccgggagatttcccaaatgttgagcacttcaaggagatcttgagtggctacaatattgataagtttgagaagttaaagccgaaaatgatacaagctgtggatgacatgctaggttatgatatcccagacctattgaagaattttagaaatccgtacgattaaagaatgccagtattttccaagataactggacaggttaaatattgagtggagtacatgccataaatcaatggtgcgggagccttgtcaagtatgggcactttaatcttcactgtttagatcaaattttgattttccaggtcccaaacaatgtccattgttatagataaatttatcggctgccccttcaatagctctgttttcgtatgaagaccatggaagttagtataataaatttctatagagatcagcatgtcttatatatatttgttatgtatataattaagaattttctataaagtgtatggtattttgggctatccatgaaatttggattgaacctacaagcatttgcactgcatcagtatcagagcatctgctaatggttatgtgtagtatagatgatctaagtggaaaattatgaggtgacaagtataattaagagttgcaaacaagagtccattaattgtatgcccgtgccagccaattttaggcccatgcactggcccatttatctgcccaacaaaaataaagtaattcaagagactcaagaacccaaaaaaaaaaaataaaattaaattaactacgactacttacgtaaacgtaaacgttaccgttaccgtaggaacgtacgtaccg

SEQ ID NO: 7860 - DNA, 2008 bp, Arabidopsis lyrata
ttgccgtcgagacgaagaacccgctttctctgaaaccgtaatttcacttcaatatctgcaaatccacaaatctggattcacacctgagaagcttgttaatctgctcctcttcagattttgcaatcggagatggagatcgaatccgtcgcagctggttcttgttcaaaggagaatcaattgatctacaaggaatggttcgaattcgccgattcagacggcgatggccgtattactggtaacgatgcgatcaagttcttcactatgtcgaatttgcctcgaccggagttgaagcagatctgggcaattgcagattcaaagagacaagggtatcttgctttcaaagactttattgttgccatgcagcttgtttcgttggctcaaactggacatgaaatatcgcatgaaattcttaatagcgatgttgatttcaaaaatatcaatcctcctaccatggaaggtctgggtgtattaatggcgaagaagaagcattcatcaaagtcgagtgatcctaatatgaatggtagccctgccgcagacacatcacttacagctcactggttctcttcaaaatcttcaaaaaagatttctctgtcctccgtaacatctatagtggatggcctgaagaggttgtacattcagaagctgaagccacttgaagtagcatatcggtttaacgattttgtatcccctttgttgactaacagtgatttcgatgcgaaacctatggtaatgcttctgggtcaatactccacagggaaaacaacattcattaagcatttgcttaaatctagttatccaggagctcatattggaccagagccgactactgacagatttgttgttgtcatgtctggacctgatgaaagaagtattccggggaacacagtagcagttcaagcagatatgccattcagtggtcttacaacttttgggactgcctttttgtcaaagtttgaatgctctcagatgcctcaccctctgctggagcatgtaacatttgtcgacacccctggagttttatcaggggaaaagcaaagaacccagcgagcatatgatttcactggtgttacatcatggtttgcctctaagtgcgatcttatcctcctcttatttgacccacacaagctggatgtaagtgatgagttcaagcgtgtaatttcatctttacgcggtcatgatgacaagatccgcgttgttcttaataaggctgatcaagtggacactcagcagctaatgagggtatatggagctctcatgtggtcacttgggaaagttctcaatactcctgaggtctcccgtgtctacattggttcgtttagtgataaacccataaacgaagctgcaactggtccaattgggagagagttgtttgaaaaggagcaagatgaccttcttgctgatttgaaagacattccaaagaaagcttgtgatcgccgaataaatgagtttgtgaaacgggcaagagcagcaaagatacatgcgtacatcatcagccatttgaagaaggagatgccagcgataatggggaaagccaaagctcaacagaaactgatagataacttggaagacgagtttggaaaggtacaaagagagcatcacttaccaaaaggagatttcccaaatgtggatcatttcagggaggtgctaagtggttacaacatcgacaagtttgagaagctaaagccgaaaatgttgcagactgttgatgatatgttggggtatgacattccagagctcttgaaaaatttcagaaacccttatgattaatatttccatccctcttatctctgtggttgctgtataatcctatatacactcacttttggcctagcccttgtgacttgtgagcattaatgcacatttgtattcttacaagacttgtagacaataaagacacataaagagtgctgacttgataattggcttatatgtatcacaactcccaaacgaaaagtataactacaatatcaagtctaacatgataacttttcaatatatataaatctgt

SEQ ID NO: 7861 - DNA, 2152 bp, Gossypium raimondii
taaagcactctctccctcgcaggaaaaaacgcggacggtggtacggctacagctttgtatttttttttcctttttcagttttgttcgatttttttttacttatattttctttctctctccactgtttcgaagccagcttctcttttatcgaacgcttgaagtaactcaaaaaaaaacatctacagttttctcttcagcaatggagattgggagcggtcggatcggttcctgctctaaagaacaccagaaaatttatcaagagtggttcaacttcgctgattcagataatgatggacgcattactggaaatgatgcaatcaagttttttggtatatcaaatttatcgcgaccagatctcaagcaggtgtgggcgactgctgattctaagagacagggatttcttggtttcaaagaatttgtttttgctatgcagctggtttcgctggcgcaagaaggtcatcaaatatcacatgatctcctgaatggtgatgtagactttgagaatattaaacctcctgtaatggaaggcttagatgcattaatcatgagaaagaaacaatcttcaaagtcaagtagccttgaaagcaatggtagttcttcaaatcaaacatcacctgcatctcaatggttttcttcaaaatcatcaaagaagatatctttgtcctctgtgacttcaattatagacggcttaaagagattgtaccttcagaagttgaagcctttagaagttacatatcattttaatgattttgtatccccattgttgacaaatagtgattttgatgccaaaccaatggttatgcttttgggtcaatattccactgggaaaacaaccttcattaaacatttgcttaagactagttatccaggagctcacattggacctgaaccaacgactgacagatttgttgttgttatgtcgggaactgatgaaagaagtgttccagggaacactatcgctgtccaggcagatatgccattcagtggcctcactactttcggaactgcatttttgtcgaagtttgagtgttctcaaatgccacatccactgttggagcacgtaacatttgtagatactcctggagtgttatcaggagaaaaacaacgaacacaacgagcctatgattttacaggtgtaacgtcatggtttgctgcaaaatgcgatcttattcttcttctgtttgatcctcacaagttagatgtaagtgatgaattcaagcgcgtgatatattctctgcgtggtcacgatgataagattcgtgtggttttgaacaaggcagatcaagttgatacgcaacaattgatgagggtttatggagccttaatgtggtcacttgggaaagtccttaacaccccagaggttgtgcgtgtgtatattggttcattcaatgacaagcctgtaaatgaagctgcaacaggaccaattgggaaagagttgttcgaaaaagaacaagaggaccttctttctgacctgaaagacattccaaagaaggcttgtgatcgtcgaataaatgagtttgtgaagcgggctagagctgccaagatacatgcttatatcatcgctcaccttaagaaggaaatgccttctatgattgggaaagcaaaaactcaacagagactgatcgataatttggaaggcgaatttggaaaagttcaaagagatcatcacctaccaccaggggattttccaaatgtggaacattttaaggagattttgtctggttacaactttgacaaattcgagaagctaaaacctaaaatgattcaagctgttgatgacatgttgggttatgatatccctgaacttttgaagacattcaggaatccctatgactaacgactgctacaaatttcttataccgaacatgatgatcaatatttgattcgattaacgacaatatctcaattctacattagcaatcttgagccagatttgttgtagattatatcttgtattagctcctagagctgctgttcttggcgagttttatgtttcgacttttcttaaacatgtaaaaaacgatgttccttaaattaagctgatagctttacgacataattatgggatcaaagattttgtgggtttgatactcacaccttaaactaccactagaagtgcaataaaagttaaattttcttaaatgttttgtaa

SEQ ID NO: 7862 - DNA, 2011 bp, Lupinus angustifolius
atttgcgccaactccattttccatttcccaatacgacaatgttaatgtaagttccatcgtcgtataagcactttctcaaacgacgagagagagatccaaaatctgcgttatcaaaagcgtaaaacgcatcgttttgagatcaatggagttcgattcgtttccaataggtacatgctcaaaagataaccaacaaatttaccaggaatggttcaattacgctgattcagatagcgatggacgcattacggggaatgatgccaccaagtttttctccatgtccaatttgtctcgccaagatcttaaacaggtgtgggctattgcagattcgaagcgacaaggatatcttggtttcactgagtttatcattgctatgcagctagtttctttggcacaatctgggcacccagtaacacatgatctgctgactagtgatgttgatttgacgaatctgaaacctcccacgatggagggtttggatgtattactatcgaagagaaagcataaacagaaagatcttgatgtgaatggtagttctcagttgcagccatcaccatcaagtaattggttttcttcaaagtcaacaaagacgctgcctctgtcctcagtgacatcaataattgatggcttgaagagactctatgttcaaaagttgaagccattggaagttacttaccgttttaatgattttgtatcaccgttactgacaaatagcgattttgatgccaaaccaatggttatgcttttgggtcagtactcaactggtaaaacaacatttatcaaacatctgcttaaaagtggttatccaggagcacatattggacctgagcctacaactgataggtttgttgttgtcatgtctggacctgatgagagaagcattcctggtaacactatcgctgtccaagcagacatgccatttagtggtttgacaacgtttggaacagcttttttgtcaaaatttgagtgttctcagatgcctcatcctctactagagcatattacatttgtggatactcctggagttctatctggagaaaaacaacggacacaacgagcatatgcttttacagatgtaacatcttggtttgctgctaagtgtgatttgatactcctcctgtttgatcctcacaaacttgacgtcagtgatgagttcaagcgtgtgatatcatccttgcggggacacgatgacaaaattcgagtggttttgaacaaggcagacaaagttgatactcagcaattgatgagggtttatggagccttaatgtggtcacttgggaaggttctgaatacacctgaagtcatgcgtgtttatattggctccttcaacgacaagcctataaatgatgtgctcagtggcccaattggcaaggaactctttgaaaaggaacaggatgaccttctttcggatctgaaagatatacctaagaaggcttgtgatcgaagaatcaatgaatttgtaaaacgagcccgggctgccaagatacatgcttatataatcagtcatcttaaaaaggagatgcctgcaatgattggcaaagctaaagctcagcaaaagctcattgataatttggagggtgaatttggaaaggtacaaagggagttccatctacctcctggtgacttcccagatgttgaacatttcagagagaccttgaatggttataatattgacaagtttgagaaattgaaaccaaaaatgatacaaacagttgatgacatgctaggttatgatattcctaacctcttgaagaattttaggaatccctatgactaattagagtgtctgacatttgtaccactctactgtatatgtgatccttcatgtattgtaccatccggtgccccttttatgtagcacagagttttgttcttacttcttagatattggtattatgtattttttatcttaatgtcatcaacaataaagtttcaagacagagtaaagggaaaaagtacagtatatgttgatctaaactttggtgcagtgtctctctctacctcttagtatact

SEQ ID NO: 7863 - DNA, 2068 bp, Populus trichocarpa
aagggaccctttgcgtcggcaaggaggtctctgtcccccggaagtaccggggcagagcaattacgaaaacagtcaaaccttaaaggcttctttcttttcttttcttttcatatttttgcttttaatcggaaataagaaatttttatttggtttcgtttcaagagtgatacagttttgtgatattttcaagagaatggaaatatcttcaggcgctattggttcctgctcgaaagaccaaaaaaccatgtatcaagagtggtttcattatgccgattcagatggtgatggtcgaattactggtaatgatgctaccaaattcttttcattgtctaaattatctcgccaggatctcaagccggtatgggccattgcagattcaaagcgacagggatatcttggcttcatcgagttcatcattgctatgcagttagtttctctggcgcaatctgggcgtgaaataacaaatgatatcctcaatagcgatgttgactttcaaagtcttaaacctccgtccatggaaggtttggatgcgttaatggcgaagaaaaggcgttctttgaaatcaaatgataatgaagcaaatggtactccgacagtgcaatcaacaccttcggcaaattggttttcttcaaaaccatcaagaaaggcatcactgtcctctgttacatcaataattgacggcttgaagagactgtacattcagaagctgaagccattagaagttacttatcgttttaatgattttgtatctccagccttgacaaatagtgattttgatgccaaacctatggttatgcttttgggtcaatactcaactggaaaaactacattcattaagcatttacttagaagcagttatccaggagctcatattggacctgagcctacaacggacagatttgttgttgtaatgtctggaactgatgaaagaagtgttccaggcaacacaattgcagttcaagctgatatgccattcagtggactcacaacttttggaactgcatttttgtcaaaatttgaatgttctcaaatgccacatcctctgctggagcatattacatttgtggacacacctggagttttatcaggagaaaaacaacggacacaacgagcttatgattttacaggtgtaacatcatggtttgctgcaaaatgtgacctcattctccttctgtttgatcctcacaaacttgatgtcagtgatgagttcaagcgtgttatttcatctttacacggtcatgatgacaaaattcgtgttgttctcaacaaggcagatcaagtggatactcagcaacttatgagagtctatggagctttaatgtggtcacttgggaaagttctcaatactccagaagttatgcgtgtctatattggctcattcaatgacaaaccagtaaatgaagctgctgttggtccaattgggaaagaacttttcgagaaagaacaggaggaccttctttctgatctaaaaaatataccaaaaaaggcttgtgatcgtcggataaatgaattcgttaaacgtgctagagctgccaagatacatgcttacattattagccatcttaaaaaggagatgcccgcaatgatgggcaaagcaaaggctcaacagagacttcttgataatttggcagaggagtttggaaaggtccaaagggagttccatttacctccaggtgatttcccaaacgtggagcaattcagggaggttctgagtggttacaacttcgacaagtttgagaaattaaagcctaaaatgatacaagctgtggatgacatgctaggttatgacatcccagacctgttaaaaaacttcagaaacccatacgattaaagcagtcataggaatcccatttggatagagggtgtgagcttctctgtctgggtaagctttctgctcattaattgttgacatttacagcatggctgattcgaatgtattaaactatgtataaagtaatgcaatggcttctgttcatggctattcttaaattggaaagaaagaaaaggttaatcattaatgcaatatttgttagttgatttttgtatcgaaagttacttgttcggatat

SEQ ID NO: 7864 - DNA, 1898 bp, Solanum phureja
ggtagatcttgcaggcatttgaagaagaagaaatcatttgacaaatggagtttgatacaaatcccattaatcgatgttcaaaagaacacgagaagatctatcaacaatggttcaattttgctgattctgatggagatggacgtctcactggtggagatgccaccaaattctttgccatgtccagtttgcctcgaccagaactcaagcaggtgtgggcaattgcagattccaaacgacaagggtttctcagttttagagattttgttgttggaatgcagttggtcgctttggcgcaagctggccatgcagtaaccagtgatcttttaaatgctgatgttgactttgaaaatttgccacctcctgcgatggaaggtctggatgttcttcttgctaagaagaagctgatgcctaaaagcgaacaggatcagaatggcagtgctcctgtcccggctgcaccaacaactagttggttttcatcgtcaaaatcttcaaagaagatctctttaacctccgtcacatcaatagttgatggactgaagaagttgtacatccaaaaactaaagccgctagaagtcgcatatcactttaatgattttgtctctcctttgttgacgaatagtgattttgatgccaagccgatggtgatgcttttgggtcaatactccactggcaaaacaacattcattaaacatttactcaaaatgagttatccaggtgctcacattggaccagagcctacaacagacagatttgtagttgtcatgaatgggcctgatgaaagaagtattccaggaaacacaattgctgttcaagcagatatgccatttagcggtctgacaacttttggaactgcatttttgtcaaagtttgagtgttctcaaatggcgcatcctttgttggagcattttacattggtggacacacctggagttttatctggggaaaagcagagaacacaaaggagctatgactttactggtgtgacttcctggtttgctgccaagtgcgatctcatccttctattgtttgatcctcacaagcttgatataagtgatgaattcaaacgtgtcattgcttctcttcgaggccatgatgataagatacgtgtggttctgaacaaagctgaccaagttgatactcaacaacttatgagggtttatggagcattaatgtggtctttggggaaagttctaaatactcctgaggtcgctcgcgtctacattggatcatttaatgacaaaccaatgagagaagctgcagcagggccacttgggaaagaactttttgaaaaggagcaagatgatctccttacagacttgaaaaacatacctaagaaggcttgtgatcgtcgtatcaatgaatttgtaaaacgtgctagagctgccaagatacatgcttacataatcagtcatcttagaaaagagatgcctgctatgataggcaaagccaagactcaacagagactcatcgatgaattggaaaacgaatttggaaaggttcaaagggaattccatctgcctgctggggattttccaaatgtcgaacacttcagggaagttcttggtggttatagctttgatagattcgaaaagttgaagccaaagatgatacaagatgttgacgatatgcttggttatgacatccctgaacttctcaagaatttcaggaatccttatgactaatcgcggcctagagctggtagaatttgaagtttattactgcctgaatttggtttgttatatcttgtaaccttattcctttttggtctctcacattgagaatttctacattcaattttgggttcaacaaggactaatgaacatactatcagctggcaattatggtggcacatataaacatattatcttcagaattttgaatacatgaagatctttatt

SEQ ID NO: 7865 - DNA, 2032 bp, Fragaria vesca
aaaaaaaaaaaaaaaatttagaattcaaatccagaaaatctgattctctttgattttccatggaaatttcctcagttccgatcagttcgtgctccaaagagcaccagaaaatctaccgggagtggtttcaattcgcagattcagatagtgatggccgcattacggggagtgatgctatcaagttcttcagcatgtccaatttgtctcgccaagatcttaagcaggtttgggcaattaccgattcaaagaggcaggggtttcttggttttactgagttcgttgctgctatgcagctagtttcccttgcacaagctggaaatgagattacaaatgatctattaaccagaaatgcagacttggaaaacttgaagcctccagtcatggaggggttggatgtgttattagcgaaaaagaagcgttcaaacaagacaaatgagaacgaagtaaacggtaatcctgtggtgcaacaatcaccttcagcactttggttttcttctaaatcatcaaaaaaggttccgctctctgctgtaacatcaattgtagatgggttgaagagattatatgtccagaagctgaaaccattggaagttacttacaagtttaatgattttgtatccccattacttacaaacagtgattttgatgccaaacccatggttatgcttttgggtcaatactccactgggaaaacaacatttattaaacatttacttaaaacaagttatccaggagctcacattggtcctgagcctacgacagatagatttgttgttgttatgtctggatctgatgaaagaagtgttcctgggaatacgattgcggtgcaagctgacatgccatttagtggcctcacatcttttggaacagcattcttgtcaaagtttgagtgttcccaaatgccacatcctttgctggagcacattacatttgttgatactcctggcgttttatctggggagaagcaacgaacacaacgagcctataattttactggagtcacttcatggttcgcttcaaagtgtgacctcattttacttttgtttgatcctcacaaacttgatgtgagtgatgagttcaagcgtgtgatttcatctttacgtggtcatgatgataagattcgcgttgtactcaacaaggcagatcaaattgatacccaacaattaatgagggtttatggcgcattgatgtggtcccttgggaaggttctgaatactcctgaggttatgcgagtttatattgggtcattcaatgacaaacctgtaaatgaggctgcctccggtccaatagggaaagaactctttgagagagaacaagaggatcttcttgctgacttaaaggatattccaaagaaatcttgtgatcgccggatcaatgaatttgtcaagcgtgctagagcggccaagatacatgcttacattatcagccatttgagaaaagagatgcctgctttgatcgggaaagccaagactcaacagaagctaacggataatttggaagatgagtttaaaaaggttcaaagggaatttcatctacctccaggggattttccgaatgttgaacaattcagggagaccttaagtggttacagctttgacaattttgagaagttgaagcctagtatgataaaagcagttgacgacatgctgggttatgatatcccagagcttctgaagaatttcagaaatccatatgactaatggatgctggaattcttaagaggaaaaataacatgttgaaacttgaaaggagcattgctcttcttgagcatcttggttacccctgtaatttaatatggttcatgccttcagcccttattgtagtgtacaagatgtcattgtagaatattcacttctaataccaatttctgttttcggaggaacacacttataggatcgagtctgtgaaaggtgggattttgaaagaaaatggggcaatgtaactcatgacaagaacacctaaacgaccgagtggattgatggaactcatcaacatccatccttcatgaagatcccttttcttacgaaaccctcct

SEQ ID NO: 7866 - DNA, 1971 bp, Eutrema halophilum
aatctcacgtatacaaaacggacttttttgtttttgtttttgcttaccttctccttttaacttcaatatctgcaaatcctcaaatctggattcacacctgagaagtttgttaatatagttttttccaatcggagatggagatcgattccatcgcagctggctcttgttccaaagagaatcaaatgatctacaaggagtggttcgaattcgccgattcagacggcgatggccgcatcactggtaacgatgcgatcaagttcttctctatgtcgaatttgcctcgaccggagttgaagcaggtctgggcaattgcagatgcaaagagacaggggtatctcggtttcaaagagtttattgttgctatgcagctcgtttctttggctcaaactggacatgaaatatcgcatgaagttcttcatagcgacgttgatttcaaaaatatgaatcctcccatcatggaaggtctgggtgtattgatggcgaagaagaagcattcatcaaaatcaagtgatcctagtgtgaatggtagtcctgctgcagatacatcacttacagctcattggttctcttcaaaatcttcaaaaaagatttctctgtcctccgtaacatctatagtcgatggcttgaagaggttatacattcagaagctgaagccacttgaagttgcttatcggtttaacgattttgtatcccctttgttgaccaacagtgatttcgatgcgaaacctatggtaatgcttctgggtcagtactccacaggaaaaacaacattcattaagcatttgcttaaagctaattatccaggagctcatattggaccagaaccaacaactgacagatttgtcgttgtcatgtctggacctgatgaaagaagcattccagggaacacagtagcagttcaagcagatatgccattcagtggtcttacaacttttggaactgccttcttgtcgaagtttgaatgctctcagatgcctcaccctctgctggagcacgtaacatttgtcgacactcccggagttttatcaggggaaaagcaacggacacagcgagcatatgaattcaccggtgtcacatcatggtttgcctctaagtgcgatctcatcctcctcctatttgacccacacaagctggatgtaagcgatgagttcaagcgtgttatttcatctttacgcggtcatgatgacaagatccgcgttgttctaaataaggcagaccaagtcgacactcagcagctgatgagggtgtatggagctctcatgtggtcacttgggaaagttctcaatactcctgaggttgtccgtgtctacattggttcgttcagtgataaacccataaacgaagctgcgacaggtccaattgggagagaattatttgaaatggagcaagatgaccttctctctgatttgaaagacattccaaaaaaagcctgtgatcgtcgaataaacgagtttgtgaaacgggcaagagctgcaaagatacatgcgtacatcatcagccatttgaagaaggagatgccagccataatgggaaaagccaaagctcaacagaaactgatagataacttggaagacgtgtttggaaaggtacaaagagagcatcatttaccaaaaggagatttcccaaatgtggagcatttcagggaggtgctaattggctacaacatcgacaagtttgagaagctaaagccgaaaatgttgcagactgttgatgatatgttggggtatgacattccagagctcttgaaaaatttcagaaacccttatgattaattctctctatcatccctttgttatctatgtggttacagttagtactaagtatacattcacctttggcttaaaactgcccttgtgagcataaatgcacatttgtattcttaaaagacttttgtaggcaataaaagacatataaagagtgctgctgacttgataatggtgtatatcacaaaacataagtattaagcatcaa

SEQ ID NO: 7867 - DNA, 1981 bp, Arabidopsis thaliana
cgagacgaagaacccgctttctctgaaaccgtaatctcacttcaatatctgcgaatccacaaatctggattcacacctgagaagtttgttaatcggtacatctctagatttttgcaatcggagatggagatcgaatccgtcgcagctggttcttgttccaaggagaatcaaatgatctacaaggaatggttcgaattctccgattcagacggcgatggccgtattactggtaacgatgcgatcaagttcttcactatgtcgaatttgcctcgtccggaattgaagcagatctgggctattgcagattcaaagagacaagggtatcttggtttcaaagagtttattgttgccatgcagcttgtttcgttggctcaaactggacatgaaatatcgcatgaagttcttattagcgatgttgatttcaaaaatatcaatcctcctaccatggaaggtctgggtgtattaatggcgaaaaagaagcattcatcaaagtcgagtgatcctaatatgaatggtagccctgccgcagacacctcacttacagctcactggttctcttcaaaatcttcaaaaaagatttctctgtcctccgtaacatctatagtggatggcctgaagaggttgtacattcagaagctgaagccacttgaagtagcatatcggtttaacgattttgtatcccctttgttgactaacagtgatttcgatgcaaaacctatggtaatgcttctgggtcaatactccacaggaaaaacaacattcattaagcatttgcttaaatctacttatccaggagctcatattggaccagagccgactactgacagatttgttgttgtcatgtctggacctgatgaaagaagcattccggggaacacagtagcagttcaagcagatatgccattcagtggtcttacaacttttgggactgcctttttgtcaaagtttgaatgctctcagatgcctcaccctctgctggagcatgtaacatttgtcgacacccctggagttttatcaggggaaaaacaaagaacacagcgagcatatgatttcactggtgttacatcatggtttgcctctaagtgtgatcttatcctccttctatttgacccacacaagctggatgtaagtgatgagttcaagcgtgtaatttcatctttacgcggtcatgatgacaagatccgcgttgttctgaataaggctgaccaagtggacactcagcagctaatgagggtatatggagctctcatgtggtcacttgggaaagttctcaatactcctgaggtctctcgtgtctacattggttccttcagtgataaacccataaacgaagctgcaactggtccaattgggagagagttgtttgaaaaggagcaagatgaccttcttgctgatttgaaagacattcctaagaaagcttgtgatcgtcgaataaatgagtttgtgaaacgggcaagagcagcaaagatacatgcgtacatcatcagccatttgaagaaggagatgccagcgataatggggaaagccaaagctcaacagaaactgatagataacttggaagacgagtttggaaaggtacaaagagagcatcacttacctaaaggagatttcccaaatgtggatcatttcagggaggtgctaagtggttacaacatcgacaagtttgagaagctaaagccgaaaatgttgcagactgttgatgatatgttggggtatgacatcccagagctcttgaaaaatttcaaaaacccttatgattaatatttctatccctcttatcttctgcggttgctgtataatccaaaactatacattcacttttggcctagcccttgtgacttgtgagcgttaatgcatatttgtatcttacaagccttgtagacaatagagacaaacataaagagtgctgacttgataattggcttatatcacaaaccaaaagtattactgttaatatcaagtctaacatgataacttttcg

SEQ ID NO: 7868 - DNA, 1948 bp, Daucus carota
ctagcaacaggaaactattatatttactgtacaaattcaaatttatttgtatatcatcaccagacttcacacttggagctgttttttgattgcctgaatggaaatcaattccagttcgatcagtcggtgttccaaacaccatcagaacatctatcaggattggttcaattttgctgattcagacagcgatgggcgccttactggagctgatgctattaagttcttctcgatgtccaatttaccccgtccagatctcaaacaggtgtgggcaattgctgattccaagcgacaaggcttccttggttttaatgagtttgttacggcaatgcagctagtttctttggcacaatctggacaaccattaacttcagatcttctgaactctgaagttgattttgaaaatctgaatcttccaaccatggatggcttggatatattattagctaagcaaaagcgtgcgtcgaaaacaaatgaagatgagctgaatggttctccagtgcaaccttcaacgtcagccaattggttttcttcttcaaagtcgtcgaagaagctatctttagcctcagttacatccatcattgatggcttgaaaaagttgtacattcaaaaggtgaggcctctagaagtcacatatcgtttcaacgattttgtttcgcccttactgactaatagcgattttgacgcgaagcccatggttatgcttttgggacaatattcaacaggaaaaacgacatttattaagcatttactcaaaagtagctatccaggtgctcatattggaccagagcctaccacagacagatttgttgttgttatgaatggacctgatgaaaggagtatacctgggaacactgttgctgttcaagcagacatgccatatagtggactgactacatttggaactgcttttttgtcaaaatttgaatgttcacaaatgccacatcctcttctggagcacatcacatttgtggatactcctggagttttgtcaggggaaaagcaacgtactcaacgaagctatgattttactggtgtaacatcatggtttgcttccaaatgtgacctcatactactactttttgatcctcacaaactagatatcagcgatgaattcaagcgtgtgatttcatctttacgaggacatgatgacaagatacgtgtggtgttgaacaaggctgaccaagtcgacacccaacaactgatgagggtatatggagcgctgatgtggtcactgggaaaagtactgaatactcctgaggttatgcgtgtttacatcggttcatttaatgacaaaccaataaacgttgctgcggctggtccactcggccaagaactatttgagagggaacaggaagatcttcttgctgatttaagagacataccgaagaaggcctgtgatcgtcgtatcaatgaatttgtgaaacgtgcaagagctgccaaaattcattcttacattatcagccatcttagaaaggagatgcctgctatgatgggcaaggcaaaagcacagcaaaggcttattgataacttggaagatgaatttaaaaaggttcagagagaacaccatttacctgcaggagacttcccaaatgttgatcattttcgggagaccctaagtggttacaacattgacaagtttgaaaagttaaaacccaaaatgatacaaactgttgatgatatgcttgggtatgacatcccaaatcttctaaaaaatttcagtaatccgtatggttaaagatggtagcattttggggagctatgttgcaattttggaatgtactgcgcataccacagtttggttagaaatttatgtcccattattaaatgaatataatatgatatcttaagcctatcaagatctcttcatgttttatgaattccatatattgatattccaatgatataaataaaaaattgtagcattcagtctaaacatattcattatgac

SEQ ID NO: 7869 - DNA, 1759 bp, Cirsium arvense
gggaaatatctgagtgcagttctcacacctcacgtagtcggcgagatctagaaaaattagggattctgattagtatttttgaaatgtcttttttagttgatctgtaattttcttcttcttaattttgataaaaatggagattgattcagcagcgatcagtcgttgctctacagaacaccagaagatctacaaaatttggttcagtgccgccgattcagatggcgatggacgtattactggtggtgatgcaacgaatttctttgtcatgtcgaatttatctcgacaggatcttaaacaggtgtgggcaattgcagattctagaagacaaggttttcttggcttcaaagagtttattactgcaatgcagctgatttctatggcacaagcgggacatgcattaagtagtgacctcttaaattctgacgttgattttgaaaatctgaaaccaccggtgatggacggactggatgccttactagctaagaaaaagcgttcaaatgattccgaatcaaatggtagttctcagctgcagacttcatcaacatctagttggtttacttcgtcaaaatctgcaaagaaggttcctttaactgctgttacatcaatcattgatggccttaagaagctgtacattcagaagctgaaacctttagaagtcacatatcaatttaatgatttcgtttctcccttattgacgaacagcgattttgatgccaaacccatggtgatgcttttgggtcaatactcaacagggaaaacaacattcatcaagcatttgcttagaagtagttatccaggagctcatattggacctgagcctactacagatagatttgttgtcgttatgaacggaccagatgagagaagtattcctggaaatactgttgctgttcaagcagatatgccatatagcggtttaactaattttggaactgcattcttgtcgaaattcgagtgctctcaaatgccacatccgcttctggagcatattacatttgtggacactcctggagttctatcaggagaaaagcaaagaacgcagagaagctatgatttcactggtgtaacttcttggtttgctgcaaagtgtgatctaatcttgcttctcttcgatccccataaacttgatattagtgatgaattcaaacgtgttatatcatctctaagaggaaatgatgacaagatacgtgtggtcttgaataaggctgatcaagttgatacccaacaactgatgagggtgtatggagcactaatgtggtcccttggtaaagtcctaaacactccggaggttatgcgtgtttacattggttcctttaatgacaaacctataaattcggttactgctggaccaattgggacagagctgttcgagaaagagcaggatgatcttcttagtgacctaaaagacatacctaagaaggcttgtgatcgcaggatcaacgagtttgtgaaacgtgctagagccgccaagattcatgcattcatcatcagccatcttaagaaagagatgcctgccatgatgggaaaggcaaaaactcagcagaaactcatcgataacctagaagacgttttcgcaaaggttcaaagggaacatcatttaccagcaggagatttcccgtacgtagaaagcttcagggagagattgagtggttataacctcgacaaatttgaaaaattgaagcctaaaatgatacaaacggttgatgatatgttgggttatgatattcccgatcttttaaagaatttcaaaaacccgtat

SEQ ID NO: 7870 - DNA, 1935 bp, Capsicum annuum
actttctccaattaggaagaaaattaatgtgtgttacatacttttttttccaataattaagtaaataaggtagatcttggaggcatttgaagaaaaaataattaaagattaagaaaaatggagtttgatacaaatcccattaatcagtgttcaaaagaacatgagaagatctatcaacaatggttcaattttgctgattctgatggagatggacgtctcactggtggagatgccacaaagttctttgccatgtccaatttgcctagaccagatctcaaacaggtgtgggcaattgcagattccaaacgacaaggttttctcagttttagagaatttattgtttcaatgcagttggtctctttggcgcaggctggccatgcagtaacgaatgatcttttaaatgctgatgttgactttgagaatttgccacctcctacaatggaaggtctggatgttcttcttgcaaagaagaaactgatgcctaaaagcgaagctgatcagactgcaggtagtgctcctgtccaggctgcaccagcaactagttggttttcatcatcaaaatcttcgaagaagatctctttaagctctgtcacatcaatagtagatggactgaagaagttgtacatccaaaaactaaagccgctagaagtcgcatatcactttaatgattttgtctctcctttgttgacggatagcgattttgatgccaagccgatggtgatgcttttgggtcaatactccacaggcaaaacaacattcattaagcatttactcaaaatgagttatccaggggctcacattggaccagagcctacaacagacagatttgtggttgttatgaatgggcctgatgaaagaagtattccgggaaacacgattgctgttcaagcagatatgccatttagcggtctgacaacttttggaactgcatttttgtcaaagtttgaatgttctcaaatgtcgcatcctttgttggagcattttacattggtggatactcccggagttttatctggggaaaagcagagaacacagaggagctatgactttactggtgtgacttcctggtttgcggccaagtgcgatctcatccttcttttgtttgatcctcacaagcttgatataagtgatgaattcaaacgtgtcattgcttctcttcgaggccatgatgataagatacgtgtggtcttgaacaaagctgaccaagttgatactcaacaacttatgagggtttatggagcattaatgtggtctttgggtaaagttctcaatactcctgaggtcgctcgcgtctacataggatcatttaatgacaaaccaatgagagaagctgcaacaggacctcttggaaaagaactttttgaaaaggaacaagatgatctcctcacggacttgaaaaacataccgaagaaggcttgtgatcgtcgtatcaatgaatttgtaaaacgtgctagagctgccaagatacatgcttacataatcggtcatctcagaaaagagatgcctgctatgataggcaaagccaagactcagcaaagactcatcgatgaactggaaaccgaatttggaaaggttcaaagggaattccatctccctgctggggattttccaaatgtcgaacacttcagggaagttctcagcggttatagctttgacagattcgagaagttgaagcctaagatgatacaagatgtcgacgatatgcttggttacgacctccctgaacttctcaataatttcaggaatccatatgactaacgcgacttagagctggtagaatctgaagttgttactgcctgagtttggtttgttatacaactaaagtcgttgtatcttgtatgttgtaaccgtattccattttggtctctcacattgagaatttttctacaaacaattttgggttcaactggtaccaatgaacacatacatacatac

SEQ ID NO: 7871 - DNA, 2209 bp, Glycine max
tcagcaagcaaaggtgagttggaactacgagacaaggcgtaatttgtcgcatttagatgaaactcacaactttacttggcactattttttggtaaacaagatcaatattcgttaaagcagcatttctgcgccaaatctagttagtttccatcgccaatacaatacgacaccgcttaatgcaagtcctcgtcgtcgtttaacgctcacgttttctgttctctgagaaggtaaaaagcgttaaaacgcagcatctcaaacacgcgattccgaagcttttctgcgatcaatggagttcgacccgatcccaatcggttcgtgctccaaagaacaccagatgatctataaggagtggttcaattacgctgattcagatagcgatggccgcattacggggagtgatgccaccaagtttttcgccatgtccaatttgtcccgcgaagatcttaagcaggtgtgggctattgcagattcaaagcgacaaggatatcttggtttcactgaatttatcattgctatgcagctagtttctttggctcaatctgggcactcaataacacccgatctgctgactagtgatgttgattttacaaatgggaaacctccctcaatggagggtttggacgtattactagttaagaaaaagcataaacaaaaagaggttgatgcaaatggtagttctcaattgcagccatcaccatcaagtaattggttttcttcaaagtcaacaaaaaaggtgcctctttcctctgtgacatcaataattgacggcttgaagagactctacattcagaagttgaagccattagaagttacttaccgttttaatgattttgtatccccattactgacaaatagtgactttgatgccaaaccaatggttatgcttttgggtcagtactcaactggtaaaacaacatttatcaaacatctgcttaaaagtagttatccaggagcacatattggacctgagccaacaactgataggtttgttgttgtcatgtctggatctgatgagagaagcgttcctggaaatactgttgctgtccaagcagacatgccatttagtggtcttacaacttttggcacagcatttttgtcaaaatttgtgtgttcacagatgcctcatcctctactggaacacatcacatttgttgacactccgggagttctatctggagaaaagcaacgcacacaacgagcatatgattttacgggtgtaacatcttggtttgctgctaagtgtgatttgattctccttctgtttgatcctcacaaacttgacatcagtgatgagttcaatcgtgtgatatcatccttacgggggcatgatgacaaaatccgagtggttttgaacaaggcagaccaagttgatacccaacaattgatgagggtttatggagccttaatgtggtcacttgggaaggtgctgaagacacctgaagtaatgcgagtgtatattggctccttcaatgacaagcctgtaaatgatgctgccactggtccacttgggaaggaactctttgaaaaggaacaggatgatctactctcggatctgaaagatgtaccaaaagcagcttgtgatcgaagaatcaatgagtttgtaaaacgggcccgagcagccaagatacatgcttacattatcagccatcttaaaaaggagatgcctgctatgataggcaaagctaaagctcaacaaaagctcatcgataatttggcagctgaatttggaaaggtacaaagggagttccatttacctcctggcgattttccaaatgtagagtttttcagagagagattgagtggttacaatattgataagtttgaaaaattgaaaccaaaaatgacacaagcagttgatgacatgttagcttacgacattcctaatctcttgaagaattttaggaatccctatgattaaatttctgagcaattgagtcggtgctataattagattagttagagtgacatttgtagcgtacaaattttacgggatctttatgcaatgtatgtgtgtcatgagatctttatgtgccatccggtggcctttcttttctagtaggaagttttattatttaatatatgtttttgtatttatgtatattttgttatctacaatcaagtgtcaagacagaaaataaagggaaaacacaattacttgtttgcatcaagtccgttatgtgtttagtgtagctaaagataatgattaaca

SEQ ID NO: 7872 - DNA, 2038 bp, Fagus grandifolia
gaagcagagaaatcagagaaagtgtttttttggttttgtaatttgtaattccatatgaagtagaaagaataatatctctcccagtttcaaaatggagatcgcttcgattccaatctcttcttgctccaaagaacaccagcagatctaccaggaatggttccattacgctgattcagatagcgatggccgcattactggtaatgatgctactaagttcttcgccttgtcgaatttgtctagacaagatctcaagcaggtgtgggcaattgcggattcgaagcgacagggatacctaggtttcaaggagtttattgcttctatgcagctagtgtctctggcacaagctggtcatgcagtaacacaagatctcctgaatagcggcgttgacttgaacaatttgaaacctcctgttatgggtagggtttggatgcactaatagacaaaagaaaaagcgtaaggataagacaagtgaactcgaaacaaatggtagttatcaattggaatcatcaccttcagctaattggttttcatcaaaatcatcgaaaaaagtacctctttcctctgttacatcaatcgttgatggcttgaagaggctgtacattcagaagctgaaaccactagaagttacttatcgttttaatgattttgtatccccattgctggcaaatagtgattttgatgcaaagccaatggttatgctattgggtcaatattccactgggaaaacaacattcattaagcatctgctcaagactagttatccaggagcacacattggaccagagccgacaactgacagatttgttgttgtcatgtctggacctgatgatagaagtatccctgggaacaccatagccgttcaagctgacatgccattcagtggtctgacaacattcggaactgtctttttgtcaaaatttgagtgttctcaaatgccacatcctctgctggagcatatcacttttgtggatactcctggtgttctgtctggggagaagcaacgaacacaaagagcgtatgattttacaggtgtaacatcatggtttgctgcaaagtgtgacctcattctacttctgtttgatcctcacaagcttgatgtcagtgatgaattcaagagagtgatatcatctttacgtggtcatgatgacaagattcgagtggttctaaataaggcagaccaaattgatacccaacaactgatgcgtgtttatggagcattaatgtggtctcttgggaaagttctaaacactcctgaagttatgcgtgtttatattggctcattcaatgacaaacctgtaaatgaagctgctactggtccaattgggaaagaactttttgaaaaagaacaggaggaccttcttgctgacctaaaagatattccaaagaaagcttgtgatcgtagaataaatgaatttgtgaaacgtgcccgagctgcaaagatacatgcttacatcattagtcatcttaagaaggagatgcctgctatgataggaaaagctaaaactcaacaaaaactcattgataatttgtcagatgaatttggaaaggtccaaagggagttccatttacctcctggagatttcccaaatgttgagcagttcagagagaccttgagtggttacaatatcgataagtttgagaagttgaaacccaaatgatacaagctgttgatgacatgctgggttatgatatcccagacctcttgaagaattttagaaatccatatgattaaagaatgctagtatttttcaagataactggagtggggaagccgtgttgagtatggacactttgatcttcactgtttagatcaaattttgattaccctggtcccaaacgctgttcattgttataatcttaatagataaaatttatcagctctcacctgtagttttgtcattcatgttgaacaaactcctatagctctattttcatattaagaccctgacatggaagtagtataataaaatttcatagagatcaacatgtcttttacatgttgttatgtatatactgaagaatgtactgaaaagtgtag

SEQ ID NO: 7873 - DNA, 2426 bp, Cannabis sativa
aaataaaacaaagttagttttagtataaatgaactaaataatttccaccgcttttttaggaagattcctttctagtctctgtacaaagaaatcactttccctaacaaattcataattttgtttcgtttttttttttttcaaaaatagaaaaatgagaagatttaacagatatttgaactgattatatgaaattcgttacattttatatttaaattcgatatatttctctctcagtaggaaaaaccactcgtttttcttttcaccatggagattgcttcttctccaatcttttcttgctctaaagagcatcaaaggatttatcatgaatggtttctttacgcagattcagatggtgatggccgcattactggcaatgatgctttaaagttcttcgctttgtcgaatttgtctcggcaagatctcaagcaggtttgggcggttgcagattcgaagagacaagggtatcttggttttggagaatttgttgctgcgatgcagctggtttctttggcgcaaactggacttgaaataacacatgatttattgaatagcaacgttgactttgagactttggatccccctgttatggagggtttggctgaattactttcgaagaaaaagagtccacagaagatcagtgagcttgatttaaatggtggttctatagtgcaacattcaccttcatcgcagtggttttcttcaaaatcatcgaaaaaggtgtctctttcctctgtaacttcaattgttgatggcttgaagcgactatatctcaagaagctgaagccacttgaagacgcataccggtttaatgactttgtatccccttcattaactaatagtgattttgatgctaaacccatggttatgcttttgggtcaatactccactgggaaaacaactttcatcaagcatttactaagaggcagttacccaggtgctcacattggaccagaacccacaactgacagatttgttgttgttatgtctgggcctgatgagaggagtatccctggcaacactgttgctgtccaagctgatatgcccttcagtggccttacaacattcggaactgctttcttatcaaaatttgagtgttcgcaaatgccacatcctctgttggagcacattacatttgtggatactcctggagttttatcaggggagaagcaacgaacacaacgagcatatgactttactggtgtaacatcatggtttgcttcaaagtgtgacctcatactacttttatttgatcctcataagcttgatgttagtgatgaatttaaacgtgtaatatcatctttacggggacatgatgataagattcgtgtggtgctgaacaaggctgatcaagttgatactcaacaactaatgagggtttatggagccttaatgtggtctctcggcaaggttattaatacacctgaggtcatgcgtgtatatattggctcattcaatgacaaaccagtaaatgaagctgcaactggtccacttgggaaagagctttttgaaagggagcaggaggatcttcttgctgatctaaaagatattccaaagaaggcttgtgatcgtcgtatcaatgaatttgtgaaacgcgccagagctgctaagatacacgcttatattattagccatctaaagaaagagatgcctgctatgatgggaaaagcaaaagctcaacagaaactaattgataatctgggtgatgcatttgccaaggtccaaagagagtttcatttaccaccaggagatttcccaaatgtagagcagttcaaggagacattaaaggggtacaacattgacaaatttgagaagctgaaaccgaaaatgatacaagccgtcgatgacatgcttggctatgacattcctgagctattaaaaagtttcaggaatccctataattaaatacactactacacaacagtaggtagcgcacagaggttgcattttgaaggagccacattattatgcatataaataagatacccaaaaacattattcaatttttaagctccaaatctgtgtaggattgcttttgagatttcttattagttttctaaaattatctacactttttaattttttttttagaaaattttgatccatgtttcttctcaacctttgagattctgattttgtttctagtagaaatttttaatttcaaaattattattattttattggtcaagtatattaagcacaacaaaattgccatgtcaaaaattccatttctctcattatttgttaagagatttttttatttttatttaatttttgaaaggggacgttattatgagattttacatagctaatgtcaggtaccacaaatgcatataaaaggttttatctttttcgaatttaatacgttgtgacatacgtaatatacgtaatattagtatttgtctgcaggatacatttgttcggtgatt

SEQ ID NO: 7874 - DNA, 2046 bp, Prunus mume
gggaaagagaaacaaacagaacctccaggagtgtttatcttttcaaaaatttgaatcaaaatccaaaagaccacctggatcagattgtgtacgaatatggaaatttcatcggttccgatcagttcgtgctccaaagagcaccagaaaatctatcaggaatggtttcgcttcgctgattcagacagtgatggccgcattacggggaatgatgctataaagtttttcggcatgtccaatctgaatcggcaagatctcaagcaggtatgggcaattgccgattcaaagaggcagggatatcttggtttcagtgagttcgttgccgctatgcagctagtttctcttgcacaaggtggacatgatatttcacatgatttattgaatagcaatgttgacttggaaaatctcaatcctcctgttatggaaggtttggatgcattattagcgaagaaaaagcaattgcacaagatgaatgaaaatgaagtaaatggtacggcggtggtggagcaatcaccttcagcgctttggttttcttcaaaatcatcaaaaaaggtaccactttcttctgtaacatcaattattgatgggttgaagagactgtatgttcagaagctgaagcccttagaagttacttaccggtttaacgattttgtatccccattactgacaaatagtgattttgatgccaaacccatggttatgctattgggtcaatactccactgggaaaacaacattcattaaacatttgctcaaaagagctcacattggtccggagcctacaacagatagatttgttgttgttatgtcagggcctgatggaagaagtgttcctgggaatactattgccgttcaagctgacatgccattcagtggtctcacaaaatttggaacagcattcttgtcaaagtttgagtgctctcaaatgccacattctctgctagaacacattacttttgtggatactcctggcgttttatctggagagaagcagcggacacaacgagcctacgattttactggggtaacttcgtggtttgctgcaaagtgcgaccttattctacttttgtttgatcctcacaaacttgatgttagtgatgaattcaagcgcgtgatttcttctttacatggtcacgacgataaaattcgtgttgttctgaacaaggcagatcaaattgacacccaacaattgatgagggtttatggagctttgatgtggtcacttgggaaggttcttaatactcctgaggtcatgcgagtttatattggctcattcaatgacaaacctgtaaatgaggctgctactggtccggttgggaaagaactctttgaaaaggaacaggaggatcttcttgctgatttaaaggatattccaaagaagtcttgtgatcgcaggatcaatgaatttgtgaagcgtgcccgagctgccaagatacacgcttacataattagccatttaaagaaggagatgcctgctatgttggggaaagctaagactcaacagaggcttatcgataatttggaagatgaatttggaaaggttcagagggagttccatctacctccaggagatttcccggatgttgaccacttccgggacatcttgagtggttacaacattgacaaattcgagaagttgaagcctaaaatgatagaagccgtcgatgaaatgctgggttatgatattccggaactcttgaagaatttcagaaatccatatggctaatgggtgaaatcagctacgagaagtatcatgaactacggttgcttcgaagtgtataagtcgaaggagcattgctcttcttgagcatctcagtatttgctgcagtatatgatttcaagtcatatttgagttttcccgggggtttagattgtacaagatttggcaggcaggctccttatttgttgtaatgtcattttccgttgtgggaagacttgggaccaagtgcaggcaaaaacatttgtctctgttattatagttccaaagaataagacttatctgtgaatgaaataaattatatatatttttattcctaagaggttcaagatc

SEQ ID NO: 7875 - DNA, 2118 bp, Trigonella foenum-graecum
gatctgttttgtgactatgttagaattatccccacattcaagttatcgttaagttgagagacttggtatgattaaaagcaaagcaaaacaaattccttgatcgaactgaagttgtaaaaaacaaattaaagttgtttgatcttgtgccaacgagcaattgctttcgaagttgtggttttctgttcacgaacgacatcagaaaatccgcgttttcttcttctatcaatggagttcgatccgatcccaatcggttcgtgctctaaagaccaccagaaaatttaccaacaatggttcaatcacgctgattcagatggtgatggtcgcataacggggaatgacgccacaaagtttttctccatgtctaatttgtctcgtcaagatcttaaacaggtgtgggctattgcagattcaaagcgacaaggttatctaggtttccaagaatttatcattgctatgcagcttgtttctttggcacaatctgggcacccaataacacatgatctgctgaatagtgatgttgatttgaaaaatctgaaacctcccatttggaaggtttggacgtattactagctaaaaaaagcataacaaagtgacctggatgtaaatggtagttctcaattacagccatcattatcaagtagtggttttctcgaagtccacaaaaaaggtgccactttcctctgtgacatcaatagttgatggcttgaagagactctacatccagaagttgaggcctttagaagttacttaccgctttaatgactttgtctccccgttattgacaaatagtgattttgatgccaaacctatggttatgcttttgggtcaatactcaactggcaaaacaacatttatcaaacatctgcttaaatgtagctatccaggtgcacatattggacctgagcctacaactgataggtttgttgttgtcatgtctggacctgacgagagaagtattcctggaaatactgttgctgtccaagcagacatgccgtttagtggacttacaacttttggcacagcgtttttgtcaaaatttgagtgttcacaaatgcctcatcctctactggagcacattacatttgtggacagtcctggagttctatctggagaaaaacaacgaacgcaacgagcatatgattttacgggtgtaacatcatggtttgctgctaagtgtgatttgatactcctcttgtttgatcctcacaaacttgatattagtgatgagttcaatcgcgtgatatcatccttacggggacatgatgacaaaattcgagtggttttgaacaaggcagatcaagttgatactcaacaactgatgagggtttatggagccttaatgtggtcacttgggaaggtgctgaacacacctgaagtcactcgtgtgtatattgggtcctttaacgacaagcccataaatgatgctgtcagtggtcctattggaaaggaactgtttgaaaaagaacaggaagaccttctttcagatctgaaagatataccaaaggcggcttgtgatcgaagaatcaatgaatttgtaaaacgagcccgagcagccaagatacatgcttacattatcagtcatcttaaaaaggagatgcctgccatgatgggaaaagctaaagctcagcaaaaactaattgataacttggcaggtgaatttggaaaggtacaaagggagttccatttacctgctggtgactttccaaatgttgagcatttcagagagagcttgagtggttataatattgacaagtttgagaaactgaagccgaaaatgatacaagtagttgatgacatgcttgcctatgacattcctaacctcttaaagaattttaagaatccctatgattaaattttttagcacttgatccagtgatgggatgatttagttggagtgacatttgtagcatgctaatatcacaggtcatatcctgtcaaaaaaaatattatgggttattattgatgtaattagtataagttcgtattggatctttatgtaatacaccccgagcccattcttctgtagtagagttttaatgttcaaacttcaaatatgaactttgaattctttatcatcactgtcatcggctaagtttcgaaacgaaaaataaagtgaaa

SEQ ID NO: 7876 - DNA, 1923 bp, Glycine max
gtaaaaagcgttaaaacgcagcatctcaaacacgcgattccgaagcttttctgcgatcaatggagttcgacccgatcccaatcggttcgtgctccaaagaacaccagatgatctataaggagtggttcaattacgctgattcagatagcgatggccgcattacggggagtgatgccaccaagtttttcgccatgtccaatttgccccgcgaagatcttaagcaggtgtgggctattgcagattcaaagcgacaaggatatcttggtttcactgaatttatcattgctatgcagctagtttctttggctcaatctgggcactcaataacacccgatctgctgactagtgatgttgattttacaaatggaaaacctccctcaatggagggtttggacgtattactagttaagaaaaagcataaacaaaaagaggttgatgcaaatgcaattagcaataatgcaggtagttctcaattgcagccatcaccatcaagtaattggttttcttcaaagtcaacaaaaaaggtgcctctttcctctgtgacatcaataattgacggcttgaagagactctacattcagaagttgaagccattagaagttacttaccgttttaatgattttgtatccccattactgacaaatagtgactttgatgccaaaccaatggttatgcttttgggtcagtactcaactggtaaaacaacatttatcaaacatctgcttaaaagtagttatccaggagcacatattggacctgagccaacaactgataggtttgttgttgtcatgtctggatctgatgagagaagcgttcctggaaatactgttgctgtccaagcagacatgccatttagtggtcttacaacttttggcacagcatttttgtcaaaatttgtgtgttcacagatgcctcatcctctactggaacacatcacatttgttgacactccgggagttctatctggagaaaagcaacgcacacaacgagcatatgattttacgggtgtaacatcttggtttgctgctaagtgtgatttgattctccttctgtttgatcctcacaaacttgacatcagtgatgagttcaatcgtgtgatatcatccttacgggggcatgatgacaaaatccgagtggttttgaacaaggcagaccaagttgatacccaacaattgatgagggtttatggagccttaatgtggtcacttgggaaggtgctgaagacacctgaagtaatgcgagtgtatattggctccttcaatgacaagcctgtaaatgatgctgccactggtccacttgggaaggaactctttgaaaaggaacaggatgatctactctcggatctgaaagatgtaccaaaagcagcttgtgatcgaagaatcaatgagtttgtaaaacgggcccgagcagccaagatacatgcttacattatcagccatcttaaaaaggagatgcctgctatgataggcaaagctaaagctcaacaaaagctcatcgataatttggcagctgaatttggaaaggtacaaagggagttccatttacctcctggcgattttccaaatgtagagtttttcagagagagattgagtggttacaatattgataagtttgaaaaattgaaaccaaaaatgacacaagcagttgatgacatgttagcttacgacattcctaatctcttgaagaattttaggaatccctatgattaaatttctgagcaattgagtcggtgctataattagattagttagagtgacatttgtagcgtacaaattttacgggatctttatgcaatgtatgtgtgtcatgagatctttatgtgccatccggtggcctttcttttctagtaggaagttttattatttaatatatgtttttgtatttatgtatattttgttatctacaatcaagtgtcaagacaga

SEQ ID NO: 7877 - DNA, 1973 bp, Centaurea maculosa
actcaaaggtttggcgcctccaaaggacaaattcaggcaaattggggaaaaatatcttgcagttgtcaacttctcacttcaccgagatctgaaaaattagggattctgattctgattctgaagcattcttcagatgctcctttatctgtagtttttaggtttatagctgatctatatagttagtattcgtgttaatttttcgataataatggagattgattcagcatcgatcagtcgatgctctgtagaacaccagaagatctacaaaatctggttcactgctgccgattcagatggcgatggacgtatcactggcggtgatgcattgaatttctttgttatgtcgaatttatctcggcaagatcttaaacaggtgtgggcaattgcagattctaaacgacaaggctttcttggcttcaaagagtttattactgcaatgcagctgatttctatggcacaagcgggacatgcattaagtagtgacctcttaaattctgacgttgattttgaaaacctgaaaccaccggtgatggatggtctggatatcttactagctaagaaaaagcgtccaacaagtgagtctgaatcaaatggtagttctcagctgcagagttcatcatcaccatctacttggtttacttcgtcaaaatctgcaaagaaggttcccttaactgccgttacatcaatcattgatggtcttaagaagctgtacattcagaagctgaaacctttagaagtcacatatcaatttaatgattttgtttctcccttattgaccaacagtgattttgatgccaaacccatggtgatgcttttgggtcaatactcaacagggaaaacaacattcatcaagcatttgcttagaagtagttatccaggagctcatattggacctgagcctactacagatagatttgttgtcgttatgaatggaccagatgagagaagtattcccggaaatacagttgctgttcaagcagatatgccgtatagcggtttaactaattttggaactgcattcttgtcaaaattcgagtgttctcaaatgccacatccgctgctagagcatattacgtttgtggacactcctggagttctatcgggagaaaagcaaagaacgcagagaagctatgacttcaccggtgtaacttcttggtttgctgcaaagtgtgatctaatcttgcttctctttgatccccataaactcgatatcagcgatgaattcaaacgtgtgatatcatcactacgaggaaatgatgataaaatacgtgtggtcttgaacaaggccgatcaagttgatacccaacaattgatgagggtgtatggagctctaatgtggtcccttggtaaagtcctacagactccagaggttatgcgggtttacattggttcctttaatgacaaacctataaattcggttaccgctggaccaattgggacagagttgtttgagaaagagcaggatgatcttcttagcgatttaaaagacatacctaagaaggcttgtgatcgcagaatcaacgagtttgtgaaacgtgctagagccgccaagattcatgctttcatcatcagccatcttaagaaagaaatgcctgccatgatgggcaaagctaaaactcagcagaagctcatcgataacctagaagacgtttttgccaaggttcaacgggagcatcatttgccagctggtgatttcccatacgtagaaagctttagggagagattgagtggttatagccttgacaaatttgaaaaattgaagcctaaaatgatacagacggtcgatgatatgttgggttatgatattcccgatcttttaaagaacttcaaaaacccgtatgattaaaaatggtggttaggttttgaagtaaaagggttcgtttatcgatcttgtaataacgtttgtatacgttcatatatagtgtagtgtagtgtgtaccatgagactggagtgatattatttgaggatgagt

SEQ ID NO: 7878 - DNA, 2145 bp, Lolium multiflorum
gcggactccaagcggctcgggtacctcggcttcggcgagttcgtcacggcgatgcagctcgtctctctggcgcaaacgggggacgagatcactccggacagcattaagcgtgacgatctaagcagcttgaatactccagcgatggagggtctggatactctgcttgcgaggtccaagcatttggtaaagagggttgatcaggctggtgatggatttcctcaggcacaaggaccttcgacggaccattggttcacctccaagtcatcgaagaagatacctctgactgctgttacttctgtcattgatggtttaaaaagactatacatcgaaaaattgaagcctttggaagttgcatacaaattcaatgattttgtgtccccattactgacaaacagtgattttgatgcaaagccgatggttatgctcttaggtcaatattcaacggggaaaactacttttatcaagcatctgctaaaaacaagctatccaggtgcccatattggaccagagccaacaaccgacagatttgttgttgtcatgtcaggacctgatgaacggactattcctgggaatactttagctgttcaagcagatatgccttttagtggtcttacaacatttgggacttcgtttttatccaagttcgaatgctctcagatgccacatccgctactggagcatatcacgtttgtcgacacacctggtgttctttctggtgaaaagcaacggacacagcgcagctacgaattcactggtgttacatcatggtttgctgccaagtgtgacctcattcttcttctatttgatcctcacaagcttgatatcagtgatgagtttaaacgtgtcatcggatctctacgtgggcatgatgacaaaatacgtgtagttctaaacaaggcagaccaaattgacacacaacagcttatgagagtgtatggtgcacttatgtggtctcttggtaaagtattgaatacccctgaggtgtcacgcgtttatattggatcattcaatgacaaaccagtaaaggaatcagctgttggtcctatcggaaaggaactgtttgagaaagagcaggatgatcttctttctgatctaaaagatataccaaagaaagcttgtgaccgccgaatcaatgaattcgtgaaacgtgctagagctgccaagatacatgcttatataattggccatctaaagaaccagatgcctacgatgatggggaaagctaaagctcaacagcgacttatagacaatttggaggatgagtttgcaaaggtgcaaagggaacatcatcttccagcaggagatttccctttcgttgaccacttcagagatgtgttgggtggctacagcatcgacaagtttgagaaggtcaagcccaagatgatccaggcggtggacgacatgctcgggtatgacatcccggagcttctcaagaacttcaggaacccttatgagtgaacacacatcttgattggaagatggtattggtttacactaacacgtgaggcgtggatggatgctgtttactgtagtgttgaaatttgtcgggcagcgccaacatcgccagtgtttcatgcgtcttggggtgtttattgctacattctacccattgttgtataactgtattatgcataagattcagaagcaattgctcaattgttctctggacatctgtcctgccggattgacaatttggcatgtaaagaatggaacggcaggtggtggcccattttttaacttccaatgagtatctatgtgtttctgaggaacatcttcaattcttgttgatgcgatccagtcaattaactacctgtgaagaatagtggaccactttgagaggtgtttttctgagtagcagccacctgtttcgctatatgtggttgcattattatttcattttggcatattagagatcaactttcatggcagcagtctggggccagagccaactttctgttattggagtttttctataacgagcgatgcgtagaggtccttcatcacacgttcacactgtagaagttaaatgcggcttcatattattcattttggagtactccctcagtttaatagtcctaggtatattgctaggtcgctaatttaaccaacttaaagtaagatatatattatctagattataccaat

SEQ ID NO: 7879 - DNA, 1835 bp, Brassica juncea
ctttctttgcccccgtcaagagacgaagaagaacccgctttctctgggattcgtgatcggagatggagatcgattccgtcgcagctggttcgtgttcaaaggagaatcaactgatctacaaggaatggttcgagttcgccgattcagacggagatggacgcattactggtagcgatgcgatcaagttcttctccatgtcgaatttgcctcggcccgagttgaagcaggtgtgggcaattgcagatgcaaagagacaggggtatcttggtttcaaagatttcattgttgctatgcagctcgtttctttggctcaaactggacatgagatatcgcatgacgttcttcacagcgacgttgacttcaagaatatgaatcctcctgttatggaaggtctgggtgtattaatggcgaagaagaagcattcatcatcaaagtcgaatgatcttagtgttaatggtagtccttctgcagatgcatcacttacagctcactggttctcttcaaaatcttctaaaaagatttctctgtcctccgtaacatctatagtcgatggcctgaagaggctgtacattcaaaagctgaagccactcgaagttgcttatcggttcaacgattttgtatcccctttgttgacgaacagtgattttgatgcgaaacccatggtaatgcttctgggtcagtattccacaggaaaaacaacattcattaagcatttgcttaaagctagttatccaggagctcatattggacccgaaccaactactgacagatttgttgttgtcatgtctggacctgatgaaagaagcattccagggaacacagtagcggttcaagcagatatgccattcagtggtcttacaacttttgggactgcctttctgtcgaagtttgaatgttctcagatgcctcatcctctgctggagcacgtagcatttgtcgacactcctggagttttatcaggggaaaagcaacggacacagcgagcatatgacttcacaggtgttacatcatggttcgcctctaagtgtgatctcatcctcctcctgttcgatcctcacaagctggatgtaagcgatgagttcaagcgggttatttcatctttacgaggtcatgatgacaagatccgcgtcgttctgaataaggctgaccaagtagacactcagcagctaatgcgagtatatggagctctcatgtggtctcttgggaaagttctcaatactcctgaggtttcccgtgtctacattggttcgttcagtgataaacccattaatgaagctgcgactggtccaattgggagagaattgtttgaaaaggagcaagatgaccttctcgctgatttgaaagacattccaaagaaagcttgtgatcgtcgaataaacgagtttgtgaaaagggcaagagctgcaaagatacatgcgtgcatcatcagtcatttgaagaaggagatgccagccataatgggaaaagccaaagctcaacagaaactgatagataacttggaagacgtctttggaaaggtacaaagagagcatcacttaccaaaaggagatttcccaaacgttgagcagttcagggaggtgctaagtggttacaacatcgacaagtttgagaagctaaagccgaaaatgttgcagactgttgatgatatgttggggtatgacattccagagctcttgaaaaatttcagaaacccttatgattaattccatcaccccttcttagcttatgtggttactgttataatcctatgtatgcattcacctttggcctaaaccttccttgtgagcacaaatgcatattgtgtattcttgaaaagacttgtaaacaatgaagac

SEQ ID NO: 7880 - DNA, 1718 bp, Brassica oleracea
cccgctttcggagatggagatcgattccgtcgcagctggttcgtgttcaaaggagaatcagctgatctacaaggaatggttcgagttcgccgattcagacggagatggacgcattactggaaacgatgcgatcaagttcttctccatgtcgaatttgcctcgacccgagttgaagcaggtgtgggcaattgcagatgcaaagagacaggggtatcttggtttcaaagatttcattgttgctatgcagctcgtttctttggctcaaactggacatgagatatcgcatgacgttcttcatagcgacgttgacttcaagaatatgaatcctcctgttatggaaggtctaggtgtattaatggcgaagaagaagcattcatcatcaaagtccagtgatcttaatgttaatggtagtccttctgcagatgcatcacttacagctcactggttctcttcaaaatcttctaaaaagatttctctgtcctccgtaacatctatagtcgatggcctgaagaggctgtacattcaaaagctgaagccactcgaagttgcttatcggttcaacgattttgtatcccctttgttgacgaacagtgattttgatgcgaaacccatggtaatgcttctcggtcagtattccacaggaaaaacaacattcattaagcatttgcttaaagctagttatccaggagctcatattggaccagaaccaactactgacagatttgttgttgtcatgtctggacctgatgaaagaagcattccagggaacacagtagcggttcaagcagatatgccattcagtggtcttacaacttttgggactgcctttctgtcgaagtttgaatgttctcagatgcctcatcctctgctggagcacgtagcatttgtcgacactcctggagttttatcaggggaaaagcaacggacacagcgagcatatgacttcactggtgttacatcatggttcgcctctaagtgtgatctcatcctcctcctgttcgatcctcacaagctggatgtaagcgatgagttcaagcgggttatttcatctttacgaggtcacgacgacaagatccgcgttgttctgaataaggctgaccaagtggacactcagcagttaatgagagtatatggtgctctcatgtggtcacttgggaaagttctcaatactcccgaggtttcccgtgtctacattggttcgttcagtgataaacccattaatgaagctgcgactggtccaattgggagagagttgtttgaaaaggagcaagatgaccttctcgctgatttgaaagacattccaaagaaagcttgtgatcgtcgaataaacgagtttgtgaaaagggcaagagctgcaaagatacatgcgtgcatcatcagtcatttgaagaaggagatgccagccataatgggaaaagccaaagctcaacagaaactgatagataacttggaagacgtctttggaaaggtacaaagagagcatcacttaccaaaaggagatttcccaaacgtggagcagttcagggaggtgctaagtggttacaacatcgacaagttcgagaagctaaagccgaaaatgttgcagactgttgatgatatgttggggtatgacattccagagctcttgaaaaatttcagaaacccctatgattaatatatatcaccccttcttagcttatgtgtttactgttataatcctatgtatgcattcacctttg

SEQ ID NO: 7881 - DNA, 1902 bp, Chelidonium majus
ttaattacgcggatgcagatggagatggccgtattactggaaacgacgcaaccaagttctttgccatgtctaatttatcacggcctgaactcaaacaggtgtgggctatctctgattccaaacggcaagggtttcttggtttcaaagagttcattactgcaatgcagctggtttctctggcacaagcaggacatgaattaacagagggcctccttagctctgcagttgacttggaaaacttaaatccgccagtgatggaaggtttggatccattattagctaaaaaacgactcacccagaaaattgagcctgaattagatttaattgcccaaccccaactatcaccagcagctaattggtttaccacaaaatccacaaagaaggtacctctaagctcagttacttcgataattgatgggttgaagaggttatatatccaaaagctaaagccactggaagttacataccgttttaatgattttgtatctcccctactggcaaacagtgattttgatgctaaaccaatggtcatgcttttggggcagtattccactggaaaaaccacatttatcaaacatttgcttagaagtaattatccaggagctcacattggaccagagcctacaaccgacagatttgttgttgttatgtcaggacctgatgaaagggatattcctgggaacaccattgctgttcaagcagacatgccatacagtggtctcacatcatttggaactgcatttttgtcaaaatttcagtgttcccaaatgccacatccactgctggagcatatcacatttgtagatactcctggagttctatccggagaaaagcaacgaacacaacgaagttatgattttactggagttacatcgtggtttgcagcgaaatgtgatcttattcttcttctgtttgatcctcataagttggacattagtgatgagttcaagcgcgttattggatctctacgtggtcacgatgacaagatacgtgtggttctcaataaggcagatcaagttgacacacaacaattgatgagagtttatggggcattgatgtggtcgttggggaaggttctgaatactcccgaggttatgcgagtttatattggctcattcaacgacaaacctgtaaatgaagccgcaattggtccaattgggaaagaactttttgaaaaggaacaagaagaccttctttctgatttgaaagatattcccaagaaggcttgtgatcgcagaatcaatgaatttgtaaaacgtgccagagctgctaagattcatgcctacataatcagtcatcttagaaaggagatgcctgcaatgatgggcaaggctaaggctcagcagagactcatagataatttagaagatgaatttgcaaaggttcaaagagagttccatctaccagctggagacttcccgaacgttgagcactttagagaggttctcagtggctacagcattgataaatttgagaagttgaaaccgaagatgatacaagctgttgatgatatgcttggctatgacatcccagagcttctaaaaagcttcaaaaacccctatgagtgatacaagttctagttttatggatgcaaccaatctaagaaaagaggaacactatcagagcctataggtatggggaggcttatgcagctcaaatctccaatcttctattacatattgtgttctgctattatttcgagacatctataacagtcaatgtggagtgtaaaagtatcatgtcgaacttgatactattatataaggtaggagatatcgtttgtcttttgtgacgagcaagaagctgcagactggaagttggaatctgtttgttaaggaaataatgtaagaaaagctataatgagaatgaagtctatcgatcgatgctatataatataaagtc

SEQ ID NO: 7882 - DNA, 1756 bp, Nicotiana benthamiana
tctgcactctgatcaatggagtttgataattctcccattaatgaatgctccaaaaatcacgagaagatatatcaacaatggttcaattttgctgattcggatggagatggacgtctcactggaatggatgctaccaattttcttgcaatgtcaaaattgcctcgtgatcatctcaagcaggtatgggcaattgcagattccaagcggcaaggatttctcagttttaaagagtttattactgcaatgcagttggtctctttggctcaagctggccatgctgtgacaagtgattccttaaatgctgaagttgactttgaaactttgcagctacctacaatggaaggtctggatggacttcttgctaagaagaagcgtgtggctaaatgggcacctgacagcaatggaagtcttatgctatcttcacgagctaattggttttcgtcatcaaaatcttcaaagaaggttccttcaaactatgtcacatcaataattgatggactgaagaagttgtacgtcaagaaactaaaaccattggaagttacatatcacttcagtgattttgtctctcctttattggcaaatagtgattttgatgccaaaccaatggtgatgcttttgggtcaatactccactggaaaaacaaccttcattaagcatttactcagaaccagttatccaggtgctcatattggaccagagcctacaacagatagatttgttgtcgtcatgaacggacctgacgaaagaactgtcccagggaatacaattgctgttcaagcagatatgccatttagcggtttgacaacttttggaacagcatttttgtcgaagtttgagtgttctcaaatgccgcatcctctgttagagaatatcacaattgtggatactccgggagttttatcaggtgaaaagcaacgaacgcaaaggagctatgactttacgggggtgacatcctggtttgctgccaaatgtgatctcattctgctattgtttgatcctcacaaacttgatattagcgatgaattcaaacgtgtgattgcatctcttcaaggtcatgacgataagatacgagttgttttgaacaaggctgaccaagttgatactcaacaactaatgagggtttatggagcattaatgtggtcgttagggaaagttctgaatacccctgaagttacgcgtgtctgcataggatcatttaatgacagacctataaatgaggctctgaccggacctctggggaaagaactctttgaaaaggaacaagatgatctacttacggacctgaaaaacataccaaagaaggcttgtgatcgtcgtataaatgaattcgtaaaacgtgctcgagctgccaagatacatgctcatatcataagtcacctgaaaaaggaaatgcctgctatgatgggcaaatcgaagaaacagaaaagacttatcgataacttggaagatgaattcgtaaagattcagaaagaacatcacctaccagccggagattttccaaatgtcgaacattttagagaagttttgagtggttataacatcgacaagtttgagaagttgaaacctaagttaatacaagctgttgatgacatgcttggttgtgacatccctgaactacacaaaaatttcaggaatccttacggctaacaagataaaaagttggtatagtacggacagaggtagagccaagatttgaagttatggggccgggattcttgtacttttatgttactttattgtaaattaataatttata

SEQ ID NO: 7883 - DNA, 2208 bp, Citrus sinensis
aaaaaaaaaattgctgcttgatctcgagaaacagcgaatggaaatcggtacgggcccaatcggttcgtgctctaaagatcaccaaaagatctacctagaatggttcaattatgccgactcagacggtgatggacgaattactggtaatgatgcaaccaagttctttgctttgtcgaatttatctcgacaagatctcaagcaggtttgggcaattgcagatgccaagcgacagggatatcttggttacagagagtttattgctgcaatgcagctgatttctctagtacaagatggacaccaagtaacacatgatctttggaatagcgatgttgactttcaaaatctgaagcctcctgcaatggaaggtctggataagttacttgcaaataaaaggcattcatcaaagaccagtgatcctaatttaaatgggagtttgcagccacagccttcgccatcagctaattggttttcttcaaaatcatcaaaaaagatatctatgtcttctgttacatcaataattgatggtttgaagagattgtacattcaaaagttgaagccattagaagttacctaccgttttaacgattttgtgtccccattgttgacaaatagtgattttgatgctaaaccaatggttatgttgttgggtcaatactctactgggaaaacaacatttataaaacatctgcttagaactagttatccaggagctcatattggacctgagccaactaccgatagatttgttgttgttatgtctggagttgatgacagaagtataccagggaacactgtcgctgtccaagcagacatgccattcagtggtctcacaacctttggcactgcatttttgtcgaagtttgagtgttctcaaatgccacattctctgctagagcacataacacttgtggatactcctggagttttgtcaggagagaagcaacggacacagcgagcctatgattttactggtgtaacatcatggtttgctgcaaagtgtgacctcatattgcttctgtttgatccccacaaacttgatattagtgatgagttcaagcgtgtaatcacatctttacgcggtcatgatgacaagattcgtgtggttttgaacaaggcagatcaagttgacactcaacagctgatgagggtttatggagctttgatgtggtcacttggaaaagttcttaatactcctgaagttgttcgtgtatatattggctcattcaatgacaaacctgttaatgaatcagcctttggccctcttggtaaagaactatttgaaaaagaacaagacgaccttctatctgatctgaaagatatccccaagaaggcttgtgatcgacgaataaatgaatttgtgaaacgtgccagagcagcaaagattcatgcttatatcatcagtcatcttagaaaagagatgcctgctatgatgggcaaagcaaagactcaacaaaaactcattgataatttagcagaggaattcggaaaggtccagaaggaattccatttacctcccggagatttccctaatgtcgagcacttcaaggagatattgagtggttacagtttcgataaatttgagaagctgaaacctaagatgatacaggttgttgatgatatgcttggttatgacattcccgacctcctgaagaatttcagaaatccctatgattaggagagtgagtgtggccatagaagataaatgtatcaattgttaacagaaaaagtttatcagcatcccgccagaaaatttatttgtttctagatcgttagaggtgaaaatctcgtgtcttttatgcccttgtgcgactctttgtataatccagtttttaacttttaaggaatcctaaatgattctttaattttgaaaaattattaactctactagattatgcaaagatggtaacatttatatttgattattgtccaagagaaatcaagagcattgaaggcaagagatcgttcaattatttgcaggaagcttcaaggaaaaagcccaggaaggaaatatgaaaattggatctctaagataaaaaggaaatttgtaatttgaaaaatcaaagatttacggttaaatgcatttttgcataatctactttcctaattcctattagggaccttaagataattaaattaatcaaagttaatatgcggttaatgtcttgccactttcttaaatgaaatatgatatgggactgttcattatgc

SEQ ID NO: 7884 - DNA, 1714 bp, Arachis hypogaea
aatcgttgcgttttcgaagtcgttccaaacgcagcgaatcgatggaattcgacccgatcccaatcggttcctgctccaaagagaaccagatcatctaccagcagtggttcaattacgccgattcagatggcgatggccgcattacggggagtgatgccaccaagtttttcgccatgtccaatttgtctcgccaggatcttaagcaggtgtgggctattgcggattcgaagcgacaaggatatcttggttttgcagagttcatcattgctatgcagctaatttctttggcacaatccggccaaccaataacacaagatcttctttctagtggtgttgagctgaaaaacttgaaacctcccacaatggatggtttggatgtattaatggctaagaaaaggcataaagaaaaagaagttgattcaaatggtagttctccattgcagccatcaccatcttcaagtagttggttctcttcgaagtcaacaaaaagggtttcactttcctccgtgacctcaataattgatggcttgaagaaactctacatccagaagttgaggccattagaagctacttatcgttttaatgattttgtatccccattactgacaaatagtgactttgaagcaaagccaatggttatgcttttgggtcaatactcaactggtaaaacaacatttatcaaacatctacttaaaagtagttatccaggagcccatattggaccggagcctacaactgatcggtttgttgttgtcatgtctggacctgacgagagaagcattcctggaaatactgttgctgtccaagcagacatgccatttagtggtcttacaagttttggcaccgcatttttgtcaaaatttgagtgctctcaaatgcctcatccgctactggaccacattacatttgtggacagtcccggagttttatccggagaaaagcaacgaacacaacgggcatatgactttacaggtgtaacatcttggtttgctgccaaatgtgatttgatactcctcctgtttgatcctcacaagcttgatattagtgatgaattcaagcgtgtgatctcatccttgcgtgggcatgatgacaaaattcgagtagttttgaacaaggcagaccaagttgatactcaacaactaatgagagtttatggagcattgatgtggtcacttgggaaggtgctgaatacacctgaagtcatgcgtgtgtatatcggctccttcaacgataaacccataaatgatgctgtcagtggtccaatcggtaaggaactctttgaaaaagaacaagaggaccttctttcagacctaaaagatataccaaagaaggcctgtgatcgaagaatcaacgaatttgtaaaacgggcacgagctgccaagatacatgcttacattatcagtcatcttaaaaaggagatgcctgctatgatgggcaaagctaaagctcagcaaaagcttattgataatctggctgcagcatttggaaaggtacaaagggagtttcatctacctcctggagacttcccagatgttgaacatttcagagagactctaagtggttataattttgacaagtttgagaaattgaaaccaaaaatgatacaggcagtagatgacatgttaggttatgacattccaaacctcttgaaaaattttaggaatccatatgattagttttacgagcaattgagcctgttaaataattaaataat

SEQ ID NO: 7885 - DNA, 1912 bp, Silene vulgaris
ctttattattcaactttaaaatacagctcaaaatttgatcaaacacattcgaattcaaagtagtatttgtagaagaggcaaatggagatagcgagtgacccgattggttcgtgcaccaaagaacaccagaaagtatatcagcaatggtttgctgttgccgattccaatggagatgggcgtattactggtaatgatgccaccaagttctttgctatgtccaacttatccagatctgacctcaaacaggtgtgggcatttgcggacactaaaagagagggctatctgggttttaagcaatttgttgctgcaatgcagctaatctctttagcacaagctggacatgagctgacagctgatctcctgagtagtgcagatatggaagagatacaacttccagttatggaagggttggacacattaatagctaagatgaagaagacctcaacatacgtggaacctgagctaaatggatctcctcagcgccaatcaccacaagcgtcaaattggttcagctcaaagccatctaagaaagtgtcgcttagtgcggtaacttctattattgatggtttgaaaagattatacctggataagctaaagccgttggagactacctatcgctttcacgactttgtatctcctccactggcaagtagtgattttgatgctaaacctatggtcatgctattaggacaatattccactgggaaaactacatttataaaacacttattacagtgtgaatatccaggagctcatattggaccggagcctacaacagaccgttttgtttgtgtcatgtctggacctgatgagaggagcattcctggcaacacaattgctgttcaagctgacatgccattcagtggtctctcaaacttcggaggggcattcttgtcaaaattccagtgttcacaaatgccacatcctttgttggagcacattacttttgtggacactccaggagttctgtctggagagaagcagagaactcagagaagctatgactttactggagttatatcgtggttcgctgccaagtgtgaccttattcttctcttatttgatcctcacaaactcgacattagtgacgagtttaagcgtgtcatttcctctttacgtggtcatgatgacaagatacgagttgttcttaacaaggctgatcaagttgatacccaacaattaatgagagtatatggtgcactgatgtggtcgcttgggaaagtcctaaatactcccgaggtttctcgtgtttatattggttcatttaatgataagcccatcaaggaagattcaattggtccaatgggaagggaactttttgagaaagagcagaatgacctcctagctgatttaaaggatatcccaaagaaagcttgtgaccgacgaataaatgaatttgtgaaacgtgccagagcagctaagattcacgcttacataattagccatctcaagaaagagatgcctgccatgatagggaagggcaaagctcaacaacgtctaattgacaatcttgagggggagtttgctaaggtccaaagggaattccatttaccagcgggagattttccttatgttgagcattttagagaagttctcggtggctatagtattgacaaatttgagaaactgaagcctaagatgatacaagccgtggatgacatgcttgggtacgatatccctgaactactgaagaacttcagaaacccgtatgactaaggtgaagtgggttaggtgaggtcgttgagttattatgaagtgtgtgtatatcattgtatttttggagattggcaagctgagttgccacttttcagcagttgaacaatttaatgtgaggaaataaccaaatgtttgagtcttcatttcaacatgaaattatcgtttaattcgggtgcttataaatctagtaaatatt

SEQ ID NO: 7886 - DNA, 2000 bp, Eschscholzia californica
aagagcatcaaaagatctacaggaatggttaatttcgctgattcagatggagatggacgagttactggaaatgatgctactaagtttttgccatgtctaacttatctcgagctgaattaaaacaggtatgggctattgcagataccaaacgacaagggtttcttggcttcaaagagttcattgcatccatgcagctggtttcgctggcacaagcagggaatgaaataacggagagcctccttagctctacagctgacttggaaaatttgaaccctccagtgatggaaggtttggcagcactgttggctaaaagacgttcacccaagaaatctgagcctgaactagcaattacaacccaaacatctgcatcagctctttggtttacctcaaaatctacaaagaaggtgcctctaggctccgtcacatcgataattgatggattgaagaagttatatattgaaaagctaaagccactggaagttgcataccgatttaatgattttgtatctccattattgacaaacagtgattttgatgctagacctatggtcatgcttttgggccagtactctactggcaaaacaacgttcattaaacatttactcaaaagcggttatccaggatctcatattggaccagagcctacaaccgaccgatttgttgtcgttatgtcaggacctgatgaaaggagcattcctggtaacaccattgcggttcaagcggatatgccatacagtggtcttacatcattcggaactgcatttttatcaaaattcgagtgttcccaaatgccacacccacttctggagcatatcacgtttgtcgatactcctggagttctttcaggagaaaagcaacgaacgcagagaagctacgattttactggagttacttcgtggtttgcagctaagtgcgatcttattcttcttctgtttgatcctcataagcttgacattagtgatgagtttaagagagtcattggatctcttcggggtcatgatgacaagatacgtgtggttctaaataaagcagatcaagttgatacccaacagctgatgagagtttatggagcattgatgtggtcattgggcaaggttttgaatactcccgaggttaatcgtgtttatattggatcattcaatgataaaccggtaaatgaagcagcaatcggcccacttggtcgagagctttttgagaaggaacaagatgaccttcttgctgatttaaaagatattcctaagaaggcttgtgatcgtcgtataaacgaattcgtaaaacgtgcgagagctgctaaaattcatgcctacataatcagtcatctcagaaaagagatgccagcaatgatgggcaaggcgaaaactcaacaaagactcatagacaatctagaagatgaatttgcgaaggttcaaagagagtttcatttaccagccggggacttccccaacgtagaccatttcagagagatccttggtgggtacaacattgataaatttgagaagctaaaaccgaaaatgattcaagcagtcgatgacatgctcggttacgacattcccgagcttttgaagagtttcaagaacccttacgagtgaataaaattacaggtcaattgatacaacactctcaagctaaaggatgggcaatcacgcaggttggaagtcttttctgacttcttaaactctcttattcgttctattctattatatggtttgtcccgagtcaaatactatatatatttagacacttctgttataaactcataatcatcattgacgattgttcaagtttcctggttgaacttcatatatcaggcgaggaagactttgtatgttgttttgtccaggatcttggctacggaaagagcggtagacatggctactgtgagagggatcaaatcaatcgtcgtcattttctgtttgtgattgtataacgaaatggcagagagtaatttttaaatactcaatactatattatttaaaattctctctgcctatttcgttata

SEQ ID NO: 7887 - DNA, 1982 bp, Triphysaria pusilla
cgcggctctgtgctcccagaacaggaacagcagatatataatattaatcacaggtacagagaaataataattcgaaaatttgaaaaaccacctgtgaaatggagatagattcggcctcaattagtcgatgctccaaggagcaccaacagatctatcagagctggttttctttcgctgattcagatggagatggccgtctcacgggagccgatgctaccaagttcttttccatgtctaatttgtctcgtcaagacctcaaacaggtgtgggcaatcgctgattcgaagaggcaaggttaccttggattgaaagaattcgttacagcaatgcagataatctccttggcacaatctgggcatggtataaccagtgatctcttagcctctgaagattttgactttgaaagcttgcaacctccaaccatggaaggtctggatgtgctccttgctaagaaaaggcgttcatccggtgctcatgagcatactgcaagtcttgaaacgcaaacttcagcttcagctggttggtttacttctaccaaatcggcaaagaaggtacctttgaactctgtcacttcaattattgatgggttgaagaaagtgtatgttcagaagctgaagcccctggaagtaacctatcggtttaatgattttgtttctcctgtactgggaaatagtgacttcgatgctaaacctatggtgatgttactgggtcagtactctactgggaagacgacatttatcaaacatttgctcagatcaagttatccaggtgctcacattggacctgagcctaccacagatagatttgttgttgtgatgaatggacctgacgaaagaagtattcctgggaacaccgttgctgtacaagcagatatgccatacagtggtttgacaacttttggaactgcatttttatcaaaattcgagtgttcacaaatgccgcatcctctgctggagcatattacatttgtggacactcctggagttttatctggagaaaagcaacgaacacaaagaagctacgactttactggcgtgacatcttggtttgcagcaaaatgcgatctcatcttgcttctgtttgatctcacaaacttgatataagtgacgaatttaaacgagtcattgggtccttgcgaggtcatgacgataaaatacgtgtggtcttgaacaaggccgatcaagttgatacacaacaacttatgcgggtgtatggagcattgatgtggtccctcgggaaagtgctgaatacacccgaagttaaccgtgtttatattggttcatttaatgacaagcctataaacgaggctgcggccggtccacttggcaaggatctttttgagaaagaacaggatgatcttctttctgatttgaaagacataccaaagaaggcttgtgatcgtcgtataaacgaatttgtaaaacgggctagggctgcaaaaatacatgctttcatcatcagtcatctgaaaaaggagatgcctgcaatgatgggcaaagctaaaacacaacaaagactcattgataacctggctgatgagtttgcaaaggttcagagggaacagcatctaccagcaggggatttcccgaacgtggaggagtttagggaggttttgagtggctacagcatagataagtttgagaaactgaaacctaaaatgatacaaaatgtcgatgacatgctcggatacgacattcctgatctattgaagaatttccgtaacccgtatgactagagatgctgatattcgtttgagtggagagattaaagtcttttttttctctgaccttgaaatgttattgttttcatttcttttattatagttgaaaggggcatgatacctgtatttgtttgtgctcttaaatctatgagatgtttgtacgagttaaaacttcaattttgtatttgttgtaatgaattgattgggcagatgtaattaaaataagatcttttctttatttgactaaaaaaaaaaaaaaaaa

SEQ ID NO: 7888 - DNA, 2037 bp, Brassica rapa
tccctctctattaatagtgggctattacaatacaatcaacagtattggggcatatgtgaaactttatgaaagtataggacactttctcgcattgctgattctctttccctctttcttgcccccgtcgagacgaagaagaacccgctttctctgggtttcgcgatcggagatggagatcgattccgtcgcagctggttcgtgttccaaggagaatcagctgatctacaaggaatggttcgagttcgccgattcagacggagatggacgcattactggtagcgatgcgatcaagttcttctccatgtcgaatttgcctcggcccgagttgaagcaggtgtgggcaattgcagatgcaaagagacaggggtatcttggtttcaaagatttcattgttgctatgcagctcgtttctttggctcaaactggacatgagatatcgcatgacgttcttcatagcgacgttgacttcaagaatatgaatcctcctgttatggaaggtctgggtgtattaatggcgaagaagaagcattcatcatcaaagtcgaatgatcttagtgttaatggtagtccttctgcagatgcatcacttacagctcactggttctcttcaaaatcttctaaaaagatttctctgtcctccgtaacatctatagtcgatggcctgaagaggctgtacattcaaaagctgaagccactcgaagttgcttatcggttcaacgattttgtatcccctttgttgacgaacagtgattttgatgcgaaacccatggtaatgcttctcggtcagtattccacaggaaaaacaacattcattaagcatttgcttaaagctagttatccaggagctcatattggaccagaaccaactactgacagatttgttgttgtcatgtctggacctgatgaaagaagcattccagggaacacagtagcggttcaagcagatatgccattcagtggtcttacaacttttgggactgcctttctgtcgaagtttgaatgttctcagatgcctcatcctctgctggagcacgtagcatttgtcgacactcctggagttttatcaggggaaaagcaacggacacagcgagcatatgacttcacaggtgttacatcatggttcgcctctaagtgtgatctcatcctcctcctgttcgatcctcacaagctggatgtaagcgatgagttcaagcgggttatttcatctttacgaggtcatgatgacaagatccgcgtcgttctgaataaggctgaccaagtagacactcagcagctaatgcgagtatatggagctctcatgtggtctcttgggaaagttctcaatactcctgaggtttcccgtgtctacattggttcgttcagtgataaacccattaatgaagctgcgactggtccaattgggagagagttgtttgaaaaggagcaagatgaccttctcgctgatttgaaagacattccaaagaaagcttgtgatcgtcgaataaacgagtttgtgaaaagggcaagagctgcaaagatacatgcgtgcatcatcagtcatttgaagaaggagatgccagccataatgggaaaagccaaagctcaacagaaactgatagataacttggaagacgtctttggaaaggtacaaagagagcatcacttaccaaaaggagttttcccaaacgtggagcagttcagggaggtgctaagtggttacaacatcgacaagtttgagaagctaaagccgaaaatgttgcagactgttgatgatatgttggggtatgacattccagagctcttgaaaaatttcagaaacccctatgattaatatatatcaccccttcttagcttatgtgtttactgttataatcctatgtatgcattcacctttggcctaaaccttcccttgtgagcacaaatgcatattgtgtattcttgaaaagacttgtaaacaatgaagacgcataaagagtatcgacttgataatggtgtatatcattatatcacaaaataaaagtattatcgttatcaaagctcgtaactctgtaattgtca

SEQ ID NO: 7889 - DNA, 2000 bp, Cichorium intybus
agtggcaaatgggcagaaaaatatcttgactgcagttttcaactcatcaacgtcggcgagatctggaaatttggggattttggtagattttcaagtgctgtataaaagcatcctgatctggtgtagtcttagaggaatctgtaatcggcgttttcatcataatcgataaaaatggagattgattcagcagcgattagtcggtgctctgcagaacaccagaagatctacaaagactggttcagtgccgccgattcagacggcgatggacgcctcaccggcggtgatgccacgaatttctttgtcatgtctaatttatctcgacaagatcttaagcaggtatgggcaattgcagattctagacgacaaggctttcttggattcaaagagtttattactgcaatgcagctgatttctatggcacaaacaggacatacattaagtagtgacctcttaaattctgatgttgattatgaaaatttgaaaccaccagtgatggacggtttagatgtcttacttgctaagaagaagcgttcaaaaaatgatcttgaatcaaatggtagtcctgaggtgcagacttcatcatcatctagctggtttacttcttcaaaatctgcaaaaaaagttcctttaaccgcggttacatcaatcattgatggtctaaagaaactatacattcaaaagctaaaacctttagaagtcacatatcaatttaatgatttcgtttctcctttattgaccaacagtgattttgatgccaaacctatggtaatgcttttgggacaatactcaacaggaaaaacaacattcatcaaacatttacttagaagtagttatccaggagctcatattggacctgaacctactacagatagatttgttgttgttatgaatggaccagatgaaagaagtattccaggaaacacagttgctgttcaagcagacatgccatacagtggtttaacaaattttggaaccgcatttttatcaaaatttgaatgttcacaaatgccacatcccctactggagcatattacatttgtggacactcctggagttttatcaggagaaaagcaacgaacacaaagaagctacgactttacaggtgtcacgtcctggttcgctgcaaaatgtgacctaattttgcttttatttgatcctcataaacttgatattagtgatgaatttaaacgtgtcatttcttctttaagaggaaatgatgataaaatacgtgtggttttaaataaggccgatcaagtcgatacacaacaattgatgagggtgtatggagctttaatgtggtcccttggtaaagtcctaaatacccctgaggttatgcgtgtgtacattggttccttcaatgacaaacctataaatcgagtcactgcgggcccaattggaaccgaactatttgaaaaagagcaagacgatcttctagccgacttaaaagacatacctaaaaaggcttgtgatcgcaggatcaacgagtttgtgaaacgtgctagagcagccaaaattcatgcttttattatcagccatcttaaaaaagaaatgccagctatgatgggaaaagccaaaactcaacaaaaactcatcgataacttagaagatgtttttgcaaaggttcaaagggagcatcatttaccagcgggggactttccgtatgtggaaagttttagggagagattgagtgggtacaatttggacaagtttgagaagttgaagcctaaaatgatccagaccgttgatgatatgttgggttatgatattccggatcttttgaagaattttaggaatccgtatgattaaggttttgggggaaagggaatgttttgagttatgtaataatatatcatatatagtgtagtgtgcatttgcaaaacgaggttgaactggatgttgtgatttcagattttcaacttattattttttacttgtagctgtaagctatacacatagatagctatatatggttgtattggaatataagggtaaaatggtca

SEQ ID NO: 7890 - DNA, 2131 bp, Eucalyptus grandis
gcacagagcaaaaaagaccagagccaccaccgccctctctcttcctctccgaaagctttcgaattcttccgatggagatcaagtcgggggcgctgggctcgtgctccaaggaccaccagcggatctatcaggagtggttccacttcgccgattcagatggagacgggcggatcactggaaatgccgccacgaagttcttcgccatgtcgaagctttcgcgacaggagctcaagcaggtttgggccattgcagattccaaacgtcaagggttcctcagcctacatgaatttatcatcgctatgcagctgatttctctggctcaagaaggagttgaattgacccctggcagccttaagtttgaagctgatgtggagaagattgatcctcccatgatggaagggttggatgccctggttgctaaaagcaagaactccacagttgttgtcgatcctgaaacaaatggaagtgctccccccgtgccaccaccatcatctcagtggtttgcttcaaaatctgggaggaaggcacaggcacctcaatattcggttacatctattgttgatggcctgaagaaattgtatatagaaaagctgaagcctcttgaagttgcttatcgttttaatgattttgtgtcccctttgttgacaaatagtgattttgatgctaaacccatggtgatgctccttggtcagtattctacgggcaaaactactttcataaagcatttgctaaggtgtgactacccaggagctcatattggacctgagcctacaactgatagatttgttgttgtcatgtctggaccggatgagaggagtatcccggggaacacaattgctgtccatgcagacatgcccttcaacggcctgacgaaatttggaggagcatttttgtcaaaatttgagtgttcccagatgccacatcctctgctggatcaaattacttttgtggatactcctggtgttctatccggagaaaaacaaagaacccaacgaagctatgattttactggtgtcatatcatggtttgcagccaagtgtgatttgattcttcttctgtttgatcctcataaacttgatattagcgatgagttcaagcgtgttatcgcatctctacgcggtaatgatgacaagatacgtgttgttcttaataaagcagaccaagtcgatacgcaacaactgatgagagtctatggagcactaatgtggtcacttggaaaagtgttgaacactcctgaagttgcacgcgtttatatcgggtctttcaatgacaagcctgttaacgatggcattgtgggccccatagggcgtgatctcttcgaaaaagaacaggatgaccttcttgcagacttgattgacattcctaagaaggcttgcgaccgtcggatcaacgaatttgtgaagcgtgctagggctgctaagattcatgcttacatcattagtcatcttaagaaggagatgcctgccatgatgggcaaggcaaaggctcagcaacgattaattgataatcttgaagatgaatttgccaaggtccaaagggattaccatctaccggcaggcgattttcccagtgtcgatcatttcagggaggtcttgagtggctacaacatcgataaattcgaaaagctgaagcctaagatgatacaagccgttgatgacatgctcggctacgagatccctgagcttctgaagaatttcagaaatccttatgaatgaatcttccaggggttgtaccttctttgtggaggcaatgtctttttgctacatgatatcttatctgaaaaaccaactttgtgtataacatttttgacgtccgatgctccatcatatcctcagatggggcaatcaggtttattaagcatgcatgtcaagtttcgatttctatttccggcttttgtctacaccaaaatagacaaagcaggtggcaattggcaaaatgagttaaaattcttcctcagctccaattacgcgaatcctagtgtgatagaggtcacctttacttgtcttggatagtcatctagatcatgtatcaaaagttcttggatgcataaatatcaattttagtaaaaggaatgctccaagtagtgtaaagaggttttgtgaaaattctgtggtttcatctaaaagtagat

SEQ ID NO: 7891 - DNA, 1957 bp, Flaveria ramosissima
aggtttggcgccccgcaccaccgaaagaataaaataaatatctttagactgaagttttaaacttctcggcgtcggcaagatctgggagattagggattttttttgatacattatcaatcatctcttcagaaatctgtaataatctgtatgttatcagctttcattaatggagattgattcagcagcgatcactcggtgctctccagaacaccagaagatctacaacgaatggttcaatgtcgctgatacagatggtgatgggcgcgtcactggtgttgatgcgacgaatttcttcattatgtccaatttagctcgacaagatctcaagcaggtgtgggcaattgcagactctaaaagacaaggctttcttggctttaaagagtttattactgcaatgcagctgatttctatggctcaagcaggacatgaattaagcagtgacctcttaaattctgaagttgattttgaaaatctcaaaccaccggtgatggacggtctggatgtcctactagctaggaaaaggcgtccaaaaagtgattctgaatcaaatggtaactcaccattgcaaacttcaccaacagcatcgtctagttggtttacctcgccaaaatctgcgaaaaaggttccattaactgctgttacatcaatcattgacggcttgaagaagctgtacattcagaagctgaaacctttagaagtcacatatcaatttaatgattttgtttctcccttattgacaaacagcgattttgatgccaaaccaatggtgatgcttttgggtcaatactcaaccgggaaaacaacattcatcaagcatttgcttagaagtagttatccaggagctcatattggacctgagcctaccacagatagatttgttgttgttatgaatggacctgatgaaagaagtattccaggaaatactgttgctgttcaagcagacatgccgtatagcggtttaactaattttggaactgcattcttgtcaaagtttgagtgttctcaaatgccacatcctctgctggagcatattacatttgtggacactcctggagtattatcaggagaaaaacaaagaacacaaagaagctatgacttcacaggtgtcacatcctggtttgctgcaaagtgtgacctaatcctgcttctctttgatccacataaacttgatataagtgatgagtttaaacgtgttatatcttccctaagaggaaatgatgacaagatacgtgtagtcttgaacaaggctgatcaagttgatacccaacaactgatgagggtgtatggagccctgatgtggtcacttggtaaagtccttaacactcctgaggttatgcgcgtttacattggttctttcaatgacaagcctataaatacggttacttctgggccaattgggacagagctgtttgagaaagagcaggaagatcttcttagtgacctaaaggacatacctaagaaggcttgtgatcgcagaatcaacgaatttgtgaaacgagctagagcagccaagattcatgctttcattattagccatcttaagaaagagatgccggccatgatgggtaaggctaaagctcagcagaagcttatcgataacctggaagatgtttttgcaaaggttcaaagggagcatcacttaccagcgggagacttcccatacgtcgaaagcttcagggagagattgagcggttacaatttggacaaatttgagaaactgaagccgaaaatgatccaaactgtagacgatatgctaggatatgacatccctgaccttttaaagaacttcaggaatccatatgattgaagctaaatggtcgagataaagggatccgcttgtcaatcgtgttgctataccttcatatgtagtgtaatgtgctatgtgtactatgaaaccgagagaccattgctcgcagatacgagtatgaacaacttgtttattgctgctaagatgctt

SEQ ID NO: 7892 - DNA, 1944 bp, Vinca minor
ccttagtataaaggttagttttacttactaaggtactagttagttaattaattaggacatagaaaaaataagatcttactaaatttaatcgtaatttattcacactattactacaactagaaaaagacagtctccttagaaaagcaaagccgcaattgggctcgtcttttagaaaaaaaaatggaaattgattcatctccaatttctagatgttctaaatacaatcaaaagatctatcaagattggttttcttttgcggattcagatggagatgggcgcctcagtggacctgatgccatcaagttttttgctttctctaacttgcctcgccaagatctcaagcaggtctgggctatcgcagattctaaaaggcaaggctttcttggttttaaagagtttatttctgcaatgcagttggtggccctagcacaagctgggcatgcggtaaataatgatatcataaatgctgaagttgacttcgaaagtttaaaacctccagcaatggaaggattggatacattgatagctaagaaaaagcatgcttctaaaagtgagcctgaacaaaatggcgatcctgaggtgcagagttcaccatctgctggttggttttcctcaacaaagtctgcaaagagggtatctttaacctcagtgacatcaattgttgatggcctgaaaaagttgtatattcagaagttgaagccattagaagtcacatatcgcttcaatgattttgtttcccccctgttggcaaacagcgattttgatgctaagcctatggtgatgcttttgggtcaatattccacgggaaaacgacatttattaaacatctactcaaaagtagttatccaggagctcacattggaccagagcctacaaccgacagatttgttgttgtcatgaatggacctgatgagagaagtattccagggaacactatagctgttcaagctgacatgccattcagtggtctgacaagttttggaactgcttttttgtcgaaattcgaatgctcacagatgccacacccacttctggaacatattacttttgtggacacccctggagttttatcgggagaaaagcaacggacgcagagaagctatgactttactggtgtaatatcatggttcgctgcaaagtgtgatcttattctgcttttgtttgaccctcataaacttgatataagtgatgaattcaagcgtgtgatttcttcactacgaggacatgatgataagataagggtggtattgaacaaggccgaccaagttgatacccaacagcttatgagggtttatggagcactgatgtggtctcttggaaaagtcctaaatactcctgaggtttctcgggtttatatcggttctttcaacgacaaacctataaatgaagctgctgctggtccgattgggacagagctttttgagaaagaacaagaaaaccttcttgctgatctgaaggacgtgcccaaaaaagcttgtgatcgtcgaataaacgaatttgtaaaacgtgccagggccgcaaaaatacattcttacattgttagtcatctgaaaaaagagatgccagccatgatgggcaaagctaaaacccaacagaaacttatagataatctcgaaacagaatttgggaaggttcaaagggagtttcatctcccagcaggcgatttcccaaatgttgaacacttccgggatatcttgagcagttacagcattgataagtttgagaagttgaagcctaaaatgatacaatctgtggacgatatgcttgggtatgacatcccagaactcttgaagaactttcggaatccttatgattaaatatggcggcaatttatgataatacagctttgttatcctgttcgagaggatggctcgtatactttttttttatttttttaattttcgctgtaaagtggaacttgtattactttaatcacaaaaatta

SEQ ID NO: 7893 - DNA, 2208 bp, Citrus clementina
aaaaaaaaaattgctgcttgatctcgagaaacagcgaatggaaatcggtacgggcccaatcggttcgtgctctaaagatcaccaaaagatctacctagaatggttcaattatgccgactcagacggtgatggacgaattactggtaatgatgcaaccaagttctttgctttgtcgaatttatctcgacaagatctcaagcaggtttgggcaattgcagatgccaagcgacagggatatcttggttacagagagtttattgctgcaatgcagctgatttctctagtacaagatggacaccaagtaacacatgatctttggaatagcgatgttgactttcaaaatctgaagcctcctgcaatggaaggtctggataagttacttgcaaataaaaggcattcatcaaagaccagtgatcctaatttaaatgggagtttgcagccacagccttcgccatcagctaattggttttcttcaaaatcatcaaaaaagatatctatgtcttctgttacatcaataattgatggtttgaagagattgtacattcaaaagttgaagccattagaagttacctaccgttttaacgattttgtgtccccattgttgacaaatagtgattttgatgctaaaccaatggttatgttgttgggtcaatactctactgggaaaacaacatttataaaacatctgcttagaactagttatccaggagctcatattggacctgagccaactaccgatagatttgttgttgttatgtctggagttgatgacagaagtataccagggaacactgtcgctgtccaagcagacatgccattcagtggtctcacaacctttggcactgcatttttgtcgaagtttgagtgttctcaaatgccacattctctgctagagcacataacacttgtggatactcctggagttttgtcaggagagaagcaacggacacagcgagcctatgattttactggtgtaacatcatggtttgctgcaaagtgtgacctcatattgcttctgtttgatccccacaaacttgatattagtgatgagttcaagcgtgtaatcacatctttacgcggtcatgatgacaagattcgtgtggttttgaacaaggcagatcaagttgacactcaacagctgatgagggtttatggagctttgatgtggtcacttggaaaagttcttaatactcctgaagttgttcgtgtatatattggctcattcaatgacaaacctgttaatgaatcagcctttggccctcttggtaaagaactatttgaaaaagaacaagacgaccttctatctgatctgaaagatatccccaagaaggcttgtgatctacgaataaatgaatttgtgaaacgtgccagagcagcaaagattcatgcttatatcatcagtcatcttagaaaagagatgcctgctatgatgggcaaagcaaagactcaacaaaaactcattgataatttagcagaggaattcggaaaggtccagaaggaattccatttacctcccggagatttccctaatgtcgagcacttcaaggagatattgagtggttacagtttcgataaatttgagaagctgaaacctaagatgatacaggttgttgatgatatgcttggttatgacattcccgacctcctgaagaatttcagaaatccctatgattaggagagtgagtgtggccatagaagataaatgtatcaattgttaacagaaaaagtttatcagcatcccgccagaaaatttatttgtttctagatcgttagaggtgaaaatctcgtgtcttttatgcccttgtgcgactctttgtataatccagtttttaacttttaaggaatcctaaatgattctttaattttgaaaaattattaactctactagattatgcaaagatggtaacatttatatttgattattgtccaagagaaatcaagagcattgaaggcaagagatcgttcaattatttgcaggaagcttcaaggaaaaagcccaggaaggaaatatgaaaattggatctctaagataaaaaggaaatttgtaatttgaaaaatcaaagatttacggttaaatgcatttttgcataatctactttcctaattcctattagggaccttaagataattaaattaatcaaagttaatatgcggttaatgtcttgccactttcttaaatgaaatatgatatgggactgttcattatgc

SEQ ID NO: 7894 - DNA, 1955 bp, Cichorium intybus
gtttggcgcctcgcacggacaagtaagtgagtggcaaatgggcagaaaaatatcttgactgcagttttcaacttattaacgtcggcgagatctggaaatttggggattttggtagattttcaagtgctgtataaaagcatcctgatctggtgtagtcttggaggaatctgtaatcggcgttttcatcataatcgataaaaatggagattgattcagcagcgattagtcggtgctctgcagaacaccagaagatctacaaagactggtttagtgccgccgattcagatggcgatggacgcctcaccggcggtgatgccacgaatttctttgtcatgtctaatttatctcgacaagatcttaagcaggtatgggcaattgcagattctagaagacaaggctttcttggctttaaagagtttattactgcaatgcagctgatttctatggcacaaacaggacatacattaagtagtgacctcttaaattctgatgttgattatgaaaatttgaaaccaccagtgatggacggtctggatgtcttacttgctaagaagaagcgttcaaaaaatgatcttgaatcgaatggtagtcctgaggtgcagacttcttcatcatctagctggtttacttcttcaaaatctgcaaaaaaggttcctttaaccgcggtcacatcaatcattgatggtctaaagaaactatacattcaaaagctaaaacctttagaagtcacatatcaatttaatgattttgtttctcctttactgaccaacagtgattttgatgccaaacctatggtaatgcttttgggacaatactcaacaggaaaaacaacattcatcaaacatttacttagaagtagttatccaggagctcatattggacctgaacctactacagatagatttgttgttgttatgaatggaccagatgaaagaagtattccaggaaacacagttgctgttcaagcagacatgccatacagtggtttaacaaattttggaaccgcatttttatcaaaatttgaatgttcacaaatgccacatcccctactggagcatattacatttgtggacactcctggagttttatcaggagaaaagcaacgaacacagagaagctatgactttacaggtgtcacgtcgtggttcgctgcaaaatgtgacctaattttgcttttatttgatcctcataaacttgatattagtgatgaatttaaacgtgtcatttcatctttaagaggaaatgatgataaaatacgtgtggttttaaataaggccgatcaagtcgatacacaacaattgatgagggtgtatggagctttaatgtggtcccttggtaaagtcctaaatacccctgaggttatgcgcgtgtacattggctccttcaatgacaaacctataaatcgagtcactgcgggcccaattggaaccgaactattcgaaaaagagcaagacgatcttctagccgacttaaaagacatacctaaaaaggcttgtgatcgcaggatcaacgagtttgtaaaacgcgctagagcagccaaaattcatgcttttattatcagccatcttaaaagagaaatgccagctatgatgggaaaagccaaaactcaacaaaaactcatcgataacttagaagatgtttttgcaaaggtgcaaagggagcatcatttaccagcgggagactttccgtatgtggaaagttttagggagagattgagtgggtataatttggacaaatttgagaagttgaagcctaaaatgatccagaccgttgatgatatgttgggttatgatattccggatcttttgaagaattttaggaatccgtatgattaaggttttgggggaaagggaatgttttgagttatgtaataatatcatatatagtgtagtgtgcatttgcaacacgaggttgaactggatgttgtgatttcagattttcaacttattattttt

SEQ ID NO: 7895 - DNA, 1850 bp, Euphorbia peplus
cttgagtggtttaatcttgctgatgcagatggtgatggtagaattactggtagtgacgctataaatttcttctccatgtccaatttatctcggcaggatctcaagcaggtatgggcgattgctgattctaagagacagggttatctcggcttcaacgaattcgtcacttctatgcagctagtttcgttagctcaagcggggaacgagataactcacgatgtcttacagagagatgtagacattgtaaatttgaatcctccagctatggaaggtctcgataagatgctcgctaagaagaggcggaaatctacatcaagtgagcctgatggaaatggtactattccttcggaatcctcaccctcggccaattggttttcttctaaatcctcaaaaaaggtatcactatcgtctgttacttctatcatcgatggactgaagaggttgtacattcagaagctgaagccattggaagttgcatatcgctttaatgattttgtatcgcctttgttgacaaacagtgattttgatgctaaaccaatggtgatgcttttgggtcaatattccactggaaaaacaacattcatcaagcatttactgaaatgtggttatccaggagctcatattggacctgagccaacaactgacagatttgttgttgttatgtcgggtcctgatgaaaggagtattccaggcaatacaatagcagttcaagcagatatgccatttaatggactcacaacgtttggatcagcatttttatcaaaatttgaatgttctcaaatgcctcattctttgctggagcatattacatttgtggacacccctggtgttttatctggagaaaaacaacgaactcaacgagcatatgacttcactggtgtcacctcttggtttgctgccaagtgcgatctcattttgcttttgtttgatcctcacaaacttgatgtgagtgatgaattcaagcgtgtgatttcatctctacgtggtcatgatgataagattcgtgtggtcctcaacaaggcagaccaagttgatactcaacaattaatgagggtttatggagcattgatgtggtcacttgggaaagttctcaacactcctgaagtttcgcgtgtctatattggatcattcaatgacaaacctgttaatgaaaatgctgttggtccacttgggaaagagctctttgagagagaacaggaagaccttttatctgatctgaaagatataccgaagaaggcttgcgatcgtcgaatcaatgaatttgtgaaacgagcaagggctgccaagatacatgcttatattataagccatctgaaaaaggaaatgccagcaatgatgggcaaatcgaaggctcaacagcgactaatggagaatttagaaactgaattcggaaaggtgcaaaaggagttccatttgccgtctggcgatttcccaaacgtggatcacttcagagaggttttgagtggctataatattgacaagtttgaaaaactgaagcctaaaatgatacaagctgttgatgacatgcttggttatgatattcctgagctcttgaagaactttagaaatccgtacgactaaatttttgacgcaatttggcggttaagggaaaaagattttgaaggtatggatgtatgtgtttaatatcctagggacaacttgaaaatgagtttattgtaagtatcggtatgcttcaaatcttgttgaagtttggtgaggcattggaatatataaatcagttcctaggtttgaggtgagaagtagttgtatatcaacaaggagctttattttcattactactaaaaccttaaattgaaattccaacacttttctttattttagtatcaagt

SEQ ID NO: 7896 - DNA, 1983 bp, Flaveria ramosissima
taatcttctcggcgtcggcaagatctgggagattaggggtttttttcgatagattatcaataatctcttcagaaatctgtaataatctgtatgttatcagctttcattaatggagtttgattcatcagcgatcagtcggtgctctgtagaacaccagaagatctacaacgaatggttcaatgtcgccgattcagatggtgatgggcgcgttactggtgttgatgcgacgaatttcttcgttatgtccaatttagctcgacaagatctcaagcaggtgtgggcaattgcggactctaaaagacaaggctttcttggcttaaaagagtttattactgcaatgcagctgatatctatggctcaagcaggacatgaattaagcggtgacctcttaaattctgaagttgattttgaaaatctcaaaccaccggtgatggacggtctggatgtcctactagctaggaaaaggcgcccaaaaagtgagcctgaatcaaatggtaactcaccattgcacccttcaccaacagcatcgtctagttggtttacttcaccaaaatctgcaaaaaaggttcccttaactgctgttacatcaatcattgacggcttgaagaagctgtacattcagaagctgaaacctttagaagtcacatatcagtttaatgattttgtttctcccttattgacaaacagtgattttgatgccaaaccaatggtgatgcttttgggtcaatactcaacagggaaaacaacattcatcaaacatttgcttagaagtagttatccaggagctcatattggacctgagcctaccacagatagatttgttgttgttatgaatggacccgatgaaagaagtattccaggaaatactgttgctgttcaagcagacatgccgtatagcggtttaactaattttggaactgcattcttgtcaaagtttgagtgttctcaaatgccacatccgctgctggagcatattacatttgtggacactcctggagtattatcaggagaaaaacaaagaacacaaagaagctatgacttcacaggtgtcacatcctggtttgctgcaaagtgtgacctaatcttgcttctctttgatccacataaacttgatatcagtgatgaatttaaacgtgttatatcttccctaagaggaaatgatgacaagatacgtgtggtcttgaacaaggctgatcaagttgatacccaacaactgatgagggtgtatggagccctgatgtggtcacttggtaaagtccttaacactcctgaggttatgcgcgtttacatcggttctttcaatgacaaacctataaatacggttaattctgggccaattggcacagagctgtttgaaaaagagcaggaagatcttcttagcgacttaaaggacatacctaagaaggcttgtgatcgcagaatcaatgaatttgtgaaacgagctagagcagccaagattcatgctttcattattagccatcttaagaaagagatgccgagcatgatgggcaaggctaaagctcagcagaagctcattgataacctcgaagacgtttttgcaaaggtccagagggagcatcacttaccagcgggagactttccatacgtcgaaagcttcagggagagattgagtggttataatttggacaaatttgagaaactgaagccaaaaatgattcaaactgtagatgatatgctcggttatgacatccctgaccttctaaagaacttcaggaatccgtatgattaaagccagatggtcgagaaagagggatccatttttcgatcgtgttggcatacattcatatgtagtgtaatgtgctgtgtgtacaatgaaactaagagaaaattgtttgtcagataccggtatgaacataatgtttattgctgctaaaaatgctttaacaaccaatcctattatggaattaaagaagttgtaaatttgaattgatatgaatttatgacaccaaaaaaaaaaatatt

SEQ ID NO: 7897 - DNA, 2057 bp, Flaveria ramosissima
tttatttgtaagttaacatcactcaagccaaggttgcgcctcgcacaccgaaagaataaaaaaaatatctttagactgaagttttaatcttctcggcgtcggcaagatctgtgagattagggatttttttgatagattatcaaatcatctcttcagaaatctgtaataatctgtatgttatcagctttcattaatggagtttgattcagcagcgatcagtcggtgctctgcagaacaccagaagatctacaacgaatggttcaatgtcgccgattcagatggcgatgggcgcgttactggtgttgatgcgacgaatttcttcgttatgtccaatttagctcgacaagatctcaagcaggtgtgggcaattgcggactctaaaagacaaggctttcttgggttaaaagagtttattactgcaatgcagctgatttctatggctcaatcaggacatgaattaagcagtgacctcttaaattctgaagttgattttgaaaatctcaaaccaccggtgatggacggtctggatgtcctactagctaggaaaaggcgcccaaaaagtgagcctgaatcaaatggtaactcaccgttgcaaacttcaccaacagcatcgtctagttggtttacttcatcaaaatctgcgaaaaaggttcccttaactgctgttacatcaatcattgacggcttgaagaagctgtacattcagaagctgaaacctttagaagtcacatatcagtttaatgattttgtttctcccttattgacaaacagtgattttgatgccaaaccaatggtgatgcttttgggtcaatattcaacagggaaaacaacatttatcaaacatttgcttagaagtagttatccaggagctcatattggacctgagcctaccacagatagatttgttgttgttatgaatggacccgatgaaagaagtattccaggaaatactgttgctgttcaagcagacatgccgtatagcggtttaactaattttggaactgcattcttgtcaaagtttgagtgttctcaaatgccacatcctctgctggagcatattacatttgtggacactcctggagtattatcaggagaaaaacaaagaacacaaagaagctatgacttcactggtgtcacatcctggtttgctgcaaagtgtgacctaatcttgcttctgtttgatccacataaacttgatatcagtgatgaatttaaacgtgttatatcttccctaagaggaaatgatgacaagatacgtgtggtcttgaacaaggctgatcaagttgatacccaacaactgatgagggtgtatggggccctgatgtggtcacttggtaaagtccttaacactcctgaggttatgcgcgtttacatcggttctttcaatgacaaacctataaatacggttaattctgggccaattggcacagagctgtttgaaaaagagcaggaagatcttcttagcgacttaaaggacatacctaagaaggcttgtgatcgcagaatcaatgaatttgtgaaacgagctagagcagccaagattcatgctttcattattagccatcttaagaaagagatgccgagcatgatgggtaaggctaaagctcagcagaagctcattgataacctcgaagacgtttttgcaaaggtccagagggagcatcacttaccagcgggagactttccatacgtcgaaagcttcagggagagattgagtggttataatttggacaaatttgagaaactgaagccaaaaatgatccaaactgtagatgatatgctcggttatgacatccccgaccttctaaagaacttcaggaatccttatgattaaagccagatggtcgagaaagagggatccatttttcgatcgtgttgacatacattcatatgtagtgtcatgtgctgtgtgtacaatgaaactaagagaacattgtttgtcagataccagtatgaacataatgtttattgctgctaaaaaagctttaacaaccaatcctattatggaattaaagttgttgtaaatttgaattttgaagttgcaaaatacgaatatt

SEQ ID NO: 7898 - DNA, 1850 bp, Nicotiana benthamiana
ggaaaagaaaaaaaagcggaacctaaaaagaagggcgctgatataggatttttttttgaaaagccattgaggaaatggagtttgatacttctccgattaatcgctgctccaaagagcatgagaaaatctatcaacagtggtttggcttggccgattcagatggagatggacgtctcactggaggcgatgccattaagttctttgccttgtccaatttgccacgccaggagctcaagcaggtgtgggcaattgcagattccaaacgacaaggctttcttggttttagagagtttattactgcaatgcagttggtttctttggctcaagctggccatccagtaaccagtgatgtcttaaatgctgaagttaactttgaaaatttgcaaccccctaccttggaaggtctggatttacttcaagctaagaaaaagcgcacgcctaaaagtaaacctgaacagaatggcaatcctacagcgcaatcttctgtttcagctaattggttttcatcatcaacatctgtaaagaaggtctctttatcctccgtcacatccataattgatggactgaagaagttatacatccaaaaactaaagcctctggaagtcgcatatcgctttaatgatttcgtctctccattcttgacaaatagtgattttgatgccaaaccaatggtgatgcttttgggtcaatactcaaccggaaaaacaacattcattaagcatttacttagaactagctatccaggtgctcatatcgggccagagcctaccacagacagatttgtggttgtcatgaatggacctgatgaaaggagtattccggggaacacaattgctgttcaggcagatatgccgtttagcggtctgacaacttttggaactgcatttttgtcaaaatttgagtgttctcaaatgccccatcctctgttggagcacatcacgtttgtagatactcctggagttctatctggcgaaaagcaacgaacacaaaggagctatgattttaccggtgtgacgtcttggtttgcttctaagtgtgatctcattcttcttttgtttgatccccacaaacttgatataagtgatgaattcaaacgtgtgattgcatctcttcgaggccatgatgataagatacgagtggttttgaacaaggctgaccaagttgatactcaacaacttatgagggtttatggagcattgatgtggtcgctagggaaggttctaaatacccctgaagtttcgcgtgtctacataggatcattcaatgacaaaccaataaatgaggctgctacagggccagttggaaaagaactttttgaaaaggagcaagatgatcttcttacagatttgaaaaacataccaaagaaggcttgtgatcgtcgtataaatgagtttgtaaaacgtgctagagctgccaagatacattcttatattatcagtcacctgaaaaaggagatgcctgcaatgataggcaaatccaagacacagcaaaaactaattgataacttggaagatcaatttgtaaaggttcaaaaggaacaccatctgccccctggggattttcctaatctcgaacacttcagagaagttctgagtggctataacattgataagtttgagaagttgaagcccaaattgatacagtccgttgatgacatgcttggttatgacatccctgaacttctcaagaatttcagaaatccttatgattgacgaggcccagagctgctgatatagtatagagtcatttcatgcagatgtgatgtttatcctcgtgtgtatcttgtattcttattcttatgtttactcccgcgttgagacctgagcgtaacagtgaatagtgaagcgata

SEQ ID NO: 7899 - DNA, 1885 bp, Solanum tuberosum
gggaaacataaaaagtgttcccctaaaagcaaggcactcagataggtgaaaaagccaattgaataatggagtttgatacatctccgattaatcggtgctccaaagatcatgagaaaatctatcaacaatggtttagtttagccgattcagatggagatggacgtctcactggcggtgatgctatcaagttctttgccatgtccaatttgcctcggcaggacctcaagcaggtgtgggcaattgcagattccaaacggcaaggctttctcggttttagagagtttattgctgcaatgcagttagtctctttggcacaagctggccacccagtaagcagtgatctcttaaatgccgaagttgactttgaaaatttgcaaccccctagcttggaaggtctggatttacttcaaactaagaaaaagcgtatgcctaaaagtgaacctgagcagaatggcagttctacagtgcaatcttctgctacagctaattggttttcatcatcttcatctgtaaagaaggtctctttaagctccgtcacatcgatagttgatggactgaagaagttgtacctccagaaactaaggccactggaagcaacatatcactataatgatttcgtctctccattactgacaaatagtgattttgatgccaaaccaatggtgatgcttttgggtcaatactcaacaggaaaaactacatttattaagcatttacttggaaccagttatccaggtgctcacattggaccagagcctacaacagacagatttgtggttgtcatgaatggacccgacgaaaggagtattcccgggaacacaattgcagttcaagcaaatatgccatttagcggtttgacaacttttggatctgcatttttgtcgaagtttgagtgttctcaaatgccacatcctctgttggagcacatcacatttgttgatactcctggagttctatcaggagaaaaacaacgaacacaaaggagctatgattttacgggagtgacgtcttggtttgcttctaagtgtgatctcattcttcttttgtttgatcctcacaaacttgatataagtgatgaattcaaacgtgtgattgcgtctcttcgaggccatgatgataagatacgggtggttttgaacaaggctgaccaagttgatactcaacaacttatgagggtttacggagcattgatgtggtctttagggaaggttctaaatacccctgaagttgcacgtgtctacataggatcatttaatgacaaaccaataaatgaggctgctatagggccaattggaaaagaactttttgagaaggaacaagatgatctccttacagacttgaaaaacataccaaagaaggcttgtgatcgtcgtataaatgaattcgtaaaacgtgctagagctgccaagatacattcttacattatcagtcatctgaaaaaggagatgccagcaatgatgggcaaagccaagacccagcaaaaacttattgataacttggaagatcaatttatgaaggttcaaaaggaacaccatctaccagctggggattttcctaacgtcgaacacttcagggaagttctgagtggttataacattgataagtttgaaaagttgaagcccaaattgatacaatccgtcgatgacatgcttggttatgacatccctgaacttctcaagaatttcagaaatccttatgattgacgaggtccagagctgatatagcatagagtaattgctggcgcctggcagacgtgatgtttattattttatggatcttgtattcttatacttactcccacattgagacttgggattaatagtgagtactgaagtaatattatcatatggtaaataaggctgcatgtaaatatgcattatgaatt

SEQ ID NO: 7900 - DNA, 2008 bp, Lippia dulcis
agtcgataaacgcgctctctcagctatagcagaataaaactggtagtttttggccggaaaatgatagagaagccattaaattaccttcagcaataaagtatgatgatcgtctgaaccaaaacatcaagccaaaaaggcgaattcgaagaagagaatggagatagattcggtcccgattagtcggtgctccaaggaacaccagaagatttatcaaaactggttctcctgcgctgattctgatggagatgggcgtctaactggagctgatgccacttaagtttttttctctctctaacatacctcgtcaagatctcaaacaggtttgggctattgctgatacaaacggcaaggctttcttggatttaaagaatttatcacagcaatgcagttaatctctttggcacaagccgggcaaactctcgccgccaatatttttaagctctctagtggactttgaaagcatacaacctccgaccatggaaggtctggatgttctccttgcaaagaaaaaacgtttatcaagagaacctgaagataatggtgatgggactcctaaagagcaatcacctgctgctggttggttttcttctacaaagtctgctaagaaggtatctctgagttctgtcacttcaattatcgatggcttgaaaaagctgtatgtgcagaagctgaagcccctggaaatgacctataagttaacgattttgtttctcctttactgaacaatagtgattttgatgctaaacccatggtaatgctactgggtcaatactccactgggaagactacatttatcaagcatttgcttaggtcaagctatccaggtgctcacattggacctgagcctacaacagatagatttgttgttgtgatgaatggacctgatgagagaagtattccagggaacactgttgctgttcgggcagacatgccgttcggtggcctaacaagttttggaacgtcgtttttgtcaaaatttgaatgttctcaaatgccacatcctctgctggaacatattacctttgtggatacccctggagttttatccggagaaaagcaacgcacccaaagaagctatgacttcactggtgtgacatcttggttcgctgcaaagtgtgatctcatcctgcttttatttgatcctcacaagcttgatattagtgatgaatttaagcgagtaattggatctttacgaggacatgatgataagatacgtgtagttttgaataaggctgaccaagttgatacacagcagcttatgcgtgtatatggagctttgatgtggtccctcgggaaagtgttaaatactcctgaggttaatcgtgtttatattggttcatttaatgacaaacctataaatgaggatgctataggtcccatcggtaaagagctctttgagggagaacgggaagatctcctgaatgatttgaagaacataccaaagaaggcctgtgatcgtcggatcaatgaatttgtaaaacgtgctagggctgctaaaatccatgcttacattatcggtcacctgaaaaaggagatgcccgcgatgatgggtaaagctaagacacagcaaaggctcatcgataacctgcccgatgaatttgcaaaggttcagagagaacaccatctaccagcaggggagtttccctcacgccgagcacttcaaggagagtttgagtgggtacaacatcgataagtttgagaagctgaagcctaaaatgatacagaatgttgatgacatgctcgggtacgacatccccgacctcttgaagaactttcgcaatccttatgattaaaaatggctggagatatatatgctcaaccactatgttttgtcacaatagcaacattttaaattggttcatcatttatgtttacactgccacatgtatagactttactcagatataatactgtatttgctgtgcacctgcatttgttaataagggtgtttaatatgcatttgttaaaagaatagaagtatatatggttaacttttgttagtattagt

SEQ ID NO: 7901 - DNA, 2058 bp, Flaveria ramosissima
gccaaaggtttggcgcctgcaccaccgaaagattagaataaaaaatatctttagactgaagttataatcttctcggcgtcggcaagatctgggagattaggggttttttttgatagattatcaataatctcttcagaaatctgtaataatctgtatgttatcagctttcattaatggagtttgattcagcagcgatcagtcggtgctctgcagaacaccagaagatctacaacgaatggttcaatgtcgccgattcagatggcgatgggcgcgttactggtgttgatgcgacgaatttcttcgttatgtccaatttagctcgacaagatctcaagcaggtgtgggcaattgcggactctaaaagacaaggctttcttgggttaaaagagtttattactgcaatgcagctgatttctatggctcaatcaggacatgaattaagcagtgacctcttaaattctgaagttgattttgaaaatctcaaaccaccggtgatggacggtctggatgtcctactagctaggaaaaggcgcccaaaaagtgagcctgaatcaaatggtaactcaccgttgcacacttcaccaacagcatcgtctagttggtttacttcaccaaaatctgcaaaaaaggttcccttaactgctgttacatcaatcattgacggcttgaagaagctgtacattcaaaagctgaaacctttagaagtcacatatcagtttaatgattttgtttctcccttattgacaaacagtgattttgatgccaaaccaatggtgatgcttttgggtcaatactcaacagggaaaacaacattcatcaaacatttgcttagaagtagttatccaggagctcatatcggacctgagcctaccacagatagatttgttgttgtaatgaatggacctgatgaaagaagtattccaggaaatactgttgctgttcaagcagacatgccctatagcggtttaactaattttggaactgcattcttgtcaaagtttgagtgttctcaaatgccacatcctctgctggagcatattacatttgtggacactcctggagtattatcaggagaaaaacaaagaacacaaagaagctatgacttcacaggtgtcacatcctggtttgctgcaaagtgtgacctaatcttgcttctgtttgatccacataaacttgatatcagtgatgaatttaaacgtgttatatcttccctaagaggaaatgatgacaagatacgtgtggtcttgaacaaggctgatcaagttgatacccaacaactgatgagggtgtatggggccctgatgtggtcacttggtaaagtccttaacactcctgaggtcatgcgcgtttacatcggttctttcaatgacaaacctataaatacggttaattctgggccaattggcacagagctgtttgaaaaagagcaggaagatcttcttagcgacttaaaggacatacctaagaaggcttgtgatcgcagaatcaatgaatttgtgaaacgagctagagcagccaagattcatgctttcattattagccatcttaagaaagagatgccgagcatgatgggcaaggctaaagctcagcagaagctcattgataacctcgaagacgtttttgcaaaggtccagagggagcatcacttaccagcgggagactttccatacgtcgaaagcttcagggagagattgagtggttataatttggacaaatttgagaaactaaagccaaaaatgatccaaactgttgatgatatgctcggttatgacatcccggatcttctaaagaacttcaggaatccgtatgattaaagccagatggtcgagaaagagggattcgatcgtgttggcatacattcatatgtagtgtaatgtgctgtgtgtacaatgaaactaagatcgtgttggatcagataccggtatgaacataatgtttattgctgctaaaaatgctttaacaaccaatcctattatggaattaaagttgtaaatttgaaattttgaagttacaaaatatgatatgaatttatgacaccaaatcagaatagtattgaag

SEQ ID NO: 7902 - DNA, 1918 bp, Helianthus annuus
atcactcaaagccataggtttggcgcttctcacgaccaaaacgaattaaaaaaaaatatcttattagactgaagttttaaacctctcttcgtcggctatagatctggctggatattattagggatttcaatatatttcagaaatctgtaataacaataatctgcatgttatagatataatggagattgattcatcggcgattagtcggtgctctgtagaacaccagaagatctacaccgaatggttcagtgttgccgattcagatggtgatggacgagttactggtgtggatgccacaaatttctttgttatgtctaatctggctagaccagatcttaaacaggtgtgggcaattgcagactctaaacgacaaggctttcttggccttaaagagtttattactgcaatgcagctgatttctatggcacaagcaggacatgtactaaatagcgacctcttaaattctgatgttgattttgaaaatcttaaaccaccggtgatggacggtctggatgccttactagctaggaaaaggcgtccaaaaagcgagcctgaatcaaatggtaattcgccgctacaaacgtcaccatcagcatcttctagctggtttacttcaccaaaatctgcaaaaaaggttcccttaactgctgttacatcaatcattgacggcctgaagaagctatacattcagaagctgaaaccattagaagtcacatatcaatttaatgattttgtttctcccttattgacaaacagtgattttgatgcgaaaccaatggtgatgcttttgggtcaatactctacagggaaaacaacattcatcaaacatttgcttagaagcagttatccaggagctcacattggacctgagcctaccacagatagatttgttgttgttatgaacggacctgatgaaagaagtattccaggaaatactgttgccgttcaagcagacatgccgtacagcggtctaactaactttggaacggcatttttgtcaaaatttgaatgctctcaaatgccacatcctctgctggagcatattacatttgtggacactcctggagtattatcaggagagaaacagaggacacaaagaagctacgacttcacaggtgtcacgtcctggtttgctgcaaagtgtgacctaatcttgcttctctttgatccgcataaacttgatatcagtgatgaatttaaacgcgttatagcttccttaagaggaaacgatgacaagatacgtgtggtcttgaacaaggctgatcaagttgatacccaacaactgatgagggtgtatggagcccttatgtggtcacttggtaaagtccttaacactcctgaagttatgcgcgtttacatcggttcttttaatgacaaacccataaattcggttactgctgggccaattgggacagagctgtttgagaaagagcaggaagatcttcttagtgacttaaaggacatacctaagaaggcttgtgatcgcagaataaacgaatttgtgaaacgagctagagcagccaggattcatgctttcataattagccatcttaagaaagagatgccgagcatgatgggtaaggctaaagctcagcagaagctcatcgataacctggaagacgtattcgcaaaggttcaaagggagcaacacctgccagcaggagactttccatttgtcgaaagcttcagggagagattgaacggttacaacttcgacaaatttgagaaactgaagccgaaattgatccaaactgtagacgatatgctcggttatgacattcccgatcttttgaagaacttcagcaatccgtatgattaaagctgtttgttggtctacatacgtatgtagtgtaatgtgctgtgtgtatcatgacaccaagagatcattgtttgtcagatacggagtatcaacatgact

SEQ ID NO: 7903 - DNA, 1987 bp, Helianthus annuus
atcactcaaagccataggtttggcgcttctcacgaccaaaaggaattaaaaaaaatatcttattagactgaagaagttttaaacctctcttcgtcggctatagatctggctggatattattagggatttcagaaatctgtaataataataatctgcatgttatagatatattcatagcatggagattgattcatcggcgattagtcggtgctctgtagaacaccagaagatctacaccgaatggttcagtgttgccgattcagatggtgatgggcgagttactggtgtggatgccacaaatttctttgttatgtctaatcttgctagaccagatcttaaacaggtgtgggcaattgcagactctaaacgacagggctttcttggccttaaagagtttattactgcaatgcagctgatttctatggcacaagcaggacatgtactaagtagcgacctcttaaattctgatgttgattttgaaaatctgaaaccaccggtgatggacggtctggatgccttactagctaggaaaaggcgtccaaaaagcgagcctgaatcaaatggtaattcgccgctacaaacgtcaccgtcagcatcatctagctggtttacttcaccaaaatctgcaaaaaaggttcccttaactgctgttacatcaatcattgacggtctgaagaagctatacattcagaagctgaaacctttagaagtcacatatcaatttaatgattttgtttctcccttattgacaaacagtgattttgatgcgaaaccaatggtgatgcttttgggtcaatactcaacggggaaaacaacattcattaaacatttgcttagaagtagttatccaggagctcacattggacctgagcctaccacagatagatttgttgttgttatgaacggacctgatgaaagaagtattccgggaaatactgttgctgttcaagcagacatgccgtacagcggtttaactaagttcggaactgcatttttatcaaagtttgagtgctctcaaatgccacatcctctgctggagcatattacatttgtggacacacctggagtattatcaggagagaaacagaggacacaaagaagctacgacttcacaggtgtcacgtcctggtttgctgcaaagtgtgacctaatcttgcttctctttgatccgcataaacttgatatcagtgatgaatttaaacgcgttatagcttccttgagaggaaacgatgacaagatacgtgtggtcttgaacaaggctgatcaagttgatacccaacaactgatgagggtgtatggagccctcatgtggtcacttggtaaagtcctaaacactcctgaggttatgcgcgtttacatcggttcttttaatgacaaacccataaattcggttactgctgggccaattgggacagagctgtttgagaaagagcaggaagatcttcttagtgacttaaaggacatacctaagaaggcttgtgatcgcagaataaacgaatttgtgaaacgagctagagcagccaggattcatgctttcattattagccatcttaagaaagagatgccgagcatgatgggtaaggctaaagctcagcagaagctcatcgataacctggaagacgtatttgcaaaggttcaaagggagcaacacctgccagcaggagactttccatttgttgaaagcttcagggagagattgaacggttacaacttcgacaaattcgagaaactgaagccaaaactgatccaaactgtagacgatatgctcggttatgacattcccgatcttttgaagaacttcagcaatccgtatgattaaagctgtttgttggtctacatacgtatgtagtgtaatgtgctgtgtgtatcatgacactaagagatcattgtttgcagatacggagtatgaacatgattattttttttgctgctaaaagtgctttgatacctcatcttcttattacagacttagtcgtaaatttaaatt

SEQ ID NO: 7904 - DNA, 1977 bp, Artemisia annua
aaaaaaatatcttcttcaactccacttttacaaacaaacgtcggtgactgttaataatagatctccaaattagggctccgatttttcaaatgctcattatttattaaaaaataaaaagaatggagatcgattcatcgtcacttagtagatgttcagctgaacatcagaaggtttatactgattggttcactctcgctgattcagatggtgatggaaggataacgggaggtgatgctaagaatttctttgttatgtctggtttatctggccatgacctcaagcaggtgtgggcgatagcagattctagacgacaaggctatcttggcttcaaagagtttattacagcaatgcagttgatttctctggcccaagcaggacaagtgttacgtagtgacatcttacaatctgatgttgattttgaatatctgcacccaccgacactggacggtctggatgctttcatagctaagaaaaagcggtcaaaaagcgattttgaatcaaatggtagtcctgaggtgcagacttccccgtcatctagttggttcacttcgacaaaatctgccaagaaggtttcattgagtaatgttacttcaattatcgacgggctgaagaaactctacattcagaagctgaaacctctagaagtgacgtatcagttcaatgatttcgtttctcccttattgaccaacagtgattttgatgccaaacccatggtgatgcttttgggtcaatactcaacagggaaaacgacatttataaagcatttgcttagaagtagttatccaggagctcacattggacccgagccgaccaccgatagatttgttgtggttatgaatggacctgatgaaagaagtattccaggaaatactgttgctgttcaagctgatatgccatacagcggtttaactaatttcggaactgcattcttgtcgaagttcgagtgttcgcaaatgccacatccgctgctggagcatattacatttgtggacacgcctggagtattatctggcgaaaagcaaagaacacaaagaagctatgacttcacaggtgtgacatcctggtttgctgcaaagtgtgatctgatcttgcttctctttgaccctcataagcttgatatcagtgatgaattcaaacgtgtcatatcatccctaagaggaaacgatgataaaatacgcgtggtcttgaacaaggctgaccaagttgatacccagcagctgatgagggtttatggagctcttatgtggtccctcggtaaagttctaaacactccagaggttatgcgtgtttacattggttcttttaatgacaaacctattaattcggttaaagctgggccaattgggactgagctatttgagaaagagcaggatgatcttcttagtgacttgaaagacatacctaagaaagcttgtgatcgcagaatcaacgagtttgtaaaacgtgctagagcagccaagattcatgcttttatcattagccatcttaaaaaagaaatgccctcgatgatgggcaaggctaaagctcaacaaaaactcattgataaccttgaagacgtttttgcaaaggttcaaagggagcatcacttaccagcaggggattttccatatgtagaaaacttcagggagaaactgggcggctacaatcttgacaacttccaaaaactgaagcccaaaatgatccaaacggtggatgacatgttgggatatgacattcctgatctgttaaagaatttcaggaacccatacgactaaagttagaagctcgtgatattgatgaaaaggggtgtgtttgtccatcatgtaatgtcgtttgtatacattcatgtgtagagtagtgtgtaccatgtcactggcgattatcatcttcagatatttgcagttttgaagttgaagttatgagtttattttctttataaactggtgatgcattatgattgttgatacaatcaatcacaaaatttgaactcttgagaat

SEQ ID NO: 7905 - DNA, 1894 bp, Solanum phureja
ggaaacataaaaagtgttcccctaaaagcaaggcactcagataggtgaaaaagccaattgaataatggagtttgatacatctccgattaatcggtgctccaaagatcatgagaaaatctatcaacaatggtttagtttagccgattcagatggagatggacgtctcactggcggtgatgctatcaagttctttgctatgtccaatttgcctcggcaggacctcaaacaggtgtgggcaattgcagattccaaacggcaaggctttctcggttttagagaatttattgctgcaatgcagttagtctctttggcacaagctggccacccagtaagcagtgatctcttaaatgccgaagttgactttgaaaatttgcaaccccctagcttagaaggtctggatttacttcaaactaagaaaaagcgtatgcctaaaagtgaacctgagcagaatggcagttctacagtgcaatcttctgctacagctaattggttttcatcatcttcatctgtaaagaaggtctctttaagctccgtcacatcgatagttgatggactgaagaagttgtacctccagaaactaaagccactggaagcaacatatcactttaatgatttcgtctctccattactgacaaatagtgattttgatgccaaaccaatggtgatgcttttgggtcaatactcaacaggaaaaactacatttattaagcatttacttggaaccagttatccaggtgctcacattggaccagagcctacaacagacagatttgtggttgtcatgaatggacccgatgaaaggagtattccagggaacacaattgcagttcaagcaaatatgccatttagcggtttgacaacttttggatctgcatttttgtcaaagtttgagtgttctcaaatgccacatcctctgttggagcacatcacatttgttgatactcctggagttctatcaggagaaaaacaacgaacacaaaggagctatgattttacgggagtgacgtcttggtttgcttctaagtgtgatctcattcttcttttgtttgatcctcacaaacttgatataagtgatgaattcaaacgtgtgattgcgtctcttcgaggccatgatgataagatacgggtggttttgaacaaggctgaccaagttgatactcaacaacttatgagggtttacggagcattgatgtggtctttagggaaggttctaaatacccctgaagttgcacgtgtctacataggatcatttaatgacgaaccaataaatgaggctgctatagggccgattggaaaagaactttttgagaaggaacaagatgatctccttacagacttgaaaaacataccaaagaaggcttgtgatcgtcgtataaatgaattcgtaaaacgtgctagagctgccaagatacattcttacattatcagtcacctgaaaaaggagatgcctgctatgataggcaaagccaagacccagcaaaaacttgttgataacttggaagatcaatttatgaaggttcaaaaggaacaccatctaccagctggggattttcctaacgttgaacacttcagggaagttctgagtggttataacattgataagtttgagaagttgaagcccaaattgatacaatccgtcgatgacatgcttggttatgacatccctgaacttctcaagaatttcagaaatccttacgattgacgaggtccagagctgatatagcatagagtaattgctggcgcctggcagacgtgatgtttattattttatggatcgtgtattctcattctaactcccacattgagacttgggcttaatagtgagtactgaagtaatagtatcatatggtaaataaggctgcatgtaaatatgcattatgaattctacatccgg

SEQ ID NO: 7906 - DNA, 1939 bp, Solanum lycopersicum
agtgaaggaaaatggaaacataaatatcgttcccctaaaagcaaggcactcaaataggtgaaaaaggcaatagaacaatggagtttgatacatctccgattaatcggtgctctaaagatcatgaaaaaatctatcaacaatggtttagtttagcagattcagatggagatgggcgtctcaccggcggtgatgctatcaagttctttgccatgtccaatttgcctcggcaggacctcaagcaggtgtgggcaattgcagattccaaacggcaaggctttctcggttttagagagtttattgctgcaatgcagttagtctctctggcacaagctggccacccagtaagcagtgatctcttaaatgccgaagttgactttgaaaatttgcaaccccctagcttggaaggtctggatttacttcaaactaagaaaaagcgtatgcctaaaagtgaacctgagcagaatggcagttctacaatgcaatcttctgctacagctaattggttttcatcatctgcatctgttaagaaggtctctttaagctccgtcacatcgatagttgatggactgaagaagttgtacctccagaaactaaagccactggaagcaacatatcactttaatgatttcgtctctccattactgacaaatagtgattttgatgccaaaccaatggtaatgcttttgggtcaatactcaacaggaaaaactacatttattaagcatttacttggaaccagttatccaggtgctcacattggaccagagcctacaacagacagatttgtggttgtcatgaatggacctgacgaaaggagtattccagggaacacaatagcagttcaagcaaatatgccatttagcggtttgacaacttttggatctgcatttttatcaaagtttgagtgttctcaaatgccacatcctctgttggagcacatcacatttgttgatactcctggagttctatcgggagaaaaacaacgaacacaaaggagttatgattttacaggagtgacgtcttggtttgcttctaagtgtgatctcattcttcttttgtttgatcctcacaaacttgatataagtgatgaattcaaacgtgtgattgcgtctcttcgaggccatgatgataagatacgggtggttttgaacaaggctgaccaagttgatacccaacaacttatgagggtttatggagcattgatgtggtctctagggaaggttctaaatacccctgaagttgcacgtgtctacataggatcatttaatgacaaaccaataaatgatgctgctatagggccaattggaaaagaactttttgagaaggaacaagatgatctgcttacagacttgaaaaacataccaaagaaggcttgtgatcgtcgtataaatgaattcgtaaaacgtgctagagctgccaagatacattcttacattatcagtcacctgaaaaaggagatgcctgcgatgataggcaaagccaagacccagcaaaaacttatcgataacttggaagatcaatttatgaaggttcaaaaggaacaccatctaccagctggggattttcctaacgtcgaacacttcagggaagttctgaatggttataacattgataagtttgagaagttgaagcccaagttgatacaatccgtcgatgacatgctgggttatgacatccctgaacttctcaagaatttcagaaatccttacgattaacgaggtacatagctgatatagcatagagtaattgctggcaccggacgtgatgtttagtattttatggatcttgtattcttattcttacacccacattgagacttgggcttaatagtgagtactgaagtaatattatcatatggtaaataagactgcatgtaaatatgcattatgaattatacatccgggaagatcttttacttttgtgctgtttttatattttt

SEQ ID NO: 7907 - DNA, 2187 bp, Cajanus cajan
gaatcagcaagcaaagcaaagcaaagagcgtatttggcgcatttagaagatacttgctcgcaactttacttcacactgtttggtaaacgaaacaagcaatgttcgttaaagcagcgtttctgcgccaacactggttagtttccatcgccaatacgacacggctagtgcaagtcctcctcgtcgtttagcactcacgttttcttttcactgaaaagtaaaaataaataaaaaagcacagcatcatcccaaacgctacgagatctcaatcacgcgatttcgaagcttttctgcgaccaatggagttcgacccgatcccagtcggttcgtgctccaaagaacaccagacgatctataaggactggttcaatatcgctgattcagataacgatggccgcattacggggagtgatgccaccaagtttttcgccatgtccaatttgtctcgccaagatcttaagcaggtgtggtctattgctgattcaaagcgacaaggatatcttggtttcactgaatttatcattgctatgcagctagtttctttggcacaatctgggcactcaataacacaagatctgctgactagtgatgttgattttagaaatttgaaacctcccacaatggacggtttggacatattacttaagaaaaagcataaacaaaaagatgttgatgcaaatggtagtcctcaattgcaccaaccactatcaagtaattggttttcttcaaagtcaaccaaaaaggcaagcattttgttactgtgtcgctttcctctgtgacatcaataattgacggcttgaaggggctttatattcagaagttgaagcctttagaagttacttaccgctttaatgattttgtatccccattactgacagagagtgactttgatgccaaaccaatggttatgcttttgggtcagtactcaactggtaaaacaacatttatcaaacatctacttaaaagtagctatccaggagcacatattggacctgagcctacaactgataggtttgttgttgtcatgtctggaactgatgaaagaaccgttcctggaaatacagttgctgtccaagcagacatgccatttagtggtcttacaacttttggcacagcatttttgtcaaaatttgcatgttcacaaatgcctcatccactattggaacacatcacatttgtcgacactcctggagttctatctggagaaaagcaacggacacaacgagcatatgattttacgggtgtaacatcttggtttgctgctaagtgtgatttaatactcttgctgtttgatcctcacaaacttgatattagtgatgagttcaatcgtgtgatatcatctttacggggacatgatgacaaaattcgagtggttttgaataaggcagatcaagttgacacccaacaactgatgagggtttatggagccttaatgtggtcacttggaaaggtgctgaagacacctgaagtgatgcgcgtgtatattgggtccttcaatgacaagcctgtgaatgatgctgtcactggtccaattggtaaagaactctttgaaaaggaacaggatgatcttctttcggatctgaaagatgtaccaaaagcggcttgtgatcgaagaatcaatgagtttgtaaaacgggcccgagcagccaagatacatgcttatattatcagtcatcttaaaaaggaaatgcctgcaatgataggtaaagctaaagctcaacaaaagctcgttgataatttggcaggggaatttggaaaggtgcagagggagttccatttacctcctggtgatttcccaaatgtagagcattttagagagaccttgagtggttacaatattgataagtttgaaaaactgaaaccgaaaatgatacaagcagttgatgacatgctagcttatgacattcctaacctcttgaagaattttaggaatccctatgattaaatttctgagcaattgtgtcggtgatataattagattagttgtgacatttgtgtcatacaaattttacggggtctttatgtaatgtacgtgcctcatggaatctttatgtgccatctggtgccccttcttctgtattaggaagtagtattattccatatctgtttttgtatttgatcttgttatctacaataaagttttaagacaaaataaagggtaaacacaattacttgttcgtgcaaagttaa

SEQ ID NO: 7908 - DNA, 2225 bp, Cucumis sativus
ctccaattcccatttcccccccttgctctctctctctcgctctcttcgcttccgtttccagttccttctcccttctctctcctcaaaagagggacgaactgaaagggagagaactccggaatcagttcttctgtgtttttcattccattgattgtttcttctttttcctgatctcggaattcgcctggaactggaacatacggaatcaagcggtggaagaagcatttcaccggagctttataaccactatatccgctcttttctgatcaccttttatggaaatcggttcctatcctatcggttcctgctcccgagatcatcagaagatctatcaagaatggtttgattacgctgattctgatggtgatgggcgtattacggggaatgatgctattaagttcttttccatgtcgactttgcctcgccaagatctcaagcaggtgtgggcaattgcagattccaagcggcaaggatatcttgggttcaaggagtttgttactgcaatgcagcttgtctctctggcgcaatcgggtggggaagtaactcatgatgtattgacttcaaatagcgaagcaactttatctttgcaatttatgaacggaggctcattcatgcttttgctttcctcttttaacttggtaattgatgactttgcaggtagctctaaggggcagtcacctgtttcagcaagttggttttcatcgaagtcatctaaaaagatacctctttcttccgttacatcgatcgttgatggtttgaaaagactttatattcagaagttgaagcccttagaagttagttatcgatttaatgattttgtttctccattactggcaaatagtgacttcgatgctaaaccaatggttatgcttttgggtcaatactctaccggcaaaacgacatttatcaaacatctgctgaaaagcagttatccaggagcccacattggaccagaacctacaactgacagatttgttgttgttatgtctggacctgatgaaagaagcattcctggaaatacgattgctgtccaagcagacatgccatttaatggtctgacaacatttggaacttcttttctatcaaaatttgagtgttcacaaatgccgcatcctctgctagaacacattacgtttgtggatactcctggagttctgtctggagaaaaacaacgaacacagcgagcatatgagtttacatctgttacatcatggtttgctgccaagtgcgatcttattttacttttatttgatccccataaacttgatattagtgatgaattcaaacgggttatagcttcattacgtgggcatgatgacaaaattcgagtagtcttgaacaaggcagaccaagttgacacgcagcaattgatgagggtttatggagcattaatgtggtcgcttgggaaggttctgaatactcctgaggttgtacgtgtttatattggctcgtttaatgacaaacctgttaatgaagccgttacaggtccgctcggaaaagacctctttgaaaaagaacaggaagatcttctttctgatttgaaggatatcccaaagaaggcatgtgatagaagaattaatgaattcgttaagcgagcaagagctgctaaaattcatgcctacattataagccatcttaggaaagagatgcctaccatgatcggcaaagccaagacccaacagcgactaatcgataatttggctgatgaattcggaaaggtacaaagagaatatcacttacccgctggagatttcccaaacgtcgaacaattccgagaaacattaagcggttacaacttcgacaaatttgaaaagttgaaaccaaaaatgattcagtcggtggatgacatgttgggatatgatgtcccagaccttttgaagaactttagaaatccctatgactaaatgagatcggagtttcaggtacgcacacggctgctttaacattcattcaaggttttcttgaacttaaatgttttaaccccaatatcaatgttttaattattataatgtataattataagtatagtctattggaagcatagttagcaagcattaatttgtccatcagcattcattctttcaagttatttttctatttaataataattaaaacaattcatatgtattattttgtatttattggagctttgccattcaggtatacttttaacattcagtttcgtcatgtatacctccatgcatagagaattttgttttattggt

SEQ ID NO: 7909 - DNA, 2542 bp, Echinacea purpurea
cggccgggggaaagaacgagagaggaaatgggtattgacatatgttctcgttatcggatatttgctccaaaacacaacatacaaagtctaaaacaaaccatattgacctacatttgagttcattcaagtgactgcaactgtacgtaatggtgtgaatatactaatcccaatcccattgaagttaacatcactcaaagccaaaagggtttggcgctcacacggaataataaaaatatcttcattcgttttaaacctcgtcgccgagatctggaaattagggattctatttcatttatcctcaaatcatcattcagaaattatctgtaatctgcatgttatcatcgattttatagtatggagattgattcatcagctattagtcggtgctctcttgaacaccagaagatctatcaagagtggttcagtgtcgctgattcagatggtgatgggcgcttaactggttccgatgccacaaatttcttcgtcatgtctaatctagctcgaccagatcttaagcaggtttgggcaattgcggactctaaacgacaaggctttcttggctttaaagagtttattactgcaatgcagctgatttcgatggcacaagcaggacatgtattaagtagtgacctcttaaattctgaagttgattttgaaaatctgaaaccacccgtgatggacggtctggatgtcttactagctaggaaaaggcgtccaaaaagtgatcctgaatcaaatggtaattcgccgctgcaaacttcaccatcactatcatctagttggtttacttcagcaaaatctgccaaaaaggttccattgactgctgttacatcaatcattgacggcctgaagaagttgtacattcagaagctaaaacctttagaagtcacatatcagtttaatgattttgtttctcccttattgacaaatagtgattttgatgccaaaccaatggtgatgcttttgggtcaatactcaacagggaaaacaacatttatcaaacatttgcttagaagtagttatccaggagctcatattggacctgagcctaccacagatagatttgttgttgttatgaatggatccgatgaaagaagtattccaggaaatactgttgctgttcaagcagacatgccgtatagtggtctaacgaactttggaactgcatttttgtcaaaatttgaatgctctcaaatgccacatcctctgctggagcatattacatttgtggacactcctggagtattatctggagagaaacaaagaacacaaagaagttatgactttacaggtgtcacatcttggtttgctgcaaagtgtgacctaatcttgcttctctttgatcctcataaacttgatgtcagtgatgaatttaaacgtgttatatcttccctaagaggaaatgatgataagatacgtgtggtcttgaacaaggctgatcaagttgatacccaacaactgatgagggtgtatggagccctaatgtggtcacttggtaaagtcctaaacactcctgaggttatgcgcgtttacatcggttctttcaatgacaaacctataaattcggttacttctgggccaattgggacagagctgtttgagaaagagcaggaagatcttcttagcgacttgaaggacatacctaagaaagcttgtgatcgcagaatcaacgagtttgtgaaacgagctagagcagcaaggattcatgctttcattatcagccaacttaagaaagagatgccgtctatgatgggtaaggctaaagctcagcagaagctcatcgataacctggaagacgttttcgcaaaggttcaaagggaacaacacttgccagcaggggacttcccttatgttgaaagcttcagggagaggttgagcggttacaactttgacaaatttgagaaactgaagccgaaattgatccaaactgtagatgatatgcttggttatgacatccccgaccttttaaagaactttagtaatccgtatgaatgaagctttttgtcgatcctgttggtatacatacatgtgttgtgtaatttgctgtgtgtatcatgacactaagagaacattgtttgcagatacagagtatgaacatgatttttatttgctgccaatagtgctttgataactattcttcttattacatagttaaagtcgtaagtttgaattttgaagttgcaaaccaacacccagctatttaaatttgggtggcaaataccacgcgtcactgcgttggcatggactatataaaataaaacctagtttgcatttactgctacgggatctgtgatctttatgatttcacggtttctttagagaagttcttttgggaataaaccaataggaaaaatgctgatagagaaacaactcagctgtgtagtttcaaaccaactcaaaactcagttaggtatcattttactcatagtttcctgctatttaatcatttggtttgatttgcataactgtttaatgtttgtgtaatgcatgtttcaattgtgtagctatttattaatatgcatttggtttcatggcgccggag

SEQ ID NO: 7910 - DNA, 1737 bp, Brassica oleracea
ctttctcagaaaccgtaatctcacgtattcaaaaactccttttgaactcccaaatctggattcacacctatctcggagatggagatcgattccgtcgcagctggctcttgctccaaggagaatcaaattatctacaaggactggttcgaattcgccgattcagacggagatggacgcattactggtagcgatgcgatcaagttcttctccatgtccaatctgcctcgacctgagttgaagcaggtctgggcgattgcagatgcaaagagacaaggctatcttggattcaaagagtttatcgttgctatgcagcttgtttctttggctcaaactggacatgagatatcgcatgaagttcttcatagtgacgcagttgatttcaaaaatatgaatcctcctgttatggatggtctcatcgtattaatggcgaagaagaagaaacattcaccaaagtcgagcgatccgaatggtagtcctgctgcagatgcatcacttacagctcattggttctcttccaaatcttcaaaaaagatttctctgtcctccgtaacatctataatcgatggcctgaagaggttgtacattcagaagctgaagccacttgaagttgcttatcagtttaacgattttgtatctcctttgttgacgaacagtgatttcgacgccaaacctatggtaatgcttctgggtcagtactccacagggaaaacaactttcattaagcatatgcttaaatctagttatccaggagctcatattggaccagaaccaactactgacagatttgttgtcgtcatgtctggacctgatgaaagaagtatcccggggaacacagtagcggttcaagcagatatgccattcagtggtcttacaagttttgggacggcctttttgtcgaagtttgaatgttcgcagatgcctcaccctctgctggagcacataacatttgtagacacacctggagttttatctggggagaagcaacggactcaacgagcatatgaattcacaggtgttacatcatggtttgcctcgaagtgcgatctcatcctcctcctgttcgatccacacaagctggatgtaagcgatgagtttaagcgggttatttcatctttacgtggtcatgatgacaagatccgcgttgttctgaataaggcagaccaggtggacactcagcagctaatgagggtgtatggagctctcatgtggtcacttgggaaagttctcaatactcctgaggttgcccgtgtctacattggatcgttcagtgataaacccattaacgaagcttcaactggtccaattgggagagaattgtttgaaatggagcaagaagatcttctctctgatctgaaaaacattccaaagaaagcttgtgatcggcgaataaatgagtttgtgaaacgggcaagagctgcaaagatacatgcgtacatcatcagccatttgaagaaagagatgccagccataatgggaaaagccaaagctcaacaaaaactgttggataacttggaagacgtctttggaaaggtacaaagagagcatcatttaccaaaaggagatttcccaaacgtggaccagtttagggaggtgctaagtggttacaacttcgacaagtttgagaagctaaagccaaaaatgttgcagactgttgatgatatgttggggtatgacattccggagctcttgaaaaatttcaaaaacccttatgattaaatactattatcccgtcttagc

SEQ ID NO: 7911 - DNA, 1946 bp, Rosmarinus officinalis
ccggggggtcgctcacacacacagctagctaacacaacttgggagtttttgcccggattgaaagaaaagctataaattaccttcacaaaaacagagtggtgatcgtttgaaccaacaaatccaaccaataagccggattcggagaagagaatggagatagattcggccccgattagtcggtgctccaaggagcaccagaagatttatcaagagtggttctcttgcgctgattccgatggtgatgggcggctaactggagctgatgcaaccaagcttgggccattgctgatacaaaaaggcaaggcttccttggatttaaagagttcatcacagcaatgcagctaatctctttggcacaagctgggcaaactctcaccagcaatattttaacctctctagttgactttgaaagcatacaacctccgaacatggaaggtctggatgtgctccttgcaaagaaaaaacgtttatcaagagaacccgaagagaatgggactcctcaagagcaatcacctgcagctggttggttttcttctacaaagtctgcaaagaaggtatctctgagctccgttacttcaattgtcgatggcttgaagaagctgtatgttcaaaagctgaagcccctggaaatgacctatcggtttaatgattttgtttctcctttactgaacaatagtgattttgatgctaaacccatggttatgctactgggtcaatactccactgggaagacaacatttatcaagcatctgcttaggacaagctacccaggtgctcacattggacctgagcctacaacagatagatttgttgttgtgatgaatggacctgacgagagaagtattccagggaacactgttgctgttcaagctgatatgccgttcagtggcctaacaaattttggaacgtcgtttttgtcaaaatttgaatgttctcaaatgccacatcctctgctggagcatattacctttgtggatactcctggagttttatctggagaaaagcaacgcacacagagaagctatgatttcactggtgtgacatcttggttcgcctcaaagtgtgatctcatcctgcttctgtttgatcctcacaaacttgatataagtgatgaatttaaacgagtaatcggatctttacgaggacatgatgataagatacgtgtagttttgaataaggctgaccaagttgatacacagcagcttatgcgtgtatatggagctttgatgtggtcacttgggaaagtgttaaatacccctgaggttaatcgtgtttatattggttcatttaatgacaagcctataaatgagggtgctattggtcccatcggtaaagagctctttgagagagaacaagaagaccttctgaatgatttgaaagacataccaaagaaagcttgtgatcgtcgtatcaatgaatttgtaaaacgtgctagggctgctaagattcatgcttacataattggtcacctaaaaaaggagatgcccgcaatgatgggtaaagctaagacacagcagaggctcatcgataatctgcctgatgaatttgcaaaggttcaaagagaacaccatctaccagcgggggatttccctcacgtcgagcactttaaggagagtttgagtgggtacaacttagacaagtttgagaagctgaaacctaaaatgatacaaagtgttgatgacatgcttgggtatgacatccctgacctcttgaagaacttccgcaatccttatgattaaaaatgttagatatcttcaactactatgtttggtcactactagtaaagaggaacattaaatcggttcatcattaaattggtcacctgtatagactatctatttgagtaagcctattataatagtttcgctcaatgattgtgttctatactctgatttaatattgtatttttgtacacctgcatttgttaacaagggtgttaagtgagc

SEQ ID NO: 7912 - DNA, 2041 bp, Brassica rapa
ttgtataaaaatatagggccgtttcgtgcattctaaatctcttcccccccccccccccccccccccccccccttgccgtcgagacgaagaacccgctttctcagaaaccgtaatctcacgtattcaaaaactccatttgaactcccaatctctgcaaatctggattcacacctatctcggagatggagatcgattccgtcgcagctggctcttgctccaaggagaatcaaattatctacaaggactggttcgaattcgcagattcagacggagatggacgcattactggtagcgatgcgatcaagttcttctccatgtccaatctgcctcgacctgagttgaagcaggtctgggcgattgcagatgcaaagagacaaggctatcttggattcaaagagtttatcgttgctatgcagcttgtttctttggctcaaactggtcatgagatatcgcatgaagttcttcatagtgacgttgatttcaaaaatatgaatcctcctgttatggatggtctcatcgtattaatggcgaagaagaagaaacattcaccaaagtcgagtgatccgaatggtagtcctgctgcagatgcatcacttacagctcattggttctcttccaaatcttcaaaaaagatttctctgtcctccgtaacatctataatcgatggcctgaagaggttgtacattcagaagctgaagccacttgaagttgcttatcagtttaacgattttgtatctcctttgttgacgaacagtgatttcgacgccaaacctatggtaatgcttctgggtcagtactccacagggaaaacaactttcattaagcatatgcttaaatctagttatccaggagctcatattggaccagaaccaactactgacagatttgttgtcgtcatgtctggacctgatgaaagaagtatcccggggaacacagtagcggttcaagcagatatgccattcagtggtcttacaagttttgggactgcctttttgtcgaagtttgaatgttctcagatgcctcaccctctgctggagcacataacatttgtcgatactcctggagttttatcaggggagaagcaacggactcaacgagcatatgaattcacaggtgttacatcatggtttgcctcgaagtgcgatctcatcctcctcctgttcgatccacacaagctggatgtaagcgatgagttcaagcgggttatttcatctttacgtggtcatgatgacaagatccgcgttgttctgaataaggctgaccaagtggacactcagcagctaatgagggtgtatggagctctcatgtggtcacttggaaaagttctcaatactcctgaggttgcccgtgtctacattggatcgttcagtgataaacccattaacgaagtttcaactggtccaattgggagagaattgtttgaaatggagcaagaagatcttctctctgatctgaaaaacattccaaagaaagcttgtgatcggcgaataaatgagtttgtgaaacgggcaagagctgcaaagatacatgcgtacatcatcagccatttgaagaaagagatgccagccataatgggaaaagccaaagctcaacaaaaactgttggataacttggaagacgtctttggaaaggtacaaagagagcatcatttaccaaaaggagatttcccaaacgtggaccagtttagggaggtgctaagtggttacaacttcgacaattttgagaagctaaagccaaaaatgttgcagactgttgatgatatgttggggtatgacattccggagctcttgaaaaatttcaaaaacccttatgattaataatactattatcccgtcttaagctatgtgcttactgtttcaaacctaatcatgcactcacctttggccctagaacttcctttttgagcataaatgcacatttgtattcttaaaagacttgtataccattaagacacaaagagtacttacaaaacaaaagtattgaatatcaatatcaagtcttggcattgtttggtttatggtggtgcacctttgaattataa

SEQ ID NO: 7913 - DNA, 1798 bp, Chrysanthemum coronarium
tggagatcgattcatcatcacttagtagatgctcagctgaacatcagaaggtgtacactgattggttcactctcgctgattccgatggtgatggaaggataacgggaggcgatgctaagaatttctttgttatgtccggtttatctggacacgaccttaagcaggtgtgggcgatagcagattctagacgacaaggctatctaggcttcaaagagtttattacagcaatgcagctgatttctctggcccaagcaggacaagtgttacgtagtgacatcttacaatctgatgttgattttgaatatctgcacccaccaacactggatggtctggatgcgttcatagctaagaaaaagcggtcaaaaagcgattttgaatcgaatggtagtcctgaggtgcagacttcgccgtcatccagttggttcacttctacaaaatctgcaaagaaggtttcattgagtaatgttacttcaatcatcgatgggctgaagaaactctacattcagaagctgaaacctctagaagtgacgtaccagttcaatgattttgtttctcccttattgaccaacagtgattttgatgccaaacccatggtgatgcttttgggtcaatactcaacagggaaaacgacatttattaagcatttgcttagaagtagttatccaggagctcacattggacccgagccgaccaccgatagatttgttgtggttatgaatggacctgatgaaagaagtattccaggaaatactgttgctgttcaagctgatatgccatacagtggtttaactaatttcggaactgcattcttgtctaagttcgagtgttcccaaatgccacatccgctgctggagcatattacatttgtggacactccgggagtattatcaggcgaaaagcaaagaacacaaagaagctatgacttcacaggtgtgacatcctggtttgctgcaaagtgtgatctgatcttgcttctctttgatcctcataagcttgatatcagtgatgagttcaaacgtgtcatatcatccctaagaggaaatgatgataaaatacgtgtggtcttgaacaaggctgatcaagttgatacccaacagctgatgagagtttatggagctcttatgtggtccctcggcaaagttctaaacactccagaggttatgcgtgtttacattggttcttttaatgacaaacctattaattcggttaaagctgggccaattgggactgagctatttgagaaagagcaggatgatcttcttagtgacttgaaagacatacctaagaaagcttgtgatcgcagaatcaacgagtttgtaaaacgtgctagagcagccaagattcatgcttttatcattagccatcttaaaaaagaaatgccctcgatgatgggcaaggctaaagctcaacaaaaactcattgataaccttgaagatgtttttgcaaaggttcaaagggagcatcacttaccagcaggagattttccgtatgttgaaaacttcagggaaagactgagcggttacaatcttgacaacttccaaaaactgaagcccaaaatgatccaaacggttgatgacatgttggggtatgacattcccgatctgttaaagaatttcaggaacccatacgactaacgttacaagctcatgatagtgaggaaaagcggtatgtttgcccatcatgtaatggcgtttgtatacattcatgtgtagagtagtgtgtaccatgtcactggcgattgttattttcagatatttgcagttttgaagttgaagttacgagtttattttctttataa

SEQ ID NO: 7914 - DNA, 2074 bp, Chrysanthemum coronarium
aaataatcactctcactcaaaggcagcctttggcgcccctcacacgtcaaaaacccccaaaaaaataaatatcttcaaatccactcatcaatcatcactatttgtcggtgatccatcccaaataatcaaatcaaatcaaaattagggctccaaatcatcaaatggagttcgattcatcgtcgcttagtagatgttcagctgaacatcagaaagtctacaccgattggttcaatctcgctgattcagatggcgatggaaggataactggaggcgatgcgaaaactttcttcgttatgtccggtttatccggacacgatctcaagcaggtgtgggcgatagcagattctagacggcaaggctatcttggctttaaagagttcgttacagcaatgcagttgatttctctggcccaagcaggacaagtgttacgtagtgacatcttacaatctgatgttgattttgaatatctgcacccaccgacattggacggtctggatgcctttatagctaagaaaaagcggtcaaaaagcgattttgaatcgaatggtagtcctgaggttcagacttctccatcttccagttggtttacttcgtcaaagtctgcaaagaaggtttcattgagtaatgttacgtcaatcattgatgggctgaagaaactctacattcagaagctgaaacctttagaacaaacgtatcagttcaatgattttgtttctcccttattgaccaacagcgattttgatgccaaacccatggtgatgcttttgggtcaatactcgacagggaaaacgacattcatcaagcatttgcttagaagtagttatccaggagctcatattggacctgagccgacaacagatagatttgttgtggttatgaatggacccgatgaaagaagtattcccgggaatactgtggctgttcaagctgatatgccatacagtggtttaactaattttggaactgcattcttgtcgaagttcgagtgttcgcaaatgccacatccgctgctggagcatattacatttgtagacactcctggagtattgtcaggcgaaaagcaaagaacacaaagaagctatgactttacaggtgtcacgtcatggttcgctgcaaagtgtgatctgatcttgcttctctttgatcctcacaagcttgatatcagcgatgagttcaaacgtgtcatagcatccctaagaggaaatgatgataaaatacgcgtggtcttgaacaaggctgatcaggttgatacccaacagctgatgagggtgtatggagctcttatgtggtccctcggtaaagttcttaacactccagaggttatgcgtgtttatatcggttctttcaacgacaaacctattaatacggctactgctgggccacttgggactgagctattcgagaaagagcaggaggatcttcttagtgacttgaaagacatacccaagaaagcttgtgatcgcagaattaacgagtttgtaaaacgtgctagagccgccaagattcacgcttttatcattagccatcttaaaaaggaaatgccctcgatgatgggcaaagctaaagctcaacaaaaactcattgataaccttgaagacgttttcgcaaaggttcaaagggagcatcacctaccagcaggagattttccgtatgttgaaaacttcagggagagactcggcggttacaatctagacaacttccaaaaactgaagcccaaaatgatccaaacggtcgatgacatgttggggtatgacattcccgacctattgaagaatttcaggaacccatatgactaatgttagaagctcgtgatattttgagaaaaagggatgtttgtccatcgaccatcgtgtaatggcgtttgtatacgttcatgtgtagagtagtgtgtaccatcactggagattgttcttttcagatattgcagttttgaagttgaagtcatgatatttcttccgaaaaactttattttattttcaaattgttaatgcgtcatgattgacgatgcagtcaatttcaatatttgaactcttggctcttgaataaataaatgaaggtcccatgacttacgaaa

SEQ ID NO: 7915 - DNA, 1781 bp, Musa acuminata
gctctgtactgctctctctctctctctctctctctttctcattttcccttcttttgccctagacgatgaatctggtgtcgtcttccgtcgcttcttgccccaaggagaagcagaagatataccaggagtggttctcagtcgccgacaaggatggagacgggcgcatcacggggaacgacgcgctcaagttcttcgccatgtcgaagctgtcccggtccgaacttaagcaggtctgggccattgcagactctaagcggcagggttttcttgatctccaagagttcattaacgcaatgcagcttgttgcactggctcaagaagggcatgagatgactccagatttgcttaatcatgcagacttggagaacttaaaaccgccagtgatggaaggtttggatattcgactagctaaatcaaagcgctcagaaaagaaaagcgatccttgttcagatgtaccaccacagcctcaatcacctgcatcagctcgctggtttaactcaaaatcagcaaaaaagataccttcaaagtcagtcacctcaattatcgatggtttgaagaaattatatattgagaaactgaagcctttggaagttacctatcaattcagtgattttgtttctcccttgttgacaaatagtgatttcgatgccaagcccatggttatgctcttgggtcaatattctactggaaagaccacattcataaaacatttattgaaatctagctatccaggtgcacatattggaccagaacctacaaccgatagatttgttgttataacatcaggaccagatgagagaagcattcccgggaatactattgctgttcaagcagatatgccttataatggcctgactgcatttggcactggctttttatcaaagttcgagtgttctcagatgccccatccacttttggaacacattacttttgttgatactcctggtgttttatctggggagaaacaacgaactcaacgcagttatgacttcactggggtgacatcatggtttgcagcaaaatgtgaccttgttcttctcctgtttgatccttataaacttgacatcagtgatgagtttaagcgtgtaattggatccttgcgtggtcatgatgataaaatacgtgttgttctgaataaggcagaccaagttgacacccaacagctcatgagagtttatggggcattgctgtggtctcttggaaaagttctgaacacccctgaagtgatgcgagtgtacattggttcgtttaatgacaaaccgataaatgaagcagaacatgctgtcattggaaagttgtttgaaaaagagcaagaagatctcctttctgatctgaatgatatcccaaaaaaggcttgtgaccgtcgtatcaatgaatttgtgaagcgtgcaagagcagccaaggttcatgcatgcataattagtcatctgaagaaggagatgcctgcaatgatgggcaaggctaaggctcagcagaaacttatagataacctggaagaagagtttttaaaggtccagaaggagttccacttagcaccaggagacttccccaatgtcgaccagttcagagaggtgttgggtggatacaatattgacaaatttgagaagatgaagcataaaatgatacaggcagtggatgatatgctggggtatgacatcccagaacttttgaagaggttcagaaacccatatgactgaggatgcctcacactgaatagtgaaacatggtctgttgctctcgagagaccaagttgtaacgaagtagatgttgagcttgtactt

SEQ ID NO: 7916 - DNA, 1823 bp, Malus domestica
tctctctctctctctctctctctctctggttttcaaatttctgagtgaagttcctcctgttttcgtccgaatggagattggatcgggtcggaccggtgtgtgcccgaaagagcatcagaagatttaccaggagtggttcaacttggttgattccgatggcgatggccgtattactggaaacgaagccaccaagttcttcgccatgtcgaagctttctcgagaagaactcaagcaggtttgggcgattgctgacacgaaacggcagggatttttggggttttcggagttcgtgactgcaatgcagatgatttccttggcacaagaacatgaactaagcccagacatcctcaaaaccgcagttgactgggaaaacattaaacctccagtaatagaaggtttggatgatttgatagctaaaaccaagagtttaacaacatatggagttgaagtaaatggaactgctcaatttcaaccatcagttcagcggtttggttcaaaatcagcaaagaaactccctcctaatgctgtgacttctatcgttgatggcttgaagagattgtacaatgagaaactaaagcctttggaacttgcatatcgtttcaatgattttgcatctccatcgttgactaatagtgattttgatgctaaacccatggtcatgcttttgggtcagtattcaactgggaaaacaacatttattaaacatttgttacgatgcgactatccaggagctcacattggaccagaacctactacagatagattcgttgtagtgatgtctggacctgatgagaggagtattcctggaaatactatagctgttcatgcagacatgcctttcagtggtctaacaactttcggaggtgcatttttgtcaaaatttgagtgttcacaaatgccacatccattgctagatgaaattacatttgtggacacccctggagttctatctggagaaaagcaacgaacgcaaaggagctacgatttcactggtgctatatcatggtttgcagcaaaatgtgatgtcattcttcttctgtttgatcctcataagctcgacatcagcgacgagtttaagcgtgttatttcatctctacgtggtcatgatgacaagattcgagtggtcttgaataaagctgatcaagttgatactcaacaactgatgagagtttatggggcattgatgtggtcgcttggaaaagttttgaatactccggaggtcgtgcgtgtttatatcggctcattcaatgataagcctgtcaatgaaggagtcgttggccccatcggtaaagaactgttcgaaaaagaacaagatgacctcctatccgatctggttgatataccaaagaaagcatgtgatcgccggatcaatgaatttgtaaaacgtgcaagagctgctaagattcatgcctacataatgagtcatctgaagaaagagatgcctgctgtgatgggaaaatccaaggctcagcgaaaactcatcgataacctcgaagaagaatttgcaaaggttcagagggacttccatttaccggctggcgactttccagacgtggagcactttcgggaggtgttgggcggctatagcatcgataagttcgacaagttgaagccgaaaatgattcaagctgtggatgacatgcttggctatgacatccctgagctcttgaagaaattcagaaatccctacaattgatagagattaatatctgattgatggagtttatttttagttgagtacttttgggagattgcattcttcatgggcatgtaagagatggtttgaggttaataatcaaagttttagcctttcttaagctaaa

SEQ ID NO: 7917 - DNA, 1929 bp, Musa acuminata
gcactgtttgcgttcacccttttcaatccccttccgccacttttcgcacgtctccggccctctctccgcttccttcctcccccttctcattctataactcgtgattcgtccacccgatcacttgctgagcatttacactatcgttgctcgatggacatcgtctcttattcgatcagtaaagagaatgacaagatctaccagaattggttctcattcgctgactcagatggagatggccgcctcacggggaccgatgccatcaagttttttgccatgtctaatttacctcggggtgacctgaagcaggtatgggcgattgcagactctagaaggcaaggttatctgggcttcaaggagtttgtgatagcaatgaagcttgtgtcactagcacaagaagggaatgagatcacacaagttgcacttgctcatgctgatttggagaaagtaaatcctccagtgatggaaggattagatacctttctctctacaaataagccttcaataaaggaaattgatcctgagcaagatgtgaattcacagccacaaactcctaaactgcagtggtttggcacaaaatcaacaaagaagattcctttgagctcagttacttcaataattgatggtttggaaagattatacatccaaaaactgaagcctttggaagttacttaccagttcagtgactttggttcttccttgttgacaagcagtgatttcgatgctaagcccatggttatgctcctaggccaatattctaccggaaaaacaacattcataaagcatttactgaagtgtagctatccaggtgctcatattggacctgagcctaccaccgatagatttgttgttgtgatgttaggacctgatgaaaggaccattcctgggaatactatagctgttcaagcagatatgcctttcactggccttacaacatatggaaatgcatttttatcaaagtttgagtgctcacaaatgccacattcgctactagaacatatcacatttgttgacactcctggggttctttctggagagaaacaacgaactcaacgtagttatgattttactggtgttacttcgtggtttgcagcaaaaagcgaccttattcttcttctatttgatccccataagctcgacataagtgatgaattcaagcgtgtcatcggatctctacgtggtcatgatgacaaaatacgtgtggttttaaataaggcagaccaaattgacacacaacagctaatgagagtttacggtgcattgacatggtctcttggaaaggttctgaatactcctgaagtgatgcgtgtttacattggttcattcaatgacaaaccagtaaatagtatggctgttggcccagtggggaaggagctgtttgaaaaggaacaagatgacctcctttctgatttgaaagatattcctaaaaaggcttgtgatcgtaagatcaatgaatttgttaagagggccagagcagcaaaaatccatgcttatattattagccaccttaggaatcagatgccagcaatgttgggcaagacaaaggctcaacaacgactcattaataacttagagaatgagtttgcaaaggttcaaagggactatcatcttccacctggggatttccctgatgtccaacacttcaaagaggttttgagtggctacaacatcgacaagttcgagaagctgaagcctaaaatgatacaggctgttgatgatatgctggcatttgatattccagaactactaagaaaattcagaaacccatatgggcagtaagtactactcatcctaagatgtattaggaccttcatcaacaagagcaaatgagttctaaatactacatcaattatccatatcaaaactataatggtgtaacatttaatttatctcttggttggtaacagtgttggtaccttgtcatccttcgtt

SEQ ID NO: 7918 - DNA, 1765 bp, Chrysanthemum coronarium
atcgattcatcatcacttagtagatgctcagctgaacatcagaaggtgtacactgattggttcactctcgctgattcagatggtgatggaaggataacaggaggcgatgctaagaatttctttgttatgtctggtttatctggacacgaccttaagcaggtgtgggcgatagcagattctagacgacaaggctatctaggcttcaaagagtttattacagcaatgcagctgatttctctggcccaagcaggacaagtgttacgtagtgacatcttacaatctgatgttgattttgaatatctgcacccaccaacactggatggtctggatgcgttcatagctaagaaaaagcggtcaaaaagcgactttgaatcaaatggtagtcctgaggtgcagacttcgccgtcatctagttggttcacttcgacaaaatctgccaagaaggtttctttgagcaatgttacttcaatcattgatgggcttaagaaactctacattcagaagctgaaacctctagaagtgacgtaccagttcaatgattttgtttctcccttattgaccaacagtgattttgatgccaaacccatggtgatgcttttgggtcaatactcaacagggaaaacgacatttattaagcatttgcttagaagtagttatccaggagctcacattggacccgagccgaccaccgatagatttgttgtggttatgaatggacctgatgaaagaagtattccaggaaatactgttgctgttcaagctgatatgccatacagtggtttaactaatttcggaactgcattcttgtctaagttcgagtgttcccaaatgccacatccgctgctggagcatattacatttgtggacactccgggagtattatcaggcgaaaagcaaagaacacaaagaagctatgacttcacaggtgtgacatcctggtttgctgcaaagtgtgatctgatcttgcttctctttgatcctcataagcttgatatcagtgatgagttcaaacgtgtcatatcatccctaagaggaaatgatgataaaatacgtgtggtcttgaacaaggctgatcaagttgatacccaacagctgatgagggtttacggagctcttatgtggtccctcggcaaagttctaaacactccagaggttatgcgtgtttacattggttcttttaatgacaaacctattaattcggttaaagctgggccaattgggactgagctatttgagaaagagcaggatgatcttcttagtgacttgaaagacatacctaagaaagcttgtgatcgcagaatcaacgagtttgtaaaacgtgctagagcagccaagattcatgcttttatcattagccatcttaaaaaagaaatgccctcgatgatgggcaaggctaaagctcaacaaaaactcattgataaccttgaagatgtttttgcaaaggttcaaagggagcatcacttaccagcaggagattttccgtatgttgaaaacttcagggaaagactgagcggttacaatcttgacaacttccaaaaactgaagcccaaaatgatccaaacggtcgatgacatgttggggtatgacattcctgatctattgaagaatttcaggaacccatatgactaaagttacaagttcgtgtgatgaaaaggggtatgtatgtccatcatgtaatgtcgtttgtatacattcatgtgtagagtagtgtgtaccatgtcactggcgatttttattttcagatattcgcagttttgaagttgaa

SEQ ID NO: 7919 - DNA, 1946 bp, Chrysanthemum coronarium
ttcactgtttgtcggtgagggatctgcaaaattaaattaaattagggctccaaatcctttgaataatctgaatcaaaaccaatggatatcgattcatcgtcacttagtagatgctcagctgaacatcagaaagtttatactgattggttcactctcgctgattccgatggtgatggaaggataacaggaggcgatgctaagaatttctttgttatgtctggtttatctggacacgaccttaagcaggtgtgggcgatagcagattctagacgacaaggctatctaggcttcaaagagtttattacagcaatgcagttgatttctctggcccaatcaggacaagtgttacgtagtgacatcttacaatctgatgttgattttgaatatctgcacccaccaacactggatggtctggatgcgttcatagctaagaaaaagcggtcaaaaagcgattttgaatcgaatggtagtcctgaggtgcagacttcgccgtcatctagttggttcacttcgacaaaatctgcaaagaaggtttcattgagtaatgttacttcaatcatcgatgggctgaagaaactctacattcagaagctgaaacctctagaagtgacgtaccagttcaatgatttcgtttctcccttattgaccaacagtgattttgatgccaaacccatggtgatgcttttgggtcaatactcaacagggaaaacgacatttattaagcatttgcttagaagtagttatccaggagctcacattggacccgagccgaccaccgatagatttgttgtggttatgaatggacctgatgaaagaagtattccaggaaatactgttgctgttcaagctgatatgccatacagtggtttaactaatttcggaactgcattcttgtctaagttcgagtgttcccaaatgccacatccgctgctggagcatattacatttgtggacactccgggagtattatcaggcgaaaagcaaagaacacaaagaagctatgacttcacaggtgtgacatcctggtttgctgcaaagtgtgatctgatcttgcttctctttgatcctcataagcttgatatcagtgatgagttcaaacgtgtcatatcatccctaagaggaaatgatgataaaatacgtgtggtcttgaacaaggctgatcaagttgatacccaacagctgatgagggtttacggagctcttatgtggtccctcggcaaagttctaaacactccagaggttatgcgtgtttacattggttcttttaatgacaaacctattaattcggttaaagctgggccaattgggactgagctatttgagaaagagcaggatgatcttcttagtgacttgaaagacatacctaagaaagcttgtgatcgcagaatcaacgagtttgtaaaacgtgctagagcagccaagattcatgcttttatcattagccatcttaaaaaagaaatgccctcgatgatgggcaaggctaaagctcaacaaaaactcattgataaccttgaagacgtttttgcaaaggttcaaagggagcatcacttaccagcaggagattttccgtatgttgaaaacttcagggaaagactgagcggttacaatcttgacaacttccaaaaactgaagcccaaaatgatccaaacggttgatgacatgttggggtatgacattcccgatctgttaaagaatttcaggaacccatacgactaaagttagaagctcgtgatattgatgaaaaggggtatgtttgtccatcatgtaatgttgtttgtatacattcatgtgtagagtagcgtgttccatgacactggcgattgtcatcttcagatatttgcagttttgatgttgaatttacgagttaattttctttatatattggtgatgcattatgattgatgatacaatcgatctcaaaatttgaactcatgagaataaaaaac

SEQ ID NO: 7920 - DNA, 1885 bp, Chrysanthemum coronarium
tcactgtttgtcggtgagggatctgcaaaattaaaattaaattagggctccaaatcctttgaatagtctcaatcaaaacaaatggagatcgattcatcgtcacttagtagatgttcagctgaacatcagaaagtttatactgattggttcactctcgctgattcagatggcgatggaaggataacgggaggcgatgctaagaatttctttgttatgtccggtttatctggacacgaccttaagcaggtgtgggcgatagcagattctagacgacaaggctatctaggcttcaaagagtttattacagcaatgcagttgatttctctggcccaatcaggacaagtgttacgtagtgacatcttacaatctgatgttgattttgaatatctgcacccaccgacactggacggtctggatgctttcatagctaagaaaaagcggtcaaaaagcgattttgaatcgaatggtagtcctgaggtgcagacttcgccgtcatccagttggttcacttctacaaaatctgcaaagaaggtttcattgagcaatgttacttcaattatcgacgggctgaagaaactctacattcagaagctgaaacctctagaagtgacgtaccagttcaatgatttcgtttctcccttattgaccaacagtgattttgatgccaaacccatggtgatgcttttgggtcaatactcaacagggaaaacgacatttattaagcatttgcttagaagtagttatccaggagctcacattggacccgagccgaccaccgatagatttgttgtggttatgaatggacctgatgaaagaagtattccaggaaatactgttgctgttcaagctgatatgccatacagtggtttaactaatttcggaactgcattcttgtctaagttcgagtgttcccaaatgccacatccgctgctggagcatattacatttgtggacacgccgggagtattatcaggcgaaaagcaaagaacacaaagaagctatgacttcacaggtgtgacatcctggtttgctgcaaagtgtgatctgatcttgcttctctttgatcctcataagcttgatatcagtgatgagttcaaacgtgtcatatcatccctaagaggaaatgatgataaaatacgtgtggtcttgaacaaggctgatcaagttgatacccaacagctgatgagggtttacggagctcttatgtggtccctcggcaaagttctaaacactccagaggttatgcgtgtttacattggttcttttaatgacaaacctattaattcggttaaagctgggccaattgggactgagctatttgagaaagagcaggatgatcttcttagtgacttgaaagacatacctaagaaagcttgtaatcgcagaatcaacgagtttgtaaaacgtgctagagcagccaagattcatgcttttatcattagccatcttaaaaaagaaatgccctcgatgatgggcaaggctaaagctcaacaaaagctcattgataaccttgaagacgtttttgcaaaggttcaaagggagcatcacttaccagcaggggattttccgtatgttgaaaacttcagagagagactgagtggttacaatcttgacaacttccaaaaactgaagcccaaaatgatccaaacggttgatgacatgttggggtatgacattcccgatctgttaaagaatttcaggaacccatacgactaacgttacaagctcatgatagtgaggaaaagcggtatgtttgcccatcatgtaatggcgtttgtatacattcatgtgtagagtagtgtgtaccatgtcactggcgattgttattttcagatatttgcagttttgaagttgaagttacgagtttattttctttataagttgg

SEQ ID NO: 7921 - DNA, 1871 bp, Chrysanthemum coronarium
ttcactgtttgtcggtgagggatctgcaaaattaaattaaattagggctccaaatcctttgaataatctgaatcaaaaccaatggatatcgattcatcgtcacttagtagatgttcagctgaacatcagaaagtttatactgattggttcactctcgctgattcagatggtgatggaaggataaccggaggcgatgctaagaatttctttgttatgtccggtttatctggacacgaccttaagcaggtgtgggcgatagcagattctagacgacaaggctatctaggcttcaaagagtttattacagcaatgcagttgatttctctggcccaatcaggacaagtgttacgtagtgacatcttacaatctgatgttgattttgaatatctgcacccaccgacactggacggtctggatgctttcatagctaagaaaaagcggtcaaaaagcgattttgaatcgaatggtagtcctgaggtgcagacttcgccgtcatccagttggttcacttctacaaaatctgcaaagaaggtttcattgagcaatgttacttcaatcattgatgggctgaagaaactctacattcagaagctgaaacctctagaagtgacgtaccagttcaatgattttgtttctcccttattgaccaacagtgattttgatgccaaacccatggtgatgcttttgggtcaatactcaacagggaaaacgacatttattaagcatttgcttagaagtagttatccaggagctcacattggacccgagccgaccaccgatagatttgttgtggttatgaatggacctgatgaaagaagtattccaggaaatactgttgctgttcaagctgatatgccatacagtggtttaactaatttcggaactgcattcttgtctaagttcgagtgttcccaaatgccacatccgctgctggagcatattacatttgtggacactccgggagtattatcaggcgaaaagcaaagaacacaaagaagctatgacttcacaggtgtgacatcctggtttgctgcaaagtgtgatctgatcttgcttctctttgatcctcataagcttgatatcagtgatgagttcaaacgtgtcatatcatccctaagaggaaatgatgataaaatacgtgtggtcttgaacaaggctgatcaagttgatacccaacagctgatgagggtttatggagctcttatgtggtccctcggcaaagttctaaacactccagaggttatgcgtgtttacattggttcttttaatgacaaacctattaattcggttaaagctgggccaattgggactgagctatttgagaaagagcaggatgatcttcttagtgacttgaaagacatacctaagaaagcttgtgatcgcagaatcaacgagtttgtaaaacgtgctagagcagccaagattcatgcttttatcattagccatcttaaaaaagaaatgccctcgatgatgggcaaggctaaagctcaacaaaagctcattgataaccttgaagatgtttttgcaaaggttcaaagggagcatcacttaccagcaggagattttccgtatgttgaaaacttcagggagagactgagcggttacaatcttgacaacttccaaaaactgaagcccaaaatgatccaaacggtcgatgacatgttggggtatgacattcctgatctattgaagaatttcaggaacccatatgactaaagttagaagctcgtgatggtgatgaaaaggggtatgtttgtccatcgtgtaatgtcgtttgtatacattcatgtgtagagtagtgtgtaccatgtcactggcgatttttattttcagatatttgcagttttgaagttgaagttacgagtttattt

SEQ ID NO: 7922 - DNA, 1895 bp, Citrullus lanatus
aatcagagtagtagagtcttaatttgaatttcatttcttttgattctgtttcaaagctttgctgaagaatggagattggatcgggtgcgattgggtcttgctccaaagagcagcttaagatctttcaggaatggttcggtttggccgattcagatggagatggtcgtgttactggaaatgatgccatacagttcttctccatgtctcatctttctcgcgccgagctcaaacaggtttgggctattgcagactcgaaacgacaaggatatttagggttcaatgagttcgttactgccatgcagcttatttctttagcgcaagcagggtatgacctgaactcagatatcctcaagaaagcagccggcatggaggaaattaaactcccagtgctagaaggcttggatgctttagttactaagactaagagattagcaatatctagccaacatgaaacaaatggagctactcaacctatgccaccgccatcaactccatggtttgcttcaaaatctgggagcaagatatcccataccgcggttacatcaataattgacggtttgaagaaactgtacaatgaaaagctaaagcatctggaagctacttatcggtttaatgattttgtgtccccattcctgacaagcagtgattttgatgctaagccaatggtaatgctgttgggccaatattcaactggaaagacaacatttatcaaacatttgttaaaatgtaattatccaggagctcatataggacctgagccaacaactgatagatttgtagtagttatgtctggaccagacgagagaagtgttccaggaaacactattgctgttcaagcagacatgccattctctggtttgacatcctttggtggagcgttcttgtcaaagttcgaatgttctcaaatgccgcattctctcctcgatcaaattacatttgtggatactcctggggttctatctggagaaaagcaacgcacacagagaagctacgatttcacaggggttatatcatggtttgcagcaaaatgcgatctcatccttcttttgtttgatccccataaactggatatcagcgacgagttcaagcgcgttataggatctcttcgtggtcaagatgataagattcgagttgttctcaataaagcagatcaagttgatactcaacagttaatgagagtttatggagctttgatgtggtctctcggtaaagtgttgaatactccagaagtcgttcgtgtttatattgggtcattcaatgacaaacctgttaatgaagcctctgtcggtccaattggtcgcgatctttttgtgaaggaacaagatgatctcttagcagacttgattgatattccaaagaaagcatgtgaccgtcggattaacgaatttgtaaaacgcgccagagcggctaagattcatgcctatattatcagccaccttaaaaaggagatgcctgccatgatgggcaaagccaaaactcaacaacggcttattgataatcttgaagatgaatttggaaaggttcaaagggagtaccacctaccggccggggacttcccaaatgtggagcattttagggaggtattaaatgggtatagtattgataaatttgagaaattgaagcctaaaatgattcaagccgtagatgacatgcttggctatgacatcccagagcttttgaagaacttcaaaaacccttatgagtagaaaatataaaataatattatagtatctcaatctctgtagctgcattgctacttgcaatggatgttgatgatgcaaagttttgttagagtttaaaattttggaaactttttattttttatttttctattttcctttcaattaatgctcaaatgtatgtgtatcttgattgggcattttgatgtaatcttc

SEQ ID NO: 7923 - DNA, 1341 bp, Glycine max
aacgaaaattttgccggcaaactgcgcgggcgcgaatattcaaatggtggcgaaattcatcatcatctattatttcccacgttttcccgccatttccagccatcatcatctgttttagcgtcgcctttgggatccaaactccaacaaaaatggacgtttccgagctcgccaagaagctcggtctctccgattccaaactcctcgtccgaaaagctgccgagctccgtcgcctctgcgatgtccagttcgattcctccgtcattggagtcggtgaggttgcaaaatctctcatatgcttggaaatcgccgccactagactcggcgttctctttgaccgatcttctgctgtgaggctcagcggaatgtccgaaagagcttacatcagatcctacaattctctccacaacggccttggtgtcaagatgaaattagatgtgagggaattggcgattcagttcggctgcgttcgcattatccctttcgttcgtgacggtcttaaattatataaggatcggtttgtttcatcattgccggcttctcgccgtgcaagtgctgatttcactcgtccagtgttcaccgcggttgctttttatttatgtgctaagaaacacaagcttaaagtagataaacttaagttaattgagctctgtggtacatctgagtctgagttttctagtgtttctgctactatgaaggatttgtgccatgatgtttttggggttgcgaaggaaaagaaggatcctaaggaagtgcagtcaaatcgagatttgcttgatgttttgccaagtaaaaggaaagctgaggatggtggttattcatcggaggatggtccagagctttcaagctataaaaaagccaagaaaatggaaaaacatgattatgagaaatggaaatcttctgtgctttcatccaataaacaaaataagaaagcgccttgcaagcgaaccagacagactagtctcaactttctcaaggaaccttccgataatcaagagttagaggcaatttgagatggtattgctatgctttattatcaaagatgattttggaggaagttcaactcattaattatgaaaaaaaaaggatgaagtatgacatcaactgatattgttatagaatagaactcaattttgttagatgttgtcctttttggattttccaaaagtttacagcaagaactctctgtacagactggcattccttttattaactttgttggtatttatttagcttcaaaacgggtcatgaatagttaaacatttgcatacgcgaagatagttcatgtatatatacattattcgtatatattcataacgattcgactttctattttttagcttc

SEQ ID NO: 7924 - DNA, 1714 bp, Glycine max
gttttttataacttaataaattatcatggccttgatttttaatattatttacaatataaaaattataatgttctagatattccttttaactgcatgggtataaataagtctagaaatatatacggaatagacttttagtatcttttactcacatcttttttaggttttaagaaatattattttttatattaattaattagtatatttcgtgaatgatttcagaagctgagggcggcaaacgaaaattttgccggcaaactgcgcgggcgcgaatattcaaatggtggcgaaattcatcatcatctattatttcccacgttttcccgccatttccagccatcatcatctgttttagcgtcgcctttgggatccaaactccaacaaaaatggacgtttccgagctcgccaagaagctcggtctctccgattccaaactcctcgtccgaaaagctgccgagctccgtcgcctctgcgatgtccagttcgattcctccgtcattggagtcggtgaggttgcaaaatctctcatatgcttggaaatcgccgccactagactcggcgttctctttgaccgatcttctgctgtgaggctcagcggaatgtccgaaagagcttacatcagatcctacaattctctccacaacggccttggtgtcaagatgaaattagatgtgagggaattggcgattcagttcggctgcgttcgcattatccctttcgttcgtgacggtcttaaattatataaggatcggtttgtttcatcattgccggcttctcgccgtgcaagtgctgatttcactcgtccagtgttcaccgcggttgctttttatttatgtgctaagaaacacaagcttaaagtagataaacttaagttaattgagctctgtggtacatctgagtctgagttttctagtgtttctgctactatgaaggatttgtgccatgatgtttttggggttgcgaaggaaaagaaggatcctaaggaagtgcagtcaaatcgagatttgcttgatgttttgccaagtaaaaggaaagctgaggatggtggttattcatcggaggatggtccagagctttcaagctataaaaaagccaagaaaatggaaaaacatgattatgagaaatggaaatcttctgtgctttcatccaataaacaaaataagaaagcgccttgcaagcgaaccagacagactagtctcaactttctcaaggaaccttccgataatcaagagttagaggcaatttgagatggtattgctatgctttattatcaaagatgattttggaggaagttcaactcattaattatgaaaaaaaaaggatgaagtatgacatcaactgatattgttatagaatagaactcaattttgttagatgttgtcctttttggattttccaaaagtttacagcaagaactctctgtacagactggcattccttttattaactttgttggtatttatttagcttcaaaacgggtcatgaatagttaaacatttgcatacgcgaagatagttcatgtatatatacattattcgtatatattcataacgattcgactttctattttttagcttcgtgtttgaattttaaatggatatatctggagacgtgcatgataatgttgataacatagctggcaacgtaattattggcattatttgatattcaaatgattatatacgacataaataactttatctatacgttaaac

SEQ ID NO: 7925 - DNA, 1394 bp, Cajanus cajan
gatttcggaagcggaggcgccaaacgaaactttcccggcaaaccccgcgcgcgcgaacattcaaatagcgacttcgatctaatttggattccacaatctcctcctcctattctcgccattttcagctccctaatcccttcaaaatgcaaacgccaaatcctagttaacgtcgtgtttgggatccaaacccacaaatggacgttttcgagttagccaagaaactcgctctctccgactccaaactcgtcgtccagaaagcggcggagctccgccgcctctgcgacgtccagttcgattcctccgtcatcggagtcggcgaggtcgcgaagtctctcatatgcttggaaatcgccgccacgaggctcggcgttatcttcgaccgatcctctgcggtgaggctcagcggaatgtccgaaagagcctacatcagatcctacaactcgctccacaacggccttggcgtcaagatgaagatagatgtgagggaattggcgattcagttcggctgcgtttgcattattcctctcgttcgcgacggtctcaaactatataaggatcggtttgtctcgtcgttgccggtctctcgccgtgcaagcgctgttttcacgcgtcctgtgttcaccgccgttgctttttatttgtgtgctaaaaaacacaagctgaaagtagacaaacttaagttaatcgagctctgcggtacatctgaatctgagttttctagtgtttatgttacaatgaaggatttgtgccatgatgtttttggggtggcaaaggaaaagaaggatcctaaggaactgcagtctaatcgagacttgcttgatgttttgccaagtaaaaggaaagctgaagaaggtggttcatccgatgatggtgcagagctttcaagttataaaaaagccaaaaaaatgggaaaacgtgattacgagaagtggaaatcttctgttcttgcatccaatcgtcaaaaaaagacgaaagcgccttgcaagcgaactaaacagactcgtctcaactttatcaaggaatctcccgatactaaggagttggaggccatgtgagatggtattgttatgttttacgatgaaagatgatttaggtggaagttcagcacagtatgaaaaaaaaggatgaagaaagatgacattaactgatatagatgaaggatgtcctttgtggaatttccaaagcattagtttatagcaagagctatgtacagactggcatcccctttgtttaatttattggtatttggcttcaaaaagggtcatgaatacaattacatacgccaagatagttcgtgcatatgtacatttttattcgtatatattgagcactttttacttgacataacgatttgactttcaaatatttagttaagtttttaaattttctatggg

SEQ ID NO: 7926 - DNA, 1239 bp, Lupinus angustifolius
ccttttcttcccgctcaatattctcactacattcatttttcattattatttcttcaccgattcatattgtatcgagttcttgaaacataacaataatattaatggatctaccacagattgcaaagaagcttggtctctcagattccaaacttgtgattcgaaaagctgcggaactacgtcgactttctgatcttcagtttgattgttctgctattggagttggtgaagttgccaaagcagttatttgtttggaaatcgctgccaccaggcttggaacactctttgatcgatcttgtgctgtgaaattgagtggaatgtctgaaagggcttatattagatcttacaattctctccacaatggcctcggagtcaaagttaagcttgatgttagagaattagcgattcaattcggatgtgttcgaattatcccttttgttcgtgatggtctcaaactttacaaggatcggtttctttcttcgttgccagcctctcgtcgtgcaagtgctgattttactcgccccgtgtttacagctgttgctttttatttatgtgcaaagaaacacaagctcaaagtggacaagattaagttaattgaactctgtggtacatctgaatctgaattctctagtgtttctactactatgaaggacttatgccatgatgtttttggggttgctaaagaaaagaaagatgctagagaagttcagtcaaatcgagatcttcttgatgtattgccatgtaaaaggaaacctgaggatggtggctatttatctgatgatgagccagagctttcaagttataaaaaacgtaagcaaatggagaagggtgattatgagaagtggaaatcttctgtgcttgcatccaatgaagagaacaaaacaaaagcagcttgcaagcgaaccacacagactagcctccaatttttcaaggaagcccctgacaccaagaagttagaggctatttgagatgttctttattatttatggtcccattttgtgatgaaagatgattttggaggaagctcaatacaataggaaagattagcatcaactttatgttaaaataatagatctgttccctaaaaaaacagaatagaactgccctggttgattgatcttgcatactggggttctgattttttttaaagtttatatcaagaactctgtacacattggcattcctttctgatttttttttaaagtttatatcaagaactctacacattggcattccttttaa

SEQ ID NO: 7927 - DNA, 1331 bp, Cicer arietinum
gccaaatgaaaacgtttcccggcaaacagtgcgcgcgagaatattcaaaaacccaaatagaaaacaacaccaaacaacgccacttttcatctcttcaaaatccacatctcaaccctcattcttcaaaaaaaaaaaaaaaaaaaccaaaaatctcatcgccatattcacttccaaaaataaacaaataatggatatctcagagatagcaaagaaactcggtttctccgattccaaactcctcatccgtaaagccgctgaactccgtcgcctctgcgatgtccacttcgattcctccgtcattggtgtcggtgaagttgcaaaagctatcatctgtatggagattgcggcgacgagactcggtgttctctttgatcgatcttcggcggttagactcagtggaatgtccgaaagggcttacatcagatcttataattcacttcataatggccttggcgtcaagttgaagctagatgtgagagaattggcgatccaattcggttgtgttcgaattataccttatgttcgcgacggtctaaagatttataaggatcggtttctttcatctttgccggcagctcgccgtgctagtgctgattttactcgtcctgtgttcatggctgttgctttttatttatgtgcaaagaaacaaaagctcaaagttgacaagattaagctaattgaactatgtggtacatctgaatctgaattttctagtgtttctactactatgaaagacttgtgccatgatgtttttggggtagctaaggaaaagaaagaccctaaagaagtaaagaccaatagagatctgcttgatgccttgccaagcaaaagaaaagctgaggatggtggctatttgtctgacgatggggcagagatttcaagttataaaaagaggaagcagatggaaacacgtgattatcaaaagtggaaatcttcagtccttgcatcgaataaacaagataagacagaagcgccttacaagaaacccaaacagacccgcctcaactttgccaaggaaactcctgagactcagaagttggaggcgatatgagatagtattgctttgtattgtgatggaagattccggaggaccttcagtacagtataaaacaaagaatgaagattgacattaacctatattgtatttgtaacagaagaggagtagtggtcttgttgattattctcacatatagcgttctcaattttgttagttgtcttttggtgaattgccaaagctttaatttatagcaagaactctgtacagactgtcactttttaaaaattcattggcattttttggcttcaaaatgggtcatatatttgttcattta

SEQ ID NO: 7928 - DNA, 1205 bp, Medicago truncatula
ttcttcacttccaaaaaaacaaaacaaaaatggatatctcagagatcgctaagaaactcaaactctccgattccaaacttctcatccgtaaagccgctgaactccgtcgcctctgcgatgttcactttgattcctccatcatcggcgtcggtgaagttgcaaaagctattatctgtatggaaatcgctgcgacgaaacttggtgttcttttcgatcgatcttctgcggtgaagcttagtggaatgtctgataggggttatattagatcctataattcacttcataatacaattggtgtcaagttgaagcttgatgtgagggaattggcgattcaatttgggtgtgttcggattataccgtttgttcgcgatggtctgaaactttataaggaacggtttctttcatcgttgccggctgctcgtcgtgcaagtgctgattttactcgtccggtttttatggctgttgctttttatttatgtgcaaagaaacataagctaaaagttgataagattaagctgattgaactttgtggtacatctgaatctgaattttctagtgtttctactactatgaaagacttgtgccatgatgtttttggggttgctaaagaaaagaaagaccctaaagaagtgaagaccaatagagatctgcttgatgtcttaccaagcaaaagaaaagctgaggatggcggctatttgtctgatgatggggaagaggtttcaagttataaaaaaaggaaacagatggaaacaaaagattatgagaaatggaaatcttcagtccttacatccaataaacaagataagaaagaagtgcccagcaagaaaccaaagcagactcgcctcaacttcgtcaaggaagctcctgagacccagaagttggaggcgatgtaagatggtggtattctttgatttgcttcgtattgtgatgaaagttaattcaagtggaagttcagtacagtataacacaaagcatgaagatgggcattaatctatgtagcaacataagagaagtggcctagttgattattcttacaatgttctcaattttgttagttttcttttggggaattgccaaagcattaatctatagcaagaactctgtacagactgttactttttatcattggaatttggcttcaaaatgagtcacatatagttgttcatttactcgtattagatagtgaatctgtaaattcatgtgtg

SEQ ID NO: 7929 - DNA, 1250 bp, Medicago truncatula
tctcattttccttcttcacttccaaaaaaacaaaacaaaaatggatatctcagagatcgctaagaaactcaaactctccgattccaaacttctcatccgtaaagccgccgaactccgtcgcctctgcgatgtccactttgattcctccatcatcggcgtcggtgaagttgcaaaagctattatctgtatggaaatcgctgcgacgaaacttggtgttcttttcgatcgatcttctgcggtgaagcttagtggaatgtctgataggggttatattagatcttataattcacttcataatacaattggtgtcaagttgaagcttgatgtgagggaattggcgattcaattcgggtgtgttcggattataccgtttgttcgcgatggtctgaagctttataaggaacggtttctttcttcgttgccggctgctcgtcgtgcaagtgctgattttactcgtccggtttttatggctgttgctttttatttatgtgcaaagaaacataagctgaaagttgataagattaagctgattgaactttgtggtacatctgaatctgaattttctagtgtttctactactatgaaagacttgtgccatgatgtttttggggttgctaaagaaaagaaagaccctaaagaagtgaagaccaatagagatctgcttgatgtcttaccaagcaaaagaaaagctgaggatggcggctatttgtctgatgatggggcagaggtttcaagttataaaaaaaggaaacagatggaaacaaaagattatgagaaatggaaatcttcagtccttacatccaataaacaagataagaaagaagtgcccagcaagaaaccaaagcagactcgcctcaacttcgtcaaggaagctcctgagacccagaagttggaggcgatgtaagatggtggtattctttgatttgcttcgtattgtgatgaaaatcgattcaagtggaagttcactacagtataacacagcatgaagatgggcattaacctatgtagcaacataagagaagtggcctagttgattattcttacaatgttctcaattttgttagttgtcttttggggaattgccaaagcattaatctatagcaagaactctgtacagactgttactttttatcattggaatttggcttcaaaatgagtcacatatagttgttcatttactcgtattagatagtgaatctgtaaattcatgtgtgtgtgcatttttctatttatccaacaaagtttgggat

SEQ ID NO: 7930 - DNA, 5354 bp, Glycine max
ccctccctccctcccaaaatttgggtccctcccgccaaagaaaatggtccaatcttaaataggtgtgtagaggtaaccctaaattcaaaatatgcccgtgcaacccatttcctctgaaaccctaaactgaggttctttgctcagtgctagccctaatttgttcaggcagatggagcagtagcaagagggtggtgacagaggtttttcccggagacgcagactgagtagtagccgcaaagcccggaacacgccgtgaaggtagcgcgacaactgcgactgcctctattttcatttctgtttctttcgactcgcaggggatcgccgatctcactatcgagcgagcgcggaagatcgtggaagacatgggttccgcttctcttctgaatccttctcaaccaggcgttaagaagaacagcaagagcaaacagaaatctgttgtttccaaaaccgaagagaaagttatggttaaagataaacaaaagaagcggagtttgttggagagcagtgagcagcctgctgctacacgcaaaatgccaaaacgtgctgcagcgtgtaaaaatttgaaggagaaatcctttttgatatctgagaagtcctgcctcattgaaatggagaaagatcagattgtagaagaagaaagtctagctgtccgcatgacagctggacaggatgatggtcgtccaaataggcgcatcacggagttcattcttcatgatgcaactggtaaagcccagccacttgaggtgctggaggttaatgaattatttatcactggacttatattgccgcttgaagtcagcacaggcaagaaaaaagagaaaggtgttaagtgtgaaggctttggtcgagtggaatcatgggatatatctggctatgaagatggctctccagtgatatggctttctactgatattgctgattatgattgccagaaacctgctgctagttacaaaaaagtttatgatcttttccttgaaaaggcccgtgcatgtatcgaagtatacctgaaacttgcgaagtcctctgggggtgaccctgatatcagtcttgatgagttacttgctggcatggtgcggtctatgagtggtagcaaatgcttttctggaactgcatctataaaggattttgttatttctcatggtgagttcatttataagcaactaattggtttggacatgacatccaaggccaatgacaggacgtttgcagatatccctgctcttattgctcttagagatgagagtaagaaacaagcaaactatgtacatgcacaagtaatgccctcaaatgggagtttaaggattgattcaggagttggagatgaagaaaacaagaatcagatggattcagtagcttctgtaaacgaggaagatgaggatgcaaagctggcacgactgttgcaggaagaagagtattggcaatctatgaagcagaagaaaaactctagaccaacctctgtatcgaacaaatactatataaaaattaatgaagatgagattgccaatgattatcctctacctgcttattataaaacctcccttcaagaaacagatgagtttatagtctttgataatgactatgacatatatgacactcaagatctccctcgaagcatgctgcataattggtctttatacaactcagatgcaagattggtttccttggaacttctgcctatgaaaccttgttcagatattgatgttgcaatctttggatcaggtataatgacttcagatgatgggagtgggtttcatcttgatactgaggctggccaatcttcttctgttggttctggagcccaggttgctgatggaatgccaatttatctgagtgccataaaggaatggatgattgaatttggatcagctatgattttcatatccatccgaactgatttggcctggtatagacttggcaaaccagcaaagcagtatgctccttggtatgacacagtattgaaaactgcaaggcttgctataagcattatcaccttgctgaaggagcagagccgagtatcacgcctttcctttggagatgtcatcaggaaagtatctgagtttaatcagaaagatggttcttacatttcttctgatccattgactgttgagagatatgttgttgtccatggacagataattctgcaactgtttgcagaatttcctgatgataatatcagaaagtcttcatttgtgactggtcttacaaataaaatggaagagcgccaccataccaaatggttagtgaagaagaagaaagttgtgccaaggagtgaaccaaatttaaatcctagagcagcagtgggtcctgttgtatccaagaggaaagctatgcaagctacaacgacaaggctgatcaatagaatatggggagagtattactcaaaccacttgccagaagattcaaaagagggaattgctagtgagttaaaggatgaggatgaagtggaggaacaagaagaaaatgaagatgatgataatgaggaggaaacaatacttttggagggaactccaaaggcacattcagcttcaaagcaaaccaaaaaaatttctgctgacacagaaataagatgggaaggggaacctgaagggaagactagttctggatatcctgtttataaacaggcaattattcgtggtgaagttatttctgtaggaagatctgtgttggtggaagttgacgaaacagatgaatttccagatatatattatgttgaatatatgtttgaatcaaagattggaagaaaaatgttccatggtaggatgatgcaatgtggttgtcagactgttcttggcaatgctgctaatgagagagaggtgtttttgactaatgagtgcagggatttgggactgcatgatgtcaaacagacagttgttgtaaatatccaaaataggccttgggggcatcagcatcgaaaggataatatcattgcagatagagttgacaggactcaagcagaagaaaggaagaagaaaggactacctactgactattactgtaaaagcttgtactggcctgaaagaggtgctttcttcacccttccacatgatacattgggtctagggtctggtgtctgcccatcttgcaaaatacaggatgctgaaaaggagaaggatgttttcaaagtaaattcctccaagtctggtttcctatttaatggaactgagtattctcttgatgattatgtttatgtaagtccttttgaatttgaggaaaagatagagcaaggaactcataaaagtgggaggaatgtggggttgaaagcttatgttgtgtgccaagtgcttgagattgttgtcaaaaaggaaataaaacaagctgaaataaaatctacacaagtcaaaatcaggaggttcttccgaccagaagatttatcaaatgagaaggcatattgctctgatatacgagaggtgtattacagtgatgaaacatatataatctctgtagaatccatagaagggaaatgtcaagtcagaaaaaagaatgatattcccgaatgcagtgctcttggtggaatcttccaaaatgtttttttctgcgagctcttgtatgatcctgccactgggtcactgaagaagttgccggctcatataaaagtaaaatattcaagtggacaaacatctgatgctgcagctagaaagaggaaaggaaaatgtatagagggagatggtgtttcagagtccacaaaggaaggaaaaacattaaatgataaacgtttagcaaccttggacatttttgcaggctgtggtggcttatcagaggggttgcagcagtcaggagtttcatcaactaaatgggctattgagtatgaagaaccagccggggatgcatttaaagctaatcatcctgaggcattggtgttcattaacaattgcaatgttattcttagggctgtaatggagaagtgtggggacacagatgattgtatctcaacatctgaggctgcagaattggctgcaaagcttgatgagaaggaaataagtagtttaccaatgcctggacaagttgatttcattaatggtggtcctccatgccagggtttctctgggatgaataggtttaaccagagcagttggagtaaagtccagtgtgagatgatattggcattcttatcctttgctgattatttccggccaaggtatttcttgttggagaatgtgaggaactttgtgtctttcaataaaggacagacattccgtttaactttggcttcacttcttgagatgggttatcaggtgaggtttggtatccttgaggctggagcatttggggtttctcagtcaagaaaaagggcattcatatgggctgcttctcctgaggatgtgcttcctgaatggccagaaccagtgcacgtcttttcggcccctgagttgaagatcacattatcagaaaatgtccagtatgctgctgtccgcagtactgcaaatggtgctcctttacgtgcaataactgttcgagatactattggtgatctcccagctgttggcaatggagcctcaaaaggaaacatggagtatcaaaatgatccagtctcatggtttcaaaagaagattcgaggtgatatggttgtcttgactgatcatatatcaaaggagatgaacgaattgaacttgattcgatgccagaaaattcccaagagaccaggtgctgattggcgtgaccttccagaagaaaagataaaactgtctagtggacaagttgttgatttgataccatggtgcttgccaaacacggctaagcggcacaatcaatggaagggactgtttggcaggttggattggcaaggaaatttcccaacttccgttacagaccctcagccaatggggaaggttggaatgtgcttccaccctgaccaagataggattcttactgttcgtgaatgtgctcggtctcaaggcttcccagatagctatgaatttgctggcaatatcatacacaagcaccggcagattggtaatgctgtgcctcctcctctagcatcagcattggggagaaagctcaaggaagcagtggacagtaagagctccacttagaagatgggccttctacattaggtcatgcttattgtattcataacagtcaccaagatattgcaaatcatcattccgggttccaaaaactagaaacccttgtatatagtgatatccattggtcatttgttgaggctaattccttgtttaactttcctcaaccaaggaattgaatggatgatgctcattttctatcaactaggattttcttgattagatggtattttggctgtttatgaaagaaatggttgggaattgattacctcccaatgtgtagttgaaaattgagaccaattttttttaacctgttatgaatatttgttgttg

SEQ ID NO: 7931 - DNA, 5538 bp, Glycine max
agcttttgcaattttccttttctaattttcaaatttgctaaaatttcagtttgagggttcatgagcggcaaacaaacaaaaaaccctccctccctccctcccaaaatttgggtccctcccgccaaagaaaatggtccaatcttaaataggtgtgtagaggtaaccctaaattcaaaatatgcccgtgcaacccatttcctctgaaaccctaaactgaggttctttgctcagtgctagccctaatttgttcaggcagatggagcagtagcaagagggtggtgacagaggtttttcccggagacgcagactgagtagtagccgcaaagcccggaacacgccgtgaaggtagcgcgacaactgcgactgcctctattttcatttctgtttctttcgactcgcaggggatcgccgatctcactatcgagcgagcgcggaagatcgtggaagacatgggttccgcttctcttctgaatccttctcaaccaggcgttaagaagaacagcaagagcaaacagaaatctgttgtttccaaaaccgaagagaaagttatggttaaagataaacaaaagaagcggagtttgttggagagcagtgagcagcctgctgctacacgcaaaatgccaaaacgtgctgcagcgtgtaaaaatttgaaggagaaatcctttttgatatctgagaagtcctgcctcattgaaatggagaaagatcagattgtagaagaagaaagtctagctgtccgcatgacagctggacaggatgatggtcgtccaaataggcgcatcacggagttcattcttcatgatgcaactggtaaagcccagccacttgaggtgctggaggttaatgaattatttatcactggacttatattgccgcttgaagtcagcacaggcaagaaaaaagagaaaggtgttaagtgtgaaggctttggtcgagtggaatcatgggatatatctggctatgaagatggctctccagtgatatggctttctactgatattgctgattatgattgccagaaacctgctgctagttacaaaaaagtttatgatcttttccttgaaaaggcccgtgcatgtatcgaagtatacctgaaacttgcgaagtcctctgggggtgaccctgatatcagtcttgatgagttacttgctggcatggtgcggtctatgagtggtagcaaatgcttttctggaactgcatctataaaggattttgttatttctcatggtgagttcatttataagcaactaattggtttggacatgacatccaaggccaatgacaggacgtttgcagatatccctgctcttattgctcttagagatgagagtaagaaacaagcaaactatgtacatgcacaagtaatgccctcaaatgggagtttaaggattgattcaggagttggagatgaagaaaacaagaatcagatggattcagtagcttctgtaaacgaggaagatgaggatgcaaagctggcacgactgttgcaggaagaagagtattggcaatctatgaagcagaagaaaaactctagaccaacctctgtatcgaacaaatactatataaaaattaatgaagatgagattgccaatgattatcctctacctgcttattataaaacctcccttcaagaaacagatgagtttatagtctttgataatgactatgacatatatgacactcaagatctccctcgaagcatgctgcataattggtctttatacaactcagatgcaagattggtttccttggaacttctgcctatgaaaccttgttcagatattgatgttgcaatctttggatcaggtataatgacttcagatgatgggagtgggtttcatcttgatactgaggctggccaatcttcttctgttggttctggagcccaggttgctgatggaatgccaatttatctgagtgccataaaggaatggatgattgaatttggatcagctatgattttcatatccatccgaactgatttggcctggtatagacttggcaaaccagcaaagcagtatgctccttggtatgacacagtattgaaaactgcaaggcttgctataagcattatcaccttgctgaaggagcagagccgagtatcacgcctttcctttggagatgtcatcaggaaagtatctgagtttaatcagaaagatggttcttacatttcttctgatccattgactgttgagagatatgttgttgtccatggacagataattctgcaactgtttgcagaatttcctgatgataatatcagaaagtcttcatttgtgactggtcttacaaataaaatggaagagcgccaccataccaaatggttagtgaagaagaagaaagttgtgccaaggagtgaaccaaatttaaatcctagagcagcagtgggtcctgttgtatccaagaggaaagctatgcaagctacaacgacaaggctgatcaatagaatatggggagagtattactcaaaccacttgccagaagattcaaaagagggaattgctagtgagttaaaggatgaggatgaagtggaggaacaagaagaaaatgaagatgatgataatgaggaggaaacaatacttttggagggaactccaaaggcacattcagcttcaaagcaaaccaaaaaaatttctgctgacacagaaataagatgggaaggggaacctgaagggaagactagttctggatatcctgtttataaacaggcaattattcgtggtgaagttatttctgtaggaagatctgtgttggtggaagttgacgaaacagatgaatttccagatatatattatgttgaatatatgtttgaatcaaagattggaagaaaaatgttccatggtaggatgatgcaatgtggttgtcagactgttcttggcaatgctgctaatgagagagaggtgtttttgactaatgagtgcagggatttgggactgcatgatgtcaaacagacagttgttgtaaatatccaaaataggccttgggggcatcagcatcgaaaggataatatcattgcagatagagttgacaggactcaagcagaagaaaggaagaagaaaggactacctactgactattactgtaaaagcttgtactggcctgaaagaggtgctttcttcacccttccacatgatacattgggtctagggtctggtgtctgcccatcttgcaaaatacaggatgctgaaaaggagaaggatgttttcaaagtaaattcctccaagtctggtttcctatttaatggaactgagtattctcttgatgattatgtttatgtaagtccttttgaatttgaggaaaagatagagcaaggaactcataaaagtgggaggaatgtggggttgaaagcttatgttgtgtgccaagtgcttgagattgttgtcaaaaaggaaataaaacaagctgaaataaaatctacacaagtcaaaatcaggaggttcttccgaccagaagatttatcaaatgagaaggcatattgctctgatatacgagaggtgtattacagtgatgaaacatatataatctctgtagaatccatagaagggaaatgtcaagtcagaaaaaagaatgatattcccgaatgcagtgctcttggtggaatcttccaaaatgtttttttctgcgagctcttgtatgatcctgccactgggtcactgaagaagttgccggctaatataaaagtaaaatattcaagtggacaaacatctgatgctgcagctagaaagaggaaaggaaaatgtatagagggagatggtgtttcagagtccacaaaggaaggaaaaacattaaatgataaacgtttagcaaccttggacatttttgcaggctgtggtggcttatcagaggggttgcagcagtcaggagtttcatcaactaaatgggctattgagtatgaagaaccagccggggatgcatttaaagctaatcatcctgaggcattggtgttcattaacaattgcaatgttattcttagggctgtaatggagaagtgtggggacacagatgattgtatctcaacatctgaggctgcagaattggctgcaaagcttgatgagaaggaaataagtagtttaccaatgcctggacaagttgatttcattaatggtggtcctccatgccagggtttctctgggatgaataggtttaaccagagcagttggagtaaagtccagtgtgagatgatattggcattcttatcctttgctgattatttccggccaaggtatttcttgttggagaatgtgaggaactttgtgtctttcaataaaggacagacattccgtttaactttggcttcacttcttgagatgggttatcaggtgaggtttggtatccttgaggctggagcatttggggtttctcagtcaagaaaaagggcattcatatgggctgcttctcctgaggatgtgcttcctgaatggccagaaccagtgcacgtcttttcggcccctgagttgaagatcacattatcagaaaatgtccagtatgctgctgtccgcagtactgcaaatggtgctcctttacgtgcaataactgttcgagatactattggtgatctcccagctgttggcaatggagcctcaaaaggaaacatggagtatcaaaatgatccagtctcatggtttcaaaagaagattcgaggtgatatggttgtcttgactgatcatatatcaaaggagatgaacgaattgaacttgattcgatgccagaaaattcccaagagaccaggtgctgattggcgtgaccttccagaagaaaagataaaactgtctagtggacaagttgttgatttgataccatggtgcttgccaaacacggctaagcggcacaatcaatggaagggactgtttggcaggttggattggcaaggaaatttcccaacttccgttacagaccctcagccaatggggaaggttggaatgtgcttccaccctgaccaagataggattcttactgttcgtgaatgtgctcggtctcaaggcttcccagatagctatgaatttgctggcaatatcatacacaagcaccggcagattggtaatgctgtgcctcctcctctagcatcagcattggggagaaagctcaaggaagcagtggacagtaagagctccacttagaagatgggccttctacattaggtcatgcttattgtattcataacagtcaccaagatattgcaaatcatcattccgggttccaaaaactagaaacccttgtatatagtgatatccattggtcatttgttgaggctaattccttgtttaactttcctcaaccaaggaattgaatggatgatgctcattttctatcaactaggattttcttgattagatggtattttggctgtttatgaaagaaatggttgggaattgattacctcccaatgtgtagttgaaaattgagaccaattttttttaacctgttatgaatatttgttgttgcaactatttggctaagaactaccaaaaaaaactatttacctaggaaacttgcataatatttaatcgaggacgatatttaatgaaataatttatctaa

SEQ ID NO: 7932 - DNA, 4770 bp, Cajanus cajan
caaatgacaagaagagtaaacagaaatctgttgcttccaaaactgaagtggaagttatggctaaagataaacaaaagaagcgaaatttgtcggagaacactgcagctatgcgcaaaatgccaaaacgtgctgcagcgtgtacaaatatgaaggagaagtccttttcaatatccgagaagtcttgtctcattgaaacagaggaggatcagattgtagaagaagaaattctagctgttcgcatgactgctggacaggatgatggtcgtccaaataggagaattacagagttcatcctccatggtgaaagtggtacaagacagccacttgagatgctggaagtttatgatttatatatcagtggggttatactgccgcttgaagcaagcacaggcaagaagaaagagaaaggtgttagatgtgaaggctttggtcgaattgaatcatgggatatatctggctatgaagatggctctccagtgatatggctttctactgatgttgctgattatgaatgccataaacctgccactagttacaagaaatattatgatcatttctttgaaaaggcccgtgcatgtatagaggtatacaaaaaacttgccaagtcctctggtggggaccctgatatcagtcttgatgagttgcttgcaggtatggtgcggtctatgagtgatagcaaatgctttactggaactgcatccataaaggattttgttatttctcagggtgagtttatttataagcaactcattggtttggacatgacatccaagacaaatgacaggatgtttgcagatatccctgctcttgttgctcttagagatgagagtaagaaacaagcaaactatgtacatgctcaagtaatgccctcagatgggactctaaggattggttcaggaattggagatgaagaaaacaagaatcagatggatttagtggcttccgtagatgaggaagatgaggatgcaaagctagcacggctgttgcaggaagaagagtattggcaatctatgaagcagaagaaaaactccagatcaacccccacatctaacaaatactatatcaaaatcaatgaagatgagattgccaatgattaccctcttcctgcttattataaaacctctgttcaggaagcagatgagtttatactttttgataatgactatgatgcgtataacactgaagatcttccaaaaagcatgctgcataattggtctttatacaactcagatgcaagattggtttccttggaacttcttcctatgaagccttgttcagacattgatgttaccatctttggatcaggttcaatgactccagatgatggaagtgggttccatcttgatactgagcctggccaatgttcttccactggttctggagcacaggttgctgatggaattccaatttatctgagtgccataaaggaatggatgattgaatttggatcatctatggtttttatatccatccggacagatttggcctggtatagacttggcaaaccatcaaagcagtatgctccttggtatgacaccgtattgaaaactgcaaggctagctataagcattatcaccttgttgaaggaacagagccgagtatcacgactttcctttggagatgtcattaagaaagtatctgagtttaatcagaaacatagttcttacatttcttctgatccattgactgttgagagatatgttgttgtccatggacagataattctgcaactgtttgcagaatttcctgatgacatgatcagaaagtctgcatttgtgactggtcttgcaaacaaaatggaagagcgacaccataccaaatggttagtgaagaagaaaaaagttgtgccaaggagtgaaccaaatttaaatcccagggcagcagtgggtcctattgtatcaaagaggaaagctatgcaagctacaacaacaaggctgatcaatagaatatggggagagtattactcaaaccacttgccagaagattcaaaagagggaactgctactgagttaaaggatgaggatgaagtggaggaacaggaagaaaatgaagatgaggacaatgaagacgagacaatacttttggagggaaccccaaagccacattcagcttcaaagcagactaaaacattttctgctgagacagaaataagatgggaaggggaacctgaagggaagactagttctggatatcatgtttataaacaggcaatcattcatggagaagttgtttctgtaggaagctctgttttagtggaagttgaagaagcagatgaacttccagacatatattatgttgaatatatgtttgaatcaaagaatgggagaaaaatgtttcatggtaggatgatgcagcgtggttttcagactgttcttggcaatgctgctaatgagagagaggtgtttttgactaatgagtgcagggatttggggctgcaggatgtcaagcagacagttgttgtgagtattcaaaaaaagccttgggggcatcagcatcgaaaggacaatattgctgcagatagagttgacagggctagagcagaagaaaggaagaagaaaagactacctactgaatattactgtaaaagcctgtactggcctgaaagaggtgctttctttagccttccattcaatactatgggtctagggtctggtgtttgcccatcttgcaaaatacaggacactcaaaaggagaaggatattttcaaagtactttcctccaagtctggtttcctattgaaaggaaccgagtattctcttaatgattatatttatgcaagtccttttgaatttgaggaaaagatagagcaagggacccataagagtgggaggaatgtagggttgaaagcttatgttgtgtgccaagtgcttgagatcattgtcaaaaaggaaataaaacaagctgactcaagatctacacagatcaaaatcagaaggttcttcagaccagaagatgtatcagatgagaaggcttacagctctgatatacgagaggtgtattacagtgaggaaacacatataatctgtgtgcaatctgtagaagggaaatgtgaagtcagaaagaagaatgacatttctgaacccagtgcccctggattcttccaaaatgtatttttctgtgagtacttgtatgagcctgccagtggctcgctgaagaagttgccagctcatataaaagttaaatattcaagtggacaaacatctgatgctgcagctagaaagaggaaaggaaaatgtaaagagggagatggtgtcccagagtctgataaggaagggaaaacattaactgaaaaacgtttagcaaccctagacatttttgcaggttgcggtggcttatcacaggggttgcatcagtcgggagtttcatcaactaaatgggctatagagtatgaagagccggctggtgatgcatttaaagctaatcatcctgaggcattggtgttcattaacaattgcaatgttattcttagggctgtgatggaaaaatgtggagacacagatgattgtatctcaacatccgaggctgcagaattggctgcaaagcttgatgagaaagaaataagtagtttacccatgcctggacaagttgatttcattaatgggggtcctccatgccaaggtttctctgggatgaataggtttaaccagagcagttggagtaaagtccagtgtgagatgatattagcattcttatcctttgccgattatttccggccaaggtacttcttgttggaaaatgtgagaaactttgtgtctttcaataaaggacagacactccgtttaactttggcttcgcttcttgagatgggttatcaggtgaggtttggtatccttgaggctggaacatttggggtttctcagtcaagaaaaagggcattcatatgggcagcctctcctgaggatgtgcttcctgaatggccagaaccagtgcatgtcttttcggctcccgaattgaagatcaaattgtcagagaatgtccagtatgctgctgtccggagtactgcaaatggtgctccattacgttcgataactgtaagagataccattggtgatctccctcctgttggcaatggagcctcaaaaggagttatggagtatcaaaatgatcctgtctcgtggtttcaaaagaagattcgtggtgacatagctctcttgactgatcatatttcaaaggagatgaacgaattaaacttgattcgatgccagagaatacctaagaggccaggtgctgattggcgtgatcttccagatgagaaggtaaatttgtctaccggacaaattgttgatttgataccatggtgcttgccaaacacggctaagcgacacaatcaatggaagggactgtttggtaggttggattggcaagggaatttcccaacttccattacagaccctcaaccaatggggaaggttggaatgtgcttccaccctgaccaagataggattcttactgttagagaatgtgctcggtctcaaggcttcccagatagctatcaattttgtggcaatatcatacacaagcacaggcagattggtaatgctgtgcctcctcctctggcattagcattagggaggaagctcaaggaagcagtggatagtaagagcttcacttagaagatgtcagatagtgcaaaaaatcattcagggttccagaaactagaaacccttgtatatagttgatcatttgttttgaggttaattgcttgtctaactttccaaaaccaaagaattgaatggatcatttgttctcccattgtgtagttgacaattg

SEQ ID NO: 7933 - DNA, 5108 bp, Phaseolus vulgaris
gatttcaccttctgcactcatgagcgccaaaaaatccctccattccaatattggcgtccccgccaaagaccagagtgtgaaaggggaccttgaaataacctcagctggttcctcacaagtcctcacagagaaagtcgagtgtaataaaacatacaatttgcggagaaagaacaggattcaagacatgggttctgcttcacttctggattcttcagaaccaggtgagaagaacgccaagggtaaggggaaactggaatctgctgtctccagaaggggaggggaacctatggctaaaaccaaacaaaagaagcgaagtttagcagagagcactgatcagccttcatcttcacgcaaaatgccaaaacgtgctgcagcgtgtaaagatttgaaagagaaatccttttcgatatctgataaatcttgtcgcattgaaatagagaaggatcagattgttgatgaagaaattgtagctgtccgacttactgctggacaggacgatggtcgcccaaacaggcgaatttcagagtttatccttcatgatgagaatggtaatatacagccacttgagatgcttgaagtgattgatttatatgtcactggttttatattgccgcttgaaccaagcataggcaagaaaaaagagaaaggtatcaagtgtgaaggatttggtcgacttgaatcctgggatatctctggctatgaagatggttctccagtcatatggatttctactgatgttgctgattatgactgtcagaaacctgctgccagttacagaaacttttatgatcatttctttgaaaaggctcgtgtatgcatagaggtatataaaaaaattgcaaagtcctcggggggagaccctaatataagtttggatgaactacttgctggtatggcacggactatgagtggtaacaaatggctttgtggagctgcaactataaaggagtttgttatttctctgggtgagttcgtttataagcaactcattggtttggacctgacatccaaggcaaatgacatgatgtttgcagatatctccgctcttattgctctcagagatgagtatatgaggcacggaaaccctgcgcatgcacaagtaattccctcaaatgggagtttaaggattggctcaggaactggaaatggagaagagacggatcagatggattctgtaaaacctgcaaatggtgaagcggaagatttaaagttagcacgactcttgcaggatgaagagtattggagatgtatgaggcagaacaaaaactacggaccgctccctgtagctaacaaatactatatcaagattaatgaagacgagattgccaatgattatcctctccctgctttttacaaaacctcccttcaagaaacagacgagtatatagtttttgataatggctatgatatgcatgggtttgatgatcttcctcgaaccaagcttcataattggtctttatacaattcagatgcaagattggtttcactggaacttcttcccatgcaagcttgttcagacatcgatgttacaatctttggttcaggtgtaatgacttcagacgatggatgtgggttcaatcttgattctgatgctggccaatcttcttccactacttcagaaccacaggttgctgaaggaatgccaatttatctgagtgccataaaggaatggttgatagaatttggatcatctatgattttcacatccatccgaacagaaatggcctggtacagacttggcaaaccatcaaaacagtatgctccttggtatgacacagtgttgaaaactgcaaggctagctatagccatgattacattgctgaaggaacagagccgagtatcacgactttcctttggagatgtcatcaagaaagtatctgagtctaatcaggaagataaatcttacatttcttctgatccattggctgttgagagatatgtcgttgtccatggacagattattctgcaactctttgcacattttcccgatgatcagatcagaaggtctccatttgtaactggtcttatgaacaaaatggaagagcggcaccataccaaatggttagtaaacaagaggaaaatttttccgagaagtgtacccaatttaaatcctagggcagcagtgggtcctattgtgtccaagaggaaagctatgcaagcaacgactacaaagctaatcaatagaatatggggagagtattactcaaaccatttgccagaggattcaaaagaggggcctgtgagcgagttaaaggaagaggatgaattggaggaacaggaagaaaatgaagatgaggacaatgaagaggagccaatacttttggagggaacctcaaagaagcattcagattcaaagcaaacaaaaacattttcggttaatgccaaaataaaatgggaaggaaaacctgaagggaagactagttctggatatcctatttataagcaggcaatcattaatggggaagttatttctgtaggaaaatctgtgttagttgaagttgatgaatttccggacatgtattatgttgagtatatgttcgagtcaaagattggaagaaaaatgtttcatggtaggatgatgcagtacggttgtcatactgttattggcaatgctgctaatgagagagaggtgtttttgactaatgagtgtagggatatgggactgcaggatgttaagcagacagttgttgtaaatattcagaaaaggccttggggtcatcagcatcgaaaggataatatcattgcagatagagttgacagggctagagcagaagaaaggaagaagaaaggactacctactgaatattattgtaaaagcctgtactggcctgaaagaggtgctttctttagccttccgtttgatactttgggtcaagggtctggtatttgctcatcttgcaaaatgcacgacgttgaaaaggcgaaagatattttcactgtaaattcctccaagtctggtttcctatttaaaggaactgagtattcccttaatgattatgtttatgtaagtccctttgagtttgaggaaaagatcgagcaaggaactcataagagtggaaggaatgtggggttgaaagcttatgttgtgtgtcaagtgctagagattgttgttaaaagagaaataaaacacaccgaaataaaatctacacaagtaaaaatcaggaggttctttcgaccagaagatgtatcaagtgagaaggcatactgctctgatatgcaagaggtgtattacagtgatgaaacacatatcatctcagtagattctatagaagggaaatgtgaggtcagaaagaagagagatattcctgaacaaagtgcccttggaatgttccaaaatgtatttttctgcgagctcttgtatgatcccgccactggatcactgaaaaagttgccagctcatataaaagtaaaatattcaactggacaaacatctgatgctgcagctagaaagagaaaaggaaaatgtaaagagggagatgacgattcagagtcctctaaggaggggaaaacattaaatgaaaaacgtttagctaccttggacatttttgcaggttgtggtggtttatcacaagggttggagcagtcaggtgtttcatcaactaaatgggctatcgagtatgaagaacctgctggtgatgcatttaaagctaatcatcctgaggcattggtgttcgttaacaattgcaatgttattcttagggctgtaatggagaagtgtggggacatggatgattgtatctcaacgactgaggctgcagaattggctgcaaagcttgatgaggaggaaataagtagtttaccaatgcctggacaagttgatttcataaatgggggtcctccatgccagggtttctctgggatgaacaggtttaaccagagcagttggagtaaagtccagtgtgagatgatattagcattcttatcctttgctgattatttccggccaagatatttcttgttggagaatgtgaggaactttgtgtctttcaataaaggacagacattccgtttaaccttggcttcacttcttgagatgggttatcaggtgagatttggtatccttgaggctggagcatttggggtttcccaatcaagaaaaagggcattcatatgggcagcctgtcctgatgatgtgcttccagaatggccggaaccactgcatgtattttcggcacccgagttgaagatcacattatctgaaaaagttcagtatgctgctgtccgtagtactgcaagtggtgctccattacgtgcaataactgttaaagataccattggtgatctcccatctgtgggcaacggagcctcaaaaggaaacatggagtatcaaaatgatcctgcatcatggtttcaaaagaagattcgtggtgagatggttgtcttgactgatcatatttcaaaggagatgaacgagttgaacatgcttcggtgccagagaattcccaagaggccaggtgctgattggcgtgatcttccagcggaaaaggtaacattgtctagtggacaagttgttgatttgataccatggtgcttacccaacacggctaagcgacacaatcaatggaagggactgtttggtaggttggattggcaagggaatttcccaacttccattacagaccctcaacccatggggaaggttggaatgtgcttccaccctgtccaagataggattcttactgttcgtgagtgtgctcgatctcaaggttttccagatagctataaattttctggcagtatcattcacaagcacagacagattggaaatgctgttcctcctcctctggcatttgcattagggagatcgctgaaagaagcagtgaacagtaagaataagagctccacatagaagatggttcttacattcttttatgatcatgcttgttagaacatttgtcaagatatttgctcatcatcattcagggtttcagaaacaattaggccttgtataatgtgatgtgcattgatactttgtttgaggctgattcgtggtttagcttttctcggccaaggaattgaatggataatgctccgaagagatcattttgtgacaatttggattttcttgaatagttggtgttcatccgtttttgttacaattgagacca

SEQ ID NO: 7934 - DNA, 4922 bp, Lotus japonicus
tttccttataaattctgtaaattaactctttttttctgctgttaatatccaaaataggtgctatgaacaggaagagccaaaagaaacctgttgtttccaaaactaaagatgaagttaaggctggagataaaaagaagcggagtttgtcaaagagcagtgagcagcctgctgctacttgcaaaaggccaaaacgagctgcagcatgtgaaaatttcaaggagaaatctttttccatatctgagaaatcctgtcttattgaatcaaagaaggaccagattgtagatgaagaaatacttgctgtccgcctgacctgtggacaggacgatggccgtccaaataggagacttacagactttatccttcatgatgaaagtggtacagcacagccacttgagatgctggaaattaatgatttatttatcactggggttatatcgccactagaaggaagtacagagaagaaaaaggagaacggtgttagatgtgaaggctttggtcgaatcgaatcatgggatatatctggatatgaagatggctctccagttatatggatttcgactgatattgctgattatgattgcctaaaaccagcccctagttacaaaaaattttatgatcatttctttgaaaaggcccgtgcatgtatagaagtatacaaaaaacttgcaaagtcttctggtggggaccctgacataagtcttgatgagttacttgctggtatagcacggtctatgagtggcagcaagttcttctctggaactgcatctctaaaagattttgttatttctcagggcgagtttatttataagcagctcataggtttagacatgtcagacaagacaaatgacaagatgtttgcagatattcctgctcttgtctctcttagagatgagagtaagaaacaagcaaactatgcacatgcacaagtggcgccttcaaatgggagtttaagaattgattctggaattgaagatgaggagaagaaggatccgatggattcaataccttctttagctgaggaagatgatgatgtaaagttagcacgactattacaggaagaagagaattggaaatccatgaagcagaagaaaaatcccagatcagcctcatctaacaaatactacatcaaaattaatgaagatgagattgccaatgattatcccctccctgcttattataaaacctcccttcaggagacagatgaattcatagtttttgataatgactatgacatatatgacactgaagaacttcctcgaagcatgctgcacaattggactttatacaactctgatgcaagattggtttccttggaacttcttcctatgaaaccttgttcagagattgatgtaaccatctttggctcaggtataatgacttcagatgatggaagcgggttccatcttgatacagagtctggccaatcttcttctactgcttctggagcacaggaaactgatggaatgccaatttatttaagtgccataaaggagtggatgattgaatttggatcatctatgattttcatatccatccgaactgatatggcctggtatagacttgggaaaccatcaaagcagtatgctccttggtatgacacagtaatgaaaactgcaagggttgctacaagcattatcaccttgttgaaggagcaaagccgagtatcgcgactttcctttggagatgtcatcaagaaagtagctgagttcactcagaaccataagtcctatatttcttctgatgcatcgaaagttgagagctatgttgttgtccatggacagataattttgcaactgtttgcagaatatcctgatgaaaagatcagaaagtctccatttatttctggtctcgtgaacaaaatggaagcacgacaccatactaaatggttagtgaagacgaagaaagttttgacaaggagtgaaccaaatttaaatcctagggcagcagtttctattgtatccaagaggaaagctatgcaagctacaacaacaaagctgatcaatagaatatggggagagtattactcaaaccacatgccagaggattcaaaagagggcactgccagtgaactaaaggatgaggatgaagtggaggaacaagaagaaaatgaagatgaggatgctgaggagacaatatgcttggagggaacccaaaagtcacactcagtttccacacaaaccaagacattttctgctgacggagaaataagatgggagggggaacctgaagggaagacctgttctggaaatcttctttataaacaggcaattatccatggtgaagttgtttctgtgggaaaatctgtgttggtggaagttgacgaattgggtgaacttcctgatatatattatgttgaatatatgtttgaatcaaagaatggaaaaaaaatgtttcatggtaggatgatgcagcgtggttgcgagactgttcttggcaacactgcaaatgagggagaggtgtttttgagtaacgaatgcagggatttgggactgcaggatgttaagcagacagttgttgttaatattcaaaaaaggccttggggacatcagcatcgaaaggataatatcattgcagacaaaatggatagggctagagcagaagaaaggaagaagaaaggactacccactgaatattactgtaagagcttgtactggcctgaaagaggtgctttcttcagccttccatttgacactttgggtctaggatctggagtttgtcactcttgtaaactaaatgaagaccaaaaggagaaggatattttcaaaataaattcatcgaagtctggtttcctattgagaggaacagaatattctcttgatgattacgtttatgtaagtcctttatactttgatgaaaagatagcgcaaggaacatacaagagtgggaggaatgttgggttgaaagcttatgttgtgtgccaagttcttgagatcattgtccaaaaggaaataaaaaaagctgaaataaagtctactgaggtcaaagtcagaaggttcttccgaccggatgatgtatcaaatgagaaggcatactgctctgatgtacaagaggtgtattacagtaatgaaacacatataatctctgtagaatccatagaaggaaaatgtgaaatcagaaaaaagaaggacatccttgaaagcagttcccctggaatattccaaaatgtttttttctgcgagcacttgtatgatcctgctactgggtcaatcaagcagttaccaactcaaatcaaagtaaaatattcaagtggacatacagctgatgctgcagctagaaagaaaaagggaaaatgtacagagggagatgacatttcagatactgataaggaaagaaatttatcaaatgaaaaacgtttagcaacgttggacatttttgccggctgtggtggcttatcagagggattgcagcagtcaggaattgcatcaactaaatgggctattgagtatgaagaaccagccgggaatgcgtttaaagctaatcatcctgacgcgttggtgtttattaacaattgcaatgttattcttagggctgtaatggagaagtgtggggacctagatgattgtatctcaacgactgaggcggcagaattggctgcgaagcttgacgagaatgaatcaagtagtttaccaatccctgggcaagttgatttcattaatgggggacctccatgccagggtttctctggaatgaatagatttaaccaaagcacttggagtaaagtccagtgcgagatgatattagcattcttatcctttgctgattatttccggccaaggtatttcttgttggagaatgtcaggacctttgtgtcctttaataaaggtcagacattccgtttaaccttggcttcacttcttgaaatgggttatcaggtaaggtttggtatccttgaggcgggagcttacggggtttcccagtcaagaaaaagggcatttatatgggcagcctctcctgaagatgtgcttcctgagtggccagaaccattgcatgtcttttcggcccctgagttgaaaatcagattgtccggaaatgtccaatatgctgcggttcgcagtacttcagacggtgcccctttacgtgcaataactgtccgagacaccattggtgatctcccacctgtgggcaatggagcctcaaaaacaaacatggagtatcaacatgatcctgtctcatggttccaaaagaagattcgacgggatatggctgtcttgacagatcatatctcaaaggagatgaatgagttgaacttgattcggtgtcagaaaataccgaagagaccaggtgctgattggcgtgaccttccagatgagaagataaagttgtctactggacaagttgttgatttgataccatggtgcttgccaaacacagctaagagacacaatcactggaagggattgtttggtaggttggattggcaaggtaacttcccaacttccatcacagatcctcaaccaatggggaaagttggaatgtgcttccatcctgatcaggataggattcttactgttcgtgaatgtgcacgctctcaaggcttcccagacaactaccaattttctggcaacattatacacaagcacaggcagattggtaatgctgttcctcctcctctagcatttgctttagggagaaagctcaaggaagcagtggatagtaagggctccacttaggaagatggccagatggggcatattccttaaagggcatgctcatcatattaaaagattagataatagtcattaaaatattgcaaattatatttcaggattcaagaaacaattaatccttgtatagatcattaccccttggtcaattttcggttaatttactgtttgatttttcttggtggaagaattggaagggtaatcttttcatacccaaatcgagtccacacttcatgttctacataactgcctgcatgc

SEQ ID NO: 7935 - DNA, 4988 bp, Lupinus angustifolius
gaaatattcagcataccattttgcacatacatttcctctttccattctctcaatagaaagtttatttgttgaaaaaggaagggagttgaaggcacaatatgggttcagcttcacttcaagattcatctcaaccatccacttgttccgatccaggtgttaagagcagccaagagaagaagaaaactgtagattgtaaaactgaagaggaagttatggcccgaggtaaacaaaagaagcgaagcttgccagaacaaagtgagcagccaactggtactcgcaaaatgccaaaacgagctgcggcaagtaaaaatctgaaggagaaatctttttccatacctgggaaatcttgtcttattgagacaaagaatgatcgagttgtagatgaagaactccttgctatccgcctgacttctgaacaggatgatggtcgtccaaatagaagacttacagactttattcttcatgatgagaatggtacgccacagcctcttgaggtgcttgaagttaatgatttgtatatcactggagttatattgcctcttgaaggaagtacagagaagaaaaaagagaaagagagggttagatgcgaaggctttggtcgcattgaaacatgggatatatcaggatatgaagagggctctccagtgatatggctttctactgatgttgctgattatgactgcttgaaaccagcccccagttacaaaaaaatttatgatcatttctttgaaaaggctagagcatgtatagaagtatacaaaaaacttgcaaagtctgctggtggggaccctgatataagtctcgatgagttacttgctggcatagcacgatctatgattggtagtaagtccttttctggaactacatctgtaaaggattttgttatttctcagggtcagtttatttataagcagctcataggtttagacatgacttccaagacaaaggacaagatgtttgtagatattcctgctcttgttgctcttagagatgagagtaagaaacaagctaactatgtgcatgcagaagtaaagccttcaaatgggagtctaaggattgattcaggagttggagatgaagagaataagagtcaaatgaattccatgactgaagttgctgaagaagatgaggatgcaaagttggcaaggctattgcaggaagaagagcaatggcgatctatgaagcagaagaaaaaccccagatcagtctcttcatctaacaaatactatatcaaaattgatgaagatgagattgcaaatgattacccactccctgtctattataaaacatctcttcaggaaacagatgaatttatagtttttgataatgactatgatgtgtatgacattgaagatcttcctcggagcatgctacataattggtctttatacaactcagatgctagattgatttccttggaacttcttcctatgaaatcttgttcagatattgatgttaccatctttgggtcaggggtaatgactgcggatgatggaagtgggttccacctggataccgatactgaccaatcttcttccattagctcaggagcacttgttgctgatggaattccaatttatctgagtgccataaaggaatggatgatcgaatttggttcatctatgattttcatatcaatccgcactgacatggcatggtacagacttgggaggccatcaaaacagtatgctccttggtatgacacagtgctgaaaactgcaaggctagctattgacattatcaccttgttgaaagggcagagccgagtatctcgactttcctttggagatgccatcaagaaagtatctgagtttactccgaaagataaatcttacatttcttctgatccattgtctgttgagaggtatattgttgtccatggacagattgttctgcagctgtttgcagaatatcctgatgacacaatcagaaagtctccatttgtcactggtcttatgagccaaatggaagcacgacgccatactaaatggttagtgaagaagaagaaagttgttcctaagagtgaaccaaatttaaatcctagggcagcagtggcttctatagtgtccaaaaggaaagccatgcaagctacaacaacgaagctgatcaatagaatctggggagaatattactctaaccacttgccagaggatgccgaagagggagctgctagtgaagtaaaggatgaggatgaattagaagaacaggaagaaaatgaagaggaggatattgaggagatgttatgtttggagggaacccaaaaagcacattctgtttccaaacaaatcaaaacattttctgctgatagtgaaataagatggggtggtggtcctgagggaaagaccagttatggatatcttctttataaagaggcaattattcatgaggaagttatttctgtgggaggatctgtgttagtagaagttgacgaagcagatgaacttcctgatatttattatgttgaatatatgttcgaagcaaagggtggaaagaaaatgtttcatggtaggaggatgcagcatgggtgtagcactgttcttggcaacactgccaatgagagagaactgtttcttactaatgagtgtagagatctgagacttgaggatgtgaagcaggcagctattgtagacttgcgaaaaatgccttgggggcatcagcatagaaaggataatattgcttctgataaaactgatagggccagagcagaagatcggaagaagaaaggactacctactgaatactattgtaaaagcctttactggcctgaaagaggtgctttcttcagccttccatctgatactttgggtctaggatctggcatttgtcactcttgcaatttaaaggaagctgaaagggagaaagaaaacttcaaagtcaattcatctaagtctagtttcctatttaatggatctgaatatgctcttcatgattatatttatgtaagtccttttgacttcgacgaaagaatagaacaaggaactcacaagagtgggaggaatgtggggctgaaggcttatgttgtttgtcaagtgctggagattattgtcaagaaggaaataaaacaagctgaaatgaaatccacacaggtcaaagtcagaaagtttttcagacctgaagatatatcaaatgagaaggcatattgctctgatgttcaagaggtatattatagtgatgaaacacacataatctcagtacaatccatagaagggaaatgtgaggtcagaaagaagaatgatgtccctgcatgcagtgcctctggactctttcaaaatgtatttttctgtgagcacttgtatgatcctgccactgggtcacttaaaaagttgccagctcatatcaaggtaaaatattcaagtggacatacatgtgatgctgcagctagaaagagaaaagggaagagtaaagagggagaaagccttccagagcctgagaaggaaaggaagacatcggatgaaaagcgcttagcaaccttggacatttttgcaggttgtggtggtttatcagaggggttgcagcagtcaggaattgctcaaactaaatgggcaatagaatatgaagaaccggctggggatgcctttagagctaaccatcctgaagcactggtgtttgttaacaactgcaatgttattcttagggccgtgatggagaaatgtggtgacacagatgattgtatttcaacttctgaggcctcggaattggctgcaaaactcgatgagaaggaaatagataatttacccatgcctgggcaagttgatttcattaatggaggacctccttgccagggtttctctgggatgaataggttcaaccaaagcagttggagtaaagtccagtgtgagatgatattagcattcttatcctttgccgattactttcggccaaggtatttcttgctagagaatgtacggaacttcgtatcctttaataaaggacagacattcaggctaaccttggcttcactcttggagatgggctatcaggtgagatttggcatcctggaagctggagcttttggagtttcacagtctagaaaaagggcattcatatgggcagcttctccagaggatgtgcttcctgagtggcctgagccaatgcacgtgttttccgccccagagttgaaaatctccttatctgaaggtgtccagtatgctgctgtccgcagtacagcaaatggtgccccactacgtgctataactgttcgtgataccattggtgatctcccaccagtggggaatggtgcctcaaaatcaaacatggagtatggacaggagcctgtctcatggttccagaggaatattcgaggggatatggtcgttctgaccgatcatatctcaaaggagatgaatgagctaaacttgattagatgtcagaagatcccaaagaggccaggtgctgattggcgtgatctcccagaggaaaagatcacattgtctaccggacaagttgtagatttgataccatggtgcttgccgaacactgctaagcggcataaccaatggaagggactgtttggtaggttggactgggatgggaacttcccaacttccattacagaccctcaaccaatggggaaggttggcatgtgcttccatcctgaccaagatagaattcttactgttcgtgagtgtgccagatctcaaggtttccctgatagctaccaattttctggtaacatcatacacaagcataggcagattgggaatgctgttcctcctccccttgcatttgcattgggaagaaagctcaaggaggcagtggaaagtaagaactccaattagatggtgcatacatcattcttatgattttataggtttgaattggctatcaagatgttgtaaattctttcagggttctagatacaattagtcattgtacaaatatacatgaaccgaaatgttaatcctatatgaatggtgcaaattgttttgcgatatgattattcttgccaacatacaacataaatacaaaaaatacaataacaacaaaaa

SEQ ID NO: 7936 - DNA, 5118 bp, Medicago truncatula
cgcgaaaagccctatacccaaaaattcatcccccgccaaatgcattacaccatttcacaaaaccctcactttctttcccatctacaacataacgattcatcaaaattcacatcgattcgtcaaaatttcgcgttttgcatataaggaaaatcattcaactaatgggttccgcttctcttctcaattcttcagatcctggtgttaaggacagcacgagtaaagaggaccctgttgtttcaaacactgaagaggaagatatggctggtggcaagcaaaagaagcgaagtttgtcagagagcaatgagcagcctgctcctactcgtaaaatgcccaaacgatcagcgagtgcagcaagtaaaaatttgaaggagaagtctttttctaaatctgataagtctgatcttattgaaacaaagaaggatcaggttgtagaagaagaatttcttgctgtccgcatgactgctggacaggaggatggccgcccaaatagaagactcacagactttatccttcatgatgaatctggtgcagcacagcaacttgagatgcttgaactcaatgatttgtttatcactggacttatattgccactggaagcaagtacagacaagaaaaaagagcaaggcgtccgatgtgaaggctttggtcgaattgagtcgtgggatatatctggttatgaagagggtgctccagtgatatggatttctactgatattgctgattacgattgcctgaaaccagctgctagttacaaaaagtattatgatcaattctttgaaaaggctcgtgcttgcattgaagtatataaaaagctaacaaagtctgctggtggagaccctgacatcagtctcgatgagttacttgctgggctggcacggaccatgagtggtagcaagtacttttctggagctgcatctctgaaggagttcatcatttctcagggcgatttcatttataagcagctcattggtttagacatgacgttgaaggccaatgacaaggggttcacagagattcctgctcttgctgctcttagagatgagagcaagaaacaaacaaactttgcaaatgcacaagtgatgccatcaaatgcaactttaaggattggttcgggaaccggggatgaagagaagaaggatcagatggctgtagatgaagaagatgaagatgcaaagctagcaagactgttgcaggaagaagagtactggaaatcaaagaagcagaggaaaaaccctagatcatcctcgtcatctaacaaattctatatcaaaatcaatgaagatgagatagcaaatgattaccctctccctgcttattataaaacttctcttcaagaaacagatgaatttattgtttttgataacgactatgatgtgtatgacactgaagatcttcctagaagcatgctgcataattgggctttatacaactctgattctagattgatttccttggaacttcttcctatgaaaccttgctcagagatagatgttacaatctttggatcaggtgtaatgacctcagatgatggaagtgggttcaatctcgatacagaggctggccaatcttccagtgcttctggagaacaggccaccgatggaattccaatttatctgagtgctataaaagaatggatgattgaatttgggtcgtctatggttttcatatccatccgaacagatatggcctggtatagacttggcaaaccatcaaagcagtactctccttggtacgacaccgtattgaaaactgcaaggattgctataagcattatcacattgttgaaggagcagagccgtgtatcacgacttaccttcggagatgtcataaaaaaagtatccgagttcagtcaagacaataagtcatacatttcttctgatccattggctgtggagagatatgttgttgtccacggacagataattctgcaactgtttgcagaatttccagatgagaagatcaggaagtgtccttttgtggccggtcttacgagcaaaatggaagcgcggcaccataccaaatggttgatgaagaagaagaaagtgttgccaaggagtgagccaaatttaaatcccagggcagcaatggcccctgttgtatccaaaagaaaagctatgcaagcaacaacaacgaagctgataaacaaaatatggggagagtattactcaaaccacttgccggaggattcaaaagaggtaattgctagtgaagtaaaggatgatgatgatgaagcggaggaacaggaacaggaagagaatgatgatgaggatgcggaggtggagacagtactgttggagggaatgcaaaagccacactcagtttccaaacaaactaaagcgttttctgatgatggagaaattagatgggaagggggtcctgaagggaagaccagttctggattgcttctttataagcaggcaattattcatggtgaagttgtttctattggaacatctgtgtcagtcgaagtagatgaatcggatgaacttcctgatatatattacgttgaatatatgtttgaatcgaagggtgggaaaaaaatgtttcacggtaggatgatgcagcatggttgtcagaccgttcttggcaatgcagctaacgagagggaggtgtttttgactaatgagtgcagggatttgggactgcagaatgttaagcagataaatgttgcaagcatccgaaaaacaccttgggggcatcaacatcgaaagaataccatcattgcagataaaatcgacagggaaagagcagaagaaagtaaaaagaaaggactgcctactgaatattactgtaaaagcttgtattggcctgaaagaggtgctttctttagccttccgtttgatacacttggtctagggtctggcgtttgtcaatcttgccagttacaggaagccgaagaggagaaggacgttttcaaaataaattcatccaagtctagttttgtattggagggaactgaatattctctcaatgactatgtttatgtcagtccttttgaatttgaggaaaaaatagagcagggaactcataagagtgggaggaatgtagggctgagagcttatgttatatgccaagtgcttgagatcattgcaaagaaggaaacaaaacaagctgaaataaaatctacagatatcaaagtaagaaggttcttccgaccggaagatgtatcaagtgagaaggcatactgttctgatgtgcaagaggtgtattacagtgacgaagcatgtacaatatctgtacaatccatagaaggtaaatgtgaagtcaggaaaaagattgacgtccctgaaggatgtgcccccggaatcttccataatatctttttttgtgagctcttgtatgatcctgccactggagcactcaagaagttgccagcacatatcaaagtaaaatattctactggacacacagctgatgctgcagctagaaagaaaaagggaaaatgtaaagagggagataacatttcagagcctgatcccgaaagaaaaacatcaaatgaaaaacgtttagcaaccttggacatttttgcaggatgcggtggcttatcagaggggttgcatcagtctggtgtttcatcaactaaatgggctattgagtatgaagaaccagctgggaatgcgtttaaagctaatcatcctgaagcattggtgtttattaacaattgcaatgttattcttagggctataatggagaaatgtggagacatagatgattgtatcacaacaacagaggctgcggagttggcctctaaacttgatgaaaaggatttaagtaatttacccttgcctgggcaagttgatttcattaatggaggacctccatgccagggtttctctgggatgaatagatttaacacaagcacctggagtaaagttcagtgtgagatgatactggcgttcttatcctttgctgattatttccggccaaggtatttcctgttggagaatgtgaggaactttgtgtcttttaataaaggacagacattccgtttaactttggcatcacttcttgagatgggttatcaggtgaggtttggtatccttgaggctggagcttttggtgtttcacagtcaagaaaaagggcatttatatgggctgcgtctccagaggacgtgcttccagagtggccagaaccaatgcatgtcttttctgctcctgaattgaaaatcacattgtcagagaatgtccagtatgctgccgtccgcagtaccgcaaatggtgctccattacgtgcaataactgttcgtgataccattggtgaactcccagtcgtaggcaatggagcttctaggacaaatatggagtaccaaagcgatccggtgtcatggtttcaaaagaaaattcgaggcaatatggctgtgttgactgatcatatatcaaaggagatgaatgagttgaacttgattcgatgtcagaaaattcccaagagaccaggttgtgattggcgtgatcttccagaggaaaagataaaactgtcaagtggacaacttgttgatttgataccatggtgcttgccaaacactgctaagaggcataatcaatggaagggactgtttggtaggttggactggcaaggaaattttccaacttccatcactgaccctcaaccaatggggaaggttggaatgtgcttccaccctgatcaagatagaattcttactgttcgtgaatgtgcccgatctcaaggcttcccagatcgctatcagttttatggtaacatcatacacaagcacaggcagattggtaatgctgttccccctcctctggcatttgcattgggaacaaaactcaaggaagcagtggatagtaagagctccaagtagaagactagggcatgcatcctgcaaaaagcatgcttatcatgagacttttgaaaaacaatgcaagttattttcttttagtgttccggagacaaccaacccttgtatagagttgtactcttggttatttttcttagcttatttcttgtttaaaagaattgaaagaattgattgaatgggcaatgctatatatatatcaagctcattttctatcaactttggttatcttggtattagagattcaacaaagttttactttggctgtctacagcctaacaaatgcaggaaagattatcgt

SEQ ID NO: 7937 - DNA, 5163 bp, Cicer arietinum
aaactcttgtaagaaagaatctaatttttttaaggaaggtggaaaagtacacatagtatagtgaaaaaataatgtgaatatcaatgggcgccaaaaaaacccttttccccaaaatttgcatccccgccaaatccaattcatcattttccttttccttttcattttcaatttcaacaacaaaccatttttccatttctgccaaaacgctactcaaatccatttcaacacctgcgttttgcgtaaaaggaaaaacattcaactcatgggttcagcttctcttttgaattcttcagattcttctcaaccgggtgttaacgacagcaacactaaacacgaacctgttgtttcaaacaccgaagaggaagaggttatggctggcggtaataaaaagaagcgaaattcgtcagagagtagcgagcagcctgctcctactcgtaaaatgccaaaacgatctgccagtgctgcaagtaaaaatttgaaggagaagtctatttccgtatctgataagtcttgtcttattgaaacaaagaaggagcaggttgtagatgaagaatttctcgctgtccgtatgactgctggacaggatgatggccgcccaaatagaagaattacagacttcatccttcacgatgaaactggtgcatcacagccacttgagatgcttgaaattaacgatttgtttatcaccggacttatattgccactagaaggaagtgcagacaagaaaaaagaacaaggtgttagatgtgaaggctttggtcgaattgaatcctgggatatatctggctatgaagatggctctccagtgatatggatttctactgatattgctgattatgattgccaaaaaccagctgctagttacaaaaagtattacgatcatttctttgaaaaggcccgtgcttgcatagaagtatacaaaaaactagcaaagtcttctggtggtgactctgacgtaagcctcgatgagttacttgctggcattgctcgggcaatgagtggtagcaagtacttttcgggaactgcatctctaaaggagttcattgtttctcagggtgagtttatctataagcagctcattggtttggacatgacgaccaaggcaaatgacaaggggtttgctgacattcctgaaaggagagtaagaaacaagctaactttgtacgtgcacaatcaatgccatccaatgggagtttaaagattggttcgggaagtggagatgaagaaaacaagaatcagatggattctggagctgatgaagatgaggatacaaagttagcacggctattgcaggaagaagagtattggaaatctaggaagcagaagaaaaaccccagatcagcctctggttctaacaaattttatatcaaaattaatgaagatgagattgccaacgattaccctctccctgcttattataaaacttctcttcaagaaacagatgaatttatagtttttgataatgagtatgatgtgtatgacattgaagatcttcctaaaagcatgctgcataattgggctctgtacaactctgattctagattgatttccttggaacttcttcctatgaaaccttgctcagagatcgatgttacaatctttggatcaggtaaaatgacttcagatgatggaagtgggttccatctcgatactgaggccggccaatcttctagtgcttctggagcacaggttactgatggaattccaatctatctgagtgccataaaggaatggatgattgaatttggatcgtctatggttttcatatccatccgaacagatatggcctggtatagacttgggaaaccatcaaagcagtacagtccttggtatgacacagtattgaaaactgcacggcttggtataagcattatcggattattgaaggagcagagccgtgtatcacgactttcctttgcagatgtcataaagaaagtatctgagtatgctcaagagcatcagtcatacatttcttctgatccgttggctgtagagaggtatgttgttgtccatggacagatcattctgcaactatttgctgaatttccagacgacaagatcaggaagtgtccttttgtgaccggccttatgaacaaaatggaagcacgtcaccatactaaatggttaatgaagaagaagaaagtgttgccaaggagtgagccaaatttgaatcctagggcagcagcggatcctgttgtatccaaaaggaaagctatgcaagctacaacaaccaagctgataaatagaatatggggagagtattactcaaaccacttgccagaggattcgaaagagggaactgccagtgaatcaaaggatgatgatgaagcagaggaacaagaacaggaacaggaagagaatgaagacgaggaagctgaagaggagacagtactattggaagaaacccaaaagccgcgctcagtttcgaaacaatcgaaagcagtttctgatggtggagatattagatgggaaggtggccctgaaggaaagaccagttctggatgccttctttataagaaggcaattattcatggcgaagttgtttccgtgggaatatctgtgtcggtggaagttgatgaatcagatgaacttcctgacatatattatgttgaatatatgtttgaatcaaagaacgggagaaaaatgtttcacggtagaatgatgcagcatggttgtcagactgttcttggaaacacggctaacgagagagaggtgtttttgactaacgagtgcaaggatgtagcactgcaggatgttaagcggacaaatgttgcaagcatccgaaaagttccttgggggcatcaatatcgaaaggataatcttgttgctgataaacttgaccgtgcaagagcagaagaaagaaaaaagaaaggactacctattgaatattactgtaaaagcttgtactggcccgaacgaggtgctttcttcagccttccgtttgatacattgggtctagggtctggcgtttgtcactcttgcaaattagaggaagccgaaaaggagaaggacactttcaaagtaaattcgtctaagtctagttttgtattggagggaacccaatattttctcaacgactatgtttatgtcagtccttttgaatttgaggaaatgatagagcagggaactcataagagtgggaggaatgtagggttgaaagcttatgttgtttgccaagtgctcgagatcattgccaaaaaggaagtaaaacaagctgagatgaaatctacggagctcaaagtcagaagattcttccgaccggaagatgtatcagatgagaaggcgtactgctctgatgtacaagaggtgtattacagtgatgaaacatgtacaatctctgtacaatccgttgaaggtaaatgtgaagtcaggaaaaagaatgacatccttgaaggaagtgctcccagaatctttcaaaatgtctttttctgcgagctcttgtatgatcctgccactggctcactcaagaagttgccagctcatatcaaagtaaaatattctagtggacatacagctgatgctgtggctagaaagaaaaagggaaaatgcaaagagggagatagcatttcagatcctgatcttgaaacaaaaacatcaaatgaaaaacgtttagcaaccttggacatttttgcaggttgtggtggtttatcagaagggttgcaccagtcgggggtttcatcaactaaatgggctattgagtatgaagaaccagctgggaatgcgtttaaagctaatcatcctgaagcgttggtgtttattaacaattgcaatgttattcttagagctataatggagaaatgtggggacatagatgattgcatctcaacaactgatgctgcagaattggcctcttcacttgatgagaaggatttaagtaatttacccttgcctggccaagttgatttcattaatggaggacctccatgccagggtttctctgggatgaatagattcaacacaagcacttggagtaaggtccagtgtgagatgatattagcattcttatcctttgctgattattttcggccgaggtatttcctgttggagaatgtgaggaactttgtgtcttttaataaaggacagacattccgtttagctttggcttcacttcttgagatgggttatcaggtgaggtttggtatccttgaggctggagcttttggggtttcacagtcaagaaaaagagcatttatttgggctgcctcgccggaggacgtacttcctgagtggccagaaccaatgcatgtcttttctgcccctgagttgaaaataaaattgtcggaaaatgtccagtatgctgctgtccgcagtaccgcaaatggtgccccgttacgggcaataactgttcgggataccattggtgatctcccagctgttggcaatggagcctctaggacaaacatggagtatcaaagcgatcccaactcatggtttcaaaagaagattcgaggcaacatggctgtcttgactgatcatatatcaaaggagatgaatgagttgaacttgattcgatgtcagagaattcctaagagaccaggttgtgattggcgcgatcttccagatgaaaagattaaattgtctactggacaagttgttgatttgataccatggtgcttgccaaacacagctaagagacataatcaatggaagggactctttggtaggttggattggcaaggaaatttcccaacttccattaccgatcctcaaccaatggggaaagttggaatgtgcttccaccctgaccaagatagaattcttactgttcgtgaatgtgcccgatctcaaggcttcccagattgctatcaattttatggtaacatcatacacaagcacaggcagattggtaatgctgttcctcctcctttggcatttgcattagggagaaaactcaaagaagcagtggataataaaagtagctccaattagatgaagtgctcttatgatatgaaacattaaataactatacgtagtcaccataacattgcaaattcttatctttcaggggattttttagaatcgacctacctttgtatatagagttgttgtcttggccatttatccaagcctaatcaattccttgttttaaaggattgacgaatggatggtaatgctataaaactcattttctatcaacttggatttttttgggattaggtgata

SEQ ID NO: 7938 - DNA, 5124 bp, Medicago truncatula
caaaatcctcactttctttccatctgcaacaaaacgattcatcaaaattcacttcgattcatcaaaattcaattcgattcatcaaaattccgcgttttgcatattaggaaaatcattcaagtcatgggttccgcttctcttctcaattcttcagatcctggcaatgtggatgattatgatgcttataaatcccttatttgtatttcacgctctgctccgataccctgtgtcgcctttacattactttccctggatcctgttgtttcgaacactgaagaggaagttatggctggtggcaagcaaaagaagcgaagtttgtcagagagcagtgagcagcctgctcctactcgtaaaatgcccaaacgatcagcgagtgcaacaagtaaaaatttgaaggagaagtctttttccaaatctgataagtctgatcttattgaaacaaagaaggatcaggttgtagaagaagaatttcttgctgtccgtatgactgctggacaggagaatggccgcccaaatagaagaatcacagactttatccttcatgatgaatctggtgcagcaaagcaacttgagatgcttgaaatcaatgatttgttcatcactggacttatattgccactggaagcaagcacatacaagaaaaaagagcaaggtgtccgatgtgaaggctttggtcgaattgaatcgtgggctatatctggttatgaagagggtgctccagtgatatggatttctactgatattgctgattacgattgccagaaaccagctgctagttacaaaaagtattatgatcaattctttgaaaaggcccgtgcttgcattgaagtatacaaaaagctaacaaagtctgctggtggagaccctgacataagtctcgatgagttacttgctggactggcacggtccatgagtggtagcaagtacttttctggagctgcatctctgaaggagttcatcatttctcagggcgattttatttataagcagctcattggtttagacatgacattgaaggccaatgacaaggggttcacagagattcctgctctttctgctcttagagatgagagcaagaaacaagcaaactttgcaaatgcacaagtgatgccatcaaatgcaactttaaggattggttcaggaaccgggaatgaagagaagaaggatcagatggattctgtagatgaagaagatgaagatgcaaagctagcaaggctattgcaggaagaagagtactggaaatcaaagaagcagaggaaaaaccctagatcatcctcgtcatctaacaaattctatatcaaaatcaatgaagatgagatagcaaatgattaccctctccctgcttattacaaaacttttcttcaagaaacagatgaatttatcgtttttgataatgactatgacgtgtatgacactgacgatcttcctagaagcatgcttcataactgggttttatacaactctgattctagattgatttccttggaacttcttcctatgaaaccttgctcagaaatagatacaatctttggatcaggtgtaatgacctcagatgatggaagtgggttcaatcttgatacagaggctggccaatcttccagtgcttctggagaacaggccactaatggaattccaatttatctgagtgctataaaagaatggatgattgaatttgggtctactatggttttcatatccatccgaacagatatggcctggtatagacttggcaaaccatcaaagcagtactctccttggtacgacaccatattgaaaactgcaagggttgctataagcattatcacattgttgaaggagcagagccgtgtatcacgactttccttcggagatgtcatcaaaaaagtatccgagttcagtcaagacaataagtcatacatatcttctgatgcattggctgtggagacatatgttgttgtccacggtcagataattctgcaactctttgcagaatttccagaggagaagatcaggaagtgtccttttgtggctggtcttacgagcaaaatggaagcgcggcaccataccaaatggttgatgaagaagaagaaagtgttgccaaggagtgagccaaatttaaatcccagggcagcaatggcccctgttgtatccaaaagaaaagccatgcgagccacaacaacaaagctgataaacaaaatatggggagagtattactcaaaccacttgccggaggattcaaaagaggtaattgctagtgaagtaaaggatgatgatgatgaagcggaggaacaggaacaggaacaggaacaggaagagaatgaagatgaggatgcggaggtggagacagtactgttggagggaatgcaaaagccgcactcagtttccaaacaaactaaagcgttttctgatgacggagaaattagatgggaaggggtccctgaagggaagaccagttctggattgtttctttataagcaagcaattattcatggtgaagttgtttctgttggaatatctgtgtcagttgcagtagatgcatcggatgaacttcctgatatatactacgttgaatatatgtttgaatcgaatggtgggaaaaaaatgtttcacggtaggatgatgcagcatggttgtcagactgttcttggcaatgcagctaacgagagggaggtgtttttgactaatgagtgcagggatttgggactgcaggatgttaagcagataaatgttgtaagcatccaaaaaacaccttggggacatcaacatcgaaaggataacatcattgcagataaaatcgacagggaaagagcagaagaaaggaaaaagaaaggactccctactgaatattactgtaaaagcttgtactggcctgaaagaggtgctttctttagccttccgtttgatacactgggtctagggtctggtgtctgtcaatcttgcaagttacaagaagccgaaaaggagaaggacgttttcaaagtaaattcatccaagtctagttttgtattggagggaactgaatattctctcaatgactatgtttatgtcagtccttttgaatttgaggaaaaaatagagcagggaactcataagggtgggaggaacgtagggctgagagcttatgttatatgccaagtgcttgagatcattgccaagaaggaaacaaaacaagctgaaataaaatctacagatatcaaagtcagaaggttcttccgaccggaagatgtatcaagtgagaaggcatactgttctgatgtgcaagaggtgtattacaatgatgaaacatgtacaatatctgtacaatccatagaaggtaaatgtgaagtcaggaaaaagattgacgtccctgaaggatgtgcccctggaatcttccataatatctttttctgtgagctcttgtatgatcctgccactggagcactcaagaagttgcctgcacatatcaaagtaaaatactctactggacacacagctgatgctgcagctagaaagaaaaagggaaaatgtaaagagggagataacatttcaaagcctgatctagaaagaaaaacattaaatgaaaaacgtttagcaaccttggacatttttgcaggatgcggtggcttatcagaggggttgcatcagtctggtgtttcatcaactaaatgggctattgagtatgaagaaccagctgggaatgcgtttaaagccaatcatcctgaagcattggtgtttattaacaattgcaatgttattcttagggctataatggagaaatgcggagacatagatgattgtatctcaacgacagaggctgcagagttgtcctctaaacttgatgagaaggatttaagtaatttacccttgcccgggcaagttgatttcattaatggaggacctccatgccagggtttctcagggatgaatagatttaacacaagcacgtggagtaaagttcagtgtgagatgatactcgcattcttatcctttgctgattatttccggccaaggtatttcctgttggagaatgtgaggaactttgtgtcttttaataaaggacagacgttccgtttaactttggcttcacttcttgagatgggttatcaggtgaggttcggtatccttgaggctggagcttttggtgtttcacagtcaagaaaaagggcatttatatgggctgcctctccagaggatgtgcttccagagtggccagaaccaatgcatgtcttttctgctcctgaattgaaaatcacattgtcagaaaatgtccagtatgctgccgtccgcagtactgcaaatggtgccccattacgtgcaataactgttcgggataccattggtgaactcccagctgtaggcaatggagcttctaggacaaacatggagtaccaaagcgatcctgtgtcatggtttcaagagaaaattcgaggcaatatggctgtgttgactgatcatatttcaaaagagatgaatgagttgaacttgattcgatgtcagaaaattcccaagagaccaggttgtgattggcgtgatcttccagatgaaaagataaagctgtcaagtggacaacttgttgatttgataccatggtgcttgccaaacactgctaagaggcataaccaatggaagggactgtttggtaggttggactggcaaggaaattttccaacttccatcactgaccctcaaccaatggggaaggttggaatgtgcttccatcctgatcaagatagaattcttactgttcgtgaatgtgcccgatctcaaggcttcccagattgctatcaattttatggtaacatcatacacaaacacaggcagattggtaatgctgtcccccctcctctggcatttgcgttagggacaaaactcaaggaagcagtggatagtaagagcgccaagtagaagactagggcatgcatcctaatggtggcttgtttcgtgatcgcttagggtactgtttggttgtcggtgttacctcctgattgcatgctgatgtaaggaccgttgtggtgtgccaagatataggttcccttaggcggttggtttttttttattttttatttttttccggtttttgtttttttggagggttttggtctagttccccctcttccctcttgtatacacttttcttatttttttaataaaatttctgagattgac

SEQ ID NO: 7939 - DNA, 6038 bp, Medicago truncatula
tttccatgtgaaaattttttgaggaatgctatttgtatatatatgcttgttcttccttcagatcatcagatgtatccctgtttatttccttgctcccatttcttttgtatttttattacagatttgattttgcgagaatgttctatttcctttccctttttgtccttctatttttaaggcaatgtggatgattatgatgcttataaatcccttatttatatttcacgatctgctccgatgccctgtgttgcctttacattactttccttggtttcgttattgaatatgtaattttttttctcttattgttcaaaataggtgttaaggacagcacgagtaaagaggatcctgttgattcgaacactgaagaggaagttatggctggtggcaagcaaaagaagcgaagtttgtcagagagcagtgagcagcccgctgctccttctcgtaaaatgcccaaacgatcagcaagtgcagcaagtaaaaatttgaaggagaagtctttttccaaatctgataagtctgatcttattgaaacaaagaagaatcaggttgtagaagaagaatttcttgctgtccgtatgactgctggacaggaggatggccgcccaaatagaagaatcacagactttatccttcatgatgaatctggtgcagcacagcaacttgagatgcttgaaatcaatgatttgttcatcactggacttatattgccactggaagcaagtgcagacaagaaaaaagagcaaggtatccgatgtgaaggctttggtcgaattgaatcgtgggatatatctggttatgaagagggtgctccagtgatatggatttctactgatattgctgattacgattgccagaaatcaactgctagttacaaaaagtattatgatcaattctttgaaaaggcccgtgcttgcattgaagtttccaaaaagctaacaaagtctgctggtggagaccctgacataagtcttgatgaattacttgctggactggcacggtccatgagtggtagcaagtacttttctggagctgcatctctgaaggagttcattatttctcagggcgattttatttataagcagctcattggtttagacctgacattgaaggcgaatgacaaggggttcacagagattcctgctcttgctgctcttagagatgagagcaagaaacaagcaaactttgcaaatgcacaagtgatgccatcaaatgcaactttaaggattggttcgggaaccggggatgaagagatgaaggatcagatggattctgtacatgaagaagatgaagatgcaaagctagcaagactgttgcaggaagaagagtactggaaatcaaaaaagcagaggaaaaaccatcatcctcccaatgattaccctctccctgcttattataaaacttctcttcaagaaacagatgaatttattgtttttgataacgactatgatgtgtatgacactgaagatcttcctagaagcatgctgcataactgggctttatacaactctgattcaagattgatttcgttggaacttcttcctatgaaaccttgctcagaaatagatgttacaatctttggatcaggtgtaatgacctcagatgatggaagtgggttcaatcttgatacagaggatggccaatcttccagtgcttctgaacaacaggccaccgatggaattccaatttacctgagtgctataaaagaatggatgattgaatttgggtcatctatggttttcatatccatccgaacagatatggcctggtatagacttggcaaaccatcaaagcagtactctccttggtacgacaccgtattgaaaactgcaaggatttctataagcattatcacattgttgaaggagcagagccgtgtatcacgactttccttcggggatgtcatcaaaaaagcatctgagttcagtcaagacaataagtcatacatttcttctgatgcattggctgtggagagatatgttgttgtccatggacagattattctgcaactgtttgcagaatttccagataagaagatcaggaagtgtccttttgtggccggtcttacgagcaaaatggaagcgcggcaccataccaaatggttgatgaagaagaagaaagtgttgccaaggagtgagccaaatttaaatcccagggcagcaatggcccctgttgtatccaaaagaaaagctatgcgagccacaacaacaaaactgataaacaaaatatggggagagtattactcaaaccacttgccggaggattcaaaagaggttattgctagcgaagtaaaggatgatgatgatgagacggaggaacaggaacaggaagagaatgaagatgaggatgcggaggtggagacagtactgttggagggaatgcaaaagccgcactcagtttccaaacaaactaaagcgttttctgatgacggagaaattagatgggaagggggtccggaagggaagactagttctggattgcttctttataggcaggcaattgttcatggtgaagttgtttctgttggaatatctgtgtcagtcgaagtagatgaatcggatgaacttcctgatatatactacgttgaatatatgtttgaatcgaagggtgggaaaaaaatgtttcacggtaggatgatgcagcatggttgtcagactgttcttggcaatgcagctaacgagagggaggtgtttttgactaatgagtgcagggatttgggactgcacgatgttaagcagataaatgttgtaagcatccgaaaaacaccttgggggcatcaacatcgtaaggctaacatcattgcagataaaatcgacagggaaagagcagaagaaaggaaaaagaaaggaccgcctactgaatattactgtaaaagcttgtactggcctgaaagaggtgctttctttagccttccgtttgatacactgggtctagggtctggcgtctgtcaatcttgcaagttacaggaagccgaagaggagaaggacgttttcaaagtaaattcatccaaatctagttttgtgttggagggaaccgaatattctctcaatgactatgtttatgtcagtccttttgaatttgaggaaaaaatagagcagggagctcataagagtgggaggaacgtagggctgagagcttatgttatatgccaagtgcttgagatcattgccaagaaggaaacaaaacaagctgaaataaaatctacagatatcaaagtcagaaggttcttccgaccggaagatgtatcaagtgagaaggcatactgttctgatgtgcaagaggtgtattacagtgatgaaacatgtacaatatctgtacaatccatagaaggtaaatgtcaagtcaggaaaaagattgacgtccctgatggatgtgcccccggaatcttccataatgtctttttctgtgagctcttgtatgatcctgccactggagcactcaagaagttgccagcacatatcaaagtaaaatattctagtggacacacagctgatgctgcagctagaaagaaaaagggaaaatgtaaagagggagatagcatttcagagcctgatctagaaagaaaaacatcaaatgaaaaacgtttagcaaccttggacatttttgcaggatgcggtggcttatcagaggggttgcatcagtctggtgtttcatcaactaaatgggctattgagtatgaagaaccagctgggaatgcgtttaaagctaaccatcctgaagcattggtgtttattaacaattgcaatgttattcttagggctataatggagaaatgtggagacatagatgattgtatcacaacgacagaggctgcagagttggcctctaaacttgatgagaaggatttaagtaatttacccttgcctgggcaagttgatttcattaatggaggacctccatgccagggtttctctgggatgaatagatttaacacaagcacctggagtaaagttcagtgtgagatgatactggcattcttatcctttgctgattatttccggccaaggtatttcctgttggagaatgtgaggaactttgtgtcttttaataaaggacagacgttccgtttaactttggcttcacttcttgagatgggttatcaggtgaggttcggtatccttgaggctggagcttttggtgtttcacagtcaagaaaaagggtatttatatgggctgcctctccagaggacgtgcttccagagtggccagaaccaatgcatgtcttttctgctcctgaattgaaaatcacattgtcagaaaaagtccagtatgctgccgtccgcagtaccacaaatggtgctccgttacgtgcaataactgttcgtgataccattggtgaactcccagctgtaggcaatggagcttctaggacaaacatggagtaccaaagcgatcccgtgtcatggtttcaaacgaaaattcgaggcaatatggctgtgttgacttatcatatatcaaaggagatgaatgagttgaacttgattcgatgccagaaaattcccaagagaccaggctgtgattggcgtgatcttccagatgaaaagataaggctgtcaagtggacaacttgttgatttgataccgtggtgcttgccaaacactgctaagaggcataatcaatggaagggactgtttggtaggttggactggcaaggaaactttcctacttccatcactgaccctcaaccaatggggaaggttggaatgtgcttccatcctgatcaagatagaattcttactgttcgtgaatgtgcccgatctcaaggcttcccagattgctatcaattttatggtaacatcatacacaaacacaggcagattggtaatgctgttccccctcctctggcatttgcgttagggagaaaactcaaggaagcagtggatagtaagagctccaagtagaacactagggcatgcatcctgcataaagcatgcttatcatgagcaaggttgtcaaacgcgcgctctaacacccaagatcgtacgatcttgcgatatatcaagccaccaccgatctggagcgggttgaagatcggagtttacggcggagcggccggtgcgccgaggaaaatctgcagattgcagaatcggtgcttttctgtgatggtttactcgatttgcaacgtcttctttagggtgtttaatggaaaacaaagtggcgttgattcagatgttcgcatctaatgagtggacatcaagcaaatttgcaaaaacagatgaaggaaagcaaattgaaaaagtggttatggatagagttttggaaagatatcgttatttcttgtcaagttacttttatgattttgtctattatgtgggatcttacgatcctacgacctacgctttttctataccccaacgatctttagtgggatcccgattttgacaaccatgatcatgagacttttgaatacctatggattgtgggcaccggtgaaaatatttatttttggacggataactggcttggtgaacctttggtgtatctgcttcaaattgaccctttatttcatgcggattttattggttcggttgtggatgtcattgttgataggggttgagatattcctgcggaggtgctggccgctcctggggtggcagctcggttgggttccattgcttgcttcgcacccaccttccttattcgcttgtttggccacattcagtcgatgataagttaactgctaaactagcttccacttttctgatgcctgttgatactattattccttgggaatctatgatatggaagacttgtattccaccctctcattcatttatattttggcgtctcattcatggtaaaatacccaccgacgagaatctctgtacctgaggttgtattattgtttcaatctgcagtttttggttgaaaactgatgaaacttcatagcaatctttttcttcgctgcccttttatagaggatctttggaacttgcttgggggaaaattaaaccacgttatggagacctcctttcagtcgctgcttctgtgtatccctctgctttgctcttctcaagttcttgatttatttgtggctg

SEQ ID NO: 7940 - DNA, 1338 bp, Phaseolus vulgaris
ctacaattatgtcgtgagcttacttagaagtaaaacattcttaaagagaaaatgaggtcaacaatgcttaaatgtataactatagtgttggtcgtatatttgatgaatcaaaatgctcattgtgaactgcaagttgggttttacagctactcatgtggcatggctgagttcattgttaaggatgaagtcagaaaagctgttagtaataatcctggaattgctgctgggcttgtaagaatgcattttcatgattgctttattagagggtgtgatgcatcagtgcttcttgattccactccctctaacactgcagagaaagactctcccgcaaataaaccaagtcttcgagggtacgaagtcattgatcatgccaaggctcaacttgaagcagtgtgtccaggaattgtttcttgtgcagacattgtggcatttgcagcaagagacagtgtggagttagctggagggcttggttatgatgttccagcagggagaagagatggcagaatctcactagcttcagatacaagaacagagttaccacctccaaccttcaatgtaaaccagctcactcaacttttcgcaaggaagggattaacacaagatgaaatggtcaccctctcaggagcacacaccattggccgctctcattgctcaagtttcagcaatagattgtacaatttcagtggcacttctagtaaggatcctagtttagatccctcatatgcagcactgctgaagcggcaatgcccacaaggcagcacaaacccaaacttggtggttccaatgaacccttcaagtcctggaattgcagatgtaggctactatgttgacatattatcaaaccgaggcctgttcacatctgaccagactctcttaactaatgctgaaacagccagccaggtgaagcaaaatgccagggatggctatcaatgggcaagtaaatttgccgatgcaatggtgaagatgggtcaaatcagtgtcttaacaggtaatgctggagagattagaacaaattgcagggtggtcagtagctagcaatattggtgaaggaagtacctgctacaaattaagatttgcaatacaagttttaagtcatgtttcttgtggggggttttttcctcctacttcattagggagcacgtaactttgcttctgttctatttttactttctttttgttcgcgaaactggtcttcacctgtcggtgaatcagtcctctctgtttgtccccaaattgatagcttgtcgtgtgtagcaagaatttactaccgttaccacaatcaatttcctttggtgcaaataccaaatcttccaatcacaatgcatcgctatcgacaac

SEQ ID NO: 7941 - DNA, 1016 bp, Vigna unguiculata
acttaaaagcaaaacaatcttaaagagaaaatgaggtcaacaatgcttaaatgtataactatagtgtcggtcatatatttgttgaatcagaatgctcattgtgaactgcaggttgggttttacagctactcatgtggtatggctgagttcattgtcaaggatgaagtcagaaaagctgtcagtactaatcctgggtttgctgctgggcttgtaagaatgcattttcatgattgctttattagagggtgtgatgcatcagtgcttcttgattccactccctcaaacactgcagagaaagactctcccgcaaataaaccaagtcttcgagggtacgaagtcattgatcatgccaaggctaaacttgaagcagtgtgtccagggattgtttcttgtgctgacattctggcatttgcagcaagggacagtgttgagttcgctggagggcttggttatgatgttccagcaggtagaagagatggcagaatctcactagcttctgatacaagaacagagttacctcctccaaccttcaatgtaaaccagctcactcaactcttcgcaaggaagggattaacacaagatgaaatggtcaccctctcaggagcacacacaattggccgttctcattgctcaagtttcagcaatagattgtacaatttcagtgccagttctagacaggatccaagtttagatccctcgtatgcagcattgctgaagcggcaatgtccacaaggcagcacaaacccaaacttggtggttccaatgaacccttcaagtcctggaattgcagatgtaggctactatgttgacatattatcaaaccgaggcctgttcacatctgatcagacactgttaactgatgctgaaacagccagccaggtggagcagaatgccagggatagctatcagtgggcaagcaaatttgctgatgcaatggtgaagatgggtcaaatcagtgtcttaacaggtaatgctggagagattagaacaaattgcagggtggttagtagctaaca

SEQ ID NO: 7942 - DNA, 1355 bp, Cajanus cajan
tacttagaagcaaagcaatctttcagagaaaatgaagtcaaaaaagcttaaatgtataactataatttttctcatatatttgttgaatcaaaatgctcattgtgagctacaggttgggttttatagctattcatgtggcatggctgagttcattgtgaaggatgaagtaagaaatagtgttactaggaatcctggacttgctgctgggcttgtaagaatgcatttccacgattgctttattagagggtgtgatgcatcagttcttcttgattccactccctcaaacactgcagagaaagactctcccgcaaataaaccaagtctccgagggtatgaagtcattgataatgccaaggctaaacttgaagcagtttgcccaggagttgtttcatgtgctgacattgttgcatttgcagcaagggatagtgtggagttagctgaaggggttggttatgatgttccagcaggaagaagagatggcagaatatcactagcttcagatacaagaacagagttacctcctccaactttcaatgtaaaccaactcactcaactctttgcaaagaagggattaacacaagatgaaatggtcaccctttcaggagcacacaccattggccgctctcattgcactgctttcagcagtagattatacaatttcagtagcacttcaagccaggatccgagtttagagccttcatatgcagctcggctgaagaggcaatgtccacaaggaagcacaaaccccaacttggtggtttcaatggacccctccagtcctgcaattgcagatgtagggtactatcttaatatattaacaaaccgaggcctgtttacttctgatcagactctcttaagtaatgctgaaacagccagtcaggtgaatcaatatgccaggaattcttatctgtgggcaaataaatttgcggatgcaatggtgaagatgggtcaaatcagtgtcttaacaggtaatgctggagagattagaacaaattgcagggtggtcaatggctagcaatggtgttcgaggactacctgcagcaatgaagatctacagattcttagtcatgtttctgtttttcttttttcctgcttgattacggagcaagtaactttgcttcccgttttttttacctcctgttcgcataactggcattcatctgtcggtgaatcgtagtcctctctgtttgccctgaaatagatagcttgtcatttgcgacaagtatttactcacgttatctaaatcaatttgcttcggtataaatgcaaggactgtccaatcacagtgcatcgctatcaacaaccaacattagattttttcttggctagatgttcttgaggactaatgctaaatt

SEQ ID NO: 7943 - DNA, 1274 bp, Lupinus angustifolius
tgagaattatagacaatgttgctagagaaaatgagttcaaggaaacttaactgtgtaatcatagttttggtcacatatttgttgagtcaaaatgctcattctgagctacaggttgggttttatagctactcatgtggcatggctgagttcattgtaaaggatgaggtcacaaaaagttataatgggaatccaggaattgctgcagggcttgttagaatgcattttcatgattgctttattagagggtgtgatgcatctgtgcttcttgattccacaccctccaacacagcagagaaagactcaccagccaacaaaccaagtctgagagggtttgaagtcattgacaatgccaaggccagacttgaagaaatgtgtaaaggaattgtttcatgtgctgacataatagcatttgcagcaagggatagtgtggagttggctcgagggcttggctatgatgttcctgcaggaagaagagatggcagaatatcactagtttcagatacaagaactgacttacctcctccaactttcaatgttaatcaactcactcaactctttgcaaagaaagggcttacacaagaagaaatggttactctatctggagcacacaccattggtcgctctcattgctcagctttcagcaacagattatacaatttcagtgcaacttcaaggcaggatccaagtttagatccctcatatgcagcacttttgaagaggcaatgtccacaaggaaacacaaatcaaaacttggtagttccaatggacccttccagccctggaactatagatgcaggctactacagtgatatcttggtaaaccgagctctgttcacatctgaccaaactctcctgactaacacagaaacagctagccaagtgaatcaaaatgcaagggatccttaccaatgggcaagtaaattggcggatgcgatggtgaagatgggtcaaattggtgtgttaaccggtaatgctggagagataagaacaaattgcagggtggtcaatagctagcaatggaagtgaagaattgcagtacttgcagctataaagatatacaaactctatggcatgtttccacccggttttgcttgcttaataagcaaacatatttgctctggtttctttttttctctgcatggttggtatgatctatctgaatataacaacttaatcaagttatcctagttatttcaatttgcataatagcaccattatgttttccctaagttggttccttgaaaactaatggtatgtgcatgttttcatttatg

SEQ ID NO: 7944 - DNA, 1365 bp, Lotus japonicus
acaacgtttcaaacaaaatgaaatttaattgtgcaatcatagttttggtcatatttttgctgaatcaaaatgcttattctgagctggaagttggttattacagctactcatgtggcatggctgagttcattgtaaaagatgaggtcagaagaagtgttactaagaatcctggaattgctgctgggcttgtgagaatgcattttcatgattgctttattagagggtgtgatgcttcagttcttcttgattccactccctcaaacactgcagagaaagactctcctgccaacaaaccaagtcttagagggtttgaagtcattgatagtgccaaggctaaacttgaagcagtgtgcaaaggagttgtttcatgtgctgacataattgcatttgcagcaagggatagtgtggaattagctggaggggttggctatgatgtccctgcaggaagaagagatgggagaatatcactagcttcagacacaagaacagacctacctcctccaactttcaatgttaaccaactcactcaactctttgcaaagaagggtctaacacaagaagaaatggtcaccctctctggagcacacaccattggccgctctcattgcgcagcattcagttccagattatacaatttcagcagcacttcaaggcaggatccaagtttggatccctcatatgtatcactgctgaagaggcaatgtccacaaggcagcacaaaccagaacttggtggttccaatggacccttctagccctggagttgcagatgcagggtactacattgatatcttggcaaacagaggccttttcacctctgaccaggccctcttgacaaacactcacacagccagtcaagtgaatcaaaatgctagggatccaaatctgtgggcaaacaaatttgcagatgcaatggtgaagatgggtcaaattagtgtcttaacaggtaatgctggagagattagagaaagttgcagggtggttaatagttagatgcggttgcaaactaccgattaagatcctctcatgttacattgtattgtgaagtgaaactttgtgtctctcttatatagacacaaaatttcaaaataattgtcatgtgaaactcacacatgagaggatcataatcttgttgtaagatttatagattccattgcttgtttcatttggttttgtacaaagcaaacaagtttgcttcggtttcttttccttttggcattcttctgttgtcgctgatatttgtcctttgattcttcttgatatggacaacttgtaagaatatctcacgttatccgagtcaatttcatgttgcgtgattacaaagatcatttaatcacaatgcatcctatcagggaagaaacttaaa

SEQ ID NO: 7945 - DNA, 1244 bp, Medicago truncatula
cataagcttaccacaaagagatatagtattcagtgaaaatgaatccgaaaaaacttaattatgcaattatagttttggtcatatattttttgaatggaaatgctcattctcagctggaggttgggttttatacttattcatgtggcatggctgagttcattgtaaaagatgaggtccgaaaaagtttcaataagaatcctggaattgctgctggacttgtaagaatgcattttcatgattgctttatcagagggtgtgacgcatcggtacttctcgattctactctctcaaacattgcagagaaagactctccagccaataaaccaagtctcagagggtttgaagttattgataatgcaaaggctaaacttgaagaagaatgcaaaggaattgtttcatgtgctgacatagttgcatttgcagcaagggatagtgtggagttggctggagggcttggctatgatgttcctgcgggaagaagagatgggaaaatatcactagcttcagatacaagaacagaattacctcctccaactttcaatgttaaccaactcactcaactctttgcaaagaaggggttaacacaagatgaaatggtcactctctctggtgcacacaccattggtcggtctcattgctccgctttcagcaagagattatacaacttcagcagcacttcaatccaggatccaagtttagatccctcatatgctgcactattgaagaggcaatgtccacaaggcaacacaaaccaaaacttggtggttccaatggacccctctagccctggaactgcagatgtaggatactataatgatatattggcaaatagaggcttgttcacttctgatcagactctcttaaccaacactggaacagccagaaaagttcatcaaaatgccaggaatccatatctatggtcaaacaaatttgcagatgcaatggtaaagatgggacaggtcggtgtcttgacaggtaatgctggagagattaggacaaattgcagggtggtcaatagctagatatggtgttgaaggactgaagttcctgcagtattaaagattttattaattctgttgtgtttcatttggttttggctacttaattacatagccaacaactttgctttggtttattttctgtgtaactgtggcattcatttgtgagttgattgtggcccttctacttttcttgaaatacacagcttgtagccttgtcatatgcaacaagaatttacccatgtt

SEQ ID NO: 7946 - DNA, 1240 bp, Cicer arietinum
ctataattgtgccataagcttacaaagaacataaacagcactaagtgaaaatgtatccaaaaaaacttaactatgtaattactattttggttatatattttttgaatgtaagtgctcattctcaattggaagttgggttttatagctattcatgtggtatggctgagctcattgtaaaagatgaggtcagaaaaagtttcaataagaatcctggaattgctgctgggcttgtaagaatgcattttcatgattgctttatcagagggtgtgatgcatcagtacttctagattctactccctcaaacactgcagaaaaagactctccagccaataaaccaagtctcagagggtttgaagttattgataatgccaaggctaaacttgaagcagtatgcaacggaactgtttcatgtgctgacataattgcatttgcagcaagggatagtgtggagttagctggagggattggctatgatgttcctgcaggaagaagggatgggaaaatatcactagcatcagatacaagaacagatttacctcctccaactttcaatgttaaccaactaactcaactctttgcaaagaaggggttaacacaagaagaaatggtcactctctctggagcacataccattggacgtgctcattgctccgctttcagcaacagattatacaacttcagcagcactttaaaacaggatccaaatttagattcatcatatgtaccacttttgaagaggcagtgtccacaaggcaacacaaacccaaacttggcggtaccaatggacccttctagccctggaactgcagatgtagggtactatattaatatcttagaggatagaggcttgttcacatctgatcagactctcttaactaacactggaacagctaggcaagttaataaaaatgctaggaatccctatctatgggcagacaaatttgcagatgcaatggtgaagatggggcaaattggtgtcttgacaggtaatgctggagagatcagaacaaattgcaggatggtcaatagctagatatggtgttggaaggattgaagttcctgcagcagtaaagatttacaaattgtatggtgtgttgcatctggttttgcctgcttaattacatagcaaataactttgctttggtttattttctgtgtaactgtaattgtatctgtcggttgattgtgacccttttctttttcttggaataagacaacttgtcgtatgcaacttaatag

SEQ ID NO: 7947 - DNA, 2566 bp, Glycine max
cagaaatggagggaaaccacctcaattccgtttctcccaaatctctctgattccgacgttctcacttccgaaccgaaccaaaaaaaccctatcaccgttccgcaaagcaaatccctccatggcggaaaccctaagccccaaccccacgatggatcagaagcagaggctccgcatcctgtccccgaccagccccttcatcctgggctccaacgacgacaagctcgaacgcgcccaggcacgcgacgcacgcgccaccgccatccgccgcaagagcctcgccctcaatcagccccttcagcccaactccgatccctgcctcaacaaacagcagatcatcgacttgttccaaaactgcatcaaactcgccagcgaaaacaaaattaatcagaaaaatacgtgggagttgaacctgattgaccacctcacagatatcatcaaggcggaagaagaaaatgatgcggagactaattttcaaaaggcaagctgcactcttgaggctggagtcaaaatttattcattaagggtggattcagtgcattctgaggcatataaagttcttggtgggatgaatagagcaggccaagaagctgaggaagatactaccctgaatggtgttaatattgaaagtggacaagtagaaagcaggaaagaaacgagcaaaaagttgtcacctttgtcaacattggaatcatcttttgaggcacttaatgtaaagaagttcgatgctgcatttgtcgtggatcctctctatcgccaaacaacagcaaaattcgatgaaggtggagccaagggtcttttaatgaataatctcggtgtatatggtgactgtagggtgctctttgattcacaagaagttcctgctaagtgtatggcaagccaaaatcaatctgatatttcagatactattgatctttcctttgccaaagattgtattgatcaaatggtgttggacatgcgtgtaaaggatgaaatttctccaagtctcaggactatagtaaaccaatttgatgaaagtaacagaagacccgctgatattcaacttcaaggccagaattcagctgaagatcttgacaatgctgataataatgaaaatggtttttacagagaagaatatgagaactgcatggcctggagtgatgatcgtgatgaccaaacagttgttgccgatccaggttataatgatgcagatccaagttttcccagttaccctcaggacaatgatgagccatttccttccccagaaattgatatggatggcagatttgaaaatgttgacgggtatttatttttgagtctgggttttagttcaaaacaaaatgcatgggcagggcctgatcattggaagtatcgaaaatccaaagtctcagaggttcatcctacttctgaagatgggtcgaccctaaaaagtagacagccaaagagtaagagacaaactgaagttgatttaaatttcacaaattctcttgagaaaaaaatgctagatacattttctcctcccaagaatcccaaattgttactgcttcctgaaagcagattaccttgcaatacaaaacttcctgaggattgtcactatcagccagaagatcttgtcaagttatttcttctgtctaatgtaaagtgtctcgggaggaaggcaaacaggttctcagatggatctagagaacaatccgatgaatatgaatcattcccttcgtgggataatggaagtgtttgtggggatgacgctggtgactacggaggtgatcttcatggtgacatggaggacaccgacactcttgttactcagcctcgtcaggtcagtaaaattgaagtccagtatgacaagacttccaaacaagtcgatgttcatgcactaaaaattactctttgggaccatgttcaagaatctgttaaacttcctttagagggtcaaaaagataccttatctttcaggaatatattagccaactttcctagcgaatgcaatgctgctgcaacaattagtgacatctctcctcatctgtgcttcatatgtctattgcatttggcaaacgagaaaggattgagcattcaaaactcccctaatttggatgatcttgccatacggtttccacaagttgctgattctatgaggggaacagtttagattcctcttcactcaattattcttcagctcaggaatcaagaaacgatggggactgttttactagtgaaacacgtccaagaaagcattgaagtgagcaacaagtttgtggttggaggttgcaaatatcagtttgcttatggtggtttaacactcgttaaggaaatttcagacctataatggctccttgttattattctgtacatgaaagtatgcaacacatgtagtgctcaatttcattctccactgcagcccgttacatgaaagtattcaacacatgtagtacgagaatggctagtgttggtataaacaaaggcatagactgatggatgagcgactgattattgaatcgcacttacctatccctccattttctattaattgtcaaactgaaataatcaaatttatttgtaaataataataataataatagtagtagtagta

SEQ ID NO: 7948 - DNA, 2689 bp, Glycine max
cacagaaatggagggaaaccacctcaattccgtttctcccaaatctctctgattccgacgttctcacttccgaaccgaaccaaaaaaaccctatcaccgttccgcaaagcaaatccctccatggcggaaaccctaagccccaaccccacgatggatcagaagcagaggctccgcatcctgtccccgaccagccccttcatcctgggctccaacgacgacaagctcgaacgcgcccaggcacgcgacgcacgcgccaccgccatccgccgcaagagcctcgccctcaatcagccccttcagcccaactccgatccctgcctcaacaaacagcagatcatcgacttgttccaaaactgcatcaaactcgccagcgaaaacaaaattaatcagaaaaatacgtgggagttgaacctgattgaccacctcacagatatcatcaaggcggaagaagaaaatgatgcggagactaattttcaaaaggcaagctgcactcttgaggctggagtcaaaatttattcattaagggtggattcagtgcattctgaggcatataaagttcttggtgggatgaatagagcaggccaagaagctgaggaagatactaccctgaatggtgttaatattgaaagtggacaagtagaaagcaggaaagaaacgagcaaaaagttgtcacctttgtcaacattggaatcatcttttgaggcacttaatgtaaagaagttcgatgctgcatttgtcgtggatcctctctatcgccaaacaacagcaaaattcgatgaaggtggagccaagggtcttttaatgaataatctcggtgtatatggtgactgtagggtgctctttgattcacaagaagttcctgctaagtgtatggcaagccaaaatcaatctgatatttcagatactattgatctttcctttgccaaagattgtattgatcaaatggtgttggacatgcgtgtaaaggatgaaatttctccaagtctcaggactatagtaaaccaatttgatgaaagtaacagaagacccgctgatattcaacttcaaggccagaattcagctgaagatcttgacaatgctgataataatgaaaatggtttttacagagaagaatatgagaactgcatggcctggagtgatgatcgtgatgaccaaacagttgttgccgatccaggttataatgatgcagatccaagttttcccagttaccctcaggacaatgatgagccatttccttccccagaaattgatatggatggcagatttgaaaatgttgacgggtatttatttttgagtctgggttttagttcaaaacaaaatgcatgggcagggcctgatcattggaagtatcgaaaatccaaagtctcagaggttcatcctacttctgaagatgggtcgaccctaaaaagtagacagccaaagagtaagagacaaactgaagttgatttaaatttcacaaattctcttgagaaaaaaatgctagatacattttctcctcccaagaatcccaaattgttactgcttcctgaaagcagattaccttgcaatacaaaacttcctgaggattgtcactatcagccagaagatcttgtcaagttatttcttctgtctaatgtaaagtgtctcgggaggaaggcaaacaggttctcagatggatctagagaacaatccgatgaatatgaatcattcccttcgtgggataatggaagtgtttgtggggatgacgctggtgactacggaggtgatcttcatggtgacatggaggacaccgacactcttgttactcagcctcgtcaggtcagtaaaattgaagtccagtatgacaagacttccaaacaagtcgatgttcatgcactaaaaattactctttgggaccatgttcaagaatctgttaaacttcctttagagggtcaaaaagataccttatctttcaggaatatattagccaactttcctagcgaatgcaatgctgctgcaacaattagtgacatctctcctcatctgtgcttcatatgtctattgcatttggcaaacgagaaaggattgagcattcaaaactcccctaatttggatgatcttgccatacggtttccacaagttgctgattctatgaggggaacagtttagattcctcttcactcaattattcttcagctcaggaatcaagaaacgatggggactgttttactagtgaaacacgtccaagaaagcattgaagtgagcaacaagtttgtggttggaggttgcaaatatcagtttgcttatggtggtttaacactcgttaaggaaatttcagacctataatggctccttgttattattctgtacatgaaagtatgcaacacatgtagtgctcaatttcattctccactgcagcccgttacatgaaagtattcaacacatgtagtacgagaatggctagtgttggtataaacaaaggcatagactgatggatgagcgactgattattgaatcgcacttacctatccctccattttctattaattgtcaaactgaaataatcaaatttatttgtaaataataataataataatagtagtagtagtagtaagttttatttatctgcctgaattaggatgtatttagataactaactaaattatgttcctaatcttttcgtgtatgactttattatttcttgaaataaagtaaaaagcactttcgataa

SEQ ID NO: 7949 - DNA, 2150 bp, Phaseolus vulgaris
tcccaaatctctgcgtctctgattccgacgttctcacttccgaatcaaaccctaacaacgctctgcaaactccatggcggaaacgttaagcccaaaccccttggtgggtcagaagcagaggttccgtatccagtcccccaccgctaacttcttcttgggctccaacaatgaccagctcgagcgcgccgaggcccgagccgctcgggccgccgccatccgccgaaagagcctcgggttcagccaacctcttcaggccaactcggatccctgcctcaacaaacagcagatcctcgatttgttccaaaactgcatcaaactcgccagcgaaaacaaaattaatcagaaaaatacgtgggagttgaacctgattgatcaccttactgatatcatcaagggcgagcaagaagatgacgcggagactaattttcaaaaagcaagctgcacacttgaggctggagtcaaaatttattcattaagagtagattcagtgcattctgaggcatataaagttcttggtgggatgaatagagcaggccaagaagccgagcaagacactagcctggatggtgttaatattgaaagtggacaagaagaaaacaggaaagaaacaagcaaaaagttgtcacctttgtcaacattggaatcatctttcgaggcacttaatgttaagaagtttgatgctgcatttgtcgtggatcctctctatcgccagacaacagcaaaatttgatgaaggtggagccaagggtcttttaatgaataatctcggtgtatatggcggatgtagggtgctctttgattcactagaagtgcccgcgaagtgtatggcaaaacaaaatcaatctgatatttcagatactattgatctttcttttgtcaaagattgtatggagcagatggtgttggacatgcgtgttaaggatgaaatttctccaactctgaggactatagtaagcctatttgatgaaagtaacagaaggcccactgatgttcaacatcacgacaagaattcagctgaagatcttgacgcctcttcttttaataatgaaagtggttttgacagagaagaatatgggaacagcatgacctggagtgacgatcacgatgaccaaacggttgttgccgatgtaggctataatgatgatgatccaagttttcccaattaccctcaggacaatgatgagccatttccgtccccagacgctgatatggatgacagatttgacaatgtcgacggatatttatttttgagtctgggctttaattcaaaacaaaacgcctgggccggccctgatcattggaagtatcgaaaatccaaagcctcagaggttcatcctacttccgaagatgggtcgatcataaaaagtaggctgccaaagagtaagagacaggctgaagttgaattaaatttcacaaattctcttgagaaagaaatgctagatatattttctactcccaagaatcccaaatcattactactccccgaaagcagattgccttgcaatacaaaacttcccgaggactgccactatcatccagaggatcttgtcaagttatttcttctgtctaatgtgaaggtagtttcttttatgtttttttcagatggatctagagaacaatccaatgaatatgaatcattcccttcgtgggacaatggaagtgttggtggggatgactatggtgactacggaggtgatcttcatagtgacatggaggactccaacactctcattactcaacctcgccaggtcaataaaattgaagtccagtatgacaagacttccaaacaagttgatgttcatgcactaaaaattactatttgggaccatgttcaagaatctgttaaacttcctttgcagggacaaaaagataccttatctttcaggaatatattggccaactttcctagcgaatgcaatgctgctgcaaccattagtgacatctctcctcacttgtgcttcatatgtctattgcatctggcaaacgagaaaggattgagcattcaaaactgctccaacttggatgatcttaccatatgccttccacatgttgctgactctttaaggggaacagtttagattcttcttcactcaattattcttcagctcatgtatcaaaaattgttttggtatgtggcctttactatttgct

SEQ ID NO: 7950 - DNA, 2441 bp, Cajanus cajan
ttcccatggcggaagccctaagccccaaccccacggtgggtcccaagcagaggctccgcatccaatcccccaccagccccttcttcctgggctccaacgacgaccagctcgaacgcgcccaggcacgcgccgcccgcgccgccgccattcgccgccggagcctcgccctcaaccaacctcttcaggccaattccgatccctgcctcaacaaacaacagatcctcgacctgttccaaaactgcatcaaactcgccagcgaaaacaaaattaatcagaaaaacacgtgggagttgaacctgattgaccatctcaccgatatcatcaaggccgaagaagaaaatgatgccgagactaattttcaaaaggcaagttgcaccctcgaggctggagtcaaaatttattcattaagggtggactcggtgcattccgaggcgtataaagttcttggtgggatgaatagagcaggccaagaagctgagcaagacactaccttggagggtgataatattgaaagtgggcaggaagaaagcaggaaagaaccgaacaaaaagttgtcacctttgacaacattggaatcatcttttgagggacttaatgcaaagaagtttgatgctgcatttgtcgtggatcctctctatcgccagacaaccgcaaaatttgatgaaggtggagccaaagggcttttaatgaataatctcggtgtatatggtggatgtagggtactctttgattcactagaagtgcctgcgaagtatatgggaagccaaaatcaatctgatatttcagatactattgatctttcttttgtcagagattgtatcgagcagatggtgttggacttgcgtgtgaaggatgaaatttctccaactctcaggactatagtaaaccaattcgatgaaaacaacagaaggcccattgattttcaacttcatagccaggatgcagctgaagatcatgatgctgctttcaatgatgtaaatggttttgatcatgatgatcatgatgagaactgcacggcctggggtgatgatcatgatgaccaaacagatgttcccgatctaggctgtaatgacgcagatccaagttttcccagttaccctcaggacaatgagccattttcttccccagacggtgatatggatgaaagatttgaaaatgttgacggctatttgtttttgagtttgggcttttcttcaaaacaaaatgcatgggcaggtcctgatcattggaagtttcgaaaatccaaagtctcagaggttcatcctacttctgaagatgggtcgaccctaaaaagtaggcagacaaagagtaagagacaggctgaagttgatttaaatttcacaaattctcttgagaaaaaaatgctcgatattttttctcctcccaagaatcccaaattgttactactccctgaaagcagattgccttgcaatacaaaactacctgaggactgccactatcagccagagaatctcgtcatgttatttcttctgtctaatgtgaagtgtctcgggagaagggcaaacaagttctcagatggatctagagaacaatacaatgaatatgaatcggtcccttcatgggataatggaagtgtttgtggggatgactctggtggctacgaaggtgatcttcatagtgacatggaggactccaacaatcttattaatcagcctcgtcaggtcaataaaattgaagtccagtatgacaagacttccaaacaagttgatgttcaggcactaaaatttactctttgggaccatgttcaagaatctgttaaacttcctttacaggatcaaaaagataccatatctttcaagaatatattggccaacttacctagcgaatgcaatgctgctgcaaccattagtgacatctctcctcatttgtgcttcatatgtctattgcatttggcaaacgagaaaggattgagcattcaaagctgccccgacttggatgatctagccatacgccttccacatgttgctgactctataaggggaacagtttagatacttcgctccattatttcagctcaggagtcaaaaaatgatggggacttttttactggtgaaatacgtccaagaaagcatcggagtgagtaacaagtctcttcttgttggaggttgcctatgagttaggttatggtggtttaacactcgttaagaaaatgtcagacctatcatgatgttttgtctttccatacatatgaaagtattcaaccttcaacgcatgtagtgctctaattttattctccactccagctcgtttcatgtgtgtctaatgctcaggctttaacgagaatttctagtgtgttagtataaataaagtctcagattgatggatgcgtgactactgattgttgaagctcacttccccttatccccattttctattaactatgaaactgaaataatcacatttgttggtaattaataata

SEQ ID NO: 7951 - DNA, 2593 bp, Lupinus angustifolius
aaatggagggaaaccacgccattctcattttgcacatttaattcttctacttccaaacacaatctctgtcttcgtaacaacaatcattattcttcttcttcttccatggctgaaaccctaagccctaacccgggtggccagaaacagaggttacccatggccgctcgcatccaatcccctaccagccccttcttcttgggctccaacgacgaccagcttgaacgcgcccgtgcacgcgctgcacgcgccgccgccatccgcagcaggaacgtctctgccaatttgaattcccaatctcaagattctgatccctgcctcgacaagcagcagattctcgatttgttccagaactgcatcaagctcgctagcgaaaataaaatcaatcagaaaaacacttgggggttgaatttgatcgatcacctcactgatattattaaggctgaagaagaaggtgatagtaccgagactaattttcaaaaggcaagctgcacccttgaggctggagtcaaaatttattcattaagggtggattcagtgcattctgaggcttataaagtccttggtgggatgaacagagcaggccaagaagctgagcaagagactcctttggaggtggctaatgttgaaagcggacaagaagaaagcaggaaagagacaaacaaaaagttgtcacctctgtcaacactggaatcatcttttgaggttcttaatgtaaagaagtttgatgctgcatttgttgtggatcccctctatcgccagacaacagcacggtttgatgaaggtggagccaaaggtcttttaatgaataatctcggtgtatatggtggatgtagggtgctctttgattcacaagaagtgcctgcaaggtgcatggcaagtcaaaatcaacatgatgtttctgatacaattgatctttcctttatgaaagattgtgttgagcagatggtatcagacatgcgcatgaaggatgaaatttctccaactatcaggactatagtcaaccaattcgatgaaaataatcgaaggcccactaattttcaaattgatggccagaattcagctgaagatcttgatgcagcctttgactgtgaaattgaatctgacagagtagaatatgagaactacacggcctggactgatgatcatgataaccaaacatttgttgctgatttgggctctaatgatgctgatccaagttttcctagttaccctgaggaaaatgagggatttccttcccaaggtcaagaccctgatatggacgacagatttgaaaatgttgatgggtatttatttttcagtctaggttttagttcaaaacaaaatgcatgggctggccctgatcattggaagtatagaaaatctaaagtcacagaggttcatcccactaatgaagatgggccaacccttaaaactaagcagccaaggagcaagaaacaggctgaagttgatttaaacttcacaagttcttttgagaagaaaatggcagatatatttgctccacccaagaatcctaaatcattactactccctgaaagtagactgccttgcaatacaaaacttccagaggactgccactatcagccagaggatcttatcaagttatttcttctgcctaatgtgaagtgtcttggaaggagggcaaaaaggttctcagatggatctagagaacaaccaaatgactatgaggcattcccttcatgggataatggaagtgcttgtggtggggaacctggtgactatgaaggtgattttcatagtgacatagaggactctggcactcttattactcagcctcgtcaggtcaataaaattgaagtccagtatgacaaaacatctaaacgaattgatgttcaggcactgaaaattactctatgggaccatgttcaagaatctgctaaattgcctcttcaggatcaaaatggaacagtatctttcaagaatatgttggccaattttcctggcgagtgcaatgctgctgcagctattagtgacatctctcctcatttgtgcttcatatgtttattgcatttggccaatgagaaaggattgagcattcaaagctgctccaacttggatgatcttgccatatgccttccacatgttgatgatgctataagtggagcagtttagacacttaatcaattcattcttccattcaggaatcataaaatggtttgatgggattttactactgaaacaagtccaaaaaagcattgaagtgagtaacaaggctgttattattcattttggttggagaaagcaaatatcacttcagatttggtggtttaaatctcgtccacaagttatttatctgattcattctgtcaaatagattgagaaagttgcttgtgaattctaaattgacaaatggtgttaacatattctcttcaaatacatctaaatttgtcaatcatatcatgaattatgacattcattgccctctgataaattgcactggcatgcagacctaaaagcttatcaagttatattaactgaaacatccaactcattctattagataagcccaactgaaccaaagttttttcgaacaatgcttaattagtaaaacaaataagcaacaatctgaaacagt

SEQ ID NO: 7952 - DNA, 1904 bp, Glycine max
caaaacacagtgctcagtaccctctctcacatttactactattttgctcttctctctaggcctgccctctctccctagggtttgtttcacttatgccttcccaactcctcagcctcagtctttcagaagttgaatgtagatgatacggaaggagagaagttgccctgtcctgtcggtggctctgatctctgtaaatgctcaatgctctccatcttgcatttttgtttggtagtaaggtgataaagcatggagtttttgaaaatcaaaaagttcagaaaatctcagaaagcaaatggagaaaaggatttggcagacaaggcagtgcctgagcctgaggaaccaaagctgaacaccgatggtcctgatcagtgtaaatcagaaaacgcagactctgcaggtgaagcagaggatgacgatgattttattaccaatgaggttaagaggaggctaaaagaattgagaagaaacagttttatggtgttgattcctgaagaagattcctgccctgaggaaggggaggatgaagaggaagaggaagccggagagacatgctcaaatgaatggagggatgtggaggcagaaggtcagcaatggtggcgtggttttgatgctgtatttgaaaagtactgtgaaagaatgctgttctttgatcggatgagcactcaacagcttagtgaagttggcaaaggttcacagtatacttcaactccatctccaagatctgcttcaaagaagctggcttctccccttcgttgtctttccttgaaaaaatttgaagaacctgatgatgagactgaacatcttcaacagcctgagcatgacccctaccaggatattgaaacagcatatgtaggtcaaatttgcttgacttgggaggcgcttcattgtcagtactctcatatgagtcagaagatatcttggcaacatgataatcctacctgttacaaccatagtgcacaagagtttcaacagttccaggttctattacaaaggtttattgaaaatgaaccttttgagcagggccgtcgagctgaaatttatgctcgcactaggaacaatttgcctaaactgcttcaggttcctaatatacgaggttcagatcatgaattgactgatgattcagagatgagagttcttgctcctgatcttatcgggataattgaaagttctatccttacattccaccttttcatgaaaagggacaagaaaaagtcaagtggtgctaccaatcagaaccagcttgatactcctctacaacagattcagtcgactcttgaaaagaaagtggtgaagctgaaggaactgcgcagaaagaaaaaaaattggaagaagaattcttggccccaaaagcacgaggacattcaggttttgcttggccttattgacgtgaagatcctgtcaagggttctgaggatgacgaggatgactagagaacaactgttttggtgtgaagaaaagatgaaaaaactggatttatcaaatagtaggttagaaagggatccatgtcccatcctcttcccttgctaggatcagttgtatatctgataaatagcagctaattatatagtagcatcagctttagttctttctcctttggatcgataactgttgctggttttgaagacgtcatcaaatcggccctacagctgtttaggatttcttgggaagaattcgggatactgtatgacaatgagggcaagaatgttttctgttacctaatatgtattcttgttctgtcaaaattgtgagtttccaagttgctttgtgaaacctccaatataacattgttgtcacgaattattcttgttggctcccagagtcgtcgatttaatgtttacaacaatgcatcttttttgtctgaaaatgctttgcaactaaggtaaataactaagaatattataaga

SEQ ID NO: 7953 - DNA, 1926 bp, Glycine max
gatcaaaatcaaatcgaaacaaaacaaaacacagtgctcagtaccctctctcacatttactactattttgctcttctctctaggcctgccctctctccctagggtttgtttcacttatgccttcccaactcctcagcctcagaagttgaatgtagatgatacggaaggagagaagttgccctgtcctgtcggtggctctgatctctgtaaatgctcaatgctctccatcttgcatttttgtttggtagtaaggtgataaagcatggagtttttgaaaatcaaaaagttcagaaaatctcagaaagcaaatggagaaaaggatttggcagacaaggcagtgcctgagcctgaggaaccaaagctgaacaccgatggtcctgatcagtgtaaatcagaaaacgcagactctgcaggtgaagcagaggatgacgatgattttattaccaatgaggttaagaggaggctaaaagaattgagaagaaacagttttatggtgttgattcctgaagaagattcctgccctgaggaaggggaggatgaagaggaagaggaagccggagagacatgctcaaatgaatggagggatgtggaggcagaaggtcagcaatggtggcgtggttttgatgctgtatttgaaaagtactgtgaaagaatgctgttctttgatcggatgagcactcaacagcttagtgaagttggcaaaggttcacagtatacttcaactccatctccaagatctgcttcaaagaagctggcttctccccttcgttgtctttccttgaaaaaatttgaagaacctgatgatgagactgaacatcttcaacagcctgagcatgacccctaccaggatattgaaacagcatatgtaggtcaaatttgcttgacttgggaggcgcttcattgtcagtactctcatatgagtcagaagatatcttggcaacatgataatcctacctgttacaaccatagtgcacaagagtttcaacagttccaggttctattacaaaggtttattgaaaatgaaccttttgagcagggccgtcgagctgaaatttatgctcgcactaggaacaatttgcctaaactgcttcaggttcctaatatacgaggttcagatcatgaattgactgatgattcagagatgagagttcttgctcctgatcttatcgggataattgaaagttctatccttacattccaccttttcatgaaaagggacaagaaaaagtcaagtggtgctaccaatcagaaccagcttgatactcctctacaacagattcagtcgactcttgaaaagaaagtggtgaagctgaaggaactgcgcagaaagaaaaaaaattggaagaagaattcttggccccaaaagcacgaggacattcaggttttgcttggccttattgacgtgaagatcctgtcaagggttctgaggatgacgaggatgactagagaacaactgttttggtgtgaagaaaagatgaaaaaactggatttatcaaatagtaggttagaaagggatccatgtcccatcctcttcccttgctaggatcagttgtatatctgataaatagcagctaattatatagtagcatcagctttagttctttctcctttggatcgataactgttgctggttttgaagacgtcatcaaatcggccctacagctgtttaggatttcttgggaagaattcgggatactgtatgacaatgagggcaagaatgttttctgttacctaatatgtattcttgttctgtcaaaattgtgagtttccaagttgctttgtgaaacctccaatataacattgttgtcacgaattattcttgttggctcccagagtcgtcgatttaatgtttacaacaatgcatcttttttgtctgaaaatgctttgcaactaaggtaaataactaagaatattataagatttgct

SEQ ID NO: 7954 - DNA, 1838 bp, Cajanus cajan
cacacacatttattttcattttcactcttcttctctgttctctctactctctatgcctagctagggtttctctttctctcggcttctgcttcccattcatcttcttatcaacttaactcctcaggtgatacggtgccttgtcggtggagctagtctctgtaaatgctcaatgccatcctagtttccttctaaaggtggtaaaaaatggagtttttgaaaatcaagaagttcagaaaatctcataaggcagatggagacaaggatttggcagacaaggcagccccagagcctgaggagccaaagctgaacacagatggttctgatcagtgtaaatcagaaaatgcagattctgcaggtgaagctgaggatgacgatgattttattaccaatgaggtaaagaggaggctgaaagaactgagaagaaacagttttatggtgttgattcctgaagaagattcctgcccagaggatggggaggacgaagaggaagagggagagacaagctcaaatgaatggagggatgtggaggcagaaggtcagcaatggtggcgtggttttgatgctgtgtttgaaaagtactgtgaaagaatgttattctttgatcggatgagcactcaacagcttagtgaagttggcaaaggtttacggcacacttcaacaccatctccaagatctgcatcaaagaagctagcttctccccttcgttgtctttccttgaaaaaatttgaaggacctgatgatgagaccgaacatcttcaacagcctgagaatgacccctaccatgatattgaaacagcatatgtcggtcaaatttgcttgacatgggaggcacttcattgtcagtactctcatatgagtcagaagatatcgtggcaacatgataatcctacctgttacaaccacagtgtgcaagagtttcaacagttcctggttctattacaaaggtttattgaaaatgaaccttttgagcagggtcatcgagcagaaatttatgctcgcacaagaaacaatttgcctaaattgcttcaggttcctaatatacgaggttcagatcatgtattgactgatgattcagagacgaaagttcttgctcctgatcttatcaggataattgaaagctctatccttactttccaccttttcctgaaaagagacaagaaaaaatcaagtggtgctaccaacctgtttggaaatcagaaccagcttgcaactcctttacaacagattcattctactcttgaaaagaaagtggtgaagctgaaggaactgcgccgaaagaaaaaaggttggaagaagaattcttggccccaaaagcatgaggacattcagcttttgcttggccttattgacgtgaagattctatcaagggttctgagaatgacgaggatgactagagaacaacttttttggtgtgaagaaaagataaaaaaactggatttatcaaataataggttagagagggatccatgtcctgtcctgttcccttgctagtatcagtggtgtatatctgataaatagctgctagagttctttttccttggattgcaaatacaacggctggttttgaagatgtcaccaaatgggtttagaagaatgtcttaggaagaattctggatactgtatgacaatgagagcaagaatggttttatgttatctaaaatgtattcttgttctgtcaaaattgtgagtttccaagttgttgtgtaactcccaatataacagttgtcaaggattattcttgttggttcgtaaattcgatttaatgtttacaagaatgcatttttttttgcctgaaaatattggaaactaagataaataaatatagaatgttactagat

SEQ ID NO: 7955 - DNA, 1726 bp, Lotus japonicus
ttttttttctgtctatccattttctcactgtactcttctcacttctctgttccctcctctctctttctctccgcgtctcctcagtctccatctctagggtttctctctgcaaaccctgctcacttgctttcctgttagtctcattgatcttgccattcccaaataccttaggtcgcattcagctcttcaatgtaggaacaaacaatgtggaagaaaactagatgagacagagagagagagagtttgtcttgtcagtggctctgatctctgtgaatgatcaatgctgtgttcctgtttcatgccaaaggttttgattaaaatattgttgggctgagcttagagtagtttgttcttgaaaagtacggtggcaaggcatggattttttgaaaatcaagaagttcaggaaatctcagaaagggaatggagaaaaggatttgacggacaaggcagtgccggagcctgaagaaccaaagactaacactggcggtcctgatcagtgtaaatcagaaaatgctgatcctgctggtgacgctgaggacgacgatgattttattaccaacgaggtcaagaggaggctgaaagaattgagaagaaacagttttatggtgttgattcctgaagaagattcctgcccggaggagggggaggatgaagaggaagagggggagactagctcgaacgagtggagggatgtggaggcagaaggtcagcagtggtggcgtggctttgatgctgtgtttgaaaagtactgtgaaaaaatgctattcttcgatcggatgagtatgcagcagcttaatgaaattggcaaaggttctctacaaacttcaactcaatctccaagatctgcgtcgaagaagttgacttctcctcttcgatgtctttccttgaaaaaatttgaagaacctgatgaggatactgaacatcttcaacagcctggaaatgatccctacctggatattgaaatggcgtatgttggtcaaatttgcttaacttgggaggcacttcattgtcaatactcgcatacaagtcagaagatatcctggcaacctgaaaatcctacctgttacaaccatagtgcgcaggagtttcagcagttccaagttctattacaaaggtttattgaaaatgaacctttcgagcagggccctcgagctgaaagttatgctcgcacaaggaaggctttgcctaaactgctacaggttcctaatatacgaggcaagttcagatcatgaattaacagatgattcagacatgagagttcttgctcctgatcttatcaggataattgaaaattctatcctcacattccaccttttcctgaagagggacaagaaaaagtcaagtggtgttatcaacctgtttggaaaccagaaccagcttgcaactcctcttcagcaggttcaatctacacttgataagaaagtgttgaaacttaaggaactgcgcagaaaggtgaagggttggaaaaaaaattcctggccccagaagcacgaggacattcagctattgcttggccttatcgatgcgaaaatcatatcaagggttctgaggatgacgcggatgagtagagaacagctgttttggtgtgaagaaaagatgaagaaactggatttatcaaatggtaggttagagagggatccatgccctatcctcttcccttgctagtagtagtaacagtggtgtatatcttataaacaacttaaacttctttctgctgggaatgata

SEQ ID NO: 7956 - DNA, 2068 bp, Cicer arietinum
tattccgtgtacgatgacactgtcttcttctactgtttctgtttctttatagcctttctcgtgttcctttcccatcccattcatttaatacattaaagctaaatgtacatttttttttttatgtatattattctgtgtcagtttaataacttttatttttttgggaaatgagatttcaaacaaatcactgagttctctctctctttcacatttattgcattttttttaatttcactcactcattcactcactctcctagggttttcacttctctttgcaaattctgctcttttcctctttgtgttctgctaatttatgcctttcctcatatgtcacattcatctctttttctttgattaagtcctcttcagaacttcaatgttggaaaagattgtgcatgcaaaatctgatctttctatgttttatgtcaaagatttgatcgaaaaagtttaaagtattgggttgagtttaggaattaggatagtttgtttttgaaaggtgaggtggtaaagtatggattttttgaagataaaaaaatttagaaaatctcagaaagcagacataaaaaaagatttggcagagaaggcagtgttggagcctgacgaactgaagcctaatagtggtggtcctgatcagtgtaaatcagaaaatgcagattctgccggtgatgctgaggatgacgatgattttattacaaatgaggtaaagaggaggctgaaggaattgagaagaaacagttttatggtgttgattcctgaagaagattcgtgtctggaggaaggggaggatgaagaggatgagggtgaggcggtctcaaatgaatggagggatgtggaggcagaaggtcagcaatggtggcgaggttttgatgctgtttttgaaaagtactgtgaaagaatgctattctttgatcggatgagcgtgcaacatcttagtgaaattggaaaaggttctcagaacacttcaactccatctccatctccacgatctacatcaaagaagctggcttctccccttcgttgtctttctttgaaaagatttgaagagcctgacgatgagactgaacatcttcaacatcccgagaacaatccctaccaggatattgaaacggcttatgttggtcaaatttgcttgacttgggaggctcttcattgccaatactctcatatgagttataagatatcttggcaacatgaaaatcccacgtgttacaaccgtagtgcacaggagtttcaacagttccaggttctattgcaaaggtttattgaaaatgaacctttcgagcagggccttcgacctgaaatttatgctcgcacaaggaatactttgcctaaactgcttcaggtccctaatatacgaggttcagatcatgaattaacagatgattcagatatgagagttcttgctccagatcttatcgggataattgaaaactctatccttactttccaccttttcctgaaaagggacaagaaaaagtcaagtggcgttagcaacctgtttggaaatcagaatcagcttgcaactcctctacaacaggttcagtctactcttgagaagaaagtggtgaaactgaaggaactgcgaagaaggaagaagggttggagaaaaaattcgtggccccaaaagcacgaggacattcaactattgcttggcctgatcgacgtgaaaatcatatcgagggttctgagaatgacaaggatgactagagaacaactgttttggtgtgaagaaaagatgaaaaaacttgatttatcaaatagtaggttagagagggatccatgtcccattctattcccttgctaattgcaatctttagttctttctgctatgaatggtaattatgtatgagtatgacaatgaaagccttttctgctatatcaaatgtattatttttctgtcatatttgtgagtttctaggttgttttttgttgtataattctggttataacaaaaagtgtcaaagattattcttgttgcttcttagatttatgatataatgcctactcgtatgtttatttttaagtctcataaactatcaatgataaagtgtttattattattatta

SEQ ID NO: 7957 - DNA, 1790 bp, Trifolium pratense
ggtaggaagaagacttgtgcatgcaaacttgttctgatctctctaaatgttcaatgctttacctcatttatggaaaaggttttgatcttaaagttttgagttgaggttagggtagtttgtttttgaaagttgaggtggtaaagcatggattttttgaagattaagaaattcaggaaatctcaaaaaccaggcgtagaaaaagatttggtggacagggcagtgccagagcctgaggaatcaaggcctaacactggtgatctggatcagtgtaaatcagaaaatgcagattctgctggtgatgccgaggatgacgatgattttattaccaatgaggtaaagaggaggctcaaggaattgagaagaaacagttttatggtgttgattcctgaagaagattcgtgtctggaggaaggggaggatgaagaggaagagggtgagacagtctcaaatgaatggagggatgtcgaggcagaaggtcagcaatggtggcgaggcttcgatgctgtttttgaaaagtactgtgaaagaatgctattctttgatcggatgagcgtgcagcatcttagtgaaatcggaaaaggttctcagaacacttcaactccatctccatctccaagatctacatcaaagaagctggcatctccccttcggtgtctttccttgaaaagatttgaagaacccgatgatgagactgaacatcttcaacagcctgaaaatcatccctacttggatattgaaacggcatacgtaggtcaaatttgcttgacttgggaggctcttcattgtcaatactgtcatatgagttataagatatcttggcaaaatgaaaatcctacctgttacaaccgtagtgcgcaggagtttcaacagtttcaggttctattgcaaaggtttattgaaaatgaaccttttgagcagggccttcgacctgaaatttatgctcgcacaaggaacactttgcctaatcttcttcaggttccaaacatacgaggttcagatcacgaattaacagatgagtcagatatgagagttcttgcacccgatcttatcacaataattgaaaactctatccttactttccaccttttcctgaaaagggacaagaaaaagtcaagcggtgttatcaacctgtttggaaatcagaaccagctcgcaactcctctacaacaggttcagtctactcttgagaagaaagtggcaaaactgaaggagctgcgtaaaaggaagaagggttggagaaaaagttcttggccccaaaagcatgaggacattcaactattgcttggcctaattgatgcgaaaatcctatcaagggttctgagaatgacgaggatgactagagaacaactgttttggtgcgaagaaaagatgaaaaaacttgatttatcaaatagtaggttagagagggatccatgtcccattctcttcccttgctaactgcaatctttcgttctttctgctttgaatgataaatgttgcggaagcaaatgcctgtattgcaccatagctggcttgcttaggatatctagggaagaattgaggattatgtatgagtatactgacaatgagagcataacaagacctttctgctatttcaaatgtagtaccgttctgtcatatttgtgagtttgtaggttgttttttgtgtaattctcgggataacaaatagtgttaaggattattcttgttgataatctctcctaagaccaaattctgtaagcagaatacttctgttagaagatgattttctagaatgcatttgaatgtgcactttcaatttgaatatcata

SEQ ID NO: 7958 - DNA, 1765 bp, Trifolium pratense
atagacagactcactcacataggctttcgtgttcccatcccatcccatcccattagtgaacaagacttgtgttttgcatgcaaacttgccctgatctcccttcaacgctttccctcatttatgcaaaaggttttgatctaaaagttttcaagttctgagttgaggttagggtagtttgtttgtccaaagctgaggtggtaaagcatggattttttgaagattaagaaattcaggaaatctcaaaaaccaggtgtagaaaaagatttggtagatagggcagtgccggagcctgaggaatcgaggcctaacactggtgatcctgatcagtataaatcagaaaatgcagattctgctgccgatgctgaggacgacgatgattttattaccaatgaggtaaagaggaggttcaaggaattgagaagaaacagttttatggcgttgattcctgaagaagattcgtgtctggaggaaggggaggatgaagaggaagacagtgagacagtctcaaatgaatggagagacgtggaggcagaaggtctgcaatggtggcgaggctttgatgctgtttttgaaaagtactctgaaagaatgctattctttgatcggatgagcgcacagcatcttggtgaaatcggaaaaggctctcagaacacttcaactccatctccaagatctacatcaaagaagctggcatctccccttcggtgtctttccttgaaaaaatttgaagaacctgatgatgagactgaacatcttcaacagcctgaaaataatccctacttggatattgaaacggcatatgtagggcaaatttgcttgacttgggaggctcttcattgtcaatactgtcatatgagttataagatatcttggcaacatgaaaatcctacctgttacaaccgtagtgcgcaggagtttcaacagttccaagttctattgcaaaggtttattgaaaatgaacctttcgagcagggccttcgacctgaaatttatgctcgcacaaggaacactttgcctaaacttcttcaggttcctaacatacgaggctcagatcaggaattaacagacgagtcagatatgagagttcttgctccagatcttatcaggataattgaaaactctattcttactttccaccttttcctgaaaagggacaagaaaaagtcaagcggtgttatcaacctgtttggaaatcagaaccagcttgcaactcctctacaacaggttcagtctactcttgagaagaaagtggcgaaactaaaggaactgcgaaagaggaagaagggttggagaaaaagttcttggccccaaaagcacgaggacattcaactattgcttggcctaattgacgcgaaaatcctatccagggttctgagaatgacgaggatgactagagaacaactgttttggtgtgaagaaaagatgaaaaaacttgatttatcaaatagtaggttagagagggatccatgtcccattctcttcccttgctagcggcaatctttagttctttttgctttgaatgataaatgttgctgaagcaaatgcctacattgcaccatagctggcctgcttaggagttaggatatctagggaagaattgtggcttatgtatgaatatcgtaacaagacttttctactataatatcaaatgtagtattgttctgtcatatttgtgagcttgtaggttgtttttctttgtaattcttgggataacaaacagcattaaggattattcttgttgattcttagacttgtgatttagcct

SEQ ID NO: 7959 - DNA, 1976 bp, Medicago truncatula
cgcggcattctgacaatattccttcctctgacgtacgacgacactgtcttctctactctttctgttcactctctctctctctctcttcataggctttcgtgttccttttccatcccattaattacattaatgctaataaacgcatttactaccattttttttatgttttaacttttctttttctttctttctttctttcattgggaaatgatatttcaaacaaatcacatagactctctctctaacatttatcactctccttgctaaagctcaactcagctaagttaagctagggttttcttttcctcatacattgattgatcttcatctttgctctgtcttatttaaggttttaatctaaattctttgtagtattgggctgtggcctggttagtttgtttttgaaaggtaaggtggtaaagcatggattttttgaagataaaaaaatttagaaaatctcagaaagcaggtgtggtaaaagatttggtagacaaggcagtgtctgagcctgaggaaccaaagcctagcactggtgatcctgatcagtgtaaatcagaaaatgcagattcttgtgctgatgctgaggacgatgatgattttattaccaatgaggtaaagaggaggctcaaggaattgagaagaaacagttttatggtgttgattcctgaagaagattcgtgtctggaggaaggggaggatgaagaggaagagggagagacggtaccaaatgaatggagggatgtggaggcagaaggccagcaatggtggcgaggctttgatgctgtttttgagaagtactgtgaaagaatgttattctttgatcggatgaatgtgcagcatcttggtgaaattggaaaaggttcacagaacacttcaactccatctccaagatctacatcaaagaagttggcatctccccttcggtgtctttccttgaaaaaatttgaaggacctgatgatgagactgaacatcttcaagagcctgaaaatattccctacttggatattgaaacggcatatgtaggtcaaatatgcttgacttgggaggctcttcattgtcaatactctcatatgagttataagatatcatggcaacatgagaatcctacctgttacagccgtagcgctcaggagtttcaacaatttcaggttctattgcaaaggtttattgaaaatgaaccttttgagcagggccctcgacccgaaatttatgctcgctcaaggaacactttgcctaaactacttcaggttccaaatatacgaggttcagatcatgaaataacagatgagtcagacatcagagttcttgctccagatcttatcaggataattgaaaactctatccttacctttcgtctattcctgaaaagggacaagaaaaagtcaagtgttatcaacctgtttggaaatcagaatcagctcgccactcctctacaacaggttcagtctactcttgagaagaaagtggtgaaactgaaggagctaaggaagaagggttggagaaaaaattcttggccccagaagcatgaagatgttcaactattgcttggccttattgacgcgaaaatcttatcaagggttctaagaatgactaggatgactagagaacagctgttttggtgtgaagaaaagatgaaaaaacttgatttatcaaataataggttagagagggatccatgccccattctattcccttgctaatcgcagtctttagttctttacgctatgaatgataaatgttgctgaagctgcttgtttaggatgtctagggaaggtttgtggattatgtgagtatgacagggcatagcaaggcttttctgctatatcaaatgtattattgttctgtaatatttgtgagtttctaggctgtctttttgtataattcttagtgtaacgtacatcattatggattactcttgttggttcttagacttgtgatttagctatgtttggaaagttaaagaaacacgtttgcg

SEQ ID NO: 7960 - DNA, 1532 bp, Arachis hypogaea
aatttcagctcttctgggtcttctcatgtgccacattcatcttatcaagcttcctaactccttaggttttgatctaaaggatatggaagactgggttctgctggaatagttttttttttttttttgggttttttgttgagacttgagaggcaaagtgttaacgcatggattttttgaagatcaagaagttcagaaaatctcagaaagcagatggaggaaaggatctggtgaacaaggacgtgctagagcctgaggaacctaaacctaactctggcggtcctgatcagtgtaaatctgtgaatgcagatcctgtggcggaaactgaggatgatgatgattttattacaaatgaagtaaagagaaggctgaaagagttgagaagaaacagttttatggtgttgattccagaagaagattcgtgccctgaggaaggggaggatgaagaggacgaaggagagacaagctccaatgactggagagatgtggaagcagagggtcagcaatggtggcgtggctttgatgctgtatatgaacagtactgcgaaagaatgctgttcttcgatcggatgagcacacagcagcttaatgaagttggcaaaggtccacagtatccttcaactccgtcaccaagatctgcatcaaggaagttggcatctccccttcgttgtctttccttaaaaaaatttgaaggtcctgatgatgagactgaacatcttcagcagccagaacatgatccctaccaggatattgaaacagcatatgttggtcaaatgtgcttaacttgggaggcactccactgccaattctctcatttgagtcacaagatatcttggcaacctgaaaatcctacgtgttacaatcacagtgctcagcagtttcaacagttccaagttctattacaaaggtttattgaaaatgagccttttgagcagggcctccgggccgaaatttatgctcgaactaggaacactttgcctaaacttcttcaggttcctaatatacagggatcagaacatgaattcatagatgaatcagactcgagagttctggctcctgatcttgtgaagataattgaaagctctatcctaacattccaccagttcctgaagagggacaagaaaaagtcaggcggggtcatcaacctctttggaaatcagagccagcttgcaactcctctacaccaggttcagtctactcttgagaagaaagtgttgaagctgaaggaagtgcgtagaaagaagaaagggtggaaaaagaatagttggccggagaagcatgaggacattcagctgttgcttgggctgatcgacgtgaaaatcctgtcgagggttctgcgaatgacgaggatgagcagagaacaactgttttggtgtgaggagaagattaagaaactggattttttatcaaatggtaggttagagagggatccttgtccaagtctcttcccttgctagtaatagtaatggagactctcatgtattaattcatgtatgtaccaaaccattgttctgctaaaattgtgagtattgtgt

SEQ ID NO: 7961 - DNA, 2052 bp, Lupinus angustifolius
agagaaggagaaaaaatatatcttaaaaagtctaatagtgttagatgaaaagtgttaccgtgattaactttgcaaatatcgaaaaaatcgaaatacaaattatttgttattaaactgaattataatccaacacaattttacaaaatgaaaggatcaattgttttggcatatattttgagagagaagggttaagtgaatgttactttggtggcagcattctgacaatattctctgagtacgaccaccacactgtcttcttctactcttactgtaacctcttctctctctctctctctccgctaaacaacataactagggttttgatctgaaacacttaagaacattggtttgagtgaagaatagtttgtctttgaaaggtaagcatggattttttgaaaatcaagaagttcatcaaatctcacacagcagatggagaaaatggtttggctgacaaggctgtgccagagcctgaggaaccaaagcctaacactgtcggtcctgattggtgtaaatcagaaaatgatgattctgtcactgaagctgaggatgatgatgattttattactaatgaggtgaagaggaggctgaaagaattgagaaggaacagttttatggtgttgattcccgaagaggattcatgcccggaggaaggggaggataaagaggaagcaggagaaacaggctttaatgaatggagggatgtggaagctgaaggtcagcaatggtggcgtggctttgatgctgtatttgaaaagtactgtgaaagaatgcttttctttgatcggatgagcatgcagcaacttaatgaagttggcaaaggtacacagcctcctttgactccatctccaagatctgcatcaaagaagctggcttctcccttccgttgtctttccttgaaaaaaattgaagaacctgatgatgagatggaacatcttcaacagcctgaaaatgatccctaccaagatattgaaacagcttatgttggtcatatatgcttgacttgggaggcacttcactgtcaatattctcatatgagtcagaagatatcttggcaacctgaaaatcctacctgttacaatcacagcacgcagcagtttcaacagttccaggttctattacagagatttatagagaatgaaccttttgagcaaggcgctcgagctgaaatttatgctcgcacaaggaaaactttgcctaaactgcttcaggttcctaacatacaaggttcagatcctaaatcaacagatgaatcagacatgagagttcttgctcctgatcttatcaaggcaattgaaagctctatcctcacattttaccttttcctgaaaagggacaagaaaaagtcaagcagtactatcaacctgtttggaaatcagagtcagctttcaactcctctacaccaggttcagtctacccttgaaaagaaagttgtgaaactgaaggaactgcgtaggaaaaagaaagggtgtaaaatgaattgttggccgcaaaagcatgaggagattcagctgttgcttgggcttattgacatgaaaatcctttcaagggttatgagaatgacaaagattagcagagaacaactgttttggtgtgaagaaaagatgaaaaaggtggatgtatcaaatagtaagttagagagggatccatgtcctatcctcttcccttgctagtaagtagtaacaaacaatggattggtgattggtgcataagttcatcatcaactttagtagtaatttgtggttggaggaatgataattgttgctgctgatacatcgttcatgcttgggaagaaatctgtacattgtatgacaagatttgggaagtgttttatgttatgagaaatggattattgttgtgacaagtttgtgtcatgtaacttggggtataacatagttgttaaggattattcttgttgatttcttcctagactcaattcaatgttatgttactcttgtcatgcttctttttttgtctggaataggtaagatgcttagattaattaagcaaaaagtataatcagatttgttatggccaaatattatgctaagttgt

SEQ ID NO: 7962 - DNA, 3166 bp, Glycine max
acacacaccaatgccctttcattcacttgaatcacaatcgccacgcacacagcgattgttctccgaacactaattttcagcttcgacgcacgctcttctcttttttcttcttctgataagatgactgtgaaaacacctggaacaccagcttcaaagatagataggactccggtatcaaccctgggagcagcaagagctagggaagagaagattgtggtcactgttaggctaaggcctttgaacagaagggagcaattggctaaagatcaggtggcatgggactgcatcaatgattatactatcgtgtataaaccaccagcgcatgaacgcacttctcaaccagcatcatttacttttgataaagtttttggtcctgcttcagtaactgaggcagtatatgaagaaggagtaaagaaagttgcattatctgcattaacgggcattaatgctacagtttttgcttatggacaaactagcagtggaaagacatacacaatgagaggaataacagagaaggctgtctatgatatctacaagcatattatgaatacccctgaaagagatttcactataaaaatatctggactagaaatatacaatgagaatgtaagggacttgttaaattcagaatctggtcgcagtttgaaacttcttgatgatcccgagaaaggtactgtggttgagaaattagtagaagaaacagcaaaagatgacaagcatttgagacatttaatctccatttgtgaagctcaaaggcaggttggtgaaactgctctaaatgataacagttcacggtctcaccagataataagactgacaattcaaagtactcttcgtgaaaatgctgattgtgtgaaatcttttgttgcaaccttgaactttgttgatcttgctggaagtgagagggctgcacaaacacatgcagatggcactaggctgaaagaaggctgccatattaaccttagcttgatgactcttacaactgttatcaggaagctcagtgttggaaaaagaagtggtcatataccttacagggattcaaagctcacacgtatattgcaacattcccttggtgggaatgcacgcactgccattgtttgtactttgagtccagcactgagtcatgtagagcaatcacgaaatactctcctgtttgctacccgggcaaaggaagtaacgaataacgctcaagttaatgtggttgtatcagacaaacagcttgttaaacatttacaaaaggaagttgcaaggctggaggcagtgttgcgcactcctgatccatctaaagaaaaggattggaaaattcaacagatggaaatggaaattgaagagctgagacgccagagagatcttgcacaaactcaggcggatgaattacgcagaaagcttcaggatgaccagaaggtctcaaacccagttgaatcaccacatctgccagtgaagaaatgcctgtcattcactggtgcactatcatcactaaaaccagagctaggatgtgagagagtaagaagctcaacattaagacagtcgatgaggcaatcctctactgctccttttacccttatgcatgaaattcgaaaacttgagcacctccaagagcagctgggtgaagaagccaatagagctttggaagtattacaaaaggaagtggcatgtcatagactaggtaaccaagatgcagctgagacaattgcaaagctgcaagcagaaataaggggaatgcgtgctgttaggtcaaccacacccaagaatgttgaagttggaagcatggtttctatcaacaagagtgtcagtgctaatctcaaggaagagattacccgacttcattcacaaggaagcaccattgcaaatcttgaacagcagcttgaaaatgttcaaaggtccatagacaagttggtgatgtctctcccgaacaacttccaacactcacccagtgaagcatcccctaagaataaaaaggaacacaaaaggaaaaagttgcttcctttgtcttcaagcaatgctgccaatcgccaaaacttcctaagatctccctgctcaccattatctactacacagcaagttttggaatctgatattgaaaatagagtccctgagaatgatgatattgtttcaactgatactcttcctgagtccgagaaggagactccatcaaagagtgaagaagctggagatgtttcatcaaaggaaaatactccaggttatcgacgctctagttcagttaacatgaagaaaatgcagaaaatgtttcagaatgcagcagaggagaatgtaagaagtataagagcatatgtgacagaattgaaagaacgtgtggccaaactgcagtaccaaaagcagttacttgtttgccaggtgcttgaacttgaagcaaacgaagcaaatggccacaacatagacaatgaagaatattcatgtgaaccggaggaaccccaggtttcatggcaaataacatttaaagagcagcagcaggagatccttgaactatgggatctatgctatgtctccattattcacaggacccagttttatttattattcaagggagacccggctgatcaaatatacatggaagtagaactaaggcgtttgacatggttgcagcaacacctagcagaacttgggaatgcaagcccagctcctcatgttggagaagaaccaactatctcgttgtcatcaagcattagagctttgaaacgagaaagggaatttctggccaagagactgacaacacgtttgtcactggaggagagggaggcgttgtatatgaaatgggatgttcctcttgatgggaagcagaggaagatgcagtttatcagcaagctttggactgatcctcatgaccaaatccatgtacaggagagtgcagaaatagttgcaaggcttgtgggtttcaggacaggaggcaacatgtcaaaggagatgtttgaactgaactttgtgcttccatctgacaagaggccatggttaatgggctggaatcacttaacaaacttgcttaatttgtaatgaatttttatgtttgtaaagtaagtagtaagtaccaattaaaatcttgtacatgctcattatttatttattttggcgctttctcaattcaaaattattgttttggactattttttttccccaataaactaatccaattcattggattcccgttatt

SEQ ID NO: 7963 - DNA, 3630 bp, Glycine max
tctggtaagtaaacaatgctaaaaaaaattgcaatttcaacaataattctccaaatgcctaaacacaattgaaagattaagtggactaaaatacaaaaatccctgcaataaaataaccccatttttctttttgacattttttgtcggataaaaagcgatttaaattcgataaaagcgaggaaaaaaacaatgtcagagcaaaacaaaactctaaacgttacgattcaaaacggggccccactgtatgagagtgtcttgtcaatgattatctggcgaacgaaaacgttggaagaacgcataattaaattaataattaataattaagactatagaatcagttaattaaataaactgaaaaagaaaaatggaaaaaaaaattgaaaactagccgttagaagggttctctgaaattcaaatgaaatggaggcgtcgcgcacacacaccaatgccctttcattcacttgaatcacaatcgccacgcacacagcgattgttctccgaacactaattttcagcttcgacgcacgctcttctcttttttcttcttctgataagatgactgtgaaaacacctggaacaccagcttcaaagatagataggactccggtatcaaccctgggagcagcaagagctagggaagagaagattgtggtcactgttaggctaaggcctttgaacagaagggagcaattggctaaagatcaggtggcatgggactgcatcaatgattatactatcgtgtataaaccaccagcgcatgaacgcacttctcaaccagcatcatttacttttgataaagtttttggtcctgcttcagtaactgaggcagtatatgaagaaggagtaaagaaagttgcattatctgcattaacgggcattaatgctacagtttttgcttatggacaaactagcagtggaaagacatacacaatgagaggaataacagagaaggctgtctatgatatctacaagcatattatgaatacccctgaaagagatttcactataaaaatatctggactagaaatatacaatgagaatgtaagggacttgttaaattcagaatctggtcgcagtttgaaacttcttgatgatcccgagaaaggtactgtggttgagaaattagtagaagaaacagcaaaagatgacaagcatttgagacatttaatctccatttgtgaagctcaaaggcaggttggtgaaactgctctaaatgataacagttcacggtctcaccagataataagactgacaattcaaagtactcttcgtgaaaatgctgattgtgtgaaatcttttgttgcaaccttgaactttgttgatcttgctggaagtgagagggctgcacaaacacatgcagatggcactaggctgaaagaaggctgccatattaaccttagcttgatgactcttacaactgttatcaggaagctcagtgttggaaaaagaagtggtcatataccttacagggattcaaagctcacacgtatattgcaacattcccttggtgggaatgcacgcactgccattgtttgtactttgagtccagcactgagtcatgtagagcaatcacgaaatactctcctgtttgctacccgggcaaaggaagtaacgaataacgctcaagttaatgtggttgtatcagacaaacagcttgttaaacatttacaaaaggaagttgcaaggctggaggcagtgttgcgcactcctgatccatctaaagaaaaggattggaaaattcaacagatggaaatggaaattgaagagctgagacgccagagagatcttgcacaaactcaggcggatgaattacgcagaaagcttcaggatgaccagaaggtctcaaacccagttgaatcaccacatctgccagtgaagaaatgcctgtcattcactggtgcactatcatcactaaaaccagagctaggatgtgagagagtaagaagctcaacattaagacagtcgatgaggcaatcctctactgctccttttacccttatgcatgaaattcgaaaacttgagcacctccaagagcagctgggtgaagaagccaatagagctttggaagtattacaaaaggaagtggcatgtcatagactaggtaaccaagatgcagctgagacaattgcaaagctgcaagcagaaataaggggaatgcgtgctgttaggtcaaccacacccaagaatgttgaagttggaagcatggtttctatcaacaagagtgtcagtgctaatctcaaggaagagattacccgacttcattcacaaggaagcaccattgcaaatcttgaacagcagcttgaaaatgttcaaaggtccatagacaagttggtgatgtctctcccgaacaacttccaacactcacccagtgaagcatcccctaagaataaaaaggaacacaaaaggaaaaagttgcttcctttgtcttcaagcaatgctgccaatcgccaaaacttcctaagatctccctgctcaccattatctactacacagcaagttttggaatctgatattgaaaatagagtccctgagaatgatgatattgtttcaactgatactcttcctgagtccgagaaggagactccatcaaagagtgaagaagctggagatgtttcatcaaaggaaaatactccaggttatcgacgctctagttcagttaacatgaagaaaatgcagaaaatgtttcagaatgcagcagaggagaatgtaagaagtataagagcatatgtgacagaattgaaagaacgtgtggccaaactgcagtaccaaaagcagttacttgtttgccaggtgcttgaacttgaagcaaacgaagcaaatggccacaacatagacaatgaagaatattcatgtgaaccggaggaaccccaggtttcatggcaaataacatttaaagagcagcagcaggagatccttgaactatgggatctatgctatgtctccattattcacaggacccagttttatttattattcaagggagacccggctgatcaaatatacatggaagtagaactaaggcgtttgacatggttgcagcaacacctagcagaacttgggaatgcaagcccagctcctcatgttggagaagaaccaactatctcgttgtcatcaagcattagagctttgaaacgagaaagggaatttctggccaagagactgacaacacgtttgtcactggaggagagggaggcgttgtatatgaaatgggatgttcctcttgatgggaagcagaggaagatgcagtttatcagcaagctttggactgatcctcatgaccaaatccatgtacaggagagtgcagaaatagttgcaaggcttgtgggtttcaggacaggaggcaacatgtcaaaggagatgtttgaactgaactttgtgcttccatctgacaagaggccatggttaatgggctggaatcacttaacaaacttgcttaatttgtaatgaatttttatgtttgtaaagtaagtagtaagtaccaattaaaatcttgtacatgctcattatttatttattttggcgctttctcaattcaaaattattgttttggactattttttttccccaataaactaatccaattcattggattcccgttattattatatgcaaaagaagcatgttcaatga

SEQ ID NO: 7964 - DNA, 3053 bp, Cajanus cajan
atgaccatgaaaacacctggaacaccagcatcgaagatagataggacaccggtatcaaccccgggaggggcaagagctagggaagagaagattgtggtcacagttaggctaaggcctttgaacagaagggagcaattggcgaaagatcaggttgcatgggactgcatcaatgattatactatcgtgtataaaccaccgacacatgatcgtgcttctcaaccagcatcatttacttttgataaagtttttggtcctgcctccttgactgaggcggtgtatgaagaaggagtaaagaaagtcgcattatctgcattaacaggcattaatgctacagtttttgcttatggacaaactagcagtggaaagacatacacaatgagaggaataactgagaaggctgtgaatgatatttacgagcatattatgaatactcccgaaagagatttcactataagaatttctggactagaaatatacaatgagaatgtaagggacttgttaaattcagaatctggtcgcagtttgaagcttcttgatgatcccgagaaaggtactgtggttgagaaattagtagaagaaacagcgaaagatgatcaacatttaagacatttgatctccatttgtgaagctcaaaggcaggttggtgaaactgctctaaatgataacagttcgcggtctcaccagataataagactgacaattcaaagcactcttcgtgaaaatgcagattgtgtgaaatcttttgtcgcaaccttgaactttgtcgatctagctggaagtgagagggctgcacagacacatgcagatggcactaggctgaaagaaggctgtcatattaaccttagcttgatgactcttacaactgttatcaggaagctgagtgttggaaaaagaagtggtcatataccttacagagattcaaagctcacacgtattttgcaacattcccttggtgggaatgcacgcactgccattgtttgtactttgagtccagcactgagccatgtagagcaatcacgaaacactctcttgtttgctacccgggcaaaggaagtaacaaataacgctcaagttaacgtggttgtatcagacaagcagctcgttaaacatttacaaaaggaagttgcaaggctggaggcagtgttgcgcactcctgatccatctaaagaaaaggattggaagattcaacagatggaaatggaaatcgaagagctaaaacgccagagagatcttgcacaaattcaggtggatgagttacgcagaaagcttcaggatgaccaaaaggtctcaaacccagttgaatcaccacatctgccggtcaaaaagtgcctgtcattcactggtgcactatcatcgctaaaaccagagctaggatgtgagagagtaagaagctcaacattaagacagtccattaggcaatcttctactgctccttttacccttatgcatgaaattcgcaaacttgagcacctccaagagcagctgggtgaagaagccaatagagctttggaagtattacaaaaggaagtggcatgtcatagactaggtaaccaagatgcagctgagacaattgcaaagttgcaagcagaaataagggaaatgcgttctgttaggtcaacacccaaggatgttgaagttggaagcatggtttctgtcaacaagagtgtcagtgccaatctcaaggacgagattacccgacttcattcacaaggcagcaccattgcaaatcttgaacagcagcttgaaaatgttcaaaggtccatagacaagttggtgatgtctctcccgaacaactttcaacattcacccagtgaagcatcccctaagaataaaaaggaacacaaaaggaaaaagttgcttcctttgtcttcaagcaatatcaccaatcgcccaaacttcctaagatctccctgctcacctttatctactacgcaacaagttttggaatctgatattgaaaatatagcccctgagaatgatgatctcgtttcaattgatactctgcctgagtccgagaaggagactccatcaaagagtgaagaaactggagatgtttcatcgaaggaaaatccttcaggttatcgacgctctagttcagttaacatgaagaaaatgcagaaaatgtttcagaatgcagcagaggagaatgtaagaagtataagagcatacgtcacagaattgaaagaacgtgtggccaaactgcagtaccaaaagcagttacttgtttgccaggtgcttgaacttgaagcaaacgaagcaaatggccacaacatagacaacgaagagtacccatgtgaaccagaggaaccccaggtttcatggcaaataacatttaaagagcagcggcagcagatccttgaattgtgggatctatgttatgtctccattattcacaggacccagttttatttgttattcaagggagacccagctgatcaaatatacatggaagtagaactaaggagattgacatggttgcaagaacacctagcagaacttgggaatgcaagcccggctcctcatgttggagaagagcctgctatctcactgtcatcaagtttgagagctttgaaaagagaaagggaatttctggccaagagacttacatcacgtttgtcactggaggagagggagatgttatatatgaaatgggatgtccctcttgatgggaagcagaggaggttgcaatttatcagcaagctttggactgatcctcatgaccaaaaccatgtgcaggagagtgcagaaattgttgcaaagcttgttggtttccagacaggaggcaacatgtcaaaggagatgtttgagctgaactttgtacttccttctgataagaggccatggttaatgggctggaaccccatatcgaactttcttaatttgtaataaattttatgtttgtaaattaagtacaccattatcttgtacatgctaattaattttggcacatttctcaattcacaattattgttttggacaatattttttttcccaataaactaatccaattcattggattcccattaatatatgaaagaagaatttttgttaat

SEQ ID NO: 7965 - DNA, 3446 bp, Cicer arietinum
acgaaattcaaatgaaatggtagcagcgtagcgcacacaaaccaatcttctttcgtttttcatttccatcatcatcactacacagagagaagagaaccctaattactctttttaaaccctaatttctagcttctacactctcttcgttcactttcctcagttaaaccaattacttactcaatacatcaatacgatgactgtgaaaacacctggaacaccagcttcaaagatagataggacaccagtatcaaccccaggagggccaagatctagggaagagaagattgtggttacagtaaggttaaggcctttaaacagaagggaacaattggctaaggatcaggtggcatgggattgtattgatgattatactatcgtgtataaaccaccaccacatgaacgtgcttctcaaccagcatcgtttacttttgacaaagtttttggtcctgcttctgtaaccgaggcggtatatgaagaaggagtaaagaatgttgcgttatctgcactaatggggatcaatgcaactgtttttgcttatggacaaactagcagtggaaagacttacacaatgagaggaataacagagaaagctgtcaatgatatttataatcatataatgaataaccctgaaagaaatttcactataaaaatatctggactagaaatatacaatgagaatgtgagggacttgttaaattcagaacctggtcgtagtttgaagctgctagatgatcctgagaaaggtactgtggttgagaaattagtggaagaaacagcaaaggatgacaagcacttgagacatttgatctccatttgtgaagctcaaagacaggtgggcgaaactgctctaaatgataacagctcgaggtctcaccagattataagactgacaattcaaagtactcatcgtgaagaagccgattgtgtgaagtcttttgttgcaaccctgaactttgttgatctggctggaagtgagagggctgcacagacacatgcagatggaactaggctcaaagaaggatgccatattaaccttagcttgatgactcttacaactgttatcaggaagctcagtgttggaaaaagaagtggtcatataccttatagagattcaaagctcacacgtatattgcaacattcccttggagggaatgcacgcactgccatcatatgtactttaagtccagcactatgccatgtagagcagtcgcgaaacactctctattttgccactcgggcgaaggaagttacaaataatgctcaagtaaacatggttgtaccagacaagcagcttgttaaacacttgcaaaaggaagtggcgaggctggaggcagttctgcgcacccctgatccatcgaaagaaaaggattggaaaattcaacagatggaaatggaaatcgaagagctgaaacgtcagagagatcaagcacaaactcaagttgatgagttacgaagaaagcttcaagaggaccagcaggtctcaaagccacttgaaccagcacatgcttcagctaagaagtgcctatccttcactggcgcactatcatcaccaaaaccagggctagggtgtgagagagtaagaaacgcatcgttaagacagtccatgaggcaatcatctactgctccttttacccttatgcacgaaattcgcaaacttgagcacctccaggagcagctaggtgaagaagccaaccgagcattggaagttttacaaaaggaagtggcatgtcatagacttggtaaccaagatgcagctgagacaattgcaaagctgcaagcagaaatacgtgaaatgcgttcggttaagccgatacccaaggaaattgtagttgggagcatggtttctgtccacaagagtgtcagtgctaatctaaaggaagagattactcgacttcattcacaaggaagcaccattgcaaatcttgagcagcaactagagaatgtacaaaggtctatagacaagttggtgatgtctcttcccaacaattttcaaactttaactagtgaagcatcccccaagcataaaaaggagcataaaaggaaaaagttgattcccttgtcttcaagtaacactgccaatcgcccaaactttattagatctccctgctcaccattatctactactcaacaagttttggaaatcgatatagaaaataaagccccagagaacgatgataatgtttcgacagagattcatccagattccgagaaggatactactcccttaaagagtgaagaaactggagatgttacatcgagggaaaatactccaggttaccgccgctctagttcagttaacatgaagaaaatgcagaaaatgtttcagaatgcagcagaggagaatgtaagaagtataagagcatatgtcactgaattgaaagaacgtgtggccaaactgcagtaccaaaagcagttacttgtttgccaggtacttgagcttgaagcaaatgaagcaagtggccacaacatagaagatgaagtgtacacaggtgaactggaggaacctcaagtttcatggcaagtaacatttagagagcagcaacagcagatccttgaattatgggatgcatgttatgtctccattattcacaggacacagttttatttgctattcaagggagatcaagctgatcaaatatatatggaagttgaactaaggcgattgacgtggttgcaacaacacctagcagaacttggaaatgcaagtcctgctcctcatgctggagatgaaccaactgtctcactgtcatcaagtatgagagccttgaaaagagaaagagaatttcttgctaagagattaatatcgcgattggcgccagaagagagggaggcattatatatcaaatgggatgtccccctagatgggaagcagaggaagatgcagtttgtcagcaagctttggacagatccttatgatcgaaaacatgtacaggagagtgctgaaatagttgcaaagctggtggatttctgcacaggaggcaacatgtcaaaggagatgtttgagctgaattttgtgcttccgtcagataagaggccatggttaatgggctggaatcatttgacaaacttgcttaatttgtgataaaatttatgtttgtaaattgtaccatttaaatcatgtacatggaaattaatcatggcacctattaaaattcaaaattattgttttggcacctatggaaattaatcatgttcggttccaataaaccaacccaattcactgggttctcatttacaaaggaattttttctattagtagtttgcaaatttggagtgctatttgtgttatggagatggagtacaatacaagttagtgacatttatactcaaaagttgagaaacaaatcttgccagttccggttttgacaacaccttatttaattctcatacactctgatgttgacaaatctccaattttatatatattcttgtcaacattgacgatg

SEQ ID NO: 7966 - DNA, 3215 bp, Medicago truncatula
cacaatcattcatcactacacagagagagaaaaaaatcaaatccaaatcccaaatccaaaccctaattttcagcttcttccctctcttcacgctttctttccaatctcaaattcaaccaattactcactcaacttctgaattgaattcctcaattgattaataagatgactgtgaaaacacctggaacaccagcttcaaagatagataggacaccggtatcaacaccgggagggccaagagctagggaggataaaattgtggttacagtaaggttaaggcctttaaacagaagggagcaattggctaaagatcaggtggcatgggattgtatcgatgattatacgatcatgtataaaccgccaccaaatgaacgtgctacacaaccggcatcattcacttttgacaaagtttttggtcctgcttctataaccgatgcagtatacgaagaaggagtaaagaatgtcgcattatctgcacttatggggatcaatgcaaccgtttttgcttatggtcaaactagtagtggaaagacatatactatgaggggaatcacagagaaggctgttaatgatatttataatcatatactgaacaaccctgaaagaaatttcactataaaaatatctggactagaaatatacaacgagaacgtgaaagacttgttaaattcagaacctggtaaaagtttgaagcttctagatgatcctgagaaaggtacggtggttgagaaattagtggaagaaacagcaagggatgaccaacacttgagacatttgatctccatttgtgaagctcaaagacaggtgggcgaaactgctctgaacgataacagctcaaggtctcaccagataattagactgacaattcaaagtactcttcgtgaaacagcagactgtgtgaaatcttttgttgctactctgaactttgttgatctggctggaagtgagagggctgcgcagacacatgcagatggcaccaggctcaaagaaggctgccatattaaccttagtttgatgactcttacaactgttatcaggaagctcagtattggaaaaagaagcggtcatataccttatagagattcaaagctcacacgtatattgcaacattcccttggtgggaatgcacgcactgccatcatttgtactttgagtccagcactaagccatgtagagcaatcgcgaaacacactatactttgctacccgagcaaaggaggttacgaataatgctcaagttaacatggttgtaccagaaaagcagcttgttaagcatttgcaaaaggaagtagcgaggctggaggcagcgctgcacactcctgatccatctaaagaaaaggattggaaaattcaacagatggaaatggaaattgaagagctaagacgtcagagagaccaagcacaaactcaagtggatgagttgcgaagaaaacttcaagaagaccagcaggtctcaaagccacttgaaccagcacatccttcagtcaagaagtgcctatctttcactggtgcactatcatcaccaaaaccagggctagggtgtgagagagtaagaaacacatcgttaagacagtccatgaggcaatcatctactgctccttttgcccttatgcatgaaatccgcaaacttgagcacctccaggagcagctaggtgaagaagctaaccgagctttggaagtactacaaaaagaagtggcatgtcatagacttgggaaccaagacgcagctgagacaattgcaaagttgcaatcagaaataagggaaatgcgttcggttaaaccaatacctaaggaggttgtagttggaggcatggtttctgtccacaaaagtgttagtgctaatctgaaggaagaaattacccgacttcattcacaaggaagcaccattgcgaatcttgagcagcagcttgagaatgtgcaaaggtctatagacaagttggtgatgtctcttccgaacaattttcaaactctaaccagtgaagcatcccccaagaataaaaaggaacataagaggaaaaaattgattcctctgtgttcaagcaactctacaaatcgccccaactttatcagatctccctgctcgccattatctactactcaacaagttatggaatctgatattgaaaataaagcccccgagaatgatgataatgtttcaacagaaattcatcctgagtctgagaagaatactcccacaaagagtgaagacgctggtgacgttacctcaaaggaaaatactccaagtccaggttaccgccgctctagttcagttaacatgaagaaaatgcagaaaatgtttcagaatgcagcagaggagaatgtaagaagtataagagcatatgtaacagaattgaaagaacgtgtggccaagctgcagtaccaaaagcagttacttgtttgtcaggtacttgaacttgaagcgaatgaagcaagtggccaagacatcgaagaggaagtgtatacaggtgaaccggaggaacctcaagtctcttggcaagtgacatttaaagagatgcagcatcagatccttgaattatgggatgtatgttatgtctccattattcacaggactcagttttatttactattcaagggagatccagctgatcaaatatatatggaagttgaactaaggcgtttgacatggttgcaacaacacctagctgaacttgggaatgcaagtccagctcctactgttggcggagacgaattaactatctcactgtcatcaagtatgagagcattgaaaagggaaagagaatttctcgctaagagattgatatcgcgactgacaccagaagagagggagatattatacatgaaatgggatgtcccccttgatgggaagcagaggaagatgcaatttgtcagcaagctttggacagatccttgtgatcaaaggcatgtacaggaaagtgctgaaatagttgcaaagctggtgggtttctgcacaggaggtaacatgtcaaaggagatgtttgagctgaatttcgtgcttccatctgataagaggccatggcttatgggctggaatcatttgacaaacttgcttaatttatgataaatttctgtttgtaaatcagaagtaccatttaaatgttgtacatggaaattaattttggcgcctattcaaattcaaaactatattgtttttggactggaccattttcagttccaataaaccaatccaattcactggattccaatttagcaaag

SEQ ID NO: 7967 - DNA, 3094 bp, Lupinus angustifolius
tgatttctctagaatatgactgtgagaacacctggaacaccagcttcaaagattgatagaacaccggtatcaacccctggagggcctagagttagggaggagaaaattgtggtaacagtaagactaaggcctttaaacagaagggagcaattggctaaagatcaggtggcatgggattgcgtcgatgattatacaatcgtgtataaatcaccctcgcatgaacgcacagctcaatcggcatcgtttacttttgataaagtttttggccctgcttgtttaactgagtcagtatatgaaggagtaaagaatgttgcattatctgcattgatgggcattaattctactatttttgcttatggacaaactagtagtggaaagacatacacaatgagaggaataacggaaaaggcggtcaacgatatctatgaacatataatgaatactccagaaagaaatttcactataaaaatatctggactagaaatatacaatgagaatgttagggacttgttaaattcagaatctggtcgcaatttgaagcttctagatgatcctgagaaaggtactgtggtggagaaattggtggaagaaacagcaaaagatgacaaacatttgagacatttgatttctatttgtgaagctcaaaggcaggtcggcgaaactgcactaaacgataacagctcacgttctcaccagataataagactgacaattcaaagtgctcagcgtgaaaatgcagattgtgtgagatcttttgttgcaaccctgaactttgttgatctggccggaagcgagagggctgcacagacacaggcagatggcactaggcttagagaaggttgtcatattaaccttagcttgatgactcttacaaccgtaatcaggaagctcagtgttggaaaaagaagcggtcatataccttacagagattcaaagctcacacgtatattgcaacactcccttggtgggaatgcacgcactgccatcatatgtacgttaagtccagccctaagccatttagagcaatcacgaaacactctcttctttgctacccgggcaaaggaagtaacaaataatgctcaagttaacatggttgtttcagaaaagcagcttgtaaaacatttgcaaaaggaagtagcgaggctggaagcagagctgtgcacccctgatccatctaaagaaaaggattggaaaattcagcagatggaaatggaaatagaagaactgagacgccagagagatcttgcacacgctcaggttgatgagttacgcaaaaagcttcaggatgaccagcagcaggtctcaaaccaacttgaatcacaacatctgccagtcaagaagtgcctctcattcactggtgcagcattgccaaaacccaagctaggttctgagagagtaagaaacaccatattaagacagtctatgaggcagtcatctactgctccttttacccttatgcatgaaattcgcaaacttgagcacctccaagagcagctgggtgaagaagccaatcgagctttggaagtattacaaaaggaagtggcatgtcatagactgggtaaccaagatgcagctgagacaattgcaaagctgcaagctgaaataagggaaatgcgttttgttaggccagcaccaaaggaagttgaagttggaaacatggtttctgtacataagagtgtgagtgctaatctcaaggaagagattacgagacttcattcacagggaagcaccattgcaaatcttgaacagcagcttgaaaatgttcagaggtcaatagacaagttagtgatgtctctcccgaacaattttcaacagataaccagtgaagcatcccccaagcataaaaaggaacacaagaagaaaaagttgcttcctttgtcttcaagtaatgcagttaatcgaccaaactttctaagatctccctgctctccattatcaactactcagcaagttttggaatccgagattgaaaataaagcccccgaggtgaatgatgatactgtttcaattgagactctgccagagtctgagaaggacactccatcaaagagtgaggatggtggagatgtatcatcaaaggaaaatactccaggccatagacgctgtagttcagttaatatgaagaaaatgcagaaaatgttccagaatgcagcagaggagaatgtaagaagcatacgagcatatgtcacagaattgaaggaacgagttgccaagctgcagtaccaaaagcagttgcttgtttgccaggtgcttgagcttgaagcaaatgaggcaaatggccaagacataggaagtgaagagtactctggtgaaccggaggaaccccaggtttcatggcaaataacatttaaagagcagcggcagcagatcatcgaattatgggatgtatgttatgtctccattattcacaggacccagttttacttgttattcaagggagaccaagcagatgaaatatacatggaagttgaactaaggcgtttgacatggctgcaacaacacctagcagaaatcgggaatgcaagcccagctcctcatgtcggtgatgaacctaccgtctcgctgtcatcaagtatgcgagccttgaaacgagaaagagaattccttgcaaagagattgacatcacgtttgactccggaagagagggatgcattatatatcaaatgggatgtccctcttgatggtaagcagaggaggctgcaatttgtgaacaagctctggacagatcctcatgatcctaggcatgtacaggagagtgctgaaatagttgcaaagcttgttggtttctgtacaggaggaaacatgtcaaaggagatgtttgagttgaattttgtgcttccatctgataagaggccatggttaatgggttggaatcccatcacaaatttgcttaatttgtaataaactttatgattgtaaatttagtaacattagaatcttgtagatggaaattaactttggagcttttactcaattctaaatgattgtttgggcaaaaaacattctctagtaaactaatcccattggattgtatggtgtttataaaagaatgcaatttgtgttaatatatggagtacaagtttatttatgtcac

SEQ ID NO: 7968 - DNA, 2990 bp, Arachis hypogaea
caaagatagataggacaccggtatcaaccccaggagggcctagagacagaggagaagattgtagttactgtaaggctatgttctttaaacagaaaagaacaattggctaaggagtaaggatcaggtggcatgggattgcattgatgattttatgattgtgtataaaccgcccgcaaacgaacgtgctgctcaaccagcatcgtttacctttgacaaagtttttggccctgcttttttaactgaggcagtgtacgaagaaggggtaaagaatgtggctttatctgcattgatgggcattaatgcaactatttttgcttatggacaaactagcagtggaaagacgtatacaatgagaggaataacagagaaggctgtcaatgatatttataagcacataatgaataccacagaaagagatttcaccataaaaatatctggactagaaatttacaatgagaatgttagggacttgttaaattcagaatctggtcgcaatctgaagcttctagatgatcctgagaaaggtactgtggttgagaaattagttgaagaaacagcaaaagacgataagcatttgagacatttgatctctatttgtgaagctcaaaggcaagttggtgaaactgctctaaatgataccagttcgcggtctcaccagataataagactgacaattcaaagtactcttcgagaaaatgcagattgtgtgagatcctttgttgcaactctgaactttgttgatctggctggaagtgagagggctgcacaaactcatgctgatggcacaaggctcagagaaggttgccatattaacctcagcttgatgactcttacaactgtaatcaggaagctaagtgttgggaaaagaagtggtcatataccttacagagattcaaagctcacacgtatattgcaacactcacttggtgggaatgcacgcactgccattatatgtactttgagtccagcactaagccacgtagagcaatctcggaacactctctactttgctactagagcaaaggaagtaacaaacaatgctcaagttaacatggttgtttcagacaaacaacttgttaaacatttgcaaaaggaagtggcaaggctggaggcagagctgcgcactcctgatcccgctaaagaaaaggattggaaaattcaacagatggaaatggaaatcgaagagctgaggcgccagagagatctagctcaatctcaggttgcagagttacgcaaaaagcttcaggatgaccagcaggtctcaatcccacctgaatcaccacatttaccagtcaagaagtgtctctcattcgctggagcactatcatctccaaaaccagagcgaagaagcacaacactaagacagtccatgaggcaatcatctactgctccttttacccttatgcatgaaattcgaaaacttgagcaccttcaggagcagcttggtgaagaagccaatagagctttggaagtattacaaaaggaagttgcatgccatagactaggtaaccaagacgcagctgagacgattgccaagcttcaagcagaaataagggagatgcgtgctgttaggtctgcaccgaaggaggttgaagttggaaacatggtttctgtaaacaagagtgtaagtgctaatctcaaggaagagatcacccgacttcattcacagggcagcaccattgcaaatcttgaacaacagcttgaaaatgttcaaaggtccatagacaaacttgtgatgtctctcccaaacaattttcaacagttaaccagtgaggcttccccaaagcacaaaaaggaacacaaaaagaaaaagttgcttcctttgacttcaagtagtgctgccaatcgccaaaacttcataagatctccatgttcaccgttatcaactactgagcaagtattggaatctgatattgaaaataaagcccctgagaatgatgatatcgtttctattgagactctgccagagtccgaaaaggagactccatcaaaaagtggagaaagtggatgtattgagtcaaaggaaaatgctccgggttataggcgctcgagttcagtaaacatgaagaaaatgcagaaaatgtttcagaatgcagcagaggagaatgtaagaagtatcagagcatatgttacagaattgaaagaacgtgtagccaaattgcagtaccaaaagcagttacttgtttgccaggtgcttgagcttgaggcaaatgaagcaaatggccacaacatagaaaatgaagagtacgcatgtgaaacagaggaaccgcaagttccctggcaaattacttttagggagcagcggcagcagattcttgacttgtggcatttatgtcatgtctccattattcataggacccagttttatttattattcaaaggagacccagctgatcaaatatacattgaagttgagctcaggagactgacatggttgcaacaacatttagcagaacttgggaatgcaagcccagctcctcgtgctggagatgaacctgtaatctcattgtcatcaagtatgagagccttgcgacgagaaagagaattcctggccaagagattgacgactcgtttaacgctggaggagagggaagcattgtatattaaaatgggatgtcccagttgatgggaagcagaggaagatgcaatttgtcagcaagctttggacagatcctcatgatcaagtgcatgtacaagagagtgctgagatagttgcaaaagcttgtgggtttcttctacagggggaaacttgtcaaaggagatgtttgagctgaactttgtccttccatctgataagaggccatggatgatgggctggaatcaaataacaaatctccttaacctgtaacatattctaagtttgtaaatgtacatgaaaattaattttggtacctttactcaatcacaattgattattttggacaatttttcttgcaataaaccaatccaattccactggatttcctattttacataaagatgtcttacga

SEQ ID NO: 7969 - DNA, 4164 bp, Lupinus angustifolius
taatttcctccactatgacttatccagaatatgactatgagaacacctggaacaccagcttcaaagatagataggacaccagtttcaacccctggagggcctagagctaaggaggagaaaattatggttacagtaaggttaaggcctttaaacagaagggagcagttggctaaagatcaggtggcatgggactgcatcaatgattatacaatcatgtataaaccacccccgcatgaacgcgtagctcaaccagcatcatttagttttgataaagtttttggtcctgcttgtttaactgagtcagtatatgaaggagtaaagaatgttgcattatctgcattgatgggtattaattcaactatttttgcttatggacaaacaagtagtggaaagacatacacgatgagaggaataaccgaaaaggctgtgaacgatatctatgagcatataatgaatactccagaaagaaatttcaccatacaaatatctggactagaaatatacaatgagaatgttagggacttgttaaattcagaatctggtcgcaatttgaagcttctagatgatcctgagaaaggtactgtggtggagaaattagtggaagaaacagcgaaagatgacaaacatttgagacatttgatctctatttgtgaagctcaaaggcaggttggcgagactgcactaaacgacaacagctcacgttctcaccagataattagattgacaattaaaagcacccagcgtgacaatgccgattgtgtgagatcttttgttgcaaccctgaactttgttgatctggctggaagtgagagggctgcacagacacaggcagatggcactaggcttagagaaggttgccatattaaccttagcttgatgactcttacaactgtaatcaggaagctcagtgttggaaaaagaagcggtcatataccttacagagattcaaagcttacacgtatattgcaacactcccttggtgggaatgcacgcactgccatcatatgtactttaagtccagcacttagccatgtagagcaatcacgaaacactctcttctttgctatccgggcaaaggaagtaacaaataatgctcaagttaacatggttgtttcagaaaagcagctagttaaacatttgcaaaaggaagtagcacggctggaagcagagcttcgcactcctgatccatctaaagaaaaggattggaaaattcaacagatggaaatggaaatagaagaactgagacaccagagagatcttgcacaatctcaggttgatgagttacgcaagaagcttcaggatgaccagcagcaggtctcaaaccaacttgaatcacaacatatgtcagtcaagaagtgcctctcattcactggtgttgcattgccaaaacccaagctaggctttgatagagtaagaaacagcacattaagacaatccatgagacaatcatctactgctccttttacccttatgcatgaaattcgcaaacttgagcacctccaagagcagctgggtgaagaagccaatcgagctttggaagtattacaaaaggaagtggcatgtcatagactgggtaaccaagatgcagctgagacaattgcaaagctgcaagctgaaataagggaaatgcgttttgttaggccagcaccaaaggaagttgaagatggaaacatgatttctgtgcacaagagtgttagtgctaatctcaaggatgagattagcagactacacttccagggaagcaccattgcaaatcttgaacagcagcttgaaaatgttcaaaggtccatagacaagttggtgatgtctctcccgaacaattttcaacagataaccagtgaagcatcccctaagcataaaaaggaacccaaaaggaaaaagttgcttcctttgtcttcaagtaacgctgctaatctcccaaactttataagatctccctgctctccattatcaactactcagcaagttttggaatcagatattgaaaataaagcccccaaggagaacgatgatgttgtttcaaccgacactgtgcaagagtctgagaaggacactccgacaaagagtgaggaaggtggagatgtttcatcgaaggaaaataattcaggtaatcgacgctgtagttcagttaacatgaagaaaatgcagaaaatgtttcagaatgcagcagaggagaatgtaagaagcataagagcatatgtcacagaattgaaagaacgagtggccaagttgcagtaccaaaagaagttgcttgtttgccaggtgcttgagcttgaagcaaatgaagcaaatggccatgacatagaaaacgaagagtacatatgtgaaccagaggaaccccaggttccatgggaaataacatttagagaccagcggcagcagatcatcgaattatgggatgtatgttatgtttccattattcacaggacccagttttacctgttattcaagggagacaccgcagatcaaatatacatggaagtggaattaagacgtttgacatggctgcgacaacacctagcagaaattggcaatgctagcccagctcctcatgttggtgatgaacctaccatctcactgtcatcaagtatgagagccttgaaacgagaaagagagttccttgctaagagattgacatcgcgcttgacgcaagaggagagggatgcattatatatcaaatgggatgtcccctttgatggtaaacagaggaggttgcaatttgtgagtaagctttggacagatcctcatgatccaaggcatgtacaggagagtgctgaaatagttgcaaagcttgttggtttctgtacaggaggcaacatttcaaaggagatgtttgagctgaattttgtgcgtccatctgagaagaggccatggttaatgggatggaatcctactataacaaacttccttaatttgtaataaattttatgtttgtaaatttagtaccattaaaatcttttaaatgggaattaactttggagcttttgctcaattcaaaatgattgtttggacaatatttttctctaataaactagtccatcccattggattgtatgggtttatttataaaagaatgcagtttgagtacacgtttatttttgtgacatgacacagattaagataattctatgtacaagtttattctttgattttggtctctcaagttaagtttgtacctattgtggaaaaatagagcaaacaatggacatgtttggcatgttttggaaaattttgttgacgattccaaacatctttgatgggaatatggaactgaagcaaggaatgaacaacattatgataattgatttcaagaaacatggcaactcttgaggcagattgaatgctgcaaaattacatatgttatcatgcacattgaacatgacaattgcttttgttctttattatgtttatttaagtcaaataatgtttttctcacaagtcataagtaatttcaattgcagaaacaactctattatacagtcaaaccttaattacaacaatcataatatgaaagagagatagagagtcaagaaataaacgttatctggtactgctttgaattataaatacaacattttgcaacaactaatgtaagataaaaccacagtcatcacaccaagcaacagaaaaaggaagacataaaaccacagcctaacattcattatgactagtacttataagttataagacatagaccacaccacagcataacataagataacactactgatcaagatgcatagtatatgcaggcatagaaaatttcttcaacacttagcagcttgggaagggagtgccacaagtgctagcaactctccttgcattgggagtgttaacaaacttcttgaggttgggattctggaggtattggcagaggcaaggtttctgttctttgatcttggagcagcataggttagatggagcagatgaagaggtgattgcacttacacatggactgagttgcactgggctgcatgttactgccaatgaaagttgaacttcagcaagaagcagcactagcaaagtgcacaaaacaatgtgagttgccttcattttcaccttaggattctatgtttaagtgtatgaggttgagagtgtgagagatgatgaactgattctgtgtacactgatgcatcttggactgagttggctccttatttatac

SEQ ID NO: 7970 - DNA, 3319 bp, Theobroma cacao
cttccccaaaccctagaaatctctctctctctctctctctctctctcgattgctacgctcctttctctcttttcttttactgtttggatctgaatctcaatcaaataatcttgattccgatccagatatttgattaagattcgactcgatttccttagcctctggagggagagggttctgtttgggtcttttcaattttcagagacaaaaaggaaataagaaaagatgacagttagaactccaggaaccccagccagtaagacagacaggacgcctgtaacaacacctggaggccctaaatcgaaggaagagaagattgtagttactgtaaggttaaggcctttaagcaaaagggagcaactggccaaagatcaagtagcatgggactgcgtcgacgaacacaccatcgtgtctaaacatcctgctcaagaacgcacagctcagccaacttctttcacatttgataaagtttttggtccttcatccttaactgaaacggtttacgaggatggagtgaagaatgttgctttgtcttctttgatgggcatcaatgctactatatttgcatatggccaaaccagcagtgggaagacatacacgatgagaggaataacagagaaggctgttaatgacatctaccagcatatattgaatacaccagagagggattttactattaaaatttcgggattagaaatttataatgagaatgttagagacctgttaaattcagaatccgaccgcaatctcaagcttctagatgatccggagaaaggtactgtggttgagaagttggtggaagaaacagcaagcaatgatcagcatttaagacatctgattagcatttgtgaagctcaaaggcaagttggtgaaactgccttaaatgatactagctcacggtcacaccaaataataagattgacaattcaaagtaccctgcgcgaaaattctgattgtgtgagatcatttgttgcaagcctgaactttgtggatctagctggaagtgaaagagcttcacaaacacatgctgatggtgcaagactcagggaaggctgtcatattaaccttagtttgatgactctgacaactgtaatcagaaaactcagtgttggaaaaagaagtggtcatataccatatcgagactcgaagcttactcgcatattgcagcactcactgggtggaaatgcacgtactgccatcatatgtactctgagtccagcactgagtcattttgaacaatctcgtaatactctcttctttgccactcgggcaaaggaagtgacaaataatgcacaagtcaatatggttgtttcggataaacaactagtcaaacatctgcagaaagaagtagccaggctagaagcagagcttcgcacccctgatccatcaagggaaaaagacttaaaaatacaacagatggaaatggagattgaagaactgaagcgccaaagagatcttgcacaatctcaggtggatgagttgcgcagaaaacttcaggaggatcagcagatctcaaacccacttgaatcatcacgtccatcagtaaagaagtgcctatcttattctggtgtgttgtccccaaaacttgatggtaaggagcttggccgcaatgatagaacaaggaaaacaatgttaaggcagtctatgaggcaatcatcaaccgctcctttcacacttatgcatgaaattcgtaaacttgaacatcttcaagagcagcttggagaagaagcaaatcgagctttggaagtacttcaaaaagaggtggcttgtcatagactaggtaatcaagatgcagctgagacaattgccaagctgcaggcagaaataagggagatgcgttctgtccggtcaattccaaaggaagttgaagttggaactgctatagctcctaacaaaagtgttagtgctaatcttaaggaagagataacaagacttcattcacaaggtagcacaatagctgaccttgaggagcaattagagaatgttcagaagtcaatagacaaattggtaatgtctcttccaagcaataatcaggaatccaaccgtgaagcaacccccaaaactaagagtcaatctaaaaagaagaagttgcttcccttagcttctagtaatgctgcgaaccggcaaaattttataagatctccatgctcacctctatcaacctctcggcaaattttggagcctgagaatgaagaaaatagacctccagaggatgatgacattgtctccaaggagactctcccagagtctgagaaagaaacacctgtgaagagtgaagagggtggagatgtctcatcaaaggaaggcactccaggatataggcgttcaagttcagtcaacatgaggaaaatgcagaagatgtttcagaatgcagccgaagagaatgtaagaagcataagagcatacgtaacagaactgaaagagcgtgttgccaagctgcaataccagaagcagctacttgtttgtcaggtgcttgagctggaagcaaatgaagcagctggatacaatatagaggatgatgagagtgccattgaaccagaggaaccccaagttgcatggcatgtaaccttcagggagcaaaggcagcagatcattgagttatgggatgtctgctatgtctccatcattcatagaacacagttttatttgttattcaagggagatcctgctgaccaaatatacatggaagtggagcttagacgcttaaattggctgcagcagcattttgcagaacttggaaatgcaagcccagctcttgtaggagatgagtcctcagtgtctttgtcatcaagtattagagcgctgaagcgtgaaagggaattccttgcaaagaggttgacctcacgcctgagtgtggaggagagagatgcattgtacataaaatgggatgtaccactggacggaaagcagaggaaactacaattcataaacaagctgtggacagatcctcatgatgcaaaacacatagaggagagtgctcagatagtggcaaagcttgtagggttctgcgaaggcggtaacatgtcgaaagagatgtttgagctcaattttgcgctaccagctgacaagaggccttgggttgtggggtggaatcagatatcaaaccttcttaatttgtaagagaaagaaagccttttttgtttgtaagtagttccattttgtgtacatgtaattgaatttttggagtcctttctccagatgttctagtttcatccattgcagtgtcaccaatcaagcacactgtgtgtgaggattgtttaagctattctttgtactcttcatgtttcaataaaggaatttggttcatcttgcattcccc

SEQ ID NO: 7971 - DNA, 3108 bp, Prunus persica
atgactgtcaaaactcctggaacaccggcttcgaaaatagacaggacaccagtatcaacaccaacttcgaaaatagataggacaccagtatcaactccaggtgggccaagagctaaggaggagaagattgttgttaccgtgcgtttgaggcctctgagcaaaagggagcaactagcaaaagaccaagtcgcgtgggaatgcattgatgataccacaattgtttataagccaccgcctcaagaacgctcagctcaaccggccccatttacatttgataaggtttttggtccttcttgcgtaactgaaacagtatatgaggaaggagtgaaaaatgtggccttgtcttctttgatgggcatcaatgcaactatatttgcttacggccaaactagcagtgggaagacgtacacaatgagaggaataacagagaaagctgtcattgatatctacaaccatataatgaatactccagagagagacttcacgataaagatttctggacttgaaatatacaatgagaatgtgagggacctgttaaactcagaatcaggccgtaacttgaagcttctagatgatccagagaaaggtaccgtggttgagaagctggtggaggagactgctagcaatgatcagcatttgaggcatttaatcagcatttgtgaggcccaaagacaagttggtgaaactgctttaaatgataacagctcacggtcacatcagataataaggctgacaattgaaagtaccctccgcgagaattcggattgcgtgagatcttttgttgcaagcctgaactttgtagatctggctggaagcgaaagagcttcacaaacacatgcagatggtgctaggctgagggagggttgccatattaaccttagcttgatgacacttacaactgttattagaaagctcagtgttgggaaaagaagtggtcatataccctatagagactcaaagctcactcgcatattgcagcattctctcggtgggaacgcacgcactgccatcatatgcaccttgagtccagcattgagccattttgaacaatctcgaaatactctcttctttgccaccagggcaaaggaagtaacgaataatgctcgtgtgaatatggttgtttcggataagcagctagtgaaacatttgcagaaggaagtagcaaggctggaagcagagctgcgcacccctgatccgtcaacggaaaaggatttgaaaattcagcagatggaaatggagatggaagaactgagacgccaaagagaccttgctcaatctcaggtggatgaattacgccaaaaactaaaggaggatcaacagggttcaaacccattggaattaccccatccctctgtgaagaaatgtctctcatacactggtgtgctatcaacaaaactcgatacaaaggagataggtcgtggtgatagagcaagaaatacaatgctcaggcagtctatgaggcaatcatcagctgctcctttcacactaatgcatgaaatccgcaaacttgaacacctgcaggaacagcttggggaggaagcaaatcgagctctggaagtattacaaaaggaagtagcttgtcataggctaggcaatcaagatgcagctgaaacaattgccaatctgcaagcagaaataagagaaatgcgtgctgtcagatcagagccaaaagaagttgaagttggaactgtagttgctactaacaagagtgtcagtgctaatctcaaggaagagattacgagacttcattcacagggcagcactattgctaatcttgaggaacagctagaaagtgttcagaagtctatagataaattggtgatgtctcttcctagcaattatgaacagtacaatagtgagtcaacccccaagtctaagaaggaacccaaaaagaaaaagttgcaacctttggcctcaagtaatgttcccaaccggcaaaattttatcagatcaccatgctctcctctatcaacttctcggcaaattgcagagtctgaaattgaaaacagggctcctgagaatgatgatgttttgtctggtgagactcaaccggagtctgagaaggggactcccacaaagaatgaagaatgtggagatgtctcatcaaaggaaaacactccaggagggtatcggcgttctagttcagtgaacatgaagaaaatgcagaagatgttccaaaacgcagcagaagagaatgttagaaacataagaacttatgtaacagaactgaaagagcgggtggccaagttgcagtaccaaaagcagctactagtttgccaggttctagagctagaagcaaatgaagcagctgggtacgatatagagaatgatgagaacacatgtgagccagaggagcccatggtctcatggcaaataacttttaaggaacaaagacagcaaatcattgagttgtgggatttgtgttttgtctccatcattcataggacacagttttatttgttatttaagggggatccagctgaccaaatctatgtggaagtggagctgaggcggttgacatggttgcaacatcatctggcagaacttgggagtgctagtcctgcccatgtgggagatgaacccacagtctctttgtcatcaagtatcagagcactaaagcgcgaaagggagttccttgctaagaggctgacttcacgtttgactgcggaggagagagatgcattgtacatgaaatgggatgtcccacttgaagggaagcagaggaagatgcagtttgtgaataagctctggactgatccccatgatgccaagcatattcaggagagcgctgaaatagttgcaaagcttgttggtttctgcgaaagcggaaacatgtcaaaagagatgtttgaactcaattttgtgcttccatctgataagaggtcatggattatgggctggaacccaatttcaaaccttcttaacttgtgagaaagtacattttgttgtaagtacttccattctttatattctgtacatgtaaatgaattttcaagtggtgtgagtgtgacttggaacattagtgagcacaatgcacactatgcatggtgttgatttggaacactagtttctgtaattttcagatctcaataaagaattgattcattt

SEQ ID NO: 7972 - DNA, 3316 bp, Prunus mume
cattttcttacgactctctttcctcttcttcttcttcgattccttgaattcgacttcaaagctctggtctcaaacttaaacgctcctttcatctctcaatttccttgggctgagatttccaggagttttccggtcgagttcggcttgctatttctctcagttaatccggtagattcagaataaagatgactgtcaaaactcctggaacaccggcttcgaaaatagacaggacaccagtatcaacaccaacttcgaaaatggataggacgccagtatcaactccgggggggccaagagctaaggaggagaagattgttgttaccgtgcgtttgaggcctctgagcaaaagggagcaactagcaaaagaccaggtcgcgtgggaatgcattgatgataccacaattgtttataagccaccgcctcaagaacgctcagctcaaccggccccatttacatttgataaggtttttggtccttcttgcgtaactgaaacagtatatgaggaaggggtgaaaaatgtggccttgtcttctttgatgggcatcaatgcaactatatttgcttacggccaaactagcagtgggaagacgtatacaatgagaggaataacagagaaagctgtcattgatatctacaaccatataatgaatactccagagagagacttcacgataaagatttcaggacttgaaatatacaatgagaatgtgagggacctgctaaactcagaatcaggccgtaacttgaagcttctagatgatccagagaaaggtaccgtggttgagaagctggtggaggagactgctagcaatgatcagcatttgaggcatttaatcagcatttgtgaggcccaaagacaagttggtgaaactgctttaaatgataacagctcacggtcacatcagataataaggctgacaattgaaagtaccctccgcgagaattcagattgcgtgagatcttttgttgcaagcctgaactttgtagatctggctggaagcgaaagagcttcacaaacacatgcagatggtgctaggctgagggagggttgccatattaaccttagcttgatgacacttacaactgttattagaaagctcagcgttgggaaaagaagtggtcatataccatatagagactcaaagctcactcgcatattgcagcattctctcggtgggaacgcacgcactgccatcatatgcaccttgagtccagcattgagccattttgaacaatctcgaaatactctcttctttgccaccagggcaaaggaagtaacgaataatgctcgtgtgaatatggttgtttcggacaagcagctagtgaaacatttgcagaaggaagtagcaaggctggaagcagagctgcgcacccctgatccatcaacggaaaaggatttgaaaattcagcagatggaaatggagatggaagaattaagacgccaaagagaccttgctcaatctcaggtggatgaattacgccaaaaactaaaggaggatcaacagggttcaaacccattggaattaccccatccctctgtgaagaaatgtctctcatacactggtgtgctatcaacaaaactcgatacaaaggagataggtcgtggtgatagagcaagaaatacaatgctcaggcagtctatgaggcaatcatcagctgctcctttcacactaatgcatgaaatccgtaaacttgaacacctgcaggaacagcttggggaggaagcaaatcgagctctggaagtattacaaaaggaagtagcttgtcataggctaggcaatcaggatgcagctgaaacaattgccaatctgcaagcagaaataagagaaatgcgtgctgtcagatcagagccaaaagaagttgaagttggaactgtagttgctactaacaagagtgtcagtgctaatctaaaggaagagattacgagacttcattcacagggcagcactattgctaatcttgaggaacagctagaaagtgttcagaagtctatagataaattggtgatgtctcttcctagcaattatgaacagtacaatagtgagtcaacccccaagtctaagaaggaacccaaaaagaaaaagttgcaacctttggcctcaattaatgttcccatccggcaaaattttatcagatcaccatgctcgcctctatcaacttctcggcaaattgcagagtctgaaatcgaaaacagggctcctgagaatgatgatattttgtctggtgagactcaaccggagtctgagaaggggactcccacaaagaatgaagaatgtggagatgtctcatcaaaggaaaacactccaggagggtatcggcgttctagttcagtaaacatgaagaaaatgcagaagatgttccaaaatgcagcagaagagaatgttagaaacataagaacttatgtaacagaactgaaagagcgggtggccaaattgcagtaccaaaagcagctactagtttgccaggttcttgagctagaagcaaatgaagcagctgggtacgatatagagaatgatgagaacacatgtgagccagaggagcctatggtctcatggcaaataacttttaaggaacaaagacagcagatcattgagttgtgggatttgtgttttgtctccatcattcataggacacagttttatttgttatttaagggggatccagctgaccaaatctatgtggaagtggagctgaggcggttgacatggttgcaacatcatctggcagaacttgggaattctagtcctgcccatgtgggagatgaacccacagtctctttgtcatcaagtatcagagcactaaagcgtgaaagggagttccttgctaagaggctgacttcacgtttgactgtggaggagagagatgcattgtatatgaaatgggatgtcccacttgaagggaagcagaggaagatgcagtttgtgaataagctctggactgatccccatgatgccaagcatgttcaggagagcgctgaaatagttgcaaagcttgttggtttctgcgaaagtggaaacatgtcaaaagagatgtttgaactcaattttgtgcttccatctgataagaggtcatggattacgggctggaacccaatttcaaaccttcttaacttgtgagaaagtacattttgttgtaagtacttccattctttatattctgtacatgtaaatgaattttcaagtggtgtgagtgtgagtgacttggaatactagtgagcacaatgcacactatgcatggtgttgatttggaacactagtttctgtaattttcagatctcaataaagaattgattcatttccattggttacgttacaaa

SEQ ID NO: 7973 - DNA, 4226 bp, Ricinus communis
ctactgatatttcagcaacttctgcaccaggagagagacaaaacgttaattccatagcctctcctgtgagaggcattatctatacttttatttggtctcaatcagaggataagtgctaattgtaatagaaagatgacagtcagaacacctggaactccagcttctaagatcgataggacgccagcaacaactccaggtcccaaatcaaaggaagagaagattgttgttactgtacgattaagacctctaaacaaaaaagaacagctagccaaagaccaagtagcatgggagtgtgttgatgatcacaccattgtatttaagccaccaactcaggaacgcacagctcaatcgacccctttcacatttgataaagtttttggtcccacctctctaactgaaagtgtatatgaggatggtgtaaagaatgttgctttgtctgctttaatgggcataaatgcaactatatttgcatatgggcaaactagcagtgggaagacatatactatgagaggaataactgagaaagctgttaatgacatctataaccatatattgaataccccacagagagactttacgattaagatttctggattagagatttataatgaaaatgtcagggacctgctgaactcagaatcaggtcgaagtctcaagcttctagatgacccagagaaaggtactgtggttgagaagttggtagaagaaacagcaaccaatgatcagcatttgaggcatctgataagtatttgtgaagcccaaaggcaagttggtgaaactgctcttaatgatactagctcgcgttcacaccaaattataaggcttacgatagaaagtactctccgtgaaaattcagattgtgtgagatcttttgttgcaagcctgaactttgtagaccttgctggaagtgaaagagcttcacagacacatgcagatggggcgaggctcagagaaggctgtcatatcaatcttagtttgatgactctgacaactgtgattagaaagctcagtgttgggaaaagaagcggtcatataccctaccgggactccaagctcactcgcatattgcagcactcacttggcggaaatgcacgaactgccatcatttgtactctaagtccagcgcttagccatgtcgaacaatcacgaaacactctcttctttgccacaagagcaaaggaagtcaccaacaatgcccaagtcaacatggttgtttccgataagcagctggtcaaacatctacagaaggaagtagccaggctggaagcagaattgcggactcctgacccttcaaaagaaaaagacttaaaaattcagcagatggagagagaaattgaagaactgagacgccagagagatcttgcgcaatctcaagtggatgagttgcagaaaaaacttcaagaggaccaacaggcgtcaagcacattagaatcaccaccacgtccatcagtgaagaagtgtctctcctactctgatgcattattatcaaaacttgagaacaaggagataagccgctgcgacagagcaaggaaaactatgttaaggcaatccatgaggcaatcatcaactgcaccttttactctaatgcatgaaatccgtaaacttgaacatcttcaggagcaacttggagaagaagccaatcgagctctagaagtattacaaaaggaggttgcttgtcatagactaggtaatcaagatgcagcggaaaccattgccaagctgcaagcagaaataagggaaatgcaatctattcaaccagcttccaaagaagtagaaattggaagtgttgtcgcccctaacaagagcgtcagcgccaacctgaaggatgagataacaagacttcattctcaaggaagcaccattgcaaatctcgaagaacaattggaaaatgttcagaaatctatagacaaattggtaatgtctcttccaagcaatgattcacagttaaactgtgaagcacctgccaaagcaaaaaatcaacagaagaagaaaaaggtacttcctttggcttcaagtaacggcgccaacaggcaaaactttttgagatctccttgctcgccactatcaacttcccggcaagttttggaaaatgagattgaaaatagagcaccggaaaatgaagacttcacatccggtgagacccagccagagtctgagaaagagactcctacaaaaagtgaagaatgtggagatgtttcatcaaaggaaggaacccctggctatcgtcgttctagttcagttaatatgaagaaaatgcagaagatgtttcagaatgcagcagaggagaacgtgagaagcataagagcttatgtgacagaattgaaggaacgtgttgccaaactgcaataccaaaagcagctacttgtttgccaggtccttgagctggaagcaaatgaagcagctggatataatcttgaggatgaggagggcactattgaaccagagccacaagtttcctggcagattacttttagagagcaaaggcagcagattattgaactgtgggatctatgctctgtatccatcatccacaggacacagttttatttgttattcaagggagaccctgctgatcaaatatacatggaagttgagcttaggcgcttgaattggttacagcagcattttgcagaaattggcaatgcaagccctgctcctcatgttggagatgagcctacaatttctctatcgtcaagtattcgagcattgagacgtgaaagagagtttctggcaaagaggttgacttcacgttttaatgtggaagagagagaggcactgtacatgaaatgggatgttccattagaggggaagcagaggagactgcagtttgtgtacaaattatggacaaatccacatgatccaagacatatacatgaaagtgctgagatagtggcaaagcttgtaggattctgcgaaggaggaaatatgtcaaaagagatgtttgagctaaattttgcactaccaacagataagagaccatggattatgggctggaatccaatttcaaaccttctacatttgtgagaattacatttttcttttgtaagtatttcctatttctgtacatgtaaatgaattttagagttttttgtccatgcatcatttatttatatccttacttttggttaaattatggtatgactggttgtgcatgctatgcgcatgaagggaagagggtttggatatgacaatattcatattttaataacaaaagaattgattcatcttgtttccaagtggtgcatttatttcatctgttgatttgttaagtgtaaaataccaaacaggtttagttgattttttttccttttcttctttcttgccaagaataccagcaatgttaataaatttcttcgaattctcctgcaactttacaaatttctaccagtatcaaaggcctgtgattctataatgagccttgactattggtgttttaagaaaagtgattattcacttctgtattttagccaagtcgttaaattgttcgcattcttccttcattatttttactatccatcacaattagataaattggctacgacaggctttgttgaagaaaaattactacttcaggctccactatccaccagtaataggttgtttttttccccagtaatctctctattttgaaacttatcatttttgcttcttctatttttttatgagttcaaattacattattgtattataattttctgcagtagggtctgaatgtcagctgaaataaaatatatgagtaattaaaaaccccattagaacctaataaaatttgtcaaagaaaacaagtggattttaaccggagataatttaaatttccattacaatagtcataattgatccaactggtaacacccattacatgatgaaaacacaccaaagaacaaagttgggcgcatgagaatgtgacccaacaaattatttccattaacaactagctagtgctccactaaagtaaataacatataccacaccaaattttgaacataaattaactctctaaatcagtctctccaccctttactggaatcctgaaatgctgattaacaagaaacaggatagagaaaattgagagtgacccaagttttttagcacttggggaatggagttccacaggtgctagcaactttcctagcatttggtgtgttgatgaatttcttgagatttggattcttgaggtattggcaaaggcaaggcttctgttccttgatcttgctgcagcaagctga

SEQ ID NO: 7974 - DNA, 3365 bp, Malus domestica
cttttcatcaccatttctctcaatctcttcgtcttccttctccaacactcgactttgacttcgaagcgattctcctcggactcaaaggcgctcctttcgtctctcaatcctcttgtgcgccgaagaattccggaagttttcgggtcgatttcggttttctatttctagagggctttcctgggaaaggcccgagatttggtgttggtgttcttcaagctcgtttgatctgctagattcgagaaacaatgactgtcaaaactcctggaacaccggcttcaaaagtagacaggacaccagcatcaacaccggcttcaaaaatagacaggacaccagtctcaactccgggcgggccaagagctaaggaggagaagattgttgtcacggtgcgattaaggcctctaaacaaaagagagcaactagcaaaagaccaagttgcgtgggaatgcctcgatgacaacacgattgtttataagcccccgcctcaagaacgctcagttcaaccggccccattcacatttgataaagtttttggtcctacttccttaacggaagcagtatacgaggaaggagtgaaaaatgtcgccttgtcttctttgatgggcatcaatgcaactatattcgcttatgggcaaacgagcagtgggaagacatacacaatgagagggataacagagaaagccgtcattgatatctacaatcatataatcaatactccggagagagactttacaataaaaatctctggacttgaaatatacaacgagaatgtgagggacctgctaaattctgaatcaggtcgtagtttgaagcttctagatgatccagagaaaggtaccgtggttgagaagctggtggaggaaactgcaagcaatgatcagcatttgagacatttaatcagcatttgtgaagcccaaagacaagttggtgaaactgctttaaatgataacagctcccggtctcatcagataataagactgacaattgaaagtacactccgtgagaattcagattgcgtgagatctttcgtggcaagcctgaactttgtcgatctggctggaagcgaaagagcttcacaatcacttgcagatggtgctaggctcagggaaggttgccacatcaaccttagcttgatgacactcacaactgtcattagaaagctcagcagtgggaaaagaagtggtcatataccctatcgagactcaaagctcactcgcatattgcagcattctctaggtgggaatgcacgcacagccatcatatgcaccttgagtccggcattgagccattttgaacaatctcgcaatacgctcttctttgccaccagggcaaaggaagtaacaaataacgctcgtgtgaatatggttgtttcggacaaacagctagtgaaacatttgcagaaggaagtagcgaggctggaagcagagctgcgcacccctgacccattaagggaaaaagaattgaaaattcagcagatggaaatggagattgaagaattgagacgccaaagagatcgtgctcagtctcaggtgcttgaattacagcaaaaacttcaggaggatccacagggttcaaacccttctggaataccccatccctctgtgaagaaatgtctctcatacaccggtgttctatcaacaaaacccgacaaaaaggatataggccctggtgatagagcaagaaatttgaggcagtctatgaggcaatcatcaactgctcctttcacactaatgcatgaaatccgcaaacttgaacacctgcaagaacagcttggggaagaagcaaatcgagctctggaagtattacaaaaggaggtggcttgtcataggctaggcaaccaagatgcagctgaaacaattgccaatctgcaagcggaaataagagaaatgcgttctgtcagatcagtgccaaaagaagttgaacttggaactgtagttgctactaacaagagtgtaagtgctaatctcaaggaagagattacgagacttcattcacagggcagcacgattgaaaatcttgaggaacagctagaaagtgttcagaagtcaatagataaattggtgatgtctcttcctagcaattatcaagagtgtaatattgaggcatcctccaagcctaagaaggagtccaaaaagaagaagtgtctacctttggcctcaagtaacattgccaaccgacaaaatttcatcagatcaccttgctcacctctatcagcttctcggcaaattgcagaatctgaaactgaaaatagggctcctgagaatgatgatattgtgtccggtgagattcaaccagagtctgagaaggggactccgacaaagaatgaagaatgtggagatgtctcatcaaaggaaagcactccaacaggttatcggcgttctagttcagtaaacatgaagaaaatgcagaagatgttccaaaatgcagcagaagagaacgtaagaaacattagaacatatgtaacggaactgaaagagcgggtggccaaactgcagtaccaaaagcagctactagtttgccaggttctggagctggaagcaaatgaagctgccgggtacaatttagagaatgacgaggacacatgtgagactgaggagccccaagtctcgtggcaaataactttcaaggaacaaagacagcagatcattgagttatgggatttgtgctttgtctccatcattcataggacacaattttatttgttgtttaaaggtgacccagctgatcaaatctacatggaagtggagcttagacggttgacatggctgcaacagcatctcgcagaacttggggatgctagccctgctcatgtgggagacgaacccagagtttcgttgtcatcaagcatgagagcgctaaagcgcgaaagagagttccttgcgaagaggttgtcttcacgcttgacagcagaggagagagatgcattgtacatgaaatgggatgtcccgcttgaaggaaagcacaggaagctgcagtttgtgaacaagctttggcaagatccccatgatcccaggcacatccaggagagtgctgaagtagttgcaaagcttgttggcttctgcgaaagtggaaacctgtcgagagagatgtttgagctcaattttgtgctcccatctgataggaggccatggatgatgggctggaaccagatttccaaccttctcaatttgtgagaaagtacatttttgttgcaagtaatttacattctttgaaataatgtatatgtaaatgatttttcaagctttcattgtctgtgttgtcaagtgtgactattgagcacaatgcacactttgcatggtgtttgattcatttccaatggtttcaaatctaattgaattaatttcactagaaattggcttctcttaaaa

SEQ ID NO: 7975 - DNA, 3357 bp, Populus trichocarpa
gaaatacctctctttctctctctaaaaaacctcagtttttcatcacgtcttcgctggatctcctatctcggcttgagatttatctacttatttgtataaacaacttttgcatccaagaaagagtggtccctctttgttagtctctccagtgagagaagctgaggctggtgatttccattctaaagagaggctggttttgacccaaaaaaagagatgacaataagaaccccaggaacaccagcttctaagattgataggacaccagcaacaaccccaggaggggctaaagcaaaagaagagaagattgtagttactgtaagattaaggcctttaaacaagaaggaacagttagctaaagaccaagttgcttgggactgtgttgatgaccatactattgtctttaagccaccctctcaagaacgagcagctcaaccggcttctttcgtgtttgataaagtttttgatccttctagtataactgaagctgtgtatgaagatggagtgaaaaatgttgctttgtctgctttgatgggcataaacgcaaccatatttgcatatgggcaaactagcagtgggaagacatacacgatgagagggataactgagaaagctgttaatgacatatataagcatataatcaatactccggaaagagattttacaattaggatttctggactagaaatctataatgaaaatgtcagggacctattaaattccgaatctggtcgcaatctcaagcttctagatgacccggagaaaggtactgtggttgagaagttggtagaagagacagcaagtaatgataagcatttaaggcatttaatcagtatttgtgaagcgcaaaggcaagttggggaaactgcccttaatgatactagttcacggtcacaccaaattataaggctgtcaatagagagtacacttcgagaaaattcagattgtgtgagatctttcgttgcaagcctgaattttgtagatctagctggaagtgaaagagcttcacagacacatgcagatggtgccagactcagagaaggttgtcatattaatcttagtttgatgactctgacaactgtgattagaaagctcagtgttggaaaacgaagtggacatataccatacagagactcgaagcttactcgcatattgcagcactcacttggtggcaatgcacgcactgccatcatatgcactctaagcccagctctgagccatgttgaacaatcccgaaataccctttactttgccacacgagctaaggaagtcactaacaatgcccacgttaacatggtagtttcagataagcagcttgtgaaacatctgcagaaggaagtagccaggctggaagcagtgctgcgcactcctgacccttcaacggaaaaggacttgaaaattcaggagatggagatggaaatggaggagctgaaacgccaaagagatcttgcacaatttgaggtggatgaattgcgcagaaaacttcaagaggatagacaggcttcgagcacattggaatcaccctgcccatcggtgaagaagtgtctctcttattctgatgcatccttgccaaatctcgacagcaaggagccaagccgcagtgatagaaccaggaagacgatgctaaggcagtcaatgaggcaatcatcaactgcacctttcacgttgatgcatgaaattcgcaaacttgaacaccttcaggagcaacttggagaagaagcaaatcgagctctggaagtactacagaaggaggtggcttgtcatagactgggtaaccaagatgcagctgagacaattgctaaactgcaagcagaaatcagggaaatgcgcactatccaaccagttccaaaagaagttgaagctggaagtgtcgtagctcctaacaagagtgtcagtgctaatctcaaggatgaaataacaaggcttcattcacagggcagcactatagcagatcttgaagagcagctcgaaaatgttcagaagtctatagacaaattagtaatgtccctcccaaacaataatccacaatcaaactgtgaagtaactcccaaggctaagaatcaacagaagaagaaaaagatacttcctttggcttcaagtaacggctctaacagacagaattttataaggtctccttgctctcctctatcaacttctcggcaaattttggaaaaagagattgagaatagagatccgtacaatgatgacattgtagccagtgagaccctgccagagtctgagaaagagactcataaaaagaatgaagaaggtggggatgtctcatcaagagaagggacacctggctatcggcgctcaagttcagtgaacatgaagaaaatgcagaagatgtttcagaatgcagcagaggagaatgtcagaaacataagagcctatgtgactgaacttaaagaacgtgtggcgaaattgcaataccaaaagcagctacttgtttgccaggtgcttgagctggaagcaaatgaagcagctggatataacatagaggaggaggaggagaataatataaatgagcaagaggagccccaagtttcgtggcatgtaacttttagggagcaaagacagctgatcattgagttgtgggatgtgtgctatgtgtccatcatccataggacacagttttatttgttattcagtggtgaccctgctgatcaaatatacatggaggtggagctaagacgcttgacttggttgcagaagcatttggcagaactcggcaatgcaagcccagctcattttggagatgagtctacaatatctctgtcatcaagtattagagcattgaaacgtgaaaaggagttccttgcaaaaaggttggcctcacgtctgactacggaagagagagatgcattatacatcaaatggaatgtcccacttgatgggaagcagagaaggctgcagtttgttaacaaactgtggacagatcctcatgatgtcaagcatatacaggagagtgctgatatagtggcaaaacttgtagggttctgtgaaggaggaaacatgtcaaaggagatgtttgaactcaattttgcactgcctacagataagagaccatggattatgggctggaacccaatttccaaccttctacatttgtgagaaacaattctctgatttgcaagtattttccctttctgtacattgtaaaggaattttggagtttctctccaagcattcaagattcttttctattatggggtgtgatcaattgaacgcactgtggatgatgatggtttgggatatttatttcatcttcatatttcaataaaaaagaatcatcaattcgtttactgttgttctctacttggtgttgatgtcacctccactttcgactcctacccaata

SEQ ID NO: 7976 - DNA, 3576 bp, Populus trichocarpa
gcaattgaaattttttttttttcgcaaattgggaagattggattggaactttccattttggtaaagcaaaggtaatatgggagctattattaataaagaggaccaaattgaaacacactcaattgattgagggtatatgtgtagtttgccctaaaaatgaagaaatcagaacctcagaaaagaaaagaaacgaactagccgttagaaatcaaattcaaattggtcacaggttttcatttcataaagaaggcaatgaaaagagcagaccctctctctctctttaacccctgcaaaaacccacctcttacattctctctctgaaaaagagctagttcttatcggttcttctctggatctgcttgtttatctggagacctcggcttgagattcctctatttacagttttttgttagtctctccagtgagagaggcagaggctggtgatttccattttcgggtctcttgtgagtgaattgtaaagggaaagagtagattttgaccaaaaaagatgacacttagaacccctggaacaccagcttctaagattgacaggacaccagcaacaaccccaggagggcctaaagcaaaagaggagaagattgtagttactgtcagattaaggcctttaaacaagaaggagcagttagctaaggaccaaattgcttgggactgtgttgatgatcatactattgtctttaagccaccccctcaagaacgagcagctcaaccggcctctttcatttttgataaagtttttggtccttctagtataactgaagctgtttatgaagatggagtgaaaaatgttgctttgtctgctttgatgggcataaatgcaaccatatttgcatatgggcaaactagcagtgggaagacatacacgatgagagggataactgataaagctgttaatgacatctataagcatataatgaatacaccagagagagattttacaattaggatttctggactagaaatctataatgaaaatgtcagggacctgttaaattctgaatctggtcgcaatctaaagcttctagatgacccggagaaaggtactgtggttgagaagttggtagaagagacagcaagtaatgatcagcatttaaggcatctaatcagtatatgtgaagcgcaaaggcaagttggtgaaactgcccttaatgatactagctcacgatcacaccaaattataaggctgacaatagaaagcacacttcgagaaaattcagattgtgtgagatctttcgttgcaagcctgaattttgttgatctagctggaagtgaaagagcttcacagacacatgcagatggtgccagactcagggaaggttgccatattaatcttagtctgatgaccctgacaactgtgattagaaagctcagtgttgggaaacgtagtggtcatataccttacagagactcgaagcttactcgcatattgcagcactcacttggtgggaatgcttgtactgccatcatatgcactttaagcccagctctgacccatgttgaacaatctcgaaataccctttactttgccacacgagcaaaggaagtaactaataatgcccatgtcaacatggttgtttcggataagcagcttgtgaaacatctgcagaaggaggtagccaggctggaagcagagctgcgcactcctgacccttcaagggaaaaagacttcaaaattcggcagatggagatggaaatggaggagctgagacgccaaagagatcttgcgcaatctgaggtggatgaattgcgcagaaaacttcaagaggatcgacaggtttcaagcacactggaatcaccccgtccattagtgaagaaatgtctctcttattctgatgcatccttgccaaatcttgacatcaaggagtcaagccactgtgatagaaccaggaaaacgttgctaaggcagtctatgaggcaatcatcaactgcacctttcacgctaatgcatgaaattcgcaaacttgaacaccttcaggagcaacttggggaggaagcaaatcgagctctggaagttctacagaaggaggtggcttgtcatagattaggcaaccaagatgcagctgagacaattgctaaactgcaagcagaaatcagggacatgcgcactatccaaccggttccaaaagaagttgaaattggaagtgttgtagctcctaacaagagtgtcaatgctaatctcaaagatgaaataacaaggcttcattcacagggaagcacttttgcagatctcgaagagcaacttgaaaatgttcaaaagtccattgacaaattagtaatgtctcttccaaacaataatccacaatcaaactgtgaagcagcttcaaaagctaagaatcaacagaagaagaaaaagatacttcctttggcttcaagtaatggcaccaacaggcaaaattttataaggtctccttgctccccgctgtctacttctcggcaagttttggaaagtgagattgaaaatagagctccgaataatgatgacattgtagtcagcgagaccatgtcagagtctgagaaagagactcctacaaagattgaagaagggggggatatctcatcaaaggaagggacacctggtggctatcggcgctcaagttcagtgaacatgaagaaaatgcagaaaatgtttcagaatgcagcagaggagaatgttagaagcataagaacttacgtgaccgaacttaaagaacgtgtggccaaattgcaataccaaaagcagctacttgtttgccaggtccttgagctggaagcaaatgaagcagctggatatactatagaggaggaagaaaatataaatgagccagagcagccccaagtttcgtggcatgtgacttttagggagcaaaggcagctgatcattgagttgtgggatatgtgctatgtatccataatccacaggacacagttttatttgttattcaagggcgaccctgctgatcaaatatacatggaagtggagctaagacgcttgacttggttgcagcagcatttggcagaacttggcaatgcaagcccagctcattttggagatgagcctacaatatctctgtcatcaagtattagagcactgaaacgtgaaaaggagttccttgcaaaaagattgacctcacgtctgactgcagaagagagagacgaattatacatcaaatggaatgtcccacttgatgggaagcagaggaggctacagtttgttaataaactgtggacagatcctcatgatgccaagcatatacaggagagtgctgacatagtggcaaaacttgtagggttctgcgaaggaggaaaaatgtcaaaggagatgtttgaactcaattttgcactgccaacagataagagaccatggattacgggctggaaccaaatttcaaacattctacatttgtgagaaactctctttttgtttgtaagtatttccattctgtacatgtaaaggaattttggagtttctctccaagcattctagattcttttttcatgatggtgtgatcaattgagagcactatggatgatgatgttctgggatcttcatatttcaataaaaaggaattcattcattta

SEQ ID NO: 7977 - DNA, 3137 bp, Citrullus lanatus
atttcagtttgttggtccgactgtgaaggagaaataggcagataatattaagtatcacgatgactatcaaaactcctgcaacaccagcttcgaaaacagagaggacaccagcatcaacacccggaggacctcgatctaaggaagagaagatcgttgttactgtgcggttaaggcctctgagtaaaaaggagcagcaagcgaaagatcaaatggcatgggagtgcattgatgatcataccattgtatacaaacctcagcctcaggaacgtcaaactcaaccagcctcgtttacatttgataaagttttcagtcccacttctttgactgaggcagtatatgaggaaggagtaaagaatgttgccttatctgccctaatgggcatcaatgccaccatattcgcctatgggcaaactagtagtggaaagacatttacaatgagggggataactgagaaagctgttaatgatatctacaaacatattagtaatacacccgagagagattttacaataagaatttctggactggaaatatacaatgagaatgttagggatctactgaatacaaaatcaggtcggaatctaaagcttcatgatgacccagagaaaggtacaatggttgagaaattagtagaggaaacggcaaataatgatcaacatttgaggcatttgattagcatctgtgaggctcaaagacaagttggtgaaactgccttgaatgactatagctctcggtcacaccagatcataaggctgacaattcaaagtaccctacgagaaaattcagattgcgttagatcttttgtggcaagcttgaattttgttgatctagctggaagtgagagagcttcacagacacatgctgatggtgctaggctaagagaaggctgtcatattaaccttagtttgatgacgctcacaactgtgatcagaaagctaagtcttggaaagagaagtggtcatataccttatagagactcaaagctcacccgcatattgcagcactcccttggtggaaatgcacgaaccgccattatttgcactttgagtccagcactgactcatgttgaacaatcgcggaacactttgtactttgccacccgggcaaaggaagtgactaataacgcccaagtcaatatggttgtatcggacaaacaattggtcaaacatttacaaaaggaagttgccaggctagaagcagaactgcgcactcctgatccaaaaagggagaaagatttaaaaatccagcagatggaaatggagattgaagaattaaaacgacaaagagaccttgctcaatcccaggttgatgagctccgcagaaaacttgaggaagaccagcagggttccaacccaattgaatctgcccgtcctccagtgaagaagtgtttgtcctttactggtacattgcctcagaaactcgacagcaaggaccttggccgtggtatgatattaaggcagtctatgatgagacaatcatcgactgctcccttcacacttatgcatgaaattcgcaagctggaacatctccaggagcagcttggggaggaagctaatagagccctcgaagtattgcaaaaggaggtggcttgtcacagactggggaaccaagatgcagcagaaacaattgccaaactacaagctgaaataagagaaatgagatcagtccgctcagaaccaaaagaggttgaggttgggaacactattgctactaaccagagtgtaggtgctaatcttaaggaagagataacacggcttcattctcaaggtagcaccattgccaatttagaggagcagcttgaaaatgttcagaagtctattgacaagttggtaatgtctctaccaagcaattatcagcagttcatgagcagtgaatcaacccccaaacaaaaaagttatactaaaaagaagaaattgcttcctttggcctcaagtaatgttaccaaccggcaaaactttttaagatcgccatgctccccttcaacaactccccagcaagtactggagtccgatactgaaaatagagctcctgagaatgatgatgacttctcatctgagattctgctcgagtctgagaaagagactccaacaaagagtgaagaaggtggagatgtctcatcaaaggagaacactccttgttatagaagatcaagttctgtgaacatgaagaagatgcaaaagatgttccaaaatgcagcagaagaaaacgtaagaagcataagagcatatgtgacagaattgaaagaacgtgtggctaaactgcagtaccaaaaacagctacttgtttgtcaggtccttgagctggaagcaaatgaagcagctggcaacaaattagattgtgatgaaaacacatttgagcaagatgacgaccaagttccgtggcatgtaactttcagggagcaaaggcagcagattattgagttatgggatgcttgctatgtctccattattcacagatctcagttctacttgttattcaagggcgacgaggctgatcagatttacctggaagtagagatgaggcgcttaacatggctgcaggatcacctagcggaatttggcaatgctagtccagctcactttggggacgagccaacaatctctcgctcgtcaagcatgagggcattgagacgtgaaagagagtttcttgcaaagagattaacttcacgattgtcagcagaagaaagagatgccttgtacattaaatgggaagtaccacttgaagggaaacagaggaaaatccaatttgtaaacaagctctggacaaatcctcacgaccccaagcatattcaggacagtgcagagatagtggcaaagcttgttgggttctgtgaaggaggcaacatgtccagggagatgtttgaactcaattttgttgttccttccgacaaaagaccatggatcatgggatggaacccaatttcaaaccttcttaatttgtgagaaaatacatttttttttttgtaagtaccttacaaccttctgattccttttgtatatcttaattaattctggagtcttcctccagaatttctcttatattgtgtctgattggacacaacaaagattgatcttttcgtatcattaattcctatctgaataaaagaatttaattcatttccccttcttgattagatt

SEQ ID NO: 7978 - DNA, 3155 bp, Fragaria vesca
atcgagcccttcaaattcgaaccccccaaacccagacgctcctctctctcttttacaaattggtcggcggcggcttgttactactccggcacaagtttggtgttgctgatctaggaaagatgacagtcagaactcctggaaccccatcttcgaaaatcgacaagacaccggtgacaactccatcttcgagaatcgacaggacaccggtgtcaactccgggagggccgagaggagcaaaggaagagaagattgttgttacggtgcgattgaggcctctgagcaaaagggagcagctggcaaaagaccaagttgcttgggaatgcgtcgacgacaacaccattgtgtctaaacctcaggaccgctcaactcaaccggcctcgtttacatttgataaagtatttggtcctaccagtataactgacactgtatatgaggaaggagtgaagaatgtggccttgtcttcgttgatgggcatcaatgctactatatttgcatatggacaaactagcagtgggaagacatacacaatgcgaggaattacagagaaagctgtcattgatatttacaaccatataatgaatactccagagagagattttacaatcaaaatttccggacttgaaatatacaatgagaatgttaaggacctgctaaactcggagtctggtcgtaatctcaagcttctagatgatccagagaaaggtactgtggttgagaaactggtggaggaaactgcaagcaatgatcagcacttgagacatttaattagcatttgtgaagctcaaagacaagttggtgaaacagctttaaatgataatagctcacggtcacatcagataataaggctgacaattgaaagtacactgcgtgaaaattcagattgcgtgagatcttttgtggcaagcctgaactttgtagatctggccggaagtgaacgagcttcacaaactcatgcggatggtgctaggctaagggaaggttgccatatcaaccttagcttgatgacacttacaactgttatcagaaagctcagtgttggaaaaagaagtggtcatataccctacagagactcaaagctcactcgcatattgcagcattctcttggtgggaatgcacgcactgctatcatatgtaccttgagtccagcaatgagtcatcttgagcaatctcggaatactcttttctttgctacaagggcaaaggaagtcacaaataatgcacgcgtgaacatggttatttcagacaagcaactagtgaaacatttgcagaaggaagtagctaggctggaagcagagctacgcacccctgccaccccagatccatcaatggaaaaagatatgaaaattcagcagatgaaaatggaaattgaagaattgaaacgtcagagagatcttgctcaatctcaagtaattgaactatgccaaaagctgaaggaggatccacaggtttcaaatcccttggaattaccccatccttcagtgaagaagtgtctatcctacactggcgaactaccaacaaaacttgatgccaaggagctagggcgtggtgataaagcaagaaatataaagttgaggcagtctatgaggcaatcatcagctgctccttttactctaatgcatgaaatacgcaaacttgagcacctgcaagagcagcttggaaacgaagcaaatcgagctctggaagtattacaaaaggaggtggcttgtcatagattaggaaaccaagatgcagctgaaacaattgctaacctgcaagcagaaataagagaaatgcgttcagtaagatcagtgccaaaagaagttgatgttggaactgtggttgctaccaacaaaagtgtcagtgctaatctaaaggatgagatcacaagacttcattcacagggcagcactattgcaaatcttgaggaacagcttgaaagtgttcagaagtctatagataaattggtgatgtctcttcctagcaattttgaacaatgcaatagtgaagcaccccccaagtctaagaaggagtccaagaagaaaaagttatcacctttatcttcaagcaatgtttccaaccggccaaattttatcagatcaccttgctcacctctatcagcttctcgtcaaattgtggagtctgatgaaattgaaaatagagttccccaacatgatgatactttgttcagtgagactcaaccagagtctgaaaaggggactcccacaaaaagtgaagattgtggagatgtttcgtcaaaggaaaacactccctataggcgttctagctcagtaaacatgaagaaaatgcagaagatgttccaaaatgcagcagaagagaatgtaagaagcataagaacatatgtaacggagctgaaagaacgggtagccaaactgcagtaccaaaagcagcttctagtctgccaggtgctggagctggaagcaaatgaagcagctgggtatgatatggagaatgatgaaatcacatgcgagcaagaggagccccagatcccatggcaaataactttcaaggatcaaaggcagcaaatcattgagctatgggatttatgctatgtctccataattcataggacacagttttatatgttattcaagggagatccagctgatcaaatctatgtggaagtggagctcaggcgattgacatggttacaagagcatctggcagaacttgggaatgctagccctgctcctcatgtgggagatgagccaacagtctctttgtcatcaagtatccgagctctaaagcgcgaaagggagttccttgccaagagggtaacatcacgtttaagcgcagaggagagagacgcattgtacatcaaatgggatgttccacttgaagggaagcagaggagaatgcagtttgtgaataagctctggatcgatcctcatgatgccaagcatatccaggagagtgctgagatagttgcaaagcttgttggtttctgtgaaagtggcaacatgccaaaggagatgtttgagctcaatttcgcacttccatctgacagaaggccatggattatgggatggaacccaatttcaaaccttcttaacttgtgagggagagagtacattttgttgtaaagtacttcacattctttagattgctgtacatgtaaattgaatttcgagttcccctaaatgctctccttcattgtc

SEQ ID NO: 7979 - DNA, 3405 bp, Gossypium raimondii
taaatttcaaatctattggtcactcccccatctctctcacttcaatggcttttcattttttccattagacaaagttttctaaagttctctcttctccaaacctaaactcgctctctctctctcttcttcttcaacttttctttatgtggttggaagtctcaaataatcttttgattagatccagaaatttgattaaaatttcagtcgatttccttcggctcgggaggtgagagggttctgacggcattacattttgtctttctaatttccaaaggcacgaaggaattaagggaaaaaaatgacagtcagaactccaggaaccccggccaggaagatagacaggacaccagtaacaactcctggaggcccaaaatcaaaggaagagaagattgtagttactgtaaggttgagaccattgagtaaaagggagcaactggccaaagatcaagtagcatgggattgcaaagatgactacaccattgtttctaagcatccttctcaagaacgcacatctcagcctcctcctttcatatttgataaagtttttggaccttcatgcttaaatgaaactgtgtacgaaggagtgaagactgttgcgttgtctgctttgggaggcataaatgctactatatttgcatatggccaaaccagcagtgggaagacatacacgatgagaggaataactgagaaggctgttaatgacatataccaccatataatgaatacaccagagagagattttaccattaaaatttcaggattagaaatttacaatgagaatgttagggacctgctaaattcagaatctggccgcaatctcaagcttcttgatgatccagagaaaggcactgtggttgagaagttggtggaagaaacagttagcaacgatcagcatttaagacatttaattagcatttgtgaagctcaaaggcaagttggtgaaactgccttaaatgatactagctcacgatcacaccaaataataaggctgacaattcaaagtactctgcgtgaaaattctgattgtgtgagatcatttgtagcaagcctgaactttgtggatctagctggtagtgaaagagcttcacaaactcatgctgatggtgcaaggctgaaggaaggttgtcatattaaccttagtttgatgactttgacaactgtaatcagaaaactcagtgttggaaaaagaagtggtcatataccgtatagagactcgaagcttactcgtattttgcagcattcacttggtggaaatgcacgtactgccatcatttgtactttgagtccagcactaagtcattttgaacaatctcgtaatactctcttctttgccacccgggcaaaggaagtgacaaataatgcgcaagtcaatatggttgtttcagataaacagttagtcaaacatcttcagaaagaagtagccaggctagaagcagagcttcgaacccctgatctatctagggagaaagacttaaaaatacaacagatggaaatggaaattgaagaacttaagcgccaaagagatcttgcacaatctgaggtggatgagttacgcagaaaacttcaggatgatcaacagacttcaaacccaattgagttaccacgtccatcaatgcagaagtgtttgtcttattctgatgtgttgtctccgaaactcgacaggaaggaaatagaccataatgataaaacaaggaaaacattgctaaggcagtctatgaggcagtcatcaactgcccctttcacacttatgcatgaaattcgtaaacttgagcaccttcaagagcagcttggagaagaagcaaatcgagctttggaagtactccagaaagaggtggcttatcatagactaggtaatcaagatgcagctgagacaattgccaagctgcaggcagaaataagggagatgtgtgctgtcaggtctattaaaaaggaggttgatgttggaactactatagctcctaacagaagtgtcagtgctaacctcaaggaagagataacaaaacttcattcacaaggtagcacaatagctaaccttgaggagcaattagagaatgttcagaagtcaatagacaaattggtaatgtctcttccaagcagtaatcaagaatccaatggtgaagcagcctccaaaaccaagaatcagtctataaagaacagtttgcttcctttaacttcaagtaatgttgcaaaccggcaaaattttataaaatctccatgctcctctctatcaacctctcagcaaattatggagcctgataatgaagaaaacagacctccagaggatgatgacattgtctctaaggagacactcccagagtctgagaaaggaacacctgcaaggagtgaacaggttggagatgtctcttcaaaggaaagcactccatatagacgtcaaagttcagttaacatgaagaaaatgcggaagatgtttcagaatgcagctgaagagaatgtaagaagcataagagcatatgtaactgagctgaaagagcgtgttgctaaactgcaataccagaagcaactacttgtttgtcaggtgcttgagctggaagctaatgaagcggctggatacaatttagaggttgatgagagtgcaattgaaccagaggaaccccaagttccatggcatgtaaccttcaaggaacaaaggcaacagatcatggagttatgggacgtctgctatgtctccatcatccataggacacaattttatttgttattcaggggagatcctgccgaccaaatatacatggaagtggagcttaggcgcttaaattggatgcagcaccattttgcagaacttggaaatgcaagcccagctctagtaggagatgagcccacagtgtccttgtcatcaagcattagagccctgaagcatgaaagggaattcctcgcaaagaggttgacatcacgattgagtgtggaggagagagatgcattgtacattaaatgggatgtacccctggaaggaaagcaaaggaagatgcaattcataaacaagctgtggacagatccgcatgatgtcaaaaacatagaggagagtgctcagatagtggcaaagcttgtagggttcagtgaaggtggtaacatgtcaagggagatgtttgagctcaattttgcattaccggctgataagagcccttggactgtggggtggaatcaaatttcaaaccttctaaatttataagacaactcattgtttggacctactttctatacctgtaaatgaattttttggaggcctttctccaaatgttctactttcatttatcacggtgtgacgaatcaagcacactgttattgaggattgtttgagattctttgtacacttcgtgaggtcaataaaggaattagatcttcaaatcacgtcatatctatttacgtttgatttgagatataatttaa

SEQ ID NO: 7980 - DNA, 3271 bp, Citrus clementina
caaagagctttttcaaataacatttcgtaaagacaaaatcgaagcctatctctctctccccattaacgctcccaaaatcgaagcctcacaatctccctctgctcgctcggcttctcacaagctcacttcagatctcaatttctctatttcagatctagaagcttatcgtggttgcaattaaaaggataccttaaaagaagatgacagtgaggacaccaggaacgccagcttcgaaatcggaaagggcgacgccgacgcagacgccggcgtcgacacctggtgggccgaaaccaagggaagagaaaattgtggttactgtgaggcttaggcctttaaacaaaagggaacaattagccaaagatcaagtggcttgggactgtgttgatgatcacactattgtttataaaccacagcctcatgagcgcgtgtctcagccttcctctttcagttttgataaagtgtttggtccttcttgtttaactgaaactgtatatgaggaaggagtgaagaatgttgctttgtctgctttaatgggcatcaacgcgactatatttgcctatggccaaaccagcagtgggaagacttacacgatgagagggataacagagaaagctgttgttgatatttataaccatataatgaatacgccagagagagattttacgattaagatttctggactagaaatctataatgagaatgtcagggatctgttaaattctgaatctggccgcaatctcaagcttctagatgatcccgagaaaggtactgttgttgagaagttagtggaggaaacagcaaataatgatcagcacttgagacatttgatcagtatttgtgaagctcaaaggcaagttggtgaaactgccctgaacgatactagctcacggtcgcatcaaattataaggctgagtatacaaagtacactccgagaaaattcagattgtgtgagatcttttgttgcaagcctgaactttgtagatttagctggaagtgaaagagcctcacagacacatgcagatggcgctaggctcagggaaggatgccatattaaccttagtttgatgactcttactacagttatcagaaagctcagtgttggaaaaagaagtggccatataccctaccgagactcgaagttaactcgcatattgcagcactctcttggtgggaatgcacgtactgccatcatatgtactttaagtccagctttgagccattttgagcaatctcgaaatactctcttctttgccacccgagcaaaggaagtaacaaataatgcccaagttaacatggttgtttctgataagcaactagtcaaacatttacaaaaggaagtagccaggctggaagcagagctgcgcactcctgatccatcaagggaaaaggatctgaaaattcagcagatggagatggaaattgaagaattgaaaagacaaagagatgtggcacaatctgaggtggatgagttacgtagaaagcttcaggaggatcagcagacttcaaatccactcgatccatcagtgaagaagtgcctctcttattctggtgtactgtcaccaaaacttgatggcaaagagctgggccgttttgataaaataagaaaaacgatgtcaaggcagtctatgaggcaatcatcaactgctcccttcacactcatgcatgaaatccgaaaacttgaacaccttcaggagcagctgggagaagaagcaaatcgggctttggaagtgctacaaaaggaagtggcttgtcatagactaggcaatcaagatgcagccgagacgattgctaggctgcaagcagaaataagggaaatgcgtgctgttcgatcggtttctaaagaagttgaagttggaactgtaatagcccccaacaagagcgtttgtgctaaccttaaggaagagataacaagacttcattcacagggaagcaccattgaggatcttgaggagcaactggaaaatgttcagaagtctatagacaaattggtaatgtctcttccaaccaacaatcaacaacctgacagtgaatcaactcccaaggctaagaaaaagaaaaagttacttcctctggcttcaagtaatgttaaccgacaaaattttataaaatctccatgctcacctctatcaacatctcggcaaattttggagtccgagactgaaaatcgacctccagagaatgataatatggccgttgagaatcttccagagtctgagaaagggactcccacaaagagcgaagaaggtggcgctgtctcatcaagggaaggcactcctggctctggctatagacgttcgagttcagttaatatgaagaaaatgcagaaaatgtttcagaatgcagcggaggagaatgtaagaagcataagagcatatgtaacggaactgaaagaacgtgtggctaaactgcaatatcaaaagcagctgcttgtttgccaggtgcttgagatggaagcaaatgaagcagctggatacaatatggagaatgacgagaacatagttgagaccgaggaacctgaagttgcatggcatataacttttagggagcaaaggcagcagattattgagctatgggatgtgtgttttgtctctatcattcataggacacagttttatttgttgttcaagggagatccagctgatcaaatatacatggaagtggagcttaggcggctgacttggttgcagcagcatttgtcagaacttgggaatgcaagcccgcttcctgtggcgggcggggagcccaccatctctctctcatcaagtattagagctctaaagcgcgaaagggagttcctcgcgaagaggttgagctcgcgcttgacagcagaggaaagggattcattgtacatcaaatgggacgtccaactcgacgggaaacatagaaggctgcagtttgtaagcaagctttggacagacccccatgatcccaggcatgtacaggagagtgctgagatagtggcaaagcttgtaggattttgtgaaggcgggaacatgtcaaaggagatgtttgagctcaattttgcaataccagctgataagaggccatggatgatgggctggaaccaaatttcaaatcttcttttgtaagagagtcattctgttgttgtaagtacttccttccattatgtaaatgtaaatgaactttggagttgcttctccaaaattacagttctgtcattactgatgggttgggatttttttttttttcaaaatttttcgtgtaacctcctgtttcaataatagaatttaattcatttatttcagtagga

SEQ ID NO: 7981 - DNA, 3272 bp, Citrus sinensis
caaagagctttttcaaataacattttgtaaagacaaaaaatcgaagcctatctctctctccccgttaacgctcccaaaatcgaagcctcacaatctccctctgctcgctcggcttctcacgagctcacttcagatctcaatttctctatttcagatctagaagcttatcgtggttgcaattaaaaggataccttaaaagaagatgacagtgaggacaccaggaacgccagcttcgaaatcggaaagggcgacgccgacgcagacgccggcgtctacacctggtgggccgaaaccaagggaagagaaaattgtggttactgtgaggcttaggcctttaaacaaaagggaacaattagccaaagatcaagtggcttgggactgtgttgatgatcacactattgtttataaaccacagcctcatgagcgcgtggctcagccttcctctttcagttttgataaagtgtttggtccttcttgtttaactgaaactgtatatgaggaaggagtgaagaatgttgctttgtctgctttaatgggcatcaacgcgactatatttgcctatggccaaaccagcagtgggaagacttacacgatgagagggataacagagaaagctgttgttgatatttataaccatataatgaatacgccagagagagattttacaattaagatttctggactagaaatctataatgagaatgtcagggatctgttaaattctgaatctggccgcaatctcaagcttctagatgatcccgagaaaggtactgttgttgagaagttagtggaggaaacagcaaataatgatcagcacttgagacatttgatcagtatttgtgaagctcaaaggcaagttggtgaaactgccctgaacgatactagctcacggtcgcatcaaattataaggctgagtatacaaagtacactccgagaaaattcagattgtgtgagatcttttgttgcaagcctgaactttgtagatttagctggaagtgaaagagcctcacagacacatgcagatggcgctaggctcagggaaggatgccatattaaccttagtttgatgactcttactacagttatcagaaagctcagtgttggaaaaagaagtggccatataccctaccgagactcgaagttaactcgcatattgcagcactctcttggtgggaatgcacgtactgccatcatatgtactttaagtccagctttgagccattttgagcaatctcgaaatactctcttctttgccacccgagcaaaggaagtaacaaataatgctcaagttaacatggttgtttctgataagcaactagtcaaacatttacaaaaggaagtagccaggctggaagcagagctgcgcactcctgatccatcaagggaaaaggatctgaaaattcagcagatggagatggaaattgaagaattgaaaagacaaagagatgtggcacaatctgaggtggatgagttacgtagaaagcttcaggaggatcagcagacttcaaatccactcgatccatcagtgaagaagtgcctctcttattctggtgtactgtcaccaaaacttgatggcaaagagctgggccgttttgataaaataagaaaaacgatgtcaaggcagtctatgaggcaatcatcaactgctcccttcacactcatgcatgaaatccgaaaacttgaacaccttcaggagcagctgggagaagaagcaaatcgggctttggaagtgctacaaaaggaagtggcttgtcatagactaggcaatcaagatgcagccgagacgattgctaggctgcaagcagaaataagggaaatgcgtgctgttcgatcggtttctaaagaagttgaagttggaactgtaatagcccccaacaagagcgtttgtgctaaccttaaggaagagataacaagacttcattcacagggaagcaccattgaggatcttgaggagcaactggagaatgttcagaagtctatagacaaattggtaatgtctcttccaaccaacaatcaacaacctgactgtgaatcaacccccaaggctaagaaaaagaaaaagttacttcctttggcttcaagtaatgttaaccggcaaaattttataaaatctccatgctcacctctatcaacatctccgcaaattttggagtcagagactgaaaatcgacctccagagaatgataatatggccgttgagaatcttccagagtctgagaaagggactcccacaaagagcgaagaaggtggcgctgtctcatcaagggaaggcactcctggctctggctatagacgttcgagttcagttaatatgaagaaaatgcagaaaatgtttcagaatgcagcggaggagaatgtaagaagcataagagcatatgtaactgaactgaaagaacgtgtggctaaattgcaatatcaaaagcagctgcttgtttgccaggtgcttgagatggaagcaaatgaagcagctggatacaatatggagaatgacgagaccatagttgagaccgaggaacctgaagttgcatggcatataacttttagggagcaaaggcagcagattattgagctatgggatgtgtgttttgtctctattattcataggacacagttttatttgttgttcaagggagatccagctgatcaaatatacatggaagtggagcttaggcggctgacttggttgcagcagcatttgtcagaactcgggaatgcaagcccgcttcctgtggcgggcggggagcccaccatctctctctcatcaagtattagagctctaaagcgcgaaagggagttcctcgcgaagaggttgagctcgcgcttgacagcagaggaaagggattcattgtacatcaaatgggacgtccaactcgacgggaaacatagaaggctgcagtttgtaagcaagctttggacagacccccatgatcccaggcatgtacaggagagtgctgagatagtggcaaagcttgtaggattttgtgaaggcgggaacatgtcaaaggagatgtttgagctcaattttgcaataccagctgataagaggccatggatgatgggctggaaccaaatttcaaatcttcttttgtaagagagtcattctgttgttgtaagtacttccttccattatgtaaatgtaaatgaactttggagttgcttctccaaaattacagttctgtcattactgatgggttgggattttttttttttcaaaatttttcgtgtaacctcctgtttcaataatagaatttaattcatttatttcagtagga

SEQ ID NO: 7982 - DNA, 3706 bp, Cannabis sativa
aaaaaaaaaaaaaaaagaaaagaaaaaccataacgcacggtcctcacacccagttagtttccactactattactgttactactgcttttctccatctctatcttttaaagccctagaaacttcaatcccatctcttatctgctccagattttcataacgctccgtcttctgtttctctcttagctctctatctagttctgatagagaagttttattttttgagcggtttgattttgatctccgtcttcagccgaaactccgacaagtttctttgtcgaatttcggtttgtcatttctctgaagatatttttgttaccgttaactcagaaagatatagttctagtcttctctcctaagaggggtgttgcacattggttttttcttgtctctgtgaaaatattcaaccataaagatgacagtcaggactcctggaacaccctcttccaaaattgatagggcccctggaacaccctcttccaaaattgataggaccccagtttcaaccccaggtgggccaagggccaaggaagagaagattgtggttactgtaaggttgaggcccttaagtaagagagagcaattagccaaagaccaagtagcatgggaatgtattgatgataacaccattgtttataagccaacatttcaggaccgttcagctcaaccagccacatttacatttgataaagtttttggtccctctagtttaacagaaactgtatatgatggagtcaaaaatgttgcattgtctgcattaatgggcatcaatgctactatatttgcttatggacaaactagcagtggtaagacatacacaatgagaggagtaactgagaaagctgttaatgacatctacaaccatatactaaatactccagaaagagatttcaacattaaaatatctggacttgaaatatataatgaaaatgtcagagatctgctaaatacagattctggtcgaaatctgaagcttctggatgatccagagaaaggtactgtggtggagaaattggtagaggaaactgcaaaagatgatcagcatttgagacatttgatcaatatttgtgaggctcaaagacaagttggagaaactgctttaaatgataccagctcacgctcccaccagataattagattgaccatagaaagcacagtccgcgaaaattcaggttgtgtaaggtcttttgttgcaagtctgaactttgtagatttagctggaagtgaaagggcttcacagacacatgcagatggtgcgaggctcagggaaggttgccatattaatctcagcctgatgaccctcacaactgtaatcagaaagctgagtgtaggaaaaagaagtggtcacgtaccctacagagactcaaagcttactcgcatattgcaacattcacttggtggaaatgcacgcactgccattatttgcacattgagtccagcactgacccatgttgaacaatctcgaaacactctcttgtttgcctcccgtgcaaaggaagtaactaataatgcccaagtcaacatggttgtctcagacaaacaactagtaagacatctacagaaggaagttgcaagactagaagcagagttgcgaacacctgatccagcaagagagaaagatatgaaaatccaacagatggaaatggaaattgaagaactgagacgtcaaagagatcttgctcaatcacaagtagatgaactgcggaaaaaactcgatgacgaccagcagggctcaactctaattgaatcacctcccacctccgtgaagaagtgtctttcctactctgaggcattctcaagaaaatctgattccaaggttctaggccgtgttgataaagcaagaagtacaatgttaaggcagtctgtgaggcaatcgtccgctgctcctttcacactaatgcatgagattcgcaaacttgaacatcttcaagaagcacttggagaagaggcaaatcgagctttggaagtactacagaaggaggttgcttgtcataggcttggaaatcaagatgcagctgaaacgattgcgaagcttcaagccgaaattcgtgaaatgcgttctgttcgatcagccccaagagaagttgatgttggaaatgttattgctactaacaagagtgtaagtgctaatctcaaggatgaaatcactagacttcattcacagggaagcactattgcggaccttgaggagcagcttgaaaatgttcagaagtctattgacaaattggtgatgtctctacctaataattttcagcagcctaactttgatccgtccccaaagactaataaggagtttaaaaagaaaaagttacttcctttgtcttctagtaatgccgttaaccgtcaaaccttcataagatccccctgctcacctctatcgacctctgagcaagtttttgagcctgagattgaaaacagatatcctgaaaatgatgataatctgtccattgatactcttccagagtccgagaaggagactcccacaaagagtgaaggaggagatatttcatcaaaagaaaacactccaggcgggtatcgacgttctagttctgttaacatgaagaaaatgcagaagatgttccaaaatgcagcagaagagaatgtaagaagtattagagcgtatgtaactgaactgaaagaaagagtagccaagttgcaataccaaaagcagctacttgtttgccaggttttggagctggaagcaaatgaagcagctggttacagcatagaggatgatgagaacgaatgtgagccagggatgcctcaggtttcctggcaaattacattcaaggagcaaaggcaacagattattgagctctgggacatgtgttttgtctccattattcatagaacacagttttatttgcttttcaagggagacccagctgatcaaatctacatggaagtagagcttagacgcttaacatggctacaacagcacctgacacagatgggaaatgcaagccctgctcctggccctgggggagaagacgccacagtctccttttcatcaagcattagagcaatacgacgtgaaagagagttccttgcaaaaaggttgacttcacgcttgaccgcggaggagagagacatgctgtacatgaaatgggatgtacctcttgaaggaaagcagaggaaaattcaatttgttaataaactttggacagatcctcatgatgctaagcacgttcaggagagtgctgaaatagttgcaaagcttgttggcttttgtgaaggaggcaatctctctagggagatgtttcaactcaattttgctcttcctggtgataagaggccttggcttatggggtggaaccaactttccaatcttcttcatttgtagtctctttctattttattcattttttgttgtaattaatttcgttatttatttatctattctatgtaaatggtgaattttggagtttcctccaaaatctcatctccatagtgtatgtgattgataactggggatgcttttgtaattgataaaccaattcaattagttgaattccaactgccaccttgaataactgcggatgcttttgtgattgctaaatgtgttcttctcgtttgacattgttaagttgatttataacttatagatatgtcacatttccacttcacgaagtactttctctctaagaaaatgttgatttgtaacttttagatacgtcacatttctacttcatcttgaagtctcaaaaaa

SEQ ID NO: 7983 - DNA, 3269 bp, Gossypium raimondii
gacaaagcttcgaattttttttttctctaaatccaatagctctctctttctttctttctctttgtacgctcctctactgtttagaagtcttgatccagaaacttgagttttcaaatttcaaaagacaaaaaggaagtaaaagaaaaagatgacagtcaaaacaccaggaaccccaagcaataagatagataagacaccagtaacaacccctggaggtccaaaatcaaaggaagagaagattgtagttactgtaaggttaaggccattaagtaaaagggagcaactagccaaagatcaagtagcatgggattgtgttgatgaccacaccattgtttctaagcatccttctcaagaacgcactgctcagccatcttctttcacatttgataaagtgtttggaccttcatgcttgaatgaaacggtgtatgaaggagtgaagaatgttgctttgtctgctttgggaggcataaatgctactatatttgcatatggccaaaccagcagtgggaagacatatacaatgagaggaataacagagaaggctgtcaatgacatctatcagcatataatgaatacaccagagagagattttaccattaaaatttctggattagaaatttataatgagaatgttagagacctgttaaattccgaatctggccgcaatctcaagcttctagatgatccggagaaaggtactgtggttgagaagttggtggaagaaacagcaagcaacgatcagcatctaaggcatctaattagcatttgtgaagctcaaagacaagttggagaaactgccctaaatgactctagctcacggtcacaccaaataataaggctgacaattgaaagtactcttcgtgaaaattctgattgtgtgagatcatttgttgcaagcctgaactttgtggatctagctggaagtgaaagagcttcacaaacaaatgccgatggtgcaaggctcagggaaggctgtcatattaaccttagtttgatgaccctgacaactgtaatcagaaaactcagtgttggaaaaagaagtggtcatataccatatagagattcgaagcttactcgaatattgcagcattcactaggtggaaatgcacgaactgccatcatatgtactttgagtccagcactaagtcattttgaacaatctcgtaatactctcttctttgctacccgggcaaaggaagtgacaaataatgcacaagtcaacatggttgtttcaaataagcaattagtcaaacatctgcagaaagaagtagccaggctagaagctgagcttcgcacccctgatccatctagggagaaggacttgaaaatacaacaaatggaaatagaaattgaagagctaaagcgccaaagagatctcgcacagtctcaagtcgatgagctacgtagaaaacttcaggaagatcagcagattttaaacccaattgagtcaccaagtccatctgtgaagaagtgtctatcgtattccgatgtgttgtctccaaaacttgatggaaaggatctaggccgtcatgataaaacaagaaaaacaatgttgttgaggcagtctatgaggcaatcatcaactgctcctttcgcacttatgcatgaaattcgtaaactcgaacacctccaagagcagctaggagaagaagcaaatcgagctttagaagtacttcagaaagaggtggcttgtcatagactaggtaatcaagatgcagctgagacaattgccaagcttcaggcagaaataagggaaatgcgttctgtccggtcagacccgaaagaagttgaagttggagcagctatagctcctaacaaaagtgttagtgctaaccttaaggaagagataacaagacttcattcacaaggtagtacaatagctgaccttgaggagcaattagagaatgttcagaagtcaatagacaaattagtaatgtctcttccaagtaatcaagaatccaactgtgaagctacccccaaaacaaagaaccagtctaaaaagaagaagctgcttcctttaacgtcaagtcacgttacaaaccggccgaattttataaaatctccatgcgctcctctgtcaacctctcggcaagttgtggagcctgagaatgaagaaaatagacctccagaggatgatgacaatgtttccaaggacactatcatcgagttcgagaaagaaacacctgtgaagagtgaagactgtggagatgttacatcaaaggaaggcactccaggatatagacgttcaagttcagtcaacatgaagaaaatgcagaaaatgtttcaaaatgcagctgaagagaatgtacgaagcatacgagcatacgtaacggaattgaaagaacgtgtcgctaaactgcaataccagaagcagttacttgtttgtcaggtgcttgagctagaagcaaatgaagcagccggatacaatttagaggacaatgagagtgaaattgaacatgaggaaccccaagttgcatggcatgtaaccttcaaagaacaaaggcgacaaatcattgaattatgggatgtctgctatgtctccatcatccataggacacagttttatctgttattcaaaggagaccctgccgaccaaatatacatggaagtggaacttaggcgcttaaattggctacagcaacattttgcagaacttggaaacgcaagcccagcaataacaggagatgaacccacagtgtcattatcatcaagcatcagggccttgaaacgtgaaagggaattccttgcaaagaggttgaccacacgtttgactttcgatgagagagacgcattgtacattaaatggaatgtaccacttgatggaaagcacaggagactacaattcataaacaagctatggactgatcctcatgatcccaaacacatagaggaaagtgctcagatagtggctaaacttgtagggttttgtgaaagtggtaacttgtcaaaggagatgtttgagcttaattttgcactaccagctgataagaagccttggatggtagggtggaaccaaatctcaaatcttcttaatctataagacaaaaatcatcttgtaagtacttttctcatttctgtatatgtaaatgaatttttggagtcctttctccaagttctttgtgaccatttgatgagcacattgtcacttgctgattgttttgaggtattctttgtattcttcatgtttcaataatagaatttgcttcattttgatgtcaatgaacgtttcacaatgctaagctatttttcttttttggctttgttttctg

SEQ ID NO: 7984 - DNA, 1031 bp, Glycine max
gtggatctgcccctaattaaagagtcagtaatgcgctgtaaagaagtgaaacgtctgcggaaaggagccaaatcacgaattgtatcatgggttgaaagtttaggtactaatacaaattacacaatcttttcaatcttttctctgaaatcccaaatgggcatcgccacaatcaaaatgggaggcaactccgactccaactgttccatcactccacgccattacaacacccacaaggtgttccttttctgcaactacattctcttgggtgcagcctccagctgcatcttcctcaccctctccctgcgcctcattccctctctatgcggcttcttcttcatccttcttcaggtcttcacgattgcgggtgcagtctcgggttgtgctgctgtgggggctaataggtggtactctgcacacatggtggccactgttctaacggctatctttcagggttctgtttcagtgttggtgtttacgcggactggcgattttctgggtcagttgaaatcttacgtgagggaggaggatggtgctgtgattctcaaattggctggtggactcaccattttgatctttgtcttggagtgggtagttttgactcttgcatttttcttgaagtattatgcttgtgttgaggggaatagtggcgctgttgtgcctgtgaggagtgggaaggtgcagcaggatgaggacttgaaggattggccttggccttttcaagtttgattcttgtgatgacaagaaaacacaagaaggaacaatgacttgttccttttgaagttgttgcagttgatttggtaatcttcaaattcgttgattcgttggagaattggatgcttttttctcctgatagaaatataagtgttttgttggctacgaattatgatcattatgtaattagttgtgtgagtgtttattctttagattcgtcttatttgttgttggattattactactttacatatcatcttcttgttgttaatcaaagaagttcagttactatattatcagttttgcccgttttatttatt

SEQ ID NO: 7985 - DNA, 1003 bp, Glycine max
atgcgctgtaaagaagtgaaacgtctgcggaaaggagccaaatcacgaattgtatcatgggttgaaagtttaggtactaatacaaattacacaatcttttcaatcttttctctgaaatcccaaatgggcatcgccacaatcaaaatgggaggcaactccgactccaactgttccatcactccacgccattacaacacccacaaggtgttccttttctgcaactacattctcttgggtgcagcctccagctgcatcttcctcaccctctccctgcgcctcattccctctctatgcggcttcttcttcatccttcttcaggtcttcacgattgcgggtgcagtctcgggttgtgctgctgtgggggctaataggtggtactctgcacacatggtggccactgttctaacggctatctttcagggttctgtttcagtgttggtgtttacgcggactggcgattttctgggtcagttgaaatcttacgtgagggaggaggatggtgctgtgattctcaaattggctggtggactcaccattttgatctttgtcttggagtgggtagttttgactcttgcatttttcttgaagtattatgcttgtgttgaggggaatagtggcgctgttgtgcctgtgaggagtgggaaggtgcagcaggatgaggacttgaaggattggccttggccttttcaagtttgattcttgtgatgacaagaaaacacaagaaggaacaatgacttgttccttttgaagttgttgcagttgatttggtaatcttcaaattcgttgattcgttggagaattggatgcttttttctcctgatagaaatataagtgttttgttggctacgaattatgatcattatgtaattagttgtgtgagtgtttattctttagattcgtcttatttgttgttggattattactactttacatatcatcttcttgttgttaatcaaagaagttcagttactatattatcagttttgcccgttttatttattta

SEQ ID NO: 7986 - DNA, 873 bp, Vigna unguiculata
ggatcacaaacccaatctcaatcacttcaacctgcaacttcactcccctgttccaaagattcaattttttcactcaaaacccaaatgggtctctccacaatgaactcttcttcctccatcactccacgccactacaacacccacaaggtgtttcttttctgcaactacattctcttgggtgcagcctccagctgcatcttcctcactctctctctgcgtctcattccctctctctgcggcttcttcttcatccttcttcagatcttcacaatcgcgggtgctgtctcgggttgtgccgcagtgggggccaatagctggtactctgcacacatggtggccactgtgttaacagcaatttttcagggttcagtttctgtcttggtgtttacaagaactggggactttttggggcagttgaagtcatatgtgagggaagaagatggtgctgtgattctgaaattggctggtggactcaccattttgatcttttgcttggagtgggtggtgctcactcttgcgtttttcttgaagtactatgcttgtgttgagggaagtaatggtgctattgtgcctatgaagagtgggaaggtgcagcaggacgaggatttgaaggattggccatggcctttccaagtttgattctgacaagaacaagaacaagatgcttctctgctgatatatgggttataaaattcgttgatttcttggagaattggatgcttatttctcctgagatagatatatgtgtgttcgtttgtttatttgtgatgtaattaggtgtgtggttgttctctccattcattctttttgttgttacctgtttttccttgtcaatcagaagttcaattactataatatcagttttgcccatta

SEQ ID NO: 7987 - DNA, 885 bp, Phaseolus vulgaris
atcacaaacccaataatcatcactcaccaacgcaacttcacttccctgttccaaagtttcaatcttctcactcaaacaccaaatgggtctctccacaatgaactcttccatcactcctcgccactacaacacccacaaggtgttccttttctgcaactacattctcttgggtgcagcctccagctgcatcttcctcaccctctctctgcgcctcattccctctctctgtggctttttcttcatccttcttcaggtcttcacaatcgcgggtgctatctccggttgtgctgctgtgggggccaatagctggtactctgcccacatggtggccactgtgttgacggcaatttttcagggttcggtttcggtgctggtgtttacaagaactggggactttttggggcagttgaagtcatatgtgagggaggaagatggtgctgtcattctgaagttggctggtggacttaccattttgatcttttgcttggagtgggtggtgctgactcttgcctttttcttgaagtattatgcttgtgttgaggggagtaatggtgctattgtggctatgaagagtggaaaggtgcagcaggatgaggacttgaaggattggccttggcctttccaagtttgattcttgtttatgacaagaactgaacaagaacaagatgcttctctgctgatatatgatcatcaaattcgttgatttgttggagaattggatgcttatttctcctaatatagatatatgtgtgcttgtttgtctgtctctgatgtaattaggtgcgtggttattctttacattcatccttttgtttgttaccttcatttccttgtcaatctgaagttcaattactataatatcagttttgcccattatattttgcc

SEQ ID NO: 7988 - DNA, 615 bp, Cajanus cajan
catcacaaccactgcaactgcactcccctttctcaaagttccaatctttgctctctaatcccaaatgggtctctccacaatgaacacctccatcactcctcgtcactacaacacccacaaggtgttccttttctgcaactacatcctcttgggtgcagcctccagctgcatcttcctcaccctctctttgcgcctcattccctctctctgcggcttcttcctcatcctcctccacgtcctcaccatcgccggtgccgtcgcgggctgcgccgccgtggggaccaaccggtggtactctgctcacatggtggccaccgttctgactgccatcttccaggggtccgtggcggtgctggtgttcaccaggactggggactttcttggggagttgaagtcctatgtgagggaggaagatggtgctgtgattctgaaattgggtggtggactcactattttgatcttttgtttggagtgggtggtgctggtgctggcattcttcttgaagtactatgcttgtgttgaggggaatagtggggctgttgtgcctgtgaggagtgggaaggtgcagcaggatgaggacttgaaggattggccatggcccttccaagtttgagt

SEQ ID NO: 7989 - DNA, 1127 bp, Cajanus cajan
cccaaaaccaaaagagtgaaagacagaaactaacgttggactctaacgttacacatcccagctggctggatctcctttcccccaacggtcacattccaccgacccaaacacaaaatatgaccgttaagcacctataatagcaaccaccaccctcaacactacccatcacattcccagaacataaacatcatcacaaccactgcaactgcactcccctttctcaaagttccaatctttgctctctaatcccaaatgggtctctccacaatgaacacctccatcactcctcgtcactacaacacccacaaggtgttccttttctgcaactacatcctcttgggtgcagcctccagctgcatcttcctcaccctctctttgcgcctcattccctctctctgcggcttcttcctcatcctcctccacgtcctcaccatcgccggtgccgtcgcgggctgcgccgccgtggggaccaaccggtggtactctgctcacatggtggccaccgttctgactgccatcttccaggggtccgtggcggtgctggtgttcaccaggactggggactttcttggggagttgaagtcctatgtgagggaggaagatggtgctgtgattctgaaattgggtggtggactcactattttgatcttttgtttggagtgggtggtgctggtgctggcattcttcttgaagtactatgcttgtgttgaggggaatagtggggctgttgtgcctgtgaggagtgggaaggtgcagcaggatgaggacttgaaggattggccatggcccttccaagtttgagtcttggttggtttggactttggacaaaaacaaaaacaagacacttgcagctgcttctctgctgatcatgatgattcgttcatttgttggagaatttgatgcttttttctcctgatagattgtgtttgtttgactatgatgtaattagttgtgtggttggttggctattcttttcattcatcttttttgttgtcggattaccaatatatcaacttgttgtcaatcagaagttcagttaccatataatatcagttttgcccgttttatattttgaggtcttttttttttcgtactgttatattttgagatctgttgttttgatcggc

SEQ ID NO: 7990 - DNA, 728 bp, Acacia harpophylla
gacacaagatcacaaattatcataaccttacgaaatcttcctcactcgtcggaaaatgggtatttctatgaacagtcagtcagcaagctcgatcactcggcatgaccacacctacaaggttttccttttctgcaactacatactcttgggtgcagcatcaagttgcatctttctcaccctctcgcttcgcctcatcccttctgtctgtggcttcttcctgattcttctccacgtcttgaccattgcaggagccgtctcaggatgtgctgcagcttcggctggggctagcctctggtactctgctcatatggtagccactgtgctaacagccatatttcagggttccgtttctgttctcatctttacaagaactggggattttcttggtcagttgaaatcttatgtgagagaagaggatggttctgtcatactcaaattggccggtgggctaagtattttgatattttgcctggagtgggttgttctgacgctcgcttttttcctcaaatattacgcccacattattggtgattctggggccaataccgtggctatgaggagtgccaaggtgcagcaggaagaggatttgaaggattggccgtggcctttccaggtctaacgtacaatttgcctctccttacaacctccatcattcattaattcgttagtctcacccatgtatttactgttcaccggtttacccttgcgagtccatgacaagtcaatgt

SEQ ID NO: 7991 - DNA, 1046 bp, Cicer arietinum
caaaatatgaccgtttggccactgaacccactatattataccatccaccgaatccaaatccaaatcacaccacagcacaagcttcagtttccatcacaatctcaatccttcttcatcacaatcactaaagtttccatctttacattcaaaatccaaatgggtctatcaatcaacaacgtgccagccacagtcacaccaagacactacaacatccacaaattattccttttttgtaactatatccttttaggtgcagcttccagctgcatcttcctcactctctcactccgcctcgtcccttcactttgtggcttcttcttaatccttctccacatcttcaccatagcaggtgctgtttcaggctgtgctgctgttggtgctaaccgttggtactctgctcacatggtagcaactgttctaaccgctatatttcagggttctgtttctgttcttgttttcacaaggactggtgattttcttggtcagttgaaatcttatgtcagagaagaagatggttctgtgattcttaagttgtctggtggacttgctattttgatctttttcttggaatggattgttttgacacttgcttttttcttgaagtactatgcctgtgttgaaggtggaaataataatagggctattgttttgggaagtgctaaggttcatcaacaggatgaagatttgaaggactggccatggccttttcaggtttaaatttttcatatgaattggaatgaaaagtttgagtgacaagggaagaaaaaacaacactactgtgtgctgttgttttaatatgcatttttttgttgttttaatatgcattttttttgtgttacagaatttctctgtttagtagtaatattttttaattcattggggaattacatgttttttctcctaatgtagatgttgcatgtcaagagggtatccgttttggaatgtaattactatgttggttttcagtggttgttaatcagattcagaatttcagtactaatttgccattttaattctatttgtttatcttgtggattttctattac

SEQ ID NO: 7992 - DNA, 831 bp, Trigonella foenum-graecum
cgttaaactaaaatatgaccgttgtgtcactgaactcaaaaaaacgctatattaactcttcttcatcacaatcttcaacacaattcactttcctttctcaatctcactcttcttcttcacattcctttttcatctctcaaactttcctcaaaatgggtgctctttcaatgaacaaccatccacccacaatcacaccacgtcactacaacatccacaaactcttccttttctgcaactatgttcttttaggtgcagcttcaagctgcatcttcctcactctttcgctccgtttatacccttccgtttgcggctacttcttgatccttctccacatcttcaccattgctggtgctgtttcaggctgtgctgctgttggtgctaaccgttggtattctgctcacatggtagctactgttctaacggctatatttcaagggtcggtttcggttcttgtttttacaaggacgagtgattttcttggtgagttgaagtcttatgttagagaggaagatggttctgtgatcttgaagctttctggtggacttgctattttgatctttttccttgaatgggttgttttgactctggcgtttttcttgaagtattatgcttgtgttgaaggtaggaatacttgtaggactgttgttttgggaagtgctaaggttcaacaagatgaagatttgaaggattggccatggccttttcaggtttgattttgaagttgttggttggggtgacaagattacaagagaagaaacaactctgatgtgtgatgttgttctaatatgatatgagtcttttgtgtgttacagaatttctctgtttaggtct

SEQ ID NO: 7993 - DNA, 811 bp, Trifolium pratense
atggggcatcacaattcactttcaatctcaatctcaattttcttcaccacccatctctcaaagtttcaatttttcctctcaaaatccaaatgggtctctcaatgaactctcatccacctacaataacaccaagacactacaacatccacaaactcttccttttctgcaactacgtcctcttaggtgcagcttcaagctgtatcttcctcacactttcgcttcgtcttataccttccgtatgcggttttttcttgatccttcttcatatcttcacaattgctggtgctgtttctggctgtgctgctgttggtgctaaccgttggtattctgctcatatggtagcaactgttttaactgctatttttcagggttcggtttcggttcttgtttttacaaggactggtgattttcttggtgagttgaagtcttatgttagagaagaagatggttctgtgattcttaaattgtctggtggacttgctattttgatcttttgtttggaatgggttgttttgactcttgcatttttcttgaagtattatgcttctgttgaaggtgttaataataatagggctattgttttgggtagtgctaaggttcaagatgaagatttgaaggattggccatggccttttcaggtttaatttcttcacatcatcatgatttgaagaagtggttgggtttggtgacaagattacaagacaagagtgaagaaacaacactattatgtgctgttagaatatatatgcattttgtttgttttacagaatttctctgtttagtactagtatattttttaattcattggaga

SEQ ID NO: 7994 - DNA, 2255 bp, Medicago truncatula
tctcacaaattccaaatgggtctctcaatgaacaatcctccagctacaatcacaccacgccactacaacatccacaaactcttccttttctgcaactatgtcctcttaggtgcagcttcaagctgcatcttcctcactctttcgctccgtttagtcccttccgtatgtggcttcttccttatccttctccacatcttcaccattgctggtgctgtttcaggctgtgctgctgtaggtgctaaccgttggtattctgctcatatggtagctactgttctaacggctatatttcaagggtcggtttctgttcttgtttttacgaggactagtgatttccttggtgagttgcagtcttatgtaagggaagaagatggttctgtgattttgaagctttctggtggacttgctattttgatcttttgccttgagtgggttgttttgactctggcgtttttcttgaagtattatgcttgtgttgaaggtggaaatacttgtaggactgttgttttgggaagtgctaaggttcaacaagatgaagatttgaaggattggccatggccttttcaggtttgaagaagtggtgataagagtataaagaaacaacactgctgtgtgatgttgttctaatatgatatgatatgagtctttttgtgtgttacagaatttctctgtttagatctatattttttaattcatttggggaattacctgttttttctcctaatagatgtttcatgtcaaaagggtattccttttgtattgtaactactatgtctcctatattgtaattggtttgttgctaatgagaatcagaatgagaatttcagtactaaattgccttttttgtttattaatttttctctaagtacttttatatcggaaactttcacaatcacacatatatatgcactatattgccattgtctttagatgaatgagatttgatccaagttacaaagccaatgggattatcatagttttttactcattcaagaactttcctattaaaacttagtttctgattgataaaaaactaaaattaacaagtttgatttatctgcttcaaaagtgattcacaagtgaaatttaaggaaagactttcatattctgttagattttctagatttgatgagggaagtcacatcacaattaccaacacagtttggaacaagtttgatttatgtgtttgaaaactgcaattcatattctgttctattttcaagatttgatcatggatcactcacaatcacaattttaaccaattcaaaaaccttggtggtatttgggtttaggtttgcattagaatcatcttgtttagcccaaaatttgattacaattccatgacagtcaacataaatatacaagctggatttaatcaacagcataacttttttcagattataaatctttagtgctaagcaagttaacaaatttttaggaataatttattagtttctttataaattttcgttttttgtcatcattcgcttttcgtgctaaatggttaggtcataggatagtgatagttgtatactttgatgaatgtcaggtcaagtatgcttgaatgaatatcattttgacaaaggaataacttcctaatgagtaccaaattcctaaagaaacaccataaaccaaaataagcaataacatgaaatagtgaattcacaatgtaaaatggaatttacaccattcttgaaccttttatcaatttacctttcaaccactattcttgaacctttatattaatgttaattcggagatataacaaaatgattatcaacaacctaaaggtaatcattgattgaattccaactagagctaaccttgccgtgcggaatgtttcaccaccggaggtatctattttgtgtgtgatgtgtaataggaaggtagaatcgtctttacatcttttcttgcattgtgatgtggcaagattggtgtggataaagttgatgaattggttggaatgtttgttcttaattccacccaacctctttgtgcattgggagtgttggtgtgggggggaaagtaatagaaaagtggctaaaggcttacggttaatttggcacactacgatttgggtcttgtggaaagcgagaaatgataaaatcttcaagggatttccgtttgaggtggatgttatagtggaagatattaaggtgttgtcttggcggtggaagttgagtaggacccttgatccggcttgcctcttttacgaatggtgttggaatcctaggcattgtctctctagataagtg

SEQ ID NO: 7995 - DNA, 893 bp, Medicago truncatula
cttcttcatcacaatcttcaacacaattcactttcttcctttctcatctcacaaagtttcaatttttctcacaaattccaaatgggtctctcaatgaacaatcctccagctacaatcacaccacgccactacaacatccacaaactcttccttttctgcaactatgtcctcttaggtgcagcttcaagctgcatcttcctcactctttcgctccgtttagtcccttccgtatgtggcttcttccttatccttctccacatcttcaccattgctggtgctgtttcaggctgtgctgctgtaggtgctaaccgttggtattctgctcatatggtagctactgttctaacggctatatttcaagggtcggtttctgttcttgtttttacgaggactagtgatttccttggtgagttgcagtcttatgtaagggaagaagatggttctgtgattttgaagctttctggtggacttgctattttgatcttttgccttgagtgggttgttttgactctggcgtttttcttgaagtattatgcttgtgttgaaggtggaaatacttgtaggactgttgttttgggaagtgctaaggttcaacaagatgaagatttgaaggattggccatggccttttcaggtttgaagaagtggtgataagagtataaagaaacaacactgctgtgtgatgttgttctaatatgatatgatatgagtctttttgtgtgttacagaatttctctgtttagatctatattttttaattcatttggggaattacctgttttttctcctaatagatgtttcatgtcaaaagggtattccttttgtattgtaactactatgtctcctatattgtaattggtttgttgctaatgagaatcagaatgagaatttcag

SEQ ID NO: 7996 - DNA, 939 bp, Lotus japonicus
ggaaaaacaacaacacaacacaaagatcacaatcttcttcttcattctctgcttcttcttcttctctttcaaaatgggtggaatctcaatgaacatgaactctgctagcaccggatcagtgactccaagacactacaacacccacaaggtgttcctcctctgcaactacatcctcctaggagcagcctccagctgcatcttcctcaccctctccctccgcctcgtcccatccatctgcggcttcttcctcatcctcctccatgtcatcaccattgccggtgctgtcaccggatgcgctgctgttggtgccaaccgatggtactctgcccacatggtagccactgtgctcactgccatatttcaaggctctgtttcggtgctgatttataccagaacaggggattttctgggtgagttgaagtcctatgtgagggaagatgatgctgctgtgattctgaagctttctggtgggttgactatcttgatcttttgcttggagtgggtggtgctgactctggcgtttttcttgaagtactatgcttatgttgaaggtggtgctaatgggggtgttgctatgagaagctctaaggtgcagcagatgaggatttgaaggattggccatggccgttccaagtttgattttgtttggtgtggatgataattggcaacactgttgtgctgctgttctgatggattttggcattttgctgttacaagactaaagttctctctgcttttatcatcatatattcgttgattcattggagaattaggtgttattttctcctatatagatgtgtcatgtcaattgggtcatggtgtgaggtttattgatttgttttctacaaattaatgtagagggttattggttttctatatctccttatttttttgtcaatgctatatatatcaatattatgaggatttgaggtactaaat

SEQ ID NO: 7997 - DNA, 1071 bp, Populus trichocarpa
atgctcatcaattctatcagttacactacaaatattatcctgcacacaaaccagtctctaacagatctttcagaatcacttgcaaaaaccacttggaaaaaatcatcaaacatcaaaagggtctgtctcatcagttctcagaaaaaaaatcaacaaatgggtgccagtatcactctaggcagcaccaattcttcagtgtcccaatcccattaccacactcacagggttttcttgttttgcaactacattctacttggagcagcctctagctgcatcttcttaaccctttcgcttcgcctggtaccttcaatatgtggcttctttctcattctccttcatgtcttcaccattgctggggcagtttcaggctgtgctgcagcgtcatccgggactaataggtggtatgctgcacatatggtggccacagtgttgacagccatatttcaagggtcagtatcggttttgatttttactagaactggggatttcctagggaacttgaagtcatatgtgagggaggaggatggtgacgtcatattgaagcttgctggtgggttgtgtgtggtgatcttttgcttggagtgggtcgtgcttactcttgcatttttcttgaagtactatgcttatgtggaaggtgatgctaataatggtggcgatattgctatgaggaggagtgctaaggtgcagcaagacgaggacttgaaagattggccatggcctttccaagtttaattaatttgggtttggatttgctggatggtttcttcaagtactatgttcgtggtgctgctgccacaaaattctttatttgttcattcaactatacaagtatcatctttttggatattgtttgaattggctttttatggatatatacatataatggattgtgcttaaattcatttgttttgtaccactggttgatggaacgatggttatcacgggtgctgtaaatctgaatttcactcttttactaataaaaatttgaactcttttattagctgttttttgttcttccaagcgtttccgggagttatttaaagaaattatttatccatgtttgaaattctc

SEQ ID NO: 7998 - DNA, 870 bp, Vicia sativa
ctcaatctcaaatcttcttcatcacactcctttctcatccatcaaagtttcagtttttctgttccaaacccaaatgggtctctcaatgaacaaccacccagccgcaataacaccacggcactacaacatccacaagctcttccttttctgcaactacgtcctgttgggtgcagcttcaagctgcatcttcctcacactctccctccgcttaatcccttccgtttgcggcttcttcttgatccttctccatattttcaccattgctggtgctgtttcaggatgtgcagctgttggtgctaaccgttggtattctgctcacatggtggcaactgtgttaacggctatttttcaggggtcggtttcggttcttgtttttacaaggacggctgattttcttggtgagctgaagtcttatgttagagaagaagatggttctgtgatcttgaagctgtctggtggacttgctattttgatctttttcttggagtgggttgttttgactctggcgtttttcttgaagtattatgcttctgttgaaggggggaataattctagggctattgttttgggaagtgctaaggttcaacaagatgaggatttgaaggattggccatggcctttccaggtttaagtttcaacagtggattcaaagactggtttaaaaaacaaggaacaacatttgtgttacagaaattctctgtttactagtatattttttgattcattggggaattactttcttttttcttttctgatagatgttgcatttcaaaatgggtatctgttttgtattgtaattactatttctatgttacctatattgtacttggtttgttgctactggtaatgagaattcagtactaaattgcc

SEQ ID NO: 7999 - DNA, 1898 bp, Cajanus cajan
ccgccttcaacacgcgctctttaaataccaaaaaacccaccacccatctacacctacacttgacccgcatctcgctcccgtccgcgaccaactcgaaactcagtccattcttgtgctgactcttggcacggcaaaccaaagcccaaacccctccccttcttctctggtctcaaattggaagaaggaggtccgagaattgcgtgagaaatgggctcagaactgattttcagaggccacgaggcccagcccgtggacgacgcgtactcgccgaagccccagaagccgtggctctcggtgactcggcccattcactacatgctccgcgagcagcgactcgtcttcgtcctcgtgggcgtcatcatagcctccttgttcttcacactcgtcccttcttcctcttccatgtcaagctctccgtacgaggcgcttccgatctcgtactttgagcgcgagtcgagggttccggcgtaccaccaccgcctcccggcggtgcactcggtggggaaggttccgttggggattaagcggaaggggctccggatcgtggtgacgggaggcgcggggttcgtggggtcgcacctggtggatcggttgattggtcgcggcgacagcgtgatcgtggtggacaatttcttcacggggaggaaggagaacgtgatgcaccacttcgggaaccctagattcgagctcatccgacacgacgtggtggagcctctcttgctggaggtggatcagatctaccatctcgcttgccctgcctcccctgtccattacaagttcaaccccgtcaagactatcaagaccaatgtggtggggaccttgaacatgcttggactcgctaaaagagtgggcgccaggttcttgttgaccagtaccagtgaggtttatggagatcctctgcagcaccctcagaaggagacttactggggcaacgtcaacccgattggtgtccgaagctgctacgacgagggaaagcgtacggctgagacgttgaccatggattaccatcgaggtgccggtgtggaggttagaattgctagaatctttaacacctacgggcctcgaatgtgcttagatgatggccgtgttgtcagtaacttcgttgctcaggcactaaggaaggagcctttgaccgtttatggagatggtaagcagacaaggagtttccagtatgtctctgatttggtggagggtctaatgcgcctcatggaaggagaacacgtgggacctttcaatcttggaaatccgggagaatttaccatgcttgaacttgccaaggtggttcaagaaacaatcgaccctgatgcgaggatagagtacaggcccaacacagaggatgacccgcataagagaaagcccgatataagtagggctaaggagctacttgggtgggagcccaaggttgacctacgcaagggcctcccactaatggtttctgacttccggcaacgcatatttggtgaccacaaggaaggtgctaccgtagcctaattcttgcttggagaatgttacatgaatcttagagtgagaaagggaaaagataatagttcgaggataaccctggcccacaaaggtccatttagtcgcagcattatatgagctccactaaaatgtcccttttgccgcttgttctccgtcaatctttatttgcgggttatttaccctctttcaagattgataaccacccatgattccaattttcaaattcctgccatctatattctatttctaatttttttttttttatgtaattggtatgtgcgagaggctacagttatagttatttcaacattttaccttggtctattttactcgaacttcattactttaccacttatttgcaatttgatctctgaatctgtagagtttactaaacatgttgaaattatgatgatcat

SEQ ID NO: 8000 - DNA, 1865 bp, Phaseolus vulgaris
acaattgacttcactcgcatctcattcccctcccggcgactcggtcgcggtcgtctctttccaactcccaactcactccattccgcatttccattctctcttctcctcaaacacacctctccttcttctttctctcatactagaaggagcaggttttagaattcattcagaaccaacacaggaatgggctcagaactcattttcagaggccacgaggcccagcccgtcaacgacgcctactcgcccaagcccaacaaaccctggctctccgtcactcgcccgattcactacatgctccgcgagcagcgactcctcttcgtcctcctcggcgtcatcatcgccaccctgttcttcaccctcatcccctcctcttccacctcctcgcccaccgtcccctacgacccgctcccgatctcctacttcgacggcgagtccaagcttccggcctaccaccaccgcatcgcagcggcggtgcattcggtgggaaaggtgcctctggggattaaacggaaaggactccggatcgtcgtcaccggtggcgcggggttcgtagggtcgcacctggtggatcggttgattgcacgaggggatagtgtgattgtggtggacaatttcttcactggaaggaaggagaacgtgatgcaccactttgggaaccctagattcgagctcatccggcacgacgtcgtggagcctctcctgctggaggtggatcagatctaccatctcgcttgccctgcttcccctgtccattacaagttcaaccccgtcaagactatcaagaccaatgtggtgggaaccttgaacatgcttgggcttgctaagagagtgggcgcgaggttcttattgaccagtaccagtgaggtttatggagatcctctgcagcaccctcagaaggagacttactggggcaacgtcaatccgattggtgtccgaagctgctacgacgagggtaagcgtacggctgagacgttgaccatggactaccaccgaggtgccggcgtcgaggttagaattgctagaatctttaacacctacgggcctcgaatgtgtttagatgatggtcgtgttgtcagtaacttcgttgctcaggcactaaggaaggaacctttgaccgtttatggggatgggaagcagacaaggagtttccagtatgtctctgatttggtggagggtctaatccgcctcatgggaggagaacacgtgggacctttcaatcttggaaatccgggagaattcaccatgcttgaacttgccaaggtggttcaagaaacaatcgatcctgatgcaaggattgagtacaggccgaacacagaggatgacccgcacaagagaaagcctgatataggtagggctaaggagctacttgggtgggaacccaaggtcgacctgcacaagggtctcccactaatggtctcagacttccggctacgcatttttggtgaccacaaggaaggtgcaaccgtagcctaattcttggcaggagtatgttacatccatcttagaagtgagaaagggaaaaagataatatagttggaggataaccctgctccgcaaaggtccattactcacagcatttgtatgagagctctcctactaaaatctcccttctatcgttcttctcctccgtcagtcaatctttgtatgcgggttatttaccctctttcaagattcacaaccacccttgattccatttttcaatttcttgccatctatattctattctctatttttttggatgtaattggtatgtactcttcgttatagttatagttatttcaacattttacctttcacttgttctattttactccaacttcattacttcaccacttatttgcaatttgatctcctgttacactcaa

SEQ ID NO: 8001 - DNA, 1825 bp, Trifolium pratense
cttcaacttaacaacatttcaaccactttgtaattctatcaccaccgtgccggagctgagttccggcaactcctaaactcgtaactcactcaatttctagtttccatttcacttcacaaaacccaaacaatctctcttcttcttcctatcacagattggaagaagaaaaacgtgaaaatgagttcagaattgactttcagaggacacgaagcacaacaagtgaacgacgaatactcaccgaaaccaaacaaaccatggctctcagcaattcgtccgattcgttacatgcttcgtgaacaacgactcgttttcgtgttgatcggaatcgtcatagcaacgttattcttcacactcgcaccatcaacttcaaccaaatcatcatcatcctcattctcaaccgttcattacgattctcatccgatctcatacttcgagaatgaaccaaaaaccacaccgtaccatcaacaacgcgccgccgcggttgttcattcgttcgggaaggttccgttaggaatcaaacgaaaaggacttcggatcgttgttaccggaggagccggtttcgttgggtctcacctagtggatcggttaattgcgagaggtgatagcgtaattgttgttgataatttcttcactggaagaaaagaaaacgttatgcatcattttggtaaccctcgatttgagcttatacgacacgacgtcgttgagcctcttttgcttgaagttgatcagatctatcatcttgcttgtcctgcttcacctgttcattacaaattcaaccctgtcaagactattaagaccaatgtggtgggaacattgaacatgcttggattggctaagagagttggagctagattcttgctaacaagtacaagtgaggtttatggtgatcctttacagcatcctcagaaggagacttattggggaaacgttaatccaattggtgttagaagctgctatgatgagggaaaacgtacagctgagacattgactatggactaccacagaggggccggtgtagaggttagaattgctaggatctttaatacatacgggcccagaatgtgcttagatgatggacgtgtcgttagtaacttcgttgctcaggcgctgaggaaggagcctttgacagtttatggggatgggaagcagacaagaagtttccagtacgtctctgacttggtggagggtctaatgcgccttatggaaggagaacatgtgggaccattcaaccttggaaatcccggtgaatttaccatgcttgaacttgccaaggtggtccaagaaacaatcgacccagatgcaaaaatagagtacaggccaaatacagaggatgacccacacaagagaaagcctgatattactaaggcaaaggagcagcttggctgggaacccaaggtggaccttcacaagggtctcccactaatggtttctgacttccgacaacgtatttttggtgaccataaggaaggtggatctgtggcctaattcttgaatgtgctatgtttatgttatgtgtaccttagagtgaggaaagggaaaagatgtagtctgaggataacaacacttaggtgtttactgttagtcacagcagcatatgaaatgccccttttgttgtttcttctccctgattgatagccatagccagccatgatttcctttatcaatttcctacaatctatataattctatttctatattttttgggtgtaattgggtactatgatgtacaagtgactacacttatagctatttcaacattttaccttattctattttgctccaacttcataaatcacaatctcttgtttgcaatttgatttctggt

SEQ ID NO: 8002 - DNA, 1848 bp, Trifolium pratense
ggggaccatcggatcttcaacttaaaacacctcaaccactttgaaattcaatcaccaccgtgccggagctgagttccggcgactcctaaactcgtaactcactcaatttctggtctccatttcacttcacaaaaccgaaacaatctctcttcttcttcctatctcagattggaagaagaaaatcgtgaaaaatgagttcagaattgactttcagaggacacgaagcacaacaagtgaacgacgaatactcaccgaaaccaaacaaaccatggctctcagcaattcgtccgattcgttacatgcttcgtgaacaacgactcgttttcgtgttaatcggaatcgtcatagcaactttattcttcacactcgcaccatcaactaccaaatcaccatcctcattctcaaccgttcattacgattctcatccgatctcatatttcgagaatgaaccaaaatccacaccgtaccatcaacgcgccgccgcggttgttcattcgttcgggaagattccgttaggaatcaaacgaaagggacttcggatcgttgttaccggaggagccggtttcgttggttctcaccttgtggatcggttaattgcgagaggtgatagcgttattgttgttgataatttcttcactggaagaaaagaaaacgttatgcatcattttggtaaccctcgatttgagcttattcgacacgacgtcgttgagcctcttttgcttgaagttgatcagatctatcatcttgcttgtcctgcttcacctgttcattacaaattcaaccctgtcaagactattaagaccaatgtagtgggaacattgaacatgcttggattggccaagagagttggagctagattcttgttaacaagtactagtgaggtttatggtgatcctttgcagcatcctcagaaggagacttattggggaaacgttaatccaattggtgttagaagctgctacgatgagggaaagcgtacggctgagacattgactatggactaccacagaggggccggtgtggaggttagaattgctaggatctttaatacatacggtcccagaatgtgcttagatgatggacgtgtcgttagtaacttcgttgctcaggcgctgaggaaggagcctttgacagtttatggggatgggaagcagacaagaagtttccagtacgtctctgacttggtggagggtctaatgcgccttatggaaggagaacatgtaggaccattcaaccttggaaatcccggtgaatttaccatgcttgaacttgccaaggtggtccaagaaacaatcgacccagatgcaaagatagagtacaggccaaatacagaggatgacccacacaagagaaagcctgatattactaaggcaaaggagcagcttggttgggaacccaaggtggaccttcacaagggcctcccactaatggtttctgacttccgacaacgtatttttggtgaccataaggaaggtggaactgtggcctaattcttgaatgtgctatgtttatgttatgtgtaccttagagtgagaaagggaaaagatgtagtccaaggataacaacacttaggtgttttccattagtcacagcagcatatgaaatgtcccttttgttgtttcttctttctcaatcttcttatgagggaagattgatcgatagccatagccagccatgatttcaatttcctacaatctatataattctatttctatattttttggatgtaagtgggtactattatgtacaagtgactacagttatagctatttcaacattttaccttattctattttgctccaacttcataaattacaacctcttgtttgcaatttgatctctggtttt

SEQ ID NO: 8003 - DNA, 2026 bp, Cicer arietinum
cattgaccttgcacccaatgacaaccattcatgtttgaaagtaattcgagggcaataacgtcattccacacaaaccacctttccccttaagttttggtacacgctcttttcagtctctcactttaaataccaaaaactcataatcgcatcctcacttaaaacaccaccgcatctcatcgccaccgtgtcggcgactgagttccggcgatttcccaactcggaactcactccatttctccattcatttcaattttctgttgttctcttaacctcacaaaataaaacaaactctctcagtcttctttctggctcagataggaagaagcaaaatctaaacaaaatgagttcagaattgattttcagaggacacgaaactcaacaagtgaacgacgaatactcacctaagccaaacaaaccatggctctcggtaattcgtccgattcgttacatgcttcttgaacagcgaatcgttttcgtattaatcggaatcgtcatagcaacgctattcttcacactcgtacctaattcatcttcaaactcttcctcttctgccttctccaccgttcattacgacgcgcatccgatctcgtacttcgagcatgaatcgaagaatacgccgtaccagcaacgcgccgcggtggtgcattcgttcgggaagataccgctggggattaagagaaaggggcttcggatcgtggtgaccggtggagccggtttcgttgggtcccatcttgtggatcggttgattgcgagaggtgatagtgtgattgttgttgataatttcttcactggtagaaaagagaatgttatgcatcatttcggtaaccctcgatttgagcttatacgacacgacgtcgttgagccacttttgcttgaagttgatcagatctatcatttagcttgtcctgcttctcctgttcattataagttcaaccctgttaagactattaagactaatgtggtgggaacattgaacatgcttggtttggctaagagagttggagctaggttcttgctaacaagtactagtgaagtttatggtgatcctctacagcatcctcagaaggagacttactggggaaacgttaatcccattggtgtgcgaagttgctacgatgagggaaagcgtacagctgagacattgactatggattaccaccgcggggccggtgtggaggttagaattgctagaatctttaacacctacggtccccgaatgtgcttagatgatggccgtgtcgttagtaacttcgttgctcaggcattgaggaaggagcctttgacagtttatggggatgggaagcagacaaggagtttccagtatgtctctgacttggtggagggtctaatgcgtcttatggaaggggaacatgtgggacctttcaaccttggaaatcctggtgaattcaccatgcttgaacttgccaaggtggtccaagaaacaatcgacccagatgccaaaatagagtacaggcccaacacagaggatgacccacacaagagaaagcctgatataactaaggctaaggagcagcttggctgggaacccaaggtagacctgcacaagggcctcccactaatggtttctgacttccggcaacgcatttttggtgaccataaggaaggtggaactgtggcctaataattcttgatggggttaaatgttattgttgttatgtgtaccttaagagtgagaaagggaaaatatgtagtacgcgaggataacaacagtttagggtttttcccattagtcacagtagcatatgagatattcttaagtgtcctttttgttgtttcttttcagtcaatcttcttatgaggaagggttatgtaccttctttcaagattgattaatagccagccatgatttcattttatcagtttcctgccatcttatatattctatttctatactagtattttttttttggatgtaattggtatgtacaagtgactacagttatagttatttctacattttactttattttattttatttggcttctacttcacaaaatcacaacc

SEQ ID NO: 8004 - DNA, 1683 bp, Medicago truncatula
cttcatcttaacaacatttcaaccactttaaatatctctcttaaccaccgtgccggaaatttcgaccacctagttccggtaaccggaactcacttcatttccgttcttcctctgtagtatctgaaaatgagttcagaattgactttcagaggacacgaaactcaacaagtcaacgacgaatactcaccaaaaccaaacaaaccatggctctccgtaattcgtccgattcgttacatgcttcgtgaacaacgactcgttttcgtcttgatcggaatcgtcatcgcatccgtattcttcacaatcataccttcatcttcaacttcttcatcctcctcattctcaacccgtccatacgaatcagactcgatctcgtacttcgaccgcgagtcaaagaccacacctgcagtgtataagcaacgcgccgcctcggtggttcattcgtccgggaagattccgttggggataaaaaggaaggggctgcggatcgtggtgactggtggagcgggattcgttgggtcccatctagtggatcggttgatggcgagaggggatagtgtgattgttgttgataatttcttcaccggtagaaaagagaacgttatgcatcattttggtaatccgagatttgagcttattcgacacgacgtcgttgagcctcttcttcttgaagttgatcagatctatcatcttgcttgtcctgcttctcctgttcattacaagttcaaccccgtcaaaactatcaagacgaatgtggtcggaacattgaacatgcttggattggcgaaaagagttggagctagattcttgctaacaagtacaagtgaggtttatggtgatcctctggagcatcctcagaaggagacttactggggaaacgttaatccaattggtgtccgaagctgctacgatgagggaaagcgtacggctgagacattgactatggattatcacagaggggccggtgtagaggttagaattgctaggatctttaatacatatggacccagaatgtgcttagatgatggacgtgtcgttagtaacttcgttgctcaggcgctgaggaaggagcctttgacagtttatggggatgggaagcagactagaagtttccaatacgtctctgacttggtggagggtctaatgcgccttatggaaggggaacatgtggggccgttcaaccttggaaatcctggtgaatttaccatgctggaacttgccaaggtggtccaagaaacaatcgacccagatgcaaagatagtgtacagagataatacagaggatgacccacacaagagaaagcctgatattagcaatgctaaggagcaccttggctgggaacccaaggtggacctgcgcaagggtctcccactaatggtttctgatttccgacaacgcatttttggtgaccataaggaaggtggatctgatgcctaattcttgatggtggtatgtttatgttatgtgtaccttagagagtgagaaagtgaaaaaatatagtctgaggataacaacatttaggtgttttccattagtcacacagaagcatatgagctcctcttaaatgttccttttgttgttccttctccctcaatctttcaagattgattgatagctatagccagccatgatttcatttatcaatttcctgccatctatataattctatctctatttttttggatg

SEQ ID NO: 8005 - DNA, 1578 bp, Glycine max
gcggtctcttcccaactcggaactcagtccattccgcatttcaattttctcttcacttggcaaagcccaaaccaaaccctggctgaagaagagaattgactgagaagaagaacacagaaatgggctccgaactgattttcagagggcacgagacccagcccgtggacgacgcgtactcaccaaagccccacaaaccctggctcaccgtgactcgcccgattcactacatgctccgtgagcagcgactcctcttcgttctcctcggcgtcatcatagcaaccctcttcttcacattcgtcccttcctcttccccttccgcttcctcctcaagcgtttcgtacgagtctctcccgatctcctacttcgagcgcgagtcaaagattccggcgtaccaccaccgcgtggctgcggcggtgcattcggtggggaaggtgccgctggggattaagaggaagggactccggatcgtagtgacgggcggcgcggggttcgtggggtcgcacctggtggatcggttgattgcgagaggggacagcgtgatcgtggtggacaatttcttcacgggaagaaaagagaacgtgatgcaccattttgggaaccctagattcgagctcatccgacacgacgtcgttgagcctctcctgctcgaggttgatcagatctaccatctggcttgccctgctgaggtttatggagatcctctgcagcaccctcagaaggagacttactggggcaacgtcaacccaattggtgtccgaagctgctacgacgagggaaagcgtacggccgagacgttgaccatggactaccaccgaggtgccggcgtcgaggttagaattgctagaatctttaacacctacgggcctagaatgtgcttagatgatggtcgtgttgttagtaacttcgttgctcaggcactaaggaaggagcctctgaccgtttatggagatgggaagcagacaagaagtttccaatatgtctctgatttggtggagggtctaatccgccttatggaaggagaacacgtgggacctttcaatcttggaaatccgggagaatttacaatgctagaacttgccaaggtggttcaagaaacaatcgaccctgatgctaggatagagtacaggccgaacacagaggatgatccgcacaagagaaagcctgatataagtagggctaaggatcaacttggctgggaacccaaggttgatctgcgcaagggcctcccactaatggtttctgacttccggcaacgcatttttggtgaccagaaggaaaaggcaaccgtagcctaattcttgcgtgtcatgtatcttagagtgagaaagggatataagataataatagttcgaggataaccctggcccgccaaaggtcccattagtcatcacaggattatatgagctctactaaaatgtccctttgtcgtttgttctccgtcaatctttacatgccgggttatttaccctctttcaagattgaccaccacccctgattccatttttcaaattcctgccatctatattctatttctttctctttttttttggatgtaattggtatgtgcaacagtgcaag

SEQ ID NO: 8006 - DNA, 1654 bp, Vicia sativa
ttccttgctcagattggaagaagaaaatctcaaaatgagctcagaattgactttcagaggacacgaaacacagcaagtgaacgacgagtactcaccgaagccaaacaaaccatggctctccgaaattcgtccgattcgttacatgcttcgtgaacaacgactcgttttcgtgctcatcggaatcgccatagccaccttgttcttcacattcgcaccatcctcttccacctcctcctccgcctcctcctcattttcaaccgtccggtacgagccgcatccgatctcgtacttcgagcacgaatccgaatccaaagtcaccccgtaccagcgccacaccgcggcagttcattcggtcgggaaagttccgttagggcttaagagaaaggggctccgaatcgtggtgaccggaggagccggtttcgttgggtcccacttagtggatcggttgattgaaagaggtgatagcgtgattgttgttgataatttcttcaccggaagaaaagagaatgttatgcatcattttggaaaccctcgatttgagcttatacgacacgacgtcgttgagccgcttttgcttgaagttgatcagatctaccatcttgcttgtcctgcttcacctgttcattacaagttcaaccccgttaagactattaagacgaatgtagtgggaacattgaacatgcttggattggctaagagaattggagctagatttttgctaacaagtactagtgaggtttatggtgatcctctgcagcatcctcagaaagagacttattggggaaacgttaatccaatcggtgtccgaagttgctacgatgaaggaaagcgtactgctgagactttgactatggattatcacagaggggctgaagtggaggttagaattgctaggatctttaacacatacggacccagaatgtgcttagatgatggacgtgttgttagtaactttgttgctcaggcattgaggaaggagcctttgacagtttatggggatgggaagcaaacaaggagtttccagtatgtctctgacttggtggagggtctaatgcgcctcatggaaggagaacatgtgggacctttcaaccttggaaatcctggtgaatttaccatgcttgaacttgccaaggtggtccaagaaacaattgacccagaggccaaaatagagtacaggcccaatacagaggatgacccacacaagagaaagcctgatataactaaggccaaggagcaacttggctgggaacccaaggtggacctgcacacgggcctcccactcatggtttctgacttccggcaacgtatttttggggaccataaggaaggtggtacagtggcctaagtcttgatggtagtatgtttatgtcatgtgtaccgtagagagtgagaaagggaaaatatgtagtctgaggataacatcacttgggtgtttcccattagtcacagcagcatatgagctcttctagagtgtcccttctgttgttccatctccagcatattttctctctttcaagaatttattgatagctatagccagtcatgatttcatttatcagtttcctgccatctatatcgttctatttctattttttttggatgttattggtatgtacaagtgactacagttatagttattacaacattttacctg

SEQ ID NO: 8007 - DNA, 1852 bp, Arachis hypogaea
caccacccttctccgatccaaatcaccagcaccaccgccggtgaccgagtaccgagcgagtttcgaactcggaactcagtcctcctttccttcacctcctcacacacaccaccatttccatttctttcagaaattccagaactttcttcttgttcttgttcttgttcttcttcaaagctccatcgacaacaacaatgggtggttcctcagaactaatcttcagaggccacgaatcgcaaccaatcaacgacgactactccccaaaaccaaacaagcgatggctctcattcactctaaaccccatcaactacctcctccgcgagcagcgcctcctcttcaccctcctcggagtcttcatcgccaccgccttcttcactctcctcccttcccacaacaccaaccttaaccaatacgacaccgttccgatcccatacttcacgcaacacgactcagtcttcccaacgaaccaccagagcaaccgccacgtggcagcagttcattccttcgggaaagtgccgcttggaataaagaggaagggcctgagaattgttgtcaccggaggagcggggttcgttgggtcccacttagtggatcggttgatagcgagaggggacagtgttatcgttgttgataatttcttcacggggaggaaggagaacgtgatgcaccattttgggaaccctagatttgagcttatacgacacgacgtcgttgaacccttgttgcttgaagttgaccagatctaccatcttgcctgccctgcttcccctgttcactacaagttcaaccccgtcaagactatcaagacgaatgtggtgggaactttgaacatgttagggcttgcaaagagagttggagccagattcttgcttacaagcaccagtgaggtttatggagatcctcttcagcaccctcagaaggagacttattggggcaacgttaatcccattggtgtgcgaagctgctacgacgagggaaagcgtacggcggagacgttgactatggactaccacagaggagccggtgtggaggttagaattgctaggatctttaacacctacggtccccgaatgtgcttagatgatggacgtgttgttagcaacttcgttgctcaggcactaaggaaggagccaatgactgtttatggagatggcaagcaaacaaggagcttccaatatgtatctgatttggtggagggtctaatgcgtcttatggaaggagaacatgtgggacctttcaaccttgggaaccctggtgaattcaccatgcttgaacttgccaaggtggtccaagaaacaatagacccagatgcaagcatagaatacaggcccaacacagaggatgatccccacaagagaaagcctgacatttccagagctaaggagcttcttggctgggagcccaaggttgacctccggaagggactccctctcatggtttccgacttccggcagcgcattttcggcgaccacaaggaaggttcaactgtggcctaattttattactgctttgggttggtttggaaccatctcatatgttaccccatggtttttgaaaagggaaaagaaaaaaaagatatagtaattaaaggattaaagacacttagtgtgtttttttccgccatatcccttcttcaatgtccattagtcatagcagcaaagtgagctcaacttgagtgtcctctcttgtcaatttattataatgtcaatcttttatagtttataagtttggggggttacccccctctttccagattagtagccagatatgattacatttcttaagtttcagctgtcttgtattcttttactatataaatttttaagcttttttttatgggatgtaattgcaa

SEQ ID NO: 8008 - DNA, 1979 bp, Lupinus angustifolius
aagcttgcaccaaacgatacctgttcacttttgaatccaaataaggacagttccgtcattccagtataacccattgtccttttatcctttaccctcacactttaaatacccactcacacaccaccacaccaccaccaccaccaccaccacccgaatctgaccaccgtgccggagactgaattctcatctccgatctcatattcctcaacctcactcacaaaaatcaatcccatatcataacaacaacattgaacgataattccattcacaaatgggttctgaactcatattcagaggccacgaaacccaacccatcaacgacgattactcacccaaacacaacaaacaatggcactcagtaactcgtccgattcactacctcctccgtgaacagcgtctcctcttcatcctcatcggcgttgccatagccaccgtcttcttcctcctcattccatcaaactcacccacctcaaattccttatacgaaccgcttccgatctcgtacatggaccacgaatcgaaccagtgggaccataagccaaggccattgattggttttcattcggtagggaaggtgccgttagggattaaacgcaaagggcttcgaattgtggtaaccggtggtgctggtttcgtagggtcgcatctagtggatcggttaattgcgagaggggatagtgtaatggtggtggataatttcttcacagggagaaaagagaatgtgatgcatcattttgggaattccagatttgaattgattagacatgatgttgttgaacctattttgttagaagtggatcagatctatcatcttgcatgtcctgcttcacctgttcattacaaattcaatccggttaagactatcaagacgaatgtggttggtacattgaacatgctggggctggctaaaagagtgggggcgaggttcttattaaccagtacaagtgaggtttatggagatcctctggaacaccctcagaaggagacttactggggcaacgtcaatcccattggtgtgagaagctgctacgacgagggtaagcgtacggcagagacattggccatggattaccatagaggagcaggtgttgaggttagaattgctagaatcttcaacacctatggccccagaatgtgcttagatgatggccgtgttgttagtaacttcgttgctcaggctctaaggaaggaacctttgacggtatacggggatgggaaacagactaggagtttccagtatgtttctgatttggtggagggtctaatgcgccttatggaaggagaacatgtgggacctttcaaccttggaaatccaggcgaatttaccatgcttgaacttgccaaggtggtccaagaaacaatagacccagatgcaaagatagagtatagggacaacacagaggatgacccacacaagagaaagcctgatattagtaaggccaaggagcaacttggctgggaacccaaggtggaccttcgcaagggtctccctctaatggtttctgacttcaggcaacgcatttttggtgaccacaaagaaggtgctactgcaacctttgcctaattattacttggagtatgttataaagtgagaaactgaaaagacagtagtagtcacagattacattaaaagggtgtttcccatcccttagaggtgcattagttacagcagcttatgagctttacagtcccttttgtcctttgttcttcatcaagattggtagctaatcattctcaattcctgcaatctatattctttctacatgttattttgagatgtaattggtatgtgcaagatgctacagttattagctctttctacattttaccttcactttattttatcgaacttcaatttgatctttgatcttatagagtttgctatcctcatgtttcattatgtgaataataataataataataatgatgaatatttttcttgtattacttatctttcaatgaagtgatatactttatgg

SEQ ID NO: 8009 - DNA, 1862 bp, Euonymus alatus
ttccatggcatttctgtaattaactctcaaaccaggctcttatagttatcatatcatactttatatacggaggtggcctctcgctaaagccacataccgaaaccggaacccgcccatacctgacccgacccggcgttgtcggagaccggttcccgacacaatatcttccctacaataaaacggattccgagtagtaccaaatttgaatctctgagaaaatctgttgttcatttgagtggggatttgaattgaatttgagtcttcaaggagatgggatcggagctgatatacagagggcacgaggaggctcagccgactgcggacggctactcgccaaagccagcgaagccatggctatcggtagttcgtccgattcgttacttgcttcgcgaacagagattgatcttcgtcctcgttggcattgcggtagctactgttttctttactctcctcccgtcctcgtctcaccgctcgtatcggcacgaaagctatgtgccgatctcttacttcggtcgtgactcgtaccggcagtcgaacaagccatacgagcagcaccggatgtttgtgcactcaagtgggaaggtgcctctggggcttaagcggaaggggctgaggatcgtagtcaccggtggggcagggttcgttggttctcaccttgtggaccgtctgattgcgaggggagatagcgtgattgttgtggacaatttcttcactgggaggaaagagaacgtcatgcaccatttttccaacccgagattcgagctcatccgacacgacgtagttgagcctcttttgctcgaggttgaccagatctatcacctcgcttgccctgcctcccctgttcactacaaattcaaccccgtcaagactatcaagacaaatgtggtgggtacattgaacatgttgggactggcaaagagagtcggtgcgcggttcttgctaaccagcactagcgaggtgtacggtgatcctcttcagcatccacaggtggagacttactggggaaatgttaacccaattggtgtacgaagctgttacgacgagggaaagaggacggcggagacattgacaatggactaccacagaggtgctggcgtcgaggtgaggatagccagaatttttaacacgtacgggcctcgtatgtgcattgatgatggccgtgtcgtcagtaattttgttgctcaggcattgaggaaggaacctttgactgtttatggtgatggtaaacagacaaggagttttcaatatgtttccgacttggttgagggtttaatgcgccttatggaaggagaacatgtgggacctttcaatcttggaaatcctggtgaattcaccatgcttgaacttgctcaggtggtccaggaaacaattgaccccaatgccaagattgaattcagacccaacacagaggacgacccacataagaggaaacctgatatcacaagggctaaagatctacttggttgggaacccaaagtgtctcttcggaagggtctacctctaatggtttcagacttccggcaacgcgtcttcggtgaccacaaggaaggtagcacaacttccactgggtcgtcttaagttggggttgtttatacatggaaggttcaagggaagctcctctttccccaaacagtgcagctctgggaacagcagtagcagtagagcagcgattgaacctcatttgttattttcagtcatcttcgaaacttttatgttaccttccctttcagtcttaatagacagcgagttgttgattccttaagaagtattgtttttcaagcgattaattgtgcagccccacgaagaaaatgaagatggaacctttaataacaaaccagattttggaatccattttttgctgt

SEQ ID NO: 8010 - DNA, 1582 bp, Glycine max
tctccctccctccccgccttctccgcattcattatttctttcttggtatcaaattcagattggagattgtgaattagctggcgagaatgtcttcgtctacgggcttgattttccgagggcacgaggcccaacccatggacgacgcctattacccgaagccgcagaagccatggctctccttccgctacctcctacgcgaacagcgtctccacttcctcctcctgggcattgtcctcgccaccctcttcttcttcctcctcccctctggcctccacgacccattccccactccttacttggagcccacccgctggcccaccaactccccaagctacgacgtcgtctccgtgcattccgtcggaaaaatccctctggggattaagcggaagggtctccggatcgttgtgaccggtggggccgggttcgtcggttcccacttggtggatcgcttgattgcccgcggagacagcgtcatcgtcgtcgacaatttcttcaccggaaggaaagaaaacgtcatgcaccatttcggcaaccccaacttcgagctcattcgacacgacgtcgttgagcctctcctgttagaggtcgaccagatctaccatctcgcctgccccgcctcccctgtccattacaagtttaacccagtcaagactatcaagaccaacgtggtgggaacgttgaacatgctgggactggctaaaagagtgggggccaggttcttgctgaccagtaccagtgaggtttacggagatcctctggaacatcctcagaaggagacctattggggcaacgttaatcccattggtgttcgaagctgctatgatgagggaaagcgtactgctgagacgttgaccatggactaccacagaggagctggagtcgaggtgagaatagctaggattttcaacacctacgggccacgaatgtgcttagatgatggtcgcgttgttagtaacttcgttgctcaggcactgaggaaggaacctttgaccgtttatggggatgggaagcagactaggagtttccaatatgtttctgacttggtggaggggctgatgcgccttatggaaggagaacatgtgggacctttcaatcttggaaatccgggtgaattcaccatgcttgaacttgccaaggtggtccaagaaacaatagatccagaggctaagatagagtacaggcccaacactgaggatgacccgcacaagagaaagcctgatattagtagggccaaggagcaactgggttgggaacccaaggtggacctacgcaagggactccctctaatggtttctgacttccgacaacgcatttttggggaccaaaaggaaggaacaacctctgcctaattcttgctaggataatggaaattggagtttgttctacaaaatatacctcagattgagtgcaaaaggggattgtagttttgcattttcatagcattagccagaaaacagttagtgggatttcccatctcttcatagttcattagtcagctatatatacataaatttcccctttatcgtttgtcctttataaatttttattgtatgtgctattgatgtccatattgatatccagt

SEQ ID NO: 8011 - DNA, 1723 bp, Glycine max
gaccagcatctcattcccgtccccggcgactgagtagcggtctcttcccaactcggaactcagtccattccgcatttcaattttctcttcacttggcaaagcccaaaccaaaccctggctgaagaagagaattgactgagaagaagaacacagaaatgggctccgaactgattttcagagggcacgagacccagcccgtggacgacgcgtactcaccaaagccccacaaaccctggctcaccgtgactcgcccgattcactacatgctccgtgagcagcgactcctcttcgttctcctcggcgtcatcatagcaaccctcttcttcacattcgtcccttcctcttccccttccgcttcctcctcaagcgtttcgtacgagtctctcccgatctcctacttcgagcgcgagtcaaagattccggcgtaccaccaccgcgtggctgcggcggtgcattcggtggggaaggtgccgctggggattaagaggaagggactccggatcgtagtgacgggcggcgcggggttcgtggggtcgcacctggtggatcggttgattgcgagaggggacagcgtgatcgtggtggacaatttcttcacgggaagaaaagagaacgtgatgcaccattttgggaaccctagattcgagctcatccgacacgacgtcgttgagcctctcctgctcgaggtttatggagatcctctgcagcaccctcagaaggagacttactggggcaacgtcaacccaattggtgtccgaagctgctacgacgagggaaagcgtacggccgagacgttgaccatggactaccaccgaggtgccggcgtcgaggttagaattgctagaatctttaacacctacgggcctagaatgtgcttagatgatggtcgtgttgttagtaacttcgttgctcaggcactaaggaaggagcctctgaccgtttatggagatgggaagcagacaagaagtttccaatatgtctctgatttggtggagggtctaatccgccttatggaaggagaacacgtgggacctttcaatcttggaaatccgggagaatttacaatgctagaacttgccaaggtggttcaagaaacaatcgaccctgatgctaggatagagtacaggccgaacacagaggatgatccgcacaagagaaagcctgatataagtagggctaaggatcaacttggctgggaacccaaggttgatctgcgcaagggcctcccactaatggtttctgacttccggcaacgcatttttggtgaccagaaggaaaaggcaaccgtagcctaattcttgcgtgtcatgtatcttagagtgagaaagggatataagataataatagttcgaggataaccctggcccgccaaaggtcccattagtcatcacaggattatatgagctctactaaaatgtccctttgtcgtttgttctccgtcaatctttacatgccgggttatttaccctctttcaagattgaccaccacccctgattccatttttcaaattcctgccatctatattctatttctttctctttttttttggatgtaattggtatgtgcaacagtgcaagaggctacagttatagttatttcaacattttaccttctcacttgttctatttttatttaaacttcattacttctccacttatttgcaatttgatctctgaatttgtagagtttgctacactcttgttgaaattattactatcatca

SEQ ID NO: 8012 - DNA, 1980 bp, Gossypium hirsutum
gaacaatctccttttctcttgagcccgcctctaactttgctggcgactcagtcttcacaattttcttttttttgaatttattctcgcgatggggtcatcggagctgatattcagaggccatgaaactcagcctgtttccgattcctattcacccaaacccgacaaaccatgggctccgttacccgcccgattcgttacatgctccgagagcaacgccttctcttcgtcttcctcggcattgctattaccactctcattttcaccctcttcccggcctcacgtgctacgcaacacaacttcgccgattccataacctacttccccatcgacacacagagcaagttctccaacccgcaccgactcggattcggatcgtctaacccgactggcaagatcccgttggggttaaaacgtaaaggcctgaggatcgtggtaacgggtggagccggcttcgttgggtctcacctcgtggaccggttaatagcaaggggagatagcgtgatggtggtggataacttctttactggcaggaaagaaaacgtgatgcaccatttcggtaaccccaatttcgagcttataagacacgacgtggtggagcctttgctattggaagttgaccagatctaccatttagcttgccctgcttcaccagttcattacaaattcaacccagtcaaaactattaagacaaatgttgtggggacattgaacatgttaggactggcgaaaagagtaggtgcaaggttcttattaaccagtaccagcgaagtatacggagatcctcttcaacatcctcagaaggaaacttattggggcaacgttaatcccattggtgtccgaagctgttacgacgaggggaaacgtacagccgaaaccctgacaatggactatcacagaggagctggagttgaggttaggattgcccggattttcaatacttacggacctcgtatgtgcatcgatgacggtcgtgttgttagcaactttgttgctcaggcattaaggaaggagcctttgactgtgtatggtgatgggaaacagacaaggagtttccaatatgtttctgatctggtggaggggctaatgcgattgatggaaggagaacatgttggaccttttaaccttggaaatccgggtgaattcaccatgcttgagcttgctgaggtggtacaagaaacaattgatccaaatgcaaagatagaattcagacccaacacagaagatgacccacacaagaggaagcctgatatctcgagagccaaggagctactcggttgggaacctaaagtctctctccgaaagggtctccctctgatggtttcggatttccggcaacgtatatttggtgatcataaggagggcagcagcaataacagcaacaatgaatcatcttaaggtggcaatggcaaaaggccaatcaaatattatttcattggaaaagaactcccaacatatatagttagcagcagcagcagtttcagtttaagttccctttagaggtttttttttttttcccttttttgacatgtatttgccatcttttgtaatttcccatgtctgttgtaagctttgattgacagtgagctttgcaaagcttaaaaacattttaccctattctatttaatgcaatagcagcaataatatgattatatgaggtttactcctgcaaaatccaaactcctcctctcatgccctcattgccttttaatgacaattttggaattgggtcactggatatttcaatttgctctggaaatatgatcagcagcgacactgaaagctgaaacaaggcatgctaccccaatgatattgttcaagtttctagtctgcgcagcaacggcagccccggcaatggcacccgctattaaagtgtttaacgggtcgttccgcttccggtatttctgaagtccacagcgagttgtggcgaatacaccggcaacaagtccactttggaagccgaattttccaacagactttgcc

SEQ ID NO: 8013 - DNA, 1970 bp, Quercus alba
gacccttcctctatttttcccactcgccgaagcgtccgagtcgccggcgagttaactcgtaactcagcacacactcaatcactcaccgattctccttcatttttcaccccctcatttccttattacccagaaacacaaaattttgaatcgtttaagaagaagaagatgagttcggagctgattttcagaggacacgagagccaacccgtgtcggacacgtacacaccgaagcaaccaaagccatggttctctgtgacccaaccgattcgctacatgctccgagaacaacgcctggtgttcgtcctcgtcggcattgctatagccaccgtcgtattcaccctcctaccttcctcctccacatcccgtgtcgagtacggacacttcacgatcccggaaacgacgacacggctgagccagtacgaccaaaaacccatgtacgagcaccgctcagctttccacatgtacagctccggcaaagtccccttggggctaaaacgcaagggtttgcggatcgtggtgaccggcggggccgggttcgttgggtcccacttggtcgaccgtctgatggagcgaggcgatagcgtgatcgtggtcgataacttcttcaccggaaggaaagagaacgtgatgcaccatttcggtaaccccaggttcgagctcatccgacacgacgtcgtcgagcctctcttgctcgaggtcgatcagatctaccatctcgcttgccctgcctctcctgttcactacaagttcaaccccgtcaaaaccatcaagaccaatgttgtggggacattgaacatgctgggacttgcgaagagagtgggtgcgaggtttttgctaacgagcacaagtgaggtgtacggagatccactgcaacaccctcaggtcgaaacctattggggaaacgtcaatcctattggtgttagaagctgttacgacgagggaaaacgtacggcggaaacgttgaccatggactatcatagaggtgcaggcgttgaggtgaggattgcaagaatcttcaacacctatggacccagaatgtgcatcgatgatggtcgtgtggtcagcaattttgttgcccaggcattaaggaaggagcctatgactgtttatggtgatgggaagcagactaggagtttccaatatgtatctgacttggtggagggtctgatgcgcctaatggaaggagaacatgtaggacctttcaatctcggtaatccgggtgaattcaccatgcttgaacttgctggggtggtccgggaaacaattgacccagacgcaaagatagagtacaagcccaacacagaggatgatccccacaagaggaagcctgatatcacaaaggctaaagagctactcggctggcaaccaaaggtggaactccgcaagggtcttcctctcatggtctcagatttccggaaacgtatctttggtgaccacaaggagggtggcgctactactgcgtaattctaagtcaggcatatatacttgaagagtgatgacagagggaaaagataattgtttcttggaaagcaattctcagctgtttccccttctccaaacaaaatacagtagcaacaccaagaaggcagcatttgtgctgcttgattcttctttggaataggttttaggtgtccctttggcatttgatttccatcatcttagtaatttctgggttacaagcccatttaagcgtaatagatttgtgattccaaaaagttcctttccttattttttaaatttgatttgttaagaggcctacagtaatagctttacctgctgcattctcattccagcttaattatcgcagttcagtttgtttccgtattgttctcttaaaagggtgtaaattatcgcagttcagcttggcaatgttgacccttgaagatctcttgctcaaagatacaattggctataaactgctatacatgtataagtgaaagcttactaatttttcaagttttcaattccaa

SEQ ID NO: 8014 - DNA, 2123 bp, Mimulus guttatus
gtgtataaattaattcaacacttggcattcaagtgacaattataggggcatttccgtaatagcacctcaatcgaaccactctttttaagctgcgtcctcgctgctagaatcgcaccagacatcaaccccacacaaacacaaaccaacgcgccggcgcgtggaatattgcgcgacgaacactccttcactctccctcttcatttcaccatttaaacacaaacacgcagtcacacacacatagatacgccgatttacagagtgtatgatctttgatctataaacgcgtccaaaacaaaataaaaaaaatgggttccgagttgatattccgcggccacgagtcgcaaccagtgagcgacgcctactcgccgaagccggcgaagccgtggctcaccgtgacccgcccgattcactacctcctccgcgagcagcgcctcgttttcgtcctcgtcggcattgcaatcgccacgctcttcttcacagtcgtccccacctccaatagcccacacgcgccgatccccgacgcgttcatttcgtccgagttgactcagctacatcagccgcacagatccatgtaccagaacggtcacctcgccaccgggttcggaatcaactcggtcgggaaaatccccctgggtttgaaacgcaagggtttgagaatcgtggtcacaggtggtgccggattcgtcggcagccatctggtggatcggctgatcagccgtggagacagcgtgatcgtggtggacaatttcttcaccgggagaaaggagaacgtcgtccaccatttcggaaaccctaggtttgaactgatccgacacgacgtcgttgagccgctccttctggaagttgaccagatctaccatctggcctgccctgcttcccccgttcattacaaacacaaccccgtcaaaacaatcaagacgaatgtggtgggaacgttgaacatgctgggattggccaagcgagtcggtgcgcggtttttgctgacgagcaccagcgaggtttacggtgatccgttacagcacccgcaggttgaaacctactggggcaacgtcaacccaatcggtgtccgaagctgctacgatgaaggaaagaggactgctgaaacgttgaccatggactatcacagaggcgctggcgttgaggttagaattgctaggatctttaacacatatggacctcgtatgtgcattgatgatggtcgtgttgttagcaactttgttgctcaggcgttgagaaaggagcctttaactgtttatggtgacgggaagcaaacaagaagttttcagtatgtttcggatctggttgagggattgatgcggttgatggaaggagagcacgttggtcctttcaatctcggtaacccaggcgaattcactatgcttgaacttgctcaggttgtacaagaaaccatagatccaaatgcaaagatagagttcaggccaaacacagaagacgacccgcacaagagaaagccggacataacaaaggcgaaagaccagctaggttgggagccaaaagtgccgcttcgtaaaggtctacctatgatggtctccgatttcaggcaaagaatattcggtgatcacaaagaaaacgttgctacttcagcgtaattggggcaaaaaagagaaaaaaaaaaaggctatatattatgagtttcttcttcttcttcttcttcttcgtatgcatataatctcttaaacctcattcaatggggaaaaaagtgacaagtcaccttttcgaccccgagaatgtacactaggagtaacggcattatagaagaaagcattgaacgtgaaccacaccatccccgcccttctttctatttagctagaaacttctagaggttatcttgtgatattactattatgttttttttcttttcttttttcttttttttcggtttttctttgaagtgcccatcttttgaaacttttttaatagactggcttctacataggtttgggctgcactctttaattccaaactcagttcaattttgaatgctcattacttgttcagatgaaatttaggtccttattgtttcagacagtcttgtattgactggactctttaattacacattcaatgccaatttagagccccatctttgggtcttgggcttt

SEQ ID NO: 8015 - DNA, 1702 bp, Tripterygium wilfordii
gcccttacgtgacccggcgttgtcggagaccggttccggagacaagtttttgattgcaataaaacggattcgaagtaccaaatttgaatctctgagaaaatctgttagttgtgggtttgaattttgaatttgagtcttgaaggagatgggatcggagttgatatacagggggcacgaggaggcccagccgacggcggacggctactcgccgaagccagcgaagccatggttctcggtagttcgtccgcttcgttacttgcttcgcgagcagagactgatcttcgtcgtcgttggcattgcaatagctactgttttctttactctcctccagtcctcgtctcccgcctcttaccggcacgaaagctatgtgccgatttcgggctccatctcttacttcgatcgtgactcgaaccggcagtcgaacaagccgtacgagcagcaccggatgttggtgcactcaagcgggaaggtgcctctagggctcaagcggaaggggctgcggatcgtggtcacaggcggggcagggttcgtcggttcgcaccttgtggaccgtctgattgcgaggggagatagcgtgattgtcgtggacaatttcttcaccggaaggaaagagaacgtcatgcaccatttctctaacccgagattcgagctcatccgacacgacgtcgttgagccccttttgctggaggttgatcagatctatcacctcgcttgccctgcctcccctgttcactacaaattcaaccccgtcaagactattaagacgaatgtggtgggtacattgaacatgctgggactggcgaagagagtcggtgcgcggttcttgctgaccagcaccagcgaggtgtacggtgatcctctgcagcatccacaggtggagacttactggggcaacgttaacccaattggtgtccgaagctgttacgatgagggaaagaggacagctgagacattgacaatggactaccacagaggtgctagtgttgaggtgagaatagccagaatttttaacacgtacgggccccgcatgtgcattgatgatggccgtgtcgttagtaattttgttgctcaggctttgaggaaggaacctttgactgtttatggtgatggcaaacagacaaggagctttcaatatgtttctgacttggttgagggtttaatgcgccttatggaaggagaacatgtgggacctttcaatcttggaaatcctggtgaattcaccatgcttgaacttgctcaggtggttcaggaaacaattgaccccaatgccaagattgaattcagacccaacacagaggacgacccacataagaggaaacctgatatcacaaaggccaaagatcaacttggttgggaacccaaggtgtctcttcgaaagggtctacctctaatggttgcagacttccggcagcgcatctttggcgaccacaaggaaggtaacacaacccccgccgtggcatcttaagttggtggtgtttatacatagaaggagaaaggggaagatcgattcccccaaacagtgcagctgttgaacaactgcagcattagagcgggaattgaacctcatttgttattttcagtcatcttcgaaaccttcttgtttaccttccctttcagtcttaatagacagtgagttgttgattccttgaaagtttaatggtaccatgggctgtgtatttttgcactcccatgtagttgttca

SEQ ID NO: 8016 - DNA, 2106 bp, Gossypium hirsutum
acaatctccttttctcttgagcccgcctctaacttgctggcgactcagtcttcacaatttcttttttgaatttattctcgcgatggggtcatcggagctgatattcagaggccatgaaactcagcctgtttccgattcctattcacccaaacccgacaaaccatgggcttccgttacccgcccgattcgttacatgctccgagagcaacgccttctcttcgtcttcctcggcattgctattgccactctcattttcaccctcttcccggcctcacgtgctccgcaacacaacttcgccgattccataacctacttccccatcgacacacagagcaagttctccaacccgcaccgactcggattcggatcgtctaacccgacgggcaagatcccgttggggttaaaacgtaaaggcctgaggatcgtggtaacgggtggagccgggttcgttgggtctcacctcgtggaccggttaatagcaaggggagatagcgtgatggtggtggataacttctttaccggcaggaaagaaaacgtgatgcaccatttcggtaaccccaatttcgagcttataagacacgacgtggtggagcctttgctattggaagttgaccagatctaccatttagcttgccctgcttcaccagttcattacaaattcaacccagtcaaaactatcaagacaaatgtggtggggacattgaacatgttaggactggcgaaaagagtaggtgcaaggttcttattaaccagtaccagcgaagtatacggagatcctcttcaacatcctcagaaggaaacttattggggcaacgttaatcccattggtgtccgaagctgttacgacgaggggaaacgtacagccgaaaccctgacaatggactatcacagaggagctggagttgaggttaggattgcccggattttcaatacttacggacctcgtatgtgcatcgatgacggtcgtgtggttagcaactttgttgctcaggcattaaggaaggagcctttgactgtgtatggtgatgggaaacagacaaggagtttccaatatgtttctgatctggtggaggggctaatgcgcttgatggaaggagaacatgttggaccttttaaccttggaaatccgggtgaattcaccatgcttgagcttgctgaggtggtacaagaaacaattgatccaaatgcaaagatagaattcagacccaacacagaagatgacccacacaagaggaagcctgatatctcgagagccaaggagctactcggttgggaacccaaagtctctctccgaaagggtctccctctgatggtttcggatttccggcaacgtatatttggtgatcataaggagggcagcagcaacaatgaagcatcatcttaaggtggcaatggcaaaaggccaatcaaatattatttcactggaaaagaactcccaacatatatagttagcagcagcagcagtttcagtttaagtcccgtttagaggttttttttcccttttttgacatgtatttgccatcttttgtaatttcccatgtctgttgtaagctttgattgacagtgctttgcaaagcttaaaaaaaaacattttaccctattctatttaatgcaatagcagcaataatatgattatacaaggtttactcctgcaaaatccaaactccttcgatcatgccctcattgccttttaatgacaattttggaattgggtcactagatatttcaatttgctctggaaatatgatcagcagcgacactgaaagctgaaacaaggcatgctaccccaatgatattgttccagtttctagtctgagcagcaacggcagcaccggcaacagcacccgctattaaagtgtttaacgggtcgttccgcttccggtatttctgaagcccacagcgagttgtggcgaatacaccagcaacgagtccactttggaagccgaattttccaacagactttgccacaaatgaagcttgagcagtaccagttaaacctcttttacgagcatcataaggggcagaacagaatccccagaatagacctgccgtagcgaatcggaggacggaatcgacggctagggaagagcagggaacaacggcggt

SEQ ID NO: 8017 - DNA, 2270 bp, Gossypium hirsutum
gggatcatcgtttacttttcaagtagaagacccgctttataaaagaccaaaagccaccgctccctttcctcggcccttctttatattgaacaatctcctcttctcctgagccggcctctaactcgctggcgactcagtcttcacaatttcttttttgaatttattctcgcgatggggtcatcggagctgatattcagaggccatgaaactcagcctgtttccgattcctattcacccaaacccgacaaaccatgggcttccgttacccgcccgattcgttacatgctccgagagcaacgccttctcttcgtcttcctcggcattgctattgccactctcattttcaccctcttcccggcctcacgtgctccgcaacacaacttcgccgattccataacctacttccccatcgacacacagagcaagttctccaacccgcaccgactcggattcggatcgtctaacccgacgggcaagatcccgttggggttaaaacgtaaaggcctgaggatcgtggtaacgggtggagccgggttcgttgggtctcacctcgtggaccggttaatagcaaggggagatagcgtgatggtggtggataacttctttaccggcaggaaagaaaacgtgatgcaccatttcggtaaccccaatttcgagcttataagacacgacgtggtggagcctttgctattggaagttgaccagatctaccatttagcgtgccctgcttcaccagttcattacaaattcaacccagtcaaaactatcaagacaaatgtggtggggacattgaacatgttaggactggcgaaaagagtaggtgcaaggttcttattaaccagtaccagcgaagtatacggagatcctcttcaacatcctcagaaggaaacttattggggcaacgttaatcccattggtgtccgaagctgttacgacgaggggaaacgtacagccgaaaccctgacaatggactatcacagaggagctggagttgaggttaggattgcccggattttcaatacttacggacctcgtatgtgcatcgatgacggtcgtgtggttagcaactttgttgctcaggcattaaggaaggagcctttgactgtgtatggtgatgggaaacagacaaggagtttccaatatgtttctgatctggtggaggggctaatgcgcttgatggaaggagaacatgttggaccttttaaccttggaaatccgggtgaattcaccatgcttgagcttgctgaggtggtacaagaaacaattgatccaaatgcaaagatagaattcagacccaacacagaagatgacccacacaagaggaagcctgatatctcgagagccaaggagctactcggttgggaacccaaagtctctctccgaaagggtctccctctgatggtttcggatttccggcaacgtatatttggtgatcataaggagggcagcagcaacaatgaagcatcatcttaaggtggcaatggcaaaaggccaatcaaatattatttcactggaaaagaactcccaacatatatagttagcagcagcagcagtttcagtttaagttcccttttagaggttttttttttttccctttttgacatgtatttgccatcttttgtaatttcccatgtctgttgtaagctttgattgacagtgagctttgcaaagcttaaaaaaaacattttaccctattctatttaatgcaatagcagcaataatatgattatatgaggtttactcctgcaaaatccaaactcctcctctcatgccctcattgccttttaatgacaattttggaattgggtcactggatatttcaatttgctctggaaatatgatcagcagcgacactgaaagctgaaacaaggcatgctaccccaatgatattgttcaagtttctagtctgcgcagcaacggcagccccggcaatggcacccgctattaaagtgtttaacgggtcgttccgcttccggtatttctgaagtccacagcgagttgtggcgaatacaccggcaacaagtccactttggaagccgaattttccaacagactttgccacaaatgaagcttgagcaataccagttaaacctcttttacgagcatcataaggggcagaacagaatccccagaagacacctgccgcagcaaatcggaggacggaatcgacggctagggaagagcagggaacaacggcggtgaactcttcttccatctcatttaatttcaatgtccaagatccggtttaatccttggttatccgcacgctg

SEQ ID NO: 8018 - DNA, 1690 bp, Gossypium raimondii
cgctccctttcctcggcccttctttatattgaacaatctcctcttctcctgagccggcctctaactcgctggcgactcagtcttcacaatttcttttttgaatttattctcgcgatggggtcatcggagctgatattcagaggccatgaaactcagcctgtttccgattcctattcacccaaacccgacaaaccatgggcttccgttacccgcccgattcgttacatgctccgagagcaacgccttctcttcgtcttcctcggcattgctattgccactctcattttcaccctcttcccggcctcacgtgctccgcaacacaacttcgccgattccataacctacttccccatcgacacacagagcaagttctccaacccgcaccgactcggattcggatcgtctaacccgacgggcaagatcccgttggggttaaaacgtaaaggcctgaggatcgtggtaacgggtggagccgggttcgttgggtctcacctcgtggaccggttaatagcaaggggagatagcgtgatggtggtggataacttctttaccggcaggaaagaaaacgtgatgcaccatttcggtaaccccaatttcgagcttataagacacgacgtggtggagcctttgctattggaagttgaccagatctaccatttagcgtgccctgcttcaccagttcattacaaattcaacccagtcaaaactatcaagacaaatgtggtggggacattgaacatgttaggactggcgaaaagagtaggtgcaaggttcttattaaccagtaccagcgaagtatacggagatcctcttcaacatcctcagaaggaaacttattggggcaacgttaatcccattggtgtccgaagctgttacgacgaggggaaacgtacagccgaaaccctgacaatggactatcacagaggagctggagttgaggttaggattgcccggattttcaatacttacggacctcgtatgtgcatcgatgacggtcgtgtggttagcaactttgttgctcaggcattaaggaaggagcctttgactgtgtatggtgatgggaaacagacaaggagtttccaatatgtttctgatctggtggaggggctaatgcgcttgatggaaggagaacatgttggaccttttaaccttggaaatccgggtgaattcaccatgcttgagcttgctgaggtggtacaagaaacaattgatccaaatgcaaagatagaattcagacccaacacagaagatgacccacacaagaggaagcctgatatctcgagagccaaggagctactcggttgggaacccaaagtctctctccgaaagggtctccctctgatggtttcggatttccggcaacgtatatttggtgatcataaggagggcagcagcaacaatgaagcatcatcttaaggtggcaatggcaaaaggccaatcaaatattatttcactggaaaagaactcccaacatatatagttagcagcagcagcagtttcagtttaagtcccctttagaggttttttttcccttttttgacatgtatttgccatcttttgtaatttcccatgtctgttgtaagctttgattgacagtgagctttgcaaagcttaaaaaaaacattttaccctattctatttaatgcaatagcagcaataatatgattatatgaggtttactcctgcaaaa

SEQ ID NO: 8019 - DNA, 1678 bp, Castanea mollissima
tcactcaccgattctccttcatttttcaccgcctcaatttccttattacacagaacacagaattttgaatcgtttaagaagaagaagatgggttcggagctgattttcagaggacacgagagccaacccgtgtcggacacgtacacaccgaaggaaccaaagccatggttctctgtgactcaaccgattcggtacatgctccgagaacaacgcctggtcttcgtcctggtcggcattgctatagccaccatcgtattcaccctccttcctgcctcctcctccacatcccgcgccgagtacggacacttcacgatcccggaaacgacgacacggctgagcctgtacgaccaaaaacccatgtacgagcaccgctctgctttccacatgtacagctctggcaaggtccccttggggctaaaacgcaagggtttgcggatcgtggtgaccggtggggccgggttcgttgggtcccacttggtcgaccgtctgatggagcgaggcgatagcgtgatcgtggtcgataacttcttcaccggaaggaaagagaacgtgatgcaccatttcgggaacccaaggttcgagctcatccgacacgacgtcgtcgagcctctcttgctcgaggtcgatcagatctaccatctcgcttgccctgcctctcctgttcactacaagttcaaccccgtcaagaccatcaagaccaatgttgtggggacattgaacatgcttggacttgcgaagagagtgggtgcgaggtttttgctaacgagcacaagtgaggtgtacggagatccgctgcaacaccctcaggtcgaaacctactggggaaacgtcaatcctattggtgttagaagctgttacgacgagggaaaacgtacggccgaaacgttgaccatggactatcatagaggtgcaggcgttgaggtgaggattgcaagaatcttcaacacctatggacccagaatgtgcatcgatgatggtcgtgtggtcagcaattttgttgcccaggcattaaggaaggagcctatgactgtttatggtgatgggaagcagacaaggagtttccaatatgtatcggacttggtggagggtctgatgcgtctaatggaaggagaacatgtaggacctttcaatctcggtaacccgggtgaattcaccatgcttgaacttgctggggtggtccgggaaacaattgacccagacgcaaagatagagtacaggcccaacacagaggatgatccccacaagaggaagcctgatatcacaaaggctaaagagctacttggctggcaaccaaaggtggaactccgcaagggtcttcctctcatggtctcagatttccggaaacgtatctttggtgaccacaaggagggcagcgctactaccgcgtagttctaagtcaggcatatatacttgaagagtgatgacagagggaaaagacaattgtttgtcggaaagcaattctcagctgtttcccttctccaaacaaaatacagtagcaacaccagaagcagcatttgagctgtttgattcttctttggaataggttttaggtgttcctccggcatttcatttccaccatcttagtaatttctgggttacaagcccatttaagcttaatagatttgtgattccaaaaagttcctttccttattttttatatttgatttgttaagaggcc

SEQ ID NO: 8020 - DNA, 1810 bp, Euonymus alatus
accaaaaccggaacccgcatatccctgaccggcgtcgtcggagaccggttctggatacaagttcttacaatagaacggattagaagtactgaagttgaatctctgagaaaatctgttgttcatttgaattttgattttagtcttcaaggagatgggatcggagctgatatacagagggcacgaggaggcccagccgactacggacggatactctccgaagccaccgaagccatggctttcggcagttcgtccgattagttacttgcttcgcgaacagagacttatctttgtcatcgttggcattgcaatagctactgttttctttactctcctcccgtcctcgtctcacggctcgtaccggcacgaaagctatgtgccgatcacggactccatctctcacttcggtcgtgactcgtacccgcagtcgaacaagccgtacgaacagcaccggatgttggttcactcaagcgggaaggtgcctttagggcttaagcggaaggggctgaggattgtggtcaccggtggggcagggttcgtcggttctcaccttgtggaccgcctgattgctaggggagatagcgtgattgttgtggacaatttcttcaccgggaggaaagagaacgtcatgcaccatttcccgaacccgagattcgagctcatccgacacgacgtcgttgagcccctgttgctcgaggttgaccagatctatcacctcgcttgccctgcctcccctgttcactacaaattcaaccccgtcaagactatcaagacaaatgtggtgggtacattgaacatgttgggactggcaaagagagttggtgcgcggttcttgctaaccagcactagcgaggtgtacggtgatcctctgcagcatccacaggtggagacttactggggcaatgttaacccaattggtgtccgaagctgttacgacgagggaaagaggacagctgagacattgacaatggactaccacagaggtgctggtgttgaggtgaggatagccagaatttttaacacgtacgggcctcgcatgtgcattgatgatggccgtgtcgttagcaattttgttgctcaggccttgaggaaggagccattgactgtttatggtgatggcaaacagacaaggagttttcaatttgtttctgacttggttgagggtttaatgcgccttatggaaggagaacatgtgggacctttcaatcttggaaatcctggtgaattcaccatgcttgaacttgctcaggtggtccaggaaacaattgaccccaacgccaagattgaattcagacccaacacggaggatgatccacataagaggaaacctgatatcacgagggctaaagatctacttggttgggaacccaaggtgtctcttcgcaagggtctacctctaatggtttcagacttcaggcaacgcatctttggtgaccacaaggaaggtagcagcagcacaacctccactgtgtcttcttaagttggttttgtttataaatagaaggagagttttaaacacggaagttctcttccccccaagggtggagcagtgggaacagcactaccagtagagctgcaattgaacctcatttgtcatttcagtcatgttcgaaacttttatgttaatttccctttcagtcttaatagacagcgagtggttgattccttaaaaagttacttcatacctatttttttctgaagccattagtgtttgttttatggtaatcataaaataggctgtattttgcagtctcatgtagtttatgaagatggaatctttattaacaaatcctgatcagcttagttgcttgct

SEQ ID NO: 8021 - DNA, 1547 bp, Glycine max
gcaccccactcttggatctgattggcgagaatgtcttcgtcttcttcgggcttgattttccgagggcacgaggcccatcccatggacgacgcctattacccgaagccgcagaagccatggctctccttcggctacctcctccgcgaacagcgtctccacttcctcctcctcggctttgtcctcgcaaccctcttcttcttcctcctcccatcatcgtccccttcccaaccccttggagcccacgacccattccccaccccttacttggagcccacccgctggcccaccaactcccgaagctacgacgtcgtctccgtgcattccgtgggaaaaatccctctcgggattaagcggaaggggctccggatcgtcgtcaccggtggggccggcttcgtcgggtctcacttggtggatcggttgattgcccgaggagacagcgtcatcgtcgtcgacaattttttcaccggaatgaaagaaaacgtgatgcaccattttgggaaccccaacttcgagctcatccgacacgacgtcgttgagcctctcctgttagaggtcgaccagatctaccatctcgcttgccccgcatcccctgtccattacaagtttaatccagtcaagactatcaagaccaacgtggtcgggacgctgaacatgctgggacttgctaaaagagtgggtgctaggttcttgttaaccagtaccagtgagatttatggtgatcctctggaacaccctcagaaggaaacctattggggcaacgttaatcccattggtgttcgaagctgctatgacgagggaaagcgtactgctgagacgttgaccatggattaccacagaggagctggagtcgaggtgagaatagctaggattttcaacacctacgggccacgaatgtgcttagatgatggtcgcgtcgttagtaacttcgtcgctcaggcactaaggaaggagcctttgacggtttatggggatgggaagcagactaggagttttcaatatgtttctgatttggtggaggggctgatgcgccttatggaaggtgaacatgttggacctttcaatcttggaaatccgggtgaattcaccatgcttgaacttgccaaggtggtacaagaaacaatagatccagaggctaagatagagtacaggcccaacacagaggatgacccacacaagagaaagcctgatattagtagggccaaggagcaactgggctgggaacccaaggtggacctacggaagggactccctctaatggtttctgacttccgacaacgcatttttggggaccaaaaggaaggaacaacctctgcctaattcttgctaggaaaatggaaattgaagttgcaaaaggggattgtagtttgcattttcatagcattagccagaaaacagttagtgggatttcccatctcttcacattagtcagagctatatacataaatttcccttttgtagtttgtcctttatgaatttttatagtatgtaatgtaccgttgatgtccatattgatgattatatttctaaaattccgacccttattcccc

SEQ ID NO: 8022 - DNA, 1681 bp, Fagus grandifolia
aacaccatttctgaccaatcctccatctctctcactcgccgaagcgaccgagttgccggcgagctaactcgtaactcagcaactcactcactcactcacccactccgcgattctcccaaaacacagaattacgaatcgttgaagaagaaaaagatggcttcggagctgattttcagaggacacgagagccagccggtgtcggacacgtactcgccgaagcaaataaaaccatggttctcggtgacccaaccgattcgctacatgctccgagagcaacgcctcgtcttcgtcctcgtcggcattgccatagccaccatcgtattcaccctcataccttcctcctcccgtgtcgactacagccacctcaccatccacgacacctatttcgaccacgacacgacacgcctcaaccccatcaaccacgacaagcccttatacgagcatcgctccgcgttcaagaattacaactccggaggcaaagtccccctgggccttaaacgcaaaggattacggatcgtagtcacaggcggtgccggtttcgtcgggtcccacctcgtcgaccgtctgatcgagcgtggcgacagcgtgatcgtcgtcgataacttcttcaccggaagaaaagagaacgtgatgcaccatttcggtaaccctaggttcgagctcattcgacacgacgtcgtcgagcctctcttgctcgaggtcgaccagatctaccatctcgcttgccctgcctcccctgttcactacaaattcaaccccgtcaagaccatcaagacaaatgtggtgggaacattaaacatgttggggctagccaagagagtcggtgcgaggtttttgctcacgagcaccagtgaggtgtacggagatccactgcaacaccctcaggtcgaaacgtattggggaaacgtcaatcccattggtgttagaagttgttacgacgagggaaaacgtacggctgaaacgttgaccatggactatcatagaggtgcaggcgttgaggttaggattgcaagaatcttcaacacctatgggccgagaatgtgcatagatgatggccgtgtggtcagcaattttgttgcccaggcgttaaggaaggagcctatgactgtttatggtgatggaaagcaaacaaggagtttccaatatgtatctgatttggtggagggtctgatgcgcctaatggaaggagaacacgtgggacctttcaatcttggaaatccgggtgaattcaccatgcttcaacttgctaatgttgtccaggaaacaattgacccagatgcaaagatagagtacaggcccaacacagaggatgacccccacaagaggaagcctgatatcacaaaggctaaagagctacttggttgggaacctaaggtggaactccgcaagggtcttcctctaatggtttcagatttccggaaacgcatctttggtgatcacaaggaagagggtgccacaactgccaagtaattctaagtcagcatataaatatacttgaagagtgaacaaagggaaaaaagataattgtctgtggaaagcaatacagtagcaacagcagcagcatatgatatgagttcatgtattcatctttggaataggtttagaggtctccctttcggcattttctttctttcatcatcttagtaattccaaatgttcctttccttattttatttttttt

SEQ ID NO: 8023 - DNA, 1949 bp, Lactuca sativa
aaactaattcaaaaggaacaccggttcaaaacaccaaagtttagactaaacccacaaaataatacttacaggaccatttttgcaattttgtcataggacaaatttaccgttttttacctgactaactttataaaggacattctcgtaattgacaagggagtgtggtatataaacacctctctacttcctccaaaaacacgcgccgcagaccgtagaggagcgtgagacaaattccacgtgccggagagtttaagccaccaccgtctgacacttttgttctatatatactccaccacttctctcccaccaccacagccttcatcgatctaaatttcacaaacacaagaaggaaaatgggatctgaactgatttacagaggccacgaaccccatcccacttcagatctatactctccaaagcctaataaaccatggtccgccgtgattccgccgattcgttacatgcttcgtgaacaacgtctcgtcttcgtgctcatcggcattgccatatctaccttcttctttacccttattccttcatccaccaccttctcttcccccaccatctccgcctacacctcctacgcagtttccggatcggctcagttaatgaaccctggaagaccagcttatcggtttaattcaggtgggaagatccctttgggtttgaaacggaaggggttaaggattgtggtgaccggcggtgcaggattcgtcggaagtcatctcgttgaccgattgattgaacgaggagacagtgtcatagtcgttgataatttcttcactggaaataaagagaacgtgatgcatcattttggaaaccctaggtttgagctcatccgacacgacgtcgtagagccgttactactggaagtcgaccagatctatcaccttgcttgccctgcttcccctgttcattacaaatacaaccccgtgaaaacaatcaagacgaatgtagtggggacattgaatatgcttggactggcgaagagagttggtgcacggttcttgctaacgagcaccagtgaggtgtacggagatcctctgcaacaccctcaagtggaaacctactggggcaacgtcaatccaatcggtgtcagaagctgctatgatgagggaaagcgtactgccgaaacactgaccatggattatcacagaggtgctggcgtcgaggttaggattgcgagaatattcaacacatatggtcctcgaatgtgcattgacgatggccgagttgtgagtaacttcgttgctcaggcgcttaggaaagaaccgatgactgtttatggagatggaaagcaaacaagaagttttcaattcgtttccgatttggtggagggtctaatgcgtttgatggaaggtgaacatgtaggcccgtttaatcttggaaatcccggtgaattcaccatgcttgaacttgctcaggtggtccaggagacgattgaccctgatgcaaaaatagagttcaggccaaacacggaggacgacccacacaagaggaagccagacatcacgaaggcgaaagatcttttgggatgggagccaaaagtggcacttcggaaaggattgccgatgatggtgtcggattttaggcagcggatatttggtgatcataataaggaccaggctgctactgcttaaggcttaactctcaaggaaggtatagacagacagacagacagagagaaagagagataaactttaattggttcgctcacaacagtaggataggtgaggaacgagctctcgtgagtgcccaatatttgtattcttcagatttaagtgtattttatgttttatggtttttccatttactaatattttatctagacaacagggacagcttcgacgtttcatttatatattttcatacataaaagtgtattgtttagaatttaactttggtatgaaatctgttattgtgttttcttaataaatattaatattaac

SEQ ID NO: 8024 - DNA, 1794 bp, Glycine max
aaaacgcacgcacccctaccttggatctgatgaggtgactctccctccctccccgccttctccgcattcattatttctttcttggtatcaaattcagattggagattgtgaattagctggcgagaatgtcttcgtctacgggcttgattttccgagggcacgaggcccaacccatggacgacgcctattacccgaagccgcagaagccatggctctccttccgctacctcctacgcgaacagcgtctccacttcctcctcctgggcattgtcctcgccaccctcttcttcttcctcctcccctctggcctccacgacccattccccactccttacttggagcccacccgctggcccaccaactccccaagctacgacgtcgtctccgtgcattccgtcggaaaaatccctctggggattaagcggaagggtctccggatcgttgtgaccggtggggccgggttcgtcggttcccacttggtggatcgcttgattgcccgcggagacagcgtcatcgtcgtcgacaatttcttcaccggaaggaaagaaaacgtcatgcaccatttcggcaaccccaacttcgagctcattcgacacgacgtcgttgagcctctcctgttagaggtcgaccagatctaccatctcgcctgccccgcctcccctgtccattacaagtttaacccaaccaacgtggtgggaacgttgaacatgctgggactggctaaaagagtgggggccaggttcttgctgaccagtaccagtgaggtttacggagatcctctggaacatcctcagaaggagacctattggggcaacgttaatcccattggtgttcgaagctgctatgatgagggaaagcgtactgctgagacgttgaccatggactaccacagaggagctggagtcgaggtgagaatagctaggattttcaacacctacgggccacgaatgtgcttagatgatggtcgcgttgttagtaacttcgttgctcaggcactgaggaaggaacctttgaccgtttatggggatgggaagcagactaggagtttccaatatgtttctgacttggtggaggggctgatgcgccttatggaaggagaacatgtgggacctttcaatcttggaaatccgggtgaattcaccatgcttgaacttgccaaggtggtccaagaaacaatagatccagaggctaagatagagtacaggcccaacactgaggatgacccgcacaagagaaagcctgatattagtagggccaaggagcaactgggttgggaacccaaggtggacctacgcaagggactccctctaatggtttctgacttccgacaacgcatttttggggaccaaaaggaaggaacaacctctgcctaattcttgctaggataatggaaattggagtttgttctacaaaatatacctcagattgagtgcaaaaggggattgtagttttgcattttcatagcattagccagaaaacagttagtgggatttcccatctcttcatagttcattagtcagctatatatacataaatttcccctttatcgtttgtcctttataaatttttattgtatgtgctattgatgtccatattgatatccagtgatgattatattcctaaaattcggtacaaagtataggagaaagtttataaacgtctaatgattaattgtgaaacggaaatatgtctgagaatttacctttggaatgagttgcaactacattgaacatcatggatatgtgccacatatcgacttattcttataaaacagacacaggatagttttaattc

SEQ ID NO: 8025 - DNA, 1966 bp, Aristolochia fimbriata
acacagagagaggaagggaaaaaaaaaaggcgttttttacacgccgggagaaagagattttgccggctttttcccggagggaaaacggaaaacggctaataagctgctgatacgccggaaaaacacctggatctcgccggtcacgagtgtaacgctctcttctccggcttatgaggattcgggaaagacggtggttgtgagttctgtttggtgaagtgatcgccgagtgtgagatattctagggaggaagatcgaggcgagttggagatattccggaatgggttcggagctgatttacagacgccatgagaaccagccggtgcctgatacctactcgcccaaacagccgaagccgtggctggccgtcgagcgtccggtcaggtacctgctccgggagcagcgactcctcttcgtcctcgtcggaatggctctcgcgactctcgtgttcaccctggcgccgcgcgctcccctctcccccgtgaagagcactcgtccgacgacgagcgatttcacggcgctggagtcgctgagtcaccgagtggcgttcgagacccagccgagttacagcttcaatccgggcgggaagattcccctggggctgaagcggaagggtcttaggatcgtggtcaccggcggcgccgggttcgtggggagccacttggtggatcggctgatcaagcgcggcgacagtgtcatcgtggtcgataatttcttcacggggaggaaggagaatgtgatgcaccattttgggaatccgaggttcgagctcatcaggcacgatgtggtggaaccgctgcttttggaggtggaccagatctaccatctcgcctgccccgcctcgcccgtgcattacaagttcaatcccgtcaagacgattaagaccaatgtagtggggacactcaacatgcttggattggcgaagcgagtcggtgccagatttcttctgacgagcaccagtgaagtttacggcgaccccttacagcaccctcaggtggagacctactggggcaacgttaacccaatcggtgttagaagttgctacgatgaggggaaacggacggcagagactttgaccatggattaccacagaggagccggagtggaggtaaggatcgctaggatctttaacacatacggccctcgtatgtgcatcgacgacggacgtgtggtcagcaacttcgtcgcccaggctttgagaaaggagccattgacggtgtatggtgacggaaaacagaccaggagtttccagtacgtctccgacctggtggagggactgattcgattgatggaaggggaacacgtgggtcctttcaatctgggtaaccctggggaattcaccatgctcgagctcgccaaggttgtacaggagacgatcgacccgaacgcccggatcgagttcaggcccaacacggaggacgacccacacaagaggaagccggacatcaccagagcgaaggagatgctggggtgggagcccaaagtggctcttcgccagggcctccctctcatggtgaaagacttcaggactcgcgtcttcggggaccagaaggaagccagttccgtcgcgtcgtagacacattaatcacagtcacggtgattgacaggagatagaagggagtgggagagagaccggtgaaaaactgatagagggtgtcgatgaattatcaaggagaaagatcagagacgaagccaacgagcttggcggagtagcactagagtctcgtaccgcccgccccccggccttctctccacagcattatagcagcaggccaatatcagtttttaccttcacattacattatgtcacatgagtttatcccttgtattaggttttaaaagtgcttctgtatttcattcccgttcccttaatattacatcatagaggcggagttagcgtaatccgatgccttctgcatataaaatcattagactgcacaactgaagtaacgtcattcttcgacatcaa

SEQ ID NO: 8026 - DNA, 1846 bp, Malus domestica
aaaacccggcacaaagcgagttgccggcgattccaactcgtttaactcagattctcaaaactcactcttcctcttccgacgcagttccgacaaatgggttcggagctgattttccgagggcacgaagccgaccaacaggtggcggacacctattcgcccaaacccccaaagccgtgggcctccgtgacccgcccgattcactacttgctccgagagcagcgcctcgttttcatcctcgtgggcattgctatcgccaccgtagtgttcaccctcctcccgtcctccgcccctatttctccgtacgccaccggtaacgtcccgatctcgaacgagtacgtccggtacgacttcgattcgtcggcgacggcccattacaagccggcctacgaccgacggttcggtttgaacagctggaattctggcggcaaggtgcctctggggctgaaacgaaaggggctccggatcgtcgtgactggcggggccgggttcgtcggatcgcatcttgtggaccgtctgattgagcgaggcgacagcgtgatcgttgtggacaatttcttcaccggaaggaaggagaatgtgatgcaccatttcggaaacccgaggttcgagctcatccggcacgacgtcgttgagcctcttctgctcgaggtcgaccagatctaccatctcgcttgccctgcctcccctgttcattacaaattcaaccctgtcaagaccattaaaaccaatgtggtggggactctaaacatgctgggtctcgcaaagaggatcggcgcgcggttcttgctgacgagcaccagcgaggtgtacggcgatcctctgcagcacccgcaggttgaaacctactggggcaacgttaatccaatcggtgtccgaagctgttacgacgagggaaaacgtacggccgagacattgaccatggactaccacagaggagctggagttgaggtcaggattgctaggatttttaacacttacgggccaagaatgtgcatagatgacggccgtgttgttagtaactttgttgctcaggcgttgaggaaagaaccgatgacggtttatggtgacgggaagcaaacaaggagcttccaatatgtttctgatctggtggaaggtctgatgcgtctgatggaaggtgaacatgtgggacctttcaatctcggaaacccgggtgaattcaccatgctcgaacttgcaaaggtggtgcaagaaacaatcgacccagcagcaaagatcgagtataggccgaacacagaggatgacccccacaagaggaaacctgatatcacaaaggctaaagacttactcggctggcaaccaaaggtgtcccttcaaaagggtctccctctcatggtctctgacttcaggaaacgcatctttggtgaccacaaggaagaaggcgctaccaccgccctgtaatatatctcccgatgttaatgtcttggcatggcaattggcaaatatacttgaattctcacttgcaaaactgcaacggggaaagacagttcctttatttcgttctctttcccgtccaattcccagacaaaatacagcagcaaagatctcgcagcagcagtagtagcaaaaacagtagcgtataagttccagcacccgtttgtatgtccttttgttcgttctgtgttgttatcgtcttaaagcttaatagaacagcgagagcttctcttttccgtcttcctattcttttctgtgccgccggtctccattagaggcggcattgataagattacataaattttcatgatatttacttcttgtattctgaattagcttctcaaaattattgatccatttcattagttacatatcaacgttcaaacaaagatgc

SEQ ID NO: 8027 - DNA, 1809 bp, Tripterygium wilfordii
gctaagtcacataacccaaaccagaccccgcccatccctgacccggcgtcatcggagatcggttccggacaccaagtttttcttttagagaagacagattcgaactactgaagttgaatctcttgagaaaaatctgttgttcatttgattgtggatttgaattttgaatttgactcttaatggagaagggatcggagctgacatacagagggcacgaggaggcccagccgaccgcggacggctacactcccaagccaccgaagccgtggctctcggtagttcgtctgattcgttacttgcttcgcgagcagagactcatcttcgtcctcgttggcattgcaattgctactgttttctttgctctcttcccgtcctcgtctcaccgctcgtaccggcacgaaagcgatgtgccgatcttggactccatctcttacttcggtcgtgactcgtaccggcagtcgaacaagccgtacgagcagcaccggatgttggtgcactcaatcgggaaggtgcctctggggcttaagcggaaggggctgaggatcgtggtcaccggtggggcagggttcgtcggttctcaccttgtggaccgtctgatcgcgaggggagatagcgtgattgttgtggacaatttcttcactgggaggaaagaaaacgtcatgcaccacttctcgaacccgagattcgagctcatccgacacgacgtcgttgagccccttttgctcgaggttgaccagatctatcacctcgcttgccctgcttcccctgttcactacaaattcaaccccgtcaagactatcaagacaaatgtggtgggtacattgaacatgctgggactggcaaagagagtcggcgctcggttcttgctaaccagcactagcgaggtgtacggtgatcctctgcaacatccacaggtggagacttactggggcaatgttaacccaatcggtgtccgaagctgttacgacgagggaaagaggacagctgagacattgacgatggactaccacagaggtgctggtgttgaggtgagaatagccagaatttttaacacgtacgggcctcgcatgtgcattgatgatggccgtgttgttagtaattttgttgctcaggccttgaggaaggagcctttgactgtttatggtgatggcaaacagacaaggagttttcaatatgtttctgacttggttgagggtttaatgcgccttatggaaggagaacatgtgggacctttcaatcttggaaatcctggtgaattcaccatgcttgaacttgctcaggtggtccaggaaacaattgaccccaacgccaagattgaattcagagccaacacagaggacgatccacataagaggaaacctgatatcacaaaggctaaagatcaacttggttgggaacccaaggtgtctcttcgcaagggtctacctctaatggtttcagacttcaggcaacgcatatttggcgaccacaaggaaggtagcacaacctccaccgtgtcgtcctaagttggttttgtttatacatagaaggagaaagggaagagtttttaaacacagcagctctcttccaccgacagtgcagatgtgggaacatcagtagcagtatagcagcaattgaacctcatttgttgtttcagtcgccttcaaaacttttatgttactttcccttccagtcttaatagacagcgagttgattccttaaaaagtttgcttcatgcctattttattcaatccattaatgtttgttttttatggtatgataatataggctgcattttgcagtcccatgcagtttatgaagttgacatct

SEQ ID NO: 8028 - DNA, 1817 bp, Theobroma cacao
agaagccccttcaccccatccccacgcgcactccgtccccaaaaccccccttccatcaccttcctcacttcgccggcgagtcagctcccggcgactcacttttccaaattctgtttattttcccctcttttgatcttataaattgagtttgatttttgaagttgtagagcaatggggtcggagctgatatacaggggccacgagacccatcctgcttcggattcatattcgcccaaacccgttaaaccatgggcctccgtcatccgcccgattcgttacatgctcagagaacaacgacttctcttcgtgcttgtcggcattgcgatagccactctgattttcaccatcttcccaacctcacgtgccccgcacgttccccaccaccactttaccacctcgatctccgattccatcacctacttccccatcgagccccagaacaagttctcctacccgcaccgggtcgggttcgagtcagccaacccgaccggtaagattccgctggggctaaaacggaagggtttgagaatcgtagtaacgggtggagccgggttcgtcgggtcccacctcgtggaccgtctgatagctagaggagacagcgtaatcgtcgtcgataacttcttcacgggaaggaaagagaacgtcatgcatcacttcggaaacccaaacttcgagcttatccgacacgacgtcgtggaacctttgctcttggaagttgaccagatctaccatctcgcttgccccgcttctccagttcattacaaattcaacccagtcaaaactatcaagacgaatgtggtggggacattgaacatgttaggcctggctaaaagagtaggtgccaggttcttattgaccagtaccagcgaagtgtacggagatcctctgcaacatcctcagaaggaaacttactggggcaacgttaatcccatcggtgtccgcagttgctacgatgagggaaagcgtactgctgaaacgttgaccatggactatcacagaggcgccggcgttgaggttaggattgccagaattttcaatacttacggacctcgtatgtgcatcgatgatggtcgtgtcgttagcaatttcgttgctcaggctttaaggaaggagcctttgactgtatatggcgatgggaaacagactaggagtttccaatatgtttctgatctggtggagggtctcatgcgcttgatggaaggtgaacacgttggaccttttaatcttggaaatccgggtgaattcaccatgcttgagcttgctgaggtcgtccaggaaacaattgacccgaatgcaaagatagagtttagacccaacacagaagatgacccacacaaaaggaagcctgatatctcaagagccaaggagctacttggttggcaacccaaggtgtcccttcgaaagggtctccctctaatggtttcagacttccggcaacgtatttttggtgaccacaaggagggcagcaacaccaacaatgcatcaacatcttaaagtggcatatatactcacagaaagaccaatcaaatataattgttcagtggaaaagaactccccccctcttttccccattgaaacaatatagttagcagcggcggcggcggcagcagcagcaaatgaagtctctttagaatagatttggagattttcctttttgacttgtgtttgccatctttgtaatttccatgtctctatcctcttttaaatcttaattgacagtgagctttgcgaatctaaaataacattttaccttttttttttattatttatgcagctgcttatgttcagcagcaatagtaattcaattctacatttat

SEQ ID NO: 8029 - DNA, 1814 bp, Cichorium intybus
cggtgttcatcctcgttcccgtgctgactaaacgggatgcacccagcatccaaagacataccttgttgcctaagactgtttgactattttcatgccggtattagtatttaaacgcctctctacttcctataaaacacacgcgccgcagatcgcagaggcgcgtgacaataactccacgtgccggtgagtttaagccaccaccgtctgacacatttggcctatatatactcctccactttcttccaccaccacaacactcatacatccaaacttcacaaacacgagaaggaaaatgggatctgagttgatttacagaggtcacgaaccccaacccacatcagatttatactctccaaagccaaacaagccatggtccgccgtgattccgccgattcgctacatgcttcgtgaacaacgtctcgtcttcgtgctcatcggcattgccattgctacattcttcttcgcctttattccgtcatccaccaccttctctccccccaccacttccgcctacacttcctactccgtttccggatcggcccagataataaaccctcaacgaccagtttatcggtttcaatcaggtggaaagatcccgttgggtttgaaacgaaaggggttaaggattgtggtcaccggcggtgcaggtttcgtcggaagtcatctcgttgaccgattgatcgaacggggagacagtgtaatagtggttgataatttcttcaccggaaataaagacaacgtcatgcatcattttggaaaccctaggtttgagctcatcagacacgacgtcgttgagccgttactactagaagtggaccagatctatcaccttgcttgtcctgcttcccctgttcattacaaatacaaccccgtcaaaactatcaagacgaatgtagtggggacattgaatatgcttggactggcgaagagagtcggtgcacggttcttgttaacgagcaccagtgaagtgtacggagatcctctgcaacatcctcaagtggaaacctattggggcaacgtcaatcctatcggtgtcagaagctgctacgacgagggaaaacgtactgccgaaacgctgaccatggattaccacagaggtgctggcgtggaggttaggattgccagaatattcaacacatatggtcctcgaatgtgcattgatgatggccgagttgttagtaacttcgttgctcaggcgcttaggaaagaaccgatgactgtttatggtgatggaaagcaaacaagaagtttccaatttgtttccgatttggtggagggtctaatgcgtttgatggaaggtgaacatgtaggcccgtttaatcttggaaatccgggtgaattcacaatgcttgaacttgcccaggtggtccaggagactattgacccggatgcaaaaatagaattcaggccgaatactgaagacgacccacacaagaggaagccggacattacaaaggcgaaagatcttttgggatgggagccaaaggtggcacttcggaaagggttgcctatgatggtgtcggacttcaggcagcggatatttggtgaccataaggacatgggtgccaccgtttaaggtatagagacagactttaattgtgtcccttcaccaacaaacgtagaggataggagagggacgagctctcgtgcccgatattcggattgtttaggttttcaaaatgtattttatgtttatgttttttctatttactaatattttatgtagagaccagggacagcgtcgaccttgtattaccttgatttttattatatattttaataaaaatgtattgcttagatttaagtttgtgatg

SEQ ID NO: 8030 - DNA, 2228 bp, Prunus mume
cgccaaatgacaaccgtttacttttcaaatgcgaaaagggtgcaagggccactctgtaaataacctccaaaccaaggccttattccccaccccctcgcagcttaaataccacaacacaaacgcacataccagcccacataaccacacgagtgagaccgacaccaccgccacagaccgagtcgccggcgagttctacccgtctaactcagttaccctcttccctatacaaattactcagagtctcgaaccgactcttcttctgaacccataaggggcagcgcaatgggttcggagctcatcttcagagggcacgacgaggcccaacatgtggccgacacctactcgccgaaaccgccaaagccatgggcctctgtgacccgcccgattgggtacttgctccgagagcagcgcctcgtcttcgttctcgtcggcattgctatagccaccgtcgggttcacgctcctcccgtcctctcgctcttcggacgttaacggcagcgtcccgatctcgaacgagtatgttaggtacgacttcgattcgtcgacccatttgacgcacaagcccgcttatgagcgccggttcgggttgacgaactggaattcgggtgggaaggtgccgctggggctgaagagaaaggggctccggatcgtggtgacgggtggggccggatttgtcgggtcgcaccttgtggaccgtctgatagagcgaggggacagcgtgatcgttgtggacaatttcttcaccggcaggaaagagaacgtaatgcaccatttcgggaaccccaggttcgagctcatccgacacgacgtcgttgagcctcttctcctcgaagtcgaccagatctaccatctcgcttgccctgcctcccctgttcattacaagttcaaccccgtcaagactattaaaaccaatgtggtggggactctgaacatgctgggtctagcgaagaggatcggagctcggttcttgctaaccagcaccagtgaggtgtacggtgatcctttgcagcacccgcaggttgaaacctactggggcaacgttaatccaatcggtgtccgaagttgttacgacgagggaaaacgtacggccgagacattgaccatggactaccacagaggagccggagttgaggttaggattgctaggattttcaacacttatgggccaagaatgtgcatagatgacggccgtgttgttagtaactttgttgcccaggcgttgaggaaagagcctatgactgtttatggagatgggaagcagacaaggagtttccaatatgtttctgatctggtggaaggtctaatgcgcctgatggaaggcgaacatgtcggaccattcaatctcgggaatccgggtgaattcaccatgcttgaacttgcaaaggtggttcaagaaacaatcgacccagatgcaaagatagagtacaggcccaacacagaggatgacccccacaagaggaagcctgatatcacaaaggctaaagacttacttggttggcaaccaaaggtgtccctgcaaaagggtctccctctcatggtctcagacttcaggaagcgcatctttggtgaccacaaggaagctggctctaccaccactcccaccaccaccaccaccatgtaataatccttccttcctctgttaatgtaggcatggccattggcatatatacttcaattctcactcagcaaactggcaatgggaaagacaattcctttctttctttcccctctccaatttccaaacgaaatacaacagcagggtcacggccacagtagcaacagcaacagcaacagtagcatataagaaattctggcacttgttttatgtccatccttgttctttatgtgttgttatcctcttaaagcttaatagacagcgagcttctcttttcggtcggtcttcctattctttcttgttatgcgaacggtgtccattagagagtgttcattagattacatgatattacttgtttgtattgtgaggagcttctccaatcactaatccattggtaatgatttgttgatatgaagcaactactcttctttggaaaaagaaaaatcccaaattctgagatgttataagacaggaatgtggtttttgaataacagattctacaggttctaaaatacagatagtatgaaatttcgaaacaataattcggagagtgatggataaagttttgcactaaagatgtcacaagcagctgatatgaagctgcattttctatg

SEQ ID NO: 8031 - DNA, 1987 bp, Citrus clementina
attttccaccaaacggagccctcatcttttcccctcccctttttataaaccaaaaccccacaactccaaaacgaaaatcgcaccaatcctgcacagcataaaacacaagccggtgactgagctctcccggcctgttcaactcagctgtagctcgtgaaaaattcaccttctcttttatatttcttctctctttgatcagctgatctcgacattggagcgaggtggggtgtgattagaaattcccgaggatggggtctgagctcatatacagaggccacgacagtcaactggcgacggattcttattcccctaaacccatcaagccatggttcgccgtgacccaaccgattcgctacatgctccgcgagcagcgactcgtgttcgtcctcgtcggcattgctatcgccaccctgttttttaccgtcattccgacgtcgtatcccgcctcgtacggtggggcccgcggccacgtagcgatctcggattcgctgtcgtattaccccgtcgagacgtaccaaagagcctacaaccctcgcgtcgggttcggggcggtgaattcgggcgggaagattcccctggggctgaaacggaaggggcttagaatagtcgtcacgggtggggcggggttcgtcgggtctcacctcgtggaccgtctgatcgcgaggggcgacagcgtgatcgttgtagataatttcttcacgggaaggaaagaaaacgtgatgcaccactttggtaacccgaattttgagctcatcagacacgacgtcgtcgagcctctcttgcttgaagtcgaccagatctaccatctcgcttgtcccgcatctccagttcattacaaattcaaccccgtcaagactattaagacgaatgtggtgggaacattgaacatgcttggattggcgaagagagtgggagcgaggttcttattaacgagtaccagtgaagtgtacggtgaccctcttcagcatccacagaaggagacttactggggcaacgtcaatcctatcggtgtccgaagttgttacgatgagggaaagcgaactgctgaaacgttgaccatggactaccacagaggagctggcgtggaggttaggattgctagaattttcaacacttatggaccccgtatgtgtatcgatgatggtcgcgttgtcagtaattttgttgctcaggctttaaggaaggagcctttgactgtatatggagatgggaagcagactaggagtttccaatttgtttctgatttggtggagggtctgatgcgcctcatggagggagaacatgtgggtccttttaatcttggaaatccgggtgaatttaccatgcttgaacttgctcaggtggtccaggaaacaattgacccaaatgcaaaaatagagttcaggcccaacactgaagatgatccacacaagaggaagcctgatatctcaagggctaaagagcttcttggttgggaaccaaaggtatcattgaggaagggtctccccaagatggtcaaagatttccggcagcgtatctttggtgaccacaaggaaggtggtgcaggtgccacccccgacaccacgtcatcggcgtaacttggcccgtgtacttcttagagtgatcaaaggaaggggaaatgtttggttgaaaacaattccccctttttcctcctcgagaacaacatatggtagccacattcaacagcagcagcggtagcagcagatgagccctttgttatctatatctggcttagatttcaaggtgccctgatataaattcgttttcctattttcttgtaattttctatgttatcctgatcctgagtttgatagacagcaagcattaccgttacaatttatccagttcttatcttccgattgtagtagaggagtttgttactgaaaataggcagtagaccacatttctttgttcctttcgttctgttttttgataatgtacttatttttgttgtttcatttcgaccataaagactcaaatcttaata

SEQ ID NO: 8032 - DNA, 1987 bp, Citrus sinensis
attttccaccaaacggagccctcatcttttcccctcccctttttataaaccaaaaccccacaactccaaaacgaaaatcgcaccaatcctgcacagcataaaacacaagccggtgactgagctctcccggcctgttcaactcagctgtagctcgtgaaaaattcaacttctcttttatatttcttctctctttgatcagctgatctcgacattggagcgaggtggggtgtgattagaaattcccgaggatggggtctgagctcatatacagaggccacgacagtcaactggcgacggattcttattcccctaaacccatcaagccatggttcgccgtgacccaaccgattcgctacatgctccgcgagcagcgactcgtgttcgtcctcgtcggcattgctatcgccaccctgttttttaccgtcattccgacgtcgtatcccgcctcgtacggtggggcccgcggccacgtagcgatctcggattcgctgtcgtattaccccgtcgagacgtaccaaagagcctacaaccctcgcgtcgggttcggggcggtgaattcgggcgggaagattcccctggggctgaaacggaaggggcttagaatagtcgtcacgggtggggcggggttcgtcgggtctcacctcgtggaccgtctgatcgcgaggggcgacagcgtgatcgttgtagataatttcttcacgggaaggaaagaaaacgtgatgcaccactttggtaacccgaatttcgagctcatcagacacgacgtcgtcgagcctctcttgcttgaagtcgaccagatctaccatctcgcttgtcccgcatctccagttcattacaaattcaaccccgtcaagactattaagacgaatgtggtgggaacattgaacatgcttggattggcgaagagagtgggagcgaggttcttattaacgagtaccagtgaagtgtacggtgaccctcttcagcatccacagaaggagacttactggggcaacgtcaatcctatcggtgtccgaagttgttacgatgagggaaagcgaactgctgaaacgttgaccatggactaccacagaggagctggcgtggaggttaggattgctagaattttcaacacttatggaccccgtatgtgtatcgatgatggtcgcgttgtcagtaattttgttgctcaggctttaaggaaggagcctttgactgtatatggagatgggaagcagactaggagtttccaatttgtttctgatttggtggagggtctgatgcgcctcatggagggagaacatgtgggtccttttaatcttggaaatccgggtgaatttaccatgcttgaacttgctcaggtggtccaggaaacaattgacccaaatgcaaaaatagagttcaggcccaacactgaagatgatccacacaagaggaagcctgatatctcaagggctaaagagcttcttggttgggaaccaaaggtatcattgaggaagggtctccccaagatggtcaaagatttccggcagcgtatctttggtgaccacaaggaaggtggtgcaggtgccacccccgacaccacgtcatcggcgtaacttggcccgtgtacttcttagagtgatcaaaggaacgggaaatgtttggttgaaaacaattccccctttttcctcctcgagaacaacatatggtagccacattcaacagcagcagcggtagcagcagatgagccctttgttatctatatctggcttagatttcaaggtgccctgatataaattcgttttcctattttcttgtaattttctatgttatcctgatcctgagtttgatagacagcaagcattaccgttacaatttatccagttcttatcttccgattgtagtagaggagtttgttactgaaaataggcagtagaccacatttctttgttcctttcgttctgttttttgataatgtacttatttttgttgtttcatttcgaccataaagactcaaatcttaata

SEQ ID NO: 8033 - DNA, 1604 bp, Vaccinium corymbosum
cgagaataagaagaagaagaaaaagtggccgaattccgggctaatttgaaacccaccaccacctccttataactcatcacccatagatacactcttacatacatatatatcttctttgtttctagagagagaagatggggtccgagttgatctacaggggtcacgagacccaatcccaatccgacgcctactcgcccaaacaacccaagccatggctcaccgtgatccgtccgattcgttacctcctccgtgaacaacgcctcctcttcgtcctcatcggcattgttatcgccaccctcttcttcaccctcctccccccttcttcttctccccagaacaccaactcgctttactttgaacccgattcgactcagctatcccaccgggtcttctaccaatcaaactcgggggggccgtttaactcgggcgggaagatcccgttggggctgaaacggaaggggcttcggatcgtggtgacgggtggggccgggttcgtagggagccacctggttgatcggttgattgggagaggggacagcgtgattgtggtggataatttcttcacggggaggaaagagaacttgatgcgccattttgggaaccctaggtttgagctgatccgacacgacgtcgttgagcctatcctgttggaagttgatcagatctatcacctcgcttgccctgcttcccctgttcattacaaattcaaccccgtcaagactattaagacgaatgtggtggggacgctgaacatgttagggctggcgaagagggtgggtgcgcggtttttgctaacgagcaccagcgaggtgtacggtgatcctctgcaacaccctcaggtcgagacttattggggcaacgtcaatcccatcggtgtccgaagttgctacgatgagggaaagcgtacggcagaaacgttgacaatggactatcaccgtggtgctggcgttgaggtgagaatcgctagaattttcaacacgtatgggcctcggatgtgcattgatgatggccgtgtggttagtaactttgttgctcaggccctgaggaaggagccattgacagtatatggtgacggcaagcagacaaggagtttccagtatgtttccgacttggtggagggtctgatgcggctgatggagggagaacatgtaggacctttcaatcttggaaatcccggagaatttaccatgcttgaacttgctcaggtggtgcaagaaacaatagactcgaatgcaaagatagaatacaggcctaacacggaggatgatccgcacaagaggaagcccgacatcacgagggcgaaagaactcctgggttgggagcccaaggtgtcccttcgcaagggtcttcctctaatggtctccgatttcaggcaacggatctttggtgaccataaagaagatggtgcctctaccaccatgtcctcagattaaacgcaagatgttggagtatccatttgagtgattgtgttcgcggtggagtgtttctggcgaatacagttcccaactcctccccactgatccaaaaggggccatagccgcggtgggattagccaacattggtgtctattgaagagttttgcgctgttccgccaccatttattt

SEQ ID NO: 8034 - DNA, 1662 bp, Panax ginseng
gagaaatgggatcggagttgatctacaggggccacgagtcccaacccatggcggatgagtattcgccgaagccaaacaagccatggctcttcgtgattcgtccgattcgctacatgcttcgcgagcaacgccttattttcgttctggtcggcattgctatcgccaccctcgtgttctccatccttccatcctcctctaacagcccttatgcagccgacggcagcggaccaaacgcgatctccgactcctacttgtcaacccagtatcctcacggggccacgtaccagaaccgggcggccggattgagagcattcagttcgggcgggaagattccgttggggctgaaaagcaaggggttgaggatcgttgttactggtggggccgggtttgttggtagtcatctagtggatcggctgatggcgagaggagatagcgtgatcgtggtggacaattttttcacgggcaggaaagaaaatgtaatgcatcattttggaaatcctaggtttgagctgatccgacacgacgtcgttgagccgttactattggaagtcgatcagatatatcatcttgcttgcccggcttctccggttcattacaagcataatcctgtgaagacaattaagacaaatgtggtgggtacgctaaacatgctaggtctggcaaagaggatcggtgcgcggttcttgctaacgagcaccagtgaggtgtacggtgatcctctgcaacacccacaggtcgagacttactggggaaatgtaaatcctgtcggtgtacgaagttgttacgacgagggaaaacgtactgcagaaacgttgaccatggactaccacagaggtgctggagttgaggtgaggattgctaggatcttcaacacttatgggcctaggatgtgcattgatgatggccgtgtggtcagtaattttgttgcccaggcgttgaggaaggagccattgacggtttatggtgatgggaagcaaacaagaagtttccaatatgtttctgatttggtggatggtctgatgcgtctgatggaaggagaacatgtgggacctttcaatcttggaaaccctggtgaattcaccatgcttgaacttgctcaggtggttcaggaaacaatagacccgaatgcaaagatagaattcaggccaaacacagaggatgacccacacaagaggaagcctgatatcacaaaggcaaaagatctacttggttgggagccaaaggtgcctctgcgtaagggtctgccactaatggtatcagacttcaggcagcgtgtcttcggtgaccagaaggaaggtgacaccacctcagcttagggaaggcaaatactcttaaactgatgcaagggatacatatttcgactcctttccctgtaagtacagcagcagccagcggaaacatgtgccgccgccttatttacgtctgcatagttttgggtgtttcaatatttcaccatttgtattttaattgctctcatccttcaagactagtgtagactacaagcctgcaaatcacataaataacttccctctacttttgtatgcaatcatcagcattggcattagcaacactgatattattagctcagtatatcgtagcgtgaattatagatgtacccagcaagtacttttagaaataaagttgggagaattatattgaaaa

SEQ ID NO: 8035 - DNA, 1955 bp, Prunus persica
ccagcccacataaccacacgagtgagaccgacaccaccgccacagaccgagtcgccggcgagttctacccgtctaactcagttaccctcttccctatacaaattactcaagagtctcgaatcgactcttcttctgaacccataaggggcagcgcaatgggttcggagctcatcttcagagggcacgaggcccaacacgtggccgacacctactcgccgaaaccgccaaagccatgggcctctgtgacccgcccgattgggtacttgctccgagagcagcgcctcgtcttcgtgctcgtcggcattgctatagccaccgtcgggttcacgctcctcccgtcctctcgctctccttacgttaacggcaacgtcccgatctcgaacgagtatgttaggtacgacttcgattcgtcgacccatttgacgcacaagcccgcttacgagcgccggttcgggttgacgaactggaattcgggtgggaaggtgccgctggggctgaagagaaaggggctccggatcgtggtgacgggtggggccggatttgtcgggtcgcaccttgtggaccgtctgatagagcgaggggacagcgtgatcgttgtggacaatttcttcaccggcaggaaagagaacgtaatgcaccatttcgggaaccccaggttcgagctcatccgacatgacgtcgttgagcctcttctcctcgaagtcgaccagatctaccatctcgcttgccctgcctcccctgtccattacaagttcaaccccgtcaagactattaaaaccaatgtggtggggactctgaacatgctgggtctagcgaagaggatcggagcgcggttcttgctaaccagcaccagtgaggtgtacggtgatcctctgcagcacccgcaggttgaaacctactggggcaacgttaatccaatcggtgtccgaagttgttacgacgagggaaaacgtacggccgagacattgaccatggactaccacagaggagccggagttgaggttaggattgctaggatttttaacacttatgggccaagaatgtgcatagatgacggccgtgttgttagtaactttgttgcccaggcgttgaggaaagagcctatgactgtttatggagatgggaagcagacaaggagtttccaatatgtttctgatctggtggaaggtctaatgcgcctgatggaaggcgaacatgttggaccattcaatctcgggaatccgggtgaattcaccatgcttgaacttgcaaaggtggttcaagaaacaatcgacccagatgcaaagatagagtacaggcccaacacagaggatgacccccacaagaggaagcctgatatcacaaaggctaaagacttacttggttggcaaccaaaggtgtccctgcaaaagggtctccctctcatggtctcagacttcaggaagcgcatctttggtgaccacaaggaagctggctctaccaccacccccaccaccaccaccaccatgtaataatccttccttcctctgttaatgtaggcatggccattggcaaatatacttcaattctcactcagcaaactggcaatgggaaagacaattcctttctttctttcccctttccaatttccaaacgaaatacaacagcagggtcacggccgcagtagcaacagcaaaagcaacagtagcatataagaagttctggcacttgttttatgtccatccttgttctttatgtgttgttatcctcttaaagcttaatagacagcgagcttctctttccgatcggtcttcctattctttcttgttatgcgaacggtgtccattagagacactgttaattagattacatgatattacttgtttgtattgtgaggagcttcttcaatcactgatccattggtaatgatatgttggtatgaagcaactactcttctttggaaaaagaaaaatcccaaattctgagatgttacaaga

SEQ ID NO: 8036 - DNA, 1564 bp, Taraxacum officinale
gcggggagccttatacatccaattttacacacattaagaaaaatgggatctgagttgatttacagaggccacgaacccctgccaacttcagatctatactctccaaagcctaacaagccatggtccgccgtgattccgccgattcgctacatgcttcgtgaacaacgtctggtcttcgtgctcatcggcattgccattgctaccttcttcttctcctttattccgtcatccaccacttcctcttcccccaccatctccgcctacacctcctacgccgttgctggatcggctcagctaatgaaccctcgacgaccagcctatcggtataattcaggggggaagatcccgttgggtttgaaacgaaaggggttaaggatcgtggtcaccggcggtgcaggtttcgttggaagtcatctcgttgaccgattaatcgaacggggcgacagtgtaatagtcgttgataatttcttcactggaaataaagacaacgtcatgcaccattttggaaaccctaggtttgagctcatcaggcacgacgttgtagagccgttactactggaagtcgatcagatctatcaccttgcttgccctgcttcccctgttcactacaaatacaaccccgtcaaaaccatcaagacgaatgtagttggtacattgaatatgcttggactggcgaagagagtcggtgctcggttcttgctcacgagcaccagcgaggtttacggagatcctctgcaacaccctcaagtggaaacctactggggcaacgtcaatcccatcggtgtcagaagctgctacgatgagggaaaacgtaccgccgaaacactgaccatggattaccacagaggtgctggcgtggaggttaggattgccagaatattcaacacatatggtcctcgaatgtgcatcgacgatgggcgcgttgtcagtaacttcgttgctcaggcacttaggaaagaacccatgactgtttatggcgacggaaaacaaacaagaagtttccaatttgtttccgatttggtggagggtctaatgcgtctgatggaaggcgaacacgtaggccccttcaatcttggaaatcccggtgaatccaccatgcttgaacttgctcaggtggtccaggagacgatcgaccctgatgcaaaaatagagttcagaccaaacacagaagacgacccacacaaaaggaaaccggacatcacaaaggcaaaagatcttttgggatgggaaccaaaagtggcacttcgtaaagggttgcctatgatggtgtcagattttaggcaaaggatttttggtgaccataatgatatgagccagggtgctactgcttaagctttttaaggtacacaacatatatagagagaaagactctaattggtgtccctttacttcacccacaaaagtaggaggataggagaggttcaagatttgcgatgtttagatttatgtgtactttatgttgttttatgggtttttttcttccatttactaatattttatgtagagaagagggacagcttcgaccttgtatcaccttgattttttatatgttatatattttaac

SEQ ID NO: 8037 - DNA, 1671 bp, Panax ginseng
aaaaaaaaccaaaacaatggcgtctgagttgatctacaggggccacgagtcccaacctgccaatgacgagtattcgcccaagcctaacaagccatggctctccgtcattcgccctattcgctacatgctccgcgagcaacgcctcattttcgtcttcgtcggcattgctatcgccaccctcttcttcgccatccttccctcttcttctatcaccaccaccacttatgtctcaggccgccgcggcccaatctccatctccgacccctacttctcctcgacccagcatccccactgggccgcgtaccagaaccgagcggttagatttgagtcgttcaatccgggtgggaagattccgttgggtctgaaaaggaaaggattgaggatcgtggttacgggtggggccgggtttgttggtagccacctggtggatcgtctgattgcgagaggggatagcgtgatcgtggtggataatttcttcacggggaggaaggagaatgtgatgcatcattttggaaaccctaggttcgagctaatccgacacgacgtcgttgagccgttgctgttggaagtagatcagatctatcatcttgcttgccctgcttctcctgttcattacaagtttaaccctgtcaagacaattaagacaaatgtggtgggtacgttaaacatgcttggtctggcaaagaggatcggtgcgcggttcttgctaacgagcaccagtgaggtgtacggagatcctctgcaacacccacaagtcgagacttactggggcaacgtcaatcctatcggtgtccgaagttgttacgatgagggaaaacgtactgctgagacattgacgatggattaccatagaggtgctggagttgaggtgaggattgccaggatatttaacacatacggacctaggatgtgcatcgatgatggtcgtgtggtcagcaattttgttgcccaggcactgaggaaggaaccattgacagtttatggcgatgggaagcaaacaagaagtttccaatatgtttctgatttggtggagggtctaatgcgcctgatggaaggagaacatgtgggacctttcaatctcggaaatcctggtgaattcaccatgcttgaacttgctcaggtggtccaggaaacaatagacccgaatgcaaagatagagtttaggccgaacacagaggatgacccacacaagaggaagcctgatatcaccaaggcaaaagatctacttggttgggagccgaaggtggcccttcgcaagggtctgcctctaatggtacaggactttaggcaacgtgtctttggtgaccagaaggaagatggtaccacctcagcttaggaaaggtgggaaggagaaattgttcaattttgtctctttttttcccatatagtacaggcatcagcatcagcagcagcagcagcagcagcagaaacacgagccccgtatacttgtctctgcatagtttgggatctttcaatagttttggtcatcttgtattttgattgctcttatcctttaagattaagattcaagcccgccagtcacagaaataactttccccccaattatcagcagtgggaactttgattttagctttccatatgagcgactcacacttgttgtatcatataattgcactgttgctgaatattagatgtcccaccatactttgc

SEQ ID NO: 8038 - DNA, 1655 bp, Amaranthus tuberculatus
cacacctttctctcctttctatttctctcttaactcggtattgattccatcttaactcaccaccgatttaactcagtttctagccgatttacaccatggcttcggagcttatctttagaggccacgaaacccagctgaaatccgatgagtattatcccaaaccgccgaaaccatggctcaccgtaactcgtccgtttcactatctcttacgtgaacaacgactcgtttttctcattctcggcattgcaatcgccgcattgattttctctgtgtttccttcttcatcatctccatcgtcaccaatcaattacaacatgcacgagtcaatcggaggagaatcgtttctaaccgctgagtcgactcggttgatgccacaccgagttatggacgggtttagatctgggaaagtacctcttgggttgaagagaaaagggttgcggatagttgtaaccggcggggctggatttgtaggatcgcatcttgtagaccgtctgattgcaagaggcgatagcgtgattgtcgtggataattttttcaccggaaggaaggaaaatgttatgcatcattttagtaaccctagatttgaattgattcgacacgacgtcgttgaacctcttctattggaagttgatcagatctatcatttggcttgccctgcttcccctgttcattacaagcacaaccctgtcaagactatcaagacaaatgtggtgggaacgttgaatatgttaggattggcaaagagagtaggtgcaaagtttcttctaacaagcacaagtgaagtgtatggtgatcctttggaacatcctcagaaagagacttattggggcaatgttaatcccattggtgttcgaagttgttatgatgaagggaaacgtacagctgaaacattgaccatggattaccatcgtggtgctggtgtcgaggtgagaattgctaggatttttaacacatacggtcctcgtatgtgcattgatgatggccgtgttgttagtaactttgttgctcaggctctaaggaaggaacccatgactgtgtatggtgacggaaagcaaaccaggagcttccagtttgtttctgacttggttgatgggttgatgcgccttatggagggtgaacatgtgggtcctttcaatttgggaaatcccggtgaatttaccatgcttgaacttgccaaggtggtccaggaaacaatagatccaaatgcaaagattgaatttagaccaaacacagaggatgatcctcacaagaggaagcccgacatctcgagggctaaagagttgctcggatgggagcctaagatcccactccgtaaaggtctacctatgatggtttcggatttcaggcagcgtatttttggagaccagaagggcggagacaccaccgcattttgatagcttacttttccggcatataaagaaaagatttctggttcgtttcgttctccctaacatcgcgtctttactgtataccgtgatctcaaggaagaggctcaagtagttgcagatttggcccgccaaattggttctcttttctcagagtatagatatgtagagtttattatagccttcagcaattttattttatatattatataaatgtcctaattttgtttcgttgctgatattattcatgtagacgctgcattaatttta

SEQ ID NO: 8039 - DNA, 2206 bp, Chenopodium quinoa
gaaatcagtcttataaacacataaaccacaatacaacacatgatgagcaatgaggccatacccaaatagttattttaaacgaatcagaacacaacacgtatatagtggactaaatctatcggatcccaaagcacgtaaacttaacacaagacatgatacgacacgtaccaatcactaattagttccaattaagctagttaatgaagactaatgtaacaacaaacattgttattagttacaccatggaacaagccaaagagagaaagaaaacaaacaagggtaccatcgtaattacccacaaatcccaaggactaaaacgcatatatttgaccattcattaaacatggcactctcagatttcagacacctacaaattcattcctcaattcctcctctcttttcccattctcacattctcccttttcttcatcttcttccttgactcaatctcaacttaccaccaaactcacatatataatcaacccgacaacaatggcgtcggaactgatcttccgaggcggccatgaatcccacctcaaatccgacgagtacgactcaccaaagcctcttaaaccatggctaaccgtaactcgtccgattcactaccttcttcgcgagcaacgactcgtgttcctcgtcctcggtatcggcatcgccacattgatcttttccctcaccccatcgtcctcctcttcgtcgccgtcatctaaaattgacatcaacatgctgcatgattcaatcggcggggaatcgttcctgaccgccgagtcaactcggctgattccgacccaccatagccgggtcagtgatgggtttagatctgggaaggtcccattagggctgaaacgaaaagggttgcggatagttgtgacgggtggggccgggtttgtcgggtcgcatcttgtggaccgtttgattgcgagaggtgatagtgtgattgttgttgataatttctttactgggaggaaagagaatgtgatgcatcattttggaaaccctaggtttgaattgatccgacacgacgtcgttgagcctcttttgttggaggttgatcagatctatcatttggcttgccctgcttcccctgttcattacaaacataaccctgtcaaaactatcaagacaaatgtggtaggaacattgaacatgttaggattggcaaagagagtaggtgcaaggttccttctaacaagtactagtgaagtttatggtgaccctttggagcaccctcagaaggagacttactggggcaatgttaatcccattggtgttcgtagttgttatgatgagggaaagcgtacagcagaaacattgactatggactaccatcgaggtgctggtgttgaggtgagaattgccaggattttcaacacttatgggcctcgaatgtgcattgatgatggtcgtgttgttagtaactttgttgcacaggccttgaggaaagaacccatgactgtttatggtgatggaaagcaaaccagaagtttccagtttgtttctgacttggttgaaggtctgatgcgcctaatggagggtgagcatgtcggtcctttcaatttaggaaatcctggtgaatttaccatgcttgaactagccaaggttgttcaagaaacaatagatccaaatgcaaagatagagttcaggcctaacaccgaggatgatcctcacaagaggaagcctgatatcagtaaggctaaagagttgcttggctgggagcctaagatcgcacttcgcaaaggtctgcccatgatggtttctgacttcaggcagcgtatctttggtgaccagaagggaggtgacaccaccaccaccgcattttaagttctgccttagcttgcgtctaaaggagcaattctggcacataaaacgatttctgctccattctccctgggcgacccttgactgtataccatcgcaaggctcgagtagttgcagatccggcttccaattggctccctttgctagattatagatatgtagagcttatagtcttcagcatttatattattatatattgtcctatttttgttcgttgctgatatccatgtagacgctgcattaatactattccgtaatcagttttttctcagctatcaggttattctttttccttatcgagggttaataatgacataaatgattataattagtagtatatgcaactaatgtattatcgtcttgtagatttaatattttaggtttttct

SEQ ID NO: 8040 - DNA, 1702 bp, Glycine max
aagcaccccactcttggatctgattggcgagaatgtcttcgtcttcttcgggcttgattttccgagggcacgaggcccatcccatggacgacgcctattacccgaagccgcagaagccatggctctccttcggctacctcctccgcgaacagcgtctccacttcctcctcctcggctttgtcctcgcaaccctcttcttcttcctcctcccatcatcgtccccttcccaaccccttggagcccacgacccattccccaccccttacttggagcccacccgctggcccaccaactcccgaagctacgacgtcgtctccgtgcattccgtgggaaaaatccctctcgggattaagcggaaggggctccggatcgtcgtcaccggtggggccggcttcgtcgggtctcacttggtggatcggttgattgcccgaggagacagcgtcatcgtcgtcgacaattttttcaccggaatgaaagaaaacgtgatgcaccattttgggaaccccaacttcgagctcatccgacacgacgtcgttgagcctctcctgttagaggtcgaccagatctaccatctcgcttgccccgcatcccctgtccattacaagtttaatccaaccaacgtggtcgggacgctgaacatgctgggacttgctaaaagagtgggtgctaggttcttgttaaccagtaccagtgagatttatggtgatcctctggaacaccctcagaaggaaacctattggggcaacgttaatcccattggtgttcgaagctgctatgacgagggaaagcgtactgctgagacgttgaccatggattaccacagaggagctggagtcgaggtgagaatagctaggattttcaacacctacgggccacgaatgtgcttagatgatggtcgcgtcgttagtaacttcgtcgctcaggcactaaggaaggagcctttgacggtttatggggatgggaagcagactaggagttttcaatatgtttctgatttggtggaggggctgatgcgccttatggaaggtgaacatgttggacctttcaatcttggaaatccgggtgaattcaccatgcttgaacttgccaaggtggtacaagaaacaatagatccagaggctaagatagagtacaggcccaacacagaggatgacccacacaagagaaagcctgatattagtagggccaaggagcaactgggctgggaacccaaggtggacctacggaagggactccctctaatggtttctgacttccgacaacgcatttttggggaccaaaaggaaggaacaacctctgcctaattcttgctaggaaaatggaaattgaagttgcaaaaggggattgtagtttgcattttcatagcattagccagaaaacagttagtgggatttcccatctcttcacattagtcagagctatatacataaatttcccttttgtagtttgtcctttatgaatttttatagtatgtaatgtaccgttgatgtccatattgatgattatatttctaaaattccgacccttattcccccttagccatgatattcggtactaaagtatacaagaaagtttataaacgtctaatgattaattatgaaacggaaatatgtctgagaatttacctttggacatgagttgcaaaaacattgaacctaatggagatgtgccgcatatcaaattattcgaataaaacagacac

SEQ ID NO: 8041 - DNA, 2255 bp, Valeriana officinalis
ttctgaggaagaagaaaggaagaaaaaccaaaaaatgggatcttcagagttgttctacagaggccatgactctcaaccttcgtccgcagcttactctcccaaaccttcaaagccattactcaccgttattcgacctattcgttacatgctcaaagagcagcgtttgatcttcgtcttcctcggcattgcgatcgctactctcgttttcaccttcattcctgctgcatcaaaatcgtctcctttacgcgagagtactcgcggccgattagctctctcagatccgtatttttcggttgagtctgggtatcatagccacgctgctgcagcgattggatcgtttcattctggaggtaagattccgttagggcttaaacgaaaggggctgaggattgtggttactggtggggcaggatttgtcggcagccacctcgttgatcggttgatggcgagaggagatagcgtgattgtcgttgataatttcttcactggaaggaaggagaacgtgatgcatcattttggaaatccgaggtttgagttgatcagacacgacgtcgttgagcctcttctgttggaagtcgatcagatctatcatctcgcttgtcctgcatctccggttcactacaagttcaatcctgtcaaaactatcaagacaaatgtggtaggaactttgaacatgctagggctcgcgaagagagtcggtgcacgatttctgctaacgagcaccagcgaggtgtacggagatcctcttcagcatccgcaggtggaaacctactggggaaacgtcaatccaatcggtgttcgtagttgctatgacgagggaaaacgcacggctgagacattgaccatggattatcatagaggtgctggcgttgaggtgagaattgcaaggatatttaacacatatggtcctagaatgtgcattgatgatgggcgtgttgttagtaattttgttgctcaggcgttgaggaaggagccattgactgtttatggggacggcaagcaaaccagaagtttccaatacgtttctgatttggtcgagggtttgatgaggctgatggaaggagaacatgttggaccatttaatcttggtaatcccggtgaattcaccatgcttgatctagctcaggtggttcaagagacgatagatccgaatgcaaagatagagttcaagccaaacacagaagacgatccgcacaaaaggaagccagacattacaaaggcgaaagatctgctcggttgggagccaaagattgcccttcgcaagggtctccctttgatggtttctgatttcaggcaacgcatattcggtgaccacaaggaccattcttcttcttccgagtaaattctttctttctcaaaacttaccctttatattagtctccttatacttccaaagagaaatataaagaaagatgccgagttgaaaaaaacaacaccatctctccgatatatagcttgcagcagagagtagcttcttcgatatatctattttccatctacattaatttcgctgcttatttagtatgtaatttcaccttttcggtcttattattaatttttatgtacaatacaattgagaagccttttgcaatttggaagaatatccttgtttctgcatttgatttgcataaaattcattaactttgaatatcgaaaacaccgacatgaatatagaaacaacatattgtcatctaacaaactggagaaaacaccacaaaagcaaaacctactccactcattaaaacttgcacaaacattgaacctagtgggctcaagtatagtgcttcttgcttctgcatcagattacctcctattattggtgatcacttgggatttctaaggacaatgatgactgaatctccgcggagaaacatcttgctgataaacctgtctttgttcaccggaagtgcttttttctttccctttccggttttcggtacctcagtccacatctctcgaacattttcaagaaccatgttgcaatgtcggtcaaaagctctcacacgtcctagaagcttcttgttgtttctgcagttgataagcacctgtgtgttgtttttgacactcatcataagtacagaaagaggtcctgtgttgaactcctcttcctcattctttgctggtacatcttcatccattgggcggctcatcttaaacgcaagcgacgaaatcttcgagctgcctagaaacgattatatgcaaatggatcgtgaaacctggggttttggagttcgagctcgaccagctccgtcttc

SEQ ID NO: 8042 - DNA, 1988 bp, Humulus lupulus
tttttattacttatttacccctctgcacctttctcctcttctcctactcctatatatacacaaatatctttgagctctttcatttgtatatgatcctctctcgagttgaaccccgagtcactcagtaatttgagggaggaaaataaaaagaaataaaccgagtctcgaaaccccaaaatcttccgaatcgaaacgtttcaccgaagaagacaagggtttcaatgagttcggcgcttactttcaggggtcatgagacccaaccggtggccgatacctactcgcccaagccccccaagccatggttagccgtgacccgtccgattcgctacatcctccgcgaacaaaggttgatattcgtcctcatcggcattgctatcgcgactctggggttcacattactcccgtccaaccaagctccccaaaggtatagctccgcgatctttgattcgttcccggccgagctcgaatcgagccacttgagtcatcgcccggtgtacaacgagcgccgtttcgggattcagagctggaattccggcgggaagattccgttgggcctgaagagaaaggggaaacggatcgtggtcaccggtggagcaggtttcgtcgggtcgcacctggtggaccgtctgatggagcgtggtgacagcgtgattgtcgttgataattttttcacaggaaggaaagagaacgtgatgcaccatttcgggaaccccagattcgagctgatccgacacgacgtcgttgagccacttctcctcgaggttgaccagatctatcacctggcttgcccggcctcccctgtccattacaagttcaaccccgtcaagactattaagactaatgtggtgggtactctgaatatgctcgggttagcgaagcgggtgggtgccaggtttctgctaacgagcaccagtgaggtatacggtgatcctctacaacaccctcaggttgaaacttactggggaaacgtcaatcccattggtgtccgaagttgttacgatgagggcaaacgtacggccgaaacgttgaccatggactatcacagaggcgctgaagttgaagttaggattgccaggatctttaacacgtatggacctagaatgtgcattgatgatggtcgtgttgttagtaattttgttgcccaggctttgaggaaggagcctatgactgtttatggtgatggaaagcaaacaaggagtttccaatatgtttctgatctggtggaaggtcttatgcgcctcatggaaggagaacatgtaggacctttcaatctgggaaacccgggtgaatttaccatgcttgaacttgccaaggttgtccaggaaaccattgacccagatgcaaagatcgagcacaggcccaacacagaggatgacccccacaaaaggaaaccggacattaccaaggctaaagaacaattgggctgggaaccaaaggtgtcccttcgcaagggccttcctcttatggtcaaagacttccgtcaacgcatttttggtgaccacaaggaaggtggttcatccacaacagcttaatccccaagtttgagggaaatttatacttggaagtggtacccgggaaagaaatttgttcacttactagaaaaagagtactcctagcttttccctacttccaaacgatacagtaacagcagaagaggtagcacagctatattcgttctctttcggaatagatcctcttaggtggtccacttggcatttgttttatgtctatctttgtaaccttgtctcagttatcctctttaagcttcaatagacgatgagctttctgatttttaaaattccttgttatggtatttagcttgcacattcttcctactgtatagcgactctggcttttgaacaaagatgggggataaaagttgagcttcaagcccaactaacagaatgaaagaacattgtttacttcagtagtagttaataagtctgtgagggattgaatcgaaaacgaaaatacaaaaacaaagttat

SEQ ID NO: 8043 - DNA, 1703 bp, Ocimum basilicum
gccccacttcttctcaaccccacgctctccacgcgccggcgggttgacggaaattctccctccattttcacgcacttcgcacacacatagtcgccggaaaacagctccggtgacgcttcgtttccaaatctcgccgagattcgatctccgatctgaactgttattgaatttttgagaagaaaatggcgtcggagttgatattccgcggccacgagtcgcaccaggtgagcgacgtctactcgccgaagccggcgaagccgtggctgagcgtgactcggccgattcggtacctcctccgcgagcagcgcctggtgttcgtcttcgtcggcattgcaatcgccactctgttcttcaccgtaattccttcgtcgtcgaactcgatgaaatcgccgatctccgactcgtacattccatccgagttgactcagtcgcagccgcaccgatcgatgtatcagaacggccacctcacgaccggattcggcatcaactcggtcggcaaaatcccgctcggactgaagcggaaaggtctccgcatcgtcgtcaccggcggcgccggcttcgttggcagccatctcgtggatcgcctcatcgcgaggggagacagcgtgattgtggtggataacttcttcaccggtaggaaggagaatctcgtccaccatttcggtaaccctaggtttgaactcattcgacacgacgtcgttgagccgctacttctggaagtcgaccagatctaccatctcgcctgccctgcctcgccggtccactacaagcacaatccagtcaaaacaatcaagacgaatgtggttggaactttgaacatgctcggcctggcgaagagagtcggtgcgcggtttctgctgaccagcaccagcgaggtgtacggagatcctctgcagcacccgcaagttgagacctactggggaaacgtcaatccaatcggtgtccgaagctgctacgatgaagggaagaggactgctgaaactctgaccatggattatcacagaggcgctggcgttgaggtccggattgctaggatcttcaacacttacggtcctcgtatgtgcatcgatgatggtcgtgttgtcagcaacttcgttgctcaggcgttgaggaaggagccgctcactgtttatggcgacggcaagcagacaagaagttttcagtttgtttctgatcttgtcgagggattgatgcggttgatggaaggggagcacgtcgggcccttcaatctcggcaacccaggcgagttcaccatgctcgagctcgcagaggtggtccaagaaaccatcgatccaaacgccaagatcgagttcaggcccaacaccgaagacgatccccacaagagaaaacccgacatctccaaggccaaggagcttcttgggtgggagcccaaagtccccctccggaaaggtctcccaatgatggtgtccgacttcaggcaacgcatcttcggcgatcacaagcaagacagcgcaacctctgcgtaaaccatgagagattaacctaaaaggaagagaggagaggctgaaaattctgcaagctagctagttgcctagagggttattttgtgagattactattatgtttcttttctctattttttttcactttcaccttttactgcccatattgtttgccattttaagtctttgtgtagacgcttttatccatttacataaaatacctccataatttttgcattc

SEQ ID NO: 8044 - DNA, 2083 bp, Panax ginseng
ttccttggatttatttctctctcctaagagtcctaatcaatcagatacacataaccagatttacagagtgggagaaaagaaaaaaaaaaccaaaacaatggcgtctgagttgatctacaggggccacgagtcccaacctgccaatgacgagtattcgcccaagcctaacaagccatggctctccgtcattcgccctattcgctacatgctccgcgagcaacgcctcattttcgtcttcgtcggcattgctatcgccaccctcttcttcgccatccttccctcttcttctatcaccaccaccacttatgtctcaggccgccgcggcccaatctccatctccgacccctacttctcctcgacccagcatccccactgggccgcctaccagaaccgagcggttagatttgagtcgttcaatccgggtgggaagattccgttgggtctgaaaaggaaaggattgaggatcgtggttacgggtggggccgggtttgttggtagccacctggtggatcgtctgattgcgagaggggatagcgtgatcgtggtggataatttcttcacggggaggaaggagaatgtgatgcatcattttggaaaccctaggttcgagctaatccgacacgacgtcgttgagccgttgctgttggaagtagatcagatctaccatcttgcttgccctgcttctcctgttcattacaagcataaccctgtcaagacaattaagacaaatgtggtgggtacgttaaacatgcttggtctggcaaagaggatcggtgcgcggttcttgctaacgagcaccagcgaggtgtacggagatcctctgcagcacccacaagtcgagacttactggggcaacgtcaatcctatcggtgtccgaagttgttacgatgagggaaaacgtactgctgagacgttgaccatggattaccatagaggtgctggagttgaggtgaggattgccaggatatttaacacatacggacctaggatgtgcatcgatgatggtcgtgtggtcagcaattttgttgctcaggcactgaggaaggaaccattgacagtttatggcgatgggaagcaaacacgaagtttccaatatgtttctgatttggtggagggtctaatgcgtctgatggaaggagaacatgtgggacctttcaatctcggaaatcctggtgaattcaccatgcttgaacttgctcaggtggtccaggaaacaatagacccgaatgcaaagatagagtttaggccgaacacagaggatgacccacacaagaggaagcctgatatcactaaggcaaaagatctacttggttgggagccaaaggtgccccttcgcaagggtctgcctctaatggtacaggactttaggcaacgtgtctttggtgaccagaaggaagatgataccacctcagcttagggaaggtgtttaacgtttaaattgattagagaaggagagattgttcaattttgtctctttttttcccatatagtacagcagtagcagtagcagcagcagcagaaacaccagccccatatacttgtctctgcatagtttgggatctttcaatagttttggtcatcttgtattttgattgctcttatcctttaagattaagattccagcccgccagtcacagaaataacttttcccccaattatctgcagtgggaactttgatattagctttccatatgcgtgactgaatttcccaaatcacacttgttgtatcatataattgcactgttgctgaatattagatgtcccaccataccttgcagtacgttttagtatatgttacgttacaagtagtactattatagttctgaattgatttattatattttagcagatactcttatagttgtgctttgatatatgatccaagtgctggattattgggttttcaagtgtcggtttccatatcctagacgaacataaaccggaggtatgtgcctgcaaaactctcaccattaaccaacagtaaattcattaggggtatgtgactaaaacctttccccttacgtttttacccctacttttacgttaacgtggtccaataattattttgtatttatgtagtacc

SEQ ID NO: 8045 - DNA, 1818 bp, Panax ginseng
tggtatcaacgcagagtacgcggggagacattcacacaaactctcccttcttcttcatttctttctttttccttggatttatttctctctcttaagagtccttatcaatcacatacacataactagatttacagagagggagaaaaagaaaaaaaaaacccaaaacaatggcgtctgagttgatctacaggggccacgagtcccaacctgccaatgacgagtattcacccaagcctaacaagccatggctctccgtcattcgtcctattcgctacatgctccgcgagcaacgcctcattttcgtcttcgtcggcattgctatcgccaccctcttcttcgccatccttccctcttcttctatcaccaccaccacttatgcctccggccgccgcggcccaatctccatctccgacccctacttctcctcgacccagcagccccactgggccgcctaccagaaccgtgcggttagatttgggtcattcaatacgggtgggaagattccgttgggtctgaaaaggaagggattgaggatcgtggttacgggtggggccgggtttgttggtagccacctcgtggatcgtctgattgcgagaggggatagcgtgatcgtggtggataatttcttcacggggaggaaggagaatgtgatgcatcattttggaaaccctaggttcgagctaatccgacacgacgtcgttgagccgttgctgttggaagtagatcagatctaccatcttgcttgccctgcttctcctgttcattacaagcataaccctgtcaagacaattaaaacaaatgtggtgggtacgttaaacatgcttggtctggcaaagaggatcggtgcgcggttcttgctaacgagcaccagtgaggtgtacggagatcctctgcagcacccacaagtcgagacttactggggcaacgtcaatcctatcggtgtccgaagttgttacgatgagggaaaacgtactgctgagacgttgaccatggattaccatagaggtgctggagttgaggtgaggattgccaggatatttaacacatacggacctaggatgtgcatcgatgatggtcgtgtggtcagcaattttgttgcccaggcactgaggaaggaaccattgacagtttatggcgatgggaagcaaacaagaagtttccaatatgtttctgatttggtggagggtctaatgcgcctgatggaaggagaacatgtgggacctttcaatctcggaaatcctggtgaattcaccatgcttgaacttgctcaggtggtccaggaaacaatagacccgaatgcaaagatagagtttaggccgaacacagaggatgacccacacaagaggaagcctgatatcaccaaggcaaaagatctacttggttgggagccgaaggtggcccttcgcaagggtctgcctctaatggtacaggactttaggcaacgtgtctttggtgaccagaaggaagatggtaccacctcagcttaggaaaggtgggaaggagaaattgttcaattttgtctttttttccctattatagtacaggcatcagcagcagcagcagcagcagcagaaacacgagccccgtatacttgtctctgcatagtttgggatctttcaatagttttggtcatcttgtattttgattgctcttatcctttaagattaagattcaagcccgccagtcacagaaataactttccccccaattatcagcagtgggaactttgattttagctttccatatgagcgactcacacttgttgtatcatataattgcactgttgctgaatattagatgtcccaccataccttgcag

SEQ ID NO: 8046 - DNA, 1906 bp, Populus trichocarpa
ccaaatccacaccatcaccacctccgtgaatcgaaggtgagagagcttctctccaggcgagcctgtctctcgtttctgaattgacccaaacactctccacgcgaaaagacatttttgtttctttgttggttcttgtgatctgatacaaaagatgggatcctcggagctgatttttagaggtcatgacgagactcaaccagcatctgatgcttactcacctaaaccaccgaagccatggctcgccgtcacccgacccattcgttacctgcttcttgagcagcgactcgtctttatcctcgtcggcattgctattgccactcttttcttcactctcctgccttcttcctcttcctcatccccttacgaacacgatccaatcccaaacactttctctcacttctctcatgagttaacaacccctatgcgttacaaatactacgagccccttcgggtaggactccaatcagccaattccggcggcaagattccgctgggactcaagagtaaaagtctccgaatcgttgttacaggtggggctgggtttgttgggtctcacttagtggaccgtctgatcgctagaggagatagcgtgatcgtggtggataattttttcacgggaaggaaagagaacgtgatgcaccattttaagaacccgagatttgagttaatcagacacgatgttgtcgagccactgttgttagaagtggaccagatctaccatcttgcttgtcctgcatcgcctgttcattacaagcacaacccggtcaagacaataaagactaacgtcgtgggcacattgaatatgttgggtttggctaagagagttggtgctaggtttttgcttaccagtaccagcgaggtttatggtgatcctttacagcatcctcaggtcgagacttactggggcaacgttaatcccatcggtgtcaggagttgttacgatgaaggaaagagaactgctgagacattgactatggactatcaccgaggtgctggtgtagaggttaggattgctagaattttcaatacttatggacctcgaatgtgcatagatgatggccgtgttgttagtaattttgttgctcaggcactaaggaaggagcctatgactgtttatggtgatgggaaacagacaaggagttttcaatttgtttctgatttggttgagggtctgatgcgccttatggaaggagaacatgtagggcctttcaatcttggaaatccgggtgaattcaccatgctcgagcttgcccaggtggtccaggaaaccattgacccaaatgcaaggatagaattcaggcctaacacagaagatgacccacacaagagaaaacctgatattacaaaggctaaagatctccttggctgggaacctaagatatcccttcgtcaaggtctgccaatgatggtgtcggacttcaggcaacgcgtcttcggtgaccacaaggaagaaggtacgacctccaccatgtcaacatcttaagtcggcatatatatgcagctcgagagccaacagaatggtaatttctccagtggataaccaatttattttttccccacccccaacaatataggaagtggtcgtagcagcaacaacagcagatgagcgttgttctctgaggaatagatttggagctgttcttttggcctttgtttgagtcatccttgtaatttcaatgttactgtccccttcaaagaatgtcaggcagtgagccctgcaattaaaattaaattttacctagtttttgatgcaattgatatgcctagcagcattagaaataagcttacctcctgttttctcgttcactgcatgaatgtgttagtcttgtttcatacgctgtccttattgccagtagaaaagttagaaatcacacgggcctacagattttgatgctcgcaggatttt

SEQ ID NO: 8047 - DNA, 2254 bp, Panax ginseng
attcacacaaactctcccttcttcttcatttctttctttttccttggatttatttctctctcctaagagtcctaatcaatcagatacacataaccagatttacagagagggagaaaagaaaaaaaaaaaaccaaaacaatggcgtctgagttgatctacaggggccacgagtcccaaccagccaatgacgagtattcgcccaagcctaacaagccatggctttccgtcattcgccctattcgctacatgctccgcgagcaacgcctcattttcgtcttcgtcggcattgctatcgccaccctcttcttcgccatccttccctcttcttctatcaccaccaccacttatgtctcaggccgccgcggcccaatctccatctccgacccctacttctcctcgacccagcatccccactgggccgcctaccagaaccgagcgattagatttgagtcgttcaatccgggtgggaagattccgttgggtctgaaaaggaagggattgaggatcgtggttacgggtggggccgggtttgttggtagccacctggtggatcgtctgattgcgagaggggatagcgtgatcgtggtggataatttcttcacggggaggaaggagaatgtgatgcatcattttggaaaccctaggttcgagctaatccgacacgacgtcgttgagccgttgctgttggaagtagatcagatctatcatcttgcttgccctgcttctcctgttcattacaagtttaaccctgtcaagacaattaagacaaatgtggtgggtacgttaaacatgcttggtctggcaaagaggatcggtgcgcggttcttgctaacgagcaccagtgaggtgtacggagatcctctgcagcacccacaagtcgagacttactggggcaacgtcaatcctatcggtgtccgaagttgttacgatgagggaaaacgtactgctgagacgttgaccatggattaccatagaggtgctggagttgaggtgaggattgccaggatatttaacacatacggacctaggatgtgcatcgatgatggtcgtgtggtcagcaattttgttgctcaggcactgaggaaggaccattgacagtttatggcgatgggaagcaaacacgaagtttcctaatatgtttctgatttggtggagggtctaatgcgcctgatggaaggagaacatgtgggacctttcaatctcggaaatcctggtgaattcaccatgcttgaacttgctcaggtggtccaggaaacaatagacccgaatgcaaagatagagtttaggccgaacacagaggatgacccacacaagaggaagcctgatatcaccaaggcaaaagatctacttggttgggagccgaaggtgccccttcgcaagggtctgcctctaatggtacaggactttaggcaacgtgtctttggtgaccagaaggaagatggtaccacctcagcttaggaaaggtgggaaggagaaattgttcaattttgtctcttttttcccatatagtacaggcatcagcatcagcagcagcagcagcagcagcagaaacacgagccccgtatacttgtctctgcatagtttgggatctttcaatagttttggtcatcttgtattttgattgctcttatcctttaagattaagattcaagcccgccagtcacggaaataactttccccccaattatcagcagtgggaactttgattttagctttccatatgagcgactcacacttgttgtatcatataattgcactgttgctgaatattagatgtcccaccatactttgcagtacgttttgttcttaaaaagtttgtcgtttacaacttttgaagagaataatttttttattattatccttagtttttcttattgtctcgagaaattctctattttgtattaatggttttcaacttctaatgaaattttaaacaattttattggtaaatgatagtactttttaatttatgttcaaaaattttaaacgacaattttttagtagcagaagtatgttagtataattgtgttttgatatatgatccgagtgctggattgttgggttttcaagtgttggtttccatgtccctagacaacataaaccggaggatgtacctgcaaaaactctcaccattaaccaacagtaaattcattgggggtatgtgcaaaactttcccctcgtttttacccacttttgtaatcattgaccaattcatgcaaaacagtcgtgggaggcaaggcacacaggggatagg

SEQ ID NO: 8048 - DNA, 1810 bp, Spinacia oleracea
cagaataaaccaaacaaaggaagaaagaggggtatcgtcgtaattacacgctaatcccaaactcatatttaaccattaaccatagcattcttagttttcggacacctacaaattcctcatttcctcctccctctctctttctcacctcactttctctctcccccattctctcaactcggtctcgattccatctcaactcatcaccgagtcgattcattcccaccgccgcccttcccgagccggctcacatggcttcggagctgatcttccgaggcgggcacgaatcccctctcaaatccgatgagtacgattcacccaagccacaaaagccatggctcaccgtgacccgtccgattcactacctcctccgcgagcaacgccttgtattcctcattgtcggcattgtcatcgccaccctcattttctctctcctcccctcctccaccgttaccaccaccccctcattgaactacaacatgcacgattcaatcggcggggaatcgttcctcaccgctgagtcaactcggttaatgccgacacaccgagtcaccgacgggtttagatctgggaaggtcccattggggctgaaacgtaaagggctgcggattgtcgtcaccggtggggccgggttcgtaggatcgcatctcgtggaccgtctgattgccagaggcgatagcgtgatcgtagtggataatttcttcactggaaggaaagaaaatgtgatgcaccatttcggaaaccctaggtttgaattgatccgacacgacgtcgttgaaccgctgttgttggaggttgatcagatctatcatttggcttgccctgcttcccctgttcattacaagcacaaccccgtcaaaactatcaagacaaatgtggtaggaacgttgaacatgctaggattggcaaagagaataggtgcaagattcctgttaacaagcacaagtgaagtttatggtgatccattagaacatcctcaaaaggagacctactggggcaacgttaatcccattggtgttcgtagttgttatgatgagggaaagcgtacggcggaaacattggccatggactaccatcgaggagctggtgttgaggtgagaattgctaggattttcaacacctatgggcctcggatgtgcattgatgatggccgtgtcgttagtaactttgttgcacaggccttgaggaaggaacccatgactgtttatggtgatggaaagcaaaccaggagtttccagtttgtttctgacttggttgagggtctaatgcgcctaatggagggtgagcatgttggtcctttcaatctaggaaatcccggtgaattcacaatgcttgaacttgccaaggtggttcaagaaacaatagatccaaatgcaaagatagaattcaggcctaataccgaggatgatcctcacaagaggaaaccagatatctcaaaggctaaagagttgcttggatgggagcctaagatagcacttcgtaaaggtctgccaatgatggtttcagacttcaggcagcgtatcttcggtgaccagaagggaggagacaccaccgctttttaagataaaactagcaatttccggcacataaaatgatatctgcttcaatctccatagccgttactctaatgttataccatcacaaaggctcaaagtggttgcagatttggcctccaattggttcccttctctagattatagatgatatgtagagttatagccttcagcatttatatttcataatgtcctatttttgttcgttcttgctcatattcatgtagacgttgcattaatactaaaaattatttctcaaa

SEQ ID NO: 8049 - DNA, 1721 bp, Mesembryanthemum crystallinum
gcctcgtgccgaattcggcacgaggctgacactgagttaactcagtgccgatttcactccaactcggagccgatccgagtcgcaagagatcgaattcgagatcaaaattcacaaacctcagaatcaagggaatataaaggaaaacaaaaatccatcaaaattcagtgacgtcgattcggatgggttcggagctgattttcagagggcatgaagcccagcaccaatctgacgagtactcgccaaagccaccgaagccatggctcgccgtgactcggccgattcactacctcctacgcgagcagcgactcgttttcctcctcgccggcattgccattgccaccgtgatcttcgccttctctccctcctcgtcaacctcctcctcagccgccacattcgcatccaacacttacatgcatgactcaatcggcggtgaatcgttcctcaccgccgagccgactcggctggtgccccaccgagtcgtcgacgcgttcagatccggaaaggtaccgctcggactgaagcggaaggggctgcggatcgtggtcaccggtggggcaggattcgttggttcacatcttgtggatcggttgatcaagaggggtgatagtgtgattgttgttgataatttcttcactgggaggaaagagaatgtgatgcatcattttggaaaccctaggtttgagatgattcgacacgatgtcgttgagccaatccttttagaagttgaccagatctatcatcttgcttgccctgcttctcctgttcattacaagcacaaccctgttaagactatcaagacaaatgtggtgggaacactcaacatgttgggattggcaaagagagttggcgccaggtttttgctaaccagcaccagtgaggtgtacggtgaccccttggagcaccctcagaaggagacttactggggcaacgttaacccaatcggtgtccggagttgttatgatgagggcaagcgtacagccgaaacattggccatggactaccaccgaggtgcaggtgttgaggtgagaattgctaggatcttcaatacttatggacctcggatgtgcattgatgatggtcgtgttgttagtaactttgtcgcacaggccctaaggaaggagccaatgacagtttatggtgatggaaagcaaactaggagtttccagtttgtttctgacttggtggagggactcatgcgccttatggagggtgaacacgtggggcctttcaatcttggaaatcctggtgaattcaccatgcttgaacttgctaaggtggtccaggaaacaatagacccaaatgcaaagatcgagttcaggcccaacactgaggatgatcctcacaagaggaaacccgacatctccaaggctaaagagcagctcggctgggagcccaagatcccacttaaagaaggtctgcctatgatggtttccgacttcaggcagcggatattcggtgaccagaagcaagcagacaccaccgcgttttgagccttcgcagtacgcacacacttagctggcatttagcaactccggcacataaaaccaattcagctctaacgtgcctcatctttatatctctcttctgtataacgcctcgaggctgcatagtagcagatgagctcccattggtttggttctcaaaagtataggtttagatttatagctttcagcatttatatttgttatattaattgttccctcttttttgttctatgttcc

SEQ ID NO: 8050 - DNA, 1752 bp, Vitis vinifera
gccagagtttccggcaagttttcctggaaagcaacggatgtgccggcgactgcaagtcacctgatctttgtttctatataacgtattcgccgtcttgatccaacctcctactccttcttggttgtgttgtttgattggagtaattgagagaaatggggtcggagctgatattcagaggccacgaaacgcagcccatggctgatgggtactcgccgaaaccccccaagccgtggctttccgtggttcgtccaattcgctacatgcttcgcgagcagcgccttcttttcacgctcgtcggcattgctatcgccaccgtggtgttcctcctcctcccatcttctcctgctccgtacacccaccggttcgacccgatctcggactcctacttcccctcggagacgacgacccagctggctcaccgggtggcgtacgccgggcacggcggcggagggtttgggtttgtgaattctggggggaaggtgccgctggggctgaagcggaaggggctgaggatagtggttaccgggggagctggtttcgtggggagccacctggtggacaggctgattaggagaggagacagcgtgattgtggtggataattttttcacggggaggaaagagaacgtgatgcaccattttggaaaccctaggttcgagctcatccgacatgacgtcgttgagccactcctcctggaggttgatcagatctaccacctggcctgtcccgcctcccccgttcactacaagttcaaccccgtcaaaaccatcaagaccaatgtggtgggcaccctcaacatgctaggcctggccaagagagtcggtgcgcgcttcctgctaaccagcaccagcgaggtctacggcgaccccctccaacacccccaggtggagacctactggggcaacgtcaaccccatcggtgtccgaagctgctatgatgaaggcaagcgtactgccgaaaccttgaccatggactaccacagaggagctgaagtcgaggttagaatcgctcgtattttcaacacctatgggcctcgaatgtgcattgatgatggccgtgttgtcagcaattttgtagctcaggcattgaggaaggagccactgacagtttatggtgatggaaagcagaccaggagtttccagtatgtttctgatctggtggagggcctgatacgcctcatggaaggggaacatgtgggtcctttcaatcttgggaaccctggtgaattcaccatgcttgaacttgctcaggtggttcaggaaacaatagaccccaatgcaaagatagagttcaggcccaacacagaggacgatccacacaagaggaagcctgatatctcaaaggccaaggatcttcttggttgggagccaaaggtggctcttcgcaagggtctcccccttatggtctccgatttccgagaacgcatctttggtgatcacaaggaagatggtgccactaccaccacatcctcatcctcctcgtcctaagctaactacacaccttacactagagtgacaaggggaaagacaattttcgatggaaagtaaatccctacttccacccaaacggtagagcagcagcagagcacaagcccctttgttctcttttgaatagttttggaggtgttactttttgcaatttgtgttctttgtcatctttgtattttccttgttactacccctttttaatcttaatagatggtaagctctttgaataaccccccaaattttcattttatgcaatgagtattgg

SEQ ID NO: 8051 - DNA, 1961 bp, Phaseolus vulgaris
agatggaggttgagatacgtgagagcatagaaactgcatagctttataaactatcaactctggatctgaaaaggtgacacagccagcactaccactttcactccccgccttctccgcattcattctcgtctcttcacatcaaattcacgaccacgcattcagaccacaaacgttgtgaattgaagcagcgaaaatggcttcgggcttggttttccgagggcacgaggcacaacctgtgaacgacgccgatttccccaagccgcaaaagccatggtttttcctccgctacatcctccgcgagcagcggctccatttcctcttcctcggcgttctcctcgcctccgtcttcttcttcttcctcctcccctcctcctcttctcctcccgtccgggcccacgacccattccccgcttctttcttggcccgcgacgacttaacgctctggcccaccaccaacacccgaagctatgacgtggcggtgcattccgtggggaagatccccctagggattaaacggaaggggctccgggttgtggtgacgggcggggccgggttcgtcgggtcacacttagtggatcggttgattagccggggagacagcgtgattgtggtggacaatttcttcacagggaggaaagaaaacgtgatgcaccattttgggaatccgaatttcgaacttctccgacacgacgtcgtcgagcctctcctcttggaagtcgaccagatctaccatcttgcttgccctgcctcccctgtccattacaagttcaatcccaccaacgtggtgggcacgttgaacatgttggggctggctaaaagaattggcgccaggttcttgttaaccagtaccagcgaggtttatggagatcctctgcagcaccctcagaaggagacttattggggcaacgtcaatcccattggtgttcgaagctgctacgacgagggaaagcgtacggccgaaacgttagccatggattaccacagaggagccggtgtcgaggtgagaatagctaggattttcaacacctacgggcctcgaatgtgcttagacgatggtcgcgttgttagtaacttcgttgctcaggcactaaggaaagaggctttgaccgtttatggggatgggaagcaaactagaagtttccaatacgtttctgatttggtggaggggctgatgcgccttatggaaggagaacacgtgggacctttcaatcttggaaatcctggtgaattcaccatgcttgaacttgccaaggtggtacaagaaaccatagatccagaggctaagatagagtacaggccaaacacagaggatgacccacacaagagaaagcctgatattactagggccaaggaactactaggctgggaacccaaggtggacctacgcaagggactccctctaatggtttctgacttcagacaacgcatttttggggaccaaaaggaaggagcaacctctacctaattcttgattggaaaatggaaattgagattttttctgctagatacctcagactaagtgcgaaaggggattgtagtttacatttttcatagcattaaccagaaaacagttagtgaggtttccgatctcttcatgatccattagtcacagtagcttatcagccatacataattttcccttttgtcctttatcctctaccatttttcctagtatgcagcattgatgtcctaattgtatttctaaagttgcgacccttgttcccccgttgttcgatgaatcacaggatgtaatacgcaatcggatacattcggtactgaagaaacaggagaaagtttatggacgagtaataattatgaagtggaaattatgtctgacaatctacatttcgggcacggaattgcattttcattgaacctcttgaagatgtgccgcatatttaacagacaccagaattgtcttttctaactctcctgcgttcaaatctttgttattacattat

SEQ ID NO: 8052 - DNA, 1800 bp, Panax ginseng
attcacacaaactctcccttcttcatttctttctttttccttggatttatttctctctcctaagagtcctaatcaatcagatacacataaccagatttacagagtgggagaaaagaaaaaaaaaccaaaacaatggcgtctgagttgatctacaggggccacgagtcccaacctgccaatgacgagtattcgcccaagcctaacaagccatggctctccgtcattcgccctattcgctacatgctccgcgagcaacgcctcattttcgtcttcgtcggcattgctatcgccaccctcttcttcgccatccttccctcttcttctatcaccaccaccacttatgtctcaggccgccgcggcccaatctccatctccgacccctacttctcctccgacccagcatcccccactgggccgcgtaccagaaccgagcggttagatttgagtcgttcaatccgggtgggaagattccgttgggtctgaaaggaaggattgaggatcgtggttacgggtggggccgggtttgttggtagccacctggtggatcgtctgattgcgagaggggatagcgtgatcgtggtggataatttcttcacggggaggaaggagaatgtgatgcatcattttggaaaccctaggttcgagctaatccgacacgacgtcgttgagccgttgctgttggaagtagatcagatctatcatcttgcttgccctgcttctcctgttcattacaagtttaaccctgtcaagacaattaagacaaatgtggtgggtacgttaaacatgcttggtctggcaaagaggatcggtgcgcggttcttgctaacgagcaccagtgaggtgtacggagatcctctgcaacacccacaagtcgagacttactggggcaacgtcaatcctatcggtgtccgaagttgttacgatgagggaaaacgtactgctgagacattgacgatggattaccatagaggtgctggagttgaggtgaggattgccaggatatttaacacatacggacctaggatgtgcatcgatgatggtcgtgtggtcagcaatttttgttgcccaggcactgaggaaggaaccattgacagtttatggcgatgggaagcaaacaagaagtttccaatatgtttctgatttggtggagggtctaatgcgtctgatggaaggagaacatgtgggacctttcaatctcggaaatcctggtgaattcaccatgcttgaacttgctcaggtggtccaggaacaatagacccgaatgcaaagatagagtttaggccgaacacagaggatgacccacacaagaggaagcctgatatcaccaaggcaaaagatctacttggttgggagccaaaggtgccccttcgcaagggtctgcctctaatggtacaggactttaggcaacgtgtctttggtgaccagaaggaaagatggtaccacctcagcttagggaaggtgggaaggagaaattgttcaattttgtctctttttttcccatatagtacaggcatcatcagcagcagcagcagcagaaacacgagccccgtatacttgtctctgcatagtttgggatctttcaatagttttggtcatcttgtattttgattgctcttatcctttaagattaagattcaagcccgccagtcacagaaataactttccccccaattatcagcagtgggaactttgattttagctttccatatgagcgactcacacttgttgtatcatataattgcactgttgctgaatattagatgtcccaccatactttgcagtacgttttgttcttaaaaa

SEQ ID NO: 8053 - DNA, 1821 bp, Chelidonium majus
acagatcgaagatggcatcagagttgatttacagacgccatgaatcactaagctcagtctgattcatatctacccaaacccccaaaaccattaatccattctgcaacaagagctgttcgttacattcttcgtgaacaaagactcttattcgttctcatcggtattgcaatcgctaccgttttcttcatcctcctcccatcttcatcatcttcctcatcacattttaactacgactctgttcctgcccaatacttccctaattccgattcaactcgtttgtctgaacgtgctgtgtacgagcatcgtagcaatttcggatcggtgagttcaggtgggaaaattccattaggtctgaaacgaaaagggcttcggatcgttgttacaggtggagctggatttgttggtagtcatcttgtggatcgtttgattgaaaggggtgatagtgtgatcgttgttgataatttcttcactggtaggaaagagaatgttatgcatcatttcggaaaccctagatttgagatgattagacatgatgttgttgagccgattttattggaagtcgatcagatctatcatcttgcttgccctgcttcacctgttcattacaaattcaatccagtcaagaccatcaagacgaatgttgttggaactttgaacatgcttggattggcaaagagagtcggtgctaggtttctgctaacgagcaccagtgaggtttacggtgatcctctgcaacacccacaagtggaaacttactggggaaacgtcaatccaatcggtgtgaggagttgttacgatgaaggaaagaggacggcggagactttgacaatggattaccacagaggtgctggcgttgaggtcaggattgctaggatttttaacacgtatggacctcgtatgtgcatcgacgatgggcgtgtcgttagtaatttcgtcgctcaggcattgaggaaagaaccattgactgtttatggagatggaaagcaaaccaggagtttccaatacgtttctgatctggtggaaggattaatgagattgatggaaggagaacatgtaggaccattcaatcttggcaaccccggcgaatttaccatgcttgaacttgcccaggttgtgcaagagactattgacccgaacgcaaagattgagttcagggacaacacagaagacgatcctcacaagaggaagcctgacatcaccaaggccaaggaccagcttggctgggaacctaaggtaccacttcgccagggtctccctctcatggttaaagacttccgtcagcgcattttcggcgaccacaaggaaggcagcaacaccaacagcggagttgcctcatccacatcttaaacatttaacctatctccttactttccaagacacacagactgctcttcatcttttgttttgtgggggaacaacataatcagcagcattattataggccaaatttctttcatttttcagcatttgttaacttttctatcctttttttttcctagtactctttgagaatttttgtattcgagtaagcttcggttccgttcatgtattttgctcatgtttattgatatcattataggtgaccagacagtaatatcaaaaaactttcgatgtcttactgatagttttcctaccaattatatttcgtggcagttgaattcttacaagtcaaagaaataataatttctaagttatccttgtcattacacagttgaattctttgctgcaatgcaattcttctttactcccaaataagtccttatcttttccatgggctattaagagacaaagtttgattctttgaaacacttctgatcattc

SEQ ID NO: 8054 - DNA, 1625 bp, Manihot esculenta
taatatatgggactaagcatactagcgtggcatttccgtagttacctgctgaacgaagccttatttgattgctgtgctctctttaaaaacagaaacgcactcctgctcaaaacgctaaaccgcagcaaggtcgtagccggagactgtgtttctggcgagcgagtcgttgtgaactcttgagtcgatctaaacaaaccactcagggaggtttcgcacattgagattgaaacaaattctgttattgatctcagaattttagtcaaggagatgccgtcggagttgatatttagaggccacgacgaagcccagcatatcaccgactcctactcgcctaagccgcccaaacgatggctttccatcagtcgcccgattcgctacatgcttcgagagcagcgtctcgtctttgtcctcgttggcattgttattgccactcttttctttaccgtccgtccttcctcttctagggctccatatgtgcctcaccacaaacacaagccgatctccgactctctggatcacttctctcgcgtgtcagtgccagcgagatacaaattatacgaacctcatgggaccgggttcgggtcgatgaatacaggtgggaagattccgcttgggctaaaacggaagggtttgagaatagtggtgaccggtggggctgggttcgttgggtcacacttggtggaccgtctgattgaaagaggcgacagcgtgatcgtggtggacaatttcttcacgggaaggaaggagaacgtgatgcaccacttcaaaaacccgagattcgagctcatacggcacgacgtcgttgagcccctgttgctggaagttgaccagatctatcaccttgcttgcccagcatcgcccgtgcattacaagcacaaccccgtcaagaccataaagaccaatgtggttggcacattgaacatgctagggttggcgaagagggtcggtgccaggtttctgctcaccagcaccagcgaggtctacggtgatcctctccagcacccgcaggtcgagacttactggggcaacgtcaatcccataggtgtccgaagttgttacgatgagggaaagaggacagctgagacattgacaatggattaccacagaggagcaggtgttgaggtcaggattgcaagaatttttaatacctatggaccccgaatgtgcattgacgacggtcgtgttgttagcaattttgttgctcaggcattgaggaaggagcctttgactgtttatggtgatgggaagcagacaaggagtttccaatatgtgtctgatttggttgaaggtctgatgcgccttatggaaggagaacatgtgggacctttcaatcttggcaatcctggtgaatttactatgcttgagcttgctcaggtggtccaagaaaccatagacccgaatgcaaggatagagttcaggcctaacacagaagatgacccacacaagaggaagcctgatattacgaaggcaaaagatctgcttggttgggagcccaagatatcccttcggaagggtctgccactaatggtctcagatttccggcaacgcatctttggtgaccacaaggaagataccaccaccaccaggagcactgtgtcaacaacttaaattggcaaaaaaatttt

SEQ ID NO: 8055 - DNA, 1335 bp, Manihot esculenta
atggggtcggaattgatatttagaggccacgacgacacccaacatgagaccgactcctactcgcccaagcctcccaagcggtggctctcctttacccgcccaattcgttacatgctccgcgagcagcgactcgtctttgtcctcgtcggcattgttattgctacccttttcttcaccgtcctttcttcctcttctaaggcgccgtatgtgcaccaccacaaatatgagccgatctctgatgcccttgctcacttctctagcgagtcagcatcatccagatacaaattgtacgaacctcgcatggctgggtttgggtcgatgaattcgggcgggaagattccgttggggctcaaacggaagggtttgagaatagtggtgaccggtggggctgggtttgttgggtcacacttggtggaccgtctgatcgaaagaggtgacagcgtgatcgtggtggacaatttcttcacgggaaggaaagagaacgtgatgcaccacttcaaaaacccaagattcgagcttatccggcacgacgtcgtagagccgctgttgctggaagtggaccagatctatcaccttgcttgtccagcatcacccgtgcattacaagcacaacccggtgaagaccataaagaccaatgtggtggggacattgaatatgctagggctggcgaagagggtcggtgccagatttttgctcaccagcaccagcgaggtctacggtgatcctcttcagcacccgcaggtcgagacgtactggggcaacgtcaatcccatcggtgtccgaagctgctacgacgagggaaagaggacagctgagactttgacaatggattatcacagaggagcaggtgtcgaggtcaggattgctagaattttcaatacctatgggccccgaatgtgcattgacgacggccgtgttgttagtaattttgttgctcaggcattaaggaaggaacctttgactgtttatggtgatgggaagcagacaaggagtttccaatatgtttctgatttggttgaaggtctgatgcgtcttatggaaggggaacatgtgggacccttcaatcttggcaatcccggtgaatttaccatgcttgagcttgctcaggtggtccaagaaactatcgatccgaatgctaggatagagttcaggcctaacacagaagatgacccacacaagaggaagcctgatattacgaaggcaaaagatatgctcggctgggagcccaagatatcccttcggaagggtctgccattgatggtatcagatttccggcaacgcatctttggggaccacaacgaagctagcaccactagcaatatttcaacagcttaa

SEQ ID NO: 8056 - DNA, 1827 bp, Chenopodium quinoa
tacaaattcattcctcaattcctcctctcattcctcattctcacattctcccccttcaaacttccttgactcgatctcaacttatcaactccgccgattaaactaatggcgtcggagctgatcttccgaggcggacatgaagcccacctcaaatccgacgagtacgactcaccaaagcctcttaaaccatggctaaccgtaactcgtccgattcactaccttcttcgcgagcaacgactcgtgttcctcgtcctcggcatcggcatcgccacattgatcttctccctgaccccatcaaacacctcgtcgtctaacattgacatcaacatgcacgattcaatcggcggggaatcgttcctgaccgccgagtcaactcggttgattccgacccaccatggtcgggtcagtgatgggtttagatctgggaaggtcccagttagggctaggaaacgaaaagggttgcggatagttgtgacgggtggggccgggtttgtcgggtcgcatcttgtggaccgtttgattgcgagaggtgatagtgtgattgttgttgataatttctttaccgggagaaaagagaatgtgatgcatcattttggaaaccctaggtttgaattgatccgacacgacgtcgttgagcctcttttgttggaggttgatcagatctatcatttggcttgccctgcttcccctgttcattacaaacataaccctgtcaaaactatcaagacaaatgtggtaggaacattgaacatgttaggattggcgaagagagtaggtgcaaggttccttctaacaagtactagtgaagtttatggtgaccctttggagcaccctcagaaagagacttactggggcaatgttaatcccattggtgttcgtagttgttatgatgagggaaagcgtactgcagaaacattggccatggactaccatcgaggtgctggtgttgaggtgagaattgctaggattttcaacacttatgggcctcgaatgtgcattgacgatggtcgtgttgttagtaacttcgttgcacaggccttgaggaaagaacccatgactgtttatggtgatggaaagcaaaccagaagtttccagtttgtttcggacttggttgaaggtctgatgcgcctaatggagggtgagcatgttggtcctttcaatttaggaaatcctggtgaatttaccatgcttgaacttgcgaaggttgttcaagaaacaatagatccaaatgcaaagatagaattcaggcctaataccgaggatgatcctcacaagaggaagcctgatatcggtaaggctaaagagttgcttggctgggagcctaagattgcacttcgcaaaggtctgcccatgatggtttctgacttcaggcagcgtatctttggtgaccagaagggaggtgacaccaccaccaccgcattttaagtctgccttagcttgcgtctataggagcaattctggcacataaaacgatttctgctccattctccctgggcgaccctcgactgtataccatcgcaaggctcgagtagtagcagatctggcttccaattggctcccttcgctagattatagatatgtagagcttatagtcttcagcatttatattattatatattgtcctattttgttcgttgctgatatccatgtagacgctgcattaatactattccgtaatcagtttttctcagctatcaggttattcttttcctaatcgaggttaataatgacataaatgattataattagtagtttatgcaactgatgtattatcgtctcgtagatcagtcgtgggaggcaaggcacacgaggggataggcccccccc

SEQ ID NO: 8057 - DNA, 1884 bp, Gossypium hirsutum
cccgttccactctcatcacctctgccccaacacgttggggactcaggctcacggcgtttcagagaattcttttgaatttctcctttttattgatcttataattttttgtttagtttttgaagccgaagagggatgggatcggagctaatatacagaggccatgagactcagcttgcttcagattcctattcacctaaaccggttaaaccatgggcctctgtcacgcgcgtggtccggtacatgctccgggagcagcgcctcctctttgtgctcgtaggcattgccatagccactctggtcttcaacatcttcccggcctcgcgtgctgcgcacggcccccacctccactccaccaccccgctccttgattctatcccctacttccccatcgagacccaaaacaagttctcctatgcacaccggctcgggttcgggtcgggcaatccaaccggtaagattccgttggggctgaagcggaaggggttgagaatcgtcgtaacgggtggagctgggttcgtggggtcgcacctcgtggaccgtctgatagcgagaggagacagcgtgatcgtggtcgataatttcttcaccggaaggaaggagaacgtcatgcaccatttcgggaaccccaacttcgagcttatccgccacgacgtcgttgaacctttactcttggaagttgaccagatctaccatctcgcttgtcctgcttctccagtccattacaaatttaaccccgtcaaaactatcaagacaaatgtggtgggaacactaaacatgttagggctggcaaaaagagttggtgccaggttcttattaaccagtaccagtgaagtatatggagatcctctacaacatcctcagaaagaaacttattggggcaacgttaatcccatcggtgtccgaagctgctacgatgagggaaagcgtactgccgagacgttgacaatggactatcacagaggggccggagttgaggttaggatagccagaattttcaatacttacggacctcgtatgtgcatcgatgatggtcgtgttgttagcaactttgttgctcaggctttaaggaaggagcctttgactgtgtatggtgatgggaagcagacaaggagtttccaatatgtttctgatctggtggagggtctcatgcgtttaatggaaggagaacatgttggaccttttaatcttggaaacccgggcgaattcaccatgcttgagcttgctgaggtggtacaagaaacaatagacccgaatgcgaagatagagttcaggccaaacacagaagatgacccgcacaagaggaagcctgatatctcaagagccaaagagttacttggttggcaacccaaggtctccctccgaaagggtctccctctaatggtttcagacttccgacaacgtatctttggtgatcacaaggtcggcagcagcaccaccaccaccaacgactcatcatcttaagatggcctatatactcttctcacagacagagcgataaaaatatataatggttaagaggaaaagagcttgccgttgtcttttccctattgaaacaattaatattatagtgtatctttatgatagatgtgggatggagttttttattttttatttttgacatttatttgtttgccatctttgtagcttcaatatttcttgtccctttttaagagttgtagttttactgtgagctttccggatctaaaaaaggttgatattttccccaattttagtgctagtgcaagatgcttgcttatgtttagaatcagccggaagaagatgaatatggaagatgatttgcttgacaatattttaggtctaatcctttcccaaatttccatcatgaagaaataataaatcacccggacttcgactctggctttt

SEQ ID NO: 8058 - DNA, 1839 bp, Gossypium raimondii
gtccccgttccactctcatcacctctgcctcaacacgttggggactcaggctcgcggcgcttcagtgaattcttttgaatttctcctttttatttgatcttatagttttttgtttagtttttgaagccgaagagggatgggatcggagctcatatacagaggccatgagactcagcttgcttcagattcctattcacctaaaccggttaaaccatgggcctctgtcacgcgcgtggtccggtacatgctccgggagcagcgcctcctctttgtgctcgtaggcattgccatagccactctggtcttcaacgtcttcccggcctcgcgtgctgcgcacggcccccacctccactccaccaccccgctccttgattctatcccctacttccccatcgagacccaaaacaagttctcctatgcacaccggctcgggttcgggtcgggcaatccaaccggtaagattccgttggggctgaagcggaaggggttgagaatcgtcgtaacgggtggagctgggttcgtggggtcgcacctcgtggaccgtctgatagcgagaggagacagcgtgatcgtggtcgataatttcttcaccggaaggaaggagaacgtcatgcaccatttcgggaaccccaacttcgagcttatccgccacgacgtcgttgaacctttactcttggaagttgaccagatctaccatctcgcttgtcctgcttctccagtccattacaaatttaaccccgtcaaaactatcaagacaaatgtggtgggaacactaaacatgttagggctggcaaaaagagttggtgccaggttcttattaaccagtaccagtgaagtatatggagatcctctacaacatcctcagaaagaaacttattggggcaacgttaatcccatcggtgtccgaagctgctacgatgagggaaagcgtactgccgagacgttgacaatggactatcacagaggggccggagttgaggttaggatagccagaattttcaatacttacggacctcgtatgtgcatcgatgatggtcgtgttgttagcaactttgttgctcaggctttaaggaaggagcctttgactgtgtatggtgatgggaagcagacaaggagtttccaatatgtttctgatctggtggagggtctcatgcgtttaatggaaggagaacatgttggaccttttaatcttggaaacccgggcgaattcaccatgcttgagcttgctgaggtggtacaagaaacaatagacccgaatgcgaagatagagttcaggccaaacacagaagatgacccgcacaagaggaagcctgatatctcaagagccaaagagttacttggttggcaacccaaggtctccctccgaaagggtctccctctaatggtttcagacttccgacaacgtatctttggtgatcacaaggtcggcagcagcaccaccaccaccaacgactcatcatcttaagatggcctatatactcttctcacagacagagcgataaaaatatataatggttaagaggaaaagagcttgccgttgtcttttccctattgaaacaattaatattatagtgtatctttatgatagatgtgggatggagttttttattttttatttttgacatttatttgtttgccatctttgtagcttcaatgtttcttgtccctttttaagagttgtagttttactgtgagctttccggatctaaaaaaggttgatattttccccccattttagtgctagtgcaaggtgcttgcttatgtttagaatctgccggaagaagatgaatatggaagatgatttgcctgacaatattttaggtctaatcctttcccaat

SEQ ID NO: 8059 - DNA, 1661 bp, Nicotiana benthamiana
cttttttctctcttctgcatatacaaaaaagtacagaagagtttttgagagacgaaagagagggcaataaaaatacccataatataactatggcttctgaattgatctaccggggaccggaatcacagccggttcccgacgtttacactccgaaaccagacaagccatggttgagtgtaattcgacccattcgttacttgttacgcgaacagcgcatcgttttcctatttgcaggcattgctatcgcctctcttattttcgcccttttgccctcgtctcgttcgggaagcttaaattatgcgaacaacgcgatttacgactcctacttaccctccgagtcgactcagccacaggtggctcaccgtatgatctaccagaaccgacccggattcgggtcgttcaattcgggcgggaagatcccgctgggcttgcgacgtaagggtttgaggatcgtagtgaccggtggtgccggttttgtaggtagccaccttgtggaccgtttgattgctagaggtgatagcgtgatagtcgttgataactttttcaccggtcgcaaagagaatgttatgcaccatttcggtaatcctaggtttgagctcatccgacacgatgtcgttgagccacttttgcttgaagttgaccagatctatcaccttgcttgccctgcttcccctgttcattacaagcataaccccgtcaagactattaagactaatgtggtggggacattgaacatgctgggattagctaaaagagtcggtgcgcggtttttgctaacgagcaccagcgaagtgtacggtgatccattggaacatccacagaaggagacatactggggcaatgttaatcccatcggtgtccgaagttgctacgatgagggaaagcgaacggctgaaacgttgaccatggactaccacagaggtgctggcgtcgaggtgaggattgctaggatctttaacacctatggacctcgtatgtgcattgatgatggtcgcgttgtcagcaactttgtcgctcaggccttaaggaaggagcctttgacggtttatggagatgggaagcagacaagaagtttccaatttgtttcagatctggttgagggccttatgcgcttgatggaaggagaacatgttgggccattcaacctcggaaaccctggcgaattcacaatgcttgaacttgctaaggtggtccaggaaaccattgatccaaatgctcagatagagttcagaccgaacacagaggatgacccacacaagaggaagcctgatatctcaagggctaaagagttgcttggttgggaaccaaaagtggctctgaggaaaggactgcctatgatggtgcaagactttaggcaacgtatttttggtgaccacaaagaagatacttcttcagccaccacagcttagtaaagattgtatttggatattgttttaactcggtcaggggcgaaatgcacccggaagatgactcttatgctcatttagttcagcagaagtgcaggcagcagtagaccgagccctctagttctttgaatagtttaatagttgttcatgttacattcctgtcaattttgtaagtctattatcctttttcaacacttgatgtagacgagcaacctccattattatcataagaataaacaggttcctattttttca

SEQ ID NO: 8060 - DNA, 2002 bp, Fragaria vesca
agacgagtgaagaaacccccgcaccgccacaacccgccacgactgagttcccggcgagttgaaaactcgtctgactcagcttcctctctgattctctctacattttcctccctacccatcaacgcttttgtcccgatcagaagagtctgctctgatttccgaatcgaaacggttggaaaaaaaatggggtcggagctgatattccggggcgggcacgacgaggcccagcccgcttccgacacctactcgccgaaacgcccgaagccttgggcctcggtgacccgtccgattgggtacctcctccgggaacagcgcctgattttcatcctggtcggcattgtcatcgccaccgtctgcttcaccctcctgccgtcgtctcgccccgccttccacggccagaacccgatccccaacgacttcgtcaggttcgacttcgagtccacccacctctcccacaaaccggcctacgagcgccggttcgggttgaccaattacaattccggcgggaaggtcccgctgggcctcaagcgcaagggtctccggatcgtcgtcaccggcggggccgggttcgtcgggtctcacctcgtcgaccgcctcatggaacgaggcgacagtgtaattgtggtagataatttcttcaccgggaggaaagagaatgtgcagcatcatttcgggaacccgagattcgaattaatccgacacgacgtcgtcgagcctctcctcctcgaagtcgaccagatctaccatctcgcctgtcctgcctcccctgtccattacaagttcaaccccgtcaagactatcaagacaaatgtggtgggaactttgaacatgctcgggctggctaagcgggtcggagctcggttcttgttgaccagcaccagcgaggtctacggcgatcctctgcagcaccctcaggtcgagacctactggggaaacgtcaaccccatcggtgtccgaagttgctacgacgagggaaagcgtacggctgagacattgaccatggactaccatagaggagctggagttgaggttaggattgctaggatcttcaacacatatggcccgagaatgtgcatagacgacggccgtgttgttagtaactttgttgctcaggcgttgaggaaagagcctatgactgtttacggtgatggaaagcagacgaggagtttccaatacgtttctgatctggtggatggtctgatgcggctgatggaaggagagcatgttggacctttcaatctcgggaaccctggtgaattcaccatgcttgagctcgctaaggtggtccaagaaacaattgacaaagatgcaaagattgagttcaggccaaatactgaggatgacccacacaagaggaagcctgatatcacaaaggccaaagaccttctgggctggcaaccaaaggtgtccctccgcaagggactcccactcatggtctcagacttcagcaaacgtatctttggtgaccacaaggaagctgccggtgccaccaccaccatgtaattttaccgtatctgtattggcattatggcatttggccatacatacttgtctccagccaatggcaacgggaatgataatccttttcgttctttaccctccattttccaaacaagaatatagcagcaaggtcgcggcagcagtagcaatagcagcaacagtagtagcatataagttcctaagttcttctctatttggagtaggtttggaggtgtcttctttcggcatttgttgtcatgtccatcctctgttctttatgtattgttatcctcttaaaaagcttaatagacagcgagcttcgttttacaatcttcctcatattcttttttatgcaatggtctacatttgagaaaataatagattacatcacacacttcatgatctaatataatgtaatcagtctacatttcaattatattctgagattgatcaacttcatgaatttcagccagaagttgatgaactcttcttttgtttaaccatgaaatgtttctaatagaat

SEQ ID NO: 8061 - DNA, 1685 bp, Gossypium hirsutum
aggccagaattgagaattcccctgttttcattttcttgtttaacaccaccacctccattccaactcagcttctactcgccggcgactcacttcaacaaattcttttgaattgattcttacgaatcgagtttgattttcttcgaagttgaaaatacgatggggtcggagctgatttatagaggctctgagacccagccttcttcagattcatattcgcccaaacccgtaaaaccatgggcctccgtcacccgcaccatccattacctcctccgtgaacaacgcctcctcttcgtcttcgtcggcattgcgatcgccaccctgattttcaccgtcttcccaacttcacccgctccgtacgtcgctcctcacagccgcttcaccaccctgatccccgattccatcacctacttccccatcgagacccaacagaagttctcctccgcgcaccgcctcgggttcgggtcggccaacccgacaagcaagatcccgttggggctgaagcggaaaggtttaagaatcgtggtaacgggcggagccgggttcgtgggatcccacctcgtggaccgtctgattgccagaggagacagcgtgatcgtcgttgataatttctttaccggaaggaaacagaacgtgatgcaccacttcggcaaccccaacttcgagcttatccgacacgacgtcgttgaaccgttgctgttggaagttgaccaaatctatcatctcgcttgcccagcttccccagttcattacaaattcaatcccgtgaaaactatcaagacaaatgtggtgggaacattgaacatgttaggcctggcaaaaagagtaggtgctaggttcttgttgaccagtacaagcgaagtctatggagatccactgcaacatcctcagaaagaaacttattggggcaacgtcaatcccatcggtgtccgaagctgttacgatgagggaaagcgtactgctgaaacgttgaccatggactatcaccgcggagccggcgtcgaggttaggattgccagaattttcaatacttatggaccacgtatgtgcatagacgatggccgtgttgttagcaatttcgtagctcaggccttaaggaaggagccattgactgtgtatggtgatggtaagcagacaaggagttttcaatatgtttctgatctggtggagggtctgatgcggttgatggaaggggaacatattggaccttttaatcttggaaatccaggagaatttaccatgcttgagcttgccgaggtggttcaagaaacgattgacccgaatgcaaagatagagttcagacccaacacagaagatgatccacacaagaggaagcctgatatctcaagagccaaagagctacttggttgggaacccaaggtgtcacttcgaaagggtctccctctaatggtttcggacttccggcaacgtatatttggtgaccataaggagggcagcaacaccaacaatgcatcatcatcttaaggtctcatatttacacccatagaaagaccaatcaatgatgccgacagcagcagcagcaacaaatgaagtccgtttagagtagattttgtaggttaccattttgacatgagatttgcatctttgtagttttatatcttatgttcctaccccgcttaagcttaattgacaatgggctttgcgaatctatattcatcattcttttg

SEQ ID NO: 8062 - DNA, 1377 bp, Euphorbia peplus
cgctcctttaccggcgatcgatttgaaattttccgtcgcaaaattaagattcagagactgaattcagatcatatcttgatcggaaatggggtcggagttgatattcagaggccatgaagacagccagcacacggcggaggagtactctccaaagccgccgaagcggtggctattcgtaacccgtccgattcgctacattctccgggagcagcgcctcctattcaccctcatcggcatttcaatcgccactcttttcttcaccttccttccatcctcatctccggcgccgcacgagctgatcaccgattcactctcacatttcgattcatcaatcccatcgcgacacaaatactacgagccggcacagctcgtgggattcggaatcggaatgaattccggcgggaagattccgttaggactccgacggaaggggatgaggatcgtggtgaccggtggggccggtttcgtcggttctcatttagtggaccgtctgatggagagaggcgatagcgtgatcgtggtggataatttcttcaccggaaggaaagaaaatgtgatgcatcattttaaaaatcctcggttcgagatgatccgacacgacgtcgttgagccgttgttgctggaggttgaccagatctatcatctcgcctgcccggcttctccagtgcattataaacataatccggtcaagacgatcaagacgaatgtcgtcgggacgttgaatatgttagggttagctaaaagagtcggcgctagatttttactcaccagtaccagtgaggtgtacggcgatcctctacagcatcctcaggtcgagacttattggggaaacgtcaatccaatcggtgtccgaagttgctacgatgaaggaaagaggacagctgagacattgacaatggattatcatagaggggcaggtgttgaggttaggattgctagaattttcaatacttatgggccaagaatgtgcattgatgacggccgtgtcgttagtaattttgttgctcaggccttgaggaaggaaccattgacagtgtatggtgatgggaagcagacaaggagtttccaatacgtttctgatttggttgaaggtcttatgcgcctcatggaaggggaacatgtgggaccattcaatcttggaaatcctggtgaattcaccatgcttgagcttgcccaggttgtccaagaaacaattgatccaaatgcaaggatagagttcaggccaaacacagaagacgacccacacaagaggaagcccgatatcacaaaggcaaaggatctcctcggctgggaacccaaggtatctctccgcaagggtctcccactaatggtttcagacttccgacaacgtgtctttggagaccacaaggaagatag

SEQ ID NO: 8063 - DNA, 1810 bp, Gossypium raimondii
atacctttcctaaacccttatttatatttattctcctcctttattcttcaggccagaattgagaattcccctgttttcatttcttgtttaacaccaccacctccattccaactcagcttctacacgccggctactcacttcaacaaattcttttgaattatttcttacgaatcgagtttgattttcttggaagtcgaaaatacgatggggtcggagctgatttatagaggctctgagacccagccttcttcagattcatattcgcccaaacccgtaaaaccatgggcctccgtcacccgccccatccattacctcctccgtgaacaacgcctcctcttcgtcttcatcggcattgcgatcgccaccctgattttcaccgtcttcccaacttcacccgctccgtacgtcgctcctcatagccgcttcaccaccctgatccccgattccatcacctacttccccatcgagacccaacagaagttctcctccgcgcaccgcctcgggttcgggtcggccaacccgacaggcaagatcccgttggggctgaagcggaaaggtttaagaatcgtggtaacgggcggagccgggttcgtgggatcccacctcgtggaccgtctgattgccagaggagacagcgtgatcgtcgttgataatttcttcaccggaaggaaacagaacgtgatgcaccacttcggcaaccccaacttcgagcttatccgacacgacgtcgttgaaccgttgctgttggaagttgaccaaatctatcatctcgcttgcccagcttccccagttcattacaaattcaatcccgtgaaaactatcaagacaaatgtggtgggaacattgaacatgttaggcctggcaaaaagagtaggtgctaggttcttgttgaccagtacaagcgaagtctatggagatccactgcaacatcctcagaaagaaacttattggggcaacgtcaatcccatcggtgtccgaagctgttacgatgagggaaagcgtactgctgaaacgttgaccatggactatcaccgcggagccggcgtcgaggttaggattgccagaattttcaatacttatggaccacgtatgtgcatagacgatggtcgtgttgttagcaatttcgtagctcaggccttaaggaaggagccattgactgtgtatggtgatggtaagcagacaaggagttttcaatatgtttctgatctggtggagggtctgatgcggttgatggaaggggaacatattggaccttttaatcttggaaatccaggagaatttaccatgcttgagcttgccgaggtggttcaagaaacgattgacccgaatgcaaagatagagttcagacccaacacagaagatgatccacacaagaggaagcctgatatctcaagagccaaagagctaattggttgggaacccaaggtgtcgcttcgaaagggtctccctctaatggtttcggacttccggcaacgtatatttggtgaccataaggagggcagcaacaccaacaatgcatcatcatcttaaggtctcatatttacacccttagaaagaccaatcaatgatgccgacagcagcggcagcagcaacaaatgaagtctgtttagagtagattttgtaggttaccattttgacatgagatttgcatctttgtagttttatatcttatgttcctaccgcgtttaagcttaattgacaatgggctttgcgaatctatattcatcattcttttgtttggttatgagttgaaacgtatcttcgcgcatgcgatttccagggttataaatttctgaatacttccatcata

SEQ ID NO: 8064 - DNA, 1725 bp, Rosmarinus officinalis
agaaaaggaaaaaatggcttccgagttgatattccgcggccacgagtcgcagccggtgagcgacacctactctccgaagccgccaaagccgtggctcagcgtggcccgcccgattcgctacatactccgcgagcagcgcctcgtcttcgtcttcgtcggcattgccatcgccacgctcttcttcaccatgctccccgccggttccaacccccacgcgccgatcgccgactcgtacatcccctccgagttgactcaatcgcggccgcaccgatccatgtaccagaacgggcacctcgcgaccgggttcggcatcaactccgtcggcaaaatcccgcttgggctgaaacgcaaggggctccgcatcgtcgtaaccggcggggccggcttcgtcggcagccacctggtggatcgcctgatggcgaggggagacagtgtgattgtagtggataatttcttcaccggcaggaaggagaacctcgtgcaccacttcgggaatccgaggttcgagctgattcgacacgacgtcgtcgagccgctcctgttggaagtcgaccagatctaccacctcgcctgccccgcctcgcccgttcattacaagcacaaccccgttaagacaatcaagacgaatgtggttgggactttgaacatgctgggactggccaagagagtcggtgcgcggtttttgctaacgagcactagcgaggtgtacggtgatccactgcagcacccacaagtcgagacctactggggcaatgtcaatccgatcggtgtccgaagctgctacgacgaggggaagaggactgctgaaacgttgacaatggactatcacagaggcgctggtgttgaggttaggattgcgaggatctttaacacatatggtcctcgtatgtgtattgatgatggccgcgtggtcagcaatttcgttgctcaggctttgaggaaggagccgttaactgtttatggtgatgggaagcagacaagaagctttcagtttgtttctgatctggtcgagggactgatgcgcctgatggaaggagagcacgtcgggcctttcaatcttggtaaccctggcgagttcaccatgctcgagcttgctcaggtggtgcaagagactatcgatccaaatgctaagatcgaattcaagcccaacacagaagatgacccgcacaagaggaagcctgacatctccaaggcgaaagagctgctgggttgggagcccaagatagctctccgtaaaggtctcccgatgatggtgtccgacttcaggcaacggatctttggcgatcacaagcaagacgttgccacctcggcttagagttttacgatctatgagttgtgactgcgagtaaacctagtcagggtgaaagaggacagttgctaatctagcaatgcaggagtattctacacaccagtttctgaaatcttggggtaatgaatggtatcatagaagcaaaggcagtgagatgttggcccatgattctgtttcttcctgttcttttttcttattttaccctcattgttttgccatttcaaaagttctgtagacgcgtctactttttacatttaagtattattataaattttggataaataagtgcagtattttctctcaagtgaacacgtcggaaatggaatccgattcagaataagcgcataaattgggttctgcacgtctcttaatctttgttacacacttacaccacatgtacagctaataccggctct

SEQ ID NO: 8065 - DNA, 1620 bp, Rosa hybrid cultivar
agcgtcttcttcttcattctctttacattttcctccaaaacccatcagccaaacggttaaatgggctcggagctgatattccggggcgggcacgacgaggcccagcccgcttccgacacctactcgccgaaacgcccgaagccgtgggcctcggtgacccgcccgattgggtacctgctccgggaacagcgcctgattttcatcctcgtcggcattgccatcgccaccgtctgcttcaccctcctgccgtcgtctcgatccccctcctaccacggccacaacccgatccccaacgacttcgtcaagttcgacttcgagtccacccacctctcccacaaacccacctacgagcgccggttcgggctgaccaattacaattccggcgggaaggtcccgctgggcctgaagcgcaagggcctccggatcgtcgtcaccggcggcgctgggttcgtcgggtcccacctcgtcgaccgcctcatggagcgcggcgacagcgtgatcgtcgtcgacaatttcttcaccggaaggaaggagaacgttcagcaccattttgggaaccctagattcgaattaatccgacacgacgtcgtcgagcctctcctcctcgaagtcgaccagatctaccatctcgcctgccccgcctcgccggtccattacaagttcaatcccgtcaagactatcaagaccaatgtggtcggaactctcaacatgctggggctggcgaagcgggtcggagctcggttcttgttgaccagcaccagcgaggtctacggcgatcctctgcagcaccctcaggtcgagacctactggggaaacgtcaatcccatcggtgtccgcagttgctacgatgagggaaagcgtacggccgagacattgactatggactaccatagaggggcaggtgtcgaggttaggattgctaggattttcaacacatacggcccgagaatgtgcatagacgacggtcgtgttgttagtaactttgttgctcaggcattgaggaaggagcctatgactgtttacggtgatggaaagcagacaagaagtttccaatacgtttctgatctggtggatggtctgatgcggcttatggaaggcgagcatgttggacctttcaatctcgggaaccctggtgaattcaccatgcttgaacttgcaaaggtggtccaagaaacaattgacaaagatgcaaagattgagttcaggccgaacactgaggatgacccgcacaagaggaagcctgatatcacaaaggccaaagaccttcttggttggcaaccaaaggtgtctctccacaagggactcccactcatggtctcagacttcagcaaacgtatcttcggtgaccacaaggaagctgctggtgccaccaccaccatgtaattctatcatatctgtactggcattatggcattggcacatacatacttctctctggccaatgacaacgggaaatataattcccttagttctttaccctccaatttccaaacaagaatatagcaacaaggtcgcggcggcagtagcaatagcagcaacagtagtagcatataagttcctaagttcttctctatttggagtaggtttggaggtgtcttctttcggcatttgttgtcatgt

SEQ ID NO: 8066 - DNA, 1438 bp, Silene vulgaris
tctctctcctcctcggaccaactcgcccgagtcaactcgctccaatggcgtccgagctcatcttccgaggcggacacgaatcccagtacaaatccgactcatactcacccaaaccagacaaaccattcctcctaactaccgtaacccgacccatacactacctcttacgcgaacaacgcctcgtcttcctcttaatcggcgcagcaatcgcattcctcctcttcacctccctctcccccaccaccgcaccttccaccgtcacctctaccgcattctccgacgactctttcctctccactgagttgactcggatcaacccccgccgagccgccttcgactcgttccgatccggaaaggcgccactcggtctgaaacggaagggattacggattgttgtcacgggtggggccgggttcgtcgggtcgcatttggtggatcggttgatcgcgcgtggagatagtgtgattgttgttgataatttttttactgggaataaagagaatgtaatgcatcattttggaaaccctagatttgaattgatacgacacgacgtcgttgagccgattttattggaagttgatcagatctatcatcttgcttgtcctgcttctcctgttcattataagcataaccctgttaaaactatcaagacgaatgtggtaggaacattgaacatgctgggattagcaaaaagagtaggtgcgaggtttctattaacaagcaccagtgaagtttatggtgatcctttggaacaccctcaaaaggagacttattggggcaacgtcaatcctattggtgtccgaagttgttatgatgagggaaagcgtacggctgaaacattggccatggattaccacagaggtgccggtgttgaggtgagaattgctaggatttttaacacatacgggcctcgtatgtgcattgacgatggtcgtgttgtcagtaatttcgtcgcacaggcgttgaggaaggagccaatgacggtctatggtgatggaaagcaaaccaggagcttccagtatgtttccgacttggtggaaggactaatgcggctaatggagggtgagcacgtcggtcctttcaacctcggaaatccgggtgaattcaccatgcttgaacttgctaaggtggttcaagaaacaatagacccaaatgcaaagatcgagtttaggccaaacacagaggatgatcctcacaagaggaagcccgacatcactagggctaaagaaatgctgggttgggagcccaagatcccactccacaaaggtctacctatgatggtttccgacttcaggcagcgtatttttggtgaccagaagagtggagacgctctttaagattggactgtgccaagacggacccgagacctccggtagtggagccctcactggttccccaagagtatagatgtagagttgtagctttcagcatgtgttag

SEQ ID NO: 8067 - DNA, 1376 bp, Platanus occidentalis
gttgaaatcctaaacccatcggcgggattatacacagatagagatctattccagttcttcacgaaaacccagattttatttgaagaaaaagagcaatcttggtctggaaacgagagaaggaagatgggttcggagttaatttacagaggccatgaaacccaacctctagccgatgcgtatttcccaaagccccagaaaccatggctgcccgtcactcgtttcattcgctacatgcttcgcgaacagcgactcgtcttcgtcctcgtcggcatcaccatcgccaccctcgtattcagcttcctcccttcctccactgcgaaatttggccacagctatcactcgatcccagatgtgtattttccgactgattcgacccagctctctcaccgagtcgtttacgagcatcgcggcggttttggggctgtgaattccggcgggaaggtgccactggggctgaaacggaaaggactgcgaatcgtcgtcacgggtggggccgggttcgttggaagccaccttgtggaccgtctgattgggcggggcgacagcgtaatcgttgttgataacttcttcacaggaaggaaggagaacgtgatgcatcattttgggagccccagattcgagctcatacgccacgacgttgtggaaccccttttactggaggttgatcagatctatcatctcgcctgccctgcctccccctgttcattacaagttcaatccagtcaaaaccattaagacgaatgtggttggaactctgaacatgcttggactggcgaagagggtcggtgctcgatttctgttaaccagcactagcgaggtgtacggtgatcctctgcaacatccccaggttgagacttactggggaaacgtcaatcccataggtgtccggagctgttatgatgaagggaaacgcactgccgagactttaaccatggattatcacagaggagctggcgttgaggttcggattgctcggatctttaacacttacgggcctcgtatgtgcatcgacgatggtcgtgttgttagtaacttcgttgctcaggcactaaggaaggagccattgacggtttatggagatgggaagcaaaccaggagtttccaatacgtttctgatctggtggagggtctgatacggctgatggaaggggaacatgtgggtccatttaatcttggaaaccctggcgaattcaccatgctcgaacttgctcaagtggtgcaggagacgatagacccgaatgcaaagatagagttcaggcccaacacggaagacgacccacataagaggaagcccgacattggcaaggccaatgagctgctcggatgggagcctacgtgcccctgcgcaagggtctccctctcatggtctctgactt

SEQ ID NO: 8068 - DNA, 1778 bp, Brassica oleracea
agaattcataactattccttttaaacatatagttacttggttactaattgaaagggtattctcgtaataagagagtgattatccttgatcagtaacgtctttggccacttaaatacacgaaaatacccgattcgcttttcacgctgctgtttgatcgagagagaggtaggaggagacaaacgaacaaggcaagcgagatggcgagcgagctgatcaaccgtcgacacgaggctgaccaaccacacgccgatgcttactacccgagacctatcaaaccgtggtcctccaccgtgacacgtcctatgcgttacatgctccgtgaacagagactcctcttcgttctcgtcggcattgccatcgcgacgttagtattcacaatcttccctcgctccaccccctactcggatcccttctccggttacggaatcaggcccgacgacgagtcgtacgttcccgcgtccaggcccagaggaggcccagtctcttgatgggagcaacaggcgggaaaatcccgctcggtttgaaacgcaaagggctgagagtggtggtgacaggtggcgcggggttcgtgggatcgcatctggtggatcggttgatggcgaggggagacacggtgatcgtcgttgacaacttcttcacgggacgtaaagagaacgtgatgcatcatttcggtaaccctaacttcgagctcatacgtcacgatgtggtggagccgatactacttgaggtggatcagatctatcatttggcgtgccctgcctcccctgttcactacaagttcaatcccgtcaagactatcaagacgaatgtggtcgggacgttgaacatgcttggtttggcgaagagagtcggtgctaggtttctactgacgagtaccagtgaggtttacggtgatcctcttcagcatcctcaggtcgagacttactggggcaacgttaatcccatcggtgttcgtagttgctacgacgaagggaagcgtacggcagagactttggccatggactatcaccgtggagccaatgttgaggtcaggattgctaggatcttcaacacatatggtccaagaatgtgtatagatgatgggcgtgttgtcagcaactttgttgcacaggcactaaggaaagaaccgatgactgtttatggtgatgggaagcagacaagaagtttccagtttgtttctgatctggttgaaggtctgatgagattgatggaaggagaacatgtagggccatttaacctgggtaaccctggtgaattcaccatgctcgagcttgctaaggtggtgcaagagacgatagatccaaacgcaaacatagagttcagaccaaacacagaagatgaccctcacaagagaaagcctgacatcacaaaggccaaagagcttttaggatgggaaccaaaggtgtctcttcgtcagggactccctctcatggtgaaagacttccgtcaacgtatctttggtgaccagaaggaaggctcctccgcgactaccaaaacaacctcagcttaaacagttgcacgtagcagccattgaccaaaagttgaaggcattgcttgcagctacattgtggagagaagagaagttcgtttgttcaaatttaattttgtttttatttatattttgatattatattatgtaacgtttagagtaagagttttggtgtacttactactactattattcatggacctcgctacagcttaaaaaaaacttgtttgtcatacaaagttaaggggcattactcatagatgagcagatatcttaatcccaatccaat

SEQ ID NO: 8069 - DNA, 2118 bp, Echinacea purpurea
aaattttattattgtcaggtacaaaataaatacaaaatatacgaaaatatcattgtccaatttaaacaaggtaccatgaatttaatctcgtagtcactcgtgtcgtgttgggccaatatacactacctaccgtttaattttcaaagtacaccaaaagggtatttacgtaatttcgcctccacgtatttaagacggtcatccctccttgtccgcaagatatcacaaacccctgtaaacctcacctcacgcgctgtacgcctgtggcgcgtgacatcactcgcgtcctcacgagccggagggttataagccatcgccacctgtcacctgacacttttagccctacatatactctctctctatacagacacacacacagagtctctctctatatatacatacaaacaacataaatctgtagcttcaacaaacagaaacagagagagatgggatctgagttgatattcagaggccacgaagcccaaacgacgtcggattcatactctccaaaacccagcaaaccctggctctccgtcattcgtccagttcgttacatgctccgggaacaacgacttctcttcgtcgtcgtcggcattttcatcggcgccgccgtcatcgccgtcatgccgtcgtcaaccaccaccgccaaccgacagatcacctaccgcgacgcctactccgtccaaacctccgaacttctaaaccctaggcggccagcgtaccgtgcaggattcggatcgatgaactccggcggtaaaattccgttaggtttgaaacggaaggggttgaggattgtggtgaccggtggagcaggtttcgtcggaagtcatctcgttgaccggttgatagctagaggagatagtgtgattgttgttgataattttttacagggaataaggataacgtgatgcatcattttggaaaccctaggtttgagcttattcgacacgacgtcgttgagccgttgttgttggaagtagatcagatctatcaccttgcttgtcctgcttcacccgttcattataagcacaatcctgttaaaactattaagacgaatgtggtggggacattgaacatgctaggtttggcgaagagagtcggtgcgcggtttttgctaacgagcaccagtgaggtgtatggtgatcccctgcaacatcctcaggttgaaacttactggggaaatgtcaatccaattggtgttagaagctgttacgatgaggggaagcggactgcggaaacattaaccatggattaccatcgaggtgctggtgtcgaggtgaggattgcaaggatctttaacacatatggtcctagaatgtgcattgatgatgggagggtcgtaagtaactttgttgctcaggcactgcgaaaagagccattgactgtttatggtgacgggaaacaaacaagaagttttcagtttgtttcagatttggtggagggtttgatgcgattgatggaaggcgaacatgtaggaccttttaatcttggaaaccctggtgaattcaccatgcttgaacttgctcaggtggtccaggagacaatcgacccgaatgcgaaaatagagtttaggcccaacacagaggatgaccctcacaagaggaagcccgatataaccaaggcgaaagatcttctgggatgggagccaaaagtgcctctacgcaaaggtctccctatgatggtgtctgactttaggcagcgaatctttggtgaccataaggacaatggtgccaccacaagcgccacatcagcttaaaccgcaacacttattataccagtaagatatgcagcaggaaaaaaggcatatacggttcccctcaccgagaacaactagtgtagcagagtttacgcccgtcctctataccgttgttcaggtttgagttggctatattagttttcgggcttgtattttcgttttattgatgttattaatattattattgttgttattgttattatcttaagataatttgggaacttaattggcattttacagagataagttttacgttgtagcctactaccatcttccctttgttattattattaatgcaattggcatttgaaaaaatcaattgtttgtttagtttgcttatgacatacataacatatttaattgtt

SEQ ID NO: 8070 - DNA, 2032 bp, Gossypium hirsutum
ctcccctcccctcgtccccgttccactctcatcacctctgcctcaacacgttggggactcaggctcgcggcgcttcagtgaattcttttgaatttctcctttttatttgatcttatagttttttgtttagtttttgaagccgaagagggatgggatcggagctcatatacagaggccatgagactcagcttgcttcagattcctattcacctaaaccggttaaaccatgggcctctgtcacgcgcgcggtccggtacatgctccgggagcagcgcctcctctttgtgctcgtcggcattgccgtagctactctggtcttcaccgtcttcccggcctcgcgtgctgcgcacggcccccacctccactccaccaccccgctcctcgattctatcccctacttccccatcgagacccaaaacaagttctcctatgcacaccggctcgggttcgggtcgggcaatccaaccggtaagattccgttggggctgaagcggaaggggttgagaatcgtcgtaacgggtggagctgggttcgtggggtcgcacctcgtggaccgtctgatagcgagaggagacagcgtgatcgtggtcgataatttcttcaccggaaggaaggagaacgtcatgcaccatttcgggaaccccaacttcgagcttatccgccacgacgtcgttgaacctttactcttggaagttgaccagatctaccatctcgcttgtcctgcttctccagtccattacaaatttaaccccgtcaaaactatcaagacaaatgtggtgggaacactgaacatgttagggctggcaaaaagagttggtgccaggttcttattaaccagtaccagtgaagtatatggagatcctctacaacatcctcagaaagaaacttactggggcaacgttaatcccatcggtgtccgaagctgctacgatgagggaaagcgtactgccgagacgttgacaatggactatcacagaggggccggagttgaggttaggatcgccagaattttcaatacttacggacctcgtatgtgcatcgatgatggtcgtgttgttagcaactttgttgctcaggctttaaggaaggagcctttgactgtgtatggtgatgggaagcagacaaggagtttccaatatgtttctgatctggtggagggtctcatgcgtttaatggaaggagaacatgttggaccttttaatcttggaaacccgggcgaattcaccatgcttgagcttgctgaggtggtacaagaaacaatagacccaaatgcgaagatagagttcaggccgaacacagaagatgacccacacaagaggaagcctgatatctcaagagccaaagagttacttggttggcaacccaaggtctccctccgaaagggtctccctctaatggtttcggacttccgacaacgtatctttggtgatcacaaggtcggcagcaccaccaccaccaccaacgactcgtcatcttaagatggcctatatactcttctcagagacacagcgataaaaagatataatggttaagaggaaaagagcttctcctagtcttttccctattgaaacaattattattatagtgtatctttatgatagatgtgggatggagttttttattttttatttttgacatttatttgcttgccatctttgtagctttaatgtttcttgtccctttttaagagttttagttttactgtgagctttccggatctaaaaaggttgatagttccccccattttagtgctagtgcaaggtgcttgcttatgtttagaatctgccggaagaagatgaatatggaagatgatttgcctgacaatattttaggtctaatcctttcccaataaataataaatctcccggacatcgactctggcttttatgactccttgcacacgagtttatgtggatctaagcaagtgcttctgttgggctaatgctagagttaacaaagtacttctcttttcacaataaattgccctaagatcctttcgctttgcttcaaatatattaaagttagtcgaaaa

SEQ ID NO: 8071 - DNA, 1779 bp, Lippia dulcis
gcctttttaaactgcaactcctcactccacgaatcccaccaccacgcgccggagaggttgaagtattcaactcccggacgaatactcttcactctctctccctctctctaaaactcgtcggatttttgatcggaaacttccacacgaaatgacttccgagttgatattccgtggccacgagtcccattccgccacagattcatactcgccgaagccgcccaagccgtggctcaccgtgacccgcccgattcgctacctcctccgcgagcagaggctcgtcttcatcttcatcggcgtcgccatcgccacgctcttcttcagcatcctcccttccgcctccgacaaccgccacgcgccgatctccgattcgtacattccgtcagagttgactcggccgcagccgcaccgatccgtgtaccagaacggccacctcgccaccgggttcgggatcaactcggtcggcaaaatccccctcggcttgaaacgtaagggtctccggatcgtcgtcaccggcggagccggattcgtcggcagccacctagtggatcgtctcattggccgcggagatagcgtgatcgtagtggataatttcttcaccgggaggaaggagaacgttgcgcaccacttcagaaatccgaggttcgagctgattcgacacgacgtcgttgagcccctgctgctggaagtcgaccagatctaccaccttgcttgccctgcctcccccgttcattacaagcacaaccccgttaagacgattaagacgaatgttgtcgggacgttgaacatgcttggactggcgaagagagtcggtgcgcggtttttgctaacgagcaccagtgaggtgtacggtgatcccctgcaacacccccaggttgagacttactggggcaacgttaatccaatcggtgtccgaagctgctacgacgagggtaagaggactgctgaaacattgaccatggattatcacagaggtgctggcgttgaggttaggattgctagaatctttaacacatatggtcctcgtatgtgcattgatgatggtcgcgtggttagcaactttgttgcccaggctttaaggaaggagcccttaactgtttatggtgatgggaagcagacaaggagtttccagtttgtatccgatctggttgagggacttatgaggttgatggagggagagcatgttgggcctttcaatcttggtaaccctggcgaattcaccatgctcgaacttgctcaggtggttcaagaaacgattgatccaaatgcgaagatagagttcaagcccaacacagaggatgatccccacaaaaggaagcccgacattgcaaaggcaaaggatctgttgggatgggagcccaaaatcccactcagaaagggtctacccatgatggtgtcagatttcaggcaaagaatcttcggtgatcacaaagaaaacgctgattcctcagcttgatcccagccataagtcgcattttgcagaatgattattctttgttagctagttcctaggaagtcatttcgcgaaacgactatgatgtttcttcataatgtttttgtgtgtcctttacagccgatttcattgtattttcagtgctctgtgtttaaatatcatgtagaccagcttcacagcctatataaagtcacccacaattttcgagtgtgtgcgtggtcggcgtctctcgaaggcacacagggggatagggccgacccctgcgcagcgatagctagcactgcgatagcatgagccgaacccgcgtgccatgcagctcagctatgcct

SEQ ID NO: 8072 - DNA, 1410 bp, Capsicum annuum
tatttgagagaagaaagagagaaacttattatggcgtctgaattgatctaccgaggaccggaatcacagccgatccccgatagttaccatccgaaaccacataagccatggcttagtgtaattcggcccatacgttacttgctacgtgaacagaggattgtttttctattagcaggcattgctattgcctctattattttcgctttttcaccatcgtcccgttcgggtgagttaagatacaccaacaatgccatctacgactcgaatctgcccacggaatcgacacaatcttcggtggcacaccgaatggtttaccagaatcgggtcggtttaggatcgtttaattcgggagggaagatcccgttgggattgaaacgtaaaggattgaggattgtggttactggtggtgccggttttgtaggtagccaccttgtggaccggttgattgcaagaggtgatagtgtgatcgtcgttgataatttttttacgggtagaaaagagaatgttatgcaccattttggtaactctagatttgagcttattcgacacgacgtcgttgagccacttttgcttgaggttgaccagatctatcatcttgcttgtcctgcttctcctgttcattataagcataatcccgtcaagactattaagactaatgtggtggggacattgaacatgctgggattggctaaacgagtcggtgcacgttttctgctaacgagcaccagcgaggtgtacggtgatccacttgaacatccacagaaggagacatactggggcaacgttaatcccatcggtgtccgaagttgctacgatgagggaaagagaacggctgaaacattgaccatggactaccacagaggtgctggcgtcgaggtgagaattgccaggatctttaacacctatggacctcgtatgtgcattgatgatggtcgcgttgtaagcaactttgtcgctcaggctttaaggaaggagccattgactgtttatggtgatgggaaacaaacaagaagtttccaatttgtttcagatctggttgagggcctaatgcgcttgatggaaggagaacacgtcgggcccttcaacctcggaaaccctggcgaattcacaatgcttgaacttgctaaggtggtccaggaaaccattgacccaaatgctcagattgaacacagaccaaacacagaggatgacccacacaagagaaagcctgacatctccagggctaaagagttacttggttgggaaccaaaagtggctctcagaaaaggtctgcctatgatggttcaagactttaggcaacgtatttttggtgaccaaaaagaagatagttcaaagtttcagcagaagtgcaggcagcagaagactgaaccccccatcgtctagttctttgaatagttggttcatgttaca

SEQ ID NO: 8073 - DNA, 1696 bp, Solanum melongena
accaagaaaaatacggccaacttttatttctctctctcttttacattacacaaaaaattttgagagaaagaaaaaacaacaattatggcttctgaattgatttaccggggaccggaatcacttccggttcccgacggttacactccaaaaccgcacaaaccctggctcaatgtaattcgacccgttcgttacttgttacgcgaacagcgaatcgttttcctattggcaggcattgttattgcctccgtatttttcgccgttttgccttcttcccgttccggcgggtcgagctacgcggatgccgggatctacgactcctacttgccgtcggagtcgagtcagtctcaggtggctcatcggatggcatatcagaatcgggtcggagtcgggtcgtttaattccggtgggaagatcccgttgggattgaagcgtaaggggttgaggatcgtggtgaccggtggtgcaggttttgtaggtagtcatcttgtggatcgcttgattgcgagaggtgatagcgtgatcgttgttgataatttcttcaccggaaggaaagagaatgttatgcatcatttcggtaaccctagatttgagcttattagacacgacgttgttgagccacttctgcttgaagttgaccagatctatcatctcgcttgtcctgcttcacccgttcattacaagcataatcccgtcaaaactattaagactaatgtggtggggactttgaacatgttgggattggccaaaagagtcggtgcgaggtttttgctaacgagcaccagtgaggtgtacggtgatccattggagcatccacaaaaggagacatactggggcaatgttaatcccattggtgtccgaagttgctacgatgagggaaagaggacagctgaaacattgaccatggactatcacagaggtgctggtgttgaggtgagaattgccaggatctttaacacttatggaccacgtatgtgcattgatgatggtcgcgttgtcagcaactttgttgctcaggctttaaggaaggagccgttgacagtttatggtgatgggaaacaaacaagaagtttccaatttgtttcagatctggttgagggcctaatgcgcttgatggaaggagaacacgtcggaccattcaaccttggaaaccctggtgaattcaccatgcttgaacttgctaaggtggtccaggaaaccatagaccccaatgctcagattgaacacagaccaaacacagaggatgacccacacaagaggaagcctgacatttcaagggccaaagaattacttggttgggaaccaaaagtgcctcttagaaaaggtctacctatgatggttcaagactttaggcaacgtatttttggtgaccacaaagaacaagatagttcaaagatcaccacagcttaatagaggaaagtttatgtttggatattgttatggtgttttaacttggtcaggggtgaaatacgtggcgacgaaagctgactcttgtgctcatgtagtttcagcggaagtgcaggcagcagaagactgagcccccccatctagttcttttgaatagccttaatagttggttcatccttacatttctgtcaattttgtagttttattattattatcttttattaacagttgatgtagtccacgaacctccattattatcataagaataaaaacaggggcgtattttttcccg

SEQ ID NO: 8074 - DNA, 1731 bp, Triphysaria pusilla
ctcacccgcagctgactaatactcctcagcttccaccattttttttacctatatcgagattcaatcatccaacagatcgatttcattctcgatctgcgtaaaaaaatggcgtccgagttaacattccgcggccacgagtcacaccacacatccgtctcatactcacccaaatccgccaagccctggctcggcgtgacccgcccgattcattacctcctccgcgagcagcgcctcgttttcatcttcgtcggcattgccatcgccacactcgtcttctcagtcctcccatcgtcgaatcaccaccagcaaatcgtcgaccctttcatctcatccgagttgactcggatccagcctcaccgatccatataccaaaacggccgcctctcaaccggattcgggatcaactcggtcgggaaaattcccttgggattaaaacgcaagggtttacgaatcgtcgtcaccggcggagctggtttcgtaggcagccatctagtagatcgtttaattgcccgtggtgacagtgtgatcgtagtggataatttcttcacggggagaaaggaaaacgtggcgcatcattttgggaatccaaggtttgagctgattcggcacgacgtcgttgagcctctactattggaagttgaccagatctaccatctcgcttgccctgcttcgcctgttcattataagcacaatccagtcaaaactatcaagacaaacgtggtggggactctgaacatgcttggactggccaagagaattggagctcggtttctgctaacgagcaccagtgaggtttatggcgatccattgcaacatccccaagttgaaacctattggggcaacgtcaatccaatcggtgtccgaagctgctacgatgaggggaagaggactgctgaaactttgaccatggactatcacagaggtgctaatgttgaggttaggattgctaggatcttcaatacatatggacctcgtatgtgcattgatgatggtcgtgttgttagcaactttgttgctcaggctttgaggaaggagccattaactgtttatggtgatgggaagcaaacaagaagctttcagtttgtttctgatctagttgagggacttatgcggttgatggaaggagagcacattggacctttcaatctgggtaacccaggcgaattcacaatgcttgaacttgctcaggtggttcaagaaaccattgatccaaatgcgaagatcgagttcaggcccaacacagaagacgacccgcacaagaggaagcccgatatcaccaaggcaaaggatcttttgggctgggaacccaaagtggcactccgtaaaggtctcccgatgatggtctccgacttcaggcaacgtatctttggtgaccataaagaagtttcttcatcggcctaattacaaacaataagtagtccttgtctcaagaagaggtcggttttagccatagatggtttattgctgctaatatgcttgatctactttgcccgaccctggagtacagtagggttcaagcatatgacggaagaagcacagcataaagctcgagccctaactcgctttcttgctatcttagcttgttattagaggttattttgggaggttattattattacttttatgtttacttgttctttctttttgccctttgattatgttttcagttgtctttcttatcccatgtcttgctcagtgagttcacaaaccttctcaattcccatgagttac

SEQ ID NO: 8075 - DNA, 1872 bp, Amsonia hubrichtii
cacacgcgccggagagtgggactgcattatttcccggctatatttcctctccacaccggcctcttctcctctttgcaaaatttcttagtcttctcctcctagtatatatttgtatatattccactactactattcaaagtccagcagagcagacaacgtaactcattttcctctcttttcccttttatcacagtagatcttctctgaatcgtgtactagactgctagtacgacttcaaccgttctaattatttctgaaagtaggagaattgagagagatagagagagcgagagaaaggggataggagaatgggttcggagttgatcttcaggggacacgagtcccagcaggtgacagacgagtactcgccgaagccgcacaagccatggttgactgtgattcggccgattcgttacatgctccgggagcagcgactgattttcgtatttgtcggcattgcgattgcctcgctctttttcgccgtcctaccctcctctcattcgccctacgccaccggtgattatagttacggccacaaccacatccacaacgccctctcttccgactcgttcttgccaatccaatcgggaggacatcgtttaacctatcagcagaaccgaggcggtttcggaccattcagttcgggcgggaaaatcccactgggcctaaaaaggaagggcttgaggattgtggtcactggtggagctggattcgttggcagtcatttggtggaccgcctgatccaaaggggggatagtgtgatcgtagttgataatttctttaccggaaggaaagagaacgtgatgcatcactttggtaaccccagatttgagctcatcagacacgacgtcgtcgagcctcttctgctcgaggtcgaccagatctaccacttggcttgtcccgcttctcctgttcattacaagcacaaccccgtcaagactatcaagactaatgtggtagggactctgaacatgcttggattggcgaagagagtcggtgcccgattcttgctgacgagcaccagtgaggtgtacggtgatccattgcagcatccacaagttgagacatactggggaaatgtcaaccccatcggtgtccgaagctgctacgatgagggaaagcgtacagctgagaccttgacaatggattaccacagaggcgctggcgttgaggtgaggatcgctcggatctttaacacatatggcccacgaatgtgcatcgatgatggacgtgttgttagtaattttgttgctcaggccttgaggaaggagccattgactgtttatggcgacggcaaacaaacaagaagtttccaatacgtttccgatttggtcgaaggtcttatgcgcttgatggaaggagaacatgtgggacctttcaatcttgggaaccctggtgaattcaccatgcttgaacttgctcaggtggtccaagaaacgattgatcctaatgctaagatcgagttcaggccgaacactgaggacgatccacacaagagaaagcctgatatcgcaaaggcgaaagatttgctcggctgggagccaaaagtccctcttcgcaaaggtcttcctatgatggtcacagactttaggcaacgcatcttcggtgatcacaaagaagatggggcctcgacatccactgtgtaactaggctgcgttatatttttagcttcagaggtatgattgatcataccgtgtccccaactagtgcagtaggggtatggcagcagaaagggcgatccgccctttgtttctctatcatatatagcgttcttagatttccttctcccagaattttgtcatttctgtattttccgtgccgctatcatttaatgccttttgtagactataagcatagcaattatattatatt

SEQ ID NO: 8076 - DNA, 1599 bp, Tabernaemontana elegans
tcggagttgatctacaggggacacgagtcccagccggtgacagacgagtattcgccgaagccacacaagccatggtcgtctgtggtacggccgattcattacatgctccgggagcagcgattagttttcgtgtttgtcggcattgccattgccacgctttttttcgccgtcctaccctcatctcattcgccctacgccaccggtgattacagttacggccacactcacatcaacaacgccctttcttccgactcgctcctgccagccgaatcgggggctcatcgatttaccttccagcagaaccggggcgggttcggacccttcacttcgggcgggaaaatcccactgggcctgaaaaggaagggcttgaggattgtggtcactggtggcgctggattcgtcggcagtcatttggttgaccgtctgatccaaagaggggatagcgtgatcgtagttgataatttcttcactggaaggaaggagaacgtgatgcaccactttggtaaccccagatttgagctcatcagacacgacgtcgtcgagcctctcctgctcgaggtcgaccagatctaccatctggcttgccccgcttctcctgttcattacaagcacaaccccgtgaagactatcaagactaatgtggtggggactctgaacatgcttggattggcgaagagagtcggtgcccggttcttgctaacaagcaccagcgaggtgtacggtgatcctctgcagcatcctcaggttgagacctactggggaaatgtcaaccccatcggtgtccgaagctgctacgatgagggaaagcgtacagcggaaaccttgaccatggactaccacaggggtgcaggcgttgaggtgaggattgctaggatctttaacacctatggcccgcgaatgtgcatcgatgatggacgcgttgttagcaattttgttgctcaggccttgaggaaggagccaatgactgtgtatggcgatggcaaacaaacaagaagtttccaatacgtttcggatttggtcgagggtcttattcgcttgatggaaggagaacatgtgggacctttcaaccttgggaaccctggtgaattcaccatgcttgaacttgctcaggtggtccaagaaacaatcgatccaaatgctaagatcgagttcagaccgaacaccgaggatgatccacacaaaagaaagcctgatatcaacaaggcaaaagatttgctcggatgggagccaaaaattcctcttcgcaaaggtcttcctatgatggtcacagattttaggcaacgtatcttcggtgatcacaaagatggggcctcaaagtccacagtgtaactaggctgcattttaagttttttagcttgagaggtatgggtcttcataccgtgtcccaaccaaactagtgcagtagaggtatgacaagaagaaagggcgatttcccctttttctctatcatatgtagcgttcttagatctcgttctcccatcaatttttgtcatattttgtattttcggtgctgctatcattaatgcctttgtagactaaaagcatagcaattattatattaataactcctgtattattcctattattttttttaatgaa

SEQ ID NO: 8077 - DNA, 1673 bp, Triphysaria pusilla
ttttccaaatccatattcaagcatacatagatcaatttattctcgatccgtgaccaaaaatggcgtccgagttaacattccgcggccacgagtcacaccacacatccgactcatactcacccaaacccgacaagccctggctcggcgtgacccgacccatccactacctcctccgcgagcagcgcctcatcttcatcttcgtcggcatcgcaatcgccacactcgtcttctccacccttccccaatcaaatcaaatctcccagatccccgactcgttcatctcctccgagttaactcggattcaacctcacagatccatgtaccaaaacggccacatgtcgaccgggttcgggatcaactcagttggtaaaattcccctcggattgaaacgcaaaggattacgaatcgttgtcaccggcggagcaggattcgtcggcagccatctggtggatcgattgattagcagaggcgatagtgtgattgtggtggataatttttttactggaaggaaggaaaacgtggcgcatcattttgggaatccaaggtttgaattgattcgacacgacgtcgttgagcctctgctattggaagttgaccagatctatcatctcgcttgccctgcttcccctgttcactataagcacaatcccgtcaaaactatcaagacaaatgtggtagggacattgaatatgctgggcctggctaagagaattggtgcgaggtttttgctgacgagtactagtgaggtgtatggagatccattgcaacacccgcaagttgagacttattggggcaatgttaatcctataggtgtccgaagttgctatgatgagggcaagaggactgctgaaaccttgaccatggactatcacaggggtgccaatgttgaggttaggattgctaggatctttaacacatatggacctcgtatgtgcattgacgatggtcgtgttgttagcaactttgttgctcaggctttgaggaaggagccattaactgtttatggtgatgggaagcagacaagaagctttcagtttgtttctgatctggttgagggactaatgaggttgatggaaggagagcacattggacctttcaatctcggcaacccgggcgaattcactatgctcgaacttgctcaagtggttcaagaaacaattgatccaaatgcgaagatcgagttcaggcccaacacagaagacgacccgcacaagaggaagcccgatatctccaaggcgaaagatatgttgggctgggagccaaaagtggcactccgtaaaggtctcccgatgatggtgtcggatttcaggcaacgtatctttggtgaccaaaaacaagaagtttctacgtcagcctaattacaaacaataggttgtgttggcatattatagtctcaagaagaggacagttttagcaattgatgggtattattgctctggagggttcaagcataatgagagaagaagcaaagcataaagctcaagccctagagctattttagctagttactagaggttattttgtgaggttattattattattactattatgttttcttgttctttctttttctcttcgattgacgttgcacaatgagagcattgttaacggatgaacaccagaaacaataactttgatgtccagctctagaagcatttttttaataaaaagct

SEQ ID NO: 8078 - DNA, 1547 bp, Valeriana officinalis
aggccatgactctcaaccttcgtccgcagcttactctcccaaaccttcaaagccattactcaccgttattcgacctattcgttacatgctcaaagagcagcgtttgatcttcgtcttcctcggcattgcgatcgctactctcgttttcaccttcattcctgctgcatcaaaatcgtctcctttacgcgagagtactcgcggccgattagctctctcagatccgtatttttcggttgagtctgggtatcatagccgcgctgctgcagcgattggatcgtttcattctggaggtaagattccgttaggtcttaaacgaaaagggatgaggattgtggttactggtggggcaggatttgtcggtagtcaccttgttgatcggttgatggcgagaggagatagtgtgattgttgttgataatttctttactggaaggaaggagaacgtgatgcatcattttggaaatccgaggtttgagttgatcagacacgacgtcgttgagcctcttctgttggaagtcgatcagatctatcatctcgcttgtcctgcatctccggttcactacaagttcaatcctgtcaaaactatcaagacaaatgtggtaggaactttgaacatgctagggctcgcgaagagagtcggtgcacgatttctgctaacgagcaccagcgaggtgtacggagatcctctacagcatccgcaggtggaaacctactggggaaacgtcaatccaatcggtgttcgtagttgctatgacgagggaaaacgcacggctgagacattgaccatggattatcatagaggtgctggcgttgaggtgagaattgcaaggatatttaacacatatggtcctagaatgtgcattgatgatgggcgtgttgttagtaattttgttgctcaggcgttgaggaaggagccattgactgtttatggcgacggcaagcaaaccagaagtttccaatacgtttctgatttggtcgagggtttgatgaggctgatggaaggagaacatgttggaccatttaatcttggtaatcccggtgaattcaccatgcttgatctagctcaggtggttcaagagacgatagatccgaatgcaaagatagagttcaagccaaacacagaagacgatccgcacaaaaggaagccagacattacaaaggcgaaagatctgctcggttgggagccaaagattgctcttcgcaagggtctccctttgatggtttcggatttcaggcaacgcatattcggtgaccacaaggaccattcttcttcttccgagtaaattctttctttctcaaaacttgccctttatattagtctccttatacttccaaagagaaatataaagaaagatgccgagttggaaaaaaacaacaccatctctccgatatatagcttgcagcagagagtagcttcttcgatatatctatttccatctacattaattttgctgcttatttagtatgtaatttcaccttttcggtcttattattaatttttatgtacaatacaattgagaagccttttgcaatttggaagaatatcct

SEQ ID NO: 8079 - DNA, 1851 bp, Papaver somniferum
ctcaaactgtacatcatcatcatcaccttcaaatctccacgtaaagtgattttagcctattaacgtaaagtgcttttacaaccccttttatatcaaattcaaatccaattctaaatgttcccgatctcataagccaaaacccagatcttcttcaaaatttcggtaaaaatggcatcggaattaacatacagaagacatgaatcacaagcacaatcagatacttatttaccgaaacccccaaaaccatttttaccagtaactagagctattcgttatatgcttagggaacaaagactcttatttgtaatacttggaatcgccatcgccacagtaatctttgtcctaatcccttcatcatcctcatcaagacagtttacaggaagttatgattcgattccggcacaatactttccgaattctgattcttcaactcgtctatcggagaaatttgtttacgagcaaagatctgtaaattcaggtgggaaaattccgttaggtttgagaaggaaagggttgaggattgttgttactggtggtgctggatttgttggtagtcatctagttgatagattgatggaaaggggggatagtgttatcgttgttgataatttctttacagggaggaaagaaaatgttatgcatcattttggtaatcctagatttgaaatgattagacatgatgttgttgaaccattgttgttggaagttgatcagatctatcatttagcttgtcctgcttctcctgttcattacaaattcaatcctgtcaagactatcaagacaaatgtagttggaacactgaatatgctggggttagctaaaagagttggtgctagatttttgttgacaagtactagtgaagtttatggtgatcctctacagcatcctcaagttgaaacttactggggaaatgtcaatccaattggtgtgaggagttgttatgatgaaggaaaaaggactgcagaaactttggcaatggattaccacagaggtgccggtgttgaggtgagaattgctaggatcttcaacacatatggaccacgaatgtgtatcgatgatggtcgagttgtcagtaattttgttgctcaggcactaagaaaagagccattgacagtgtatggtgatggaaagcaaacaaggagtttccaatacgtttctgatctggtggagggtttgatgaggttaatggaaggagaacatgttggtccattcaatctcggtaaccctggtgaattcaccatgcttgaacttgctcaggtagtgcaggagactatagaccctaatgcaaagatcgagttcagggccaacacagaggatgacccacacaagaggaagccagacatcaccaaggccaaggagcaacttggctgggagcctaaggtagcactacgcaaagggttgcctctcatggtcactgacttccgtcagcgtatctttggagaccacaaagaaggaagcagcagcaccaccagtggtgttgtctctaattcctaaacaattcattattcacatctttagaggcgcccggaggcattgtgataggactccattctattaaaaacaggaggggaaagaaaaagattagaagcttcataggtcatatttctttcaattctcagtatttgttgtatcttctgttgtgtcagtactttaccataatttttgtctttcgttaataggttatcttcatgtactgtgttttgtgagcaacacagattcatcttttgttgatgttaacttcttttaaagcaattcttggatgtttcacaactttaaaggcagtctcagatgtactagtgttctttctgttccgtttttttatactaatcataaatggtaaactatgtatat

SEQ ID NO: 8080 - DNA, 1811 bp, Cichorium intybus
cggtgttcatcctcgttccagtgctgactaaacgggatgcacccagcatccaaagatataccttgttgcctaagactgtttgactattttcatgccggtattagtatttaaacgcctctctacttcctataaaacacacgcgccgcagatcgcagaggcgcgtgacaataactccacgtgccggtgagtttaagccaccaccgtctgacacatttggcctatatatagttcctccactttcttccaccaccacaacactcatacatccaaacttcacaaacacgagaaggaaaatgggatctgagttgatttacagaggtcacgaaccccaacccacatcagatttatactctccaaagccaaacaagccatggtccgccgtgattccgccgattcgctacatgcttcgtgaacaacgtctcgtcttcgtgctcatcggcattgccattgctacattcttcttcgcctttataccgtcatccaccacctactctccccccaccacttccgcctacacttcctactccgtttccggatcggcccagataataaaccctcaacgaccagtttatcggtttcaatcaggtggaaagatcccgttgggtttgaaacgaaaggggttaaggattgtggtcaccggcggtgcaggtttcgtcggaagtcatctcgttgaccgattgatcgaacggggagacagtgtaatagtcgttgataatttcttcaccggaaataaagacaacgtcatgcatcattttggaaaccctaggtttgagctcatcagacacgacgtcgttgagccgttactactagaagtggaccagatctatcaccttgcttgtcctgcttcccctgttcattacaaatacaaccccgtcaaaactatcaagacgaatgtagtggggacattgaatatgcttggactggcgaagagagtcggtgcacggttcttgttaacgagcaccagtgaagtgtacggagatcctctgcaacatcctcaagtggaaacctactggggcaacgtcaatcctatcggtgtcagaagttgctacgatgaaggaaagcgtactgcagaaacgttgaccatggactaccatagaggcgctggcgtcgaggtaaggattgcgaggatatttaatacatatgggcctaggatgtgcattgacgatgggcgtgtcgttagtaactttgttgctcaggctcttaggaaagaaccactcactgtttacggtgatggcaagcaaacaagaagtttccaatatgtttccgatttggtggaaggtctaatgagattgatggaaggagaacatgtcggaccttttaatcttggtaaccctggtgaattcaccatgctcgaactcgcccaggtggtccaggagacaatagactcagaggcaaaaattgagttcaagccaaacacagaagatgatccacacaaaagaaagcccgatatcaccaaagctaaagagcttttaggatggaagcccaaagtccctctccgcaagggtctccctatgatggttgctgacttcaggcagcgcatttttggcgatcagaagagctccggtgccaccgccgccaccacctccaccacggcataggcggggtgttgtatactatgagtccattcttgacggtttagttttgaaattgtatactagttgtatcggttgccttttatttcggttgatgatttttatcatcgtatttataattttgttgcaacctacagattgcatttgttagaagttaatgataacttgttttgtttcacaattactttgaattttaatttacaaatagatttcatgggt

SEQ ID NO: 8081 - DNA, 1661 bp, Triphysaria pusilla
atggcgtccgagttaacattccgtggccacgagtcgcaacacgtgtccgacgcgtactcgcccaaatccggcaagccttggctcggcgtgacccgcccgattcattacctcctccgcgagcagcgcctcgttttcatcttcgtcggcattgctatcgccacatcgtcttctcgatcctcccatcatcaaatcaccaccagcaaatcgtcgacccgttcatctcatccgagttgactcggatccagcctcaccgatccgtataccaaaacggccgcctctcaaccggattcgggatcaactcggtcgggaaaataccactcggattaaaacgcaagggtttacgaatcgtcgtcaccggcggggctggtttcgttggcagccatctagtggatcgtttaattgcccgtggtgatagtgtgatcgtagtggataatttcttcacggggagaaaggaaaacgtggcgcatcattttgggaatccaaggtttgagctgattcgacacgacgtcgttgagcctctactattggaagttgaccagatctatcatctcgcttgccctgcttcgcctgttcattataagcacaatccagtcaaaactatcaagacaaacgtggtggggactctgaacatgcttggactggccaagagaattggagctcggtttctgctaacgagcaccagtgaggtttatggcgatccattgcaacatccccaagttgaaacctattggggaaacgtcaatccaatcggtgtccgaagttgctacgatgaggggaagaggactgctgaaactttgaccatggactatcacagaggtgctaatgttgaggttaggattgctaggatcttcaatacatatggacctcgtatgtgcattgatgatggtcgtgttgttagcaactttgttgctcaggctttgaggaaggagccattaactgtttatggtgatgggaagcagacaagaagctttcagtttgtttctgatctggttgagggacttatgcggttgatggaaggagagcacattggacctttcaatctcggtaacccgggcgaattcactatgctcgaacttgctcaagtggttcaagaaaccattgatccaaatgcgaagatcgagttcaggcccaacacagaagacgacccgcacaagaggaagcccgatatcaccaaggcaaaggatcttttgggctgggagcccaaagtggcactccgtaaaggtctcccgatgatggtctccgacttcaggcaacgtatattcggtgaccataaagaagtttcttcattggcctaattacaaacaataagtagtccttgtctcaagaagaggtcggttttagccatagatggtttattgctgctaatatgcttgatctactttgcccgaccctggagtacagtagggttcaagcatatgacggaagaagcacagcataaagctcgagccctaactcgctttcttgctatcttagcttgttattagaggttattttgggaggttattattattacttttatgtttttattgttctttctttttgccctttgttcgattatgttttcagttgtctttcttatcccatgtgttgctcagtgagttcacaaaccttctcaattcccatgagttatatagttatttagtttaagaaacaaaaaaaaa

SEQ ID NO: 8082 - DNA, 1503 bp, Triphysaria pusilla
ctcacccgcagctgactaatactcctcagcttccaccattttttttacctatatcgagattcaatcatccaacagatcgatttcattctcgatctgcgtaaaaaaatggcgtccgagttaacattccgcggccacgagtcacaccacacatccgtctcatactcacccaaatccgccaagccctggctcggcgtgacccgcccgattcattacctcctccgcgagcagcgcctcgttttcatcttcgtcggcattgccatcgccacactcgtcttctcagtcctcccatcgtcgaatcaccaccagcaaatcgtcgaccctttcatctcatccgagttgactcggatccagcctcaccgatccatataccaaaacggccgcctctcaaccggattcgggatcaactcggtcgggaaaattcccttgggattaaaacgcaagggtttacgaatcgtcgtcaccggcggagctggtttcgtaggcagccatctagtagatcgtttaattgcccgtggtgatagtgtgatcgtagtggataatttcttcacagggagaaaggaaaacgtggcgcatcattttgggaatccaaggtttgagctgattcgacacgacgtcgttgagcctctactattggaagttgaccagatctatcatctcgcttgccctgcttcgcctgttcattataagcacaatccagtcaaaactatcaagacaaacgtggtggggactctgaacatgcttggattggccaagagaattggtgcgcggtttctgctaacgagcacaagtgaggtttatggcgatccattgcaacatccccaagttgaaacctattggggcaacgtcaatccaatcggtgtccgaagttgctacgatgagggggagaggactgctgaaactttgaccatggactatcatagaggtgctaatgtcgaggttaggattgctaggatcttcaatacatatggacctcgtatgtgcattgatgatggtcgtgttgttagcaactttgttgctcaggctttgaggaaggagcccttaactgtttatggtgatgggaagcaaacaagaagctttcagtttgtttctgatctggttgagggacttatgcggttgatggaaggagagcacattggacctttcaatctgggtaacccaggcgaattcacaatgcttgaacttgctcaggtggttcaagaaaccattgatccaaatgcgaagatcgagttcaggcccaacacagaagacgacccgcacaagaggaagcccgatatcaccaaggcaaaagatcttttaggctgggagcccaaagtggcactccgtaaaggtcttccgatgatggtctccgacttcaggcaacgtatcttcggtgaccataaagaagtttcttcattggcctaattacaaacaataagtagtccttgtctcaagaagaggtcggttatagccatagatggtttattgctgctaatatgcttgatctactttgcccgaccctggagt

SEQ ID NO: 8083 - DNA, 1639 bp, Primula obconica
tttatttttacggtttccgttaaaaactccctcacactagtcgccggagaaacccccaaacaaacaaaaaaaagcaaattcaacacgaaaccccattgcatgcacccacccacctagtgagagaaagagaaacgtcacgatggcatcggagctgatcttccgtgggcacgaggcccaattagaatccgacacgtactcacccaaacgggtcaagccttggtccgccgttgttaacccgatccgatacatactacgcgagcagcggcttttgtttgttctcatcggcattgtcatcgcctctttgttcttctctctcctcccttcttcctcgccgtcgtattacccgatcgccgagtactcccgcgacccgatctctgacccgacccgaatcacccaccgcgtcatgtaccaccccttcagcactgccggcggaaaggttccgcttgggttgaaaggaaggggcgtgcgggtggtggtgacaggtggcgcagggtttgtagggagccatctggtggaccgtttgatggagagaggggatagcgtgatcgtggtggataattttttcacaggcaggaaagagaatgtgatgcatcattttaaaaacccgcgctttgagatgattagacacgatgttgttgagccgattcttttggaggtcgatcagatctaccatctcgcttgccctgcctcgcctgttcattacaagttcaaccctgtcaagactatcaagacaaatgtggtggggacattgaacatgttaggtctggcgaagagggttggtgcgaggtttttgctaacaagcaccagcgaggtctacggtgatccactccaacaccctcaggttgaaacttattggggaaatgtcaatcccattggtgttcgaagctgttacgatgaaggaaagagaactgctgagactctgacaatggactaccacagaggtgccaatgttgaggttaggatagctaggattttcaacacatacgggccccggatgtgcattgatgatggccgagttgttagtaattttgttgctcaggcattaaggaaggagccattaactgtttatggcgacgggaagcaaactaggagtttccaatacgtttcggatttggtggagggtctcatgcgcctgatggaaggggaacatgttggtccttttaatctcggaaaccctggtgaattcaccatgctcgaacttgctcaggtggtgcaagacacgatagaccctaatgcaaagatagagttcaaagataatacagaggatgatccacataagcggaagcccgatattagcaaggccaaagatcagctaggatgggaacccaaggtgtctctccgcgatggtctccctcttatggtcaaagattttagacaaaggatcttcggtgaccacaaaaaagagggtggtgcaactgtttaattatatttcaaaatttgggccaaaactagtaaagtattattggccatgctgattcgaatacagaagaacgccttttgggacttcagcacattttgatttttgagtaaagagataagcatgttgttaatttttagttccctcattttccagcaaactgttcatgtatttggttattttctttcttattatgataaatacgtctctgaatttctaagg

SEQ ID NO: 8084 - DNA, 2063 bp, Tropaeolum majus
tccattaggatccttatttagcatcgagccatttgcattagccctctctcactgcttaaaagctcgaaactccgggaaaatatctcagacgcaaacatcattttccggcggcataatctccggcgaggaagaatcgaaaggaaatagtaatccaccgtctggattcaagttgctcgattggatctgattatttggaggtggtttggttttttttatgaaaatttgaattgagagagaaaacagagaggcagaaatggcgtcggagcttatatacagagggcatgaaaccgaccaacctgtatcagattggtactcaccgaaacgtatcaagccatgttttgcggtgactcaatcgattcgttacttgctccgggaacagaggctaatcttcgtgatagtggggatggtgttagcgactttggtcttcgcgtttttccctcattcgtctaggtcaacaaaccttcccgattacgtcgacccgatatccgggtcggactcttactaccccatccaaacacagaagaagaccaacttggagtacttgaaccgagtcggatttggatcggctggtggtaaggttccgctaggtttgaaacggaaaggattaagaatcgtggtgaccggtggggccggattcgtcgggtcccatctcgtggatcgtttgattgcgagaggtgatagcgtgatcgtcgtggataatttcttcactgggaataaagagaatgtgatgcatcatttcgggaatccgaatttcgagctcatcagacatgacgttgttgaacctttgctccttgaagtcgatcagatctatcatctcgcttgccctgcatcgcctgttcattacaaattcaaccccgtcaagactatcaaaacgaatgtggttggaacactcaacatgcttgggttagcaaagcgagttggagcgagatttttgctgacgagcaccagtgaagtatacggagatcctctgcaacatcctcaggtcgaaacatattggggaaacgtgaatcccatcggtgtaagaagctgttatgatgagggaaaacgtactgctgaaactttgaccatggactaccatagaggagctggtgtagaggtacgaattgctaggattttcaatacttatggacctcgaatgtgcattgatgacggtcgtgttgttagcaatttcgttgctcaggcattaaggaaagagcctatgactgtttatggtgacgggaagcagacaaggagtttccaatttgtttccgacctggttgagggattgatgcgcctaatggaaggagagcatgtaggacctttcaatcttggaaatcccggggaattcaccatgcttgagcttgctaaggtggtacaagaaactattgactcaaatgcaaagatagagttcaggccgaacacagaagatgatcctcacaagaggaagccggatatcacaagggctaaagaccttcttggctgggaaccaaaggtatcccttcaaaagggtctacctcttatggtggcggacttccgacaccgtattttcggtgatcacaaagagggtagcaccaccaccaccaccaccaccaccacaacaactaagaactcgtcttaaagtcaagccgttttgtttttatgtacaacttttaccgagcaacccgagaaaaggatgaccgatgactaactatgcatgaaaaaaaaacagaagtctcttttctcttctatcgttcgtgttttttctagaaaaaggtaaaaaaaaacaatatcagcatcaaacggaggcgacggaatctgcaaggagtcttctcttagatatatcttctggaataggttttgaggtgcgccattttggcgagtttattcgcgtcgtcgttgttatttttttttgtaatgttagttttttctttatgggatttgcagctactcaggaaataacactttagtatttgaaatgttgatgatccaagtttttgtctccataaaaaaaaaaaatccaatctcatacaccaaacagaacaaatgtaatactacagcataaaacacagactgaaaaatcgtacctgaccagaagccaaaacaac

SEQ ID NO: 8085 - DNA, 2030 bp, Populus trichocarpa
caaacccacaccatcgccacctccgtgaatcgaaaggaagagtagcccactccccatctcccggcgactctgtctctccttttgaattgaccaaaacaaacaactccccatacatttttgtatccattgttggttcttgtgatctgatacaaaaatgggatcttcagagcttatttttagaggtcacgacgagactcaaccaacacctgatgcttactcgcctaaaccagcgaagccatggctcttcgtcatccgacccgttcgttacctgcttcgcgagaagcgactcgtctttttccttgttggcatggctattgctactgttttcttcactatcctcccttcctcttccccgcatgctcacaaatatgatccactcccagactctttctctcacatctctcacgagttaacaacccctgtgcgttacaaatactacgagccccttcaggtgggattccaatcagccaattcgggcggcaagattccgcttggactcaaaagaaaagggctccgaattgtcgttacaggtggagctgggtttgttgggtcccacttagtggaccgtctgatcgctagaggagatagcgtgatcgtggtggataattttttcacgggaaggaaagagaacgtgatgcatcattttaagaacccgagatttgagttgatcagacacgatgttgtcgagccactgttgttagaagtggaccagatctaccaccttgcttgtcctgcatcgcctgtccactacaagcacaatccggtcaagacgataaaaactaatgtcgtgggcacattgaatatgttgggtttggctaagagagttggtgctcggtttttgcttaccagtaccagcgaggtttatggtgatcctctacagcatcctcaggtcgagacttactggggcaacgttaatcccatcggtgtcaggagttgttacgatgaaggaaagagaacagcagagacattggctatggactatcaccgtggtgccggtgttgaggtcaggattgctagaatcttcaatacttatggaccccggatgtgcattgatgatggccgtgttgttagtaattttgttgctcaggcactgaggaaggaacctatgactgtttatggtgatgggaaacagactaggagttttcaatttgtttctgatttggttgagggcctgatgcgccttatggaaggagaacatgtagggcctttcaatcttgggaatccgggtgaattcaccatgcttgagcttgctcaggtggtccaggaaaccatcgatccaaatgcaaggatagagttcaggcctaacacagaagatgacccacacaagaggaaacctgatattaccaaggctaaagatctccttggatgggaacccaagattccccttcgtaaaggtctgccaatgatggtctcagacttcaggcaacgcatcttcggtgaccacaaggaagaaggcacggccaccaatacgtcaacatcttaagttggcatatatatatatgcttgagaggcaacagaatggtaatctttccagtggataaccaaatttattttttcccaatcccaagcagtatagatagcggtggtagcagcaaactgagcattgtcctatgaggaataggttcggagttgttcttttggcctttgtttgaagtcatctttgtaatttcaatgttactatcccctttaaagaatgttagacagtgaacactgcaatcgaaattaaattttactagttttttttatgcaattgacatgtgtagcagccatagaaataagctttacctctgccctgtcatttactgtttgaatgaatttgttttgtttcatacaccaagtcttcttattgccacaagaaaagttggaaatcacatgaaagaatttaattgtttgaatgaattgacatttgtagcagccattgttctacggcttttaaagcttgcaggatattttctgttcttgcctgacaacgagcgtgtgcatcgtctagacaagttttgagactttaccatgaaagaattgtagtaaaa

SEQ ID NO: 8086 - DNA, 1715 bp, Papaver somniferum
taaaaatggcatcggaattaacatacagaagacatgaatcacaagcacaatcagatacttatttaccaaaaccccaaaaccatttttaccagtaaccagagctattcgttacatgctacgggaacaaagactcttatttgtactactcggaatcgccatcgccacagtaatctttgtcctaatcccttcctcatcctcatcaagacagtttacaggaagttatgattcgattccggcacaatactttccgaattctgattcttcaactcgtctatcggagaaatttgtttacgagcaaagatctgtaaattcaggtgggaaattccgttaggtttgagaaggaaagggttgaggattgttgttactggggtgctggatttgttggtagtcatctagttgatagattgatggaaagggagatagtgttatcgttgttgataatttctttacagggaggaaagaaaatgttatgcatcattttggtaatcctagatttgaaatgattagacatgatgttgttgaaccattgttgttggaagttgatcagatctatcatttagcttgtcctgcttctcctgttcattacaaattcaatcctgtcaagactatcaagacaaatgtagttggaacactgaatatgctggggttagctaaaagagttggtgctagatttttgttgactagtaccagtgaagtttatggtgatcctctacaacatcctcaagttgaaacttactggggaaatgtcaatccaattggtgtaaggagttgttatgatgaaggaaaaggactgcagaaactttggcaatggattaccacagaggtgctggcgttgaggtgagaattgctaggatcttcaacacatatggaccacgaatgtgtatcgatgacggtcgagttgtcagtaattttgttgctcaggcactaagaaaagagccattgacagtgtatggtgatggaaagcaaacaaggagtttccaatacgtttctgatctggtggagggtttgatgaggttaatggaaggagaacatgttggtccattcaatctcggtaaccctggtgaattcaccatgcttgaacttgctcaggtagtacaggagactatagaccctaatgcaaagatcgagttcagggccaacacagaggatgacccacacaagaggaagccagacatcaccaaggccaaggagcaacttggctgggagcctaaggtagcactacgcaaagggttgcctctcatggtcactgacttccgtcagcgtatctttggagaccacaaagaaggaagcagcagcaccagtggtgttgtctctaattcctaaacaatcattattcacatctttaaaggcgccaggaggcattgtgataagactccattctattaaaaacaggagaagaaagaaaaagattagaagcttcataggtcatatttctttcaatttcagtatttgttgtatcttcggttgtgtcagtactttaccataatttttgtctttcattaataggttatcttcgtgtactgtgttttatgagtaacacaggttcatcttttgttgatgttaacttttttaaagcaattcttggatgtgttgctagttgtctggttcttagttcacaactttaaaggcagtctcagatatactagtgttctttctgttccgtttttttatactaatcataaaatggtaaacgatgtatatcagttaagtgtaaa

SEQ ID NO: 8087 - DNA, 2797 bp, Vinca minor
tcccggcgtcattctctctcccaccatcggccatttctccacgatatatatatttttctaatactagatcttctcttctcacttctccgaatccgttttttatacttcacctagattatttacaccagctaattcaacacaaattcctagttaaaattattagccggagcagaattctagagagagaaaatgggttcggagttgatctacaggggacacgagtcccagcaggtgaccgactcgtactcgccgaagccacagaagccatggttcaccgtgattcgtccgattcgttatattctccgagaacagcgactgattttcgtattcgtcggcgttgcaatcgccacactctttttcgccgtccttccgtcttcttctcgttatcccaccatcggcggcgattataatagtatcgaaactaacaaccacatccacaacgctctctctacgaaatcgtactttccgacagattcgggagctcagactcgttttggattacagcagaaccgggtcgggttttccggcgggaaattccgttaggtctaaaaaggaaaggattgaggattgtggtgactggtggggccggatttgtagggagccatttggttgatcggttgatgcaaagaggggatagtgtgattgtagttgataatttcttcactggtaggaaggaaaacgtgatgcaccattttggtaattccagatttgagctcattagacacgacgtcgttgagccacttttgcttgaggttgaccagatctatcacttggcctgtcccgcttctcccgttcattacaagcataaccccgtcaagaccattaagacaaatgtggtggggacattgaacatgcttggattggcgaagagagtcggtgcgcggtttttgctaacgagcaccagtgaggtgtacggtgatcctctgcagcatccacaggttgagacttactggggaaatgtcaaccccatcggtgtgcgaagttgctacgatgagggaaagcgtacagctgagacgttgaccatggactaccacagaggtgctggcgttgaggtgaggatcgctaggatattcaacacatatggaccacgaatgtgcatcgatgatggacgtgttgttagcaattttgttgctcaggccttaaggaaggagccaatgacggtctatggcgacggcaaacagacgagaagtttccaatacgtttcagatttggttgagggtcttatgcgtttaatggagggagaacacgtaggacctttcaatcttggaaaccctggtgaattcaccatgcttgaacttgctcaggttgtccaagaaactatcgatccaaatgctaagatcgtgttcaggccaaacaccgaggatgatccacacaagaggaaacctgatatcacaaaggcgaaggatatgctgggctgggagcctaaagttcctcttcgcaaaggcctgccgatgatggtaacagattttaggcaacggatttttggtgatcacaaagaagatggtaccacatcatccaccgtgtaactaggctacgtacgttaatgtgctttttttttagctatgagaggtatgattttctttgtacggttctccccgtctaagtgcactaggggcaactctcaacttctggatcgttcttgatattactaaatattcaacttcaacttcaatcgtttgtttaacaaggccttcaagctcaatttccatgtccctgtagctctcctgatgcaactctattgtacgccctgtttctcccaccggcaacctactgtttaaggttccgtcaagttcaataattcttgcttccttcaccttgagtagggctgttgcatcatcaagcctcctttccaataaattcaccttctgctttaagccagccacctgaggctctacagcatcggaagactcttggaaaatatcaccagactgtaaaagctgatccgagccgctgtccaaaactgaatcatcgccaaggtcttgcttgccaatttccctaaatttctgaacttctgtttctagctcttcccgcaaagactgcagcgtcataacagactcagccataggatctatattcctagacgggccattgttatcactcttttcgtccttaaacccccaagtcgactcagcaactattttttcttgagaagtgacttcaaactctccaccatattttctgtcaccatcctgtgcttcatcactattttctccatcataattggctgactttccacttcgtctcccgttactggttgcagaattattaccctgcataaacacaaatttggaacttcgcgagtcagattccatgctggaatgagagttttccttctcgattttgaccatttctcctctaagcttcttactagtctccgaccgaacttttccctgatgatccttttgaatagaattgctcaaattcttcccactcagattcttcatctcgttcttatcaaacacaaatcctgatacaataggcatctcatatcttatcttaggagcactagcagctgtagaagacttgctacttcggtcttcactatactcagattccgtcccggcagctaaaataggtgacatccctaaacatgaatcattaatttccgcaaaatgatcaaccacagcactcaaattcctcgctacagcattcgtagaagaaacagacccttcactgttttgtttcatatccacggaaaactgcagtggtctgttcgaatccgcgccttgatcagccaatccccgcttcaataacttaacagtatccaaattacttcccccctcagaactaacatctc

SEQ ID NO: 8088 - DNA, 1574 bp, Aquilegia formosa
aaaaaatggcttcattggttttcagaggccatgatacaacattaataccagattcatattcaccaaaacatccaaaaccatggtcatctttaacacgttcaattcaatatatacttcgagaacaacgtttaatctttgttcttgttggtatggcaattgcagcacttgtatttacaatattaccatcttcaccatcacattataattatagtactatacctgattcatattttacatctgaatcaactcgtcttgctgctgctcatcgtgttgttttcgatcgacgtgttggttttgttggtggtgttggtggaaaaataccattaggattgaaaagaaaagggttaagaattgttgttactggtggtgctggttttgttggaagtcatcttgttgatcgtttaatagctagaggtgatagtgttattgttgttgataatttctttacagggtttaaaggaaatttgattcatcattttggtaatccaagatttgagcttattcgacatgatgtcgttgaaccaattttattagaagttgatcagatctatcatcttgcttgccctgcttcacctgttcattataaattcaatccagtcaagaccatcaagacaaatgtggtaggaacattgaacatgcttggattggcaaagagagttggtgcaaggtttttgctgacaagtacaagtgaagtttatggtgatcctttgcaacacccacaggttgaaacctattggggcaatgttaatcctattggtgttagaagctgctatgatgaaggaaaacgtactgcagaaacattgaccatggattaccacagaggagctggtgttgaggtgaggattgctagaatcttcaacacttatggaccaagaatgtgcattgacgatggtcgtgttgttagtaactttgttgcgcaggcactaaggaaggaaccattaactgtttatggagatgggaagcaaacaaggagtttccaatacgtttctgatctggttgagggtctgatgaggttaatggaaggggaacatgtgggtccctttaaccttggtaaccctggcgaattcaccatgatggagcttgcacaggttgtacaggaaacaatagacccgaatgcaaagattgaattcaggccaaacacagaggacgacccacataagaggaaaccagacatttccaaggctaaggagctcctgggatgggagcctgttgtcccgttacgaaagggtctacctatgatggtcagtgacttccgtcaacgcatctttggtgatcataaagatggttcctctgacatgtcttccacagtctaaaattatgaggaaattctgaaaagaagaaagttttacagcagccaatatccttccatctattagcggaagcagcaacattgttgcctaggtgcttctttttgaatttgtcgtcttttattgtttaaagttttcatcatcaggttattgtccctttgtatgtcatctttaaatttaaggtcaaggtcacaatagacagtacaaacaataccacaatctcaactttgtttggtatcttttgcattagtaaaatttgattacatc

SEQ ID NO: 8089 - DNA, 1800 bp, Nicotiana benthamiana
ggcgaaaaatcctcttgtcccagctctcttccccctatatttatttccaatttccacaaactatccaaaggccagcttttttctctttctgcatatacagaaaagtagagaagagtttttgggagaagaaagggtgggcaataagaaaacccaataatataactatggcttctgaattgatctaccggggaccggaatcacagccggttcccgacgtttacactccgaaaccagacaagccatggttgagtgtaattcgacccgttcgttacttgttacgcgaacaacgcatcgttttcctatttgcaggcattgctatcgcctctcttattttcgcccttttgccctcgtctcgttcgggcagcttaaattatgcgaacaacgcgatctacgactcgtacttaccctccgagtcgactcagtcacaggtggctcaccgtatgatctaccagaaccgacccggattcggctcgttcaatttgggcgggaagatcccgctgggcttgcaacgtaaggggttgaggatcgtagtaaccggtggtgccggttttgtaggtagccaccttgtggaccgtttgattgctagaggtgatagcgtgatcgtcgttgataactttttcaccggtcgcaaagagaatgttatgcaccatttcggtaaccctaggtttgagctcattcgacacgacgtcgttgagccacttttgcttgaagtagaccagatctatcaccttgcttgccctgcttcccctgttcattacaagcataaccccgtcaagactattaagactaatgtggtggggacattgaacatgctgggattagctaaaagagtcggtgcgcggtttttgctaacgagcaccagcgaggtgtacggtgatccattagaacatccacagaaggagacatactggggcaatgttaatcccatcggtgtccgaagttgctacgatgagggaaagcgaacggctgaaacgttgaccatggactaccacagaggtgctggcgtcgaggtgaggattgctaggatctttaacacctatggacctcgtatgtgcattgatgatggtcgcgttgtcagcaactttgtcgctcaggccttaaggaagatgcctttgacggtttatggagatgggaaacaaacaagaagtttccaatttgtttcagatctggttgagggccttatgcgcttgatggaaggagaacatgttgggccattcaacctcgggaaccctggcgaattcacaatgcttgaacttgctaaggtggtacaggaaaccattgatccaaatgctcagattgagttcagaccaaacacagaggatgacccacacaagaggaagcctgatatctcaagggctaaagagttgcttggttgggaaccaaaagtagctctcaggaaaggactgcctatgatggtgcaagactttaggcaacgtatttttgctgaccacaaagaagatacttcttcagccaccatagcttaatagagagtgtatttggatattgtttatggtaactcggtcaggggcgaaatgcaccgcggcgaaagatgaatcttatgctcatttagttcagcaaaagtgcaggcagcagtagactgagccccctagttctttgaatagtttaatagttgttcatgttacattcctgtcaattttgtaattctattgtcctttttcaacacttgatgtagacgagcaacctccattattatcataagaataaacaggttcctattttttcacttaaagtggaacttgattgatattggggctgtttgcaaactatactagaaacaca

SEQ ID NO: 8090 - DNA, 2300 bp, Lotus japonicus
gtttctcactgcatatttgaatcaatgaatggttcattgtttccattcattctctaactctattttctattttaatcaatttaatcactactagtacttgtttccctttctgaaaaaatcttcaatctcactcacccaccattgaccctgcacccaaatgcagccgtccacacttttcaagggcattcccgtcattccacaaaaccccttttccccttaaacactcccacttctctgtttaaatactctgcagatctccacctccattcatttctccctcatctaaccaccaccgtgccgccggcgaccgagttccggcgacttcccaactcgtaactcagtcaatcttctaatcatcttctcttcacaccacttcacaaaatccctgactccatttttctggaatttcaaaccaggaaaaatgggttcggaattgaattacagaaggcacgacgagacccgacccgttaacgatgcttactctcctaaacccgacaaaccatggctctctgtaacccgcccgattcgctacatgctccgcgagcagcgactcctcttcgtcctcgccggcgtcgccatagccaccgtcttcttcaccgtcgtcccttcctcttcctcctcatcctcctccttcaccaccacctcccttaatgagccggtcccgatctcttacttcaaccacgagtacaagcagccggcgttccaccaccgcatccactccgtcgggaagattccactggggatcaagcgaaaggggctccggatcgttgtcaccggcggagccggtttcgtcgggtcgcacctggtggatcggttgatggcgagaggcgacagtgtgatcgtggttgacaatttcttcaccgggaggaaggagaacgtgatgcaccactttggaaaccctaggtttgaactcatccgccacgacgtcgttgagcctctcttgcttgaagtcgatcagatctaccatctcgcttgccctgcttcccctgttcactacaagttcaaccctgtcaaaactatcatatccttttttttttttttttttttttttctgtttctgcattcaatttcaatgtttagattattgatctgtttggatttgaatttggagttcttaactgtgtttgcttcacaagaccaatgtggtgggtacactgaacatgctgggtttggctaagagagttggtgcgagattcttgctaaccagtaccagtgaggtttatggagatcctctgcagcatcctcagaaggaaacctactggggcaacgtcaatcctattggtgttcgaagttgctacgacgagggaaagcgtacggcggagacattgaccatggactaccaccgaggggccggtgttgaggttagaattgctagaatcttcaacacctacggaccccgaatgtgcttagatgatggccgtgtcgttagtaactttgcactgaggaaggagcctttgactgtttatggtgatgggaagcagacaagaagtttccaatatgtgtctgatttggtggagggtctgatgcgccttatggaaggagaacacgtaggacctttcaaccttggaaatccgggtgaattcacaatgcttgaacttgccaaggtggtccaagaaacaatcgacccagatgcaaagatagagtacaggcccaacacagaggatgaccctcacaagagaaagcctgatattgatagggccaaggagctacttggctgggaaccaaaggtggacctgcacaagggcctccctctcatggtttctgacttccgacaacgcatttttggtgaccacaaggaaggtgcaaccgtcgcctaattcttgctcagaccatgttatgtgtaccttagagtgagaagaaagggaagagaagatgctagttccaggataacagtagtacatttccctatcacccccagaggttcattagtaacagcagcatatgatcttcattttgtggttcgttcttcatcaatctttatatgcgggttattattaccttctttgaaaatttgtagccagtcatgatgatttcatttatcaaattcctgttatctatattctatttctacattttgttttatgtaattggtatgtataagagactacagttatagttatttcaacatatttacctttacattttctacttccttcgaacttaaattgtttgcatgggagagggtgtggaagtttttgtgatctgatctctgtctttacccttccctttagccaacattagttctaaagtttgcaattctgcttctgttactattttaaattttaataaaacattctgtc

SEQ ID NO: 8091 - DNA, 1660 bp, Cirsium arvense
ctgtgtaaacctcattttacgcgtgaccggaattgcttcctcacgtggccggaaggagtttaccacctccaccaccaccacctccacctgtcatctctttcttttcttttctttatataaacttccatctctctctccacacaaacaacaccaaatctaagcagtaagcactagacggagatgggatctgagttgacatataggcgtcacgaaccccaaaccatctcagatgcttactcccccaagcctaacaagccatggctttctctcatccgtcccattcgctacatgctccgtgaacaacgtcttctttttgtcctagtcggcattctcatcggtgctttcttcatcgccatcattccatcctctaccaccacctcccaccgccagatcacataccacgatgcctactccgtctctcaactcgctcaaatgatgaaccccaaacaaaccgtttatcgtacctctatgaattccggtggaaaggttcctttgggtctgaaacggaaggggttaaggatagtggtcaccggcggggcgggtttcgtcggaagtcatctcgttgaccggttaatcgctagaggagacagcgtgattgttgttgataatttctttactgggaataaggataacgtcatgcatcattttggaaaccctagatttgagcttattcggcatgatgttgttgagccgttactactcgaagtggatcagatctatcaccttgcttgtcctgcttcccctgttcactacaaatacaatcccgtcaagacaatcaagacgaatgtggtggggacactcaacatgttagggttggccaagagagttggtgcgcggttcttgctaacaagcaccagtgaagtatacggtgatccccttcaacatcctcaagtcgaaacttactggggcaatgtcaatcctattggtgtcagaagttgctacgatgagggaaagcggaccgctgaaacattggccatggactaccatcgaggtgccggggttgaggtgagaattgctaggatattcaacacatatggccctagaatgtgcattgatgatggccgtgtggttagtaattttgttgctcaggcactgagaaaagagcctttaactgtctatggtgatggaaagcaaaccagaagtttccagtttgtttctgacttggtggagggcttgatgcgtttgatggaaggtgaacatgtaggacccttcaatcttggaaaccccggtgaatttaccatgcttgaactagctcaggtggtccaggagacgatagacccaaatgcaaaaatagagtttaagccaaacacagaggacgacccacacaagaggaagccggatatcaccaaggcaaaagatctgttgggatgggaaccaaaggtgcctcttcgcaaaggtctccctatgatggtgtctgactttaggcagcgcatctttggtgatcataaggactcatccagctcggcttagtaaaatatgatatgttttatctttttaaagctacacttcccttggtctaaaactagtaatagtatagcagcagcagagaggtttaagccatcttctacctatcattgtttaggttagagttggctggctatatgtattttcatttttatctggtgggaattattattaattgggtattttactttacaga

SEQ ID NO: 8092 - DNA, 1763 bp, Coffea canephora
agaagagaagaggtgagagagagggagacttgtgagagcatgggttcggagttgatctacaggggacacgagtcccatccggccaccgacgagtactttcccaaaccccccaagccttggctcagcgtgatccgcccgattcgttacatgctccgggagcagcgactcatcttcgtattcgtcggcattgccatagccactcttgtcttcgccctcctcccttcctcctccaattccccctattacaacaccgggggcggttacaattacaatcacggcggtggcagcagcctggagtccatcacatcccggtcgtggaatccccatcggatggcctaccagaaccagctgggagggttcaattcgggcgggaaaattcctctggggctgaagaggaaggggctgaggatcgtggtgacgggtggggccgggttcgtcgggagccatctggtggaccgtctgatggctagaggagatagcgtgatcgtggtagataatttcttcacgggaaggaaggagaatgtgcagcatcacttggggaaccctagattcgagctcatcaggcacgacgtcgtcgagccccttctgttggaggtggaccagatctaccacttggcttgccctgcttctcctgtccattacaagcacaatcctgtcaagactattaagacgaacgtggttgggactctgaacatgctgggactggcaaagagagtgggagcccggtttttgctaaccagcaccagcgaggtgtacggcgaccctctgcaacatccacaagtcgaaacctactggggcaatgtcaaccccatcggtgtccgaagttgttacgatgagggaaagcggactgctgaaacgttgacaatggactaccacaggggtgccgatgttgaggtgaggattgctaggatctttaatacctatggacctagaatgtttcttgatgatggtcgtgttgtcagcaattttgttgctcaggccttgaggaaggaaccattgacagtttatggtgatgggaaacagaccagaagtttccaatacgtttcagatctggttgagggtcttatgcgcttgatggaaggagaacatgtagggcctttcaatcttggaaaccctggtgaattcaccatgctcgaactcgctcaggtggtacaagaaactattgatccaaatgctaagattgagttcaggccaaacacagaggatgacccgcacaaaagaaaaccagatatctcaaaagcgaaagagtttcttggttgggagcccaaaataccgcttaggaagggtcttcctttgatggttgcagattttaggcaacgcatctttggtgaccacaaggaacatggcacctcaacgtcgtgagtttcagcagagcgcctgtgtgttagtgctggacgagactcttgacagagggaaatatgctggacgagactctgtattttagtgcctgtatgctgcttcgtgtatccatgcctaactagttatagtcggggtaatggtggcaaaagtacgatccccttcttgtcgcttcggtatggtaccttagatgtatgtcttttcctgcatttttgtaattttaagtgccctactattgatgctttttgtagaccaccgctgcacagtatctgcatcaattgcagcctattttttcatgctattgcaatagctaaattcgagtttgcttgttgtacactatttcttttggcatccctccggtaggtgcgattggcatttacttgatgcctgaatttccgccattccca

SEQ ID NO: 8093 - DNA, 1956 bp, Eucalyptus grandis
cgcccctcgccggagaatagttttccggcgaacccgacccgacccgaattctctctctctctctctctgcaaatcatccttcgtttctctcgttccgatctcgaaatctccggcctccgatcgtccctgagatcggcaccggaaggaagggagggagaagagagaggacggagaaaagctcgagagaacgaagacggacgggagcgcacgaggaagagagagagagggagggacggccggaatcgggatggggtcggagctgacctaccgggggcacggcgcgcagccggtgacggacgcgtactcgccgaagcccgacaagccgtggctccccgtggcccgcgcgatccgctacctgctccgggagcagcgcctcctcttcgtcctcgtcggcattgccatcgccaccgtcctcttcaccgtcttccccggcggcccctcggcccgccccgggtacggatccgggccctacgacccgatccccggcgcccacgtggcccgctacggtggcggcttcgaccggttcgagagcgagcgcgcgttgtaccagcagcgcgccgggttcgggtcagtgagcgggaaggtgccccttggcctgaagcggaaagggctgcggatcgtggtgacgggcggagccgggttcgtcggatcgcacctggtggaccggctgatggccaggggcgacagcgtcatcgtcgtcgacaacttcttcacggggcggaaggagaacgtgatgcaccacttcgggaacccccggttcgagctgatccgccacgacgtcgtggagccgctcctcctggaggtcgaccagatctaccacctggcctgcccggcgtcgccggtccactacaagttcaatcccgtcaagactatcaagacgaacgtggtcgggacgctgaatatgctcgggttggcgaagcgggtcggggcgcgattcctgctgaccagcacgagcgaggtgtacggagatccgctgcagcaccctcaggtcgagacttactggggcaatgtcaatcccatcggtgtccgaagctgctacgacgagggaaagcggactgccgagacgttgaccatggactaccaccgaggagccagtgtcgaggtgagaattgccaggatcttcaacacgtacggccctcgcatgtgcattgatgacggtcgtgtcgtcagtaacttcgttgctcaggcattgaggaaggaaccgatgaccgtctatggggacgggaagcagacaaggagcttccaatacgtttctgacttggttgagggtctgatgcgtctgatggaaggcgagcatgtgggacctttcaatctcggcaatcctggtgaattcaccatgcttgaacttgctgaggtggtgaaggagacaatcgatccgaatgcaaagatcgagttcaagccaaacacagaagacgacccacacaagaggaagcccgatatcacaaaggccaaggagttgcttggttgggagcctaaggttgcgctccgcaagggtctgcctcttatggtatcggacttcaggcagcgcgtcttcggagaccacaaggaaggagtcgcatctggcagttcgtcttcttaggtcggagcacattatacagtgaaatgagatggtaggggaaggatcgagagaaatcgcgtgggacgacacgctggaacttcccctggacctagaaatcttcagtaccggcacagacggtagagaagcacaagagtcttttacgttctctatggaactagctttttagaggcataatctcgattcaatatatttacctcctttgtaattttcatgtcattatcgaccgtggactaatagagatgaagtttctaaattcttttctttgttttcccctctttggcccttcccttgcgcatctgaggaacaccatgagacagctagtcctgtatttctcttcagcttcagcaatatatgaccgagtttcctgttacttctcc

SEQ ID NO: 8094 - DNA, 1786 bp, Lactuca sativa
aagtacacaaactaggactttccgcaactctctcttacttggaacctactgtttgctttttatgctacatccaaagggccaatttgtaaattcaccctacgccagtctttattctattcattctttctttagtcacctaccggagagtttaaactttaaaccaccgccaccagacatcttctccccatatatataccgccctccactacgcctccaccactcatctctcttcctgtacacatacatagagagaaacagaaacacatagtgaaacgacatgaagatgggatctgagttgacatacaggcggcacgaacctcaacccacgtcggattcttactcaccgaagcccaacaaaccatggctcgctgtcactcgccttgttcgttacatgctccgggaacaacgccttgtgtttgtcctcgtcggcattgtcatcgccacctccgtcttcgcgattcttccttcctccaccaacaccaacacctccatccattcctactccgtctccgaatcgatccaaatgacaaacccgagacgatccgtttatcctactggattcgagtcgtcgttcagtatgggcgggaagattcctttagggctgaaaagaaaggggttaaggattgtggtgactggtggcgcaggtttcgtcggaagtcatctggttgatcggttgattgcgaggggagatagcgtgattgttgttgataatttcttcaccggaaataaagataacgtgatgcatcattttgggaaccctagatttgagctaattcgacacgatgttgttgagcccttactacttgaagtcgatcagatctatcaccttgcttgccctgcttcccctgttcactacaaacacaatcccgtcaagacaatcaaaacgaacgtagtggggacattgaacatgctagggttagcaaagaggatcggagcacgcttcttgctgacaagcaccagtgaggtatacggtgatcctcttcaacatcctcaagtcgaaacctactggggcaacgtcaatcccatcggtgtccgaagctgctacgatgaaggaaagcgtactgcagaaacgttgaccatggactaccatagaggtgctggcgtcgaggtacggattgcaaggatattcaatacatatggtcctcggatgtgcattgacgatggacgtgtcgttagtaactttgttgctcaggcactaaggaaagaacctctcactgtttatggtgatggcaagcaaacaagaagtttccaatatgtttccgatttggttgaaggtctaatacgattaatggaaggagaacatgtcggaccttttaatcttggaaaccccggtgaattcaccatgctcgaactcgcccaggtggtccaggagacaatagactcggaagcgaaaatagagttcaggccaaacacggaagatgatccacacaaaagaaagccagatattacaaaggctaaggagcttctaggatggaatccgaaggtccctctccgcaagggtctccctatgatggtttctgatttcaggcaacgcatttttggtgatcacaagaccaccaccaccgccacctcaacataggtgataggtggggtgttgtatacagtaaagcagttgtattatgttatgagtcttatgactccattctcgattgtttcattttgaaattatatactagttgtctagttatatatattgattaccttttatttgaatggatgagtttttaattttattgcaactcaaaaattatatcctccattataaatcaattttttttttgccacc

SEQ ID NO: 8095 - DNA, 1620 bp, Tropaeolum majus
gctcacttcttaaaaacccaaaacccagctccggtgactatttctcttgccggaaaaaaaataataattaagaacttgattccattccggatctgatcatttgagtgataaattctctcaattttgaattggatacggaaggaggaaatgggatcagagcttacatatagagggcacgaaacggacttaccggcgacagatgggtactcaccgaaacctattaagccatggtacgccgagactcgtccaattcggtacttgctccgagaacagaggcttgtcttcttgctggttggcattgctttagctgctctggtcttcacggtttaccctttcacctctaggtcaactaacattcaaagctacgccgactatatccccatgtctggttcttacgtccccgtccaaaccaagaggaagtctaatttcgagtacctgaatcgggtaggattagggtccgcgggaggtaagattccgctgggtttaaaacggaaaggattaagagtcgtggtgactggcggcgccgggttcgtcgggtcacaccttgtagaccgtcttattgccagaggtgacaacgtgatcgtggttgacaatttcttcaccggaaggaaagagaacgtgatgcaccatttcggaaatccgaatttcgagctcatcagacacgacgttgtggaaccaatcctacttgaagtcgaccagatctaccatctcgcttgccctgcctcacctgttcattacaaattcaatcccgtcaagactatcaagacgaatgtggtggggacactaaacatgcttggattagcaaagagagttggagcgagattcttgctgacgagcaccagtgaggtgtacggagatcctctacaacatcctcaggtcgaaacctattggggcaacgtgaatcccatcggtgtccgaagttgttacgacgagggaaaacgtacagctgagactctcaccatggattaccacagaggagcaggagttgaggtgagaattgctaggatcttcaacacatatggaccacgaatgtgcattgatgatggacgtgttgttagtaactttgttgctcaggcgttaaggaaagagcctatgactgtttatggagatgggaaacaaacgaggagtttccaatttgtttctgatctggttgagggtttgatgcgcctaatggaaggagaacatgtgggaccttttaatcttggaaatcctggtgaattcaccatgcttgagcttgctaaggtggtgcaggaaacaatcgaccctaatgcgaggatagagttcaggcccaacactgaagacgatcctcacaagaggaagccggatataacaaaggctaaaaaccttctcggttgggagccgtcagtatcacttcacaagggtctacctcttatggtgaaagacttcaggcagcgtatctttggtgatcataaggaaggtagctcatcttaagcctcctcgtattattatgtatacaattcaccgagcaccgaatcaaagggaaagtagtcgcatcagaaacagtaaacagaattcacgagtgacttttaaaacctcttgaggggtgtgtattttggcgaaaatatggttttcatcatctttgtgttttttaatggtagg

SEQ ID NO: 8096 - DNA, 1430 bp, Cirsium arvense
cgcgggggacctctctttctctctctacctatacatatagagagagaaacatagagatacaatacacgcaaagaagaagatgggatctgagttgacatatagaggtcatgaagctcaatccatggtggattcctattcgccgaagtttaagaagccatggccggccgttactcgcgttatacgttacatgctcaaggaacaacgtcttgttttcgtcctcgttggcattgcaatcgccaccgtcgtcttcgcgttccgtccttcaaccaccgtctccaccggtcatatcaccgatgcttactccgtctccgaatcggttcagatgatgaatccacgacgatctgtgtatcctattggatttgattcgtttaatttgggcgggaagattccgttagggttgaaacggaaggggttaaggattgtggtgactggtggtgcagggttcgtcggaagtcatctcgttgatcggttgattgcgaggggagatagtgtgattgttgttgataatttcttcaccgggaataaggataacgtgatgcatcactttggaaaccctagatttgagcttattcgacatgatgttgtggagccgttattactcgaggtcgatcagatctatcaccttgcttgccctgcttctcctgttcattacaaatacaatcccgtcaaaacaatcaagacgaatgtagtggggacattgaacatgttagggttggcaaaaagagttggagcacggttcttgctaacgagcaccagtgaggtctacggtgatcctctacaacatccacaagtagaaacatattggggaaacgtgaatcctatcggtgttagaagctgctacgacgagggaaagcgtacagcagaaacgttgaccatggactatcatagaggtgctggggtcgaggtgagaattgcgaggatattcaatacatatggtcctaggatgtgcattgatgatggtcgtgttgttagtaactttgttgctcaggcacttaggaaagaaccgctcactgtttatggtgacggcaagcaaacaaggagtttccaatttgtttccgacttggttgaaggtctaatgagattgatggaaggagaacatgtcggaccttttaatcttggaaaccctggtgaattcaccatgctcgaactcgcacaggtcgttcaagagacaatagacccgaacgcgaaaatagagttcaagccaaacacagaagacgacccacacaaaaggaagccagatatcaccaaggctaaagaacttttgggatggaaacccaaggtgccactacgcaaaggtcttcctatgatggtttcagacttcaggcaacgtatttttggcgatcaaaagaacattggtgcctctaccacgacatagtggcattttgagtccattgtttagtcttgagtttacgtttgatttattaatattt

SEQ ID NO: 8097 - DNA, 1646 bp, Solanum tuberosum
atcttcttttctctctcttttaacccaattttgagagaaagaaaaatcatataatggcttctgaattgatctaccgcggaccggaatcacttccggttcccgacagttacactcccaaaccacacaaaccatggtttactgtaattcgtccccttcgttacttgctacgagaacagagaatcgtttttctattcgcaggcattgctatcgcttctctaatttttgcctttttaccttcttctcgttccggaggatcgaactacgcaaacaccgggatctacgattcgtacttaccgtcggagtcgactcagtctcaggtggctcaccggattatctatcagaatcgggtcgggttcgggtcgtttaattccggtgggaagatcccgttgggattgcagcggaagagtttgaggatcgtggtgactggtggtgctggttttgtaggtagtcatcttgtggaccgtttgattgcgagaggtgatagcgtgatcgtcgttgataatttcttcaccggacggaaagagaatgttatgcatcattttggtaaccctaggtttgagcttattagacatgatgttgttgagccacttttgcttgaagttgaccagatctatcatctcgcttgccctgcttctcccgttcattacaagcataatcccgtcaagactattaagactaatgtggtggggactttgaacatgctgggattggctaaaagagtcggtgcgaggtttttgctgacgagcaccagcgaggtgtacggtgatcctttagaacatccacagaaggagacatactggggcaatgttaatcctattggtgtccgaagttgctacgatgagggaaaacgtacagctgaaacattgaccatggattatcacagaggtgctgaagttgaggtgagaattgctaggatctttaacacttatggacctcgtatgtgcattgatgatggtcgcgttgtcagcaactttgtcgctcaggctttaaggaaggagcctttgacagtttatggtgatgggaaacaaacaagaagtttccaatttgtttcagatctggttgaaggcctaatgcggttgatggaaggagaacatgtcggacccttcaacctcggaaaccctggtgaattcacaatgcttgaacttgctaaggtggtccaggaaaccattgacccaaatgcacagattgtacacaaaccaaacacagaagatgacccacacaagaggaaacctgatatctcaaaggctaaagagttacttggttgggaaccaaaagtggctcttagaaatggtctacctatgatggttcaagactttaggcaacgtattttcggtgatcacaaagaagacagtggaaagatcaccacagcttaatagaagagaaagtgtgtatgtttggatattgttaaacttggtcaggggtgaaatgcacgcgacgaaaagatgactcttgtgttcatgtagtttcaagcagaagtgcaggcagcagaagactgagctgagctccccatgtagttcttttgaatagtcttaatagttggttctttgtcaattttgtaattctattattatccttttgttaacagttgatgtagtcgaccaactttcattattatcataagaataaaactggtacgtattttcccc

SEQ ID NO: 8098 - DNA, 1648 bp, Solanum phureja
aaaaaaaaaaactatcttcttttctctctcttttaacccaattttgagagaaagaaaaatcatataatggcttctgaattgatctaccgcggaccggaatcacttccggttcccgacagttacactcccaaaccacacaaaccatggtttactgttattcgtccccttcgttacttgctacgagaacagagaatcgtttttctattcgcaggcattgctatcgcttctctaatttttgcctttttaccttcttctcgttccggaggatcgaactacgcaaacaccgggatctacgattcgtacttaccgtcggagtcgactcagtctcaggtggctcaccggattatctatcagaatcgggtcgggttcgggtcgtttaattccggtgggaagatcccgttgggattgcagcggaagagtttgaggatcgtggtgactggtggtgctggttttgtaggtagtcatcttgtggaccgtttgattgcgagaggtgatagcgtgatcgtcgttgataatttcttcaccggacggaaagaaaatgttatgcatcattttggtaaccctaggtttgagcttattagacacgatgttgttgagccacttttgcttgaagttgaccagatctatcatctcgcttgccctgcttctcccgttcattacaagcataatcccgtcaagactattaagactaatgtggtggggactttgaacatgctgggattggctaaaagagtcggtgcgaggtttttgctaacgagcaccagcgaggtgtacggtgatcctttagaacatccacagaaggagacatactggggcaatgttaatcctattggtgtccgaagttgctacgatgagggaaaacgtacagctgaaacattgaccatggattatcacagaggtgctgaagttgaggtgagaattgctaggatctttaacacttatggacctcgtatgtgcattgatgatggtcgcgttgtcagcaactttgtcgctcaggctttaaggaaggagcctttgacagtttatggtgatgggaaacaaacaagaagtttccaatttgtttcagatctggttgaaggcctaatgcggttgatggaaggagaacatgtcggacccttcaacctcggaaaccctggtgaattcacaatgcttgaacttgctaaggtggtccaggaaaccattgacccaaatgcacagattgtacacaaaccaaacacagaagatgacccacacaagaggaaacctgatatctcaaaggctaaagagttacttggttgggaaccaaaagtggctcttagaaatggtctacctatgatggttcaagactttaggcaacgtattttcggtgatcacaaagaagacagtggaaagatcaccacagcttaatagaagagaaagtgtgtatgtttggatattgttaaacttggtcaggggtgaaatgcacgcgacgaaaagatgacacttgtgttcatgtagtttcaagcagaagactgagctgagctccccgtgtagttcttttgaatagtcttaatagttggttctttgtcaattttgtaattctattattatccttttgttaacagttgatgtagtcgaccaactttcattattatcataagaataaaacaggttcttattttcccccaac

SEQ ID NO: 8099 - DNA, 1480 bp, Arnica chamissonis
tatgggatctgagttgacatataggcggcaagaaacccaaccgaaacctaacaagcagtcatgggccgccgtcactcgcgtcgttcgttacatgctccgtgaacagcgtctcgtatttgtacttgtcggcattgcaatcgccacctccgtcttcacgctattcccctcctccaacaccaccgatgccttttccgtctccgaatcggtcaaactgatgaacccgcagccatccttttatcctaccacgttcaatatgggcgggaagattcccttaggtttgaagcggaaggggttaaggattgtggtgaccggtggtgcaggttttgtaggaagtcatctcgttgatcggttgattgcgaggggcgacagtgtgattgttgttgataatttcttcaccggtaataaggataacgtcatgcatcactttggaaaccctagatttgagcttattcgtcacgacgttgttgagccgttgctactcgaagtcgatcagatctatcaccttgcctgtcctgcttcccctgttcattacaaattcaaccccgtcaagacaatcaagacaaatgtagtagggacattgaacatgctaggattggccaagagggtgggtgcgcgctttttgctaacaagcaccagcgaggtatacggtgatcctctgcaacaccctcaagtcgaaacctactggggcaacgtcaatcctatcggtgtcagaagctgctacgatgaaggaaagcgtactgcagaaacgttgaccatggactatcatagaggtgctggcgtagaggtgaggattgcgaggatattcaatacatatggtcctaggatgtgcattgatgatggtcgtgttgtcagtaactttgttgctcaggcacttagaaaagagccactcaccgtttatggtgacggcatgcaaacaagaagtttccaatatgtttctgacttggtggaaggtctcatgcggttgatggaaggagaacacgtcggacctttcaatcttggaaaccctggtgaattcaccatgcttgaactcgccaaggtggtccaggacacaatagacccaaatgcaaaaatagagttcaagccaaacacagaagacgacccacacaagaggaagccagatatcaccaaggctaaagaacttctaggttggaagcccaaggtcccgcttcgcaaaggtctccctatgatggtttctgacttcaggcagcgcatttttggtgatcaaaagaacccagccaccacggcgtaggtggcagtttgtatacactaaagaaagcagtttgttttgagtcgattattcattgtttagttttgaaacttcctatatttacgtttgatttattaatatttttggatatgggaaggggtttgattgacttgtagttgtaacccagtttccctttttaaagtgcaaacagcaccaatatcatcataggtgcataaataacggttaacagtatatcgctctttgtttggcagc

SEQ ID NO: 8100 - DNA, 1571 bp, Brassica napus
ccttagaagcgagagatggcaagcgagctgataaaccggcgacacgaggcggaccaaccagcctccgatgcgtactacccgaaaccgatcaaaccgtggttctccgtggcacgtccgatgcgttacatgctccgcgagcagaggctcctcttcgtcctcgtcggcattgcgatcgcgacggttgtcttcacaatcttccctcgcgccacccactccaccccttactcggatccgttctccggtaacgggatgagatccgacgattcgcacgttccggccttccaggcccagaggaagcccagcctcgagtacctgaaccggatgggagcaaccggcgggaaaatcccgctggggctgaaacgcaaagggctgagagtggtggtaaccggtggtgccggtttcgtgggatcgcatctggtggatcggttgatggcgaggggagacacggtgatcgtcgttgacaatttcttcacggggcgtaaagagaacgtgatgcatcacttcggcaaccctaactttgaactcatacgacacgacgtcgtcgagccgattctgctagaggtggatcagatctatcatttggcgtgccctgcctcccctgttcactacaagttcaaccccgtcaagactatcaagaccaatgtggtcggaacgttgaacatgcttggtttggcgaagagagtcggtgctaggtttctcctgacgagtaccagtgaggtttacggtgatcctctccagcatcctcaggttgaaacttactggggcaacgttaatcccatcggtgtccgtagttgctacgacgaaggaaagcgtacggcagagacgcttgccatggactatcaccgtggagccaacgttgaggtcaggattgctaggatcttcaacacctatggtccaagaatgtgtattgatgatgggcgtgttgtcagcaacttcgttgcgcaggcactaaggaaagaacctttgactgtttatggtgatgggaagcagacacgaagtttccagtttgtttctgacctggtcgaaggtctgatgagattgatggaaggagaacatgtcgggccatttaacctgggtaaccctggtgaattcaccatgctcgagctcgctaaggtggttcaagagacgattgatccaaacgcaagcatagagttcagaccaaacacagaagatgaccctcacaagagaaagcctgacatcacaaaggccaaagagcttttaggatgggaacctaaggtgtctcttcgtcagggactccctctcatggtcaaagacttccgtcaacgtgtctttggtgaccagaaggaaggctcctccatggctacaaccaccaccaaaacaacctcagcttgagcacaagcagatgcaagtagcagcagccattgcgagttggatggtttataccaaaaaatacaaggcactgcttgcagctacgatttggagggaagagagcttcgttatttaaattttattttgtttttgagttttctattatgatattatattcgtgtaacgtagagtatgagtttggtacctttactacttattcatggacgtcactacagtttaag

SEQ ID NO: 8101 - DNA, 1606 bp, Papaver somniferum
atcggaattaacatacagaagacatgaatcacaaccacaatcagatacttatttaccaaaacccccaaaaccatttttaccagtaactagagctattcgttatatgctacgggaacaaagactcttatttgtactacttggaatcgccatcgccacagtagtctttgtcctaatcccttcctcatcctcatcaagacaatttacaggaagttatgattcgattccggcacagtactttccgaattctgattcttcaactcgtctatcggagaaatttgtttacgagcaaagatctgtgaattcaggtggaaaaattccgttaggattgaaaaggaaagggttgaggattgttgttactggtggtgctggatttgttggtagtcatctagttgatagacttatggaaaggggggatagtgttatcgttgttgataatttctttacagggaggaaagaaaatgttatgcatcattttggtaatcctagatttgaaatgattagacatgatgttgttgaaccattgttgttggaagttgatcagatctatcatttagcttgtcctgcttctcctgttcattacaaattcaatcctgtcaagactatcaagacaaatgtagttggaacactgaatatgctggggttagctaaaagagttggtgctagatttttgttgacaagtactagtgaagtttatggtgatcctctacagcatcctcaagttgaaacttactggggaaatgtcaatccaattggtgtaaggagttgttatgatgaaggaaaaaggactgcagaaactttggcaatggattaccacagaggtgctggcgttgaggtgagaattgctaggatcttcaacacatatggaccacgaatgtgtatcgatgatggtcgagttgtcagtaattttgttgctcaggcactaagaaaagagccattgacagtgtatggagatggaaagcaaacaaggagtttccaatacgtttctgatctggtggagggtttgatgaggttaatggaaggagaacatgttggtccattcaatctcggtaaccctggtgaattcaccatgcttgaacttgctcaggtagtgcaggagactatagaccctaatgcaaagatcgagttcagggccaacacagaggatgacccacacaagaggaagccagacatcaccaaggccaaggagcaacttggctgggagcctaaggtagcactacgcaaagggttgcctctcatggtcagtgacttccgtcagcgtatctttggagaccacaaagaaggaagcagcagcaccagtggtgtcgtctctaattcctaaacaattcatttttcacatctttaaaggtgcccggaggcattgtgataagaatccattttattaaaaacaggagaagaaatattagaagctccgtgggtcatatttctttcaattctcagtgtttgttgtatcttctgttgtgtcagtactttaccataatttttgtctttcattaatcaggttatcttcatgcaccgtgttttgctagtaactcatattcatcttttgttaatgttaaaacatttttttaaagtcaattcttggtatgcattgctagttgtactaggt

SEQ ID NO: 8102 - DNA, 1720 bp, Solanum lycopersicum
acaccaaaaaataaaaataaaaaactatcttcttttctctctctttttcaacacaattttgagagaagaaaaataaataaatcatgacttccgaattgatttatcgtggaccggaatcagttccggtgaccgacggttacactcccaaaccacataaaccatggtttactgtaattcgtccccttcgttacttgctccgagaacagagaattgtttttctattcgcaggcattgctatcgcttctctaatttttgcttttttaccgtcttctcgttcctccggaggatcgagctacgctaacaccgggatctacgattcgtacttaccgtcggagtcgactgagtctcaggtggctcaccggatgatctatcataatcgggtcgggttcgggtcgattaattccggtgggaagatcccgttgggattaaagcggaaggttttgaggattgtggtgactggtggtgctggttttgttggtagtcatttagtggatcgtttgattgctagaggtgatagtgtgatcgtcgttgataatttcttcaccggacggaaagagaatgttatgcatcattttggtaaccctaggtttgagcttattagacatgatgttgttgagccacttttgcttgaagttgaccagatctatcatctcgcttgccctgcttctcccgttcattacaagcataatcccgtcaaaactatcaagactaatgtagttggtactttgaacatgctgggattggctaaaagagtcggtgcgaggtttttgctaaccagcactagcgaagtgtacggtgatcctttagaacatccacagaaggagacatactggggcaatgttaatcctattggtgtccgaagttgctacgatgagggaaaacgaacagctgaaacattgacgatggattatcacagaggtgcagaagttgaggtgagaattgctaggatctttaacacttatggacctcgtatgtgtattgatgatggtcgggttgtcagcaactttgtcgctcaggctttaaggaaagagcctttgacagtttatggtgatgggaaacaaacaagaagtttccaatttgtttcagatctggttgaaggcttaatgcggttgatggaaggagaacatgtcggacccttcaacctcggaaaccctggtgaattcacaatgcttgaacttgctaaggtggtccaggaaaccattgacccaaatgcacagattgtacacaaaccaaacacagaagatgacccacacaagcgaaaacctgatatctcaaaggctaaagagttacttggttgggaaccgaaagtggctcttagaaatggtttacctatgatggttcaagacttcaggcaacgtattttcggtgatcacaaagaagaaagtgcaaagatcaccacagcttaatagaaaagaaaagagtgtatgtttggatatttgttaaacttggtaaggggtgaaacgcacgcgaagaaaagatgactctcttgtgttgatgtagtttcaagcagaagtgcaggcagcagaagactgagctgagctccccatgtacttcttttgaatagttggttctttgtcaattttgcaattctattattagtattattatccttttgttaacagttgatgtagtagaccaactttcattattctcataagaataaaactggtacgtattttccccaaacttattttgaaatcctcatcttgctcacagtgca

SEQ ID NO: 8103 - DNA, 1731 bp, Brassica napus
gactcttgttcaaagtcgactcagttcccggcgagttcgactcggagataaaaaaaaaacagaagcgagagatggcgagcgagctgataaaccggcgacacgaggcggaccaaccagcatcggatgcgtactacccgaaaccgatcaaaccgtggttctccgtggcacgtccgatgcgttacatgctccgcgaacagaggctcctcttcgtcctcgtcggcattgcgatcgcgacggttgttttcacaatcttcccacgctccacacaatcctccccttactcggatcccttctccggctacggaatgagatccgaggaggagtcgcacgttccgggcctcccggccttccaggcccagaggaagcccagcctcgagtacctgaaccggatgggagcaaccggcgggaaaatcccgctggggctgaaacgcaaagggctgcgagtggtggtaaccggcggtgccggtttcgtgggatcgcatctggtggatcggttgatggcgaggggagacacggtgatcgtcgttgacaatttcttcacggggcgtaaagagaacgtgatgcatcacttcggtaaccctaactttgaactcatacgacacgacgtcgtcgagccgattctcctagaggttgatcagatctatcatttggcgtgccctgcctcacctgttcattacaagttcaaccccgtcaagactatcaagaccaatgtggtcggaacgttgaacatgcttggtttggcgaagagagtcggtgctaggtttcttctgacgagtaccagtgaggtttacggtgatcctctccagcatcctcaggttgaaacttactggggcaacgttaatcccatcggtgtccgtagttgctacgacgaaggaaagcgtacggcagagacgcttgccatggactatcaccgtggagccaacgttgaggtcaggattgctaggatcttcaacacctatggtccaagaatgtgtattgatgatgggcgtgttgtcagcaacttcgttgcgcaggcactaaggaaagaacctttgactgtttatggtgatgggaagcagacacgaagtttccagtttgtttctgacctggtcgaaggtctgatgagattgatggaaggagaacatgtcgggccatttaacctgggtaaccctggtgaattcaccatgctcgagctcgctaaggtggttcaagagacgattgatccaaacgcaaacatagagttcagaccaaacacagaagatgaccctcacaagagaaagcctgacattacaaaggccaaagagcttttaggttgggaaccaaaggtgtctcttcgtcagggactccctctcatggtcaaagacttccgtcaacgtgtctttggtgaccagaaggaaggctcctccatggctacaaccaccaccaaaacaacctcagcttgagcacacgcagatgcaagtagcagcagccattgcgagttggttaatggtttataccaaaaaatacaaggcactgcttgcagctacgatttggagggaagagagcttcgttatttaaattttattttgtttttgagttttctattatgatattatattcgtgtaacgtagagtatgagtttggtacctttactacttattcatggacgtcactacagtttaagaaaaccccttttgtgttttgcaactacaaagattagtggtatctacttataagatatgttctctctgcttcgtgcaacaataaagattt

SEQ ID NO: 8104 - DNA, 1612 bp, Triphysaria pusilla
ccgtggccatgagtcgcaacacgtgtccgacgcgtactcgcccaaatccgccaagccctggctcggcgtgacccgcccgattcactacctcctccgcgagcagcgcctcgttttcatcttcgtcggcattgctatgccacactcgtcttctcggttctcccatcgtcgaatcaccaccagcaaatcgtcgacccgttcatctcatccgagttgactcggatccagcctcaccgatccgtctaccaaaacggccgcctctgactggattcgggatcaactcggtcgggaaaatacccctcggattgaagcgcaagggtttacgaatcgtcgtcaccggcggagctggtttcgttggtagccatctagtggatcgtttaattgcccgtggtgacagtgtgatcgtagtggataattccttcacggggagaaaggaaaacgtggcgcatcattttgggaatccaaggtttgagctgattcgacacgacgtcgttgagcctctactattggaagttgaccagatctaccatctcgcctgccctgcttcgcctgttcattataagcacaatccagtcaaaactatcaagacaaacgtggtggggactctgaacatgcttggactggccaagagaattggtgctcggtttctgctaacgagcaccagtgaggtttatggcgatccattgcaacatccccaagttgaaacctattggggcaacgtcaatccaatcggtgtccgaagttgctacgatgaggggaagaggactgctgaaactttgaccatggactatcacagaggtgctaacgttgaggttaggattgccaggatcttcaatacatatggacctcgtatgtgcattgatgatggtcgtgttgttagcaactttgttgctcaggctttaaggaaggagccattaactgtttatggtgatgggaagcagacaagaagctttcagtttgtttctgatttggttgagggactcatgcggttgatggaaggagagcacattggacctttcaatctgggtaacccaggcgaattcacaatgcttgaacttgctcaggtggttcaagaaaccattgatccaaatgcgaagatcgagttcaggcccaacacagaagacgacccgcacaagaggaagcccgatatcaccaaggcaaaggatcttttgggctgggagcccaaagtggcactccgtaaaggtctcccgatgatggtctccgacttcaggcaacgtatattcggtgaccataaagaagtttcttcatcggcctaattacaaacaataagtagtccttgtctcaagaagaggttggttttagccatagatggtttattgctgctaatatgattgatctactttgcccgaccctggagtacagtagggttcaagcatatgacggaagaagcacagcataaagctcgagccctaactcgctttcttgctatcttagcttgttattagaggttattttgggaggttattattattacttttatgttttcttgttctttctttttgcccttcgattatgttttcagttgtctttcttatcccatgtcttgctcagtgagttcacaaaccttctcaattcccatgagttatatagttat

SEQ ID NO: 8105 - DNA, 1639 bp, Vinca minor
acttctccgaatcgtttttatttacactagttactccaacaattccctggttaaaattattagccggaggaggagaattctagagagaaaatgggttcggagttgatctataggggacacgagtcacagccggcgactgactcctactcgccgaagccacagaagccatggcttacagtgattcgtccgattcgctacattctccgggaacagcgactaatttttgtattcgttggcattgcaatcgccacgctctttttcgcagtccttccgtcttattctcgttcgcctctttatcccaccaccggcggggattataatagtatcggaaataacaaccacatccacaacgctctctctacgaattcgttagaatccggagctcaaaatcgattcggcttccataccaaccgggtcgggttttcgggcgggaaaattccgttaggtctaaaaaggaagggattgaggattgtggtgacgggtggggccggattcgtgggaagtcatttggttgatcggttgatgcaaagaggagatagtgtgattgtagttgataatttcttcactggaaggaaggaaaacgtgatgcaccattttggtaactccagatttgagctcatcagacacgacgtcgttgagcctctcttgcttgaggttgaccagatctaccacttggcctgtcccgcttctcccgttcattacaagcataaccccgtcaagaccatcaagactaatgtggtggggacactgaacatgcttggattggcgaagagagtgggtgcgcggtttttgctaacgagcaccagtgaggtgtacggtgatcctctgcagcatccacaggtagagacctactggggaaatgtcaatcccatcggtgtgcgaagttgctacgatgagggaaagcgtacagctgaaacgttgaccatggactaccacagaggtgctggtgttgaggtgaggatcgccaggatatttaacacatatggacccagaatgtgcatcgacgatggacgtgttgttagcaattttgttgctcaggccttaaggaaggagccaatgacagtctatggcgacggcaaacagacgagaagtttccaatacgtttcagatttggttgagggtcttatgcggttgatggaaggagaacacgtggggcctttcaatcttggtaatcctggtgaattcaccatgcttgaacttgctcaggttgttcaagaaactatcgatccaaatgctaagatcgtgttcaggccaaacaccgaggatgatccacacaagagaaaacccgatatcacaaaagcaaaagacatgctgggctgggaacctaaagtccctcttcgcaaaggtctcccaatgatggtcacagatttcaggcagcgcatatttggtgatcacaaagacgggacctcgacgtccactgtgtaactaggctacgttatacttgtttttttaggctctgagaggtatgattctcactgtatccgttctccccaactagtgcagtagtaggggcatggcagcaaaagggcgagacacccccttgttttcactcttatctgatcacatttggtttcagcgctgctattgtagactatacacatagcaattattatattaaaataactcgtgtatttttttc

SEQ ID NO: 8106 - DNA, 1585 bp, Vinca minor
tccccgccaccatcccctttctccctcacgatatatataatcctcatacaaagtcttctctgaatcgtctataccacttcagctaagctacttgaacaattcctcgtataaattattagccggaggagaatttagagagagataaaatgggttcggagttgatctacaggggacacgagtcccaaccgatgaccgactcgtactcaccgaagccacggttagccgtgattcgtcctattcattacatcctccgggagcagcgactaatcttcgtattcgtcggcattgcaatcgccacgctctttttcgccgtccttccgtcttatcgtccgccttatcctgctgtcgattacagtagtcacatccacagcgcgctctcgacgaattcgtacttgccagccgacgaatccggtgctcatactcgttttagcttgcagagcaatcgggtcgggttttcgggcgggaaaattccgttaggtctaaaaaggaagggaatgaggattgtggtgactggtggggccggatttgttgggagtcatttggttgatcgattgatggaaagaggggatagtgtgattgtagttgataatttcttcactggaaggaaggagaacttgatgcaccactttggtaaccccagatttgagctcattagacacgacgtcgttgagccacttttgcttgaggttgaccagatctatcacttggcctgtcccgcttctcccgttcattacaaacataaccccgtcaagaccatcaagacaaatgtggtggggacactaaacatgcttggattggcgaagagagtgggtgcgcggtttttgctaacgagcaccagtgaggtgtacggtgatcctctgcaacatccacaggttgagacttactggggaaatgtaaatcccatcggtgtgcgaagttgctacgatgaggggaagcgtacagctgaaacgttgacgatggactaccacagaggtgctggtgttgaggtgaggatcgctaggatattcaacacatatggaccccgaatgtgtatcgatgatggacgtgttgttagcaattttgttgctcaggccttaaggaaagagccaatgacagtctatggcgacggcaaacagactagaagtttccaatacgtttcagatttggttgagggtcttatgcggttgatggagggagaacatgtgggacctttcaatcttggaaaccctggtgaattcaccatgcttgaacttgctcaggttgtccaagaaactatcgatccaaatgctaagatcgtgttcaggccaaacaccgaggatgatccacacaagagaaaacctgatatcacaaaggccaaggatatgctggggtgggagcctaaagttcctcttcgcaaaggtctgccaatgatggttacagattttaggcaacgcatttttggtgatcacaaagatgggaccttggcgtccactgtgtaactaggctacctacgttatacttcttttttagcttgagaggtatggttttcttggtaggggcatagcagcagaagggcaaccacccttgtttctacccttaccatatataggctcttgcattttgcccc

SEQ ID NO: 8107 - DNA, 1792 bp, Arabidopsis lyrata
tctcgtaataagagtgaaaaacaagccttgacctgtaacgcttccgtactagttaaatacaccacaaagaccgattcgcttttcactctctcgttcaaggtccgactcagttcccggcgagttcgactcggtgatttttttcctagaaaacaaatttgattgatttcgattttctctctttcgattctagatctagaattcaattttgaggtttggagatggcgaacgagctgatcaatcggcgacacgaggcggatcaaccaatcgccgatgcttattacccgaaaccaatcaaaccatggttcatggtgactcgtccgatgcgttacatgctccgtgaacagagacttatcttcgttctcgttggcattgcaatcgctactttggttttcacaattttccctcgctccacccaatcaagcgcttactcggatccgttctccggttacggaatcagacccgacgaatcgtacgttccggcgatacaagctcagaggaaacctagcctcgagtacctgaaccggatcggagcaacaggcgggaaaatcccactcggattgaaacgcaaagggctaagagtcgttgtcactggtggtgctggattcgttggatcgcatcttgtggatcgtttgatggcgagaggagacactgtgatcgttgttgacaatttcttcactggaaggaaagagaacgttatgcaccatttcagtaaccctaattttgaacttatccgtcacgatgttgttgagccgattcttcttgaggttgatcagatctatcatctggcttgccctgcctctcctgttcattacaaattcaatcccgtcaagactatcaagacgaatgtggttggaacactgaacatgcttggtttggctaagcgagtcggtgctagatttcttctgacgagtaccagtgaggtctatggggatcctctgcagcatcctcaggtcgagacttactggggaaacgttaatccaattggtgttcgtagttgctacgatgaaggaaaacgtacggcagagacgttgaccatggactatcacagaggtgccaatgttgaggtcaggattgctaggatcttcaacacctatggtccaagaatgtgtatagatgatgggcgtgttgtcagcaacttcgttgcacaggcactaaggaaagaaccattgactgtttacggtgatgggaagcagacaaggagtttccaatttgtttctgatctggttgaaggtttgatgagattgatggaaggagaacatgtcgggccatttaacctcggtaaccctggtgaattcacaatgctcgagctcgctaaggtggtccaagagacgattgatcacaacgcaaacatagagttcagaccaaacacagaagacgaccctcacaagagaaagcctgacatcacaaaggccaaagagcttttaggttgggaaccaaaggtctctcttcgtcagggactgcctctcatggtcaaagatttccgtcaacgtgtctttggtgaccagagagaaggctcctccgcagctgcaaccaccaccaagacaacttcagcttgagcaaatgcagaatcgagtagcatccactgcggctggtagtgggttgatagcaaaaatgcaagaccttgcagtgtgaagagagcagagcttcgtttctatttatttcgtttttgatttctgttttgataatcgtgtaaaattagagtaagaatttggtacctttacttactactactattcatgaacctctcactacagttttaaaagaaaaagaacttgtcttttgctattacaaa

SEQ ID NO: 8108 - DNA, 1440 bp, Brassica oleracea
gaagaatccttagaagcgagagatggcaagcgagctgataaaccggcgacacgaggcggaccaaccagcctccgatgcgtactacccgaaaccgatcaaaccgtggttctccgtggcacgtccgatgcgttacatgctccgcgagcagaggctcctcttcgtcctcgtcggcattgcgatcgcgacggtcgttttcacaatcttccctcgcgccacccactccaccccttactcggatccgttctccggttacggaatgagatccgacgattcgcacgttccgggccttccggccttccaggcccagaggaagcccagcctcgagtacctgaaccggatgggagcaaccggcgggaaagtcccgctcgggctgaaacgcaaagggctgagagtggtggtaaccggtggtgccggtttcgtgggatcgcatctggtggatcggttgatggcgaggggagacacggtgatcgtcgttgacaatttcttcacggggcgtaaagagaacgtgatgcatcacttcggtaaccctaactttgaactcatacgacacgacgtcgtcgagccgattctcctagaggttgatcagatctatcatttggcttgccctgcctcacctgttcattacaagttcaaccccgtcaagactatcaagaccaatgtggtcggaacgttgaacatgcttggtttggcgaagagagtcggtgctaggtttcttctgacgagtaccagtgaggtttacggtgatcctctacagcatcctcaggttgaaacttactggggcaacgttaatcccatcggtgtccgtagttgctacgacgaaggaaagcgtacggcagagacgcttgccatggactatcaccgtggagccaacgttgaggtcaggattgctaggatcttcaacacctatggtccaagaatgtgtattgatgatggacgtgttgtcagcaacttcgttgcgcaggcactaaggaaagaacctttgactgtttatggtgatgggaagcagacacgaagtttccagtttgtttctgacctggtcgaaggtctgatgagattgatggaaggagaacatgtcgggccatttaacctgggtaaccctggtgaattcaccatgctcgagctcgctaaggtggttcaagagacgattgatccaaacgcaaacatagagttcagaccaaacacagaagatgaccctcacaagagaaagcctgacatcacaaaggccaaagagcttttaggttgggaaccaaaggtgtctcttcgtcagggactccctctcatggtcaaagacttccgtcaacgtgtatttggtgaccagaaggaaggctcctccatggctacaaccatcaccaaaacaacctcagcttgagtacacgcagatgcaagtagcagcagccattgcgagttggactgcttgcagctacgatttggagggaagag

SEQ ID NO: 8109 - DNA, 1544 bp, Helianthus annuus
aatctcaatctcaatcccacacacagtaacaatatgcaatctgagttgacttaccggcgcccggagtcccaaccgacgtcggaatcttactctccgaagccaaacaaaccgtcatggaccaccgtcaatcgccttgttcattacatgctccgtgaacagcgtctcgtatttctactcatcggcattgccatcgccaccaccgccgtcacgctcctcccctcctccaccatcaccaccggtccaattgatgcctattcggtctctgaatcggtccaactgatgaacccgaggcgatccgtttacaatcctactggattcgagtcgtttaatatgggcgggaagattccgttagggttgaaacggaaggggttaaggatagtggtgaccggcggtgcaggtttcgtgggaagtcatctggttgatcggttgattgcgagaggagatagtgtgattgttgttgataatttcttcaccggtaataaggataacgtcatgcatcactttggaaaccctagatttgaacttattcgacacgacgtcgttgagccgttgttgcttgaagtcgatcagatctatcaccttgcttgccctgcttcccctgttcattacaaatataatccagtcaagacaatcaagacgaatgtagtggggacattgaacatgttagggttagcgaagaggataggtgcgcggttcttgctaacgagcaccagcgaggtgtacggagatcctctgcagcaccctcaggtggaaacctactggggcaacgtgaatccaatcggtgtcagaagctgctacgatgaaggaaaacgtactgcagaaacgttgaccatggactatcatagaggtgccggtgtagaggtgaggattgcgaggatattcaatacatatggtcctaggatgtgcattgacgatggtcgcgttgtcagtaactttgttgctcaggcgcttaggaaagagccgctcactgtttacggcgacggcaagcaaacaagaagtttccaatacgtttctgacttggtggaaggtctaatgcgattgatggaaggagaacacgtgggacctttcaatcttggaaaccctggtgaattcaccatgcttgaactcgctcaggtggtccaggaaacaatagacccaaatgcgaaaatagaattcaagccaaacactgaagatgacccacacaaaaggaagccggacatcaccaaggctaaagaacttctaggttggaagcccaaggtccctcttcgcaaaggtctccctatgatggtttccgacttcaggcagcgcatttttggtgaccaaaagaacccagccaccaccaccaccacctccactaccacggcataggtgtcagtttgtatacactaaagcagttgtgttttgagtcattgtttagttatgaatttcttatatttacgtttgatttattaatatttttggatagagagaaggggttggacttgtacggagatgtgttgtaactgtaccccagttttccttttcaaatgaaacagactataacaacaccaatatcataggtgcaa

SEQ ID NO: 8110 - DNA, 1497 bp, Musa acuminata
cttcgcaaccagatccccgggctatcgacgatggcctccgagctcatctaccgcggcggccacgacgcccacccgccggagagcggcagcgggtacaccccgaagccggagaaacacctcctctggctctggcgcccgcttcgctaccttctgcgggagcagcgccttgtcttcgtgctcgtcggcatggccctcgcctccctcctcttcgccctcgctccctcatcttcctccaccaactcctactcctactcctccgccgcggcggcgaggggattcgtcggggggaaggtgccgctagggatcaagcggaaagggctccgcatcgtggtgacgggcggggccgggttcgtgggcagccacctggtggaccggctgatcgccaggggtgacagcgtgatcgtggtggacaacttcttcacggggcggaaggagaacgtgatgcaccacttcgggaaccccaacttcgagctcatccgccatgacgtcgtcgagcccctgcttctcgaggtcgaccagatctaccacctcgcctgccccgcctcccccgtccactacaagttcaaccccgtcaagaccatcaagaccaatgttgtgggaactctcaacatgctaggcctggccaagcgagtgggggccaggttcctcctcaccagcaccagcgaggtctatggcgatcccttgcagcaccctcaagttgagacctactggggcaatgttaatcccatcggggttaggagctgctatgatgaaggcaagcgtacagcggagacactgaccatggactaccaccgtggtgcccaagtcgaggtgaggattgctcgaatcttcaacacttatgggccccgcatgtgcattgacgatggccgggttgtcagcaactttgttgctcaggccttgaggaaggagccaatgacggtttatggggatggaaagcagacaaggagtttccaatatgtttctgaccttgtggaggggttaatgaggctgatggaaggagaacacattggtccattcaacctgggcaaccctggagagttcacaatgctggagcttgctaaagttgtgcaggaaaccattgaccccaatgctaaaatcgagttccgtcccaacacagaggatgatcctcacaagcgcaagcctgacatcaccagggccaaggaactgctcggctgggagcccaagatccctctccgccagggtcttcctctaatggtctccgactttcacaaacgtatctttggtgatcactctgatgctaaaccatccacaacttccacagccactggaacgggatcctcctaagattcaaagttctcttttggacctggtttgtgctatacaggaaatttacagactacaagaatcccatttggtagaagcgcagcaagagaaggatcatgccttgattggtttaggttctaaatgacttggccattattgtccttttgctggttgctgtataagctactagagattcctgcattgcagtgggac

SEQ ID NO: 8111 - DNA, 1497 bp, Flaveria ramosissima
acatacatctgttgaacagagatcgaagcgaagaagaagaagacgatgggatctgagttgatatacagaggccacgagccccaaacgacgtcggattcatactcacccaaaccccacaaaccctggctctccgtcatccgccccattcgctacctcctccgtgaacaacgcctcctcttcgtcctcatcggcgccgtcatcggcgccgccatcatcgccgtcattccgacctccaccaccaccgccgccgaccgccagatcagctaccgcgacgcctactccctctcccaatcgtcggaccttgtcaaccccggcgacccgttttccgacccgggttcggatccttgaactccggcgggaagatcccgttggggctgaaacgaaaggggctgaggatcgtcgtcaccggcggagcggggttcgtcggaagtcacctcgttgaccgattgatcgctagaggcgatagcgtgattgtcgttgataatttcttcacagggaataaggataacgtgatgcatcattttgggaaccctagatttgagctcattcgtcacgatgttgtggagccgttgctgcttgaagtagatcagatctaccatcttgcgtgccctgcgtcaccggtgcattacaagcacaatcccgttaaaacgatcaagacgaatgtggtggggacgttgaacatgctagggttagcgaagagggttggagctaagttcttgctcacgagcaccagtgaggtgtatggtgatcctctgcaacatcctcaagttgaaacttattggggcaatgttaatccgattggtgttagaagctgctacgatgagggaaagcggactgctgaaacgttagcaatggactaccatcgtggtgctggtgtcgaggtgaggattgctaggatattcaacacatatggtcctaggatgtgcattgatgatgggcgtgtcgttagcaactttgtcgctcaggcacttagaaaagaacctttgactgtttatggtgatgggaagcaaacaagaagtttccaatttgtttcggatctggttgagggtttgatgcgattgatggaaggtgaacatgtcggacctttcaatctcggaaaccctggtgaattcacaatgcttgaacttgctcaggttgtccaagagacgattgacccgaatgcaaagatagagttcaggccaaacacagaggatgatccacacaagcgcaagcctgacataaccaaggcgaaagatctcctcggatgggagccaaaggtgccgctacgcaaaggtctccctatgatggtgtctgactttaggcagcgaatcttcggtgaccataaggacaacattgctacctccacctccacctcagcttaatcggcaacgcttgccattacgatataatgatatgcagcatgagaaaagcgtatactgttttcgctttaaggcaactgttcccttcacccagaacaactagtgtagcagaggttactgtctctctaccattgttcag

SEQ ID NO: 8112 - DNA, 1610 bp, Arnica chamissonis
acaaagggagatgggatctgagttgacatacagaggccacgaagctcaaacgacgtcggattcatattcgcccaaacccaacaaaccatggctctccgtcattcgccccattcgctacatgctccgtgaacagcgtcttctgttcgtcctcatcggcgttttaatcggcgccatcttcatcgccgttcttccatcctccacaaccacctccaaccgtcagatcaactaccatgacgcatactccgtctcccaaacctccgagattctgaacccgagacaacccgtttatcgtcccgggttcggatcgttgaactctggcggaaagattccgttgggcctgaaacggaaggggttacggattgtggtgaccggcggagccggtttcgtcggaagtcatctcgttgaccggttaatcgctagaggagatagcgtaattgttgttgataatttcttcaccggaaataaagataacgtcatgcatcatttcggaaaccctagatttgagcttattcgacacgacgtcgttgagccgttactactggaagtagatcagatctatcatcttgcttgtcctgcttcacctgttcactacaaatacaatcccgtcaaaactatcaagacgaacgtggtggggacattgaacatgctagggttggcgaagagagtcggtgcgcggtttttgctaacgagcaccagtgaggtgtacggtgatcccctgcaacatccgcaagtggaaacttattggggcaatgtcaatcctatcggtgttagaagctgttacgatgagggaaagcggactgcagagacattagcgatggactaccatcgaggtgccgatgtcgaggttaggattgccaggatattcaacacatatggtcctagaatgtgcattgatgatgggcgtgtcgttagtaacttcgttgcgcaggcattgcgaaaagagcccttgactgtttatggtgatgggaagcaaacaagaagtttccaatttgtttcagatttggtggagggtttgatgcgtttgatggaaggcgaacatgtaggacctttcaatcttggaaacccgggtgaattcaccatgcttgaacttgctcaggtggtccaagagacaatcgacccgaatgcaaaaatagagttcaagccaaacacagaggatgacccgcacaagaggaagcctgatataaccaaggcgaaagatctcctgggatgggagccgaaggtgcctctacgcaaaggtctccctatgatggtatccgactttaggcaacggatctttggtgaccataaggacaacgttgccacctccacctctaccaccacctcggcttaaaaacggcaacactttttataccagtaagatatgatgatatgcagaatgaaaaaaggcgtatactgttccggctttaaagccgttctcctcacccagaacagctagcataggagaggttgctgcctctctaccattgttcaggtttgagttggctgtattagattttttggcttgtaatgtcgttttattattgttttcttaaacatgttttgggaacttaattggcattttacagagatgttttacgttgtagcacatcatcttgtctttgatattaata

SEQ ID NO: 8113 - DNA, 1729 bp, Elaeis guineensis
ggcaaaagggagcggagatcctttgcggatacccccctcgaaatatcttccctttacgttttagtctctcgtcctcttccgccgcgaccgccgagatgggctcggagcttatctatcgaggccatgatcaccagccccaggagggcgccggcgggtactcgccgaagcccctgaagcagtggtggtggatctcgaggccactccgctacctcctccgcgagcaaaggctcctctttgtgctcgtcggaatggccctagccaccctcgtcgtcttccttctaccccgggcttcaccggccgcgggatccgccatcggagcccacctcatggtcgaccttgcccgtcgctccaccgccgccgtcggcggcggagggcactacagccaccggacggcgctcccggcgagaggatttgtcggggggaaggtgccgctggggctgaagcggaagggtctgaggatcgtggtgaccggcggtgcgggattcgtcgggagtcatctcgtggaccgtctgattgctcgcggggacagcgtaatcgtggtggataacttcttcaccgggaggaaggagaatgtgatgcaccacttcggaaaccctaacttcgagctcatccgccatgatgtcgtggagccgctcctcctcgaggtcgaccagatctaccacctcgcctgcccggcttctcccgtccactacaagttcaatcccgtcaagactatcaagaccaacgtagtcggaactctcaacatgctcggcctcgccaagagggtcggcgcccgtttccttctcaccagcaccagcgaagtctatggcgaccctctccaacacccccaggttgagacctattggggcaatgtcaatcccattggtgttcggagctgctacgacgagggcaagcgtacggccgagactttgaccatggactaccatcgcggtgcccaagttgaggtgaggattgctcggatctttaacacatacgggcctcgcatgtgcatcgacgatggccgagtcgtcagcaacttcgtggcccaggcgctgaggaaggagccaatgacggtatacggggatgggaagcaaaccagaagtttccagtacgtctcagatctggtcgaggggttgatgaggttgatggaaggggagcacgttgggccattcaaccttgggaatcctggtgaattcacaatgctcgagctcgccaaggtggtgcaagagacaattgaccccaatgcccggatcgagttccggcccaacaccgaggatgacccccacaagcgcaagcctgacatcaacagggcgaaggaacagcttggctgggagcctaagatcgccctccgccagggccttcctctcatggtctctgacttccgcaagcgaatctttggcgaccacacgggctctgatgccaccaccactggaaccggcactgcttgagaatcttctctctccatttcattagtcaattgaggatctgatccatgatacactccaagaaagaataggagagagatcagttccatttacatttatattcttgatgacctggcttattgttcctctatttttagcccttttatctactaccgctgcaggttgaggagagccaactgcagaatagtagtttcagaacctttcattagcatattcttctctcccatttttaagtaatttttctctttgaatgttgaagcaggtattcctagttacttgttattgcgttataaatatagatgttt

SEQ ID NO: 8114 - DNA, 1695 bp, Arabidopsis thaliana
ctctctcgttcaaggtccgactcagttcccggcgagttcgactcggtgattgattttttcctagaaaaataaaatttcttcttaacgattgatcgattttggttttctatctttcgattctagatctagaattcaatttgtgaggtttggagatggcgagcgagctgatcaatcggcgacacgagacggatcaaccaaccgccgatgcttattacccgaaaccaatcaaaccatggttcacggtgactcgtccgatgcgttacatgctccgtgaacagagacttatcttcgttctcgttggcattgcaatcgctactttggttttcacaattttccctcgctccacacaatcaaccccttactcggatcctttctccggttacggaatccgacccgacgaatcgtacgttccggctatacaagctcagaggaaacctagcctcgagtacctgaaccggatcggagcaacaggcgggaaaatcccactgggattgaaacgcaaagggctaagagtggttgtgaccggtggtgctggattcgttggatcgcatctcgtggatcgtttgatggctagaggagatactgtgattgttgttgataatttcttcactggaaggaaagagaacgttatgcaccatttcagtaaccctaactttgagatgatccgtcacgatgtggttgagccgattcttcttgaggttgatcagatctaccatttggcttgccctgcttctcctgttcattacaaattcaatcccgtcaagactatcaagacgaatgtggttggaacattgaacatgcttggtttggctaagcgagttggggctagatttcttctgacgagtaccagtgaggtttatggtgatcctctgcagcatcctcaggttgagacttactggggcaacgttaatcccattggtgttcgtagttgctacgatgaaggaaaacgtacggcagagacgttgaccatggactatcaccgaggtgccaatgttgaggtcagaattgctaggatcttcaacacctatggtccaagaatgtgtatagatgatgggcgtgttgttagtaacttcgttgcacaggcactaaggaaagagccattgactgtttacggtgatgggaagcagacaaggagtttccaatttgtttctgatctggttgaaggtttgatgagactgatggaaggagaacatgtcggcccattcaacctcggtaaccctggtgaattcacgatgctcgagctcgctaaggtggtccaagagacaattgatccgaatgcaaacatagagttcagaccaaacacagaagacgaccctcacaagagaaagcctgacatcacaaaggccaaagagcttttaggttgggaaccaaaggtctctcttcgtcagggactgcctctcatggtcaaagatttccgtcaacgtgtctttggtgaccagaaggaaggctcctccgcagctgcaaccaccaccaagacaacttcagcttgagcaaatgcagaatctgagtagcagccactgcggctggtagtgggtttataacaaaattgcaagagcgtcgtttctttaaatttatttcgcttttgatttctgttttgataatcgtgtaaacgtagagtaagaatttggtacctttacttactactattcatggacctcactacagttttaaaagaaaaaagaacttctcttttga

SEQ ID NO: 8115 - DNA, 1584 bp, Brassica oleracea
aaaaacagaagaatccttagaagcgagagatggcaagcgagctgataaaccggcgacacgaggcggaccaaccagcctccgatgcgtactacccgaaaccgatcaaaccgtggttctccgtggcacgtccgatgcgttacatgctccgcgagcagaggctcctcttcgtcctcgtcggcattgcgatcgcgacggtcgttttcacaatcttccctcgcgccacccactccaccccttactcggatccgttctccggttacggaatgagatccgacgattcgcacgttccgggccttccggccttccaggcccagaggaagcccagcctcgagtacctgaaccggatgggagcaaccggcgggaaaatcccgctggggctgaaacgcaaagggctgagagtggtggtaaccggtggtgccggtttcgtgggatcgcatctggtggatcggttgatggcgaggggagacacggtgatcgtcgttgacaatttcttcacggggcgtaaagagaacgtgatgcatcacttcggtaaccctaactttgaactcatacgacacgacgtcgtcgagccgattctcctagaggttgatcagatctatcatttggcgtgccctgcctcacctgttcattacaagttcaaccccgtcaagactatcaagaccaatgtggtcggaacgttgaacatgcttggtttggcgaagagagtcggtgctaggtttcttctgacgagtaccagtgaggtttacggtgatcctctccagcatcctcaggttgaaacttactggggcaacgttaatcccatcggtgtccgtagttgctacgacgaaggaaagcgtacggcagagacgcttgccatggactatcaccgtggagccaacgttgaggtcaggattgctaggatcttcaacacctatggtccaagaatgtgtattgatgatggacgtgttgtcagcaacttcgttgcgcaggcactaaggaaagaacctttgactgtttatggtgatgggaagcagacacgaagtttccagtttgtttctgacctggtcgaaggtctgatgagattgatggaaggagaacatgtcgggccatttaacctgggtaaccctggtgaattcaccatgctcgagctcgctaaggtggttcaagagacgattgatccaaacgcaaacatagagttcagaccaaacacagaagatgaccctcacaagagaaagcctgacatcacaaaggccaaagagcttttaggttgggaaccaaaggtgtctcttcgtcagggactccctctcatggtcaaagacttccgtcaacgtgtatttggtgaccagaaggaaggctcctccatggctacaaccatcaccaaaacaacctcagcttgagcacacgcagatgcaagtagcagcagccattgcgagttggactgcttgcagctacgatttggagggaagagagcttcgttatttaaattttattttgtttttgagttttctattatgatattatattcgtgtaacgtagagtatttggtacctttactacttattcatggacctcactacagtttaagaaaaccccttttgtgttttg

SEQ ID NO: 8116 - DNA, 2166 bp, Cocos nucifera
ggcggcgtccatgttcgatagtaggcgaacagatcggacgttctggagggaggatgggttagagctattttattcctgcgggttatcagaacgcgaccctttaataaataaataccagagggagtgcgagtgtggcagcggcaccatccacgcgccggacagcgagcgtgggcgtatttacaatcagaccgctgggtctggtctcctccacaaaaaggctgcctcctcccttctttctaacggcaaagaggcaagagggagcggagatcttttgcggagacccctcaaaatatcttctctttacgttttagtacctcgccctcttcctccacgaccgccgggatgggctcggagcttatctatcgaggccacgatccccagccccaggaaggcgccggcgggtactcgccgaagcccctgaagcggtggtggtggatctcgaggccactccgctacctcctccgcgagcaaaggctcctatttgtgctcgtcggaatggccctagccaccctcgtcgtcgcccttctgccccgggcgccaccagccgcgggatccgccgtcggggcccacctcatggtcgaccttgcccgtcgctccaccgccgccgtcagcggcggagggcactacagccatcggacggcgctcccggcgagaggattcgtcggggggaaggtgccgctggggctgaagcggaagggtctgaggatcgtggtgaccggcggcgcggggttcgtcgggagtcatctcgtggaccgtctgattgctcgcggggacagcgtgatcgtggtggataacttcttcaccgggaggaaggagaacgtgatgcaccacttcggaaaccctaactttgagctcatccgccatgacgtcgtggagccgctcctcctcgaggtcgaccagatctaccacctcgcctgcccggcttctcccgtccactataagttcaatcccgtcaagactatcaagaccaacgtggtcggaactctcaacatgctcggcctcgccaagagggtcggtgcccgtttccttctcaccagcaccagcgaagtctatggcgaccctctccaacacccccaggttgagacctattggggcaatgtcaatcccattggcgttcggagctgctacgacgaggggaagcgtacggccgagactttgaccatggactaccatcgcggcgcccaagttgaggtgaggatagctcggatctttaacacatacgggcctcgcatgtgcatagacgatggccgagtcgtcagcaactttgtggcccaggcactgaggaaggagccaatgacggtttacggggatgggaaacaaaccagaagtttccagtacgtctcagatctggtggaggggttgatgaggttgatggaaggggagcatgttgggccattcaaccttgggaatcctggtgaattcacaatgctcgagctcgccaaggtggtgcaagagacaattgaccccaatgcccggatagagttccggcctaacaccgaggacgacccccacaagcgcaagcctgacatcaacagggcgaaggaactgctcggctgggagcccaaggtcgccctccgccagggccttcccctcatggtctctgatttccgcaagcgaatcttcggagaccactccggatccgatgccaccaccaccaccggaaccggcaccgcttgagaatcttctctctctccatttcattaatctattgaggatctgatccatgttacactccaagaaggagaaggagagagatcagttccatttacatttatattcttgatcacttggcttgttgttcctctatttttagcccttatatatagcgactactgctgcaggctgaggaaagacaactgcagaatggtagtaaccggtcgttaccatattcttctctcccatttttaagtaatttttctctttgaatgttgaagcagttgttcctttttacttgttattgcattataaatatagatgttatgtttctttcacggaatttttcatctctcttttggcggcatgccacttgattgttgttaggacataagcgtttctctaagcctacctgtaaagactggaggtcttcagacttctctaacagcaaagcttaatctcgtttggtatgtccttattttaaaagatgccggttggattctaattccatgc

SEQ ID NO: 8117 - DNA, 1751 bp, Musa acuminata
acggcagctccaagaaagtggaactcccgtcgccccacttacgtggccttctcgatcctccgccgatggcctccgagctcatctaccgcggtggccacgacgcttaccgctcggtgagcggcggcgactacgtccccaaaccggagaagcggatcctctggctctcgcgcccgattcgctatctcctccgggagcaacgcctcgtcttcgtgctcgtaggcatggcccttggctcactcttcttcgccctcgctccctcatcttcttcctcctctgccgtggcggccgagatcgccctgcgctcggtggagccgacgaggttcggtgcgttccagcagcaccaccacaggacggcgttcgaggcggcgaataaggggttcgtgggggggaaggtgccgctggggatcaagcggaaggggctgcgcgtcgtggtgacgggcggggccgggttcgtggggagtcacctggtggaccggctgatcgccaggggggacagcgtgatcgtggtggacaacttcttcacggggcggaaggagaacgtgatgcatcacttcgggaaccccaacttcgagctcatccgccacgacgtcgtcgagccgctgctgctcgaggtcgaccagatctaccacctcgcctgccccgcctcccccgtccactacaagttcaacccaatcaagaccatcaagaccaatgtggtgggaactctcaacatgctaggcctggccaagagagtgggggccagattcctcctcaccagcaccagcgaggtctatggtgatccattgcagcaccctcaagttgagacctactggggcaatgttaatcccattggagttaggagctgctatgatgaaggcaagcgcacagcagagacgctgaccatggattaccaccgtggtgcccaagtcgaggtgaggattgctcgaatcttcaacacctatgggcctcgcatgtgcatcgatgatggcagggtggtcagcaattttgttgctcaggccttgaggaaggagccactgactgtttatggagatggaaaccagacaaggagtttccaatatgtctccgacctggtggagggtttgatgaggctgatggaaggagaacatattggtccattcaatctgggaaaccccggagagtttacaatggtggagcttgctaaagttgtgcaggaaaccattgatcccgatgccaaaattgagttccgccccaacacagaggatgatccccacaagcgcaagcctgacatcaccagggccaaggagctgctcggctgggagcccaagatccctctccgccaaggccttccgcttatggtctccgacttccgtaagcgtatctttggtgatcactccgacgccaatccttccacaacttctataactactggcactggatcctcctaagagtctatattttcatcctacacgggatatatacagaccataagaatcccattcggcagaagcgaggagacacacagatcttgggttgcttggtttaggttactaatgagttatccattgtcccatagctgttgtatgagctatactactgctgcaggctgagagatagctgcagctgcattgcagtggtgcaagtccctttggataatacaatttcatcatgtatctttacttgctgtagcagattggccttctgtattggatgttattattgtaatgttagattatgttatattcccttggcagaatgcattattgcaagtatcctgacatgtaaaaagcatg

SEQ ID NO: 8118 - DNA, 1742 bp, Elaeis guineensis
cggcagcgagctccggggaaattacgcaattagatcgtcggagttcttttcgtctactaaaacgtcccttacccttctctcctcacaagtttcaaaggggagaaggaggccgaagatcttttgtggatacccccctcaaaatatcttcccctttacgttttagtccctcgctttccgcctccgccatctccgggatgggttcggagctcatctatagaggccacgagccccagccccaggacggcgccggcgggtactcgccgaagcctccgaagcggtctggctggctctcgtggccgctccgctacctactcggcgagcaaagactcctctgcgtgctcgtcgggatggccttcgcctccctcgccttcgtcctcctcccgcgtgcgtctccggccgcgggatctgccgtcggtgcccaagtcatggtcgacctcgtccgccgctccgccgccggtgtcggcggagggtactacaaccaccgggaggcgctcccggtgaggaggttcatcggggggaaggtgccgctggggctgaagcggaaggggctgaggatcgtagtgaccggcggggcggggttcgtcgggagccatctcgtggaccgtctgcttgctcgcggtgacagcgtgatcgtggtggataacttcttcaccgggaagaaggagaacgtgatgcatcacttcgggaaccctaatttcgagcttatccgccatgatgtcgtggagccgctcctcctcgaggtcgaccagatctaccacctcgcgtgcccggcttctcccgtgcactataagttcaaccccgtcaagactatcaagaccaacgtggtgggaaccctcaacatgctcggcctggccaagagggtcggcgcccgtttcctccttaccagcaccagtgaagtctatggcgaccccctccagcacccccaggttgagacctactggggcaacgtcaatcccattggtgttaggagctgctacgacgagggcaagcgtacagcggagacgctgaccatggactaccatcgtggtgcccacgttgaggttaggattgctcgaatctttaacacgtacgggcctcgcatgtgcatcgacgatggccgggtggtgagcaactttgtggcccaggcgctgaggaaggaaccaatgacagtttacggggatgggaagcaaacgaggagtttccagtacgtctctgatctggtcgaggggttgatgaggctgatggaaggagagcatgttgggccattcaaccttgggaatcctggtgagttcacaatgctggagctcgccaaggtggtgcaggagaccatcgatcccaatgcccggatcgagttccggcccaacactgaggatgatccccacaagcgcaagcctgacatcaccaaggcgaaggaactgctcggctgggagcccaaggtctccctccgccatggtcttcccctcatggtctctgacttccgcaagcgaatcttcggtgaccaatccacatctgatgccggcaacactggcactggcgcctcctaagagtcttcttcgttcttcatttcagtagttaattaaggacccgatccatgtcatgctccaagaaagaggtcaaaagagagatctatataggaggacagagatacagctccagttccatttctattcttgatgtcttggtcttcgttttttttttaggtaaaaaaaattgaggtacttggtcttattattcctttattttacgtccttgctagttacgac

SEQ ID NO: 8119 - DNA, 1590 bp, Brassica rapa
acgctgctgtttgatcgagagagagaggtaggaggagacaaacgagatggctagcgagctgatcaaccgtcgacacgaggctggccaaccacacgccgatgcttactacccgagacctatcaaaccgtggtcctccaccgtgacacgtcctatgcgttacatgctccgtgaacagagactcctcttcgttctcgtcggcattgccatcgcgacattagtattcacaatcttccctcgctccaccccctactcggatcccttctccggttacggaatcaggcccgacgacgagtcgttccaggcccagaggaggcccagtctcttgatgggagcaacaggcgggaaaatcccgctcggtttgaaacgcaaagggctgagagtggtggtgacaggtggcgcggggttcgtgggatcgcagctggtggatcggttgatggtgaggggagacacggtgatcgtcgttgacaacttcttcacgggacgtaaagagaacgtgatgcatcatttcggtagccctaacttcgagctcatacgtcacgatgtggtggagccgatactactggaggtggatcagatctatcatttggcgtgccctgcctcccctgttcactacaagttcaatcccgtcaagacaatcaagacgaatgtggtcgggacgttgaacatgcttggtttggcgaagagagtgggtgctaggtgtctattgacgagtaccagtgaggtttacggtgatcctcttcagcatcctcaggttgagacttactggggcaacgttaatcccatcggtgttcgtagttgctacgacgaagggaagcgtaccgctgagacgctaaccatggactatcaccgtggagccaatgttgaggtcaggattgctaggatcttcaacacctatggtccaagaatgtgcatagatgatgggcgtgttgtcagcaacttcgttgcgcaggcactaaggaaagaaccattgactgtttacggtgatgggaagcagacaagaagtttccagtttgtttctgatctggtcgaaggcttgatgagattgatggaaggagaacatgtagggccatttaacctcggtaaccctggtgaattcaccatgctcgagcttgctaaggtggtgcaagagacaatagatccaaacgcaaacatagcgttcagaccaaacacggaggatgatcctcacaagagaaagcctgacatcacaaaggccaaggagcttcttggttgggaaccaaaggtgtctcttcgtcagggactccctctcatggtcaaagacttccgtcaacgtgtctttggtgaccagaaggaaggctcttccgtgactaccaaaataaccgcagcttaaacagttgcacgtagcagcgatagcgtttggttaatggtttataaccaaaagtagaggcattgcttgcagctacattgtggagagaggagaacttcgtttgttcaaatttaattttgtttttatttatattttgataatatattctgtaacgtttaagagtaagaattttggtgtacttacttattactactattattcatggacttcactacagcttaagaaaaacttgtctgtcatacaaa

SEQ ID NO: 8120 - DNA, 1440 bp, Flaveria ramosissima
tgggatcggagttgatattcagaggccacgagccccaaacgacgtcggattcatactcacccaaaccccacaaaccctggctctccgtcattcgccccatccgctacatgcttcgtgaacaacgtctcctcttcgtcctcatcggcattctcatcggcgccgccgtcatcgccgtcgttcccacctccaccaccaccgccgccgaccgccagatcagctatcgcgacgcctactccctctcccaatcgtcggaccttctcaacccccggcgacccgttttccgacccgggttcggatcgatgaactccggcgggaagatcccgttggggttgaagcgaaaggggttgaggatcgtcgtcaccggcggagcggggttcgtcggaagtcacctcgttgaccgcttgatcgctagaggagatagcgtgattgttgttgataacttcttcacagggaataaggataacgtgatgcatcattttgggaaccctagatttgagctcattcgtcacgatgttgtggagccgttgctgcttgaagtagatcagatctatcatcttgcgtgccctgcttcaccggtgcactacaagcacaatcctgttaaaacgatcaagacgaatgtggtggggactttgaacatgctagggcttgcgaagagggttggagctaggtttttgctcacgagcaccagtgaggtgtatggtgatcctctgcaacaccctcaagttgaaacttattggggcaatgttaatccgattggtgttagaagctgctatgatgagggaaagcggactgctgagacgttagccatggactaccatcgcggtgctggtgttgaggtgaggattgctaggatattcaacacatatggtcctaggatgtgcattgatgatgggcgtgtcgttagcaactttgtagctcaggcacttagaaaagaacccttgactgtttatggtgatgggaagcaaacaagaagtttccaatttgtttcggatttggtcgagggtttgatgcggttgatggaaggcgaacatgtaggacctttcaatcttggaaatcctggtgaattcaccatgcttgaacttgctcaggttgtccaggagacgattgacccgaatgcaaagatagagttcaggccaaacacagaggatgacccacacaagcgcaagcctgatataaccaaggcaaaagatctcctcgggtgggagccaaaggtgccgctacgcaaaggtctccctatgatggtgtctgactttaggcagcgaatcttcggtgaccataaggacaacattgccacctccacctccatctcagcttaatcggaaacggttaccatttaccattacgatataatgatatgcagcatgagaaaaagcgtatactgtttacgcttttaaggcaaatgttcccttcgcccagagcaactagtgtagcagaggttac

SEQ ID NO: 8121 - DNA, 1744 bp, Eutrema halophilum
gtaataaaagtgaataattagccttgaactgtaacgccttggctacttaaatacacaaaaacccgattcgcttttcactcacgttcaaggtcgactcagttcccggcgagttcgactcggagaattttttcttagaaaaaatcgaggcaacgagaaggaagcgagatggcgagcgagctgatcaaccggcgacacgaggcggaccaaccggccgcagatgcttactacccgaaaccaatcaaaccgtggttcatggtgactcgtccgatgcgttacatgctccgagaacagaggcttctctttgttctcgtgggcattgcaatcgcgacattggttttcacaattttccctcgctccacccaatccatcgcctactcggatccgttttccggttacggaatcaggaccgacgagtcgtaccttccggcggtccaggcccagaggaaaccaagcgtggagtacctgaaccggatcggggcaacaggcgggaaaatcccactggggttgaaacggaaagggctgcgagtggtggtgaccggtggtgccggattcgtcgggtcgcatctggtggatcgtctgatggaaagaggagacacagtgatcgtcgtcgataatttcttcacgggtcgcaaagagaacgtgatgcatcatttcggtaaccctaatttcgaaatgatccgccacgacgtcgtcgagccgatcctccttgaggtggatcagatctatcatctggcgtgccctgcctcccctgtccactacaaattcaatcccgtcaagaccatcaagacgaatgtggttggaacgttgaacatgcttggtttggccaagcgagtcggtgccagattcctcctcaccagcaccagtgaggtctacggtgatcctcttcagcatcctcaggtcgagacttactggggcaacgttaatcccatcggtgttcgtagttgctacgatgaagggaagcgtacggcagagactctgaccatggactatcaccgtggtgccaatgttgaggtcaggattgctaggatcttcaacacctacggtccaagaatgtgtatagatgatgggcgtgttgtcagcaacttcgttgcgcaggcactaaggaaagaaccattaactgtttatggtgatgggaagcagacaaggagtttccagtttgtttctgatctggtcgaaggtttgatgagattgatggaaggagaacatgtcgggccatttaacctcggtaaccctggtgaattcaccatgcttgagcttgctaaggtggttcaagagacgattgatccaaacgcaaacatagagttcagaccaaacacagaagatgaccctcacaagagaaagcctgacatcacaaaggccaaggagcttcttggttgggaaccaaaggtctctcttcgtcagggactccctctcatggtcaaagacttccgtcaacgtgtctttggtgaccagaaggaaggctcctccatggctgcaaccaccaccaaaacaacctcagcttgagcaaacgcagatgcaagtagcggccattgcggttggttaatggtttatcaccaaaaaaaatacaaggcattgcttgcagctacaatgtggagagaagagagagcttcgtttcctaaaatttattgtttttgatttctattttggtattatattcgtgtaaacgtagagtaagaatttggtgcctttacaatattcatggacctcactacagtttttgaaaaaaaaacttcgtcaaatcatc

SEQ ID NO: 8122 - DNA, 1527 bp, Brassica oleracea
aaagaaaacgaagaaggaagcgagatggcgagcgagctgatcaaccggcgacacgaggcggatcaacccgccgccgatgcgtactacccgagacctaccaaaccgtggctctccgccacccgcccgatgcgttacatgctgcgcgaacagagactcatcttcgtcatcgtcggaatcgcaatcgcgacattagcgttcacaatcttccctcgctccacccgatccatctcttattccgatccgttctccggctacggaatcaaaccctacgttccggcccagaggaggcccagcatcgagtacacgagccggatcgggtcaacgggcgggaaaatcccgctcggattgaaacgcaaggggctgagagtcgtggtcaccggcggcgcggggttcgtggggtcgcatctggtggatcggctgatggagaggggagacacggtgatcgtggtggataacttcttcacggggagtaaagagaacgtgatgcatcatttcgggaaccctaacttcgagctcatacgccacgacgtcgtcgagcccattcttcttgaggtggatcagatctatcacttggcctgccctgcctcccctgttcactacaagttcaatcccgtcaagactatcaagacgaatgtggttgggacgttgaacatgcttggtttggccaagagagtgggtgctaggtttctactgacgagtactagtgaggtttacggtgatcctcttcagcatcctcaggtcgagacttactggggcaacgttaatcccatcggtgttcgtagttgctacgacgaaggaaagcgtacggcagagactttggccatggactatcaccgtggagccaatgttgaggtcaggattgctaggatcttcaacacatatggtccaagaatgtgtatagatgatggacgtgttgtcagcaactttgttgcgcaggcactaaggaaagaaccgttgactgtttatggtgatgggaagcagacaagaagtttccagtttgtttctgatctggttgaaggtctgatgagattgatggaaggagaacatgtagggccatttaacctgggtaaccctggtgaattcaccatgctcgagcttgctaaggtggtgcaagagacgatagatccaaacgcaaacatagagttcagaccaaacacagaagatgaccctcacaagagaaagcctgacatcacaaaggccaaagagcttttaggatgggaaccaaaggtgtctcttcgtcagggactccctctcatggtcaaagacttccgtcaacgtgtctttggtgacctgaaggaaggctcctccgcgactgcaacaaccaccaaaacaacctcagcttgagcaaacgcagttgcatgtagctgccattgtggtttataaccagaaatcataagccacaatgaggagagaaagagagcttcgtttcataagatttattttgtttttgatttttctattttgacatgatattcgtgtaacgtagagtaagagtggttgcctttacttatattcatgggacctcac

SEQ ID NO: 8123 - DNA, 1596 bp, Brassica napus
actcagttcccggcgagttcgactcggagatttttttccttaaagaaaacgaagaaggaagcgagatggcgagcgagctgatcaaccggcgacacgaggcggatcaacccgccgccgatgcgtactacccgagacctaccaaaccgtggctctccgccacccgcccgatgcgttacatgctgcgcgaacagagactcatgttcgtcatcgtcggaatcgcaatcgcgacattagcgttcacaatcttccctcgctccacccgatccatctcttattccgatccgttctccggctacggaatcaaaccctacgttccggcccagaggaggcccagcatcgagtacacgagccggatcgggtcaacgggcgggaaaatcccgctcggattgaaacgcaaggggctgagagtcgtggtcaccggcggcgcggggttcgtggggtcgcatctggtggatcggttgatggagagaggagacacggtgatcgtcgtggataacttcttcacggggagtaaagagaacgtgatgcatcatttcggtaaccctaacttcgagctcatacgccacgatgtggtggagccgattcttcttgaggtggatcagatctatcatttggcttgccctgcttcccctgttcactacaagttcaatcccgtcaagactatcaagacgaatgtggttgggacgttgaacatgcttggtttggcgaagagagtcggtgctaggtttctcctgacgagtactagtgaggtttacggtgatcctcttcagcatcctcaggtcgagacttactggggcaacgttaatcccatcggtgttcgtagttgctacgacgaaggaaagcgtacggcagagacgttggccatggactatcaccgtggagccaatgttgaggtcaggattgctaggatcttcaacacctacggtccaagaatgtgtatagatgatggacgtgttgtcagcaactttgttgcgcaggcactaaggaaagaaccgttgactgtttatggtgatgggaagcagacacgaagtttccagtttgtttctgatctggtcgaaggtttgatgagattgatggaaggagaacatgtcgggccatttaaccttgggaaccctggtgaattcaccatgctcgagcttgctaaggtggttcaagagactatagatccaaacgcaaacatagagttcagaccaaacacagaagacgaccctcacaagagaaagcctgacatcacaaaggccaaagagcttttaggatgggaaccaaaggtgtctcttcgtcagggactccctctcatggtcaaagacttccgtcaacgtgtctttggtgacctgaaggaaggctcctccgcgactgcaacaaccaccaaaacaacctcagcttgagcaaacgcagttgcatgtagctgccattgtggtttataaccagaaatcataagccacaatgaggagagaaagagagcttcgtttcataagatttattttgtttttgatttttctattttgacatgatattcgtgtaacgtagagtaagagtggttgcctttacttatattcatgggacctcactacagtttaaggaaagcttttgtctttt

SEQ ID NO: 8124 - DNA, 2344 bp, Glycine max
ctctatctcactctcatctcactttcttttcttttcttttctttttccgaatctgaaatttttcctacaaaatccactccctgtcctcaaagacagatccgaaagtggatgccaaatttattacccctcttcgcccgagattatcgtacccattagattcctcttctttcatccttctacactttcctaatttttcacagtattcgatgctgtagagcacaatatagtttatctacacactcttactccgatttttgtcctacccttttcgctattttatctcttttctccgaagaagaggaagaaggggtttctttgaatgatccccagaatcgcgtttgtgctttgattcaacgagcaatgggtgttttgtagattctagtttttgatcttatttttgctgatcaaatttttatttgttgttgatttttgaggtattggggttagcatagcctgaacttttgagttgttgaatgcactttgggatctctgtgttagtgataaatctctgtggatctgagattgtgctgtaaataaaggtgaatcgttgatgaattactcggattaggcaaacaaagtttttttttttttaattgaggtgtgtagttgagtgctttagtaatataataaggatcaagagattgggcttgtatcatggatcatgttattggtggaaaattcaagcttgggaggaagattgggagtggatcgtttggagagctttacttaggtgttaatgtgcaaagtggggaggaagtggctgtgaagctggaatctgtgaagaccaagcacccacagcttcactatgaatcaaaactatatatgcttcttcaagggggaactggtataccccatctaaaatggttcggagttgagggtgactacaatgtcatggttattgatctccttgggccaagtcttgaagacttgtttaactattgcaatagaaaattatccctgaaaacagttctgatgctggcagatcagctaataaacagagttgaatacatgcactcccggggttttctgcatcgcgatataaagcctgacaactttttaatgggtttaggccgcaaggcaaatcaggtatacataattgattatggcctggcaaaaaagtatcgggatcttcaaactcataagcatataccatacagggaaaacaaaaatctcactggaactgctcggtatgcaagtgttaatactcatttgggagttgaacaaagcagaagagatgatctagaatctctcggatatttgctcatgtattttttgagaggaagtctcccatggcaaggcttgagagctggcactaaaaagcaaaaatatgacaagataagtgagaagaagatgcttactccaatagaggtcttatgcaagtcatatccattggagtttacatcatacttccactactgccgaacgttgcggtttgaagataagcctgattattcttatcttaagagactatttcgggacctattcatccgagaaggttatcagtttgattatgtatttgattggactatgctgaagtatcctcaaattggatccagttctagagcccgaccaagtgggaaaccagtcataaaccccggacaatcaggagagagaatagaacggccttcagggggtttctcaggtgctgttgaggcatttgcaaggaggaatggctctggacttgttctgcaaagtgagcattctaggcataggtcttcagatgatgtgccatcttccaaagacgtgcaagctgattctgagaggcctcgcagctcttctcgtaatggcagttcttcaaaaaagcctgtcttgtcaagcagccggccaagctcttctggtgagccaagtgaaagccgtactagccgactggtcttaagcagtggccgactatcaacaactcagagacttcaacctggttttgaatccaaaacatctttatctcgggcttcggcaacaagaggtggtcgtgatgatacactcaggagctttgaactcctgtcacttggttcaggaaaaaggaaatgaagaactgtgtggtcagcagatttcttgtgtcaagggtcttagttctgccctgatactttcctttgagatgtctacacatgttgattactctgtatatttctatccaatgttgggtccttcaaggctaaaaagctcattgaaacttcttgatgaagatttggcagactcttcttatacttcttctgatgttcttccatgattatttcagcagggactcattcatgaagagatactatgttacttaaggaatttgttaatatatggctacttgtaataaatacattctttatttttctgtcgaaggaaaggagaagcatct

SEQ ID NO: 8125 - DNA, 2558 bp, Glycine max
ggacagtcgttcattttcttcctcctctaaccttacattagcctttctttctttctatgttctctctatctcactctcatctcactttcttttcttttcttttctttttccgaatctgaaatttttcctacaaaatccactccctgtcctcaaagacagatccgaaagtggatgccaaatttattacccctcttcgcccgagattatcgtacccattagattcctcttctttcatccttctacactttcctaatttttcacagtattcgatgctgtagagcacaatatagtttatctacacactcttactccgatttttgtcctacccttttcgctattttatctcttttctccgaagaagaggaagaaggggtttctttgaatgatccccagaatcgcgtttgtgctttgattcaacgagcaatgggtgttttgtagattctagtttttgatcttatttttgctgatcaaatttttatttgttgttgatttttgaggtattggggttagcatagcctgaacttttgagttgttgaatgcactttgggatctctgtgttagtgataaatctctgtggatctgagattgtgctgtaaataaaggtgaatcgttgatgaattactcggattaggcaaacaaagtttttttttttttaattgaggtgtgtagttgagtgctttagtaatataataaggatcaagagattgggcttgtatcatggatcatgttattggtggaaaattcaagcttgggaggaagattgggagtggatcgtttggagagctttacttaggtgttaatgtgcaaagtggggaggaagtggctgtgaagctggaatctgtgaagaccaagcacccacagcttcactatgaatcaaaactatatatgcttcttcaagggggaactggtataccccatctaaaatggttcggagttgagggtgactacaatgtcatggttattgatctccttgggccaagtcttgaagacttgtttaactattgcaatagaaaattatccctgaaaacagttctgatgctggcagatcagctaataaacagagttgaatacatgcactcccggggttttctgcatcgcgatataaagcctgacaactttttaatgggtttaggccgcaaggcaaatcaggtatacataattgattatggcctggcaaaaaagtatcgggatcttcaaactcataagcatataccatacagggaaaacaaaaatctcactggaactgctcggtatgcaagtgttaatactcatttgggagttgaacaaagcagaagagatgatctagaatctctcggatatttgctcatgtattttttgagaggaagtctcccatggcaaggcttgagagctggcactaaaaagcaaaaatatgacaagataagtgagaagaagatgcttactccaatagaggtcttatgcaagtcatatccattggagtttacatcatacttccactactgccgaacgttgcggtttgaagataagcctgattattcttatcttaagagactatttcgggacctattcatccgagaaggttatcagtttgattatgtatttgattggactatgctgaagtatcctcaaattggatccagttctagagcccgaccaagtgggaaaccagtcataaaccccggacaatcaggagagagaatagaacggccttcagggggtttctcaggtgctgttgaggcatttgcaaggaggaatggctctggacttgttctgcaaagtgagcattctaggcataggtcttcagatgatgtgccatcttccaaagacgtgcaagctgattctgagaggcctcgcagctcttctcgtaatggcagttcttcaaaaaagcctgtcttgtcaagcagccggccaagctcttctggtgagccaagtgaaagccgtactagccgactggtcttaagcagtggccgactatcaacaactcagagacttcaacctggttttgaatccaaaacatctttatctcgggcttcggcaacaagaggtggtcgtgatgatacactcaggagctttgaactcctgtcacttggttcaggaaaaaggaaatgaagaactgtgtggtcagcagatttcttgtgtcaagggtcttagttctgccctgatactttcctttgagatgtctacacatgttgattactctgtatatttctatccaatgttgggtccttcaaggctaaaaagctcattgaaacttcttgatgaagatttggcagactcttcttatacttcttctgatgttcttccatgattatttcagcagggactcattcatgaagagatactatgttacttaaggaatttgttaatatatggctacttgtaataaatacattctttatttttctgtcgaaggaaaggagaagcatctgcaaaaatgcttttggatgttttgcacccttctatgcatattttatacccgtctattttgttccaatgtacatttgagggaatggaaatgtcaattgttggctccgattatggataagagaatggaaaggcatcatatttgaattcacaaa

SEQ ID NO: 8126 - DNA, 2545 bp, Cajanus cajan
ggagagtcgtccattttgttcgtcctgtaaccttacattagctcttctttgtatgcttctctctatctctcatctcattttcttttcttttccggaatctcattttttccctacaaattccactccctgtcctcaaagacagatccgaaagcggatgccaaatctattgcccctctccgccccagattatcgtacccattagattcctcttccttctacactctttgcaattcttttcacactattcactgctatagagcacaatatagcttatctactcactctcactccgatttttgtcccacccttttcactattttagctcttttcttcgaagaagaggaaaaggggtttctttgaataaccccacaatcgcgattgtgctttggttcaacgagcaatgggtgttttgtagattctagttcttgatcttattttcattgatcaaaagttttttttttttttttttttgctgatttttgaggtaccggtgtaagcatagcctattttttaagttattaaatacactttcggatctttgtgttaatgttaaatctcgttggatctgagtttgtgctgtaaataaggatgaatagttgatgcaatacccggaataggcaaaaaaaaagtgtatttttttgttgttgtgtgtagtagagtggttttgtaatttaacaaggatcaagagattgggtttgtatcatggatcatgttattggtggaaaattcaagcttgggaggaagattggcagtggatcgtttggagagctttacttaggtgttaatgtacaaagtggagaggaagttgctgtcaagctggaatctgtgaagaccaagcatccccagcttcactacgagtcaaaattgtatatgcttcttcaagggggaactggtataccccatctaaaatggtttggagttgagggagactacaatgtcatggttattgacctccttgggccaagtcttgaagacttgtttaactattgcaataggaaattcactctgaaaacagttctgatgctggcagatcagctaattaacagagttgagtacatgcactcccggggttttctgcatcgtgatataaagcctgacaactttttaatgggtttaggccgtaaggcaaatcaggtatacataattgattatggccttgcaaaaaagtatcgggatcttcagactcataagcatataccatacagggaaaacaaaaacctcactggaactgctcggtatgcaagtgttaatactcatctgggagttgaacaaagcagaagagatgatctagaatctcttggttatgtgctcatgtactttttgagaggaagtctcccatggcaaggcttgaaagctggcaataaaaagcaaaaatatgacaagataagtgagaaaaagatgcttactccaatagaggtcttatgcaagtcatatccattggaattcacatcatacttccactattgccgatcgttgcggtttgaagataagcctgattattcctatcttaagagactctttcgggacctattcatccgagaaggttatcagtttgattatgtatttgattggactatgttgaagtatccccaaattggatccagttctagagcgcgaccaagtgggaaaccagtcataaacccaggacaatccggagagagaatagaacggccttcagggggaccagagatccgggatagattctcaggtgcagttgaggcctttgcaagaaggaatagctctggacttggtctgcatagtgatcattctaggcataataggtcttcagatgatgtgccatcttccaaagacgtgcaagctgattcggataggcctcgcagctcttctcgtaacggaagttcttcaaaaaagcctgtcttgtcaagcagcaggccgagctcttctggtgagcctagtgaaagccgtgctagccgactggtctcaagcagtggccgactatcaacaactcagagacttcaacctggttttgagtccaaatcatctttaactcggccttcggtgacaaggggtggtgggcgtgatgatacactcaggagctttgaactcctctcacttgctactggaaaacgcaaatgaagaactgtatggttagcagatttcttgtgtcaagggtcttagttctgccttcacactttcctttgagatgtctacacatgttgattactctgtatatttgcatccatgttgggtcctttcaaggctaaagttcattgaaacttctccatgaagatttggcactcttcttatacctcttcagatgttcttccatgattatttcagcatggacccattcgtgaggagatattatgttacttaaggaatttgttaatatatggctacttgtaataaatacgttctctatttttctgttgaaggaaaggaaaagaatgcttttggaagatttgcaccttttctatgcatatttcgtgcccgactattttgttctaatatacaatttgttggctccaattatggataagagagaaagatattggcgtgcttttagccagtttgacttatgtgt

SEQ ID NO: 8127 - DNA, 2436 bp, Phaseolus vulgaris
atctctcatatcactttcttttcttttctttttttccgaatctgaaatttttcctacaaaatctactccctgtcctcacagacagatccgaaggttgatgctaaatctatcacccctctttgcccgataatatcgtacctattagattcttcttccttctacattactgcatttttttcatactattcgccgctgtagaacataatttagtttttctactcactgttactccgttcttttcccacccttctcgccattcgatctcttttcctcgtagaagaggaaaaagggtttctttgaacgaccccagaatcgcaatgggtgttttgtagattctggttcccgatcttacttctgttgatcaaaacttgtttcttatgatttttacggtattgggattagcatagcctgaaattttgagttattaaatatactttcggatcattgggttagtggcaaatctcgttggatctgagattgtgctgtaaataactcaatcgttgatgagatactcggaataggcaaaaaaataataatttttgtttgagttgcgtagtagagtgtttttgtaatttaacaaggatcaggagattgggtttgtatcatggatcatgttattggtggaaaattcaagctcggtaggaagattgggagtggatcgtttggagagctttacttaggtgttaatgtacaaagtggagaggaagtggctgtcaagctagaacctgtgaagaccaagcatccccagcttcactatgagtctaaattgtatatgcttctccaagggggaactggtataccccatctaaaatggtttggaagtgagggtgactacaatgtcatggctattgacctccttgggccaagtcttgaagacttgtttaactattgtaataggaaattatctctgaaaacagttctgatgctggcagatcagctaataaacagagttgagtacatgcactcccggggttttctgcatcgagatataaagcctgacaactttttaatgggtttaggccggaaggcaaatcaggtatacataattgattatggccttgcaaaaaagtaccgggatcttcaaacacataagcatataccatacagggaaaacaaaaacctcactggcactgctcgttatgcaagtgttaatactcatcttggagttgagcaaagcagaagagatgatctagaatctcttggttatgtgctcatgtattttttgagaggaagtctcccatggcaaggcttgaaagctggcactaaaaagcaaaagtatgacaagataagtgaaaagaagatgcttactccaatagaggtcctatgcaagtcctatccaatggaatttgcatcatacttccactattgccgatcgttgcggtttgaagataagcccgattattcttatcttaagagactctttcgggacctattcatccgagaaggttatcagtttgactatgtatttgattggacaatgttgaagtatccacaaattggatccagctctagagctcgaccaagtgggaaaccagtcataaacccagggcaatcaggagaacggccttcagcggtaccagatattcgagatagattctctggtgcagttgaggcatttgcgaggaggaatggctcaggacttggtctgcatggtgatcattctaggcataggtcttccgatgatgtcccatcgtcgtccaaagatgtgcaacctgattctgagaggcctcgtagttcttctcgtaatggcagttcttcaaaaaagcctgtcttgtcaagcagccgaccaagctcttctggcgagcccagtgaaagccgcgttagccgactggtctcaagcagtggcagactatcaacaactcagagacttcaagctggttctgagtctaaaacatctctaactcgggcttcagggacaagacttggccgtgacgatgccctcaggagctttgaactcctgtcacttggtacgggaaaaaggaaatgaagcacttcgtgatcagaagatttattgtgtcaagggtcttagttctgcgctgatactttcatctgagatgtctacaaatgttgattactctgtatatttccatccaatattgaggctaaagctcgttcaaacttcttcttgaagatttgaaagactcttatacctcttcggatgttcttccatgattatttcagcatggacccattcatgaagagatactatgttacttaagtaagttgttaatatggctacttgtaagttgtaataaatacatcattctctatttttctgttaaaggaatggaaaagaatctgcaaaagtgcttttggaagttttgtacctttctattcatatttcgtaaccagaggatttcattctaatgtacatttaagggaatgacattattggttccaataatgaaaacgagaatgaaaatgcccttacgagca

SEQ ID NO: 8128 - DNA, 2419 bp, Quercus alba
acgcgtctagtgacttcgaagtctcccccacccactctctctctctctctctcattcttttcctgaaaacacaacacaataattttccgtttaaagaaacaaccgctttttatttccttttcttcaacctttgttttatctcatcttgattttaccaagaaaagaaaaaaacaaaacaaagaaatacccttttgatgaccctgaatcccgggtttttattcggtgattattgggctttctttagatttttatattttttttaattgtagttgtatcctatgttagagttaggtgtattacatagaatttttttttttttgatattgaattttttgggggaaaagtttggatttttgagcttagtatttgaagagtagaaaagggtattttttttcttcttgggatcattgtgtttctgttggagttaggtggatctgagagtggattagaatcaaagatctattggtgatgagctttttggataagcaaaaagctttttgacattttagtattgtattaaaagagttaggagggtgagcttgttggttttgtatttactttgattgggaattgaaccatggatcatgtgattggtgggaagtttaagctcgggcgaaagatcggtagtggatcatttggagaactctatttgggggttaatatacaaagtggagaggaagtggctgtaaagctggaatctgtgaagaccaagcaccctcagcttcattatgagtcaaaattatacatgcttctacaaggaggaacgggtatcccccatctgaaatggtttggcgttgagggagagtacaatgttatggttattgaccttcttggcccaagcctagaagacctgttcaactattgcaaccggaagttttctttgaaaacggttttaatgcttgcagatcagttgataaacagagttgagtatatgcactcacggggttttcttcaccgtgatataaagcctgacaactttttgatgggtttagggcgcaaagctaatcaggtatatataattgattatggtcttgcaaaaaagtatagagatcttcaaacacacaagcacataccatacagggaaaacaaaaatctcacaggaacagctcgttatgcaagtgttaatacccaccttggagttgaacaaagcagaagagatgatcttgagtctcttggttatgtgcttatgtattttctgaggggaagccttccgtggcagggcttaaaagcaggtacgaagaagcagaaatatgacaagatcagtgaaaagaagatgcttactcccatagaggttctttgcaaatcgtatccatcagagttcacatcatacttccattactgccgatcattgcggtttgaggacaaacctgattattcgtatctgaagaggcttttccgagatctatttattcgagaaggttatcagtttgactatgtgtttgattggactatattgaaataccctcaagttggctccagttcgagaggaagaccaagtgggaaaccagctttaaatccaggaacatctgctgaaagaccttcagtgggacaagagattcgagataggttctctggtgctgttgaggcctttgctagaaggaatggcacagggcatggtttgcatggtgagcacaccaggcacagatcttcagatgatgtgccatcttccaaggatgtgcaacctgattctgaaaggggaaggagttctcgcaatggcagttcttcaaagaggccagttgtatcaagcagcagaccaagctcctctggtgagccaagtgaaaatcggtcaagccggctggtctcaagcagtggtcgcctgtctacaacccagaggattcaacctgggtttgaatccaaaacaacatcttttacccgaactgctgctaccagaggtggtcgtgatgatgcacttaggagctttgagcttctatcgattggcacaggaaagaggaaataaagggtaagaagtgcttgtgtcaagactcaactttttttgcagtttttcacaatgtcagcaatattatgattttacctcagttactttgtatatgtgttatctgttgctgggttcaatttgctgctaaggctcgcaaatgttctacttgagaacatgtccagactcttttacctcttcaggattctcgcaattataatgcccctcttgggctcacctaagaaagagagatcgtctcactttagggaattgttcatatatttgagacacgaatagttgtaataagcacggatgttatattttttcctggggaaaaatgaaaaccatgctttatgactaatacaccctttgtcttgtcatgtattacgtaatatattcatattttttgtctttgtagtatgggtaaatgatgtataatcattaatcagtggtttcatcagccacctgttgaattcttttgtccac

SEQ ID NO: 8129 - DNA, 2047 bp, Castanea mollissima
ttttcttttcttgggatcattgtgtttatgttggagttaggtggatctgagagtggattagaatcaaagatctattgagctttttggataagcaaaaagctttttggtcattttagtattgtattaaaagagttaggagggtgagcttgttggttttgtatctactttgattgggaattgggaattgaatcatggatcatgtgattggtgggaagtttaagctcgggcgaaagatcggtagtggatcgtttggagaactctatttgggggttaatatacaaagtggagaggaagtggctgtaaagctggaatctgtgaagaccaagcaccctcagcttcattatgagtcaaaattatacatgcttctacaaggaggaacgggtatcccccatctgaaatggtttggcgttgagggagagtacaatgttatggttattgaccttcttggcccaagcctagaagacctgttcaactattgcaaccggaagttttctttaaaaacagttttaatgctcgcagatcagttgataaacagagtcgagtatatgcactcacggggttttcttcaccgtgatataaagcctgacaactttttgatgggtttagggcgcaaagctaatcaggtatatataattgattatggtcttgcaaaaaagtatagagatcttcaaacacacaagcacataccatacagggaaaacaaaaatctcacaggaacagctcgttatgcaagtgttaatacccaccttggagttgaacaaagcagaagagatgatcttgagtctcttggttatgtgcttatgtattttctgaggggaagccttccatggcagggcttgaaagcaggtacgaagaagcagaaatatgacaagatcagtgaaaagaagatgcttactcccatagaggttctttgcaaatcgtatccatcagagttcacatcatacttccattactgccgatcattgcggtttgaggacaaacctgattattcatatctgaagaggcttttccgagatctatttattcgagaaggttatcagtttgactatgtgtttgattggactatattgaaatatcctcaagttggctccagttcgagaggaagaccaagtgggaaaccagctctaaatccaggaacatctgctgaaagaccttcagtgggacaagagattcgagataggttctctggtgctgttgaggcctttgctagaaggaatggcacagggcatggattgcatggtgagcacaccaggcacagatcttcagatgatgtgccatcttccaaggatgtgcaacctgattctgaaaggggacggagttctcgcaatggcagtacttcaaagaggccagttgtatcaatcagccgaccaagctcctctggtgagccaagtgaaaatcgatcaagccggctggtctcaagcagtggtcgcctgtctacaacccagaggattcaacctgggtttgaatccaaaacaacatcttttacccgaactgctgctaccagaggtggtcgtgatgatgcacttaggagctttgagcttctatcgattggcacaggaaagaggaaataaagggtaagaagcgcttgtgtcaagactcaactcttttcttttgcagtttttcacgatgtcagcaatattatgattttacctcagttactttgtatatgtgttatctgttgctgggttcaatttgctgctaaagctcgcaaatgttctacttgagaacatgtccagactattttacatcttcaggattcttgcaattataatgcccctcttgggctcacccaagaaagagatatcgtctcactttagggaattgttcatatatttgagacatgaatagttgtaataagcacggatgttatattttttcctggggaaaaatgaaagccatgcttgacgactaatactccctttgtcttgtcatgtattacgtaatatattcatatttttcgtctttgtagtatggataaatgatgtataatcattaatcagtggtttcatcagccacctgttgaattctcttgtccacttggtttaaa

SEQ ID NO: 8130 - DNA, 2861 bp, Cicer arietinum
gtaaaaataaaaaaatgagatgagagtgaagtagtttggtcagtgatccattttgtgtcctttcctcctctcacatcatattctcttcttttcttttcccggattcccgaaattttcctagaaaattcacgccgtgtcctcgaagacagatccgaagggaacgccaaatccaatacccatctccgcccaaatatataatttccttcttctttctctttctacactttcccattttccacactattcactattatacactaatttctactttttcgactcaaatttactccgatttttgtcgcaacccttttcgttattttagctgtttacttcgaataagaggaataagtttcattgagtgaccccataatcgcgattgtgcttcgatttagcgtgtaattgagggttttgtagattctacttcttgatcctattttcattgatcaaaatcacttttttcctctgtcattttgttctggggttttattttctaggtatccacattagcatagtctgaatttttgagtaattcaacacacttttggatctcaatgtttgttaaatctctttggatctgagattgtgctggaaatcaagatgaatcgttgttgagacacttgtaacaggcaaaagatttttttttttttttgcaattgatgtgtgtagtagagggcttttttgtaatttagcaaggattaggaatttgggtttgtgatgatggatcatgttattggtggaaaattcaagcttgggaggaagattgggggtgggtcatttggagagctttacttgggtgttaatgtacagactggagaggaagtggccgtcaagctggaacctgtgaagaccaagcatcctcaacttcactatgagtcaaaattgtacatgcttcttcaagggggaacgggtattccccatttgaaatggtttggagttgagggtgactacaatgccatggcaattgacctccttggaccaagtcttgaagacttgtttaactattgcaataggaaattctctctgaaaacagttctgatgcttgcagatcaactacttaacagagttgagtacatgcactcccggggttttctgcaccgtgatataaagcctgacaactttttaatgggtttaggccgtaaagcaaatcaggtctacgtaattgattatggccttgcaaaaaagtatcgggatcttcacacacataagcatataccatatagggaaaacaaaaacctcactggaactgcgcggtatgcaagtgttaatactcatctgggagttgaacaaagcagaagagatgatctggaatcacttggttatgtgctcatgtactttttgagaggaagtctcccttggcaaggtttgagagctggcaccaaaaaacaaaaatacgacaagataagtgaaaagaaaatgcttactcctatagaggttttgtgcaagtcacatccattggaatttacatcatacttccattactgccgatcgttgcggtttgaagacaagcctgattattcgtatcttaagaaactctttcgggacctattcatccgagaaggctatcagtttgattatgtctttgattggactatattgaagtatccacaaattggttccagttccagaaccaggcctagtagcgggaaaccagtcataaatccaggacaatcaggagatagaatagaacggccttcagggggaccagagattcgggatagattctcaggtgctgtcgaggcatttgcaagaaggaatggatctgggcatggtctgcatggtgatcattccaggcataggtcttcggatgatgtgccatcttctaaagaagtgcaagctgattctgagaggccccgtagctcttctcgtcatggcagttcttctaaaagacccgtcttatcaagcagccgtccaaactcctctggtgaaccgagtgaaaaccgctctagccgactggtcttgagcagtagccgactatctactactcagaggactcaaccagctttagagtccaaaccatcatttactcgtgcttctgggacaagagggggtcgtgatgatacactcaggagctttgaactcctgtcaattggcacaggaaaaaggaaatgaagaactctgtacttatatcaagggtcatggttctgttacttctgatacttttcctttgagagatgtctctacccttgttggttactctgtatatttccatccaaggctaaaaactcattgaaatttcttcatgaagctttagcagactcctcttatagctcttctgatgttcttccatgaatatttcagcatggatggacacgttcatgaagagacaccatgttactttaggaatatgttaatatatggctggctacatgtaataagtactttctctatttgtttctgctgaagaaaaggaaaagaaactgcaatttgcagaaaatgctctaaaagattttgcaccctttttatccatatttcgtggctgagtgctaggttgttgtagtgtacattgatggaatggaattgttggctcccattatgtacaagagaaagaaaaaagattgctgtgcatttagccagtttgacttggatttgtagatcttatccattgtctatctaattggcatacttcttttcacaaaaccactttatcttgttgagtttataacagaacaaagaatgtagatgccgatttccttgcaaaggtggctacaattatgcttagtctttgcttatttctagtgacttaggagttacgacattgtgctttcactatgtttgtgttgaatttatttattttatgtgtaggataatataaaataattttacgacagacatctttaataaaaaagttattaaattctaaa

SEQ ID NO: 8131 - DNA, 2009 bp, Arachis hypogaea
tttttcttaatttgtttattttttccgtctctttgttgttgatgatgatttttgaggtattgaggattaacaaggcctgaatttttgagttgttcgatacagtttttggatcgctgtgttaatcttaatagaatctctttggatctgagggttttcgggaaataaaggtggatcgttgatgagactctcggagtagggcaaaattttttattttttttaaatcggttaatgtgtgtggtcaagtagttttgtaattaaggaaggttgaacatattgagtttgtgatctttgtgatcatggatcacgttatcggtggaaaattcaagcttgggagaaagattggaagtgggtcatttggagagctctacttgggtgttaatgtgcaaagtggagaggaagttgctgtcaagctggaatctgtgaagaccaaacatccacaacttcattatgagtcaaaattatatatgcttcttcaaggcggaactggtataccccatttaaaatggtttggagttgagggtgactacaatgtcatggtgattgaccttcttggaccaagtctggaagacttatttaactattgcaacaggaaattttcgctgaaaacagttctgatgcttgcagatcaactcctaaacagagttgagtacatgcactcccggggttttctgcaccgtgatataaaacccgacaactttttaatgggtttgggccgcaaggcaaatcaggtttacataattgattatggtcttgcaaaaaagtatcgtgatcttcaaacccataagcatataccatacagggaaaacaaaaaccttactggaactgcacgctatgcaagtgttaatactcatcttggagttgaacaaagcagaagagatgatctagaatctcttggttatgtgctcatgtacttcttgagaggaagtctcccttggcaaggcttgaaagctgggactaaaaagcagaagtatgacaagataagtgaaaagaagatgcttactccaatagaggtcttgtgcaaatcacacccactggaattcacatcctactttcactactgccggtcattgcgttttgaagataagcctgattattcatatctcaagagactcttccgtgacctattcatacgagaaggttatcaatttgactatgtatttgactggactatattgaagtatccacaaattggatccagttctagagctcgactaaccgggaagccagtcggaaacccaggactatcaggagataggttagttcgaccttcaggtgggccagagattcgggaaagattatcaggtgctgttgaggcatttgcaagaaggaatggctctggactaaatctgcataggtcttcagatgatgtgccatcttccaaagatgtgcaagctgattcggagagaactcgtagctcttctcgcaatggcagtgcctcaaaaaggcctgttgttttgagcagtcggccgagttcttctggtgagcctagcgagaaccgttcaagtaggctgcttgcaagcagcagccgtctatctacaactcacaggattcaaccaggtctggagtccaaaacatcattcacccgtgcatccgggacaaggggaggccgtgatgacacactcaggagctttgaactcctgtcaattggtacgggaaaaaggaaatgaagaactgtgtggtcagaagactacttgcgccaaagggcatcagttccattcatgaaacttctgagatatcgcacaattgttgattactatgtatatttccatctttatattgggtccattcaaaggctatagagctaattgaaattacctcatgaagctttggcagacttcttctatacctcttcaaatgttcttccatgatttatttccacatggacccataagaagagatactatgttactctaggaatttgtttatatgcaagaactatatggctacttgataaatacattctctatatttgtgttgaggaaaaagaaaaacgacatgcaaaaaatgct

SEQ ID NO: 8132 - DNA, 1667 bp, Arachis hypogaea
ggaaggttgaacatattgagtttgtgatctttgtgatcatggatcacgttatcggtggaaaattcaagcttgggagaaagattggaagtgggtcatttggagagctctacttgggtgttaatgtgcaaagtggagaggaagttgctgtcaagctggaatctgtgaagaccaaacatccacaacttcattatgagtcaaaattgtatatgcttcttcaaggcggaactggtataccccatttaaaatggtttggagttgagggtgactacaatgtcatggtgattgaccttcttggaccaagtctggaagacttatttaactattgcaacaggaaattttcgctgaaaacagttctgatgcttgcagatcaactcctaaacagagttgagtacatgcactcccggggttttctgcaccgtgatataaaacccgacaactttttaatgggtttgggccgcaaggcaaatcaggtttacataattgattatggtcttgcaaaaaagtatcgtgatcttcaaacccataagcatataccatacagggaaaacaaaaaccttactggaactgcacgctatgcaagtgttaatactcatcttggagttgaacaaagcagaagagatgatctagaatctcttggttatgtgctcatgtacttcttgagaggaagtcttccttggcaaggcttgaaagctgggactaaaaagcagaagtatgacaagataagtgaaaagaagatgcttactccaatagaggtcttgtgcaaatcacacccactggaattcacatcctactttcactactgccggtcattgcgttttgaagataagcctgattattcatatctcaagagactcttccgtgacctattcatacgagaaggttatcaatttgactatgtatttgactggactatattgaagtatccacaaattggatccagttctagagctcgactaaccgggaagccagtcggaaacccaggactgtcaggagatagattagatcgaccttcaggtgggccagagattcgggaaagattatcaggtgccgttgaggcatttgcaagaaggaatggctctggactaaatctgcataggtcttcagatgatttgccatcttccaaagatgtgcaagctgattcggagagaactcgtagctcttctcgcaatggcagtgcctcaaaaaggcctgttgttttgagcagccggcctagttcttctggtgagcctagtgagaaccgttcaagtaggctgcttgcaagcagcagccgtctatctacaactcagaggattcaaccaggtctggagtccaaaacgtcattcacccgtgcatccgggacaaggggaggccgtgatgacacactcaggagctttgaactcctgtcaattggtacgggaaaaaggaaatgaagaactgtgtggtcagaagactacttgcgccaaagggcatcagttccattcatgaaacttctgagatatcgcacaattgttgattactatgtatatttccatctttatattgggtccattcaaaggctatagagctaattggaattacctcatgaagctttggcagacttcttctatacctcttcaaatgttcttccatgatttatttccacatggacccataagaagagatactatgttactctaggaatttgttta

SEQ ID NO: 8133 - DNA, 2584 bp, Trifolium pratense
tttctgttctttcctatcatctcacctgacactttaaccatatctctctctctctctctctctctcactcacacacacacacacactttctttccctttcccggaatcccgaaattttcccagaaaatccactcttgtcctcaaagacagatccaaaagctgatgccaaatccaacacccatctttgggcaattacatcccaaccattaaatctccttcttccttcttcttcactcccattttcatcactattcactattataccccaaattcatacttcatcgactcaacttcactccaatttttctcgcccccttttcgctattttacatcttttcttcgtacaacaggataaaaaaatagtttctttgagtgacccatattcacaattatgcttcgatttagcttgcaattaagggttttgtagattctagttcttgatcttattttcattgatcaaaatcacttttttttttggattacttttgtttgagggtttgatttttgaggttttgtgtttattagtatagcctgaattttcgagttattcaatttcaattcacttttggatctcaatttttgtgttaaatctcgttggatctaagattgtactggaaataaagatcaatcgttgatgagacgcttggaatagcaattttttttgtttgcaattgagtgattttgtaatttagcaaggattagggatttgggtttgtgataatggatcatattattggtggaaaattcaagcttgggaggaaaattgggggtggttcatttggagaactttacttggctgttaatgtacaaactggagaggaagttgctatcaagcttgaacctgtgaagaccaagcatcctcagcttcactatgagtcaaaattgtacatgcttcttcaagggggaacgggtattccccatttaaaatggtttggagttgagggtgactataattgcatggcaattgacctccttggaccaagtcttgaagacctgtttaactattgcaataggaaattctctctgaaaacagttctgatgcttgcagatcagctactaaacagagttgagtacatgcactcccggggtttcctgcaccgtgatataaagcctgacaactttttaatgggattaggccgcaaagcaaatcaggtatacataattgattacggccttgcaaaaaagtatcgagatcttcacacgcacaagcatataccatatagggaaaacaaaaacctcactggaactgcccggtatgcaagtgttaatacccatctaggagttgaacaaagcagaagagatgatctggaatcacttggttatgtactcatgtactttttgagaggaagcctcccttggcaaggcttgagagctggcaataaaaaacaaaaatatgacaagataagtgaaaagaagatgcttactcctatagaggttttgtgcaagtcacatccattggaatttacatcatacttccactactgccgatcgttgcggtttgaagataagcctgattatccgtatcttaaaagactctttcgtgatctattcatccgagaaggctatcagtttgactatgtgtttgactggactatattgaagtatccacaaattggatccagctccagatcccggccaagtgggaaaccagtcataaatccaggacaatcaggagagagaataatagaacggccttcaggtggaccagagactcgggatagattctcaggtgcagtcgaggcatttgcaagaaggaatggatctgggcatggcatgcatggtgatcattccaggcataggtcttcggatgacatgccatcttctaaagaagtgcaagctgattctgagaggccccgtagctcttcgcgtcatggcagctcttcgaaaagacccgtcttatctagcagccgtcctaactcttctggtgaaccgagtgaaagccggtctagccgattactcttgagcagtagccgcctatctactactcagaggactcagccaggtcttgagtccaaaacatcatcatttaatcgtgcttctgggacaagaggcggtcgtgatgatacactgaggagctttgaactcctgtcacttggcacaggaaaaaggaaatgaagaactaactctgatcaagcagactttttaagtcaatggtcgtggttctgttctgatactttttctttgagtgatgtctaccctcgttgattactgtatattttccatccaatgttagctccatccatggctaaaagctcattggaattttttcatgaagctttggcagactcctcttatagctcttctgatgttcttccatgaatatttcagcatggacccattcacgaagagacaccttcgttactttaggatttgttaatatatggctacttgtaataaatacattctctattttttcttctgaagaaaaggaaaagagactgcaatttgcaaaaatgatccgtaagttttggcacgtttgtgatgcatatttcgtatctgtgtactatatgttctagtgtaaattgctggaatggaactgttgactccaattatggacaagagaatgaaaagagattgatgtgca

SEQ ID NO: 8134 - DNA, 1680 bp, Fagus grandifolia
cattgtttgtgttgggatttggtggatctaagagtggattggaatcaaagatctattggtgatgagctttttgaataagcaaaaggcttttgatcattgtagtattggattgggttggaaaagctaggagggtgaaaagggtaagcttgttggttttgttttagttttcattgggaattggatcatggatcatgtgattggtgggaagtttaagctcgggcgaaagatcggtagtggatcgtttggagaactctatttgggggttaatgtacagagtggagaggaagtggctgtcaagctggaatctgtgaagaccaagcaccctcagcttcattatgagtcaaaattatacatgcttctacaaggaggaacgggtatcccccatctgaaatggtttggcgttgagggagagtacaatgttatggctattgaccttcttggcccaagcctagaagacctgttcaactattgcacccggaagttctctttaaaaacagttttaatgcttgcagatcagttgataaacagagttgagtatttgcactcacggggttttcttcaccgtgatataaagcctgacaactttttaatgggtttaggccgcaaagcaaatcaggtatatataattgattatggtcttgacaaaaaagtatagggatcttcaaacacacaagcacataccatacagggaaaacaaaatctcacaggaacggctcgttatgcaagtgttaatacccaccttggagttgaacaaagtagaagagatgatcttgagtctcttggttatgtgcttatgtattttctgaggggaagccttccctggcagggcttaaaagcaggtaataagaagcagaaatatgacaagatcagtgaaaagaagatgcttactcccattgaggtcctttgcaaatcgtatccatcagagttcacatcatacttccattactgccgatcattgcagtttgaggacaaaccggattattcatacttgaagaggcttttccgggatctatttattcgagaaggttatcagtttgactatgtatttgattggactatattgaaatatcctcaaattggctccagttcaagagcacgaccaagtgggaaaccagcattaaatccagggacatctgctgaaagaatagataggccttcagtggggcaagagattcgagataggttctctggtgccgttgaggcgtttgctagaaggaatggttcagggcatggtttgcatggtgatcactctaggcacagatcttcagatgatgtgccatcttccaaggacgcgcaacctgattctgaaaggggacgcagttcttctcgtaatggcagtagttcaaagaggccggttgtatcaagcagccggccaagctcctctggtgagcccagtgaaaatcggtcaagccggctgatgtcgagcagtggtcgtctgtctacaacccagaggattcaacctgggtttgaatccaagacaactacttttacgcgtactgcagccaccagaggtggtcgtgatgatacactaaggagctttgagctcctatcgattggcacaggaaagaggaaataaaggatgaatccatctgttactttgtatatcagtatatgtgtatccattgctgggttcaatttgctgctaaagcttgcagatgttccacctgagaacatgtccag

SEQ ID NO: 8135 - DNA, 2063 bp, Trigonella foenum-graecum
gggcttgaagatatactttcgattgatgtgtggaatgaatgtttgagtgaggaggataggtttttattttatttttgaggtattgggattagtaaagcttgaatttttgagttattcaacacccttttggatctcaattttcgatctaagatagtaagacgcatgaaataggaaaaagaagattttttttttattttttttgcaattggtgtgtgtagtagagtgattttgtaattaagcttgaattaggagattgggtttgtgatgatggatcatgttattggtggaaaattcaagcttgggaggaaaattggtggtgggtcatttggagagctttacttgggtgttaatgtacaaactggagaggaagttgctgttaagctggaacctgcgaagaccaagcatcctcaacttcactatgagtcaaaattgtacatgcttcttcaaggggaccggtattccccatttaaaaatggtttggagttgagggtgactttaatgccatggcgattgacctccttgggccaagtcttgaagacctgtttaactattgcaatagaaaattctctctgaaaacagttctgatgcttgcagatcagctactaaacagagttgagtacatgcactcccggggtttcctgcaccgtgatataaagcctgacaactttttaatgggtttaggccgtaaagctaatcaggtatacataattgattatggccttgcaaaaaaaaaccgggatctacacacacacaaacatataccatacagggaaaacaaaaacctcactggaactgcacggtatgcaagtgttaatactcatctgggagttgaacaaagcagaagagatgatctggaatcacttggctatgtgctcatgtactttttgagaggaagtctcccttggcaaggtttgaaagctggcaataaaaaacaaaaatacgacaagataagtgaaaagaagatgcttactcctatagaggttttgtgcaagtctcatccgttggaatttacatcatacttccattactgccgatcgttgcggtttgaagataagcctgattattcgtatcttaagaaactcttccgtgacctattcatccgagaaggttatcagtttgattatgtgtttgattggacgatattgaagtatccacaaattggatctagttccagatccaggccaagtgggaaaccggtcataaatccaggacaatcaggagagagaatagaacggcctccaggtggactagagattcgggatagattctcaggtgcagttgaggcttttgcaaggaggaatggatctggccatggtgtgcatggtgatcattccaggcatagatcttcagatgatgtgccatcttctaaagaagtgcaagctgattctgagaggcctcgtagctcttctcgtcatggcagttcttcaaaacggcccgtcttatcgagcagccgtccaaactcttctggtgaaccgagtgaaagccgctctagccgattgctcttgagcagtagccgattatcttctactcagaggactcaatcaggtcttgagtccaaaacatcatttaatcgtgcttctgggacaagaagtggtcgtgatgatgcactccggagctttgaactcctgtcacttggcacaggaaaaaggaaatgaagaactaacctgtgatcaagcagacttgttgtgtcaagggtcacggttctgttctgatactttttctttgagaaatgtctacccttgttgattactctgtatatttgcatgcaatattgggaccattcaaggctaaaagctcgttggaatttcttcatgaagctttggcagactcctcttatagctcttctgaatgttcttccatgaatatttcagcttggtcccattcacgaagagacaccatgttactttagaaatttgttaatatatggctacttgtaataagtacatgctctatttttttctgctcaatttgcacaaatgctctgtaagttttcgcactttgtgatgcatattttgtacctgactactgtgttctagtatacattgatggaatggaattcttga

SEQ ID NO: 8136 - DNA, 1913 bp, Malus domestica
gggtgtgggggtttgggctttttcttgtatagtatttgattgggactgttcagatcatggagcatgtaattggtgggaaatttaagctaggaagaaagatcggtagtggatcgttcggagagctttatttgggtattaatgtacaaactggagaggaggtagctgtcaagctggaatcagtgaagacaaaacacccccagcttcattatgagtcaaagttgtacatgcttcttcaaggaggaactggtgtaccccatcttaaatggttcggtgttgagggtgaatacaatgtcatggttatcgatctgcttggtcccagccttgaagacctcttcaactattgcaatcggaagttctctttgaagacagttttgatgcttgcagatcaattaataaacagagttgagtacatgcactcacggggatttcttcaccgtgatataaagcctgacaactttttaatgggcctgggacgcaaagctaatcaggtatatatcattgattatggccttgcaaaaaagtatagagatcttcaaacgcacaagcacataccatacagggaaaacaagaatctgacaggaactgcccgctatgctagtgttaacactcaccttggtgttgagcaaagcagaagggatgatctagaatctcttggttatgtgctcatgtattttctgagggggagccttccctggcagggcttgaaagcaggtacaaaaaagcaaaaatatgacaagatcagtgagaagaagatgctaactccaattgaggtgctctgcaaatcatatccttcagaattcacgtcgtacttccattattgtcgatcattacgctttgaggacaaaccagattattcatacctgaagaggcttttccgggacctttttattcgagaagggtatcaatttgactatgtatttgattggactatactgaagtatccgcaaattggctccagttctagaacacgaccaagtacaaaaccagctttaaaccctggaccatctgcagaaagaacagaaaggcctacagtggcacaagattttcgagaaaagtactcgggtgcagttgaggcattttctagaaggaatagttctggttatggctatggcgatcactccagacatagagcgactgatgatgccccgtcgtccaaagacgtccaagctgactctgaaagggctcggagttcatctagaaatgggagtagttcaaagaggccagttatatcaagcagcaggccaagctcatctggtgagcccagcgagagtcggtcaagccggctggtctcaagtagtggccgcctgtccaccacccaaagggttcaacctgggtacgagtccaaaacatctttcacccgaacatccgccgcaagaggcggccgtgatgatacactaaggagctttgaactccttgcaatcggcacgggaaagaggaagtgaagtctgatccctctggtaaaatgctcgtgtcgagattccttgtgatctttatctatcaaagatgtctctcagcactaaaatggttttgcaacagtttactctgtatgtgtatccattgttgggttgatttcactgttgaaaagctcaatggagtttctccttagacactactactacccctacgcttttaccttcttcatggtttctcgccgttacaacgccatcgatcggagactctccaagaaagagattcaccatctcacttcaggagattgtctatgtatatatatatttgagatactggtcggctttcttacccgagaaaacaaaaacgcctgccgactcttaattgtgcattatgctctatgtttgttctcccactcgtatcgtcaactttcttagtttccgatttgtccctcaaatatcatatttacagaaaatcacttaaatcggaagttacatgacattgag

SEQ ID NO: 8137 - DNA, 2625 bp, Populus trichocarpa
ctgcgaggtaacagcaactataaaaagggaaaaacgcaaataatcaaatatatacacacagcatccactttttctcggatcacttttttggtaagtattattttcttcacagaatctccaaattttctcgagaaaacacaatccttgtcttagccagatctttaaaattccccaaattcttgccgcacatatcgttgccaccccatactctttctctctctctcccccctactttattattgttgttgttgttgttgttattctttctcttcaaagtctattttttttcccgttaattatttcaaaaactttaccttcttctctctctctacttcctttctcttcactttctcaagataacgcagtttcgtgatttgcaaaccctagtttcccttcgctgattaatggggttttcttagatttttaagtaacatcttagtttgctcggttgctaagcagattgggttacaaaagatatcttttcttttattttgcttttcaattttgaggcatttactgaatcatttagagtggtctttgagtgttctgggttttttttttgttttgacaaggaagagtcttaggtcactttagttggtgaattttgactgcgaacttgaaagaaaaagggggggtcttttttttctttcctttattcgtttggtgggttataatatttgattgagattgttagatcatggatcatgtgattggtggcaagtttaagcttgggcggaagatcggtagtgggtcctttggtgaactttatttaggtattaatgtacagagtggagaggaagtggctgttaagttggaatctgtgaaaaccaagcacccccagcttcattatgaatcaaaactatacatgctacttcaaggaggaacgggtattcctcatctcaaatggtttggtgttgaggttgattacaatgtcatggttattgaccttcttggaccaagtcttgaagacttgtttaattattgcaatcggaagttatctttgaaaacagtgttgatgcttgcagatcaattaataaatagagttgaatatatgcactcacggggttttcttcaccgtgacatcaagcctgacaactttttgatgggtttagggcgcaaagcaaatcaggtctacattattgactatggccttgcaaaaaagtacagagatctgcaaacacacaagcatataccatatagggaaaacaagaatctcacaggcacggctcgctatgctagtgttaatactcatcttggagttgagcaaagcagaagagatgatctggaatcccttggttatgtgcttatgtattttttgaggggaagccttccatggcagggcatgaaagctggtaataaaaagcagaaatatgacaagatcagtgaaaagaagatgcttgttcctatagaggtcctttgcaagaactatccttcagaatttacatcttactttcattattgccgttcactgcggtttgaagacaaacctgattattcatacctgaagagacttttccgcgacttgtttattcgagaagggtatcagtttgattatgtttttgactggaccatattgaagtacccgcagattggttcaagttctagatcacgaccaagtggcaaaccagctgtatacccagggccatctgcagaaagagtggaacggccatcagtaggccaggaagtccgagacagattctctggtggagttgaggcatttgctcgaaggaatagctctggacatgctttgcacagcgatcagtccaggcacaggtcctcagatgatgcgccatcatccaaggatgtgcatcccgattcagaaaggccccgttcgtcatctcgaaatggaagcacttcaaagagggctgtcatgtcaagcagccggccaagctcttctggcgagcctagtgagaatcggtcaagccggctggtctcaagcagtggtcgcctgtcaacaacccaaagggttcaacctgggtttgagtcaaaatcatcttcttttactcgtgcttcagccacaagtggtggtcgtggcaatgcacttaggagctttgaactcctgtctattggcacaggaaagaggaaataagcactggacctgtctggtacgaagatttacttgtgcaaggggtcaaaattcccttgtgtatttctatcagtgttgggactccaatggtgtgtcgccagttactgtatattcatacccaccattaggtttccatcacagcaaaagatcagggaatcctctccttggaagactgggactcgtcttgtatccatctctctggaggattggcaatacaaaggcaagcggactcaattcttaaaagagaagaatcatttcagggtaggaattgttcatatatttgagatgcttttagctctaataaatacttaaatttttctgggaaaaaaaattacaacttccgctaagagaccggtatgaactccggccatcctctctactactatatacataatcttagctgtggttcaggcagaggtcgattcaacaatggagcgaaaaatgcaataaaatggaattgaattcttttttagtttctgatgctgaactcatttaaacttttctgttcaaaataaagtaacaataataaataaataaat

SEQ ID NO: 8138 - DNA, 2291 bp, Medicago truncatula
cacagcttttctttccattttctttctttctctttcattccacttttcttttctttccttttcccggaatcccgaaattttcccagaaaaattcacaccttgtcctctaagacagatccaaaatccacccatccatatcctctttccacactattcactatcttaccccaatttcacttcatcgactcaaatttaaatcaaattttctcatccccttttcgctattttacctattttcgaggaaaaaaagtttcttttattcaacacataatcgattttgcgtgcaattcagggttttgttgtagattctacttcttgatcttattttcattcatcaaaaatcaaaatcacttttttcctctgttctgtttgtgggttttcatttttgaggaaataattgttttagcaattgatgggtgaagtagagtggttttgaaattcagcttgaattaggagattgggttttgtgatgatggatcatgttattggtggaaaattcaagcttggaaggaaaatcggtggtgggtcatttggagagctttacttgggtgttaatatacaaactggagaggaagttgctcttaaattggaacctgcaaagaccaaacatcctcaacttcactatgagtcaaaattgtacatgcttcttcaagggggaacgggtattccccatttaaaatggtttggagttgagggtgactacaatgccatggcaattgacctccttggaccaagtctggaagacttgtttaactattgcaataggaaattctctctaaaaacagttctgatgcttgcagatcagctactaaacagagttgagtacatgcactcccggggtttccttcaccgtgatataaagcctgacaactttttaatgggtttaggccgcaaagcaaatcaggtatacataattgattatggccttgcgaaaaagttccgagatcttcacacacacaagcatataccatatagggaaaacaaaaacctcactggaactgcccggtatgcgagtgttaatactcatctaggagttgaacaaagcagaagagatgatctggaatcgcttggttttgtcctcatgtactttttgagaggaagtctcccttggcaaggtttgaaagctggcaataaaaaacaaaaatacgacaagataagtgaaaagaagatgcttactcctgtagaggttttgtgcaagtcacatccgttggaatttacatcatacttccattactgccgatcgttgcggtttgaagataagcctgattattcatatctcaagagactctttcgtgacctattcatccgagaaggctatcagtttgattatgtgttcgattggactatattgaagtatccacaaattggatctagttccagagcccggccaagtgggaaaccagtcataaatccaggacaatcaggagagagagtagaacggccttcaggtggaccagagattcgggatagattctcgggtgcagttcaggcatttgcaagaaggaatggatctggccatggtgtgcatggtgatcattccaggcatagatcttcagatgagccatcttctaaagacgtgcaagctgattctgagaggccacgtagctcttctcgtcatggcagttcctccaaaagacctgtcttatcaagcagccgtccaaactcttctggtgaaccgagtgaaagccgctctagccgattgctcttaagcagtagcagactatctactactcagaggactcaaccaggtcttgagtccaaatcatcatcatttaataatcgtgcttctggggcaagaggtggtcgtgatgataccctcaggagctttgaactcctgtcacttggcacaggaaaaaggaaatgaagaactaactctgatcaagcagacttcttgagttaagcaagggtcatggttctgttctgatactttttctttgaagatgtctacccttgttgattactctgtatattttccatccaatgttgggttcattcaaggaatttcttctcgaagctttggaagactcctcttatatctcttttgatgttcttccatgaatatttcagcatggacccgttcatgaagagacaacatgttactttagaaatttgttaatatatggctgcttgtaataattacatgctctattttttctgctgaagagaaggaaaagaaactgcaatttgcaaaattgctatgtaagtttctgcacccttgtgatgcatattttatacctgagtactatgttctagtgtacattcatggaagggaataggcgagtaaggattgg

SEQ ID NO: 8139 - DNA, 2720 bp, Populus trichocarpa
aactcaacctcttcgttctttcctttactttcttggcaaccaaacaaaaatatcctcattattttttgttactaccaaacaacaaagcaaagtaaggattattattaccactactaaataactgtacaacaccaaaatacatatagacttttccttcccttcttacatcatcatccatttttttctcaatcacctttttcccttcccttcccttccctctcttatagggggtagagtattattctcttcccagaatctcaaaattttcccgagaaaactcaatctttgtccttaaaccacaccttaaacttccccaaattcttgccgcacgtatcgttgtcactccatattctctctctttccccccttactcttattattcttctttctctctccaaagaaaaaataaattttcttttttgcccgctgatctttcgtaaacttttgaaaaacccattaccccctcctttttgtctctcgtcttttctgttcactttatcgagataatgcagtttcgtgattcccaatccctgaacacccttcactgattaatgggtttttcttagattcttaagtaacatcttactttacttggttactaagtagattggattgcaaaaaaaatcttttcttttcagttttgagggatttattgaatcattgagagtggtcatttagtgatccgggagtcgttttgtttttcaacaaggggagagttttaggtcactttggttggtgaattttgattgtgaactaaaaaataaagggcggtctttttttgttttttccttatttgtttggtggattataatttttgtctgagattcttagatcatggatcatgtgattggtggcaagtttaggcttggccggaagatcggtagtggatcctttggtgaactttatttaggtattaatgtacagagtggagaggaagtggctgttaagttggaatctgtgaaaaccaagcaccctcagcttcattatgaatcaaaactatacatgctacttcaaggaggaactggtattcctcatctcaaatggtttggagttgagggtgaatacaatgtcatggttattgaccttcttggaccaagcctcgaagacttgtttaattattgcaatcgaaagttatctttgaaaacggtgctgatgcttgcagatcaattaataaatagagttgaatacatgcactcaaggggttttcttcaccgtgacatcaagcctgacaactttttgatgggtttagggcgcaaagcaaatcagatctacatcattgactatggccttggaaaaaagtatagggatctgcaaacacacaagcatataccatatagggaaaacaagaatctcacaggcacggctcgctatgctagtgttaatacccatcttggagttgagcaaagcagaagagatgatctggaatctcttggttacgtgcttatgtattttttgaggggaagccttccatggcagggcttgaaagctggcactaaaaaacagaaatatgacaggatcagtgaaaagaagatgcttactcccatagaggtcctttgcaaaaactatccttcagaatttacatcttactttcattattgccgttcactgcgattcgaagacaaaccagattattcatacctgaagagactattccgtgacttgtttattcgagaaggctatcagtttgattatgtatttgactggactatattgaagtacccgcagattggctccagttctagatcacgactaagtggaaaaccagctgtaaacccaggaccatccgcagaaagagtagaatggccttcaggccaggaaatccgggacagattctctggtgcagttgaagcatttgctcgaaagaatagcactggacatgctatgcacagagatcggtccaggcacaggtcctcagatgatgtgccatcatcaaaggatgtgcatcctgattcagaaaggccccggtcatcttctcgaaatggcagcacttcaaagagggctgtaatttcaagcagccggccaagctcttctggtgagcctagtgagaatcggtcaagccggctggcctcgagcagtggtcgcctgtcaacaacccagaggattcaacctgggcttgagtcaaaatcatcttcctttactcgtgctctagccacaagaggtggtcgtgatgatacactcaggagctttgaactcctgtctattggaagaggaaagaggaaataagctctacatctgtctggcacgaagatttgcttgtgtaaggagtcagaattcccttgtgtatttctatcagggtcgggactgcaatggttgtgccagttgctctgtatattcatacccactatcaggttcccttacatgcaaaagatcagtgaatcctctccttggaagacgggcactcatcttgtatctctctccggggggtttgccattcaaaggcaagcgagctcattcataaaagagaagaatgatttcgcggtaggaattgtttatatatttgagatgcttgtagctctaataaatacttgtttttctatgcaaaagaagaaaaccttacctaatagactaaagatgaactttggccatcctcctggatggttggtattaatcactctctacttcatccatttaaattagaacacatattgattgatcatggtggtctgattcttattataacttttatatattgtttctatattcttaaaatcatttatatt

SEQ ID NO: 8140 - DNA, 2317 bp, Manihot esculenta
agtattattcctttcctggaatctgcaatttttccctgaaaactcaatccctgtcctcaactcagatcctacaagatcccttaattcttgccgcaaataccgtcttcagtagatattctcctattctttaccagtactccctcccacggaaaaaggaaccctctctttcgctcagtaattccatcagaaactcacctttctcttttatcgtcaccttttttttttctttttactttgccaagaaaatgcagtgtcattatttgtgaaccctcattttcctttcgctgattactgggtattgcttagatttatcaagcaacatcttgctttgcttctaaattttagatactagcgggttatattacgcggttcttttttcatatttttactcgatgagcttggttgctctgtgcgtttaatgaaattgatggatctgagagttgccgtgttttttgacaagggaacagttttcggaccctgtggttggtgaattcagttgtaaagcagtaggggatattagtaattgattagtgcattatagtgcttattggaactattaatcatggatcatgttattggtggcaagtttaagcttggacggaagatcggtagcggatcctttggtgaactttatttgggcatcaacgtacaaactggagaggaagtggctgttaagttggaatctgtgaagacaaagcaccctcagcttcactatgagtcaaagctgtatatgctacttcaaggaggaactggtattccccatctgaaatggtttggagttgaggctgagtacaatgtcatggttattgaccttcttggaccgagcttagaagacttgtttaattattgcaataggaagttttcactgaaaacagttttgatgcttgcggatcaattaataaacagagttgaatatatgcattcacggggttttcttcaccgtgatataaagcctgacaactttctaatgggtttagggcgtaaagcaaaccaggtctatatcattgattatggccttgcaaaaaagtacaaggatcttcaaacacacaagcatataccatatagggaaaacaaaaatcttacaggcacagctcgctatgctagtgttaatacacatcttggagttgaacaaagcagaagagatgatctggaatctcttggttatgtgcttatgtattttctaagaggaagccttccttggcagggcttgaaagctggtactaaaaagcagaaatatgacaagatcagcgaaaagaagatgctcacccctatagagtttctttgcaaaaactatccttcagaattcacatcatacttccactattgtcgaacattacggtttgaagactcaccagattactcatacctgaagaggctcttccgggacttatttattcgagaaggttatcagtttgactatgtgtttgactggactatattgaagtatcctcagattggctccagttctagagcaaggccaagcagcaaaccagctgtaaatccaggtccatcagctgaaagagtggaacgaccatcagttggccaagagatccgagatagattttcaggtgcagttgaggcatttgctcgaagaaatggttctggacatgctttgcatggggatcactcccgacacagatcttcagatgatgtgccatcgtctaaggatgtgcatcctgatcctgaaaggccccgatcatcatctagaaatggcagtacttcaaagagggccgttgtatcaagcagccggccaagctcatctggtgagcctagtgagaatcggtcaagccggcttctctcaaacagtggtcgattgtctatgacccacagaatgcaaccagggtttgagtccaaatcatcttcatttactcgtgctactgccacaagaggcggtcgtgatgatacacttaggagttttgagctcttatccataggcacaggaaagaggaaataaaggatctgtgtgataagaactaagaagtgttatcttgtcttggggatcaacattccctttgtagtatcctcgagatatgaggattataatggtttgttagcagtactttgtgtatgtgttcccattcacgggtacccactcacagcaaaagctccacgaagtttgagtgttggactcctgcagtgcagtatgtattcagggattcttgtaattacaaggtccacaggaccgtccttgaaggacatgtgaatcatttcgctttagggaattgtttataatcgagacgctagtaacttgtaataaatatcacttctatttgttttttttcttcctccaaggaaaatgttaaacttcaattaaagg

SEQ ID NO: 8141 - DNA, 2588 bp, Citrullus lanatus
ctctgctccactttccctccttttcccccttcaatctcaatctctcaaaatacttttcctttcttccaacctttcatgtcccttccaccatattcaatctttcatgaatctgttctaaatttttttgacctctttttttaacttcaattttttgattctttgctgccaataccgctaagtatcagattcttttcaccttcaaacttcatcatcttctccataatttccccccactgtactgatctttgcactctcacaattccgatttaaagatccgtttcttattcctgttgtgggtttttatttatttatttatttatttatttttattttgggggtggggtggggtggggtgggggaagtatattatcacactcttcccaaacgacagaagtgccttttgctcgtttggggcttgggttttgctcactcactaatttctacttgttagattcttcattctgtatcatattttggggttttaagtgtgatttgaagtattttcggcggtctggtgttggatttttgagctataatttcttttcctcgaagcttgaaagtttgattagaagttggtggatttgagatggtgcttggagattgaaatccttacaaggctataggaattgcggattggtagttgaactgttactgtagggttagtattttgggtttgctggttttgctggattgtgttagttgaggtcacaaaaaggtgaactgcaattgctctaattggattcgagctaaatcatggagcatgtaattggtgggaagtttaagttgggccggaagattggaagcggatcctttggtgaactgtatttgggtactaatgtgcaaactgaggaggaagtggctgttaagctggaatctgtgaaaaccaagcatcctcagcttcactatgaatcaaaactgtacatgcttcttcaaggaggaactggtattcctcatctcaaatggtttggagttgagggtgagtataatgttatggttatcgacctccttgggccaagccttgaagatctgttcaactactgtaatcggaaactgtctttgaaaacagtattaatgcttgctgatcagttaataaacagagttgagtacatgcactcacgggggttccttcaccgtgacataaagcctgacaactttctaatggggttggggcggaaggctaaccaggtatatattatcgattacggtcttggaaaaaagtatcgggatctccaaacacacaagcatataccatacagagaaaataagaatctcacaggaacagctcgctatgctagtattaatactcaccttggagtcgagcaaagcagaagagatgatctcgaatctcttggctatgttctaatgtattttctcaggggaagtcttccctggcagggtttgagagccgggaccaaaaagcaaaaatatgataagattagtgaaaagaaaatgctcactccaattgaggtcctctgcaaatcttatccaacggaattcacatcttacttccactattgccgagccctaagatttgaagacaaaccagattattcctatctgaagaggcttttccgggatcttttcattagagaaggttaccaatttgactacgtatttgactggactatattgaaatatccacagattggctccagttctaggacacgaccatctgggaaagcagctataaaccctggaccatctgcagaaagagtggagaggccattagtaggacaagatctccgagataaattttctggtgcagtagaggcttttgctagaaggaatggcactgggattggtctacacagtgatcactccagacatagatcctctgatgacgtgccctcttccaaggatgtgcaaccggatgcagaacgagcacggagttcttctcggcaagggagtgcttctaagaggcctgtattgtcaaccagtcggcctagctcctctggggagccaagtgaactccgctcaagccgacttttgtcaagcagcagccgtctgtctgcttctactcaaaggattcaacctggggctgagtcaaaatcatcctttttccgttctgctacaaaaggcagtcgtgatgatgcacttcgaagctttgaactattatcaattggcaccggaaagaagaaataagaactgatcatcgagggcgaagaagttcatgcttttctctgtagttactgttggaattcatcatcattatgatgatgttttaaacatctgtatggtgtctcttcatatccatcatcagattccatccccagggactttgacatgaaccggaaagacttaattgcctctgtggccataattctgctagatcaagcaatggatggagacaactcctgcagatcttttggatgaatagaaagaaaagtcagctttatttctgtatttatttttctttttgtcttaatttttcgtatctgctactactgttttcttataaagatctgattttacaatgactcttactttccctttcaaatcatgtctgtaatggaagagataatttttacctttatggatgatagctaaaagaaaatgaagaacagggaagattaatgatgggttaaatt

SEQ ID NO: 8142 - DNA, 2631 bp, Prunus mume
aaaaaaagtaaaagaattaaagttaattataagttatgtagcaattaaaaaacctaatcatatcgtgtcatatacccagcttttccttgacatcaatcatccactctcatccatcttcccttgttttctcttcccctcttcccctctcccctctctatcaacccaatattccttttctcagaccgtccaaattttcaccagaaaatcaaaactttcctagaaaacccaaaaccccttatcctcaacccagatccaaagatcccctccaatcctaacatcactttctttcttaccaaaattcatatttgttcctttttgggccgtgaaaatctcaagcggtagattccttttcgacttcaaagtcccatccattcttttcccacgctgaaattttttccattttacatgaaaataattacgcagcgaagaaaccctttctccacattcttgccctcatctcctttcccgagaaaaatgcctttttgatgaccccaaaattttgttctggctccactgtttagtgggtttcctttagattttcaaatcttgtatcagttttgtgtatactatactataggtttgagcattctttttgcaagcttgatatgctagagtaagaatttctggacattccatccatgctgaaatttggtggatctgagattgcatagaaacaattaactcagcagtggattaggagtttgactcggattgctgatgagctatttgagcagtgggaaacgattgggatcatagtttagagtggattgggttctaatttaaggaggtgaagtggggttttgtgcttattgtgtttttgattgggaattcagatcatggagcatgttattggtggaaagttcaagctaggacgtaagatcggtagcggatcctttggagaactttatttgggcattaatgtacaaactggagaggaggtggctgtcaagctggaatccgtgaagacaaaacaccctcagcttcattatgagtcaaagttgtacatgcttcttcaaggaggaacgggtgtaccccatcttaaatggttcggagttgaaggtgaatacaatgtcatggttattgaccttcttgggccaagcctagaagacttgttcaactattgcaatcggaagttctctttgaagacagttttgatgcttgcagatcaattaataaacagagttgagtacatgcattcacggggatttcttcaccgtgatataaagcctgacaactttttaatgggtctgggacgcaaagctaatcaggtatatatcattgattatggccttgcaaaaaagtatagagatcttcaaacgcacaagcacataccatacagggaaaacaagaatctgacaggaacagctcgctatgcaagtgttaacactcaccttggtgttgagcaaagcagaagggatgatcttgaatctcttggttatgtgcttatgtattttctgagggggagccttccctggcagggcttgaaagcaggtactaaaaagcagaaatatgacaagatcagtgaaaagaagatgcttactccaattgaggttctctgcaaatcatatccatcagaattcacgtcatacttccattactgccgatcattacgctttgaagataaaccagattattcatacctgaagaggcttttccgggacctttttattcgagaaggatatcaatttgactatgtatttgattggactatattgaagtatccacaaattggctccagttctagatcacgatcaagtgcaaaaccagctttaaaccctggaccatctgcagaaagaacagaaaggccttcagtggcacaagattttcgagatagattctcaggtgcagttgaggcattttctagaaggaatagttctggtcatggttatggtgatcactcgagacatagactgactgatgatgcgccgtcgtccaaagatgtgcaacctgattcggaaagggctcgtagttcatctagaaatggcagtacctcaaagaggcctgtcatatcaagcagccggccaagctcctccggtgagcctagcgaaagtaggtcaagccggctagtctcaagtagtggtcgcttgtccaccgcccaaaggattcaacctgggtatgattccaaaacatctttcacccgaactgcagccgcaagaggcggccgtgatgatacgcttcggagctttgaactcctttcaatcggcacgggaaagaggaaatgaagcctgatccatctgataaaatgcttgtgtcaagattccttatgtagtatctatcaaagatgtcagcactataatggttttacaaagttactctgtatatgtgtatccattgttgggttcattcacagttgaaaagctcaatgaagtttcaccttagaactatccctgtttcaccatcttcatggattcttgccattctgatgcatcggagactcacccaagaaagagatttaaccatctcacttcagggagttgtctatatatttgagatactggtagctgtaataaatacgtctttcgtgatttttcttcaccagaagataatgactttgcttaaaatacgtgccttgagctgcttcatgtgcattattttatgatctatgtttgtttgtttgttcccccttcccca

SEQ ID NO: 8143 - DNA, 1414 bp, Manihot esculenta
tttaatcgggactgctaatcatggatcatgttattggtggcaagtttaggcttggacggaagatcggtagcggatcctttggtgaactttatttgggcatcaacgtgcaaactggagatgaagtggctattaagttggaatctgcaaagacaaagcaccctcagcttcactatgagtcaaagctctatatgcttcttcaaggaggaacgggtattcctcatctgaaatggtttggagtcgagggtgatcacaatgtcatggtcattgaccttcttggaccaagcttagaagacttgtttaattattgcaatcggaagttttccttgaaaacggttttgatgcttgctgatcaattaataaacagggttgaatatatgcactctcgtggttttcttcaccgtgatataaagcctgacaactttttaatggggttagggcgtaaagcaaatcaggtctatatcattgattatggccttgcaaaaaagtacaaggatcttcaaacgcacaagcatataccatatagggaaaacaaaaatctcacaggcacagctcgctatgctagtgttaatacacatcttggagttgagcaaagcagaagggatgatctggaatcacttggctatgtgcttatgtattttctgagaggaagccttccctggcagggcttgaaagctggtaccaaaaagcagaaatatgacaagatcagtgaaaagaagatgcttactccagtagagatcctttgcaaaaactatccttcagagttcacatcatacttccattattgccgatcactgcgatttgacgatgcaccagattactcatatctgaagaggctcttcagggacttgtttattcgagaagggtatcagtttgactatgtctttgactggactatattgaagtatcctcagattggctccagttctagagcaaggccaagcagcaaagcagccataaatccaggtccatcagcagaaagagtagaacgaccatcagtgggccaagagatccgagataggttctcaggtgcagttgaggcatttgcccgaagaaatggttctggacatgctttgcatggggatcagtcccgatacaggtcaatagatgatgtgccgtcttctaaggatgtgcatactgattctgaaaggcctcgatcatcatctcgaaatggcagtacttcaaagagggctgttgtatccagcagccggccaagctcctctggagaacctagtgagaatcggtcaagccggttgctctcaagcagtggtcgattgtccacaacccacagagtgcaacctgggtttgagtccaaatcatcttcatttagtcgtgctacagccacaagaggcggtcgcgatgatacgcttaggagctttgagctcctgtccattggcacaggaaaacggaaataagg

SEQ ID NO: 8144 - DNA, 2146 bp, Prunus persica
gatgaccccaaaattttgttctggctccactgtttagtgggtttcctttagattttcaaatcttgtatcagtttggtgtgtactatactataggtttaagcattctttttgcaagcttgatatgtagaataagaatttctggacattccatccatgctgaaatttggtggatctgagattgcatagaaacaattaactcagcagtggattaggagtttgactcggattgttgatgagctatttgagcagtgggaaacgattgggatcatagtttagagtggattgggttctaatttaaggaggtgaagtggggttttgggcttattgtgtatttgattgggaattcagatcatggagcatgttattggtggaaagttcaagctaggacgtaagatcggtagcggatcctttggagaactttacttgggcattaatgtacaaactggagaggaggtggctgtcaagctggaatccgtgaagacgaaacaccctcagcttcattatgagtcaaagttgtacatgcttcttcaaggaggaacgggtgtaccccatcttaaatggtttggagttgaaggtgaatacaatgtcatggttattgaccttcttgggccaagcctagaagacctgttcaactattgcaatcggaagttctctttgaagacagttttgatgcttgcagatcaattaataaacagagttgagtacatgcattcacggggatttcttcaccgtgatataaagcctgacaactttttaatgggtctgggacgcaaagctaatcaggtatatatcattgattatggccttgcaaaaaagtatagagatcttcaaacgcacaagcacataccatacagggaaaacaagaatctgacaggaacagctcgctatgcaagtgttaacactcaccttggtgttgagcaaagcagaagagatgatcttgaatctcttggttatgtgcttatgtattttctgagggggagccttccctggcagggcttgaaagcaggtactaaaaagcagaaatatgacaagatcagtgaaaagaagatgcttactccaattgaggttctctgcaaatcatatccatcagaattcacgtcatacttccattactgccgatcattacgctttgaagataaaccagattattcatacctgaagaggcttttccgggacctttttattcgagaaggatatcaatttgactatgtatttgattggactatattgaagtatccgcaaattggctccagttctagatcacgaccaagtgcaaaaccagctttaaaccctggaccatctgcagaaagaacagaaaggccttcagcagtggcacaagattttcgagatagattctcaggtgcagttgaggcattttctagaaggaatagttctggtcatggttatggtgatcactcgagacatagactgactgatgatgctccgtcgtccaaagatgtgcaacctgattcagaaagggctcgtagttcatctagaaatggcagtacctcaaagaggcctgtcatatcaaacagccggccaagctcctctggtgagcctagcgaaaataggtcaagccgtctagtctcaagtagtggtcgcttgtccaccgcccaaaggattcaacctgggtatgattccaaaacatctttcacccgaactgcagccgcaagaggcggccgtgatgatacgcttcggagctttgaactcctttcaattggcacgggaaagaggaaatgaagcctgatccatctgataaaatgcttgtgtcaagattccttttgtagtatctatcaaagatgtcagcactataatggttttacaagagttactctgtatatgtgtatccattgttgggttcattcacagttgaaaagctcaatgaagtttcaccttagaactatccctgtttcaccatcttcatggattcttgccattctgatgcatcggagactcacccaagaaagagatttaaccatctcacttcagggagttgtctatatatttgagatactggtagctgtaataagtacgtctttcatgatttttcttcaccagaagataataactttgcttaaaatacgtgccttgagctgcttcatgtgcattattttataatctatgtttgtttgtctgttcccccttc

SEQ ID NO: 8145 - DNA, 2844 bp, Eucalyptus grandis
cttctcctcccgtctctctccctctctgtcctcctcctcctctcccttcatcaatcatccgatttcatcactttttcccctctctctctcttctttctctctctggctgggtggagatattctatttttctgcaagaatctccaattccttgcccagggaaagccttaaatccctctgcccccccctgcaactcagatctgaaggattacctccttcccctcccctcgattgatttccccagaaactcttccctcccttccatccttaatctccccgaaaaccccacctgcccaatattattcctttccccttttctcactccaaagttccccccctttccccttccaattccatcctcctcctccctcttctcctcgtcctccgccgccgccgccgccgccgccgccaccgccgccgcaatgtcgcaccgccgacgcctcagctagggcttccctcgcgcgccggttcatgggtacatctcaagttctctccttgaggatcgttgattcgcgggtccccggtaccggagagtaccctgcatagatttgtagggttccgttggaaattcgctgaagattcttttttgtagctcttgcgaagctcttttttggagaggcttggagggcattttttgattttggcgataggtcgatcgatctgcaatctttgtttttcttggaagaaaagatccctctttcgtgtgggatagaatctcagtttggatctgggggcgagcttcttgaggattttgcgttcggatcatctctgacccggggacggaaggggaaaaagttggttctgtctcgcttcttgaacccgattggatcatggatcatgtgattggtggcaaatttaagctcggccggaagatcggtagcggatcgttcggggaactatatttgggaatcaatgtgcagagtggagaggaggtggcaataaagctggaatctgtgaagactaagcatcctcagcttcactatgagtcaaaaatatacatgctgctacagggaggaactggtattccccatctgaaatggtttggagtcgagggagagtacaatgtgatggttattgatcttcttggaccaagtttggaggacttattcaactattgtaatcggaagttttctttgaagactgttttgatgctcgcggatcaattaataaatagagttgagtatatgcactcacggggttttctccatcgtgatataaagcctgacaacttcttgatgggtttagggcgaaaagctaatcaggtgtacattattgactacggacttgctaaaaaatacagggatcttcaaacacacaagcacattccatacagggaaaacaagaatcttacaggaacagctcgctatgcaagtgtcaacactcatcttggagttgaacaaagtaggagagatgatttggaatctcttggttatgtgcttatgtactttcttcgaggaagccttccatggcagggcctgaaagcaggcactaaaaagcagaaatatgacaagattagtgaaaagaagatgctcactcccattgaggttctctgcagatcatatccatctgaattcacatcatacttccactattgtcgttcattgcggtttgaggacaaaccagattattcatacctgaagaggctattccgggatctatttattcgtgaaggttatcaatttgactatgttttcgattggaccatactgaaatacccacagattggctccagttctagagcacggccaagcagtaaacctgctctaaatcctggaccttctgcagaaagagcagaaagatcagaaagaccttctgtgggacaagagattcgagagagactctcgggtgctgttgaggcatttgctaggaggaatggcgccagccatggctttcatggtgatcattccaggcacagatcttcagatgatgcaccctcatccaaggatgtgcaacccgattctgagaaagcccgcagttcttctcgcaatggaagtacttcaaagagagcagtaatatcgagcagccgaccaagctcctctggtgagcccagtgatggtcggtcgagccgattggtatcgagcagtggacgcctgtccaccacccacagggttcaacctggcttcgagtcgaaatcgtcatccttcacccggaacggggccacaaggggcagccgggacgatgcacttcggagcttcgagcttctatctcttggcactagcaagagaaaataaatgatgggattccgcctgatggggctagcatgcattttgctggtgctctattgttcgctgtagcgtatgaacccaggaagctattatgagacgacatgattactttccttgcatatgtatatctcccgttgctgggttctattcagaagctaaagaacctatttgaagttcttgaagcagtttggactccttgttccatcgggaattgtttccgtcaaaaaaaaaaaaaaaaaacacattatctggggtaagaaagcttgagaaaaatctcacatgagggaattgttaatatgtttgagaccgtttgtagctgtaataagtaccttctttaatttctgctgaagaacatttgttttatctataagatgctatgtcaatgcccctctatgtaatggtgtcttgtatctctgttctgcatttggtggaggatcattgttgaatgccttcttttggtccagtagtacaaactcttttaggattcacatgatgttacataatgaacttcatcctgtattaatgatggagattgtgaggtttatggtccctttgagatcagagttacgcctagacccatgtcttgttacttgcttatccaagtatctgcagacgatcaaa

SEQ ID NO: 8146 - DNA, 2433 bp, Fragaria vesca
attcaatcatccactttctctcatatccatttctcttctttcccttctttgtcgctcttccaatattcctttttctcagtccgtccaatttttgccgacgaaaagagattaaagatcaatccttcaccggaaaaccaacccaaacccttcatcttcttcctacccagatcccaaagatcccatctttgatttcttatccgactttaaatgttccctttcattcttttttcttgtgtaaaaattgaaactttcccttgctcacattcttgatttcacccccaaatttttgttctttgggctccactgattagtgggtatctttcagattttgcaatcaattttgggtctttgagggttttcgtttgagcattgttcttgggtttcgataaggattttggggtttttgttttttcatggaatttggtggatctaaggattgcatggctgtaatggagtcatcagtgtaatagggaggattgggttgcagtttcaaggagtgaagtgggtttttcgggtagtgttttgattgggggatttagatcatggagcatgttattggaggcaagtttaagctggggaggaagatcggcagtggatcgttcggagagctttatttggggatcaatgtgcaaactggggaggaggtggctgtgaagctggaatctgttaagacaaaacaccctcagcttcactatgagtcaaagttgtacatgcttcttcaaggaggaacgggtgtaccccatctcaaatggttcggagttgagggtgaatataatgtcatggttattgaccttcttggcccaagcctagaagacttgttcaactattgcaaccggaagttctctttgaagacggttttaatgcttgcagatcaattaataaatcgagtggagtacatgcactcgcggggatttcttcaccgtgacataaagcctgacaacttcttaatgggtcttgggcgtaaagctaatcaggtatatatcattgattatggcctcgcgaaaaagtatagagatcttcaaacgcataagcacataccatacagggaaaataagaatctgacaggaacagctcgctatgcaagtgttaacactcaccttggtgttgagcaaagcaggagagatgatctggaatctctgggttatgtgcttatgtattttcttaggggaagccttccctggcaggggttgaaagcaggtaccaaaaaacagaaatatgacaagatcagtgaaaagaagatgcttactccaattgagggtctgtgtaaatcgtatccatcagagttcacttcatatttccattactgccgctcattacgctttgaagataaaccagactattcatacctgaagagacttttccgagatctttttattcgagaaggttatcaatttgactatgtatttgattggacaatactgaagtatccacaaattggctccagttctagagcaagaacaagtgcaaaaccagctttgagtcctggaccatctgcagaaagaacagaaaggcgttcagagagagacgagtttcgagagagactctcaggtgcagttgaagcattttctagaaggaatggttctgggcagggtgacaactccagacttaaatcagttgaagatgcgccatcatccaaagatgtgcatcatgattcagaaagaacccggagttcatctagaaatggcagcacctcaaagaggcctgtcatatcaagcagtaggccaagctcctctggtgagcctagcgagagcaggtcaagccggctgatctcgagcagtggtcgcctgtcaaccacccaaaggacacctgggtatgaatcgaaagtgtcttatactcgtacttcagctgcaagaggcggtcgtgatgatgcacttaggagctttgagctcctttctattggtacggggaagaggaaataaagtctgatctatctactgattaatttcctgcctcaaagttccgtgtagtatctatcccaagatgtcagccctacaatggttttactacagttgctctgtatatgtgtatcccttgtcgggttcattcatagttgaaaagctcagtgaagtttctcctttagaaggacccatcatttaccacttccatggatttcttgccattacaacgtgcctcggtgactcacccaagaaagagattaaccatctcacttcagggagttgtttatatatttgagattctggtagctgtaataaatacagctttggtgatctttttccagggaaataaaaacttttgttaagatgttcattaagctctggtttgtaacatgtgtagctatctagcagaaattggttacatagtcattcttgtttctcatgtacttagtatcaactcccttttcttttaccaaatcagaccttttgccagtagtgattgctttaaacatttctgaaaatctgatatgtcctattc

SEQ ID NO: 8147 - DNA, 1409 bp, Cucumis sativus
ctcaatcatggagcatgtaattggtgggaagtttaagttgggccggaagattggaagcggatcctttggtgaactgtatttgggtactaatgtgcaaactgaggaggaagtggctgttaagctagaatctgtgaaaaccaagcatcctcagcttcactacgaatctaaactgtatatgcttcttcaaggaggaactggtattcctcatctcaaatggtttggagttgagggtgagtataatgttatggttattgacctccttggaccgagccttgaagatctgttcaactactgtaatcggaaactatctttgaaaacagtattaatgcttgctgatcagttaataaacagagttgagtacatgcactcacgggggttccttcaccgtgacataaagcctgacaactttctaatggggttggggcggaaggctaaccaggtctatattatcgattatggtcttggaaaaaagtatcgggatcttcaaacacacaagcatataccatacagagaaaataagaatctaacaggaacagctcgctatgctagcattaatactcaccttggagttgagcaaagcagaagagatgatctcgaatctcttggttatgtgcttatgtattttctcaggggaagtcttccttggcagggtttgagagcagggaccaaaaagcaaaaatatgataagattagtgaaaagaaaatgctcactccaattgaggtcctctgcaaatcttatccaacagaattcacatcttacttccactattgccgagccctaagatttgaagacaaaccagattattcctatctgaagaggcttttccgcgatcttttcattagagaaggttaccaatttgactatgtatttgactggactatattgaaatatccacagattggctccagttctaggacacgaccaactgggaaagcagctataacccctggaccatctgcagaaagagtggagaggcctttagtgggacaagatctgcgagacaaattttctggtccagtggaggcttttgctagaaggaatggcactggcattggtctacacagtgatcattctagacatagatcttctgatgacgtgccttcttccaaggatgtgcaaccggatgcagaacgagcacggagttcttctcggcaagggagtgcttctaagagacctatattgtcgagcagtcggcctagctcctctggggagccaagcgaactccgctcaagccggcttttttcaagcagcagccgtctgtctggttctacacaaagaattcaacctggggttgagtcaaaatcatcctttctccgttcttctgctacaaaaggcagccgtgatgatgcacttcgaagctttgaactattaacaatcggcactggaaagaagaaataagaactgattg

SEQ ID NO: 8148 - DNA, 2176 bp, Vitis vinifera
attaataataatttttataaagagggagagatgggagagatggatagtactgatttgtttgctacaccttgtcgtcgcccaaaagcaggaagatttgttgatttttgggcgattaagaaggttgttgtgccactgtgtatgttgggaattgatggatctgagagttgggagatttgatcggtctgcgagaagggcatcgaaattgtatcgaggggaaaggtttgtttgtgatttgtaatggtgaatggtcttttgggttaagagggaaagggtcgagattgttttgtttttggggctttgattttaattgggatttggcatcatggatcatgtgattggtgggaagtttaagctcggccgcaagatcgggagtggatcgttcggagagctttacttagggattaatgtacaaactggagaagaagtggctgttaagctggaacctgtaaagacaaagcaccctcaacttcactatgagtccaaattgtatatgcttcttcaaggaggaactggcgttccccatctcaaatggtttggagttgagggtgaatacaatgccatggtcattgaccttcttggaccaagccttgaggacttgttcaactactgcaatcggaaattttcattgaaaacagttttaatgctcgcagatcaactaattaatagagttgaatatatgcactcaaggggttttcttcaccgtgatataaagcctgataactttttaatgggtttaggacgaaaagcaaatcaggtttacatcattgattatggccttgctaagaagtaccgagattttcagacacacaagcacataccttacagagaaaacaagaatctcactggaacagctcgctatgcaagtgttaacacacacctcggagttgaacaaagcaggagagatgatctggaatctcttggttatgtgctaatgtattttttgaggggaagccttccatggcagggcttgaaagccggtactaaaaaacagaaatatgacaagatcagtgaaaagaagatgctgactcccatagaggtactttgcaaatcatatccatcagagttcacatcatatttccattactgtcgatcattgcggtttgatgacaaaccagattattcatacctgaagaggcttttccgggacctatttattcgtgaaggttatcagtttgattatgtatttgactggaccgtactcaagtatccgcaaattggatccagttctagagtgcggcagcctagtggaaaaccagctttaaatcctggaccatctgcagaaagaatggagcggccatcagtgggacaagagattcgagatagattctcaggtgcagttgaagcattttctagaaggaacaactcaggttctggttatcatggtgaccagtccaggcacagaggttcggaggatgtaccatcttcaaaggatgtgcaaactgattctgaaagaccccggagctcctctcgaaatggcagtacttcaaagagggctgttgtatcaagcagccgcccaagctcctctggtgaacctactgagactcgtgcaagccgtctggtctcaggcagtggccgcttgtctacgactcaaaggagccaacctggttttgaatcgaaatcatcatctttcactcgtgcttctgcagcaagaggtgggcgtgaagatcctctacggagctttgagctcctaacgattggctctgggaagaagaaatgagggagagattgatcttgtaagaagttgattgggagggggaaattcccctggctagtgtcctatcagaatctcagcacccttgatagttttaccatggctctgtatatgtgaattatgcattattgggctcacatgcgcagttagaagctcagtcaaagcactcgagactcttccttcttcctctttgagagttcgtgccattatattgccttgtagactatatccaagaaacagagaaaatatctcacttcagggaattgtttatatatttgagacttcagtagttgtaataaatacctctggtatatgatgatgagaaacttatctgaagggtcacagcgctcgacgccccccctacgtgcgacgcagtcgtcttttcttgatgtttttttacgttgtttcttgtcggtctcatgcaggtcatggttttggctctatgggtcctacttctttaatgac

SEQ ID NO: 8149 - DNA, 2302 bp, Cucumis melo
tcccccaatcatccaacttttgtttctcatccattttccttcattttctcgcttccttttcttcactccgtcaaaatccaccaaatattctcctctaattcccccaacaaacttcatctttctccaaaaactcagatccgaagatctcaatctcaggaatgtgtgttctcacctttttattacggatggtgttcgtcgtttgttctgcgtgatttctcgttttaatggaatttccgatcatttccatcatctgcctggaaggtgtggatcagagattcagaggcagtgtttgatgatttgaattaagaatcgacgctgtacttggattgggaaaggaattgtctgaagaggaagcatttttgtggcattttttttgtatggtggactaaattttgagttgattgatatatcaagggagagcttggtggattagttaattaggtcatggagcatattataggtgggaagtttaagcttggaaggaagatcggtagcggatcatttggggaactttatttgggtacaaatgtacagacaggagaggaagtggctgtgaagctggaatctgcaaagaccaagcacccacagcttcactatgagtcaaaactatacatgcttcttcaaggaggaaccggtatcccccatctcaaatggtttggagttgaaggtgattacaatgtcatggttattgatctccttgggccaagcctagaagatttgttcaactactgcaatcggaaactgtccttgaagtcagttttgatgctggcagatcagttgataaacagagttgaatatatgcattcacggggtttccttcatcgtgacataaagccggacaattttctaatgggtttggggcgaaaggctaatcaggtgtacatcattgactatggtcttgcgaagaagtatagagatcttcagacacacaagcatataccatacagagaaaataagaatctcacgggaactgctcgctatgcaagtgtcaatactcatcttggagttgagcaaagcaggagggacgatttagagtcactgggctatgtgctgatgtattttcttaggggaagccttccttggcaaggactgaaggcagggactaaaaagcaaaaatatgataagatcagtgaaaagaagatgcttactccagtagaggtcctctgcaagtcatatccatcagaatttacatcctactttcactattgtcggtcactgaggtttgaagataaacctgattattcatatctgaagagattattccgagaccttttcatccgtgaaggatatcaatttgactatgtatttgactggactatactcaaatatccacagattggctccagttcaaaaccacgacctagtggaaaaccaggtcacgccccaggaccatccgctgaaagaggggaaaagcatccagtgggacaagatatccgagatagatactctggtggagcagaggcattcggaagaaggaacgccagtgggcatttgcatggtgatcattccagacacagatctgatgatgtaccatcttccaaggatgtgcaacctgattcagaaaggggccgcagtagttataggaatggaagcatttcaaagaggcctgttctatcaagcagtcgaccaagctcctctggggagccaagtgaaatccgatcaagtcgtctggtgtcagccagtagtcgtctatctgcaggccaaagggttcaacctggttttgagtccaaaacgacaacttttacccgttcttcaactacaaaaggtggtcgtgatgatacactccggagctttgagctgttgtctattggaactggcaagaggaaatgaaaaaaaggatacagatcaatgtgggtaagtagtgactgtgtgaatggtcaacaaaacaccctatgtatcttctgtaaaatgccccagctctatggtattttatatcaattgaacatgtatatgtgtatctcgatcattagttggctcagttcgtccacactataaaatttaatgaaatctccaaaaaacattggttggaagcgaaagcgaaacctccatggattttcttggttacaatggtgcttctttcgttctaggaatttgttaatacatttgagacagttgtaatataccttccaggtaaaatctttcaggtgaagggaccctgctgaaactcaaacatgcttttttctgtcctctattcatttatttttaccattccttttgtatctttatgcagtatgcaaatttaatgttacttttcaggaagagaatacttatgtttgcctgttcaaaaaaaaaaaaaaaaaaa

SEQ ID NO: 8150 - DNA, 2294 bp, Citrullus lanatus
tcacctcgccttgtcttccttccccttcccccaatcatccaacttttgtttctcatccattttccttcattttctcgcttccttttcttcactccgtcaaaatccaccaaatattctcctctaattcccgaagaaacttgatccttgtccaaaactcagatccgaagatctcatctcaggaatgtatattctgagctttttattacggaagctcttcgtttcttctgcctgatttctggcttgaatggaatttgcgatcattgccatcatcgccctggaaggtgtggatcacaggcagcatttcatgatttgaatccttataggaatcgacgccgcacctggattgagaacggaattgtccgacggggaaacatttttttgccatttgtgtatggtggactaaattttgagtcgattgatatataataggcgagcttggtggattggtaaattaggtcatggagcatattataggtgggaagtttaagcttggaaggaagatcggcagcggatcatttggagaactttatttgggtacaaatgtacaaactggagaggaagtggctgtgaagctggaatctgcaaagaccaagcaccctcagcttcactacgagtcaaaactatacatgcttcttcaaggaggaactggtatcccccatctcaaatggtttggagttgagggcgattacaatgtcatggttattgatctccttgggccaagcctggaagacttgttcaactactgcaatcggaaactgtccttgaagtcggttttgatgcttgcagatcagttgataaacagagttgaatatatgcattcacggggtttccttcatcgtgacataaagccagacaattttctaatgggcttgggtcgaaaggctaatcaggtgtacatcattgactatggtcttgcgaagaagtatagagatcttcagacacacaagcatataccatacagagaaaataagaatcttacgggaacagctcgctatgcaagtgtcaatactcatcttggagttgagcaaagcagaagggacgatttagaatcactgggctacgtgctaatgtattttcttaggggaagccttccttggcagggactgaaggcagggactaaaaagcaaaaatatgataagatcagtgaaaagaagatgcttactccagtagaggtcctctgcaagtcatatccatcagaatttacatcctactttcactattgtcggtcgctgaggtttgaagataaacctgactattcatatctgaagagattattccgagaccttttcatccgtgaaggatatcaatttgactatgtatttgactggactatactcaaatatccacagattggctccagttcaaaaccacgacccagtggaaaaccaggtcacaccccagggccatcagctgaaagaggggaaaagcatccagtgggccaagatgtccgagatagattctctggtggagctgaggcattcggaagaaggaacgccagtgggcatttgcatggtgatcattccagacacagatctgatgatgtaccatcttccaaggatgtgcaacctgattcagaaaggggccgcagtagttacaggaatggaagcatttcgaagaggcctgttctatcgagcagtcgaccaagctcctctggggagccaagtgaaatccgatcaagtcgcctggtgtcagcaagtagtcgtctatctgcagggcaaagggttcaacctggttttgagtccaaaacgacaacttttacccgttcttcaactacaaaaggcggtcgtgatgatacactccggagctttgagctgttgtctattggaactggcaagaggaaatgaaaaaagaaacagatcaatgtgggtaactagtggccgtgtgaatggtcaacataacacctatgtatcttctgtaaaatgccccagctctacggtattttatatcaattgaacatgtatatgtgtatcgatcattagttggctcggttcgtccacactacaaaatttaatgaaatctcctccgaaaacattggttggaagcgaaacctccatggattttcttggttacaatggtgcttgtttcgttctaggaagttgttaatacatttgagacagttgtaatataccttccaggtaaaatctttcaggtgaaggaactgctgaaactcaaagatgctttttactgtcccctattcatttatttttaccatttcttttgttctctttatgcagtacgcaaatttgatgttaccttccaggatgagaatagttgttatgtgtacttgttgaaaa

SEQ ID NO: 8151 - DNA, 2337 bp, Theobroma cacao
taacccagatcgatagatcatcacccaaatccttgccgataaattcgttccttttagattctttttccattttcccctttttatggggcaatcaaaatatacccttttttttctttaatactcctaagttttatctcttagaaaaaagacccaactttttctctttacctttttcccacctagagaatgcagcttgatgatcccaaaacgcttgttttggttcactgatcaatgggaatcccgtagattttcaatcaagtttctccgttttttagccctttagtcactaataggataagaattttggtggatctgagagttagtttgaagagaagggttttgagccattttccctgttgaaagtcaagttttccaatattaataaagtgaaataagaggggaggggcagtttttttgtttttgagtaagattagatcatggagcatattattggtggaaaattcaagcttggtcgaaagatcggaagtgggtcgtttggtgaactttatttaggagttaatgtacaaagtggagaggaagtggcggttaagctggaatctgttaagacaaagcatccccaacttcactatgagtcgaagctgtacatgcttcttcaaggagggatgggtattccccatctaaaatggtttggagttgagggtgaatacaatgttatggttattgatcttcttggaccaagcctcgaagacttgttcaactattgcaatcggaagttttctttaaaaacagttttgatgcttgcagatcagttaataaatagagttgagtatatgcactctcgtggttttcttcaccgtgatataaagcctgataactttttgatgggtttagggcgcaaagcaaatcaggtatacataattgattatggccttgcaaaaaagtatagggatcttcaaacatacaagcacataccatacagggaaaataagaatcttacaggaacagctcgatatgcaagtgttaacactcaccttggagtcgagcaaagcaggagggatgatctggaatctcttggttatgtgcttatgtacttcctcaggggaagccttccatggcagggcctgaaagctggcaccaaaaagcagaagtatgacaagattagtgaaaagaagatgcttacccccatagaggtcctttgcaaatcatatccttctgagttcacatcgtactttcattattgccgatcactacggtttgaagaccgaccagattattcgtacctgaaaaggctgtttagagacctttttattcgagaaggttatcagtttgactacgtatttgattggaccatcctgagatatccacaggttggctctagctcaagggcacggccaagcccaaagccaggtttaaatccccctggtgtatctgctgacagaacagaaaggccgtcagttggccaagagataagagaaaggttctcaggtgcggttggggtacttggtagacggaatggtttgcatggtgatcagtctagatacagatcttcagatgatgtgccatcatcgaaggatgtgcaacctgattcagaaaagggtcgctcctcctcaagaaatggtagtacttcaaagagggctgtggtatcaagcagtcggcctagctcttctggggagcctagcgagaacaggtctagcagattggtctcaagcagtggtcgcctgtcaacaactcagagggtccaacctgggtttgaatcaaaatcatcaacttttattcgtactgcagccacaagaggtggtcgtgatgatgccctcaggagctttgagctcttgacaattgggagtgggaaaaggaaataaatggcatatgcatctgttagggaggatttgcttgtgttgagggcttaatttccctattctagtctctgatggagatcttagcaactataatggtatttacaaacagtcactctgtatatctgtgtccatttgggttccatccacaacaatctcatgaagaagttcatcctcaggaaaacttttcgactcattcctcttgtacctcgtcaggtattcttgccattatgatgcctctagagtcctagactcattaaagaaagagataaatgatctcactttagggaattgttcatatgtttccaacattctagctttaataaacacttaatatttctttctttcagaagcaaaagaagagaactatgcctagaagtctattatagcaaagactttctggctttatgtgatctggcttactctgtttatatcttttcgcagtttatgttgccattatctgtaaaacatgaatgatgtttctggttttagcattacaatattgtagtgaccataacatgat

SEQ ID NO: 8152 - DNA, 2027 bp, Cucumis sativus
tcccccaatcatccaacttttgtttctcatccattttccttcattttctcgcttccttttcttcactccgtcaaaatccaccaaatattctcctctaattcccccaacaaacttcatctttctccaaaaactcagatccgaagatctcaatctcaggaatgtgtgttctcaccttttcattaaggatgctgtttgtcgtttgttctgcgtgatttctccttttaatggaatttccgatcattaacatcatctgcctggaaggtgtggatcagagattcagacgcagtgtttgatgattttgaattaagaatcgacgctgtacttgtattgggaaaggaattgtctgacgaggaagcatatttttttttgtatggtggactaaattttgagttgattgatatataaagggcgagcttggtggattagttaattaggtcatggagcatattataggtgggaagtttaagcttggaaggaagatcggtagcggatcatttggggaactttatttgggtacaaatgtacagacaggagaggaagtggctgtgaagctggaatctgcaaagaccaagcaccctcagcttcactatgagtcaaaactatacatgcttcttcaaggaggaaccggtatcccccatctcaaatggtttggagttgaaggtgattacaatgtcatggttattgatctccttggtccaagcctagaagatttgttcaactactgcaatcggaaactctccttgaagtcagttttgatgctggcagatcagttgataaacagagttgaatatatgcattcaaggggtttccttcatcgtgacataaagccggacaattttctaatgggtttggggcgaaaggctaatcaggtgtacatcattgactatggtcttgcaaagaagtatagagatcttcagacacacaagcatataccatacagagaaaataagaatctcaccggaactgctcgctatgcaagtgtcaatactcatcttggagttgagcaaagcaggagggatgatttagaatcactgggctatgtgctgatgtattttcttaggggaagccttccttggcaaggactgaaggcagggactaaaaagcaaaaatatgataagatcagtgaaaagaagatgcttactccggtagaggtcctctgcaagtcatatccatcagaatttacatcctactttcactattgtcggtcactgaggtttgaagataaacctgattattcatatctgaagagattattccgagaccttttcatccgtgaaggatatcaatttgactatgtatttgactggactatactcaaatatccacagattggctccagttcaaaagcacgacccagtggaaaaccaggtcacaccccaggaccatccgctgaaagaggggaaaagcatccagtgggacaagaaatccgagatagataccctggtggagcagaggcattcggaagaaggaacgccagtgggcatttgcatggtgatcattccagacacagatctgatgatgtaccatcttccaaggatgtgcaacctgattcagaaaggggccgcagtagttataggaatggaagcatttcaaagaggcctgttctatcaagcagtcggccaagctcctctggggagccaagtgaaatccgatcaagtcgcctggtgtcagccagtagtcgtctatctgcaggccaaagggttcaacctggttttgagtccaaaacaacaacttttacccgttcttcaaccacaaaaggtggtcgtgatgatgcactccggagctttgagctgttgtctattggaactggcaagaggaaatgaaaaaggatacagatcaatgtgggtaactagtgaccgtgtgaatggtcaacacaacaccctatgtatcttctgtaaaatgcctcagctctatggtattttatatcaattgaacatgtatatgtgtatctcgatcattagttggctcggttcgtccacactataaaatttaatgaaatctccaaaaaacattggttggaagcgaaa

SEQ ID NO: 8153 - DNA, 2266 bp, Cucumis melo
ggaggtgggtttgtggggagtagtacattatctcactcttcccaaacgacagaagagctttttgctcgtttggggtttgagtttttgctcacttactaatttctatttgtttcattctgtatcatattttggggttctaagtgtgatttgaagtatttcggtggtttggagttggattttgagctttgatttttttttcctcgaagcttgaaagtttgattggaagttggtggatctgagatggttccaggagattgaaatcgtttcaaggatattgggattgaggattggtagttgaactgttactgtagggttagtatttggagtttgctggttttggtggattgtgttagctgaggtaataaaaaggtgaactgggattgctttgattctgttcaagctaaatcatggagcatgtaattggtgggaagtttaagttgggccggaagattggaagcggatccttcggtgaactgtatttgggtactaatgtgcaaactgaggaggaagtggctgttaagctggagtctgtgaaaaccaagcatcctcagcttcactacgaatcaaaactgtatatgcttcttcaaggaggaactggtattcctcatctcaaatggtttggagttgagggtgagtataatgttatggttattgacctccttggaccgagccttgaagatctgttcaactactgtaatcggaaactatctttgaaaacagtattaatgcttgctgatcagctaataaacagagttgagtacatgcactcacgggggttccttcaccgtgacataaagcctgacaactttctaatggggttggggcggaaggctaaccaggtctatattatcgattatggtcttggaaaaagtatcgggatcttcaaacacacaagcatataccatacagagaaaataagaatctcacaggaacagctcgctatgctagcattaatactcaccttggagttgagcaaagcagaagagatgatctcgaatctcttggttatgtgcttatgtattttctcagaggaagtcttccttggcagggtttgagagcagggaccaaaaagcaaaaatatgataagattagtgaaaagaaaatgctcactccaattgaggtcctctgcaaatcttatcctacagaatttacatcttacttccactattgccgagccctaagatttgaagacaaaccagattattcctatctgaagaggcttttccgtgatcttttcattagagaaggttaccaatttgactacgtattcgactggactatattgaaatatccacagattggctccagttctaggacacgaccaactgggaaagcagctataacccctggaccatctgcagaaagagtggagaggcctttagtgggacaagatctgcgagacaaattttctggtccagtggaggcttttgctagaaggaatggcactggcattggtctaaacagtgatcattctagacatagatcttctgatgacgtgccttcttccaaggatgtgcaaccggatgcagaacgagcacggagttcttctcggcaagggagtgcttctaagagacctattttgtcgagcagtcggcctagctcctctggggagccaagcgaactccgctcaagccggcttttttcaagcagcagccgtctgtctggttctacacaaagaattcaacctggggttgagtcaaaatcatcctttctgcgttcttctgctacaaaaggaagccgtgatgatgcacttcgaagctttgaactattaacaattggcacaggaaagaagaaataagaactgatcgatcgtcgggggtgaactgttttttctctgtagttactgttggaattcatcattctgatgacgtttttaaacatctgtatggtgtctcttcatgttcatcatcagattccgtcccagggctttgacaccaaccaaccggaaaaagtcttaattgcctctgtggccataattctgctagatgaagcaagggatagagatgactcctgccagaccttttggatgaatagaaagagaagtcagctttattgttattgtcgtctctgttgctatttttttctttataaagatctgattttacaattactcttaactttccctttcaaatcatgtctgcaatggaagagtgatatttacctttatggatgatagctataaggaaaatgaagaacagggaagattatgatgggttaaattatagatactcacggatatatatatatatatatatatatatatata

SEQ ID NO: 8154 - DNA, 1804 bp, Ricinus communis
gttgttgtggtgatatatttttaatgaaatttgatggatctgaaagctgctgtgtttttcaataatggaacagttttgggtcaccgtggttggtgaattttgattgttagttgtttgattgggggttttgcttggtgtgttattatagtgcttttgattgggaatgtcaatcatggatgttttgattggtggcaagtttaagttgggaaggaagatcggtagtggatcctttggtgaactttatttgggtatcaatgtacaaagtggagaggaagtagctgttaaactggaatctgcgaagacaaagcatcctcagcttcactacgagtcgaagctctatgtgcttcttcaaggaggaacgggtattccccatctgaaatggtttggagttgagggtgattacaacgtcatggccattgaccttcttggaccaagtctggaagacttgtttaattattgcaatcggaagttttccttgaaaacagttttgatgcttgcagatcaattgttaaatagagtggagtttatgcactcgcggggcttccttcaccgtgatataaagcctgacaactttttgatggggttagggcgcaaagcaaatcaagtctatatcattgattatggccttgcgaaaaagtacaaggatcttcaaacgcacaagcacataccatatagggaaaacaaaaatctcacaggcacagctcgctatgctagtgttaatacgcaccttggggttgagcaaagcaggagggatgatctggaatctctaggttatgtgcttatgtattttctgaggggaagccttccctggcagggactgaaagcaggtaccaaaaagcaaaaatatgacaagatcagtgaaaagaagatgcttactcccatagagtttctgtgcaaaaactacccttcagaattcacgtcatacttccattattgccgatcattgcgatttgaagacgcaccggattattcatacctgaagaggctctttcgggacttatttatccgagaagggtatcagtttgattatgtatttgactggactatattgaagtacccgcagattggctccagttctagagcaaggccaattagcaaaccagctgtgaatccaggtccatcagcagaaagaacagaacggccttcagtgggtcaagaaatccgagacagattctcaggggcagttgaggcatttgctcgtaggaatggctctgggcatgctttgcatggggatcactcgcggcacaggtcttcagatgatgtgccatcatctaaagatgtgcatcttgattctgaaaggcctcgatcatcatctcgaaatggcagtacttcaaagagggctgtcatatccagcagtcggccaagctcatcgggcgagcctactgagagtcgatcaagccggctgctatcaagcagcggtcgattgtccacaacgcacagggtgcaacctggatttgagtcgaaatcatcttcttttactcgagctgcagcaacaagaagtagtcgtgatgatgcacttaggagctttgagcttctctcaatgggcacaggaaaaagaaaataagcatcagatttataagcaggacgtccttgtgttaggggtccaatttcccatatgtggtttgtatcaaaatcttgggatgataatggtgtgttagcagttactttgtatatgcgcgccaattcttgggtttcattcgcattaagtgccagcaggcccagcacaacaaagtttcacctggaaagactgctcagctcctgctcttcagggattcttgcaagtacatgacctactggaatcatg

SEQ ID NO: 8155 - DNA, 2512 bp, Gossypium raimondii
acttaagaaatattagaagaaaaaaaaatccacctaattcatcatccagctccaactttttcttctgcaaatcatccgttttccctttttttggggggggtttacttcaaggaaaaaattcccgagaaaattaaatccttgtccttaactcagatccgtagatcattatcccaaattcttgccgataaatctgtttgttttagattcttttccatattcccctttttccggggcaaaacaaaatatacctttttttttctttaatactgcctaagttttatctcctctacttttttttttctccccacctagaaaatgcagcttaatgaccccaaaacgcttgttttggttcactgattaatgtattttcgtgaaattttcaatcaagttttttttccccttggggttcccctttagtcacttaaaagggataacagggtgttttctttttggaatttttggagggtctaacaagcattcaataatctgggttttgatctttggagttaatagataagaatttttgatggatctcagagttggtttgaagagaaacatcttgtagtcaatttcaatattaataaagtggaataagaagggagggtttcttttatatcgtgataaagttacaataaaagattagagatcatggagcatattatcggtggcaaattcaagcttggtcgaaagatcgggagtggatcgtttggtgaactgtatttaggcgttaatgtacaaagtggagaagaagtggctgttaagctagaatctgtcaagactaagcatccacagcttcactatgagtcaaagctgtatatgcttctacaagggggaacgggtattccacatttaaaatggtttggagttgagggtgagtacaatgttatggttattgatcttcttggaccaagcttagaagacttgttcaactattgcaatcggaagttctctttaaaaactgttttgatgcttgcagatcagttaataaatagagttgagtacatgcactctcgtggttttcttcaccgtgacataaagcctgataactttttgatgggtttagggcgcaaagcaaaccaggtgtatataattgattacggccttgcgaaaaaatatagggatcttcaaacacacaagcacataccatacagggaaaacaagaatcttacaggaacagctcgatatgcaagtgttaacactcacctcggagttgagcagagcaggagagatgatctggaatctcttggttatgtgcttatgtacttcctaagaggaagccttccatggcagggcctgaaagccggcaccaaaaagcagaagtatgacaaaattagtgaaaagaagatgcttactcccatagaggtcctctgcaaatcgtatccatctgagtttacatcttactttcattattgtcgatcgctacggtttgaagacaaaccagattactcatacctgaaaaggctgttccgggacctttttattcgtgaaggatatcagtttgactatgtatttgattggactatactgagatatccacaggttggctctagctcaagagcacgggcaagcccaaagccaggtttaagtccccccggagtatctgctgaaagaacagaaaggccatctgttggccaagagattcgagaaaggttttctggtgcagttgaggcatttgcaagacggaatgtctctggccatggtttgcatggtgatcagtctagacacagatcttcagatgacgtgccatcatccaaggatgcgcaacctgattctgaaaggacacgctcctcttcgagaaatgatagtgcttcaaagcggcctgttgttgtatcaggcaacagccaacctggctcctctggtgagccaagtgagaatcgttctagcagattattctcaagcagtggtcgcatgtcaacgactcagagagttcaacccggctttgaatcaaaatcatcatctttcactcgtactgcagtcacaagagctggccgtgatgacaccctccgaagctttgatcttttgacgatcgggagtgggaaaaggaaataaaccacacatgcatctggtaagaagaatttccctctatcctattctctgatggagatttcgacactagagtggtatttacaaaccgtttactccgtatatcatcgtccattattgggttccatccacagcaatccccggaaaaaaatgaactttccaatcccgtcctctcgtaccattgtcaagtgttcttgctttgctattatgatgcatctaaaagaaagagataaactgatcccattttagggtgaaattgttcatatatttccaacagtttagctgtaataaacacttgatgtttctttgtttctttcaatcagataccaaaaaagcaaaaaaacactgcctaaaggttttctggttatgacatatgatgactcttaatataccttcaaatcttgtgttagtattatctgtaagatgaatgttgtttctcattttagtattgcttggtacaatgttatag

SEQ ID NO: 8156 - DNA, 2521 bp, Citrus clementina
ttacaataatagaataattaaatttaaaaaaaatatatatcgtagaatataaatattaaacttaaacacaacaattaattaatttattttttctcctaaaatatttactacggaacggataccaaattacaattaaaaaaaaaaacaaaaatccaataatatatcatccaatttctcgttcatcaatcatcgtccatttccattcactttcccttcattttctctctctctccttcattcttttctcataaaatttcccgagaaaattcaagctgttttctcaaactcaatccttgtctgcaactcagatccgattctcctccccgaattcttgcctcaagtttcgcctgcttagattcttttcgctctgtatttttccctctgaaagaattaatttaaggaaaaaaaaacaccatttctaaccattattttctcttcaaaatcccaccttttttctcttcaaaaatttcccagaaaatgcattattgtgatcgctcaacaatgttaacaaatgggtattgcttggttttttaagcaaactcatgttttgttttgtatagtaacagatagattgtaaaggctaatttttattttaagttgcattgtttttttggtttatcaataaatttgatggatctaaagattctctgacaagggaatcttttgtgggtagtttcatgtttggtgaacaaatttgattgtaatataattaatagtggaaagaaaaaaagtccaaatttgttgtattaaattttttgttcgggtcaaaagtagatccatggatcatgtaattggaggcaagttcaagctggggaggaagatcgggagtggatcgtttggtgagctttatttaggggttaatgtgcaaactggcgaggaagttgctgtgaagctggaatctgtgaagacgaagcatcctcagcttcattatgaatcaaaattgtacatgcttcttcaaggaggaacgggtgttccccatctcaaatggtttggagtggagggtgaatacaatgtcatggttattgatcttcttggaccaagcctggaagatttatttaattactgcaacagaaagttttctctgaaaacagttttaatgcttgcggatcaattaataaacagagttgagtatatgcactcacgtggttttctacaccgtgatataaagcctgacaactttctgatgggtttagggcgcaagtcaaatcaggtatacatcattgattacggccttgctaagaagtatagggatcttcaaacacacaagcatataccatacagggaaaacaagaatcttacaggaacagctcgctatgcaagtgttaacactcaccttggagttgagcaaagcagaagagatgatctggaatctcttggatatgtgcttatgtattttctcaggggaagtcttccctggcagggattgaaagctggtaccaaaaagcagaaatatgacaagattagtgaaaagaagatgcttactcctattgaggtcctttgcaaatcttatccttcagagttcacatcatacttccactattgccggtcattgcggtttgaagataaaccagattattcatacttgaaaaggcttttccgcgatctgtttatacgagaaggttatcagtttgactatgtttttgattggactatattgaagtatccgcagacgggctccagttcaagatcacgaccaagcgggaaaccaaatttgaaccctgcaggaccatcagctgaaagagtagagaggccttcaggacaagaggttcgagatagattcgctggtggaattgaggcctttgcaagacggaatacatctggtcatggtctgcatggtgatcactcaaggcacaaatcttcagatgatgtgccatcatcaaaggatgtgcaacctgattcagaaaggcctcgctctttgtctcgaaacagtagttctttaaagagggctatcatgtcaggtggccgaccaagctcatctggtgaccatagtgataatcggtcaggcagactggtctcaggctctggcagtggtcgtctgtctactacccaaagggctcaacctgggtatgagtctaagtcatcatccttctctcgtggtgcagccacaagaagtggtcgtgatgatgcacttcggagctttgagctcctgacaattggttcaggaaagaggaaataaacgacataactatctggtaagatagatttgtctctaccgaggatgaaaattttcttgttgctcctatcgagatccctgcactgaaatggttttaccacattttgtatatgtgtacccattattggactcagtccacggccactgccacagccagagctagagaaagcgctttgtactttgtcagggatttttgccattatgttatgctgctagactcctaaaaggaagagagcaaatgatgattttaccctagggaatttgttcataaatttgaacactagtagttgtaataaagacctgcgttatattttgttcagaagaaaaactaagccaaataatctagtt

SEQ ID NO: 8157 - DNA, 2520 bp, Citrus sinensis
ttacaataatagaatgattaaatttaaaaaaaaaaatatatcgtagaatataaatattaaacttaaacacaacaattaattaatttattttttctcctaaaatatttactacggaacggataccaaattacaattaaaaaaaaaacaaaaatccaataatatatcatccaatttctcgttcatcaatcatcgtccatttccattcactttcccttcattttctctctctctccttcattcttttctcataaaatttcccgagaaaattcaagctgttttctcaaactcaatccttgtctgcaactcagatccgattctcctccccgaattcttgcctcaagtttcgcctgcttagattcttttcgctctgtatttttccctctgaaagaattaatttaaggaaaaaaaaacaccatttctaaccattattttctcttcaaaatcccaccttttttctcttcaaaattttcccagaaaatgcattattgtgatcgctcaacaatgttaacaaatgggtattgcttggttttttaagcaaactcatgttttgttttgtatagtaacagatagattgtaaaggctaatttttattttaagttgcattgtttttttggtttatcaataaatttgatggatctaaagattctctgacaagggaatcttttgtgggtagtttcatgtttggtgaacaaatttgattgtaatataattaatagtggaaagaaaaaaagtccaaatttgttgtattaattttttgttcgggtcaaaagtagatccatggatcatgtaattggaggcaagttcaagctggggaggaagatcgggagtggatcgtttggtgagctttatttaggggttaatgtgcaaactggcgaggaagttgctgtgaagctggaatctgtgaagacgaagcatcctcagcttcactatgaatcaaaattgtacatgcttcttcaaggaggaacgggtgttccccatctcaaatggtttggagtggagggtgaatacaatgtcatggttattgatcttcttggaccaagcctggaagatttatttaattactgcaacagaaagttttctctgaaaacagttttaatgcttgcggatcaattaataaacagagttgagtatatgcactcacgtggttttctacaccgtgatataaagcctgacaactttctgatgggtttagggcgcaagtcaaatcaggtatacatcattgattacggccttgctaagaagtatagggatcttcaaacacacaagcatataccatacagggaaaacaagaatcttacaggaacagctcgctatgcaagtgttaacactcaccttggagttgagcaaagcagaagagatgatctggaatctcttggatatgtgcttatgtattttctcaggggaagtcttccctggcagggattgaaagctggtaccaaaaagcagaaatatgacaagattagtgaaaagaagatgcttactcctattgaggtcctttgcaaatcttatccttcagagttcacatcatacttccactattgccggtcattgcggtttgaagataaaccagattattcatacttgaaaaggcttttccgcgatctgtttatacgagaaggttatcagttcgactatgtttttgattggactatattgaagtatccgcagacgggctccagttcaagatcacgaccaagcgggaaaccaaatttgaaccctgcaggaccatcagctgaaagagtagagaggccttcaggacaagaggttcgagatagattcgctggtggaattgaggcctttgcaagacggaatacatctggtcatggtctgcatggtgatcactcaaggcacaaatcttcagatgatgtgccatcatcaaaggatgtgcaacctgattcagaaaggcctcgctctttgtctcgaaacagtagttctttaaagagggctatcatgtcaggtggccgaccaagctcatctggtgaccatagtgataatcggtcaggcagactggtctcaggctctggcagtggtcgtctgtctactacccaaagggctcaacctgggtatgagtctaagtcatcatccttctctcgtggtgcagccacaagaagtggtcgtgatgatgcacttcggagctttgagctcttgacaattggttcaggaaagaggaaataaacgacagaactatctggtaagatggatttgtctctaccgaggatgaaaattttcttgttgctcctatcgagatccctgcactgaaatggttttaccacattttgtatatgtgtacccattattggactcagtccacggccactgccacagccagagctagagaaagctctttgtactttgtcagggatttttgccattatgttatgctgctagactcctaaaaggaagagagcaaatgatgattttaccctagggaatttgttcataaatttgaacactagtagttgtaataaagacctgcgttatattttgttcagaagaaaaactaagccaaataatctagtt

SEQ ID NO: 8158 - DNA, 1859 bp, Gossypium hirsutum
aagtggaataagaaggggggtttcttttatatcgtgataaagttacaataaaagattagagatcatggagcatattatcggtggcaaattcaagcttggtcgaaagatcgggagtggatcgtttggtgaactgtatttaggcgttaatgtacaaagtggagaagaagtggctgttaagctagaatctgtcaagactaagcatccacagcttcactatgagtcaaagctgtatatgcttctacaagggggaacgggtattccacatttaaaatggtttggagttgagggtgagtacaatgttatggttattgatcttcttggaccaagcttagaagacttgttcaactattgcaatcggaagttctctttaaaaactgttttgatgcttgcagatcagttaataaatagagttgagtacatgcactctcgtggttttcttcaccgagacataaagcctgataactttttgatgggtttagggcgcaaagcaaaccaggtgtatataattgattacggccttgcgaaaaaatatagggatcttcaaacacacaagcacataccatacagggaaaacaagaatcttacaggaacagctcgatatgcaagtgttaacactcacctcggagttgagcagagcaggagagatgatctggaatctcttggttatgtgcttatgtacttcctaagaggaagccttccatggcagggcctgaaagccggcaccaaaaagcagaagtatgacaaaattagtgaaaagaagatgcttactcccatagaggtcctctgcaaatcgtatccatctgagtttacatcttactttcattattgtcgatcgctacggtttgaagacaaaccagattactcatacctgaaaaggctgttccgggacctttttattcgtgaaggatatcagtttgactatgtatttgattggactatactgagatatccacaggttggctctagcacaagagcacgggcaagcccaaagccaggtttaagtccccccggagtatctgctgaaagaacagaaaggccatctgttggccaagagattcgagaaaggttttctggtgcggttgaggcatttgcaagacggaatgtctctggccatggtttgcatggtgatcagtctagacacagatcttcagatgacgtgccatcatccaaggatgcacaacctgattctgaaaggacacgctcctcttcgagaaatgatagtgcttcaaagcggcctgttgttgtatcaggcaacagccaacctggctcctctggtgagccaagtgagaatcgttctagcagattattctcaagcagtggtcgcatgtcaacgactcagagagttcaacccggctttgaatctaaatcatcatctttcactcgtactgcagtcacaagagctggccgtgatgacaccctccgaagctttgatcttttgacgatcgggagtgggaaaaggaaataaaccacacatgcatctggtaagaagaatttccctctatcctattctctgatggagatattgacactatagtggtatttacaaaccgtttactccgtatgtcatcgtccattattgggttccatccacaacaatccccagaaaaaaaatgaactttccaatcccgtcctctcgtaccatcgtcaagtgttcttgctttgctattatgatgcatctaaaagaaagagataaactgatcccattttagggtgaaattgttcatatatttccaacagtttagctgtaataaacacttgatgtttctttgtttctttcaatcagataccaaaaaagacaaaaaacaactgcctaaagaattttcttggttatgacatatgatgactcttaatataccttc

SEQ ID NO: 8159 - DNA, 2414 bp, Cicer arietinum
agttagaaaagtaaaatttaaataaaaaattgggaaagtttatcgactgaataattaatgattttttggtacatacctccacaatcattcacttcctgatatccaatttgtttcctacaaaatctaaaaaatttcggagctcactttatttccttcattcacctcaactcacagatccaaactattcactccaaaaatccttctctctctgcgcgaatatctcaaccaatagattccttttcgtccttcaccttttacgcgtttctagattttcttatacggtgccgtattgatggatctgatatgagatttttggaatttcatttttttagttaagtagagtggcttgtaatttaagttaaaagaatagaagaggtttgaattttattagagttgttatcatggatcttgttgttggtggaaaatttaagcttgggaggaaaattgggagtggatcatttggcgagctttatttaggtgttaatgttcaaactgaagaggaagtggctgttaagctggaatctgtgaagacaaagcatcctcaacttctctatgagtccaaattgtatatgcttcttcaaggaggaaccggcatacctcatataaagtggtctggagtggagggtgactacaatgtcatggctattgaccttcttggaccaagccttgaagacttgtttaactattgcagtagaaaattctctctgaaaacagtgttgatgcttgcagatcaactaataaacagagtagagtatatgcactcccggggctttctgcatcgtgatataaagcccgacaactttttaatgggtttaggccgcaaggcaaatcaggtttacattattgactatggccttgcgaaaaagtatcgtgatcttcaaacacataagcatataccatacagggaaaataagaatctcaccggaaccgctcgatatgcaagtgttaacactcaccttggagttgaacaaagcagaagagatgatcttgaatcgcttggttatgtactaatgtactttttgagaggaagtcttccatggcaaggcttgaaagctggcactaaaaagcagaaatacgacaagataagtgaaaagaagatgcttactccaatagaggtcttgtgcaagtcacatccaacagaattcacatcatatttccactattgccgatcgttgcggtttgaagataaacccgattattcatatcttaagagactcttccgagaccttttcattagagaaggttatcagtttgactatgtatttgattggactatattgaagtatcctcaaataggatccagttctagaacacggccaagtgtgaaaccagtcttaaacccaggaccatctggagagagattagaacgaccttcagtcggaaaagagattcgagatagattatcaggtgcagtgggggcattttctagaaggaatggctcggggcatgggctgcataaggatctttccaagcacagatctttagataatacaccatctcccaaagatgtgcaacctgattctgacagggctcgcagttctactcgtcatggcagtgcttcgaaaaggcctatcatatcaagcagcagacctagctcttctggggaacccagtgaaagtcgttctagtcgattgatctcgggcagtagtcgtctatcttctactcaaagggttcaaccaggttttgagtccaaaccatccttcacccgtgccaccgcagggacacgaggtagccgcgatgatacactccggagttttgagctcctgtcaattagtacagggaaaaggaaatgagagaaaactgtaatggttgcatctcttccttttttgagacatccacccttcacacctgttcatttactcagttgtgttggggtccattcaaggccaaaagcttattgaaatttctcaatgaagctttggccttgtatgcttcttcagatgttcttccatgattatctaagcatggaaccattcatgaagagtctctatgtttaggaatttgtttatacatgagagatggtttcttgtaataaatataaatataaatacacattatctacattttttttttctattggacaaaaggaaaaagaaactgcaaagtctaatatgctttgcaagtttttgcacccttccattgcatcactgggaatgggtggctcctaatttggattggagaaaaacacgagactgttgtgtaacagtgcacaggtgtaaactcgaacttttgttctatttctaaattgattggagcctctaaggttaaaactttaaagttttttctggcatctacaaagttgttgtactctttttgattaaaatataggcacggtccaccttttgcttaacatacattccatatatgcaatttgtctttttctccatcggcctcatgtatccgcaaggaagaca

SEQ ID NO: 8160 - DNA, 1795 bp, Euphorbia peplus
agttttgttgggtgatagggttaatcaaattaatggatctgagggttgtcaaataagtagaaattgttagggtttgattggtgagtgtagtgtttaattgggtttttttttcaatcatggatcatgtaattggaggaaagtttaagctgggccggaagatcggcagtggatcctttggtgaactttatttgggtatcaatgtacagagtggagaggaagttgctgttaagttggaatctgtgaagacaaagcatcctcaacttcactatgagtcaaagttgtacatgcttcttcaaggaggaactggtattccacatctgaaatggtttggagttgagactgagtacaatgtcatggttattgaccttctgggaccaagcttagaagatctgtttaattattgcaaccggaagtttaccttgaaaacagttttgatgcttgcagatcaactaataaacagggttgagtatatgcacactcgtggttttctccaccgcgatataaagcctgacaactttttgatggggttggggcgcaaagcaaatcaggtctacatcattgattatggtcttgccaaaaagtataaggatctacagacacacaagcatataccatatagggaaaacaaaaatctcactggcacagctcgttatgctagtgttaatactcatcttggtgttgagcaaagcagacgggatgatctagaatcccttggctatgtgctgatgtattttctgaggggaagccttccatggcaaggtttgaaagcaggtaccaaaaagcagaaatatgacaaaatcagtgaaaagaagatgcttactcccatagagttcctttgcaaaaaccatccttcagagttcacatcatactttcattattgccggtcattgaggtttgaagacacacccgattattcatacctgaagaggctcttccgggacttatttattcgagaagggtatcaatttgattatgtatttgactggactattttgaagtaccctcagattgggtccagttctagagcaaggccaagtagcaaaccggttgtgaatccgggcccaccagcagaaagaacagaacgaccttcagtgggccaagaaatccgggagagattctcaggtgctgttgaggcgtttgctagaaggaatggctctgggcatgccgatcatttgcggcacaggtcttctgatgatgtggcatcacctaaggatgtgcatccggattctgagaggccacgatcatcatctcgtaatggaggtacttcaaagagggctctcgtgtctagcaccaggcctagttcatctggtgaaccaagtgagaaccgttcaagcaggctattatctagcagtggaagattgtccacagcccatagagcccaacctggtttcgagtccaaatcatcttctttcactcgtgctactaaaagtggtcgtgatgatgcacttaggagttttgagctcctctctattggaactggaaaaaggaaataataagcaatcagtttatgtggtaagaaggatttgtctatgttagagggttgaaataacaccccttttgtgctgtgaagatcttgggatcataattgtacattattcttgggttccatcacagaaaatgttcaacgtggtttcaccctttcgaaggaatcgaacccgggatttcttatgaaggatgaggaggcttgagagggagatgaatgattccactttagggaattgtttatatctgagaaaaccggcagttgtaataataatgaaaaagttattactgttgtatttcttcttaccttacc

SEQ ID NO: 8161 - DNA, 2496 bp, Lupinus angustifolius
gagtttggacactcatccattttctttgctttcctcctcccaacctcacaacaccttttttctccaattctctctctgtcatcccattttctttcctttccttttctctccgacaatattcactccttcttctcaacacacagatcccaaatcaaatatctatctctcacccataaaatcgtagcggttagattccttttccctcttcatcttctctcacactttgactcttcttcaggtttcaattttctagctcctttatccgaaaaagagcaaaaagggtttctttgaatgtgcccagataactgattcatccagaaattggttttttttatattctagttcttgatcgcattttcattgatcaaaaccttgtttagttgagtttaaggtattgggaatagcaaagcctgaatttttatgttatccaatacactttcggatcgttgtgttaatgtaaaatctctttggatctaagattttgctgggaataaagatggattgttgatgagactctctgagtatgtaagaagatttttttaaatagaataaaaatataaaatttatgtgtggtggagtgactttgcaatttagcaaagttgaagggttgagtttgttatcatggatcatgttattggtggaaaattcaagcttgggaggaagattggagctggatcgtttggagaactttatttgggtgttaatgtacaaactggagaggaagtggctgtcaaattggaacctgcgaagaccaagcatcctcaacttcactatgagtcaaaattgtatatgcttcttcaagggggaactggaataccccatttaaaatggtttggagttgagggtgactacaatgtcatggtaattgaccttcttggaccaagtcttgaagacttgtttaactattgcaaccggaaactatctctgaagacagttctgatgcttgcagatcagctaataaacagagttgagtacatgcactcccggggttttctgcatcgtgatataaagcctgacaactttttaatgggtttaggccgcaaggcaaatcaggtatatgtaattgattatggccttgcaaaaaagtatagggatcttcaaacacataaacatataccttacagggaaaacaagaacctcactggaactgctcgatatgcaagtgttaatacccaccttggagttgaacaaagcagaagagatgatctagaatcacttggctatgtgctcatgtactttttgagaggaagtctcccttggcaaggcatgaaaggtggaactaaaaagcaaaagtatgacaagattagtgaaaagaagatgcttactccgatagagatattatgcaagtcatatccatcggaattcacatcttacttccactactgtcgatcattgaggttcgaagataagcctgattattcatatcttaagagactctttcgggacctattcattcgagaaggttatcagtttgactatgtatttgattggactatattgaagtatccacaaattggatccagttctagagctcgaaaatggcttttatcagctaatgattctttaattttaggtgtgccagaggtccgggatagattgtctggtgcactcgaggaatttgcaagaaggaatagaccgactagctccgggcttgggctgcatggtgataattctaggcataggtcttcagatgatgtgccatcttccaaagatgtgcaagctgattctgagaggcctcgtagctcttctcgtaatggtagtacctcaaaacggcccgtcgtatcaagcagccgaccaagcacatccggtgaacctaataaaagccattctggtcgactggtctcaagcagtggtcgtctgtctacaactcagaggattctaccaggtttagattccaaaacattcttcactcgtgcttccgggtcaagaggtggtcgcgatgatacacttcggagctttgaactcctgtcaattggcaggaaaaaggaaatgaagacagtacagtgaacagacttattatgccaagggttgcattccattctaagacatttcctttgacatgaccaaacttgtttgattactctgtatgtttctatcctatgtagtatgttgggtccattcaaggcaaaaaggtaattgaaatttcttcatgaagctttgacagactcctcttatacctcctcagatgttcttccatgaatatttgaacatggacccattcatgaagagagactatgttgctttaggaatttgtttatatatgagatggttgcttgtaatgaatatattctctatattgtgctcttgaagaaaaaaggagaagaaactgtaaaaatgcttttcaagttttgcactctttctttgcatatatttggaactgattatttctaatattcgttcaaatgtacaatgaaggaagggactaggtggctactattgtggataagacagaaaatagtttgctgatatttaaatagattgatgaatcaaaatcaa

SEQ ID NO: 8162 - DNA, 2412 bp, Panax ginseng
aaatttctttgaaattcctcatcccttgtcaatttttattacatatatccttcagaatctaattcccaattattatttttggcgtggatttcgttttctttagagtccttatcttgcttcaaatccccaatttgttcttcctttaatccttcatttctcttgctccccttctttatctgctcggtcaatgtatgatatgattagggtttcgaaatctgacttatagttgtggcatgtgggttatgttttcagatgatgtagattctagggtttatattttaatccattggtttattcattttcttttcacattcctttttgtttgaagattgtagtccacgtgcattatccttattcttgtgcagtatatgatttaatgtttatacactgcttttaggtatcagaagtttcggggtcaacatttagtctataaaaatttaggattttgaagatcttttgatgattatgcataatgtgttttactggatctgagcctgtgtaatgatttaagcttttgagacactgaattttgttgatgatatttgatagctacaaaaagtgagaaattggggttctttttgtttgtttgtttgtttgttcgaggtaatttaacttggctttgaaatatggatcatgtcattggtggtaagtttaagcttgggaggaaaattgggagtggatcatttggagagctttatttgggagtaaatgtacaaacaggagaagaagttgcttgtaagctggaatcagctaagactaaacatcctcagctccactatgaatcaaagttatacatgcttcttcagggaggaactggtattccccatctgaagtggtttggagttgaaggagaatacaatgccatggttattgaccttcttggaccaagccttgaggacttgttcaactattgtaatcggaagtttacgttgaaaacagttttaatgttagctgatcagttaatcaatagagttgaatatatgcactcgagaggttttcttcaccgtgatataaagcctgataactttttaatgggtttagggcgcaaagcaaatcaggtgtacatcattgactacggtcttgcaaaaaagtatagggatcttcaaacacacaagcatataccatacagggaaaacaaaaatctcactggaacagctcgttacgcgagtgttaacacccatcttggagttgagcaaagcaggcgagacgatctggaatctcttggttatgtgcttatgtactttttgaggggaagccttccctggcaaggtctgaaagctggcacaaaaaaacaaaagtatgacaaaattagtgaaaagaagatgcttactcccattgaggtgctttgcaaatcttatccatcagaattcatatcatacttccattattgccgttcattgcggtttgatgacaaaccagattattcatacttgaagaggcttttcagggatttatttattagagaaggttatcagtttgactatgtatttgactggactattttgaagtatccacagattggctccagttctagaggacggcaaccagctgggaaattagctttgaatcctggaccatctgcagatagagcagaaaagacgccagtgaaacgagagatgagagatagattctcaggcgcagttgaggcatttgctagaagaaatggttccggtgcaggtttgcatggagatcactcgaggcacagatcttcagaggatgtaccttcatcaaaggatgtgcaagccgacacagaaagaggacgggtttctcgaactagtagtgcttccaaaagggttgtcataccaagcagccgtccaagctcgtctggtgaacccagtgagaacaggtcgaatcgcctgggctcaggcagtggtcgtttatccactacccaaaggatccaacctggtttcgagtccaaatcatctttcacccgcgctgtagcatcagcatcaagaggtggccgtgatgatgctcttcggagctttgagctgctaaccattggcacaaaaaagaggaaataagggtgtcaatttgcttgcttctgggccaattttcaatgcaacttttattaagtttcttgagcaccattgtgttctacacttgtagcagtgtccacgaaacaccatctcttgttgaatatccattcacagctaatctcaaattcatgtttttaccctcaggaaacatctttggagattctactgatgtgattattgctatcaggttgccatgtaaactcgacagaggaagagaaaatctctcttttttaaggaaatataacatatttgcgactagagttgcaacaacttataaataattctgtttgttgtactaataccagcttatagtttctatattcttcttgtgaaaactagacttagtagtacaattttttaattactaataacccgg

SEQ ID NO: 8163 - DNA, 1888 bp, Chenopodium quinoa
gggttcttcaaagtttttaatttgggttagcctagctgtttgagagtgctttaccatggatcatgtaattggtgggaagtttaagctcggccgtaagattggtagtggttcatttggggagctttacttaggtatcaatgtacagactggtgaggaagtcgccgttaagctggaacctgcaaagacaaagcaccctcagctgcattatgagtcaaaattgtacatgcttcttcagggaggcactggtgttccccatctaaaatggtttggagttgaaggtgaatacaatgtcatggttattgatcttcttggcccaagtctagaggacttatttaactattgcaaccgcaagttttccctaaagacagttctaatgcttgctgatcaaatgatcaatagggtggaatatatgcactcaagaggctttcttcatcgtgatattaaacctgacaactttttaatgggtcttggacggaaggcaaatcaggtgtatgtcattgattttggccttgcaaaaaagtatcgtgatcttcaaacacacaaacacataccttacagagaaaacaagaatctcacagggactgctcgatatgctagtgtcaatactcatcttggtgttgaacaaagcagaagagacgatctagagtcccttggctatgtccttatgtattttttgaggggaagccttccatggcagggcttgaaagctggaactaaaaagcagaagtatgacaaaataagtgaaaagaaaatgcttacgcccatagaggttctttgcaaaaattatccctcagagttcacatcatacttccactattgccggtcattacggtttgatgacaagcctgattactcatatctaaaaagactatttcgggatctcttcattcgagaaggttaccaatttgactatgtatttgactggacaatattgaagtatccacaaattggttccagctcccgatcacggccaactgcgaaacctgctttaaatcccggaccttctgctgaaagagcagagaggactccaggacaagaaatccgagatagattttctggtacagttgaggcatttactagaagaaataattcgagctcaggtttgcaaggtgattcacgtcatagatcatcagatgagccatcatcaaaggatgtgcaagcagatcgggaaagaggtcgtatttctaggaatgggagtacttcaaagagagcagttgcatcatcaagtaggccaagctcttctggtgagcccagtgacggtcgctcaagtaggttgatgtcatctggtggtcgtctgtctacaacccaaaggattcaacctggttttgagtcaaagacatctactcttgcccgtgtttctgctgcaaggcctggacgagacgacaccctaaggagcttcgagtttctatctattggtgccgggaggagaaagtaagcactaagtacatgctgagctttgtttttgggtgcatcctgctacaaaatggagatataatcaagatctcaagcctagtttttaaaaggtttttcacctgggttgttctctgcaaaaatgtaaatgatcagttccaaatctgacactcgtaaagcttaacgggatattccatttccttgcaaagattgtgctctcccagatcctttcaccattaaatggctgtaaaaccttcatttctttcctaccatcccaagaagaaaagaaaaggagatcgcactaggaaattgtctatatgttgagacttggacagtgatgtttgcaatgaataattttgttgtactatatgatgaaacaatttggcaaaagaacaagatgatgtttttataacttttttgtgtaatacagatttatgattatcactttatcgagtataggtgtctttgattggatgca

SEQ ID NO: 8164 - DNA, 2421 bp, Trifolium pratense
cgtgcagacctccacaatcattcactttctttctcatccattttcattttgattcctacacatacacaaacaaaatctctacaatttatgagtccagatcatttccttgacctccaagcacagatccaaagcatccatccatatactctcatcactccactctctctccgcgccaatatcgcatatattccttttccgccttcttttcattctataaatataccttctcctcactacaataaactataagggttttcttttctgaacccagattcgtacttcctttgattcaatctttgatgggtctcttctagattcttagttctttatcctattttcatcaaaattggatttttactgcttttgaagggtgttattagtagtaaaattctgaattttggggtctgtgttttattgggtttgttatgatggatcttgttattggtggaaaatttaagcttgggaggaaaattgggagtggatcatttggagagctttatttgggtgttaatgtgcaaactcaagaggaagtggctgttaagctggaacctgtgaagacaaagcatcctcaacttctctatgagtccaaattgtatatgcttcttcaaggaggaaccggcatacctcatataaagtggtctggagtcgagggtgactacaatgttatggctattgaccttcttggaccaagtctcgaagacttgtttaactattgcagtagaaaattctctctgaaaacagtgttgatgcttgcagatcaactattaaacagagtagagtatatgcactctcggggctttctgcatcgtgatataaagcctgacaactttctaatgggtttaggtcgcaaggcaaatcaggtatatattattgactatggccttgcgaaaaagtatcgtgatcttcaaacacacaagcatataccatacagggaaaacaagaatctcactggaaccgctcgatatgcaagtgttaacactcaccttggagttgaacaaagcagaagagatgatctagaatcacttggttatgtactaatgtactttttgagaggaagtcttccatggcaaggcttgaaagctggcactaaaaagcagaaatatgacaagataagtgaaaagaagatgcttactccaatagaggtcttgtgcaagtcacatccaacagaattcacatcatatttccactattgccgatcattgcggtttgaagataaacccgattattcatatcttaagagactcttccgtgacctattcattagagaaggttatcagtttgactatgtatttgattggactatattgaagtatccacaaattggatccagttctagaacacggccaagtgtgaaaccagtattaaacccagcaccatctggagagcgagagcgattagaacggccttcagttggacaagagattcgtgatagattatcaggtgcggtgggggcattttcaagaaggaatggctctgcacatggactgcataaggatcttgccaagcagcacaggtctttagataatatgccatctcccaaagatgtgcaacctgattctgaaagggctcgcagttctactcgtaatggcagtgcttcaaaaaggcctatgatatcaaacagcagaccaagctcttctggggaacctagtgaaagccggtctagtcgattggtctcaagcagtagtcgtctatcgactactcaaagggttcaaccaggttttgaatccaaatcatccttcacccgtgccaccgcagggacacgaggtagtcgcgatgatacactcaggagcttcgagctcctgtcaattggtactggtaaaaagaaatgagccaaaactttccatggttgttttgtcttgtccttttttaagacattcacccttcacacctgttcatttactcagtatatttccatcaaatgttggggtccattcatggccaaaagctaattgaaattaatcaataaagcttttggcagacccctcatatgcttcttcatatgttcttccatgattacctaagcatggttacattcatgaagagtctctatctttaggaatttgtttatacatgagatgtctacttgtaataaatatacacattctatacattttttttctgctggacaaggaaaaaagaaaacctgcaaagtctaatatgctttgcaagtttttgcacccttctgttgcatcatcaggacctttcgaatagtgggcggctcctagtttggattgaagaaaacatgaaagctaatgtgtatcagtgcacaagtggaaactaaaactcttgttcaatttataaattgtttggagcctctaaggtttaaagtttttttgcaggcagctatgaagttgttctcttttaagataatgataattatgtaattgatattaaaagtggttcataacttctgtattaatg

SEQ ID NO: 8165 - DNA, 1559 bp, Euonymus alatus
aggttttccaatagggcttacaacaaaggagttccggttcattccgtgcattggattggattgtgagctaatttaatgaatgagggtatccttgatttttgtagtttgttgagatcatggatcatgttatcggtgacaaatttaagctgggtcgcaagatcggcagcggatcatttggtgaactctatttaggagttaacgtacaaactggggaggaagtggctgtcaagctggaatcagtgaagaccaagcatcctcagcttcattatgagtcgaaattgtacatgtttcttcaaggaggaactggaattccccatctcaaatggtttggtgtagagggcgactacaatgttatggttattgaccttcttggaccaagcctggaggacttatttaattattgcagtcggaagttctcgctgaagacagttttaatgcttgctgatcatttgattagcagagttgagtacatgcactcacgaggttttcttcatcgtgatataaagcctgacaattttttaatgggtttggggcgtaaagcaaaccaggtctacgtaattgattttggtcttgcaaagaagtaccgcgatcttcaaacgcacaggcatataccgtacagggagaacaagaatctcacaggaacagcacgctatgctagtgttaatactcatcttggggttgagcaaagcagacgagatgatctggaatcccttggttatgtgctgatgtattttttgaggggaagccttccctggcagggtttgaaagcaggtactaaaaagcagaagtacgacaagattagtgagaagaagatgcttactccaattgaggttctttgtaaatcatatccttctgagttcatgtcttatttccattattgccgatcactgcggtttgaagacaaaccagattattcatacctgaagagacttttccgggacctgtttattcgagaagggtatcaatttgactatgtatttgattggaccatattgaaatatccacagattgggtctagctctagagcacggccaagtgcaaagccagctatggctcgaggaccatctgtagaaagagttgaaaggccctcagtgggacaagagattcgagatccattctcaggtgcggttgctagaagaaatggctctgggcatggcctgcatggcgatcactctagacacagaccttcagatgatgtgctgccatccaaagacgtgcatcctaattcagagaggcctcgttctttgtcacgcaaccgtagtgcttctaagagagctgttgtatcaggcagtcgcccaagctcctcagttgagcctagtgagaatcggtcaagcaggctgctctcaagcactggacgtctatctacaacccaaagggttcaacctggaattgagtctaaatctttgtcttttacacgtactggtgctgcaagaggtgatcgtgataatactttacggagcttggagctcctgtcaattggtacgggaaagaggaaataaccgacagatttattggattagaaggcaatgaatctttggaaataatcgaaatgctgaaac

SEQ ID NO: 8166 - DNA, 1780 bp, Panax ginseng
gtttgtttgtttgaggtaatttaacttggctttgaaatatggatcatgtcattggtggtaagtttaagcttgggaggaaaattgggagtggatcatttggagagctttatttgggagtaaatgtacaaacaggagaagaagttgcttgtaagctggaatcagctaagactaaacatcctcagctccactatgaatcaaagttatacatgcttcttcagggaggaactggtattccccatctgaagtggtttggagttgaaggagaatacaatgccatggttattgaccttcttggaccaagccttgaggacttgttcaactattgtaatcggaagtttacgttgaaaacagttttaatgttagctgatcagttaatcaatagagttgaatatatgcactcgagaggttttcttcaccgtgatataaagcctgataactttttaatgggtttaggtcgcaaagcaaatcaggtgtacatcattgactacggtcttgcaaaaaagtatagggatcttcaaacgcacaagcatataccatacagggaaaacaaaaatctcactggaacagctcgttacgcgagtgttaacacccatcttggagttgagcaaagcaggcgagacgatctggaatctcttggttatgtgcttatgtactttttgaggggaagccttccctggcagggtctgaaagctggcacaaaaaaacaaaagtatgacaaaattagtgaaaagaagatgcttactcccattgaggtgctttgcaaatcttatccatcagaattcatatcatacttccattattgccgttcattgcgatttgatgacaaaccagattattcatacttgaagaggcttttcagggatttatttattagagaaggttatcagtttgactatgtatttgactggactattttgaagtatccacagattggctccagttctagaggacggcaaccagctgggaaattagctttgaatcctggaccatctgcagatagagcagaaaagacaccagtgaaacgagagatgagagatagattctcaggcgcagttgaggcatttgctagaagaaatggttccggtgcaggtttgcatggagatccctcgaggcacagatcttcagaggatgtaccttcatcaaaggatgtgcaagccgacacagaaagaggacgggtttctcgaactagtagtgcttccaaaagggttgtcataccaagcagccgtccaagctcgtctggtgaacccagtgagaacaggtcgaatcgcctgggctcaggcagtggtcgtttttccactacccaaaggatccaacctggtttcgagtccaaatcatcatctttcacccgcgctgtagcgtcagcatcaagaggtggctgtgatgatgctcttcggagctttgagctgctaaccattggcacaggaaagaggaaataagggtgtcaatttgcttgcttctgagccaattttcaatgcaacttttatcaagtttcttgagcaccattgtgttctacacttgtaacagtgtccacgaagcaacatctcttgttgaatatccattcacagctaatctcaaattcatgtttggagattctactgatgtgattattgctatcaggttgccatgtaaaggaagagaaaatctctcttttttaaggaaatataacatatttgcgactagctagagttgcaacaacttataaataattctgtttgttgtactaatagcagtatcttaaaccagcttatagtttctatattcttaaaacgagaaaaagaat

SEQ ID NO: 8167 - DNA, 2320 bp, Medicago truncatula
ttcacacttccattctcatccattttccttctttcctacaaaatctctacaatttcggaactcagatcatttccttcatctccacgcacagatccaaatccccactcttctctctgcgtcaatatcgcttttcacccattagattttttttttttttttttttgtataaattcattttctggagtagaacaaagtaaaagggttttcttttcacaacccagattcgttcttacttcgattcaactagtgatgggtcgcttttagttttttcgttttccatcctatttttataaaaattggatttttactttttacagttgtaaaattctgaattttggggtgtgtttttattgggtttgttatgatggatcttgttattggtggaaaattcaaacttgggaggaaaattggaagtgggtcatttggagaaatttatttgggtgttaatgtgcaaactcaagaggaagtggctgttaagctggaacctgtgaagacaaagcatcctcaacttctgtacgagtccaaattgtatatgcttcttcaaggaggaactggaataccgcatataaagtggtctggagttgagggtgagtacaatgtcatggccattgaccttcttggacccagtctcgaagacttatttaactactgtagtagaaaattctctcttaagacagtgttgatgcttgctgatcaactaataaacagagtagagtatatgcactctcggggttttctgcatcgtgatataaagcccgacaattttctgatgggtttaggccgcaaggcaaatcaggtatacattattgactacggccttgcaaaaaagtatcgtgatcttcagacacataagcatataccatacagggaaaacaagaatctcactggaactgctcgatatgcaagtgttaacactcaccttggagttgaacaaagcagaagagatgatctagaatcacttggttatgtactaatgtactttttgagaggaagtcttccatggcaaggaatgaaagctggcactaaaaagcagaaatatgacaagataagtgaaaagaaaatgcttactccaatagaggtattgtgcaagtcacatccaacagaattcacatcatatttccactattgccgatcattgcggtttgaagataaacccgattattcatatcttaagagactcttccgggacctattcattcgagaaggttatcagtttgactatgtatttgattggactatattgaagtatccacaaattggatccagttctagaacacggccaagtgtgaaaccagtcttaaacccaggaccatctggagagcgattagaacggccttcagtcggacaagaaattcgagatagattatcaggtgcagtgggggcattttcaagaaggaatggctctgcgcaaggactgcagcataggtctctagataatatgccgtcttccaaagacgtgcaacctgattctgatagggctcgaagttctactcgtaatggcagtgcttcaaaaaggcctatgatatcaagcagcagaccaagctcttctggggaacctagtgaaagccggtctagtcgattgatctcaagcagtagtcgtctatcgactactcagagggttcaaccaggtcttgaatcaaaatcatccttcacccgtaccgcagggacacgaggtggtcgcgatgatacactcaagagttttgagctcctgtcaattggtacagggaaaaggaaatgagcgaaaactgtcgatggctgcattgtcttatccttttttttttgagacatccacccttcacacctgttcattttactcaatatatttctatcctgtgttggggtccattcatggccaaaagctaattgatattcctcaatgaagcgttggcagatccctcaaatacttcttcagatgctcttccatgattatctaagcttggttccattcatgaagagtctttatctttaggaatttgtttatacaagagagatgttaatttgtaataaatacacattctctacaatttttctgttggacaaaagggtaaaaactgcaaagtctaatatgctttgcaagttttataacccttccattgcatctgggacccctctaatagtgggtggctccgaatttagattgaagaaaaacatgagactgatgtgtatcagtgaacaagaatgtttggagcctccttaggttttgaagtttttgcaggcatctatgaagttgttgtactcttttaagataatgctgattatgtaattgatattaaatgtgattcataacttctgtattaatgtttaactaggcttgtttcgc

SEQ ID NO: 8168 - DNA, 2421 bp, Trifolium pratense
cgtgcagacctccacaatcattcactttctttctcatccattttcattttgattcctacacatacacaaacaaaatctctacaatttatgagtccagatcatttccttgacctccaagcacagatccaaagcatccatccatatactctcatcactccactctctctccgcgccaatatcgcatatattccttttccgccttcttttcattctataaatataccttctcctcactacaataaactataagggttttcttttctgaacccagattcgtactccctttgattcaatctttgatgggtctcttctagattcttagttctttatcctattttcatcaaaattggatttttactgcttttgaagggtgttattagtagtaaaattctgaattttggggtctgtgttttattgggtttgttatgatggatcttgttattggtggaaaatttaagcttgggaggaaaattgggagtggatcatttggagagctttatttgggtgttaatgtgcaaactcaagaggaagtggctgttaagctggaacctgtgaagacaaagcatcctcaacttctctatgagtccaaattgtatatgcttcttcaaggaggaaccggcatacctcatataaagtggtctggagttgagggtgactacaatgttatggctattgaccttcttggaccgagtctcgaagacttgtttaactattgcagtagaaaattctctctgaaaacagtgttgatgcttgcagatcaactattaaacagagtagagtatatgcactctcggggctttctgcatcgtgatataaagcctgacaactttctaatgggtttaggtcgcaaggcaaatcaggtatatattattgactatggccttgcgaaaaagtatcgtgatcttcaaacacacaagcatataccatacagggaaaacaagaatctcactggaaccgctcgatatgcaagtgttaacactcaccttggagttgaacaaagcagaagagatgatctagaatcacttggttatgtactaatgtactttttgagaggaagtcttccatggcaaggcttgaaagctggcactaaaaagcagaaatatgacaagataagtgaaaagaagatgcttactccaatagaggtcttgtgcaagtcacatccaacagaattcacatcatatttccactattgccgatcattgcggtttgaagataaacccgattattcatatcttaagagactcttccgtgacctattcattagagaaggttatcagtttgactatgtatttgattggactatattgaagtatccacaaattggatccagttctagaacacggccaagtgtgaaaccagtcttaaacccaggaccatctggagagcgattagaacggccttcagtcggacaagagattcgtgatagattatcaggtgcagtgggggcattttcaagaaggaatggctctgcacatggactgcataaggatcttgccaagcagcacaggtctttagataatatgccatctcccaaagatgtgcaacctgattctgaaagggctcgcagttctactcgtaatggcagtgcttcaaaaaggcctatgatatcaaacagcagaccaagctcttctggggaacctaatgaaagccggtctagtcgattggtttcgagcagtagtcgtctatcgactactcagagggttcaaccaggttttgactccaaatcatccttcacccgtgccaccgcagggacacgaggtagtcgcgatgatgcactcaggagctttgagctcctgacaattggtactggaaaaaagaaatgatcgaaaactttccatggttgttttgtcttgtccttttattgagacattcatccttcacacctgttcatttactcagtatatttccatcctgtgttggggtccattcatggccaaaagctaattgaaatttatcaataaagctttttgcagacccctcatatgcttcttcatatgttcttccatgattacctaagcatggtaccattcatgaagagtctctatctttaggaatttgtttatacatgagatgtctacttgtaataaatattcacattctctacattttttctgttggacaaggaaaaagaaaactgcaaagtctaatatactttgcaagtttttgcacccttccattgcatcattgggatctttctaatagtgggcggctcgcaatttggatcgaagaaaacatgaaagctgatgtgtatcagtgcacaagtggaaactaatactcttgttcaatttataaatttgtttggagcctctaaggtttaaagttctttttgcaggcggctatgaagttgttctacatttttaagataatgaatgataattatgtaattgatattaaaagtggttcataacttatgtattaatg

SEQ ID NO: 8169 - DNA, 1708 bp, Lippia dulcis
cgaagattactcttttgggaagtttcagttaatctttaggaagccaccaagtatggatcatgtcattggaggcaagttcaagctggggagaaagattggtagcggatcttttggagaactttacttgggagtaaatatccaaactggagaggaagttgctgtgaagctggaatctgtaaagactaagcacccccagcttcattatgaatcaaagttgtacatgcttcttcagggaggaactggaattccacaccttaaatggtatggagttgaaggggagtataattgcatggctattgatcttcttgggccaagcttggaagatttgtttaactattgtaataggaagttcacattgaaaactgttctgatgctagcggatcaattaataaatagagttgaatacatgcactctagaggctttcttcaccgtgatattaagcctgataacttcttaatgggcttaggacgtaaagcaaatcaggtgtacattattgactatggacttgccaaaaaatatagggacctacagacccacaagcatataccttacagggaaaataaaaatctcactggcacagctcgttatgctagcgtaaacacccatcttggagttgaacaaagcagaagggatgatttagaatctcttggctatgtccttatgtacttcctcagaggaagcctcccctggcagggactgagagctggcacaaagaagcagaagtatgataaaatcagtgagaaaaagatgcttacacctgtagaagtgctttgtaaatcttatccatcagagttcatatcatacttccattactgtcgatcattgcgattcgaagacaagcctgattattcatacttgaagagacttttcagagacttgttcattcgggaaggttatcagtttgattatgtgttcgactggaccatattgaagtatccccagattggttccagttctagatcggcacgaccaacaggaaaagtacctctgaacttggggacatctgcagaaagagttgaaaagacaccagtgaaacaagagcttcgggacagattctctggtgcagttggggcatttgcccgaaggaatggttcaagttcaggcttgcatgcagcagaccactctagacaacacagatcttcagatgatgtaccatcctctaaagatgtgcaagctgattccgaaagaggccagctttcccggcccggtagtgcttcaaagagggcagttatatcaagcagcaggcccagttcatctggggaaccaggtgaaaaccgccacagccgtttgggctcaagcagcggtaggatttcaacttctcatagactacagcccggttatgagtccaaatcttcttcttttgctcgtgctgctgctgctacaaggggcgttagagatgaagctcttcgaagctttgagctattgtcgattggcaccgggaaaagaaaataacacaaaaagaaggaaactcaggttccgttaatcgaaggggtatacatattacgatatatcctggtctgttctttttcgttctttacgagcagaagtttgaaattcaactgtatttttaagaaattgttctgtccgaaatgaatattaaatggtgtttgttcttgcttcaatatgttgcatgtgttgtaaacctgtgagaacatgtatgtggtgctgctgctgttcaatgaatactgtgatttctgcaaaaaaaag

SEQ ID NO: 8170 - DNA, 2006 bp, Trifolium pratense
tttttgcaattgagtgattttgcaatttagcaaggattaggaatttgggtttgtgatgatggatcatgttattggtggaaaattcaagcttgggaggaaaattgggggtggttcatttggagaactttacttggctgttaatgtacaaactggagaggaagttgctatcaagctagagcctgtgaagaccaaacatcctcaacttcactacgagtcaaaattgtacctgcttcttcaagggggaacgggtattccccatttaaaatggtttggagttgagggtgactataattgcatggcaattgacctccttggaccaagtcttgaagacctgtttaactattgcaataggaaattctctctgaaaacagttctgatgcttgccgatcagctagtaagtatggccttaattttaatatcactatacttttaatagaaagctattgtatttttactaataatcaaatctgtacacttagctaaacagagttgagtacatgcactcccggggtttcctgcaccgtgatataaagcctgacaactttttaatgggattaggtcgcaaagcaaatcaggtatacataattgattacggccttgcaaaaaagtatcgagatcttcacacacacaagcatataccatatagggaaaacaagaacctcactggaactgcccggtatgcaagtgttaatacccatctgggagttgaacaaagcagaagagatgacctggaatcacttggttatgtgctcatgtactttttgagaggaagcctcccttggcaaggcttgaaagctggcaataaaaaacaaaaatacgacaagataagtgaaaagaagatgcttactcctatagaggttttgtgcaagtcacatccattggaatttacatcattcttccactattgccgatctttgcggtttgaggataagcctgattattcgtatcttaaaagactctttcgtgacctattcatccgagaaggctatcagtttgactatgtgtttgattggactatattgaaatatccacaaattggatccagctccagatcccggccaagtggaaaaccagtcataaatccaggacaatcaggagagagaataatagaacggccttcaggtggaccagagatccgggatagattttcaggcgcagtcgaggcatttgcaagaaggaatggatctgggactggtcttcacagtgataattccaggcataggtcttcggacgataggccatcttctaaagacgtgcaagctgattctgagaggccccgtagctcttcgcgtcatggcagttcttcaaaaagacctgtcttatcaagcagccgtcctaactcttccggtgaaccgagtgaaagccggtctagccgattgctcttgagcagtagccggctatctactactcagaggactcagccaggtctcgagtccaaaacatcatcatttaatcgtgtttctgggacaagaggtggtcgtgatgatacactccggagttttgaactcctgtcacttggcacaggaaaaaggaaatgaagaactaactctgatcaagcagatttcttgagtcaatggtcgtggttctgttctgatgctttttcttctaccctcgttgattgctgtatattttccatccaatgttagctccatccaaggctaaaaagctcattggaaatttttcatgaagctttggcagactcctcttatagctcttctgatgttcttccatgaatatttcagcatggacccatcaacgaagagacacctgcgttactttaggatttgttaatatatggctacttgtaataataaatacattctctaatttttcttctgaagaaaaagaaacgaaactgcaatttgcaaaaatgatccgtaagttttggcacctttgtgatgcatatttcgtatctgtgtactatgtctagtgtacattgatggaatggaactgttgactccaattatggacaacagaaagaaaagagattgatgtgcattttagcc

SEQ ID NO: 8171 - DNA, 2539 bp, Panax ginseng
aagcagtggtatcaacgcagagtacatgggggtcgatacacatacagcacgcccaataaggcaataatattacaccatctctctctgtttctctgtatttctctccgtctatctcatatcccaatttcaagattcttgaatcaaaatttctttgaaattcctcatcccctttgtcaatttttattacacagatccctcagaatctaattcccaattattagttttggcgtggatttcgttttctttagagtccttatcttgcttcaaatccccaatttgttcttcctctaatccttcatttcccttgcttcccttctttatctgctcggtcaatgtatgatatggttagggtttcgaaatctgacatatagttgtggcatatgggttatgttttcagatgatgtagattctagggtttatattttaatctattggtttattcattttcttttcacattcctttttgtttgaagattgtagtccacgtgcattatccttattcttatgcagtatatgatattatgtttatacactgcttttaggtatcagaagtttcggggtcaacatttagtctataaaaatttaggattttgaagatcttttgatgattatgcataatgtgttttactggatctgagcccgtgtaatgatttaagcttttgagacactgaatttggttgatgatatttgatagctacaaaaagtgagaaattggggttctttttgtttgtttgtttgaggtaatttaacttggctttgaaatatggatcatgtcattggtggtaagtttaagcttgggaggaaaattgggagtggatcatttggggagctttatttgggagtaaatgtacaaacaggagaagaagttgcttgtaagctggaatcagctaagactaaacatcctcagctccactatgaatcaaagttatacatgcttcttcagggaggaactggtattccccatctcaagtggtttggagttgaaggagaatacaatgccatggttatcgaccttcttggaccaagccttgaggacttgttcaactattgtaatcggaagtttacgttgaaaacagttttaatgttagctgatcagttaatcaatagagttgaatatatgcactcgagaggttttcttcaccgtgatataaagcctgataactttttaatgggtttagggcgcaaagcaaatcaggtgtacatcattgactacggtcttgcaaaaaagtatagggatcttcaaacacacaagcatataccatacagggaaaacaaaaatctcactggaacagctcgttacgcgagtgttaacacccatcttggagttgagcaaagcaggcgagacgatctggaatctcttggttatgtgcttatgtactttttgaggggaagccttccctggcagggtctgaaagctggcacaaaaaacaaaagtatgacaaaattagtgaaaagaagatgcttactcccattgaggttctttgcaaatcttatccatcagaattcatatcatacttccattattgccgttcattgcggtttgatgacaaaccagattattcatacttgaagaggcttttcagggatttatttattagagaaggttatcagtttgactatgtatttgactggactattttgaagtatccacagattggctccagttctagaggacggcaaccagctgggaaattagctttgaatcctggaccatctgcagatagagcagaaaagacgccagtgaaacgagagatgagagatagattctcaggcgcagttgaggcatttgctagaagaaatggttccggtgcaggtttgcatggagatcactcgaggcacagatcttcagaggatgtaccttcatcaaaggatgtgcaagccgacacagaaagaggacgggtttctcgaactagtagtgcttccaaaagggttgtcataccaagcagccgtccaagctcgtctggtgaacccagtgagaacaggtcgaatcgcctgggctcaggcagtggtcgtttatccactacccaaaggatccaacctggtttcgagtccaaatcatcatctttcacccgcgctgtagcatcagcatcaagaggtggccgtgatgatgctcttcggagctttgagctgctaaccattggcacaaaaaagaggaaataagggtgtcaatttgcttgcttctgggccaattttcaatgcaacttttattaagtttcttgagcaccattgtgttctacacttgtagcagtgtccacgaaacaccatctcttgttgaatatccattcacagctaatctcaaattcatgtttttaccctcaggaaacatctttggagattctactgatgtgattattgctatcaggttgccatgtaaactcgacagaggaagagaaaatctctctttttttaaggaaatataacatatttgcgactagagttgcaacaacttataaataattctgtttgttgtactaataccagcttatagtttctatattcttcttgtgaaactgcttgtgtcatttttattctataccgg

SEQ ID NO: 8172 - DNA, 1806 bp, Gossypium hirsutum
aataaaccagtaagaataaatcatggaacatgttattggtggaaaattcaagcttggtcgaaagattgggagtggatcctttggtgaactttatttaggtgttaatgtccaaagtggagaggaagtggctgttaagttggaatctatcaagaccaagcatccccaacttctgtatgagtcaaagctgtacatgcttcttcaaggagggaccggaattcctcatttaaaatggtttggagttgagggtgaatacaatgttatggttatcgatcttcttggaccaagcctagaagatttgttcaactattgcaatcggaagttttctttaaaaacagttttgatgcttgcagatcagttattaatcagagttgagtacatgcattctcgcggttttcttcatcgtgacataaagcccgataactttttgatgggtctagggcgcaaagcaaatcaggtatacataattgattatggtcttgcaaaaaagtatagggatcttcaaacacacaagcacataccatacagggaaaataagaatcttacaggaacagctcgatatgcaagtgttaacactcaccttggagttgagcaaagcaggagggatgatcttgaatctcttggttatgtgcttatgtacttcctcagggggagccttccatggcagggattgaaagctggcaccaaaaagcagaagtatgacaaaattagtgaaaagaagatgcttactcccatagaggtcctttgcaaatcatatccttctgagttcacatcatacttccattattgtcgatcactacgatttgaagacaaaccggattattcatacctgaagaggctgttccgagaccttttcattcgagaaggttatcagtttgactatgtatttgattggactatacggagatacccacaggttggctctagctcaagagctcggcctagcccgaagccaggtttaaatcccccgggagtctctgccgaaagaacagaaaggccttcagttggccaagagattggagaaagggtgtctggcactattgagccgcttacaagacgcattggttccgggcagggtttgcatggtgatcaatctagatacagatctgatgacgtgccgtcatccaaggatgtgcaacctgattctgaaaaggttcgctcctcctcaagaaacgatagttcttcaaagaggcctgtcgcaacaggaagccgactggactcctctggtgagcctaacgaaaaccggtctagcagattagtctcaagcagtagtcgcctgtcaacaactcagagaatcctccctgggtttcaatccagatcagcatcttatactcgaacctcggccacaagaggtggtcaagatgatacccttcggagctttgagttcttgacaattgggagtgggaaaaggaaataaattgaacatgcatcttgtaggaaggatttgcttgtgtcggaggcacacttattatctgatggagatctcggcactataacggtatttatgaacagttactagtatgtgtatcggtggtcatgatttggttccaaccatgacagtctccctggaaagctttttcaatccttccccatgtaccccgtcagtatacttgtcattatgatgcctccagtcagtaaagtaatagaaatgagcgtcgtcctaagtaattgtccatatattttcaacattctatctgtaataaacacttgatgtttctttctttaattagaagattaaaagaaatatatattatagcaaagacgttctgccttcaaaaaagaaataaagtttttgctcggaatatgaat

SEQ ID NO: 8173 - DNA, 2293 bp, Lupinus angustifolius
agaagggttgaaatccacacacacccatctttatactactatgcgcgaatattggaggaaccattagattcccttccattttcatcgttttccttattcacccttttacaaaacaataataataattagttaatgacccagatttgcttttacttgaattcaatgctctcgatcatatttcgattaaaaaaaccaatttttgaggtgttgggagtaaaaagcctcgatttttatgagtgatttgagctaacatattcagaatagtatatttgttgtgaagaggtagagtttgggagtgagtgtttattggattagttttgtgataatggatcatgtaattaatggaaagttcaagcttgggaggaagattgggagtggatcttttggggaactttatttgggtgttaatgttcaaagtggagaggaagtggctgttaagttggaacctgtgaaaacaaagcatcctcaacttcactatgagtcaaaattgtatatgcttcttcaaggaggaactggcatacctcatttgaaatggtttggagttgagggtgactacaatgtcatggtcattgaccttcttggtccaagtctcgaagacttgttcaactattgcagtcggaagttctctctgaaaacagttctgatgcttgcggaccaaatgataaacagagttgagtacatgcactcacggggacttctgcatcgtgatataaagcctgataactttttaatgggtttaggccgcaaggcaaatcaggtatacataattgattatggccttgcaaaaaagtatcgcgaccttcaaacacataaacatataccatacagggaaaacaagaatctcactggaactgctcggtatgctagtgttaacactcaccttggaattgaacaaagcagaagagatgatcttgaatcgcttggttatgtgttcatgtactttttgagaggaagtctcccttggcaaggcttgaaagctggcactaaaaagcaaaagtatgacaagataagtgaaaagaagatgcttactccaatagaggtcttatgcaagtcacatccatcagagttcacatcatacttccactattgtcgttcattgcggtttgaagataaacctgattattcatatcttaagagactctttcgggatctattcattagagaaggttatcagtttgactatgtatttgattggactatattgaagtatccacaaattggatcaagttctatagttcaaccaagtgggaaacctgtcttaaatccaggaccatctggggagagatcagaacggatttcagttggaaaagagattcgggatagattatcaggtgcagtcaaggtattttcaagaaggaatagctctgggcgtggtccaagtactgatcgttctaggcatagggcttcagatgatgtgccatcttccaaagatgtgcaacctgatattgagagagctcgtagttcttctcggaatggcagtgcattaaaaaggcctgtcatttcaagcagccgactaagctcctctggtgagcctagtgaaaatcattcgagccgattggtctcaaacagtggtcgcatatctactactactcggaggattcaaccaagtttcgagtccaaatcatctttcacccgcactgcagggacacaaggtggccgtcatgatgcactccggagttttgagctcttatcaattgcttcagggaaaaagaaatgaagaactttatggtcagaaagcttgattttgggctcctttcccttacattttcttcagacatccactctctccaattactgtgtatatttcattcttatgttggatccatccattaaaggctaaaagctaatggaaaatccttcatgaggctttttcagacccctcttataacccttttcagatgttcttccattagtatttctacatggatccattcttgaagagattctatcctttggaatttgtttatatgagagatggtggctacttgtaatgaataaatttggtatctttatgttgcagtaaaggaaaaagaaattgcaaagatttaatatgctttgcaacttttgtaccctttatgcttcctttggttgagagaacaaactaagaagaaagaaatatgtgagagagaatgagaagagaagtagagtgaattttaatattgtttggttgtatagaaaaagaagagaaataagtgatagtttatcttcattcttttccgcacaagaatctgaactatatcctatatcggttaaaatttgttatgtcaattaaaaaaattaaatattcattatt

SEQ ID NO: 8174 - DNA, 2385 bp, Gossypium raimondii
gtcttcttcactcatccatttttctctctcatccaaacaacgaaaaaaggcttattttttttgagaattttcccgagaaaattaaatccttgtccttaacccagatccgtagatcatcacctccaaattcttgccgataaattagttccttttagattctttttttttttttatattccctttattaggcaatcaaaatatattctttttttttttcattaatactgctaagtttttatctctcataacaacctaactttttctcttttctctcccacctagtaaatgcagcctgatgatcccaaaaacgcttgttttggttcactgattaatgggtatttagtagatgttcaatagactttatccctttgcttctccttgtagtcactagaagtaacggttttttttttttttgaattttggagggttttgaaagtattttagaatctggattttgagttttggagttgataccaatttggatggatctgagagttagttcaaagagaagggtttcgagtcaatttctctgttaaaacttaaaagtaaaaatttcaatatttataaagtagaataagagtttttccttttcttttttccttttaaataaacccagtaagaataaatcatggaacatgttattggtggaaaattcaagcttggtcgaaagattgggagtggatcctttggtgaactttatttaggtgttaatgtccaaagtggagaggaagtggctgttaagttggaatctatcaagaccaagcatccccaacttctgtatgagtcaaagctgtacatgcttcttcaaggagggaccggaattcctcatttaaaatggtttggagttgagggtgaatacaatgttatggttatcgatcttcttggaccaagcctagaagatttgttcaactattgcaatcggaagttttctttaaaaacagttttgatgcttgcagatcagttattaatcagagttgagtacatgcattctcgcggttttcttcatcgtgacataaagcccgataactttttgatgggtctagggcgcaaagcaaatcaggtatacataattgattatggtcttgcaaaaaagtatagggatcttcaaacacacaagcacataccatacagggaaaataagaatcttacaggaacagctcgatatgcaagtgttaacactcaccttggagttgagcaaagcaggagggatgatcttgaatctcttggttatgtgcttatgtacttcctcagggggagccttccatggcagggattgaaagctggcaccaaaaagcagaagtatgacaaaattagtgaaaagaagatgcttactcccatagaggtcctttgcaaatcatatccttctgagttcacatcatacttccattattgtcgatcactacgatttgaagataaaccggattattcatacctgaagaggctgttccgagaccttttcattcgagaaggttatcagtttgactatgtatttgattggactatacggagatacccacaggttggctctagctcaagagctcggcctagcccgaagccaggtttaaatcccccgggagtctctgccgaaagaacagaaaggccttcagttggccaagagattggagaaagggtgtctggcactattgagccgcttacaagacgcattggttccgggcagggtttgcatggtgatcaatctagatacagatctgatgacgtgccgtcatccaaggatgtgcaacctgattctgaaaaggttcgctcctcctcaagaaatgatagttcttcaaagaggcctgtcgcaacaggaagccgactggactcctctggtgagcctaacgaaaatcggtctggcagattagtctcaagcagtagtcgcctgtcaacaactcagagaatcctccctgggtttcaatccaaatcagcatcttatactcgaacctcagccacaagaggtggtcaagatgattcccttcggagcttcgagttcttgacaattgggagtgggaaaaggaaataaattgaacatgcatcttgtaggaaggatttgcttgtttcggaggcacacttattatctgatggaaatctcggcactataacggtatttacgagcagttactagtatgtatatcggtggtcatgatttggttccaaccatgacagtctccctggaaaactttttcagtccttccccatgtaccccgtcagtatacttgtcattatgatgcctctagtcagtaaagtaatagaaatgagcttcatcctaagtaattgtccatatattttcaacattctatctgtaataaacacttgatgtttctttctttaattagaagcattaaaagaaatatatatattatagcaaagacgttctgccttcaggta

SEQ ID NO: 8175 - DNA, 2582 bp, Gossypium raimondii
ccaatcatccaaaacatttttatttctctttctttctcaaaaaaaaaaaaaagtatttcctttttcttcgtccaaaagaaatttcccgagaaaattaaatccttgtcttataacccagatccaatagatcatcgcccccaaattctttgcccataaattcgttccttttggattctttttcccatattcccctttaccggggcaatcaaaatatagccttttttcccccttctatactactgaacttttatctccttaaaaatttctcttttctttttcccaccttgaaaatgcagcttgatggtcccaaaacgtttgccttggttcactgattaatgggtattccgtagtttctcagtcaagtttgcttcttttgtttattatccttttagtcactaaagaggttaacgcctttttgttcttttaagggagcttttataaggattttagaaactgggttttgatctctggagttgatagttaataattttgatcgatctgagaactagtttaaagagaaggatagtgagtcaatttgtcaatattagtttagtgaaataagaggcaagggtgtttttctttccctttactgtgatatatagttgagtgtgcaaagtttattaagattagatcatggaacacattattggtggaaaattcaagcttggtcgaaagatcgggaatggatcatttggtgaactttatttaggcgttaatgttcaaagtggagaggaagtggctgttaagctggaacctgtcaagaccaaacatcctcaacttcactatgagtcaaagctgtacatgcttcttcaaggagggactggtattcctcatttaaaatggtttggagttgagggtgaatacagtattatggtcattgatcttcttggaccaagccttgaagatttgttcaactattgcaaccggaagttttctttaaaaacggttttgatgctggcagatcagttaataaatagagttgagtatatgcactctcgtggttttcttcaccgtgacataaagcctgataactttttgatgggtttagggcgcaaagcaaatcaggtatatgtaattgattatggccttgcaaaaaagtatagggatcttcaaacgcacaagcacataccatacagggaaaacaagaatcttacaggaacagctcgatatgcaagtgttaacactcaccttggagtcgagcaaagcaggagggatgatctcgaatctcttggttatgtgcttatgtacttccttaggggaagccttccatggcagggtttgaaagctggtaataaaaagcagaagtacgacaaaattagtgaaaagaagatgcttacccccatagaggtcctttgcaaatcatatccttctgagttcacatcgtacttccattattgccgatcactacggtttgaagacaaaccagattattcatacctgaagaggctattccgggaccttttcattcgagaaggttatcagtttgactatgtatttgattggaccatgctgagatatccacaggctgcctctagctcaagagtacggccaagcccaaagccgggtttaaatccccaaggagtatctgctgaaagaaccggaaggccttcagttggtcaagagattcgagaaaggttctctggtgctgttgaggcatttgcaagacggaatggatcagggcatggtgatcagtctagacacagatctcccgacaatgtgctatcatccaaagacatgcaacctggttctgatagggctcactcttcctcgagaaatggtagtacttcaaagaggcctgttgtatcaggcagccgacctaactcctctggtgagcctagtgacaaccggtctagcagattggtctcaagcagtggtcgcctgtcaacaactcagagagttcaacctgggtttgaatccaaatcatcaacttttactcgtactacagccacgagaagtagccgcaaccatgcccttaggagctttgagttcttgacaatcgggagcgggaaaaggaaataaacagcactacacatctagtaaggatttgcttgtcttgaaggagatctccgcactatttcggtatctacaaacagtttactctcgtgtatcagtgcccacaatttggttccatcaagaaccgcaacaatctccttgtgcaccctttcaggtattctcactagtatcatgcccctctagattgtcattgaagaaaaaagagaggaatgatatcatgctcaccttagggaaaattgttcatatattttccaagtttcaacttttattctagctgtaataaaacacttgatgtttcttttatttcattagaagcaaacaagaagaaatgcctgaaaagtatattatagcaaagacactatggcttttatgtgtcatctacattggaagtattgttctcttcgagtccttcgaggctttggttcgaaccaaggatcatttttcgcaacataagtattaagtactggctgagctaagtttgtaatttactgttaagaaaaatggatgttgctatgattaaaaatttaacatgggctatgttgttaatcattgttctctcttttttcctt

SEQ ID NO: 8176 - DNA, 1398 bp, Chenopodium quinoa
ttgggttagcctaagctgtttgagagtgctttaccatggatcatgtaattggtgggaagtttaagctcggccgtaagattggtagtggttcatttggggagctttacttaggtatcaatgtacagactggtgaggaagtcgccgttaagctggaacctgctaagacaaagcatcctcagctgcattatgagtcaaaattgtacatgcttcttcagggaggcactggtgttccccatctaaaatggtttggagttgaaggtgaatacaatgtcatggttattgatcttcttggcccaagtctagaggacttatttaactattgcaaccgcaagttttctctaaagacagttctaatgcttgctgatcaaatgatcaatagggtggaatatatgcactcaagaggctttcttcatcgtgatattaaacctgacaactttttaatgggtcttggacggaaggcaaatcaggtgtatgtcattgattttggccttgcaaaaaagtatcgtgatcttcaaacacacaaacacataccttacagagaaaacaagaatctcactgggactgctcgatatgctagtgtcaatactcatcttggtgttgaacaaagcagaagagacgatctagagtcccttggttatgtccttatgtattttttgaggggaagccttccatggcagggcttgaaagctggaactaaaaagcagaagtatgacaaaataagtgaaaagaaaatgcttacgcccatagaggttctttgcaaaaattatccctcggagttcacatcatacttccactattgccgatcattacggtttgatgacaagcctgattactcatatcttaaaagactatttcgggatcttttcattcgagaaggttaccaatttgactatgtatttgactggacaatattgaagtatccacaaattggttccagctcccgttcacggccaactgcgaaacctgctttaaatcccggaccttctgctgaaagagcagagaggacgccaggacaagaactccgagatagattttctggtacagttgaggcatttactagaagaaataattctagctcaggtttgcaaggtgattcacgtcatagatcatcagatgagccatcatcaaaggatgtgcaagcagatcgggaaagaggtcgtatttctaggaatgggagtacttcaaagagagcagttgcatcatcaagtaggccaagctcttctggtgagcccagtgatggtcgctcaagcaggttgatgtcatccggtggtcgtctgtctacaacccataggattcaacctggttttgagtcgaagacatctactcttgctcgtgtttctgctgcaaggcctggacgagatgacaccctaaggagcttcgagtttctatctattggtg

SEQ ID NO: 8177 - DNA, 2333 bp, Panax ginseng
atttctctccgtctatctcatatcccaatttaattcttgaaccaaaatttctttgaaattcctcatcccttgtcaatttttattccatagatccttcagaatctaattcccaattattatttttgtcgtggatttcgttttctttagagtccttatcttgcttcaaatccccaatttgttcttcctttaatccttcatttctcttgctccccttctttatctgctcggtcaatgtatgatatgattagggtttcgaaatctgacttatagttgtggcatgtgggttatgttttcagatgatgtagattctagggtttatattttaatccattggtttattcattttcttttcacattcctttttgtttgaagattgtagtccacgtgcattatccttattcttgtgcagtatatgatttaatgtttatacactgcttttaggtatcagaagtttcggggtcaacatttagtctataaaaatttaggattttgaagatcttttgatgattatgcataatgtgttttactggatctgagcctgtgtaatgatttaagcttttgagacactgtattttgttgatgatatttgatagctacaaaaagtgagaaattggggttctttttgtttgtttgtttgtttgttcgaggtaatttaacttggctttgaaatatggatcatgtcattggtggtaagtttaagcttgggaggaaaattgggagtggatcatttggagagctttatttgggagtaaatgtacaaacaggagaagaagttgcttgtaagctggaatcagctaagactaaacatcctcagctccactatgaatcaaagttatacatgcttcttcagggaggaactggtattccccatctgaagtggtttggagttgaaggagaatacaatgccatggttattgaccttcttggaccaagccttgaggacttgttcaactattgtaatcggaagtttacgttgaaaacagttttaatgttagctgatcagttaatcaatagagttgaatatatgcactcgagaggttttctcaccgtgatataaagcctgataactttttaatgggattagggcgcaaagcaaatcaggtgtacatcattgactacggtcttgcaaaaaagtatagggatcttcaaacgcacaagcatataccatacagggaaaacaaaaatctcactggaacagctcgttacgcgagtgttaacacccatcttggagttgagcaaagcaggcgagacgatctggaatctcttggttatgtgcttatgtactttttgaggggaagccttccctggcagggactgaaagctggcacaaaaaaacaaagtatgacaaaattagtgaaaagaagatgcttactcccattgaggtgctttgcaaatcttatccatcagaattcatatcatacttccattattgccgttcattgcgatttgatgacaaaccagattattcatacttgaagaggcttttcagggatttatttattagagaaggttatcagtttgactatgtatttgactggacattttgaagtatccacagattggctccagttctagaggacggcaaccagctgggaaattagctttgaatcctggaccatctgcagatagagcagaaaagacaccagtgaaacgagagatgagagatagattctcaggcgcagttgaggcatttgctagaagaaatggttctggtgcaggtttgcatggagatccctcgaggcacagatcttcagaggatgtaccttcatcaaaggatgtgcaagccgacacagaaagaggacgggtttctcgaactagtagtgcttccaaaagggttgtcataccaagcagccgtccaagctcgtctggtgaacccagtgagaacaggtcgaatcgcctgggctcaggcagtggtcgtttttccactacccaaaggatccaacctggtttcgagtccaaatcatcatctttcacccgcgctgtagcgtcagcatcaagaggtggctgtgatgatgctcttcggagctttgagctgctaaccattggcacaggaaagaggaaataagggtgtcaatttgcttacttctgagccaattttcaatgcaacttttatcaagtttcttgagcaccattgtgttctacacttgtaacagtgtccacgaagcaacatctcttgttgaatatccattcacagctaatctcaaattcatgtttggagattctactgatgtgattattgctatcaggttgccatgtgaaggaagagaaaatctctcttttttaaggaaatataacatatttgcgactagctagagttgcaacaacttataaat

SEQ ID NO: 8178 - DNA, 2111 bp, Panax ginseng
atctcttctcttttctgtcccgctgcatctctctcgtatccaattgtcaagattcttgaataaaattttcttcgaaactcctcataattctctcaatttcttcttccacagatctctctgaatctaatacccaattgttttcccgcgtgggtttcgttttcctttagattcccatctcttacttcaaattcccaattttttttaccttgctttaatcctccatttatacggctgccctgctctgtatcatcataattacttgtacaatccattttgtcaatgtatgataaagttagggtttttacatcagcttttgctatataaatttaggattctggagaacttttgatgattatgcatgtgtgttttactggatctgagctgtgtgtaaagatttaagcttttgatacagtgaatttcgttgatattcaatagctacaaaaagtgagaaattgggttttgtcggtttgaggttatttaatttggctataacaatatggatcatgtggttggtgggaagtttaagcttgggaggaaaattgggagtggatcatttggagagctttatttgggagtaaatgtacaaactggtgaagaagttgctgttaagctggaatcagctaagactaaacatcctcagctccactatgaatcaaagttatacttgcttcttcagggaggaactggtgttcctcatctcaagtggtttggagttgaaggagaatacagtgccatggttattgaccttcttggaccaagcctagaggacttattcaactactgtaaccaaaagttcacattgaaaacagttttaatgcttgcggatcagttaattaatagagttgaatatatgcactcaagaggttttcttcaccgtgacataaagcctgacaactttttaatgggtttagggcgaaaagcaaatcaggtgtacatcattgactacggtcttgctaaaaagtatagggatcttcaaacacacaagcatataccatacagggaaaacaaaaatctcactggaacagctcgttatgcgagtgttaatacccaccttggagttgagcagagcaggagggatgatctggaatctcttggttatgtgcttatgtattttttgaggggaagccttccctggcagggactgaaagctggcacaaaaaaacaaaagtatgacaaaattagtgaaaagaagatgcttactcccatagagatgctttgcaaatcttatccatcagaattcatatcatacttccattattgccgttcgctgcgatttgatgacaaaccggattattcatatttgaagaggcttttccgggacttattcattagagaaggttatcagtttgactatgtatttgactggactatattgaagtatccgcagattggctccagttctagaggacggcagtcggctgggaaattagctttgaaccctggaccatctgtagataaagcagaaaaaacgccagtgagacgagagacaagagatcgtttctcaggcgcagttgaggcatttgctaggaaaaatggctctgctgctggtttgcatggagatcactcaaggcacagatcttcagacaatgtaccatcatcaaaggatgtgcaagctgacaaagaaagaggacaggtttctcgaaccggaagtgcttcaaagagagctgtcatatcaagcagccggccaagctcctccggcgaacccagcgagaacaggttgaatcggctgggttcaagcagtggtcgtttgtccaccacccaaaggattcaacctggttttgagtccaaatcatcatcgtttactcgtgctgtagcatcaagaggtggccgtgatgatgctcttcggagctttgagcttctaaccattggctccgggaagaggaaataaggttgtcaatttgagctaattttcaatgtggtttttatcaagttcctgtcctgtccacggaaaattattttgtgcacagctaaatatcaaattctagttttttccctcttatgtcattatatacttgtcaaaaggaagagataaaatctctcttttttagggaattattacatatatttacgactagagttgcaataactaatatatacttctggaattttgt

SEQ ID NO: 8179 - DNA, 2516 bp, Lupinus angustifolius
attttctttctcttcctcatccaacctcacacaccttctctctctctctctctgggaattctcaatatcttcccagaaaattcactcatcacagatcccaaactccgatgccaaatccaatacctatctctacgcgagaaaatcgtaaccattagattccttttctctctcactgtttcacactattcgctctttttcaccaacatactcccattttctacctcctttctccgaacaatggggaaaaagggttttttaatgtcccttgaaaagtggttgtgcttcgattcaatcaggaattattttttgtagattctagttcctgatcctattttcattgatcaaaaccgttttttttatcttattccctttttagtggattttttaggtattgggattctcaaagtttgaatttttgagttattcaatttcaatacacttttggatcgttgtgttaatgttaaatctcgttggatctgagattctgatggaaataaagatggattattgatgagactctgagtaggaaaaagatttttttaaataatattaacaggcaattaatgtgtgttgtggagtggctttgtaatctagcgaagttgaagaggttgaggttgtgatcatggatcatgttattggtggaaaattcaagcttgggaggaagattggagctggatcatttggagagctttatttgggtgttaatgtacaaagtggagatgaagtggctgtcaaattggaacctacaaagaccaagcatcctcaacttcactatgagtcaaaattgtatatgcttcttcaagggggaactggaataccccatttaaaatggtttggagttgagggtgactacaatgttatggtaattgaccttcttggaccaagtcttgaagacttgtttaactattgcaaccgaaaattatctctgaaaacagttctgatgcttgcagatcagttgataaacagagttgagtacatgcactcccggggttttctgcaccgtgatataaagcctgataactttttgatgggtttaggccgcaaggcaaatcaggtatatgtaattgattatggccttgcaaaaaagtatagggatcttcaaacacataagcatataccatacagggaaaacaagaacctcactggaactgctcggtatgcaagtgttaatactcaccttggagttgaacaaagcagaagagatgatctagaatcacttggttatgtgctcatgtattttttgagaggaagtctcccttggcaaggcatgaaaggtggaactaaaaagcagaagtatgacaagataagtgaaaagaagatgcttactccgatagaggtcttatgcaagtcatacccattagaattcacgacttacttccattattgccgatcgttaaggtttgaagataagcctgattattcatatcttaagagactctttcgggacctattcattagagaaggttatcagtttgactatgtatttgattggactatcttgaagtatccacaaattggatccagttctcgagctcgaccaagtgggaagccagcaataaatctgggactgtcaggagagagagtagaacggccttcaggtgtgccagaggttcgggatagattttctggtgcactcgagcaatttgcaagaaggaataggccgaatagctctgggcttggtctgcatggtgaaaattctaggcataggtcttcagatgatgtgccatcgtccaaagatgtgcaagctgattccgagaggactcggagctcttctcgtaatggtagtacctcaaaacggcctgtcgtatcaagcagccgaccaagcacatctggtgaacctaatgaaagtcgttctagccgactgctctcaagcagtggccgtctgtctacaactcagaggattcaagcaggtttagagtccaaaacaccccttactcagcggattcaagcaggtttagagtccaaaacatcccttactcagaggattcaagcaggtttagagtccaaaacatcccttactcgtgcttcagggtcgagaggcggtcgagacgatacattcaggagctttgaacttctatcaattggtacaggaaaaaggaaatgaagaacagtagtcagaagacttcttgtgccaagggttgcagttccattctaatacttttcctttgatatgtctaaacttgttgatgactctgtatatttccattctatgttgggtccattcaaggtggatctttggcagactcctctcatacctcctcagatgttcttccatgactatttcaacatggacccattcatgaagagatactgttactttagaaacatgtttatatgaaatggttacttgttacaaatacattctctatattgtgcacttgatgaaagaggaaaagaaactgtaaaaaatgctttgcaagttttgcaccctttgcatatatttggaacctgattattctcaatattttgttcagatgtacattgagtgaatggactaggtggctccttgtggataa

SEQ ID NO: 8180 - DNA, 2143 bp, Amsonia hubrichtii
cttagtttcctagatttaatgaattgtggctccttcttacgatgtagattgtaaaggctgacttttaattcattgatttattccttcattttttagattgaaaaattagcatctgtttcttgcatatatatataaaggaaatctcatgtgtaaagaaatatatatatgcgaaattttatgaattcttgattttcaatatcaagagttgattttgggacttctggatttgagtttcatttgttggctagctacggaaagggtcttcctcgaggggattttgatatctttgtttggaaagcttttggtggatctgaggcttatttaaagatttgagctttggatgattgatcagagacggtttgattatatgatgaacggtgaattgggttccagcgtgaacttgtgaaatcaagagagactgaacatttgggtactttttatcagaaaaaaggaaaacaaggtaaaaggtaggaagggtaatatttatcgggagatttaattatggatcatgtgattggtggcaagtttaagcttggaagaaagattggtagcggatcctttggagagctctatctgggtgtaaatgtacaaactggagaagaagttgctgtgaagcttgaaccacttaaaactaagcatccacagcttcactatgaatcaaagttgtatatgcttcttcagggaggaactggcgtaccccatcttaaatggtttggagtcgaaggcgaatacagtgctatggttattgaccttctcgggccaagcttagaagatttgtttaactactgcaatagaaagttcactttgaaaacagttctaatgcttgcagatcaattaattaacagagtggaatacatgcattctagaggttttcttcaccgtgatattaagccagacaacttcttaatgggtttaggacgcaaagcaaatcaggtatacgtcattgactatggtctggccaaaaaatatagagatctccaaacacacaaacacataccttacagggaaaacaaaaatcttacgggcacggctcgttatgcaagtgtcaatacgcatcttggagttgagcagagcagaagggatgatttggagtctcttggctatgtacttatgtactttctcagaggaagccttccatggcaggggttgaaagctgggactaaaaaacagaaatatgacaaaattagtgagaagaagatgttaacgccgattgaggtgctctgtaaatcttacccatcagaattcatatcctatttccattattgtcggtcattgcggtttgatgacaagccagattattcttacctcaaaagacttttccgtgacttatttattcgggaaggttatcagtttgactatgtgtttgactggaccatcttaaagtacccacagattgcctcaagttcaagaggacggcagccaatggggagattgcctttgaatggagggccatcagtggagagactagagaagaacccagcaagacaggaaactcgagataggttctctggtgcagtcgagtcatttactcgaaggagtggttctggtgctggcttgcatggggatcccatgaggcacagatcttcagacgatgttccatcatccaaggatgtgcaagccgattctgaaagacgactgacccgtactggtagtagttcaaagagggctgttatgtcaagcagcagaccaagctcctcaggtgaacctagtgaaaatcgtactagccggcttggatcaggcactggccgtctgtcaacaacacaaagaattcagcccgggtttgaatccaagtcatcgtctttcacacgggttgctgccacaagaggcaaccgtgatgaaacccttcgaagctttgaactgctgacaattggctccgggaaaaggaaatgagaaattctcgtctggcatctgtttatctcgaagatcaaattaagtttctctggcaaagttgctaatgcttaaaccttccttcttattcaggatgagtcctgtccacctatgtttttggtctgaattatcgtataaagagtttctattaccgtattgtattcacagctaaacatcatgaattgtactttcccaacatttgtctgctgattcctgctatataattgccttgtaacctatcaaacaaagagaaaaa

SEQ ID NO: 8181 - DNA, 2055 bp, Cichorium intybus
tagattcccccacttcgatctaacttcaaattatcttcactcgtatcccttcatccattagttctagggttttaactttcaaccgatccatttactttgttcgtctgtatcttaggagcgatatccagaatttccttacttggggttttaagtttctagcattgctagacttcatcaagtgcaattgtttcctcacaaatcttcataccaaagttcggtgtagattttggtgtggaggctttgtatctcgcgagttttgtgttgtggatttttgatggatctgagtgcattttggagatcttagcttttgacgccgcgaaaattcttcaactaatttcacagaggctatttatttgtttccacttaagctttattcgtttgggaattcatcatggatcatgtgattggtgggaagttcaagcttggcaggaagattggtagtggatctttcggagagctttatttgggagtaaatgttcaaagtggagaagaagttgctgtcaaattggaatctgttaaaaccaaacacccacaacttcactatgaagccaaattgtacatgcttcttcaaggaggaactggtgtaccccaccttaaatggataggagttgaaggcgaatacaatgctatggttattgatcttcttggaccaagtttagaagatttattcaattattgtaaccgaaaattcactttgaagacagttttaatgcttgcagatcaattgataaacagagttgaatatatgcattcaagagggttccttcaccgtgatataaaaccagataactttttaatgggtcttggacgtaaggcaaatcaggtttacattatagattatggtcttgcaaaaaagtatagggatctccaaacacacaaacatataccatacagggaaaacaaaaatctcactggtactgctcgttatgccagtgttaatacccaccttggagttgagcaaagtagaagggatgatttggagtctcttggttatgtgctcatgtatttcttgagaggaagccttccatggcaggggctaaaagctggcactaagaagcaaaaatatgataaaattagtgaaaagaaaatgcttactcctatagaggtgctatgtaagtcttatccgactgaattcatatcatattttcattattgtcgatcacttcgatttgatgacaaaccggattattcatacttgaagaggctttttcgtgatctttttattcgagaaggttatcagtttgactatgtctttgactggactattttgaagtaccctcaaattggttcaggttccagttctagaggacggacggttggcaaactaccactgaatcccgggccttctgcagacaaggtggaaaaaaccccagtgagacactcaggggcagttgaggcatttgctaggcgtaatgtttctggaagtggtttacatggtgaacactcaaggcacagatcttcagaacatgccacgtcatccaaagaaatgcatgctgactcagatagaggccgtatttcacgaaccggtagcacttcaaaaagagcagtagtctcgagcagtaggccgagttcatcgggcgagccaagtgagggccggtcaaaccggttaggttcgggcagcgggcggatatcaactgcccaaagactccactctcagcccggattcgagtccaaatcatcgtctttcacacgggcggttccgtcatcgagaggcggtcgtgatgatgctctaagaagctttgaattgctaactatcggaaaaaggaaataaaaagagaaattttggatttgcgtgtgggacccgtttggatggatgactttttataagttgagttacacaaaaatgcaaaaatgtaaaagattcgttgttgttgttgttgttgatgttgttgtaaccttgaagaaagagagattgtgtctcactttagggtgggtgttcatatggtgtcaagtaccctaattgaggaatgtttatgttggaagaatcatttaaattggatttggcttcttgtttatttgtgttcttatttggtgttaagttgatttgggtaagat

SEQ ID NO: 8182 - DNA, 1543 bp, Cichorium intybus
ttttcacgccgcgaaaattcttcaactaatttcacagaggctatttatttgtttccacttaagctttattcgtttgggaactcatcatggatcatgtgattggtgggaagttcaagcttggcaggaagattggtagtggatccttcggagagctttatttgggagtaaatgttcaaagtggagaagaagttgctgtcaaattggaatctgttaaaactaagcacccacaacttcactatgaagccaaattgtacatgcttcttcaaggaggaactggtgtaccccatcttaaatggataggagttgaaggcgaatacaatgctatggttattgatcttcttggaccaagtttagaagatttattcaattattgtaatcgaaaattcactttgaagacagttttaatgcttgcagatcaattgataaacagagttgaatatatgcattcaagagggttccttcaccgtgatataaaaccagataactttttaatgggtttaggacggaaggcaaatcaggtttacattatagattatggtcttgcaaaaaagtatagggatctccaaacacacaaacatataccatacagggaaaacaaaaatctcactggtactgctcgttatgccagtgttaatactcaccttggagttgagcaaagtagaagggatgatttggagtctcttggttatgtgctcatgtatttcttgagaggaagccttccttggcaagggctaaaagctggcactaagaaacagaaatatgataaaattagtgaaaagaaaatgcttactcctattgaggtgctttgtaagtcttatccgactgaattcatatcatattttcattattgtcgatcacttcgatttgatgacaaaccggattattcatacttaaagaggctttttcgtgatctttttattcgagaaggttatcagtttgactatgtctttgactggactattttgaagtaccctcaaattggttcaggttccagttctagaggacggacggttggcaaactaccactgaatcccgggccttcagcagacaaggtggaaaaaaccccagtgagacactcaggggcagttgaggcatttgctaggcgtaatgtttctggaagtggtttacatggtgaacactcgaggcacagatcttcagaacatgccacgtcatccaaagaaatgcatgctgactcagatagaggccgaatttcacgaaccggtagcacttcaaaaagagcagtagtctcgagcagtaggccgagttcatcgggcgagccaagtgagggccggtcaaaccggttaggttcgggcagcgggcggatatcaactgcccaaagactccactctcagcccggattcgagtccaaatcatcgtctttcacacgggcagttccgtcatcgagaggcggtcgtgatgatgctctaagaagctttgaattgctaactatcggaaaaaggaaataaaaagagaaattttggatttgcgtgtgggacccgtttacacaaaattgtaaaagattcgttgttgttgttgttgatgt

SEQ ID NO: 8183 - DNA, 1913 bp, Cichorium intybus
tagttctagggttttaactttcaaccgatccatttactttgttcgtctgtatcttaggagcgatatccagaatttccttacttggggttttaagtttctagcattgctagacttcatcaagtgcaattgtttcctcacaaatcttcataccaaagttcggtgtagattttggtgtggaggctttgtatctcgcgagttttgtgttgtggatttttgatggatctgagtgcattttggagatcttagcttttgacgccgcgaaaattcttcaactaatttcacagaggctatttatttgtttccacttaagctttattcgtttgggaactcatcatggatcatgtgattggtgggaagttcaagcttggcaggaagattggtagtggatctttcggagagctttatttgggagtaaatgttcaaagtggagaagaagttgctgtcaaattggaatctgttaaaactaagcacccacaacttcactatgaagccaaattgtacatgcttcttcaaggaggaactggtgtaccccaccttaaatggataggagttgaaggcgaatacaatgctatggttattgatcttcttggaccaagtttagaagatttattcaattattgtaaccgaaaattcactttgaagacagttttaatgcttgcagatcaattgataaacagagttgaatatatgcattcaagagggttccttcaccgtgatataaaaccagataactttttaatgggtcttggacggaaggcaaatcaggtttacattatagattatggtcttgcaaaaaagtatagggatctccaaacacacaaacatataccatacagggaaaacaaaaatctcactggtactgctcgttatgccagtgttaatacccaccttggagttgagcaaagtagaagggatgatttggagtctcttggttatgtgctcatgtatttcttgagaggaagccttccatggcaagggctaaaagctggcactaagaagcaaaaatatgataaaattagtgaaaagaaaatgcttactcctatagaggtgctatgtaagtcttatccgactgaattcatatcatattttcattattgtcgatcacttcgatttgatgacaaaccggattattcatacttgaagaggctttttcgtgatctttttattcgagaaggttatcagtttgactatgtctttgactggactattttgaagtaccctcaaattggctcaggttccagttctagaggacggacggttggcaaactaccactgaatcccgggccttctgcagacaaggtggaaaaaaccccagtgagacactcaggggcagttgaggcatttactaggcgtaatatttctggaagtggtttacatggtgaacactcaaggcacagatcttcagaacatgccacgtcatccaaagaaatgcatgctgactcagatagaggccgtatttcacgaaccggtagcacttcaaaaagagcagtagtctcaagcagtaggccgagttcatcgggcgagccaagtgagagtcggtcaaaccggttaggttcgggcagcgggcggatatcaactgcccaaagactccactctcagcccggattcgagtccaaatcatcgtctttcacacgggcggttccgtcatcgagaggcggtcgtgatgatgctctgagaagctttgaattgctaactatcggaaaaaggaaataaaaagagaaattttggatttgcgtgtgggacccgtttggatggatgactttttataagttgagttacacaaaaatgcaaaaatgtaaaagattcgttgttgttgttgttgttgatgttgttgtaaccttgaagaaagagagattgtgtctcactttagggtgggtgttcatatggtgtcaagtaccctaattgaggaatgt

SEQ ID NO: 8184 - DNA, 2097 bp, Panax ginseng
cttttccttcatctcctcttttctatcccgctgcatctctctcatatccaattgttaagattcttgaataaaattttcttcgaaactcctcataattctcgcaatttcttcttccacagatctctctgaatctaatacccaatttttttccgcgtgggtttcgttttccttagattcccatctcttacttcaaattcccattttttttaccttgctttaatcctccatttatacggctgcgctgctctgtatcatcataattacttgtacaatccatttttgtcaatgtatgataaagttagggttcttacatcaagcttttgctatataaatttaggattgtggagaacttttgatgattatgcatgcgtgttttactggatctgagttgtgtgtaaagatttaagcttttgatacagtgattttggttcatattcaatagctacaaaaagtgagaaattggggtttgtcggtttgaggttatttaatttggctataacaatatggatcatgtggttggtgggaagtttaagcttgggaggaaaattgggagtggatcatttggagagctttatttgggagtaaatgtacaaactggtgaagaagttgctgttaagctggaatcagctaagactaaacatcctcagctccactatgaatcaaagttatacctgcttcttcagggaggaactggtgttcctcatctcaagtggtttggagttggagaagaatacaatgccatggttattgaccttcttggaccgagcctagaggacttattcaactactgtaaccgaaagttcacattgaaaacagttttaatgcttgcggatcagttaattaatagagttgaatatatgcactcaagaggttttcttcaccgtgacataaagcctgacaactttttaatgggtttagggcgaaaagcaaatcaggtgtacatcattgactacggtcttgctaaaaagtatagggatcttcaaacacacaagcatataccatacagggaaaacaaaaatctcactggaacagctcgttatgcgagtgttaacacccaccttggagttgagcaaagcaggagagacgatctggaatctcttggttatgtgcttatgtattttttgaggggaagccttccctggcagggactgaaagctggcacaaaaaaacaaaagtatgacaaaattagtgaaaagaagatgcttactcccatagagatgctttgcaaatcttatccatcagaattcatatcatacttccattattgccgttcgctgcgatttgatgacaaaccggattattcatatttgaagaggcttttccgggacttattcattagagaaggttatcagtttgactatgtatttgactggactatattgaagtatccgcagattggctccagttctagaggacggcagtcggctgggaaattagctttgaaccctggaccatctgtagataaagcagaaaaaacgccagtgagacgagagacaagagatcgtttctcaggcgcagttgaggcatttgctaggaaaaatggctctgctgctggtttgcatggagatcactcaaggcacagatcttcagacaatgtaccatcatcaaaggatgtgcaagctgacaaagaaagaggacaggtttctcgaaccggaagtgcttcaaagagagctgtcatatcaagcagccggccaagctcctctggtgaacccagcgagaacaggttgaatcggctgggttcaagcagtggtcgtttgtccaccacccaaaggattcaacctggttttgagtccaaatcatcatcgtttactcgtgctgtagcaagaggtggccgtgatgatgctcttcggagctttgagctgctaaccattggcacaggaaagaggaaataagggtgtcaatttgcttgcttctgggccaattttcaatgcaacttttatcaagtttcttgagcaccattgtgttctacacttgtagcagtgtccacgaaacaccatctcttgttgaatatccattcacagctaatctcaaattcatgtttggagattctactgatgtgattattgctatcaggttgccatgtaaactcgacagagg

SEQ ID NO: 8185 - DNA, 2467 bp, Aquilegia formosa
ccaaaacccctcaaaaaaaatattatctttcgatttcatctgtaattacgaagattaatcttcgaatttgtttttttttttcaatcacgaaattattctcattcgattcgttcttgttgtaaatttgtttcaatatttatttatttatttttaccagttttttttattattgaagatcttgtttcgttttattggtaattgatcgcatttgatcttttattaagaaatggattttggatttttcagaattagggtttggatttgttgtcggtaagcttggatataaggtgttattaatcttatatcatcggtgatgtagattggttaattggtgtttaagatcggaatttggttcattttgaggtaaattttaggattttggttcggcaattcgtgtagattaattggagtttgtttaaggtgattttttgtcgattttgttgaaatttggaagtgttaatcatcaaagattggatttgttttggaatcgggaatagttttaattttgagattgaggggtttatgggagattgttgaattgttgagaaattggtaaattttataattctggaagtgttttgaggaaggttgaatttggttaggatctaaatagagaggtggtgaaacctaattgtgattgatttgaggttattgagctgaattagaattatggaacatgttattggggcaaaatttaaggttgggcggaagattgggagtggatcatttggtgagctttatctaggtgtaaacatacaaagtggagaagaggtggcaatcaaattggaaaatgtgaagacaaagcaccctcaactacattatgagtcaaaattgtatatgctcctgcaaggaggaacgggaattccccacctaaagtggtttggtgtcgagggagagtacaatgtcatggttattgaccttcttgggccaagcttggaggatttgttcaactactgcaatcgaaagttcacgttgaaaacagttctgatgcttgcagatcagttgattaacagagttgaatacatgcactcaaggggttttcttcatcgtgatattaagcccgacaatttcttaatgggtttaggacgaaaagcaaatcaggtatacataattgactatggtcttgcaaagaagtatagagatcttcaaacccataagcatataccttacagagaaaacaagaatttaacaggaacagctcgctacgcaagtgtcaacactcaccttggagttgaacaaagcaggagagatgatctggagtctctgggttatgtgcttatgtactttctaagaggaagccttccctggcagggactgaaagctggaactaagaagcagaagtatgataagatcagtgaaaaaaagatgctgactccgatagaggtgctttgtaaatcatatccatcagagttcatatcatattttcattactgtcgatcactacgttttgatgacaaacctgattactcgtatttgaagaggcttttccgtgacttatttattcgagaaggttatcaattcgattatgtatttgactggaccatattaaagtaccctcagattggtgccaactctagagcacggatgcctagtggaaaaattggcgcaaacgcaggaccatctgcagaaagagtggaaaggacttcagtgggacaagacatgcgtgataggttctcgggtgccgttgaagcttttgctaaacgaaactattcagtgtctggacttcatggtgatcactctaagcacaagagttcggaggatgggccatcgtccaataatttggtacctgattctgaaagagggcgaacgtcttcctctaggaatggtagtagttcaaaaagggctgttatgtcgagcactcggccaagctcctcttgtgaacccagtgagaatcgatcaagccgactagcatcaagcagtgcccgagtgtctactactcacagggtccaaccgggttttgaatctaaaacatcatctttcactcgtgcaacagctgcaagaggtgctcgtgatgatccgctgaggagttttgaactcctttcgataggcccagaaaagaggaagtaaaagcaagtggtgattagatattacttatatcaaggtggaaatccctttttgcccatttcatttatgttcctgagtattgattacggttgtatattgcatatatcgattttcacgggttctttcagagctgaggttcattggtgttcctccttgagaacattcagtcatatgtagaggctttggccattatattatgttgtagacgtgtccaacaaagagaagatctcacttcagggaattgtttatatatccgagacttgaatacttagattagtagtaaaaaatactgctagtcttatatcaacatactttccctttggatgatgaaaaaccgaatttctctgttttaccttctgtactaatgtaatgccttcaatacattcgaaattttattgttttc

SEQ ID NO: 8186 - DNA, 1949 bp, Catharanthus roseus
ttacagaatttatatagttgatttttgggagttgtggatttgaggttcatttttgttggctagctacggaaaaggttagctacggaaaaggtcttccttggggggattcttgatatatttgtattgaaatcgtttggtggatctggggcttattttaagatttgagctttgggtgattgaccagagaagattggtcccgtgaagaatggtcaattgggttacagtgtgtgaactgtgaaatcaggagcatttgggttattgttatcagtaaagaaataaaaggaaaaagattggtgggtgaagggaatatttattggagatttagttatggatcacgtaattggtgggaagtttaagcttgggagaaagattggtagcggatcctttggagagctctatcttggagtaaatgtacaaactggagaagaagttgctgtgaaacttgagccacttaaaacgaagcatccgcagcttcactatgaatcaaagttgtacatgcttcttcagggaggaactggggttccccaccttaaatggtttggagttgaaggcgaatacagcgcaatggttattgaccttcttggcccaagcttagaagatttgtttaactactgtaatagaaagttcagtttgaaaacagttctaatgcttgcagatcaattaattaatagagttgaatatatgcattctagagggtttcttcaccgtgatattaagccagacaacttcttaatgggtttggggcgcaaggcaaatcaggtatacatcattgactatggcctggccaaaaagtatagagatctgcaaacgcataaacacataccttacagggagaacaaaaatcttacaggcacagctcgatatgcaagtgtgaatacacatcttggagttgagcaaagcagaagggatgatttggagtctcttggctatgtacttatgtactttctcagaggaagcctcccatggcagggattgaaagctggaactaagaagcaaaaatatgataaaattagcgagaagaagatgttaacgccatttgaggtgctctgcaaatcttatccatcagaattcatatcctattttcattattgtcgatcactacggtttgatgacaagccagattattcttacctcaaaaggcttttccgtgatttattcattcgggaaggctatcagtttgattatgtctttgactggaccatattaaagtacccacagattgcctcaagttcaagaggacggcagccaatgggaagattgccgttgaatggaggaccggctttggaaagagtagagaagaacccagtgagacaggaaactcgagatagattctctggtacagttgaatcatttactcgaaggagtggttctgctggcttgcatggggatcccttaaggcacagatcttcagatgatgttccatcatccaaggatgtgcaagcagattctgaaagacgtctgtcccgggctggcagtagttcaaagagggctgttatgtcaagcagcagaccaagctcttcaggtgaaccaagtgaaaatcgtactagccggctaggaggaggatcaggcactggccgtctctcaacaacacaaagacttcagcctggatttgaatccaaatcatcttctttcacgcgtgttgctgcaacaagaggcagccgtgatgaaacccttagaagctttgaacttctgacaattggctcagggaaaaggaaatgagaaaattatctcatataatttgataaccatcaatcaacgcatgggggaagaagatggaagaggataagtgtttatcccatcctatgttttttttggttcgatttatcttagtatattatgagttcttattaccataaaaatgtattatcagagctaaaacatgatgaattggtactttgttcaaaacaaatattctccttcctcttcttcgtgctctcgctatagtggcc

SEQ ID NO: 8187 - DNA, 1899 bp, Actinidia deliciosa
tctagagattttagctttgggcgactatttggggaagagtttggggtttgggattgcgaattagattgaagtttgaaagttagagggaggttgaattttttgggtgttatttagagaaggtgatctcaattgaggatcaaatcatggatcatgtgattgggggaaagttcaagcttggtcgaaagattgggagcgggtctttcggcgagctttatttgggagtgaatgtccaaactggagaggaagttgctgtgaagctggaatcagtcaaaactaaacatcctcagctttactatgaatcaaaattgtacatgctccttcagggtggaactggtgttccccacctcaaatggtttggagttgaaggtgaatacaatgcaatggttattgaccttcttgggcctagcctagaagacttgttcaactattgtaatcggaaattcactttaaaaacagttctaatgcttgctgatcagttaacgaatagagttgaatatatgcactcaagaggttttcttcatcgtgatataaagcccgacaactttttaatgggtttagggcgcaaagccaatcaggtctacatcattgactatggccttgcaaaaaagtatagagaccttcaaacacataaacacataccatacagggaaaacaaaaatctgacaggcacagctcgttatgcaagcgttaacactcaccttggagttgagcaaagcagaagggatgatctggaatctcttggttatgtgcttatgtattttctgcggggaagccttccttggcagggtttgaaagctggcactaaaaagcagaaatacgacaaaattagtgaaaagaagatgcttactcccatagaggtcctttgcaaatcctatccatcagaattcatatcgtactttcactattgtcgatcattgcgatttgatgacaaaccagattattcgtacctgaagaggcttttccgtgacttatttattcgagaaggttatcagtttgactatgtatttgactggactattttgaagtatccacagattggttccagttcaataccacggcagcctgctgggaagttagctttgaaccctggagcatctgcagaaagagctcctgtgaggcaagaggttcgagataaattctcaggtgcagttgaggcatttgctagaaggaaaggtactggcggcggtttgcatgaacactccaggcacagtgatcgctttagaaatacatcctcggaggatgtaccatcctccaaggatgtgcaagctgactctgaaagaagtcgcggagccgcaagaagtggaagtacttcaaaaagggttgtcatctctggaagccgcccgagctcatctggtgaagccagcgagaaccgaccaagccggttgggttcaggcagtgctcggctctctaccacccaaagggtccaacctggtttcgagtcaaaatcatcgtctttcacccgtgctgccgccacaagaggcggccgtgaagatcctctccgtagcttcgagctgctcaccatcggcacgggaaagaggaagtgaaggcacaaatctactttctcatggggctcaattcttgttgtagaaaaccagatgtgtccctaaagttacaagcagtcgaatcaaggattccattcacagttcaagcttgagcgcaagtttctcttagagcatttccagaagttcttcactcattgttgccattgttgtaacaagttgtaaactcgtcagagagagagagtttacctcaagttagcgaatttttttatagttttggaaatctaggactgttagttattacaagtacttgggtgtgttgttattatgagaaactttgtttggagaccagcatgtacactgtttccctttgtgtaatacattacttgggccttggcca

SEQ ID NO: 8188 - DNA, 1927 bp, Gossypium hirsutum
gaaagtattttagaatctgggttttgagttttggagttgataccaatttggatggatctgagagttagttcaaagagaagggtttcgagtcaatttctctgttaaaacttaaaagtaaaaatttcaatatttatgaagtagaataagagtttttccttttaaataaacccagtcagaataaatcatggaacatgttattggtggaaaattcaagcttggtcgaaagattgggagtggatcctttggtgaactttatttaggtgttaatgtacaaagtggagaggaagtggctgttaagttggaatctatcaagaccaagcatccccaacttctgtatgagtcaaagctgtacatgcttcttcaaggagggaccggaattcctcatttaaaatggtttggagttgagggtgaatacaatgttatggttatcgatcttcttggaccaagcctagaagatttgttcaactattgcaatcggaagttttctttaaaaacagttttgatgcttgcagatcagttattaatcagagttgagtatatgcattctcgcggttttcttcatcgtgacataaagcccgataactttttgatgggtctagggcgcaaagcaaatcaggtatacgtaattgattatggtcttgcaaaaaagtttagggatcttcaaacacacaagcacataccatacagggaaaataagaatcttacaggaacagctcgatatgcaagtgttaacactcaccttggagttgagcaaagcaggagggatgatctcgaatctcttggttatgtgcttatgtacttccttagggggagccttccatggcagggattgaaagctggcaccaaaaagcagaagtatgacaaaattagtgaaaagaagatgcttactcccatagaggtcctttgcaaatcatatccttctgagttcacatcatacttccattattgtcgatcactacgatttgaagataaaccggattattcatacctgaagaggctgttccgagaccttttcattcgagaaggttatcagtttgactatgtatttgattggactatacggagatacccacaggttggctctagctcaagagctcggcctagcctgaagccaggtttaaatcccccgggagtctctgctgaaagaacagaaaggccttcagttggccaagagattggagaaaggttgtctggcactattgagccgcttacaagacgcattggttctgggcagggtttgcatggtgatcagtctagatacatatctgatgatgtgccgtcatccaaggatgtgcaacctgattctgaaaaggttcactcctcctcaagaaatgatagttcttcaaagaggcctgtcgcaacaggaagccgactggactcctctggtgagcctaacgaaaatcggtctggcagattagtctcaagcagtagtcgcctgtcaacaactcagagaatcctccctgggtttcaatccaaatcagcatcttatactcgaacctcagccacaagaggtggtcaagatgattcccttcggagcttcgagttcttgacaattgggagtgggaaaaggaaataaattgaacatgcatcttgtaggaaggatttgcttgtgtcggaggcacacttattatctgatggaaatctcggcactataacggtatttacgagcagttactagtatgtatatcggtggtcatgatttggttccaaccatgacagtctccctggaaaacattttcagtccttccccatgtaccccgtcagtatacttggcattatgatgcctctagtcagtaaagtaatagaaatgagcttcatcctaagtaattgtccgtatattttcaacattctatctgtaataaacacttgatgtttctttctttaattagaagcattaaaagaaatatatatatattatggcaaaaaa

SEQ ID NO: 8189 - DNA, 2917 bp, Gossypium hirsutum
tgcagcttgatggtcccaaaacgtttgccttggttcactgattaatgggtattccgtagtttctcagtcaagtttgctccttttgtttattatccctttagtcactaaagaggttaacgcctttttgttcttttaagggagcttttataaggattttagaaactgggttttgatctctggagttgatagttaataattttgatcgatctgagaactagtttaaagagaaggttattgagtcaatttgtcaatattagtttagtgaaataagaggcaagggtgtttttctttccctttactgtgatatatagttgagtgtgcaaagtttattaagattagatcatggaacacattattggtggaaaattcaagcttggtcgaaagatcgggaatggatcatttggtcaactttatttaggcgttaatgttcaaagtggagaggaagtggctgttaagctggaacctgtcaagaccaaacatcctcaacttcactatgagtcaaagctgtacatgcttcttcaaggagggactggtattcctcatttaaaatggtttggagttgagggtgaatacagtattatggttattgatcttcttggaccaagccttgaagatttgttcaactattgcaaccggaagttttctttaaaaacggttttgatgctggcagatcagttaataaatagagctgagtatatgcactctcgtggttttcttcaccgtgacataaagcctgataactttttgatgggtttagggcgcaaagcaaatcaggtatatgtaattgattatggccttgcaaaaaagtatagggatcttcaaacgcacaagcacataccatacagggaaaacaagaatcttacaggaacagctcgatatgcaagtgttaacactcaccttggagtcgagcaaagcaggagggatgatctcgaatctcttggttatgtgcttatgtacttccttaggggaagccttccatggcagggtttgaaagctggtaataaaaagcagaagtacgacaaaattagtgaaaagaagatgcttacccccatagaggtcctttgcaaatcatatccttctgagttcacatcgtacttccattattgccgatcactacggtttgaagacaaaccagattattcatacctgaagaggctattccgggaccttttcattcgagaaggttatcagtttgactatgtatttgattggaccatgctgagatatccacaggctgcctctagctcaagagtacggccaagcccaaagccgggtttaaatccccaaggagtatctgctgaaagaaccggaaggccttcagttggtcaagagattcgagaaaggttctctggtgctgttgaggcatttgcaagacggaatggatcagggcatggtgatcagtctagacacagatctcccgacaatgtgctatcatccaaagacatgcaacctggttctgatagggctcagtcttcctcgagaaatggtagtacttcaaagaggcctgttgtatcaggcagccgacctaactcctctggtgagcctagtgacaaccggtctagcagattggtctcaagcagtggtcgcctgttaacaactcagagagttcaacctgggtttgaatccaaatcatcaacttttactcgtactacagccacgagaagtagccgcaaccatgcccttaggagctttgagttcttgacaatcgggagcgggaaaaggaaataaacagcactacacatctagtaaggatttgcttgtcttgaaggagatctccgcactatttcggtatctacaaacagtttactctcgtgtatcagtgcccacaatttggttccatcaagaaccgcaacaatctccttcctcgtgcaccctttcaggtattctcactagtatcatgcccctctagattgtcattgaagaaaaaagacagaaatgatatcatgctcaccttagggaaaattgttcatatattttccaagtttcaactattattctagctgtaataaaacacttgatgtttcttttatttcattagaagcaaacaagaacaaatgcctgaaaagtatattatagcaaagacactatggcttttatgtgtcatctacattggaagtattgttctcttcgagtccttcgaggctttggttcgaaccaaggatcatttttcgcaacataaatattaagtactcgctgagctaagtttgtaatttactgttaagaaaaatggatgttgctatgattaaaaatttaacatgggctatgttgttaatcattgttctctcttttttccttttttgttattacttgtctacttaagtttaaagtgagaaaagggtttatttagtgtccttttatcatcattttggtagccatgaatgagtaaaagggagcgtgtagggcatcaatagttgacataactttatcatatatttgctacataacataatgtgtcggatttatattcatatctgatacttgttttgtgtttggtgctagatattgctttgtattgttcatgatttatctttttaaataacaatattattagaataactccatgaaaggggttgttgagaagcatataataattacatggctgaagtgatgccttttattcacatgaatcaatgatgcaaagccaaaagatacttattcatgacttaaattttattaatttttgggtaagctacaattatgctttaagttttatttttggtcatctaattaaaaaattacaaaatagttatccaaattgtgttttttttgtctaattttgttaattgtcgttgactttgtgatgaaatggcagttctaaaatcttctattttcctttttgttctaaactccttccccatagaggatggatttgggaaagtaatggaggataagaaaggagaatacaagagaaaaagaa

SEQ ID NO: 8190 - DNA, 1920 bp, Olea europaea
aatcattttctgtaattaagttggaatggatctgagagctgttgtttgaatttgaggatttgattgttgagaagaagttatcacttttggcgttgactgttgaatggttaactgtataatcaagcaagattaatttttaattgggtcgtttttaattcatttttcgaaattaagtatggatcatgtgattggaggtaaatttaagctggggaggaagattggaagtggatcctttggagagctttatttgggaacaaatatacaatctggagaagaagttgctgtgaagctggaatctgctaaaactaaacaccctcagcttcactatgaatcaaagttgtatatgcttcttcagggaggcactgggattccccaccttaaatggtttggagttgaaggggagtataatgccatggttattgatcttcttggacctagtttagaagatttatttaactattgcaatcggaaatttacattaaaaacagttctaatgctggctgatcagttaatcgctagaatagagtacatgcattctaggggttttcttcaccgtgatataaagcctgataacttcttaatggggttggggcgcaaagcaagtcaggtatatatcattgactatgggcttggaaagaaatacagggatcttcaaactcagaagcacataccatacagggaaaataaaaatctcactggcacggctcgttatgcaagcgtaaacacccatcttggagttgaacaaagcagaagggatgatctagaatctcttggttatgtccttatgtacttcctcaggggaagcctcccttggcagggcctgaaagctggcactaagaagcaaaagtatgacaaaattagtgagaagaagatgcttacacctgtagaagttctttgtaaatcttatccatcggagttcatatcatatttccattattgtcgatcattgcgattcgaggacaagcctgattatatgtacttgaagaggcttttccaagacctctttattcgagaaggttatcagttggactatgtgtttgactggactatattgaagtatccacagattggctccagttctagagcacgaccaatggggaaattacctataaaccctggactatcggctgaaagagtacaaaagactccagtgaagcaagaagttcgagacaaattatctggtgcagttgaagcatttgccaaaaggaacggttctaatggaggcttgcacagggaaaactcgaggcacagatcggtagacgtgccatcatcaaaagatgtgcaacctgattctgaaagaggacggttatctcgcactggtagcacttcaaagagccgcctactatcaagcagcaggccaagctcctatggggaagccagtgaaaatcgcaatagccggttaggttctggcagcggtcgactatccaccactcacagattacaacctggatttgagtccaaatcttcttctttcatgcgtgctgcagtctccagaggcggccatgatgatgctctccgtagctttgagcttctaagaattggctccgggaaaagaaaatgatgaaatggcgtatttgaaacattgtggttgtgttaaagcctcattgttcctaccttacaatggaaataaagcgaccctattttatacattcgtgactctgagtatcgggtatgcaactaaaatttcatgggtcgagtttaaccgtgtggcctaagaattcagctgtcgtaaagccacttctttgaaaattgttacttactattctagctttaaccttgtattgtaacccaacaatgatgcatgttatcgttagactattgtagttctactagtacttgtcttatccattgttatacaactttccaaatcttacttgtctattggtgtattgtaccttgctttcgtcttctactctcctt

SEQ ID NO: 8191 - DNA, 1932 bp, Spinacia oleracea
ttcttttgaatttttggtggcttaaaaattctaatttgggttagattaagctgtttgagagtattgaaccatggatcatgtaattggtgggaagtttaagctcggccgaaagattggaagtggttcatttggggagctttacttaggtatcaatgtacagaccggcgaggaagtcgccgttaagctggaatctgcaaagacaaaacaccctcaactgcattacgagtcgaaattgtacatgcttcttcagggaggcactggtgttccccatctcaaatggtatggagtagaaggtgaatacaatgttatggttattgatcttcttggccctagtctggaggacttgttcaactattgcactcgcaagttttcactgaagacagtactaatgcttgctgatcaaatgattagtagggttgagtacatgcactcaagagggtttcttcaccgcgacataaaacccgacaacttcttaatgggtcttggacggaaggcaaatcaggtgtatgtcatcgattttggccttgcaaaaaagtatcgagatcttcaaacacacaaacacataccttatagagaaaacaagaatctcacagggactgctcgatatgctagtgtcaatacacatcttggtgttgagcaaagcagaagagacgatctagagtcccttggctacgtgcttatgtattttttgaggggaagccttccatggcagggcttgaaagctggaactaaaaagcagaagtatgacaaaataagtgaaaagaaaatgcttacgccaatagaggttttgtgcaaaaattatccctcagagttcacatcgtacttccactattgccggtcattgcgatttgatgacaagcctgattactcatacctaaagagactatttagggatcttttcattcgagaaggttaccaatttgactatgtatttgactggacaatattgaagtatccacaaattggttccagctccagaccaaggcctactgcgaaaccagctttaaaccctgggccttctgctgaaagagctgagaggacttcaggacaagatattcgggatagattttctggtgcagtcgagggatttgctagaagaaataatccaggtacaggttcacaaggtgatcagtcacgtcatagatcagcagatgatccatcatctaaggatgtgcaagcggatcgtgatagaggtcgtatatcaaggaacgggagtacttcaaagagagcaattgcatcatcaagtaggccaagctcttctggtgagcctagtgatagtcggtcaagcaggctgatgtcaacaagtggtcgtctgtcaacaactcaaagggttcaacccggtttagagtcaaaaacatctagtcttgctcgtgtttccgcagcaagacctggacgagacgatgccctaaggagcttcgactttctatctattggtgcaggtaggagaaagtaagaacaaggggacatgctcaatactggtttttcgcggttacaaaaagggagagattaatcaatgatctcaagcctactttttaaaaggtttcttatatcaccttgggttgttctctgtgaaaatgtaaatgatcagctccttcatacctgacacttgaatagcttaatggggttaaattccatttccttgcaatgataatgataagtgttctcctagattatttcgccgttaaatggtgctataaaccttttgcccaccggccccgggagagaagaaaaaaggagatgacactaggaaatatgttgagacttggacagtgatgtttgcaatgaataattttcgtgtatgataatacttcatgataagatacattgacatatggatgtgaatttcgtgctgatacgtatttaatggtatcgttaaatgtcagtatatttttctttcttgttgcacattttgttttcacctgaacactgaac

SEQ ID NO: 8192 - DNA, 1835 bp, Cichorium intybus
aaagggatttccgccttgatttattcttgttagattcccccacttcgatctaacttcaaattatcttcactcgtatcccttcatccattagttctagggttttaactttcaaccgatccatttactttgttcgtctgtatcttaggagcgatatccagaatttccttacttggggttttaagtttctagcattgctagacttcatcaagtgcaattgtttcctcacaaatcttcataccaaagttcggtgtagattttggtgtggaggctttgtatctcgcgggtttgtggtgtgggttttgatggatctgagtgcattttggagatcttagcttttgatgccgggaaaattcttcaactaatttcacagaggctatttatttgtttccacttaagctttattcgtttgggaattcatcatggatcatgtgattggtgggaagttcaagcttggcaggaagattggtagtggatctttcggagagctttatttgggagtaaatgttcaaagtggagaagaagttgctgtcaaattggaatctgttaaaaccaaacacccacaacttcactatgaagccaaattgtacatgcttcttcaaggaggaactggtgtaccccaccttaaatggataggagttgaaggcgaatacaatgctatggttattgatcttcttggaccaagtttagaagatttattcaattattgtaaccgaaaattcactttgaagacagttttaatgcttgcagatcaattgataaacagagttgaatatatgcattcaagagggttccttcaccgtgatataaaaccagataactttttaatgggtcttggacgtaaggcaaatcaggtttacattatagattatggtcttgcaaaaaagtatagggatctccaaacacacaaacatataccatacagggaaaacaaaaatctcactggtactgctcgttatgccagtgttaatactcaccttggagttgagcaaagtagaagggatgatttggagtctcttggttatgtgctcatgtatttcttgagaggaagccttccatggcaggggctaaaagctggcactaagaagcaaaaatatgataaaattagtgaaaagaaaatgcttactcctatagaggtgctatgtaagtcttatccgactgaattcatatcatattttcattattgtcgatcacttcgatttgatgacaaaccggattattcatacttgaagaggctttttcgtgatctttttattcgagaaggttatcagtttgactatgtctttgactggactattttgaagtaccctcaaattggttcaggttccagttctagaggacggacggttggcaaactaccactgaatcccgggccttctgcagacaaggtggaaaaaaccccagtgagacactcaggggcagttgaggcatttactaggcgtaatatttctggaagtggtttacatggtgaacactcaaggcacagatcttcagaacatgccacgtcatccaaagaaatgcatgctgactcagatagaggccgaatttcacgaaccggtagcacttcaaaaagagcagtagtctcaagcagcaggccgagttcatcgggcgagccaagtgagggtcggtcaaaccggttaggttcgggcagcgggcggatatcaactgcccaaagactccactctcagcctggattcgagtccaaatcatcatctttcacacgggcagtgccatcttcaagaggcggtcgtgatgatgctttgagaagctttgaattgctaactatcggaaaaaggaaataaaaagagaaattttggatttgcgtgtgggacccgttt

SEQ ID NO: 8193 - DNA, 2276 bp, Gossypium hirsutum
accttgaaaatgcagcttgatggtcccaaaacgtttgccttggttcactgattaatgggtattccgtagtttctcagtcaagtttgcttcttttgtttattatccttttagtcactaaagaggttaacgcctttttgttcttttaagggagcttttataaggattttagaaactgggttttgatctctggagttgatagttaataattttgatcgatctgagaactagtttaaagagaaggatagtgagtcaatttgtcaatattagtttagtgaaataagaggcaagggtgtttttctttccctttattgtgatatatagttgagtgtgcaaagtttattaagattagatcatggaacacattattggcggaaaattcaagcttggtcgaaagatcgggaatggatcatttggtgaactttatttaggcgttaatgttcaaagtggagaggaagtggctgttaagctggaacctgtcaagaccaaacatcctcaacttcactatgagtcaaagctgtacatgcttcttcaaggagggactggtattcctcatttaaaatggtttggagttgagggtgaatacagtattatggtcattgatcttcttggaccaagccttgaagatttgttcaactattgcaaccggaagttttctttaaaaacggttttgatgctggcagatcagttaataaatagagttgagtatatgcactctcgtggttttcttcaccgtgatataaagcctgataattttttgatgggtttagggcgcaaagcaaatcaggtatatgtaattgattatggccttgcaaaaaagtatagggatcttcaaacgcacaagcacgtaccatacagggaaaacaagaatcttacaggaacagctcgatatgcaagtgttaacactcaccttggagtcgagcaaagcaggagggatgatctcgaatctcttggttatgtgcttatgtacttccttaggggaagccttccatggcagggtttgaaagctggtaataaaaagcagaagtacgacaaaattagtgaaaagaagatgcttacccccatagaggtcctttgcaaatcatattcttctgagttcacatcgtacttccattattgccgatcactacggtttgaagacaaaccagattattcatacctgaagaggctattccgggaccttttcattcgagaaggttatcagtttgactgcgtatttgattggaccatgctgagatatccacaggctgcctctagctcaagagtacggccaagcccaaagccgggtttaaatcctcaaggagtatctgctgaaagaaccggaaggccttcagttggtcaagagattcgagaaaggttctctggtgctgttgaggcatttgcaagacggaatggatcagggcatggtgatcagtctagacacagatctcccgacaatgcgctatcatccaaagacacgcaacctggttctgatagggctcactcttcctcaagaaatggtagtacttcaaagaggcctgttgtatcaggcagccgacctaactcctctggtgagcctagtgacaaccggtctagcagattgatctcaagcagtggtcgcctgtcaacaactcagagagttcaacctgggtttgaatccaaatcatcaacttttactcgtactgcagccacgagaagtagccgcaacgatgcccttaggagctttgagttcttgacaatcgggagcgggaaaaggaaataaacagcactacacatctagtaaggatttgcttgtcttgagggagatctccgcactatttcggtatctacaaacagtttactcttgtgtatcagtgcccacaatttggttccatcaagaaccgcaacaatctccttgtgcaccctttcaggtattctcactagtatcatgcccctctagattgtcattgaagaaaaaagagaggaatgatatcatgctcaccttagggaaaattgttcatatattttccaagtttcaacttttattctagctgtaataaaacacttgatgtttcttttatttcattagaagcaaacaagaagaaatgcctgaaaagtatattatagcaaagacactatggcttttatgtgtcatctacattggaagtattgttctcttcaagtccttcgaggttttggttcgacccaaggaccatttttcgcaacataagtattaagtactgggctaagtttgtaatttactggtaaaaaaaatggatgctgctatgattaaaaatttaacatgggctatgttggttatc

SEQ ID NO: 8194 - DNA, 2587 bp, Rosmarinus officinalis
acacacacgtatatgtatatataaatacccacacccatatcttgaactgatattcatgagatagccacaaatgttatcaatcagagcagtctgaatttgctcttcaattcttgtctctgttctcccctcacacggatccttcccagaatctattaactaaaattttcaccgctacttttgtctccttcagattcttctttctctctcttagtttctcgccttccacatccgacatcttgctattgaaatacttctccacttctgtaaaacattcctcaattgatttttaattccggataaaaggagaaaaaattctggggttttgcttgccaagtcccagatgttgactttgcgtgcccaaatttgtgtagtttccccttttgcagcggtatcttagctattacttcagtccctgttgttttctaactttcaagtaacgaagatttgatttttttttcttctatacatagtgtatgtatatttttgggtttatgtgatatcgaattcgaaagagctcgtgtattttcgattagggtattttttctgggtgcctttttgtatcgtttactttaataggatctgaagggtgtctgcagaaatttgggtttttgattatttattagggattttccaaatatcgtgatacattaagctgtgcatcgtgaaataaaaggagattcattttttgtattgattttctgggagaattttggattaatttctaaaaaccaagtatggatcatgtcatcggagggaagtttaagctgggaagaaagattggcagcggatcttttggagagctttacttgggagtaaatatacaaactggagaagaagttgctgtcaaactggaatctgttaagactaagcacccccaacttcactatgaatcaaagttgtacatgcttcttcaggggggaactggtattccccaccttaaatggtttggagttgaaggagagtacaatgccatggctattgaccttcttggcccaagtttggaggatttgtttaactactgcaacaggaagttctcattgaaaacagttcttatgctagcagatcaattaataaatagagttgaatacatgcattctagaggttttcttcatcgtgatataaagcctgataacttcttaatgggattgggacgcaaagccaaccaggtgtacatcattgactatggacttgctaagaaataccgagatctacaaactcacaagcatataccttacagggaaaacaagaatctcactggcacagctcgttatgctagtgttaacacccatcttggagttgagcaaagcagaagggatgatttagaatctcttggctacgtccttatgtattttctaagaggaagccttccttggcagggactaaaagctggcacaaaaaagcagaagtatgacagaatcagtgagaaaaagatgcttactccagtagaagtgctctgtaaatcttatccgtcagagttcatttcatatttccattattgtcggtcattgcgattcgaagacaagcctgattattcttacttgaagagacttttccgagacctctttattcgagaaggttatcaatttgattatgtgtttgattggacaatcctgaagtatccacaagttggctccagttctaaaacaaggccaacaggaaaaatccctttaaacctcggacagcctgcagaaagagttgagaaggctccagtgaagcacgagattcgggacagattgtccggtgcaatggaggcatttggcagaaggaccggttctagtgcaggcttgcatgcagatagctcgagaaacagatctgatgaagtaccaccatctaaagacgtgaaaattgactccgaaagaggtcggctttctcggactggcagcagctcaaagagggcggtcgtgtcaagcagcaggcccagctcctccggtgaacccagcgacaatcgtcacagtcggctcggctcaggcagtggacggatatcaaccactcaaagattacaaccaggattcgagtccaaatcctcatctttcactcgtgctgctgcaagaggcgtccgagacgaaactctccgtagcttcgagctgttgacgatcggcagtgggaagaagaagtaacaggctaccatatatatctcatttcagctttgtccgaggccaaactatggtatggcatcatctcaccactctcctcggtcgatatggctccggatactgtctgcggatgcgacgacatcaccggtcagtttcccatggagaaaccctaaatcttttcttgaattattttcttgacttattcttgcttcgatacatcacgtacgtataaatcgacgaagacgaatgtattgattttgctaagtggaactactactcttcatgtttgtgattctactgtaattcaaataattaccgtctccgcaactggttgtatcaagaatgctatgctaccatgttagtgcctgaaggcgcacttgcttgctatattcttcttgtaaactctacttgtttgtttcagccgttttgctttggaaatttgtgaaattatgtaacgttttgatctttaaatgttaaggtttttgaaattattc

SEQ ID NO: 8195 - DNA, 2114 bp, Valeriana officinalis
attctactgtctcctccatttcctctctctatcttcttgctcagatccttcgccatatccaaatacctcaaatttcatcatctctttcgtttttctgttacgctaaactactgctttatattccgtcatttcgatttacatgtaattgcacatacatccgatttcttcaccaatcttttctactaacttatcccatcccaaattttaggtttgatttagggttccgatgactaaattctagggttttcaactagagatttgttcacactaccttcttctgaggctgtaagactacaatccctttcaccgttttttgtaaagtatgtttctttcctcaatttagagattagggttgcttttagcggtgtttactgtattatcccaaactgtgaagatttttgagtgattttctccggtggattttagtggatctgaagatttgagctttacagttcgtgatattgtgcgtttagaccttaagtttgattgaagtaaatcaattaaggatttcagtatggatcatgtgattggtggaaaattcaagcttggccggaaaattggcagtggatcatttggcgaactctatttggggataaatgtacaaacaggagaagaagttgctgtcaaattggaatcggctaagactaaacatcctcaactgcattatgaatccaaactgtacatgcttcttcaaggaggaactggtattccgcatctaaagtggtttggagttgaaggggaatacaatgcgatggttattgaccttcttggtcctagcttagaagaccttttcaactactgcaaccgaaaactcactttaaagacggttttgatgctggcagatcagctaataaatagagttgaatatatgcactcaagaggttttcttcaccgcgatataaagcctgacaactttttaatggggttaggacgcaaagcaaatcaggtgtatgtcattgattatggacttgcaaagaagtatagggatcttcaaacacataagcatataccttacagggaaaacaaaaatctcacaggaacagcccgttatgcaagcgttaacactcaccttggcgtcgagcaaagtaggagggatgatcttgaatctcttggttatgtgcttatgtattttctgaggggaagtcttccctggcaaggtttgaaagctggcactaaaaagcagaagtatgacaaaatcagtgagaagaagatggttactcctattgaggttctttgcaaatcttacccatcagaattcatatcttatttccactattgccgttcattgcggtttgacgacaaaccagactattcttatttgaagagactattccgtgatctttttattcgcgaaggatatcagtttgactatgtgttcgattggactatactgaaatatccgcaaattggctccagttctagagcaggacggccaactggtaaattagctttgaacccgggaacatcagctgaaagagcagaaagaacaccggtgaaacgagaaagcggacgagatagattatcaggtgcagtcgaggcatttgctagaaggaatggttcttcatcaggcatcgccttgcacgctgaccactccacccgacacagaacgcctgacgctgtcccttcatcgaaggaagcgcttgcctctgactctgacagaggccgtatttctcgaacaggtagtacctcaaagagggctataatgtcaagcagcaggccaagctcgtccggtgagcccagtgagagccggcttaaccggctcggctcaggtagcgggcggatctccacgacccagcgggtccaacccggatttgaatccaaatcatcctcattcacacgtgctgctgtcggaggaacaagaagcggaggaggccgcgatgatgctcttcgaagctttgagctgctgacgattggcagcgggaagaggaagtagcgaacgcggggcccacgtgttatttgttcgtgagttcacgttgaaaacatcgggagctctgaaattgaggtttgttgtaagtgcggaactaaataatatactgtatttttctgtttgttgccacaaactactcgaagcaaaagaagaaaaaatgtgatttttaaagcacgacttttgtttt

SEQ ID NO: 8196 - DNA, 2606 bp, Solanum lycopersicum
agcttaatatttttcttgtataatcccattttctccatttttcttctttttcatcttcttcttcttctcttctcttacacagaaaaaaaaaattcccataaattttccgcagatttcgttttcagttagattctctcttctcccctacccccaaaatccccattttattttgtagcttactgtatttttccatttccatttcttctgtcatttacttcttcttttttttttgaatttttttttcaagaatccaaaaccccttttaagctttttcatttctcatcaagttgtaatttttgtgtcattcattggattattcttttatttctttagagaaaaagggggacactgttgtttaggaaaaatagttacttgttttaagtgttttccatatatatagaactgatattaggctttagggtttttgaagatttttcatctggggtgcctcaaagaagtgatttttttgtatttttgttctttggggtaaggtagattttgctggatctggggtaatttccagattttaatttcctgactatttgtgggagtagtggttgataattgatatttgtttggtttgattgggtttgttgaatctttaactatggatcatgtggttggtggaaagtttaaactgggacgaaagatcggtagtggatcttttggggaactatatttaggggtaaatgtgcaaactggagaagaagttgctgtgaagctggaatcaactaaaacaaagcaccctcagcttcattatgaatcaaagctgtatatgcttctacaaggaggaactggaattccacacctcaagtggtttggcgttgaaggtgaatacaatgccatggttatcgaccttcttggaccaagtttggaagacttgtttaactattgcaataggaggttcactttaaagacagctttaatgctggcagatcaactgattaatagggttgaatatatgcactcaagaggatttcttcaccgtgatattaagcccgacaacttcttaatgggtttagggcgtaaagcaaatcaggtatacatcattgactatggtcttgccaagaaatacagagatcttcagacacacaagcatataccatacagggaaaacaaaaacctcacaggaacagctcgttatgctagtgttaacacccatcttggagttgaacaaagcagaagagacgatctggagtctcttggttatgtgcttatgtattttttgagaggaagtctgccatggcaaggtctgaaagctggcaccaaaaagcagaaatatgacaagattagtgagaagaagatgcttacacctatagaggtgctttgcaaatcctatccctcagaattcatatcatattttcattattgccgatcattacggtttgatgacaagccagattactcatacctaaagaggctattccgtgaccttttcattagagagggttatcaatttgactacgtgtttgattggactatcttgaagtatccccagatcggctccagttcaagagcacgacaacctattgcaagattacctgtgaatccgggaccatccattgaaagaccagaaaagatccctgtgaggcaggaaatcaaagataggttttctggtgctgtggaggcgttttctagaaggaacgtgtctggaactggtttgcaaggggaccatttgagacatcacagatcatctgacgatgtaccatcatctaaggatgtgctgatgctgaaagaggccgtgtatctcggactggtagcacctcgaggagggctgtaatgggaagcagccggcccagctcatctggcgaacccactgacaatcgctctggtcgcttgggttcaagcagcggccgtatttccactacccaaagagtacaacctggatttgaatccaagtcttcatcttttacccgcgctactgcaacaagagggggtagggatgatgctcttaggagctttgagctactaactattggcaccggaagaaggaaatgaggctatataatgtctaatatctacccccaagttgagcagctatcttcaaggacttaccaacaagcatgcactgattcttgcaatttaacaaacttgctaaactttcaagagatagaggggtgtttctgttttgtatatttgagaatacctctctaatgtgatgttgtagaccgggatctctctcgaaaaataaaaatatttcacatctggccattgctcccctgatgtgcatggctgctatgcttgcgaacggggaggatgttaatggcgaaagtaaatagctcatggttatgcagtgtagctccgattacttaaggggctacctcagtacttcctcttagttgtgtggttcttgtgcccagaattgttatcatatacttttatgttatgtaccctctaatttttcttcctatattaacttgttactatgaacgtgtgttgtcttattacgtgttgtttcctttgcttcggttactgtactcttctccattatactcgacacgaaaaaaattacgcggttaagtaaatttataccattataactatagttggctgtaagtaccacttacgactaacattatacattaattgtgtgggccgacttcgag

SEQ ID NO: 8197 - DNA, 2409 bp, Nicotiana benthamiana
tataccattttccctatttctccttcatcatcttcttcttctctccctctctttgaatcaaattccctttagttttccacaaatttcgtttccattagattctctctctcctctctctcttattttcccttctctttcccattccatttccatttcctctctaattctttttttcaagaatctttttttctttcctcatattatcttcccagatttagggtttctcttcaacgctataaattttttgttgcattttttgcccattcattgtattattcttttattttattttttttaattaaaaaggggagacttttgttgaaaaagatacttgttccaagtgttttccatatatatgactgatattaggtattagggttttgaagattttttgtttgtttctggtgtcaccggaaagaagtcatttttggtaatttcttttgtttttttctggatctgagggtaatttcaagatttaaacctgtttagttgaattgggtttaagtgaaatcaagaaaagattcaatctttgagtatggatcatgtggtaggtggcaagtttaagctaggccgaaagatcggtagtggatcttttggggaactttatttaggggtcaatgtacaaaccggagaagaagttgctgttaagctggaatcaactaaaacaaagcaccctcagcttcattatgaatcaaagctgtatatgcttctacaaggaggaactggaattccacacctcaagtggtttggcgttgaaggtgaatacaatgccatggttattgaccttcttgggccaagtttggaagacttgtttaactattgcaataggaggttcactctaaagacagtgttaatgctggcagatcaattgattaatagagttgaatatatgcactcgaggggatttcttcatcgcgacattaagcctgacaacttcttaatgggtttagggcgtaaagcaaatcaggtatacatcattgactatggtcttgccaagaagtacagggatcttcagacgcataagcatataccatacagggaaaacaaaaacctcacaggaactgctcgttatgctagtgttaacacccatcttggagttgaacaaagcagaagggacgatctggagtctcttggttatgtgcttatgtattttttgagaggaagtctgccgtggcaaggtttgaaagctggcaccaaaaagcaaaaatatgacaagattagtgagaagaagatgcttacacctatagaggtgctttgcaaatcctatccctcagaattcatatcatattttcattactgtcgatcattacggtttgatgacaagccagattactcatacctgaagaggctattccgagacctttttattagagaaggttatcaatttgactacgtatttgactggactatattgaaatatccacagattggctctagttcaagaggacggcaaactactgggagattacctgtgaacccaggaccatccgctgagagagcagaaaagattcctgtgaggcaggaaattaaagataggttttctggtgctgttgaggcgtttactagaaggaatgtgtctggaactggtttgcaaggggaccatttgagacaccacagatcttcagacgatgtaccatcatccaaggacgtgcaagctgatactgaaagaggccgtgtaactcggactggtagcacctcgaggagggctgtcatgggaagcagccgaccaagctcatctggtgaacccactgacaatcggactggtcgattgggttcaagtagtggccgtatttccactacccaaagagtgcaacccggatttgaatccaagtcgtcatcttttacccgcgctactgcaacaagaggcggtagagatgatgctcttaggagctttgagctgctaactattggcactggaagaaggaaatgagaggctatatgatgtctaaaatctgccccttcaagctgagcagcagattgagcagctttcattaagcacttccccacaatcgtgcactgattcttgcaatttaacagacttgctaaacattcagagataggaggctgtttctctgtttgtatatttgagaatgcctctctaatgtgtgatattgtagaccgggatgtctcgaaaataaaaatatttcacatctctgtaaattgcctaatgcagagatgagcatagctcccttttttttcctgatgcatggctgctatttttgcaaatggggaggaagtttagtggaaagtaaatagttcattgttatgcagtgtagttccgattactttaggggctacctcggtactttttcttagttgtgtggttcttgtgccaagaaagatattcatttactttatgtaatgtaccttaaatttcttctatccaatcttatatgattgttgctatgg

SEQ ID NO: 8198 - DNA, 1626 bp, Tabernaemontana elegans
aaaggttggtagagaaagtaatatttatcgagggatttaatgatggatcatgtgattggtggcaagtttaagcttggtagaaagattggtagtggatcctttggagagctctatctgggagtaaatgtgcaaactggtgaagaagttgctgtgaagcttgaaccacttaaaactaagcatccacagcttcactatgaatccaagttgtatatgcttcttcagggaggaactggtgttccccaccttaaatggtttggagttgaaggtgaatacagtgcaatggttattgaccttctcgggccaagtttagaagatttgtttaactactgcaatagaaagttcactttgaaaacagttctaatgcttgcagatcaattaattaatagagtggaatacatgcattctagaggttttcttcaccgcgatattaagccagacaacttcttaatgggcttagggcgcaaagcaaatcaggtatacatcattgactatggtctggcaaaaaagtatagagatctccaaacacacaaacacataccttacagggagaacaaaaatcttacgggcactgcacgttatgcgagtgtcaatacacatcttggagttgagcagagcagaagggatgatttggagtctcttggctatgtactaatgtactttctcagaggaagccttccatggcaggggttgaaagctggcactaagaagcagaaatatgacaaaattagtgagaagaagatgttaacgccgattgaggtgctctgcaaatcttatccatcagaattcatatcctattttcattattgtcgatcgctgcggttcgatgacaagcctgattattcatacctcaaaagacttttccgggacttatttattcgggaaggttatcaatttgactatgtctttgactggaccatattaaagtacccacagattgcctcaagttcgagaggacggcagccaatgggaagattgcctttaaatggagggccatctgtggaaagagtagagaagaatgcagtgagacaggaaactcgggatagattctctggtgcagttgattcatttaatcggaggagtagttctggggctggcttgcatggggatcccacgaggcacagatcttcagaagatgttccatcatccaaggatgtgcaagcggattctgaaagacgtctgacccggactggtagtagttcaaagagggctgttatgtcaagcagcagaccaagctcctcaggtgaacctagtgaaaatcgtactagccggctaggctcaggcactggccgtctgtcaacaacacaaagaattcagcctgggtttgaatccaagtcatcatctttcacgcgggttgctgcaccaagaggcaaccgtgatgaaacccttcgaagctttgaactgctgaccattggctcagggaaaaggaaatgaaaagttctcttataatatggtatccgcccatcgcaaaggtccaattgagtttcatcagcagagttgctaatgcctaaaccttcctttttatttaggataagtcttgtccgcctatgtttttggttcgattatcgtataaaaagtttctattaccgtactgtattcacagttaaacgccataaattgtactctccc

SEQ ID NO: 8199 - DNA, 2418 bp, Solanum phureja
catcttcttcttcttcttcttctcttacacaggaaaaattcccataaattttccgcagatttcgtttctgttagattctctcttctcccctcccccccaaacccccatttttttcagcttcctgtatttttccatttccatttcttctgtcatttcctttttcttttttcttttttgaaaatcttttcaagaatccaaaatcccttttaagttttttcatttctcatcaagtttaatttttgtgtcattcattggattattcttttatttctttagagaaaaaggggggagactgttgtttggaaaaaaaaagttacttgttctaagtgtttccatatatatagaactgatatcaggctttagggtttttgaagatttttcatctggggtccctcaaagaagtgattttttggtatttttgttctttggggtaaggtagattttgctggatctggggtaatttccagattttaacttcctgataatttgtgggagtagtggttgataattgatatctgtttggtttaattgggtttgttcaatctttaactatggatcatgtggttggtggaaagtttaaactgggacgaaagatcggtagtggatcttttggggaactttatttaggggtaaatgtgcaaactggagaagaagttgctgtgaagctggaatcaactaaaacaaagcaccctcagcttcattatgaatcaaagctgtatatgcttctacaaggaggaactggaattccacacctcaagtggtttggcgttgaaggtgaatacaatgccatggctatcgaccttcttggaccaagtttggaagacttgtttaactattgcaataggaggttcactttaaagacagctttaatgctggcagatcaactgattaatagggttgaatatatgcactcaagaggatttcttcaccgtgacattaagcctgacaacttcttaatgggtttagggcgtaaagcaaatcaggtatacatcattgactatggtcttgccaagaaatacagagatcttcagacacacaagcatataccatacagggaaaacaaaaacctcacaggaacagctcgttatgctagtgttaacacccatcttggagttgaacaaagcagaagagatgatctggagtctcttggttatgtgcttatgtattttttgagaggaagtctgccatggcaaggtctgaaagctggcaccaaaaagcagaaatatgacaagattagtgagaagaagatgcttacacctatagaggtcctttgcaaatcctatccctcagaattcatatcttattttcattattgccgatcattacggtttgatgacaagccagattactcatacctaaagaggctattccgtgaccttttcattagagagggttatcaatttgactatgtgtttgattggactatcttgaagtatccccagatcggctccagttcaagagcacgacaacctattgcaagattacctgtgaatccgggaccatccattgaaagaccagaaaagatccctgtgaggcaggaaattaaagataggttttctggtgctgtggaggcgttttctagaaggaacatgcctggaactggtttgcaaggggaccatttgagacatcacagatcatctgacgatgtaccatcatctaaggatatgcaagctgatgctgaaagaggccgtgtatctcggactggtagcacctcgaggagggctgtaatgggaagcagccggcccagctcatctggcgaacccactgacaatcgctctggtcgcttaggttcaagcagtggccgcatttccactacccaaagagtacaacctggatttgaatccaagtcttcatcttttacccgtgctactgcaacaagagggggtagggatgatgctcttaggagctttgagctactaactattggcactggaagaaggaaatgaggctatatgatgtctaatatctacccccaagttgagcagcagattgagcagctgtcttaaggacttcccaacaagcatgcactgattcttgcaatttaacagtcttgctgaactttcaagagatagaggggtgtttctgttttgtatatttgagaatacctctctaatgtgatgttgttgaccgggatctgtctcgaaaaataaaaatatttcacatctggccattgctccccttttttccactgatgtgcatggctgccatgctcgcgaacggggaggatgttagtggtgaaagtaaatagctcatggttatgcagtgtagttccgattacttaaggggctacctcagtactttctcttagttgtgtggttcttgtgcccagaaagattttcatatactttatgttatgtaatgtaccatctaatttttcttcctatataactagttactatgaacttgtgttgtcttatt

SEQ ID NO: 8200 - DNA, 2099 bp, Panax ginseng
attgttttctcaaacacattttcgtcttttttatctgtgtttgattcctcgatcctcgctcatttgttccccacccattttcttcattccttagaaattttatttgctctaatcaatgacgttggatatgatgtttctgaaattagtatttttatttatcatcccttgttgatgatatagggtttgcaataatccaaggatgtagttcgataaggtggtcaggttattgattgtgaatttgctcaacaaatttcaaatttgttgccgttagaatctgtacggcgtaattacattttgatccgttggcatctcaatttggttaattgacagagttatggagggttgaattatatggcgtgtttggtttagcccgaattggtgttaaattaggtacagatctgagtagaggtaggttcagaaagaggattgtagaattatggatcatgttatgggtggaaagtttaagctggggaggaaaattgggagtgggtcttttggtgagctttatttaggtattaatgtacaaagtggagaagaagtagccatcaagctggaatctgtgaagactaagcaccctcaacttcactatgaatcaaaaatttatatgcttctacagggaggaacggggattcccaacctcaaatggtttggagtcgagggtgagtacaatgtcatggttattgaccttcttggcccgagtttggaagatctgttcaactattgcaacagaaagttctcactgaaaacagtattgatgcttgcagatcaactaattaatagagttgaatacatgcattcgagaggttttcttcaccgtgacataaagcctgacaactttttaatgggcctagggcgcaaagcaaatcaggtatatgtcatcgactttggccttgcaaagaaatatagggatcttcagactcataagcacataccgtacagggaaaacaaaaatcttacgggcacagctcgctatgctagcgttaacacacaccttggagttgaacaaagcagaagggatgatctggaatctctcggttacgtgcttatgtatttcttaagaggaagtcttccttggcagggactgaaggccggcaacaaaaagcagaaatatgataagattagtgaaaagaagatgttaacgcctatagaggtgctatgcaaatcatatccttcagaattcatatcatactttcactactgccgatcattacgctttgaagacaaaccagattattcatatttgaagaggcttttcagggacttatttattcgcgaaggttatcaatttgactatgtttttgattggactatattgaaatatcctcagattggggccagttctagaggaaggaatcccagtgggaatgcaggaccatctgcagaaaggccaggaaggacctcagtaggacaagatattagagagagattctcaggtgctgttgaagcattttccagaagaaatacttcaggtcctggtcgtcatggtgaacactctagacacagaagttcggacgaagtaccttcatccaaggatgtgcaagccgattctgaaaaaggccgaacttctcgaaatggaagctcttcaaaaagagctgccattacaaacagcagcaaaccaagctcctctggggaattcactgagggacgctcaagccgattagtatccagcagtggcagactgtctactacacaaagaatccagcccgggacagagtccaaaccaccaacaaattcgcggaatgcagtcacgaagggcactcgggacaatccacttcgtagctttgatttcctgtcaatcaggaagtaaacaccataccatccaaaggaaatctaaacatatatcactcttgtaaatgggaagtgtcgtgacaagtaaaggtcatcttacccgacaatagttcctgctttaattttgttccaaagtttgtggtcattgcaacactttttagactcatcccagtaaggtgatgagttttgtgtacggaattttctttaaaatgtatgaaacatggatgtagctgtaataaactctgccctgatgtatggtatcaccaaaaaaaactattatataattatgttcttaaagatgcatatttaaa

SEQ ID NO: 8201 - DNA, 1880 bp, Nicotiana benthamiana
ttgaatcaaattccctttaattttccataaatttcatttccattagattctctcccttaatttcccttctctttcacattccatttccgtttcctctctaattctttttttcaagaatccaaaaaaccacttaaccttttttctttcctcatattatcttcccagatttagggtttctcttcaacgctataatttttttttgttgcaatttttctccattcattgtattattctttcattttattttattttaattagaaagtggagacttttgttgaaaaatacttgttctaagtgttttctgtatatatatatgactgataataggtattagggttttgattttttttctgggtcaccaaaaagaagtcatttttggtaatttcttttttggttttttctggatctgagggtaatttcaagatttaaacctgtttagttgagttgggtttaagtgaaatcaagaaaagattcaatctctgagtatggatcatgtggtaggtggaaagtttaagctaggccgaaagataggtagtggatcttttggggaactttatttaggggtcaatgtacaaactggagaagaagttgctgttaagctggaatcaactaaaacaaagcaccctcagcttcattatgaatcaaagctgtatatgcttctacaaggaggaactggaattccacacctcaagtggtttggcgttgaaggtgaatacaatgccatggttattgaccttcttgggccaagtttggaagacttgtttaactattgcaataggaggttcactctaaagacagtgttaatgctggcagatcaattgattaatagagttgaatatatgcactcgaggggatttctacatcgcgacattaagcccgacaacttcttaatgggtttagggcgtaaagcgaatcaggtatacatcattgactatggtcttgccaagaagttcagagatctgcagacgcataagcatataccatacagggaaaacaaaaacctcacaggaactgctcgttatgctagtgttaacacccatcttggagttgaacaaagcagaagagacgatctggagtctcttggttatgtgcttatgtatttcttgagaggaagtctgccgtggcaaggtttgaaagctggcaccaaaaagcagaaatatgacaagattagtgagaagaagatgcttacacctatagaggtgctttgcaaatcctatccgtcagaattcatatcatattttcattactgtcgatcattgcggtttgatgacaagccagattactcctacctgaagaggctattccgagacctttttattagagaaggttatcaatttgactacgtatttgactggactatattgaaatatccacagatcggctctagttcaagaggacgacaacctactgggagattacctgtgaacccaggaccatcggctgagagagcagaaaagattcctgtgaggcaggaaattaaagataggttttccggtgctgttgaggcatttactagaaggaacgtgtctggaactggtttgcaaggggaccatttgagacaccacagatcttcagacgatgtaccggcatccaaggatgtgcaagctgatgctgaaagaggccgtgtaactcggactgttagcacttcaaggagggctgtcatgggaagcagccgaccaagctcatctggtgaacccactgacaatcgtactggtcgattgggttcaagtagtggccgtatttccactacccaaagagtgcaacccggatttgaatccaagtcatcatcttttacccgcgctactgcaacaagaggcggtagagatgatgctcttaggagctttgagctgctaactattggcacgggaagaaggaaatga

SEQ ID NO: 8202 - DNA, 2025 bp, Carica papaya
ctggctttagaatttcgatgattttgtgatttcaggattttttttttttaggggttctatttttctgatttaattattagattttgatattcagtggttgatttgaggtataattgaaaacttcgaaatttggtgggtaaattttgttaatcttttcttttgtgagggtcattggctgggtggggatgagattatgcggcaataagtgctttttggcataaatctggtgtgaaatcgtagcgatattgagctcttttgggggtaggttttgaagagagcttgaaaatggatcatgtgatcggtggcaagtttaagctcggaaggaagatagggagtggctcttttggggagctctatttaggtgtaaatgtgcaaactggagaggaagttgctgttaagctggaatctgtgaagactaagcatcctcagcttcactatgagtcaaagttgtatatgcttcttcaaggaggaactggaattcctcacctcaagtggtttggggttgagggagactacaatgtcatggttatcgaccttcttggaccaagtttggaggatctgtttaactactgcaatcggaagttctcgttgaaaacagtgctaatgcttgcagatcaactgattaacagggttgagtacatgcactcaagaggttttcttcaccgtgacataaagcctgacaactttttaatgggcctgggacgaaaagctaatcaggtgtacatcattgactatggtcttgctaagaagtatagagatcttcagacacataagcacataccatacagggagaacaagaacctcactggcactgcacggtatgctagtgtcaacactcaccttggagtcgaacaaagtcgaagggatgatttggaatctcttggttatgtcctaatgtatttcctgagaggaagcctaccctggcagggactaaaggctggaacgaaaaagcaaaaatatgataaaattagcgagaagaaggtatcaactcctttagaggtgttatgtaaatcatatccaactgagtttatgtcatattttcactactgccgatcattgcggtttgaggataaaccggattactcatatctgaagaggcttttccgagacttatttattcgagaaggttatcagtttgattatgtctttgactggactgtgttgaagtaccctcaaattggttccagttccagagcacggcatcacactgggaaacaaggattaacaggtccagctgctgaaaaacaagagaggttttcagttgggaaagagatacgggacaggttctctggggcagttgaagcattttccagaagaaatgtttcaggcactagtccacgtgattattccaaacacaggagctcagaagatggaccttcatccaaacatgtgcatgattcagaaaaaggtcgcagctcttctagatatggaagtgcttcaagaaaagcaattgtttctagcagtaggccaagttcctctggtgaaccaggtgatagccgggcctcaagccgattagtttcgagcagtggtggaggccgcccatctacaacgcagagatcatcccaacctggttatgagtcaaaaacaagcttttctcgtgctgcagcttccagaggccctcgtgaagatgctcttaggagctttgagcttctctcaatccgaaaatgaggggaagtatgatgtttgtaagatgattgccaatgcatgatgcatctactttggaaaaactcttcaaagtggggagctatcatagattccgaattctctcacttctgtatatgggatatcaccaaccaacggcattacaggtcattttgcttccctacagcaaactgtctcaattctttcctattccattttcttccccaaatattttctggccgttgtaacatgttatgaacacatccatgagcgagttcgtgtattggaattttcatatatgaagacttaaacagctgtaataaattctgtttatttgtccatctagtaccgcaaaaatgaatccaatatccatatttgtgtgaa

SEQ ID NO: 8203 - DNA, 1655 bp, Capsicum annuum
attgaagtttagttaaataaagaaaagagtgaatctttttggtgtttttgttgattgttcaatctttgactatggatcatgtggttggtggcaagtttaaactaggccgaaagatcggtagtggatcttttggggaactttatttaggggttaatgtgcaaactggtgaagaagttgctgttaagctggaaccaactaaaacaaagcatcctcagcttcattatgaatcaaaactgtatatgcttctgcaagggggaactggaattccacacctcaagtggtttggcgttgaaggtgaatacaatgccatggttattgaccttcttggaccaagtttagaagacttatttaactattgcaataggaggttcactttaaagacagctttaatgttggcagatcaattgattaatagggttgaatatatgcactcaagaggatttcttcaccgtgacattaagcccgataacttcttaatgggtttagggcgtaaagcaaatcaggtatacatcattgactatggtcttgccaagaaatatatagatcttcagacacacaagcatataccatacagggaaaacaaaaaccttaccggaacagctcgttatgctagtgttaacacccatcttggagttgaacaaagcagaagagatgatctggagtctcttggttatgtgcttatgtattttttgagaggaagtctgccgtggcaaggtctgaaagctggcaccaaaaagcagaaatatgacaagattagtgagaagaagatgcttacacctatagaggtgctttgcaaatcctatccctcagaattcgtatcatattttcattattgccgatcattacggttcgatgacaagccagattactcatacctgaaaaggctgttccgagatcttttcattagagagggttatcaatttgactatgtgtttgattggactatcttgaagtatcctcaaattggctccagttcaagagcacgacaacctgttgcaagattacctgcgaatccgggaccatccattgaaagagcagaaaagatccccgtgaggcaggaaattaaagatagattttctggtgcggtggaggcgttttccagaaggaatgtgtctggaactggtttaggggacaattttagacatcacagatcttcagaagatgtaccatcatctaaggatgtgcaagctgatgctgaaagaggccgtgtatctcgaactggtagcacctcgaggagggctgtaatgggaagcagccgaccaagctcatctggtgaacccactgacaatcgcactggtcgcttaggttcaggcagtggccgtatttccactacccaaagagtacaaccaggatttgagtccaagtcatcatcgtttacccgtgctactgcaacaagagggggtagggatgatgctcttaggagctttgagctgctaactattggcactggaagaaggaaatgaggctatatgatgtctaatatctgcccctcaaagttgagcagcagattgagcagctgtcttaagcacttcccaacaagcatgcactgattcctgcaatttaacaaacttgctaaactttcaagagataaggggggtgtttctgttttgtatatttgagaatgcctctctaaatgtgtgatgttgtaaaccggg

SEQ ID NO: 8204 - DNA, 1989 bp, Panax ginseng
ttacttctctcccatttgatttgttcgttcatatttcattgtctacaatttaatttatatgtatatatatttgttctgatcaatgacgttggatatgatagtttatgaaattagtgttcaatttatcctccgccgttgatgattagggttttcaataatcgaaggatgtagttcgttatttgttgggattttttgtgtttaatttgctcaacaaattttatctgttggcattagaatcagtacagtgtaatgcacatgtcttttatgatccgttgcctctcaatttggttgatttgaacgcgttgtgggggttaaattgtttggtgggttaggtataacccgaattggtgttaaatttggcatagatctgagtagaggtaggtcgaaaaagaggattgggaatcatggatcatgttgtgggggggaagtttaagctgggaaggaaaattggaagtgggtcttttggtgagctgtatttaggtattaatattcaaagtggagaagaagtggccatcaagctggaaactgtcaagactaagcaccctcagcttcactatgaatcaaaaatttatatgcttctccaaggaggaactgggattccgaacttcaaatggttcggagtggagggtgagtacaatatcatggttattgaccttcttggcccgagtttggaagatctattcaactattgcaacagaaaactctcactgaaaacagtattgatgcttgcagatcaactaataaatagagttgaatacatgcattcaagaggttttcttcaccgtgacataaagcctgacaactttttaatgggcctagggcgcaaagcaaatcaggtatacgttatcgactttggccttgcaaagaagtatagggatcttcaaactcataagcacataccgtacagggaaaacaaaaatcttacaggcactgctcgctatgctagtgttaacacacacctaggagttgaacaatgcagaagggatgatctggaatctctcggttacgtgcttatgtatttcttaagaggaagtcttccctggcagggtctgaaagccggcaacaaaaagcagaagtatgataaaattagtgaaaagaagatgttaacacctatagaggtgctatgcaaatcatatccttcagaattcatatcatactttcactactgccgatcattacgctttgaagacaaaccagattattcatatttgaagaggcttttcagggacttatttattcgcgaaggttatcaatttgactatgtttttgattggactatattgaaatatcctcagattggggccagttctagaggaaggaatcccagtgggaatgcaggaccatctgcagaaaggccaggaaggacctcaggacaagatattagagagagattctcaggtgctgttgaagcattttccagaagaaatacttcaggtcctggtcgtcatggtgaacactctagacacagaagttcggacgaagtaccttcatccaaggatgtgcaagccgattctgaaaaaggccgaacttctcgaaatggaagctcttcaaaaagagctgccattacaaacagcagcaaaccaagctcctctggggaattcactgagggacgctcaagccgattagtatccagcagtggcagactgtctactacacaaagaatccagcccgggacagagtccaaaccaccaacaaattcgcggaatgcagtcacgaagggcactcgggacaatccacttcgtagctttgatttcctgtcaatcaggaagtaaacaccataccatccaaaggaaatctaaacatatatcactcttgtaaatgggaagtgtcgtgacaagtaaaggtcatcttacccgacaatagttcatgctttaattttgttccaaagtttgtggtcattgcaacactttttagactcatcccagtaaggtgatgagttttgtgtacggaattttctttaaaatgtatgaaacatggatgtagctgtaa

SEQ ID NO: 8205 - DNA, 1801 bp, Silene vulgaris
gggtaagattttaggtaattatataagagagtataagtttaagttacttaggttttgtgtgatcatggatcatgtgattggtggaaagtttaagcttgggagaaagattggaagtggttcatttggggagctttatttaggtatcaatgtgcagactggtgaagaagtggctgttaagctggaatctgcaaagacaaagcaccctcaattgcattacgagtccaaattgtacatgcttcttcagggaggaactggtattccacatatcaagtggtatggagtagagggcgagtataatgttatggttattgaccttcttggcccgagtttggaagacttgtttaactactgcagccgcaagttttcgttgaagacagttctaatgcttgctgatcaaatgatcaataaagtggagtacatgcactcaagaggttttctgcatcgtgatatcaaacccgacaactttttgatgggcctcggacgtaaggcaaatcaggtgtatgtcattgattttggacttgcaaaaaagtttcgcgatctacaaacacacaaacacataccttacagagagaacaagaatctcacgggcactgctcgatatgccagtgttaatacacatcttggtgttgagcaaagcagaagagatgacttggagtcccttggttatgtgctcatgtatttcttaaggggaagcctcccatggcagggcttgaaagctggtaccaaaaagcagaagtatgacaaaatcagtgaaaagaaaatgctcaccccaattgaggtactttgcaaaaattatccatcggagttcacatcatacttccactactgtcgctctttaagatttgatgacaagccagattattcgtatcttaagaggctattcagggaccttttcatcagagaaggttaccagtttgactatgtatttgattggacaatactgaaatacccacagattggttctagctctcgaacaaggccggctctcaaaccagctttaactccagggccatctgcagaaagagctgagaggacttcagtgggacaagaaattcgagatagagtttcaggggctgttgaggcattcgctagaagaaatagtcaggtctctgggttgcaagttgatcaatctcgtcatagatcactaggcgatccatcttccaaggatatgcaaggtgaacttgaaagaggccgcagttctcgaaatggcagtacttcaaaaagagcagttggttcaactagtaggccaagctcctctaatgggcccagtgacggccgatcaagccggctgttggcaagcagtggtcatgtttctacaactcaaaggatacagcccgggttagagtcgaaaacatcttctcgtacacgagtctctgcaacaagaccaggccgagatgatacattacggagctttgacttcttgtctattggtacgggtcgaagaaaatgagggtaatgtcgttttccggggtgcatctaccccaacaaaatgaggaatcaaaatcaagcatttcaacttgtttgttttggtgaaagtgtcgcctgtttgggttactcaagaatggtaaactttcgaagttcttctgaatccgtgcttgaagagcttaacaaatactttcattttactgtagcaatgttagtgttcttgcatgtattttcttcgccaaacaccatgtaaaacagctcactgtgctcgcttggggagagaggaaaacgaaatcatgttaaagaaattgtttatatgttaagtttggaatatttgcgattgtaataattggttacagtatactttatggtcgat

SEQ ID NO: 8206 - DNA, 2057 bp, Nicotiana benthamiana
aaacaatcattctttctttactcactccgccccttagcttttttcacaacacacactgcacaaatcaattcatccctttctatcttttcccttttttggtgtaaaaaaaaaaagcgctttgttttttctctttttccttaaacttcgctaatttgtcccctttcttctttttattttatctgccaatagagcagaacaaaagaaaagacatatgtacacagttcttgcatgtaattatcggttcgcacattgattatacatttttttattgcaatcaatgtagatcggtttattttggttgtcaattagggtttcaatttcttgtcggtacttgaatattgtaagggtttgtatttattaaacgatagttcaataattaattttttttaatcggtaaccttattggttcttcccattttttctgagttaaactggtgctttccatttctgggtttttggtatttgatccatagttgtgtatttaggatagatttatgggtaaaaattttattttgggtttttgggatttggtgtattaggtgaaagtcctagtaaaagcgtgtgattgttgccttttattatttggttatcgaaatgttgaagtgaagttgtttagtttacgatggatcatgttgcgggtgggaagtttaagctgggaaggaagatcggaagtgggtcttttggtgagctttatttgggtgtgaatatacagaatggagaagaagttgccattaagctggaatctgtcaagacaaagcaccctcaattgcactatgaatcaaaaatatatatgcttctttcaggaggaactggaattcccaatcttaaatggtttggagtcgaaggcgagtacaatgtaatggtcatagaccttcttggaccgagcttggaagacctcttcaactattgcaataggaaactttcattgaaaacagttttgatgcttgcggatcagctaatcaatagagttgaatacatgcactcgagaggatttcttcaccgtgacataaagccagacaacttcctaatgggccttggtcgcaaagcaaatcaggtgtacgccatcgacttcgggcttgccaaaaagtatagggacctgcagactcacaagcatataccgtacagggaaaacaagaatctgacaggcacagctcgctatgccagtgtcaacacacaccttggagttgagcaaagtagaagagatgatttggaatctctgggttatgtgcttatgtattttcttagaggaagtcttccgtggcagggattgaaagctggtactaagaagcagaaatatgataaaatcagtgagaagaagatgttgactccaatagaggtgctatgtaaatcatatccgtcggagttcatatcatacttccattattgtcggtcgttacggtttgaagataaacctgactattcatatctgaagaggcttttcagagacttgtttattcgtgaaggttatcagtttgactatgtatttgattggaccattttgaagtatcctcagattggtgccagttctagaggacgtaatattagtggaagtgtgacactaaatgctgggccatctgctgaaagaccgggaagggcatcagtgggacaggatatccgagacaggttttctggtgctgttggagcatttacacggaggaatgcttctggctctggcaggcatgacgaatactcaagatacaagacttcagatgatataccttcatctaaagatgtgcaatttgattcagaaagagggcgtacctcaagaaatggtagctcgtccagaagggctgccatttcaagtagcagaccgagctcttctggtgaacctactgatagtcgctcaagcagattagtgtcgagcagtggccgcttatcttccacacaaagggttcattctggagttgaaccaaaaccatcattttcacttgcaaagggcagccgtgatgaccctcttcggagctttgagcttctttcaatcagaaagtaaagagaaattttctcgttgttgaatcttgtaatcctataataggatgtctccgtgctgtaaattgaaa

SEQ ID NO: 8207 - DNA, 1987 bp, Solanum phureja
cgtggaaaaaaataaagctgcttttgtttttctctttttccccaattgtcgctaatttgtcccctgtttttcttcatctgcaaatgaagctgaaccaaatcaacaaaaatacatgtatatatcggttcgcacattgattatgcaaaaaaaaattgatcaatggggatcggtgatttttgttttgtaaattagggtttcaatttcttgtcggtatttgaaaattgtaacggagttttatttattgacaatcttaattggttctgagttgagaatcatagctcaagattagttttttaagttgaaaacgataattggtgttttccatttctgggatttgatccataacgggaagttttttttggatttttggggttcttttttttgttacctatattgggtggaaattcgaataggaacgtgtgattgttgctgttgaaatatttggttgtcgaaatcttgaagtggagttgttcagttaccatggatcatgttgtgggtgggaagtttaagttgggaaggaagatcggaagtgggtcttttggtgagctttatttaggtgtgaatttacagaatggagaagaagttgccattaagctggaatctgtcaagacaaagcaccctcaactgcactatgaatcaaaaatatatatgcttctctcgggaggaactggaattcccaaccttaaatggtttggagtcgaaggcgagtacaatgtaatggtcatagaccttcttggaccgagcttggaagacctcttcaactattgtaataggaagctttcattgaaaacagtgttgatgcttgcagatcagctaattaatagagttgaatacatgcactcaagaggatttcttcaccgtgacataaagccagacaactttctgatgggccttggtcgcaaagcaaatcaggtgtatgcaattgactttggacttgccaaaaagtatagggacctccaaactcacaagcatataccctacagggaaaacaagaatctgaccggcacagctcgctatgcaagtgtcaacacgcaccttggagttgagcaaagtagaagagatgatctggaatctctgggttatgtgcttatgtattttcttagaggaagtcttccatggcagggattgaaagctggtactaagaagcagaaatatgataaaatcagtgagaagaagatgttgacaccaatagaggtgctttgtaaatcatatccgtcagagttcatatcatacttccattattgtcggtcattacggtttgaagataaacctgactattcatatttgaagaggctttttagggacttgtttattcgtgaaggttatcagtttgactatgtgtttgattggaccattttgaagtatcctcagatcggtgcaagctctagaggacgtaatattagtggaagtgcgccgctaaatgctgtgccatctgctgaaagaccgggaaggacatcagtgggacaggatattcgggacaggttttctggtgctgttggagcattttcccggaggaatgcttctagttctggtaggcatggggaccactccagaaacaagacttcagatgatataccttcatctaaagatgtgcaagctgattcagaaagaggccgtacctcgagaaattgcagctcgtccagaagggctgcaatttcaagtagcagaccgagctcttcaggtgaacctacggagagtcgctcaagcagcagattagtgtcaagcagtgggcgcttatctgccacacaaaggattcattctggagctgaaccaaaaccatcactgttctcccgaacttcagttacgaagggcagccgtgatgaccctcttcggagctttgagcttctttcaatcaggaagtaaagggctgcacttgtaaagagaaattttctcgttgtttgaatcttgtgatcctataaaaggatgtctctgtgctgtaaattgaaattttctacatgaaaactaaagcttaatccaacttttcatt

SEQ ID NO: 8208 - DNA, 2175 bp, Solanum lycopersicum
aaaacagtcaataatcattttccctttttttcgtgcaaaaaaaaaaagctgcttttgtttttctctttttccccaattgtcgctaatttgtcccctgtttttcttcatctgcaaatgaagctgaaccaaatcaacaaaaatatatgtatatatcggttcgtacattgattatgcgaaaaaaattgatcaatggggatcggtgattttgttttatgaattagggtttcaatttcttgtcggtatttgaaaattgtagccgattgacaatcttaattggttctgagttgagaatcatagctcaagattagttttttaagttgaaaacgataattggtgttatccatttctgggatttgatccataactggctgtttttttggattttttttatgatacgtatattgggtggaaattcgaataggaacgtgtgattgttgctgttgaaatatttggttgttgaaatcttgaagtggagttgttcagttaccatggatcatgttgtgggtgggaagtttaagttgggaaggaagatcggaagtgggtcttttggtgaactttatttaggtgtgaatttacagaatggagaagaagttgccattaagctggaatctgtcaagacaaagcaccctcaactgcactatgaatcaaaaatatatatgcttctctcaggaggaactggaattcccaaccttaaatggtttggagtcgaaggtgagtacaatgtaatggtcatagaccttcttggaccgagcttggaagacctcttcaactattgtaataggaagctttcgttgaaaacagtgttgatgcttgcagatcagctaattaatagagttgaatacatgcactcaagaggatttcttcaccgagacataaagccagacaactttctgatgggccttggtcgcaaagcaaatcaggtgtatgcaattgactttggacttgccaaaaagtatagggacctccaaactcacaagcatataccctacagggaaaacaagaatctgactggcacagctcgctatgcaagtgtcaacacgcaccttggagttgagcaaagcagaagagatgatctggaatctctgggttatgtgcttatgtattttcttaggggaagtcttccatggcagggattgaaagctggtactaagaagcagaaatatgataaaatcagtgagaagaagatgttgacaccaatagaggtgctttgtaaatcatatccgtctgagttcatatcatacttccattattgtcggtcattacggtttgaagataaacccgactactcatatttgaagaggctttttagggacttgtttattcgtgaaggttatcagtttgactatgtgtttgattggaccattttgaagtatcctcagatcggtgctagctctagaggacgtaatattggtggaagtgcgccgctaaatgctgtgccatctgctgaaagaccgggaaggacatcagtgggacaggatattcgggacaggttttctggtgccgttggagcattttcgcggaggaatgcttctagttctggtaggcatggggaacactccagacacaagacttcagatgatataccttcatctaaagatgtgcaagctgattcagatagaggccgtacctcaagaaattgcagctcgtctagaagggctgcgatttcaagtagcagaccgagctcttctggtgaacctacagagagtcgctcgagcagcagattagtgtcaagcagtggtcgcttatctgccacacaaaggattcattctggagctgaaccgaaaccatcactgttctcccgaacttcagttacgaagggcagccgagatgaccctcttcggagctttgagcttctttcaatcaggaagtaaagggagggatgcacttgtaaagagaaatcttctcattgtttgaatcttgtgatcctataaaaggatgtctctgtgctgtaaattgaaattttctacatgaaaactaaagcttaatccaacttttcattataacttggtgttgttttacctgaagagtttctggtcattgtaacgctatttagcctcatccaaagaagtgatgagtattatgtactaagttaatattaaatatttgatgatgatgatgtacgaatgtgtagtggagaaattctgttcaaggttctagagatgattataactacca

SEQ ID NO: 8209 - DNA, 2059 bp, Nicotiana benthamiana
gcagaacaaaaacaaaaagaaagacatatgtttgcagtttttgcatgtaattatcggttcgctcattgattatacattttttatcacaatcaatggggatcggttgattttggttgtaaattagggtttcaatttcttgtcggtacttgaatataataagggtttgtatttattaaacgatagttcaagaatttatatttttttaatcggtaaccttaattggttcttcccatttttctgtgttaaaccggtgctttccatttctgggtttttggcatttgatccacagttgtgtatttaggataggtttatgggtaaaatttgtatttggggtttttggatttggtgtattaggtgaaagtcctagaaaaaacgtttgattgttgctttttattatttggttatcgaaatcttgaagtggagttgtttagtttacgatggatcatgttgtgggagggaagtttaagctgggaaggaagatcggaagtgggtcttttggtgagctttatttaggcgtgaatatacagaatggagaagaagttgccattaagctggaatctgtcaagacaaagcaccctcaattgcactatgaatcaaaaatatatatgcttctttcgggaggaattggaattcccaatcttaaatggtttggagtcgaaggcgagtacaatgtaatggtcatagaccttcttggaccaagcttggaagacctcttcaactattgcaataggaaactttcattgaaaacggttttgatgcttgcagatcagttaattaatagagttgaatacatgcactcaagaggatttcttcaccgtgacataaagccagacaacttcctaatgggccttggtcgcaaagcaaatcaggtgtacgccatcgacttcgggcttgccaaaaagtatagggacctgcagactcacaagcatataccgtacagggaaaacaagaatctgacaggcacagctcgctatgccagtgtcaacacacaccttggagttgagcaaagcagaagagatgatttggaatctctgggttatgtgctaatgtattttcttagaggaagtctaccatggcagggattgaaagctggtactaagaagcagaaatatgataaaatcagtgagaagaagatgttgactccaatagaggtgctacgtaaatcatatccgtcagagttcatatcatacttccattattgtcggtcgttacggtttgaagataaacctgactattcatatctgaagaggcttttcagggacttgtttattcgtgaaggttatcagtttgactatgtgtttgattggaccattttgaagtatcctcagattggtgctagttctagaggacgtaatattagtggatctgcggcactaaatgctgggccaactgctgaaagaccgggaagggcatcagtgggacaggatattcgagacaggttttctggtgctgttggagcgtttacgcgtaggaatgcttctggttctggcaggcatgacgaatactcaaagacacaagacttcagatgatataccttcatctaaagatgtgcaatttgattcagaaagaggccgtacctcaagaaatggtagctcatccagaagggctgccatttcaagtagcagaccgagctcttctggtgaacctactgatagtcgctcaagcagattagtgtcgagcagtggccgcgtatcttccacacaaagggttcattctggagttgaaccaaaaccatcattgttttcccgaagttcacttgcaaagggcagccgtgatgaccctcttcggagctttgagcttctttcaatcagaaagtaaagagaaattttctcgttgtttgagtcttgtaatcctataataggatgtctccgtgctgtaaattgaaaattttctacatgaaaactaaagctttatgtgacttttcattattacttggtttgttttccgtgaagagtatctggccattgtgactccattcaggctcatccgaaaaaaagtgatgagtaatatgtaccaaggtggatagtaacaataaatattcatgatgtacgaatgggta

SEQ ID NO: 8210 - DNA, 1647 bp, Triphysaria pusilla
atctgtttttaagaaacagctattttattttctagttgggactttttgggttattgatttgctattggggaaatcgttgttggcttttttttatggtttaaatccattttctgtaatgagtttggaatggatctgaaggttgtgcggtgaaatttgttataaatttttgggaggttttgattaatttttagggatttgataatggatcttgtcattggaggcaagttcaaactggggagaaagattggtagcggatcttttggagagctttatttgggtgtaaatatacaaactggagaagaagttgctgttaaactggaatctgttaaaaccaagcacccccagcttcactatgaatcgaaattgtacatgcttcttcagggaggaactggagttcctcatctgaaatggtttggagtcgaaggtgagtacaatgccatggcaattgatcttctcgggccgagcttggaagatttgttcaactattgcaataggaaattcacattgaaaacagtcctaatgctggcggatcaattaataaatagagttgaatatatgcactctagaggttttcttcaccgtgacataaagcccgataacttcttaatgggcctaggacgcaaagcaaatcaggtctacatcattgactatgggcttgcaaagaaatacagagatttacagactcacaagcatataccttacagagaaaataaaaatctcactggcacagctcgttatgctagtgtaaacacccatcttggagtcgaacagagtcgaagggatgatttagaatctctaggctatgtccttatgtacttcctcagaggaagccttccctggcaaggactgagagctggcacgaagaaacagaaatacgacaagatcagtgagaagaagatgcttacgcccgtagaagtgctttgtaaatcttattcatccgagttcatttcatattttcattattgtcgatctttgcggtttgatgacaagcctgattattcatacttgaagagacttttccgagacctatttattcgagaaggttatcagtttgattatgtatttgactggactatattgaagtatccacagattggctccagttctagaacacggccgatgggaaagatacctttaaacatgggatcatctgcacaaagagccgagaaaaccccagtgaggcaagagggtcgagacaggttgactggttctatggacgtgattgcgaaaagaaatggttcaagttcaggcttacgtggagatccctcgaggcacagatcttctgatattgatataccatcatctaaagacgtgcaaattgattctgaccggggtcgaatttctcgaaccggtagtgcttcaaagagaccagtgctatcaagcagtaggcccgcctcgtccggtgagcacagcgaaaaccgacacagccgcctcggctcaggcagtggtcgtgtatccactactcatagagtacaacctggatttgagtccaagtcatcttcgtttacccgtgctgctgccggttcaagaggtgtccgagatgaggcccttcgaagctttgagcttctaacaatcggctccgggaaaagaaaacagtgaaaatatcggtactcgttaatagtttcgtcctgagccccattctagtaa

SEQ ID NO: 8211 - DNA, 2008 bp, Amaranthus tuberculatus
attcccttttagagggaagttttacttgtaaagaaagtgatagttcagttctataaaattttaattttatagaaattttatttactttcctctaaattttagtggggggcaattttcagtttaattttgaaaaaaaaaataatcatttgggttctaaaattgagttgagatagctaaagttttgtgaagtgcttaattatggatcgtgtcattggtgggaagtttaagcttggtcgtaagattggaagtggttcatttggggagctctatttaggtatcaatgtacagaatggtgaggaagttgctgttaagctggaatctactaagacaaaacaccctcaactgcattatgagtcgaaattgtacatgcttcttcaaggaggcactggtatctcccatctcaaatggtttggagtagaaggtgaatacaatgttatggttattgatcttcttggtcccagcctggaggatttgtttaactattgcagccgcaagttttcattgaagacagttctaatgcttgctgatcaaatgattaatagagttgagtacatgcactcgagaggttttcttcaccgtgatataaaacccgacaactttttaatgggtcttggacggaaggcaaatcaggtttatgtcatcgattttggccttgcaaaaaagtatcgagatcttcaaacacataaacacataccttatagagaaaacaagaacctcaccggaactgctcgatacgctagtgtcaatacacatcttggtgttgaacaaagcagacgagatgatctagagtccctcggctatgtgctcatgtattttttgaggggaagccttccatggcaaggcttgaaagctggaactaagaagcagaagtacgacaaaattagtgaaaagaaaatggttacacccatagaggttctttgcaaaaatcatccctcggaattcacatcatacttccactattgtcgttcattacgattcgatgacaagcctgattactcttatctcaaaagattattccgggaccttttcattcgggaaggttaccaatttgactatgtgtttgactggacaatattgaaatatccacaaataggttccagctccaaaccacggccaacggtgaaacccatgttgaatcctggaccttctgctgaaaggaccgagagaatatcagttggacaagaaatcagggatagattttcgggtgcagttgaagcatttactagaagaaataatcctggatcgggttcacaaggtgatccacgtcatagatcagatgatccgtcatctaaggatatgcatgctgatcgtgaaagaggtcgtacttctcgaaatgggagtacttcaaagagagcaattgcatcatcaagtaggccgggctcatcttgtgagccaagtgatagtcgaacaagcaggctacactcgaccagtggtcgtatgtctacgacccagaggattcaacctagttttgagtcaaaaacgtctactcttgctcgcggttctgctgttagaccaggacgagatgatgccctaaggagcttcgagttcctatctattggcaccgggaggagaaagtaagaaacaagaacgcgtcaaacatttcttttcggtgggtttgctaccaggagagatcaactacaagatcttccgtcttttaataaggtttttcacccgggttccctaagaacatgtaaatgatgtagttcgtaacccgacactcgaaaaacgcttaatggatccatttccttttaatgattgtgctcttccggttccagatacttccgccatcaaatggcccaataaacctactgtttactccctttatctctttaagtttgctactgaacgtttgtaaattcaaaggaacggacgagttctattttttagacttatggaaaggagatcaatttaggaaatcgtctatatgttgagactttggaccatgatgtgtgttgagactttggcttagtccttaagctgttaagcatatggtttaatcctttgtagg

SEQ ID NO: 8212 - DNA, 2125 bp, Vitis vinifera
tttcccatctacactactttcccaaaacattttccccattttctcacaccacaaacacttcttctctttctctttctctttctgatcccagcctggaatgtcccctgatttatttttttgattggttttcagttctgggtttcattgctttgaattgttttcattcacattgcattcgttttgataatccattcgtggttttctgattagggtttgggttgttgcatgtggttgaggatttggtggatgccggatgtgggtttgttgggattcatgattgggttttgtgcgtgaggttttagggttgattggtttgttttcgacatttgatgctttgattttgatgattaatgcatttttctctgggtcatccattggggtgttaatttggtgaatctgattgattttggtgatttttttggtggtttggagttcttcacaaataaatggtaaattggggacgaatttgagttttgagtagattgagattgaggctgaattgaggtgttgtgaagtggggtttacaatggagcatgtaatcggtgggaagttcaagatgggaaggaaaattgggagtgggtcttttggggagctatacataggtgttaatgtacaaagtggggaggaagtggccatcaaggtggaacctaccaaaactaagcaccctcaacttcaatatgaatcaaagttgtacatgcttctccaaggaggaacgggaattccccacctcaagtggtttggagttgagggtgagtacaatgtcatggttattgaccttcttggaccgagcttggaagacctgttcaactattgcaataggaagttcacattgaagacagtattgatgcttgcagatcaattaattaacagagttgaatacatgcattcgagaggttttcttcaccgtgatataaagcccgacaactttttaatgggcctagggcgcagggcaaatcaggtgtatgccattgattttggccttgctaaaaagtatagggatctacagacacataaacacattccatacagggaaaataagaacctcacaggcacagctcgctatgcaagtgttaacacccatctaggagttgagcaaagcagaagggatgatctggaatctctaggctacgtgcttatgtatttcctaagaggaagccttccctggcaggggctgaaagctggcacaaaaaagcagaaatatgataagatcagtgaaaagaagatgttaactcccatagaggtactttgcaaatcatatccgtcagagttcacatcatactttcactattgccgatcattgcgatttgaagacaagccagattattcatatctgaagaggctgttccgggacttattcattcgagaaggttatcaatttgactatgtatttgactggactatattgaagtaccctcagattggtgccagctctagaggacggcattccactggcaaagcaggtttaaatgctggaccatcagctgaaagactggataggacctcagggcaagagattcgggatagattctctggtgcagttgaaacattcccccgaagaaatgcttttggttctggtttgcacagtgaccattccaaaaaccggacttcagatggtgtaccctcatccaaggatgtgcaagcagattcagaaagaggccgcacttcccgaaatggaagcacttcaaaaagagctctcatctcaagcagcaggccaagctcctctggagaacccagtgaaggacggtcaagccgactagtgtcgagcagcagccgcatgtcctcctcccatagaatccaaccagggtttgagtccaaatcatcgtcatttacacgcactgcagcaacaaaaggcacacgagatgaccctctgaggagctttgagctgctctcaatcaggaagtgagaggagaattggttgccttaaaaaaaaaagtgtcgctggggtttaatgatatctctcttgttgtatatgggaaaccacttttatcatcatgattattaaaggtcacaccttgcagtttctttcttcatctacatattttgtgccctgtgtagcttataattgaacacgtctatgaaagatatgattatctgcaattgtgagcggcttttattctctgacaaa

SEQ ID NO: 8213 - DNA, 1949 bp, Cichorium intybus
aaagattgatttcatgatttggcccgatctcacttcaaaatctctctgagttttcacttctttttaaccccttttctcttttctcattcgtccgtaacaaacaatcgtgtatatatccataaatttatcatcatcgagttccttgattaacgtgtttcaaatatcacattttgattttgatatctgaccacacgattttgaccatcccgatgatgtaggttctagggttttatactgattcatttgttttgttcatctgtacatcataaaatcggtacccaaactttccttatcagttttcaacttcttcgcatcactagaatacatcgtcattcgtctcacatatcttcatatcgaagtgtcaaactctgtttatagcttttggaaattagggttgttgagatttttttgttttagccgatcattgctgtggttttaggtagatctggtggatcctggcttttttgagccggtgaattttgtcaaaagtttgaagctcgaaagataattatttgattaatttgtgtggatttaatcatggatcatgtgattggtggtaagtttaagcttgggaggaagattggcagtggatcttttggagagctttatttgggagtaaatgtacaaaccggtgaagaagttgctgtcaagctggaatctaccaagactaagcaccctcaacttcactatgagtccaaattatacatgcttctccaaggaggaactggtgttccccacctgaaatggtttggtgttgaaggagagtacaatgctatggctattgaccttcttggaccaagtttagaagacttgttcaattattgtaatcggaagttgacactgaaaacagttttgatgcttgctgatcaattaataaacagagttgaatatatgcatacaagaggttttcttcaccgcgatataaagccagacaactttttgatgggtctaggtcgcaaggcaaatcaggtttacattattgattatggtcttgcaaaaaagtatagggatctccagactcacaggcatataccatacagggaaaacaaaaatcttacaggcacagctcggtatgcaagtgttaacacgcacctcggagttgaacaaagcaggagggatgatttggaatctctcggttatgtactcatgtatttccttagaggaagccttccatggcaggggttaaaagctggcaccaagaaacagaaatacgacaaaattagtgaaaaaaagatgcttactcccattgaggtgctttgcaaatcttatccttctgaattcatacaatatttccattattgtcgatcattgcgatttgaagacaagccagattattcttacttgaagaggcttttccgtgaactgttcattagagaaggttatcagtttgactatatatttgactggaccatgttaaagtatccccatgttggctccagttctagaggaaggacaactgcaaaattaccattgaaccctggactttcagcagagagagcagaaaggaccccagtgaaacaagaagttcgagatagattctcaggggcagtcgagtcatttactaggcgaaatggttctagtagcggcttgcatggtgattcatcaagacacagatcttcagagaacgtaacaccatccaaggatgtgcatggggagtcagatagaggtaggatatcacgaaatggaagtacttcaaaaagagcagtaatgggaagcagcagcaggccaagttcatccggtgagcctaagcggttgggttcaggcagtggtcgcatatcaacaaccgctacttcacaaaggcttcactctcaaccgggatttgaatccaaatcatcgtctttcacgcgcccggtggtctcgagaggtggtcgcgatgatgctcttcgaagctttgagttgctaacaatcgggtcggggaagaggaagtaaaattaaataatgagtttttt

SEQ ID NO: 8214 - DNA, 2325 bp, Vaccinium corymbosum
tccatcacgtattttctcatctacttttcacagtaatgtaccatcgaacctgggtttcgattcccaaactttagttttagatttaggggttccagcctctgatagatgtagattcaacggccatcttttgattcattggtttgttggaatttctttcggtggttcaacgttatagagtcctatacaaattacttatattaattttcttttgtattcattagggattcgttttgtaatccttttctgagctaactattgcgatatatatggtttttgattggtcggattttgatggatccgagagttgtatggagattttagggtttgggtgttgtttggtttgggatgatgaattgggttgaatttggaatttgaaaaaagaataggaaaggggtcatattttgggttcttctgaaaaggatattttggggtttggtttgggatgatgaattgggttgatcttgaaattgggaaaaaataagagaaaaggttcaaattttgggttcttcaagaaagggtattttaatttggggattaaactatggatcatgtgattggtggaaagttcaagctggggaggaagattgggagcggatcttttggcgagctatatttgggagtaaatgtacaaacaggagaagaagtggctgtgaagctggaatcagtaaagacaaaacacccacagcttcactatgaatcaaaattgtacatgcttcttcaaggaggaaccggtattccccacctcaaatggtttggagttgaaggcgagtacagtgcaatggttattgaccttcttgggccaagcttagaagatctattcaactattgtaataggaagttcacattaaaaacagttttaatgcttgcggatcagttaattaatagagttgaatatatgcattcaagaggttttcttcaccgtgatataaagcccgacaactttctaatgggtttaggacgcaaagcaaatcaggtatacgccattgactttggtctagcaaaaaagtatagagatcttcaaacgcacaagcacataccatacagggaaaacaaaaatctcacaggcacagctcggtatgctagtgttaacacccaccttggagtcgagcaaagcagaagggatgatctggaatctcttggttacgttcttatgtattttctgcggggaagccttccttggcagggccttaaagctgggactaagaagcagaaatatgataaaattagtgaaaagaagatgcttactcccatagaggtgctgtgcaaatcctatccatcggagttcatatcatacttccattactgtcgatcattgcgatttgatgacaaaccagattattcataccttaaaaggcttttccgtgacctatttattcgagaaggttaccagtttgactatgtatttgactggactattctgaagtatccacaagttgggtctagttctagagcacggcagccggttgggaaattagccttgaacccaggaccatctgcagaaaaagctgaaaggcctccagtgaggcaagagggtcgagataggttctcaggtgcagttgaagcgttttctagaaggaatgctactggttccggtttgcatggtgaacactccaggcacagagatcactccagaaatagatcttcagatgatgtaccatcatcgaaggatgtgcaagttgactctgaacgaggacgtacttctcgaaacggtagtacttcgaaaagggttgtggcgtcgagcagcagaccaagttcatctggggaaattcggttgggtacaggcagtggtcgcctatctacaacccaaagggtccaacccggtttcgagtccaaatcatcatctttcaccagggctgcaggcacaaaagccggccgcgacgatcctctccgaagctttgagcttctaacgattggcacaggaaaaaggaatgaaataacagggaaggcctccattccctatttttagcttttacgaagatctcagcgacattataagtccaatgcgcgaattttcgtttcactgtttacgttataagtccaatgcgcgaattttcgtttcactgttttaagctgaaatttaagttttcctagtcttcctcactgattctttgctgctatattttatactacgctgtatctgatcgaacaaaaggagattaaaaattaatctcaagcttagggaaatgtgtttttggaccgcggtagagttgtaataattgcaattgtgtttgttgtactaagaaaattttctgctttcgtaatgcacattcggccatgtggttgcattcattgagttctgttgagggcattgtatgtcataatatc

SEQ ID NO: 8215 - DNA, 2165 bp, Tropaeolum majus
atgatcaatcattctttcgttattctctcactcctcatactctacaaagtgtacaatgtatatattcattcgatgaacacacaaacccccgtcttttaatcagattctgaagattaccctctgaaccactcctaatttcttgccagaaagatcgtagcttttagattcttctcatcttagttaaattttttttgttgttccttgtaagaaaggaaaacaacaacaacactaatctcatcatcaattccctttttctccaataatttccagttggtgaacttatttttttttcgattcgattgtaatggacgcttcttagatttttcgagcaagttatagtgttgggtaatagagtgattacttgctctctttcgattctatcaactggagcaactttttttttgtttgaaagttgagttttcaatttctgtttggtgaataaatttggtagatctagggtttggtgtaacaatcggagaggagaatataagttgaggggttgctttttttcatttgttgtctgtccatttttttctgtagaacttctaattcagcattcaaacatgaatcatgtggttggaggtaggtttaagctcggacgcaagattggtagtggatcttttggggaactctttttaggggtcaatatacaaaatggtgaagaagtagctgttaagcttgaatctgcaaagaccagacatcctcaacttcactatgagtcaaaactatacatgcttctccaaggaggaacgggtataccacatatcaaatggttcggagtcgagggagaatacaatgttatggttattgatcttcttggaccaagcttggaagacttgtttaattattgcaaccggaagttatctttgaaaactgtcttaatgctcgcagatcagttattaaacagagttgagtacatgcacacacgaggatttctccatcgtgatattaagcccgacaactttttaatgggtttgggccgtaaagcaaaccaggtatacatcattgattacggcctagcgaaaaagtatagggatctccaaacacacagacatataccatacagggaaaacaagaatctcactggaacagctcgctatgccagtgttaacacacaccttggtatagagcaaagcagaagagatgatttggaatctcttggctacgtgctgatgtattttttgcgaggaagccttccatggcaaggcattagagccggtaccaagaaacaaaagtacgacaagatcagtgaaaaaaaaatgcatactcctgttgaggttctctgcaaatcatttccgtcggagtttacatcatattttcattattgccgatcgttgcgatttgaggacaaaccagattactcgtacttaaaaaagcttttccgagatttatttattcgagaaggttatcagtttgattatgttttcgattggacgatattgaagtatccacaaattggttcaagttcgagatcacggccgaatccgaatcctaaagtagcagctttaaaccaaccgcctggaaaatctgccgatagaacttcagtaggacaagatgttcgagacagatttacaggtgcaatcgagggtttcactagacgaaacggttctgtccctggtgttctaaatggtgatcggtctagacaacgatcttcagatgacgtgccgtcatccaaggacatgcatcctgattctgaaagacccgggtcatcgtctcgtaacacaagctcttcaaaaagagcggttgtttcgagcggcagccgaccgagctcttctttcgagccgagtgagaatcgatcgagtagattggtatcgagcagcagtcgtttatccacaacccaaagggtgatgaatcaacccgggtttgaatccaaatcctcttcctttattcgtgctccgatcactagaactggtcgggatgatacccttcgcagccttgaactccttacaatcggaggtggaagaagacatacataaagagtaagaagaaaacaacattctcctcctgaaaactttcccgtcgacaatccgacaactggttttccggttggttttccggttgtaactctgtacatttgtatcctttattggacggatattattctgatggcatgtctttcaaaaagagagatggttattttttaatatgcattggctataccttca

SEQ ID NO: 8216 - DNA, 2195 bp, Nicotiana benthamiana
agctcatttgtcctttctctttctttttctccattgccaagaattcttgacccttctttgattcatctgtcaaacagaaacaaggcagaaaaaaaaaaagagaaccctaacacacatttttagtttgtacatctaggtttgccaaaagatttaatttttcttaatcaatggggtgattctgctcagaaagataggatttttattccttttttgagtatttttagatgatgggtgtttgtacttttttaaggatgtagctggaaaataattttcttgaatcttgatcaataatttttaggcctttctttgtaaagataggatttttattccttcttttcttgttttttaattcaaagttgtgaactttaacaatggattcttgatttgatggggttattgattcttggattttcttggttttttgggggattaacctaagtggggtgaaaatctgagtaatttttttttattttggctgttgaaaattgttgttggtgaaaattttgaagtggggttgttgaatctcgaatcaacatggatcatgttgtgggtgggaagtttaagcttgggaggaagattggtagtggctcttttggtgagctttatttaggtgtgaatatacagaacggagaagaagttgccattaagctggaatcggtcaagacaaagcaccctcaacttcattatgaatcaaaaatatatatgcttctccaaggaggaaccgggattcccaacctcaaatggtttggagttgagggcgagtacaatgtaatggttattgaccttcttggaccgagtttggaagacctcttcaactattgcaataggaagttctctttgaaaacagttttaatgcttgcggatcagctaattaatagagttgagtatatgcactcaagaggatttcttcaccgtgacataaagccagacaactttttaatgggcctaggtcgcaaagcaaatcaggtttacgcgatcgactttgggcttgccaaaaagtatagggacctacagactcacaagcatataccatacagagaaaacaagaatctgaccggcacagctcgttatgccagtgtcaacacacaccttggagttgagcaaagcagaagagatgatttagaatctctgggctacgtgcttatgtattttcttagaggaagccttccatggcaaggactgaaagctggtaccaagaagcagaagtacgacaaaatcagtgagaagaaggtgttaactccaatagaggtgttatgcaaatcctatccatcagaatttatatcatacttccactattgccgatcattacgatttgaagataaagctgactattcatatttgaagaggcttttcagagacttgtttatccgtgaaggttatcaatttgactatgtttttgattggaccattttgaagtatcctcagatcggtgccagttctagaggacgagctcctggtggaagtgccggactaaacgctgggccatctgctgaaagaccaggaaggacagttggacaagatattcgagagaggttttctggtgctgttgaagcattttcgagaaggaatgcttcgggtacaggaaggcatggggaacattccagacacaagacttcagaggatatgacttcatctaaagatgtgcaacctgattcagaaagaggccgtacctcgagaaatggaagctcttcaaaaagggctgccatttctagcagcagaccgagctcttctggtgatcccaccatcactgatagtcgctcgagcagactagtgtcaagcaatggccgtgtgtctaccacacaaaggattcatcctggcatcgaaccaaaaccatcaccattctcacgtaaggggacacatgatgaccctcttcggagctttgagttcctttcgatcagaaagtaaatggcatgcacttgtaaagagagaatttcctgtttgtttggaacattgctatcctatttacggatgtcttttttaagtgttgtatattgaaaatgttctatgtgacaaaagcttatccaactttccattatccctttgttttgattttgatttagagcttctggccacgtaaaagcctttagactcatctaaagaaatgatgagtaaaaagtgctagagttttatacatgtatactcggatagatgtaataaatattattattgtaccatgaatgtatctttttaactca

SEQ ID NO: 8217 - DNA, 2281 bp, Solanum phureja
tgctgcttgcttttccacaaaattaaatttgtttctactttttctgaaaatctctctctctctctcttctcaatcttccctcatttgtcccatctcttttttttctccattgcaagaattcttgacctttttttatttattttcagctgtcaacaggagcttaagaacaccccaatacacttttttttaaatttgtacatctgtggttgcagaaagattgcttttttattaatggggtgatttttcttgtaaagatagggtttttattcatgggttatttggagatgatgggtgttggtatttgtagaaggatgtagctggacaataattttcttcaaattttgattgatgatttttaggcttcattgttttgaaagttgtgaactttaaattgattttgatctttaagggtggtaaattggatagatgtatgagtagttttgatggggttaattgtttcttggatttgctgggattttttggccaatctaagtgagtgaaaatctgagagaattaattattttggcttgttgaaattgttgttgttggtgaaatttctgaagtggggttgttgaaatcagcatggatcatgttgtgggtgggaagtttaagcttggaaggaagattgggagtggttcttttggtgagctttatttaggtgtgaatatacagaatggagaagaagttgccattaagctggaatctgtcaagacgaagcaccctcaacttcattacgagtcaaaaatatatatgcttctccaaggaggaaccgggattcccaatctcaaatggtttggagttgagggcgagtacaatgtgatggtcattgaccttcttggaccaagtttggaagacctcttcaactattgcaataggaagttcactttgaaaacagttttaatgcttgcagatcaactaattaatagagttgaatatatgcactcacgaggatttcttcaccgtgacataaagccagacaactttttaatgggtttaggtcgcaaagcaaatcaggtttatgccatcgactttgggcttgccaaaaagtatagggacctacagactcacaagcatataccatacagagaaaacaagaatctgaccggcacagctcgttatgccagtgtcaacacacaccttggagttgagcaaagcagaagagatgatttggaatctctcggctatgtgcttatgtattttcttagaggaagccttccatggcagggactgaaagctggtaccaaaaagcagaaatatgataaaattagtgagaagaagatgttaactccaatagaggtgttatgcaaatcctatccttcagaatttatatcatacttccactattgtcgatcattacggtttgaagataaacctgactattcatatttgaagaggttgttcagagatttgtttattcgtgaaggttatcaatttgactatgtttttgattggaccattttgaagtaccctcagatcggtgccagttctagaggacgacttcctggtggaagtgccggactaaatgctgggccatctgctgaaagaccaggaaggacatcagtcggacaagatattagagacaggttttctggtgctgttgaagcattttctagaaggaatgcttctggtacaggaaagcatggggagtactccagacacaagacttcagaggatatgacttcatctaaagatgtgcaagctgattcagaaagaggccgtacctcaagaaacggaagctcttcaaaaagggctgccatttctagcagcagaccgagctcttctggtgatcccaccatcactgatagtcggtcgagcagactagtgtcaagcaatgggcgtgtgtctaccacacaaagaattcatctaggtatggaaccaaaaccatcacctttctcacgtaaggggacacgtgatgaccctcttcggagcttcgagttcctttcaatccgaaagtagaaaaaagcatgtcacttgtataaagagagaatttcctgtttgttttggaacattgcaatccttttaagtgttgtatattgaaaatgtttctatgtgacaacttaagcttatcccaacttccaattgttccttgttttggttttgattttagagcttgagttctggccatttgtaaaagccttttgactcatccaaagaattgatgagtaaaaagtgctagagtttcatacatgtacactcagatagtatgtattatgtaataaatattattattgtaccaatgaatgtatcttttttactcagtagtaggatgaaccttttatcg

SEQ ID NO: 8218 - DNA, 1785 bp, Arnica chamissonis
attgtcaccgttgttgagtttttgattgatttatttgtaacaatagcgtcttaatttggttttttgggcacaagttttatgttttgtcgattggtgtaggttctggggttttttttatcgatccagcgagaccgacaaattccgttgtcaagtttttggcagtactagattgcttcaagttcaattattaaaacacaaatcttcatatcgaaatttgcaatcgattttggtgtggagactttgaatttcgcgagtttgtattgcggctttagatggatctgagtgcattttggggatcttagattttgttgcggtgaaatttcttttaattgatttaatagtagttaatcatctgctcagggcttatttgattgtaaatttgggatttcatcaatatggatcatgtgattggtgggaagtttaagcttggtaggaagattggtagtggatcttttggagagctttatctgggagtaaatcttcaaagtaaagaagaagttgctgtcaagttggaatctgttaagaccaagcacccacagcttcactatgaggccaaattgtacatgcttcttcaaggcggaactggtgttccccaccttaaatggattggagttgaaggagaatacaatgctatggttattgatcttcttggaccaagtttagaagatctatttaattactgtaaccggaaattcactttaaaaacagttttaatgcttgcagatcagttgataaatagagttgaatatatgcattcaagaggtttccttcaccgtgatataaagccagataactttttgatgggtttaggacgaaaggcaaatcaggtttacattatagattatggtcttgcaaaaaagtatagggatctccagacacacaagcatataccatacagggaaaacaaaaatctcactggtactgcccgttatgccagtgttaatacccaccttggagttgagcaaagcaggagggatgatctggaatctcttggttatgtgctaatgtattttttgagaggaagccttccttggcaggggctgaaagctggcactaagaagcaaaaatatgataaaattagtgaaaagaagatgcttactcctgtagaggttctatgcaagtcttatcctactgaattcacatcgtattttcattattgccgatcattgcggtttgatgacaagcccgattattcatacttgaaaaggctattccgggatcttttcattcgagaaggttatcagtttgactatgtttttgactggactatattgaagtatcctcaaattggttccggctccagctctagaggacggactgttggaaaactaccactgaatcccgggccttcagcagaaagagtggaaaaaaccccagtgaaaccagaggctcgagatagattctcaggcacaattgaggcatttgctaggcgtagtggtttgcatggtgatcactcgagacacagatcttcagaacatgcaacaccatccaaagaaatgcgcgttgactcggataaatcccgcatcacacgaaccggtagtacttcaaaaagagcagtgatatcaagcagcagaccaagctcatctggtgagcccaatgagagccgatcaaaccggctcggttcaggcagtggtcgcatatcaaccacccatcggctccattctcaacctgggttcgaatccaaatcatcatctttctcacgggcagtaccctcatcaagaggtggccgtgatgatgcccttagaagctttgaactgcttaccattggcaaaaggaaataagaag

SEQ ID NO: 8219 - DNA, 1525 bp, Nicotiana benthamiana
gaggttgattggatcatcatggatcatgttgtgggtgggaagtttaaactgggaagaaagattggaagtgggtcttttggtgaactttatttaggtgtgaatatacagaatggagaggaagttgctgttaagctggaatcagtcaagacaaagcaccctcaactacactatgagtcgaaaatttatatgcttcttcaaggaggaaccgggattcctaatctcaaatggtttggagttgagggtgagtacaatataatggtcattgaccttcttggaccaagtttggaagacctcttcaactattgcaacaggaagtttactctgaaaacagtgcttatgctagcagatcaactcattaatagagttgaatacatgcactctagaggatttcttcaccgtgacataaagccagacaactttttaatgggcttaggtcgcaaggcaaaccaggtttacgccattgactttgggcttgccaaaaagtatagggatctccagactcacaagcatataccatacagggaaaacaagaatctgacaggaacagctcggtatgccagcgtcaacacacatagagatacaccacaaagcagaagagatgatttggaatctcttggttatgtgcttatgtattttcttagaggaagccttccatggcagggactgaaagctggtaccaagaagcagaaatatgataaaatcagtgagaaaaagatgttaacaccaatagaggtactgtgcaaatcatatccatctgaattcatatcatacttccactactgccgatcattaagatttgaggataaacctgactattcatatttgaagaggctttttagagacttgtttattcgtgaaggttatcaatttgactatgtatttgattggacaattttgaagtatcctcagatcggtgccagttctagaggacgaattcctagtgggaacaccggattaaatgctgggccatctgctgaaagaccaggaaggacgtcagtggggcaagatattcgagacaggttttctggtgctgttgaagcattttccagaaggaatacttctgcggctggtaggcacggggaacactccagacatcggacttcagaagatgtaccttcatctaaagatgtgcaagctgattcagaaagaggccgtacctcgagaaatggcagctcttcaagaaaggctgctatttcaagcagcagaccgacctcttctggtggacccacagatagtcgctcaagcagattagtgtcaagcactggccgtctatctaccacacaaagaattcagcatggaatcgaaccaaaaccatcatcattctcccgaacttcagtcacaaagggtacccatgataaccctcttcggagctttgagtttctttctatcagaaagtaaggggatgcacttgtaaacagaaaatttcctgattgtttgaacatgcaatcctatttaaggatgtctcgagtgctgtaaattggaaatgttttaccttctatgtgacaattgaagctgatccaacttc

SEQ ID NO: 8220 - DNA, 1362 bp, Panax ginseng
aagtttaagcttgggaggaaaattgggagtggatcatttggagagctttatttgggagtaaatgtacaaactggtgaagaagttgctgttaagctggaatcagctaagactaaacatcctcagctccactatgaatcaaagttatacttgcttcttcagggaggaactggtgttcctcatctcaagtggtttggagttggagaagaatacaatgccatggttattgaccttcttggaccgagcctagaggacttattcaactactgtaaccgaaagttcacattgaaaacagttttaatgcttgcggatcagttaattaatagagttgaatatatgcactcaagaggttttcttcaccgtgacataaagcctgacaactttttaatgggtttagggcgaaaagcaaatcaggtgtacatcattgactacggtcttgctaaaaagtatagggatcttcaaacacacaagcatataccatacagggaaaacaaaaatctcactggaacagctcgttatgcgagtgttaatacccaccttggagttgagcagagcaggagggatgatctggaatctcttggttatgtgcttatgtattttttgaggggaagccttccctggcagggactgaaagctggcacaaaaaaacaaaagtatgacaaaattagtgaaaagaagatgcttatcccatagagatgctttgcaaatcttatccatcagaattcatatcatatttccattattgccgttcgctgcgatttgatgacaaacccgattattcatatttgaagaggcttttccgggacttattcattagagaaggttatcagtttgactatgtatttgactggactatattgaagtatccgcatattggctccagttctagaggacggcagtcggctgggaaatttactttgaaccctggaccatctgtagataaagtggaaaaaacaccagtaagacgagagacaagagatcgtttcccaggcgcagttgaggcatttgctaggaaaaatggttctgctgctggtttgcatggagatcactcaaggcacagatcttcagacaatgtaccatcatcaaaggatgtgcaagctgacaaagaaagaggacaggtttctcgaaccggaagtgcttcaaacagagctgtcatatcaagcagccggccaagctcctccggcgaacccagcgagaacaggttgaatcggctgggttcaagcagtggtcgtttgtccaccacccaaaggattcaacctggttttgagtccaaatcatcatcgtttactcgtgctgtagcaagaggtggccgtgatgatgctcttcggagctttgagctgctaaccattggcacaggaaagagga

SEQ ID NO: 8221 - DNA, 2525 bp, Citrus clementina
tctcttcctcctcttcctcctcgttctcctccttctctgtctcttcaacacgttttcctgtttcctcagaaacactgtcgttgtgtttatttatttatttttcatcaattatcctgatcacgataccaaaaaaaaaaacaaaaaaaagaaaagaaaagaaaaaactctctttctttcgtttttacttcaattcccgttttactctttgcatttccaatagagagtttctggtcaatgtgcctggattgtttatagaaaattaaattagggtttcggtcctcaattgaagatttggggatcgagcgttgttgaagaaaattttcttgcttttatcggcaactcatcctctttttgggacaattctatgttaatcgaatgcattagatgattccattggtggataatcaataaaaaaggaaaaaaaataaagaaaggggagattttattttatttttgttaatttgacctgccggtgtgttaatttggcaaatctgttatttcatttttactttttatttttttggattcaactgtttggtgggtattgggattttcgacgaccattgtcaaattgagcacaaatctgggttaaataaagctagattgagctagttgtttctatgtttgccgacgggaaattgagaatggaccatgtgattggtggcaagtttaagttggggaggaagatcggtagtggctccttcggagagctttatttaggtgtcaatgtacaaactggagaggaaattgctgtcaagctggaacttgtgaagaccaagcatccacagcttcattacgaatcaaaattgtatatgcttcttcagggaggaactggaattcctcacctcaagtggtttggagttgaaggggactacaatatcatggttattgatcttcttggaccaagtttagaagatttgttcaattattgcaatagaaagttctctttgaaaacagtattgatgcttgcggatcaattaattaatagagtggaatacatgcactcaaggggctttcttcaccgtgatataaagcctgacaatttcttaatgggccttggacgcaaagcaaatcaggtctacataattgactatggccttgcaaagaagtatagggatcttcaaactcataagcacatcccatacagggaaaataagaatctcaccggcacagctcgctatgcaagtgtaaatactcaccttggagttgaacaaagtcgaagggatgatttagagtctcttggttatgtccttatgtatttccttagaggaagccttccctggcaaggattaaaagctggcacaaaaaagcaaaaatatgataagatcagcgaaaagaaggtgtcaactccgatagaggtgctctgtaaatcatacccatctgagtttgtatcatactttcattactgtcgatcgttgcggtttgaggacaaaccagattattcatatttaaagaggcttttccgcgacttatttattcgagaaggttttcagtttgactatgtatttgattggactgtattaaagtaccctcagattggttccagctctaaaggaaggcattccagtgggaaggtaggcttaaccccaggaccatctgctgaaagaccagaaaggggttcagttgggaaggagattagggataaattgtctggtgcagttgaagcattttcaagaaaaaatgctgctggtactcctcatcgtgatcatcccagacacaagagttcagatgatggtccttcatctaagcatgtgaaccctgattctgaaaaaggacgaagctcttcccggtatggaagcacttcaagaaaagctgtaatcgcaagcactaaacctggttcatctggtgaattcagtgagtgtcgctctagccgactagtctcaagcagtggccgcttgtctaccacgcaaagattgcaatctgggtatgattccaggcaatcttcatttaatcgcactgctggtggaagaatctgcacccgtgatgatcctattcggagttttgagatgctgtcaatcaggaaatgatgtttatttgatgaatttgtgagaaggtattgcttatgcacgtagtggccgcgaagaattcttgaaagttatagtctcacttttgtctatgggataaaacctagtcgaatgccataacaggtcattttgactcataaaaggacgtatcccaatcatttttctgcttcctcttgttttattcattccattttaattgttcctgggagcttcacgtcaatgtaacgtgtcctagactggcggattggagaaaagggaatttctgtattggaatttcatttgtctatgtgacttgaatagctgtaatgattactcctattcttatgcttttgagaccaaaagtagtaatgaatctatcatctatgtacttgggcggaaatggggacaattttctttaagatgaaagcatgagcttcatcctgtttactagtttatttcttgttccaggtgatgctagattataacaaaaagcttaccttttctttttttcggttctcttat

SEQ ID NO: 8222 - DNA, 1819 bp, Eschscholzia californica
cctttattttaaaggttggtcaatcatcaacatttcaagagctatatgttcatggaaactagtcagatgtggtgaatttttttagcttcctcaagaaatcggtggaggaagaagaataatagtgtgattgatcaatgagaaaggggatttggttggaaaaggttaggtgagagggtgttagggttaattgggttagaattgctgcttcttaaccggaattgataagatcatggagagtgttattgggggtaaattcaaacttggacgtaagattggaagtgggtcctttggtgagctttttctaggtgttaacatacaaagtggggaggaggtggctattaagttggaatctgtgaagacgaagcaccctcagctccattatgagtccaaattatatatgcttcttcaaggagggacgggaattccccatctgaagtggtttggggtcgagactgagtacagttgcatggtcattgaccttctcgggcctagcttggaagacttgtttaactactgtaatcggaagttcacgttgaaaacagtattgatgcttgcagatcaattgattaacagagttgagtatatgcactctagggggtttcttcaccgtgatatcaaacctgacaactttttaatgggcttaggacgtcgagcaaatcaggtatacatcatcgactatggccttgcgaaaaagtacagggatcttcaaactcataagcacattccatacagggaaaataagaatctcacaggaacggcgcgttatgcaagtgttaacacacaccttggagtcgagcaaagcaggagagatgatctggaatctcttggttatgtgcttatgtacttcttaagggggagccttccgtggcagggactaaaagcgggaaacaagaagcagaagtatgacaaaatcagtgaaaagaagatgctcactcccatcgaggtgctttgcaaatcatatccatcagagtttatatcatatttccactattgtcggtcactgcggtttgaagataagccagattattcatatctgaagaggctgttccgcgacctatttattcgagaaggttatcagtttgattacgtattcgattggactgtattaaagtaccctcagattggtggcaattctagaaggctgcccagtggtaaagtaggcacaaccccaggaccatctgctgaaagaacagaaaggacttcaggcctggtgggacaagagattcgtgacagattttcaggtgcagtcgaagcatttactagaagaaacagttcaggttccggtttacatggcgaccactctaagctcaagaatggagaggattccccgacaccaaaggatttggtacctgattctgaaaaacttcgaacttcttctaggaacggcagcacttcaaggagagccgtcgcgtcaagcagtcggcctacttcttctggtgagcctagtgagagtcgatcaagtcggttactctcaggcagccatcgtgtttcttccacgcaaaggatccaacctggactagaatcgagatcgacttctctcactcgctccactggtgcaaggggtacacgtgatgatcctcttcgaagctttgagcttctttcaattggcagagagaagcgaaagtgaagtaagctactaagtaacataaggtgtttccttttccttgaaatcgagggaaattctcgtttgttgtttgtactgatttctttctcgaagtactttaaatacgtaactatgtatatgcaatttgtttatttccctgaagtccgtctcgatgatgttactccatccttacttatgaacacattaatatcattt

SEQ ID NO: 8223 - DNA, 1884 bp, Tabernaemontana elegans
acttcctagtttgttttgtgtagtcaggtcgattgttattttgactccggtcggcgcggttgttttccttttattttagtaaaacgttgggggcttagttttcctggcggatttccggctctctcttcactcctcacctttaatttttggttggggtacaatttggtgtaatctgagtaggaaaggacgtgttgggtttgttgttggacattcctataggaggaaggtcattaaagcatcatggatcatgtggtgggtggcaaatttaagctggggaggaagattggtagcggttcatttggtgaactttatctaggtgtcaatatacaaaatggagaagaagtagctatcaagctggaacctgtcaagaccaagcaccctcagcttcagtatgagtcaaaaatttatatgcttctccaaggaggaactgggattcccaacctcaaatggtttggagtggagagcgaatataatgtcatggttatcgaccttcttggcccgagtttggaagacctattcaattattgcaacaggaagttctccctgaaaacagtattgatgcttgcagatcagctgattaatagagttgagtacatgcattcaagaggatttcttcaccgtgatataaagcctgacaattttttaatgggcttaggacgcaaggccaatcaggtttacgtcattgactttggccttgcaaaaaagtacagggatctgcagactcacaagcacataccatacagggaaaacaagaacctgacaggcacggctcgttatgctagtgttaatacacacctaggacttgagcaaagcaggagggatgatctggaatctcttggctatgtgcttatgtactttctcagaggaagccttccttggcagggattgaaagcaggcaccaagaagcaaaaatatgacaagattagtgaaaagaagatgctaacccccattgaggttctatgtaaatcatatccatcggagttcatatcatattttcactattgccgttcattacggtttgaagacaaaccagactattcatatttgaagaggcttttccgggatttatttatccgtgaaggataccaatttgactatgtctttgactggacaatattgaagtaccctcaaattggtgccagttctcgaggacggaatcctagcggaagtgcgggaatgagtgcaggaccatctgcagaacgagcaggaaggacctcagtggggcaagatattagagatagattctctggtgcagttgaagcattttcaagaagaaatgcttcaagttctgctcggcatggtgaacacacaagacacagatcagatgacgtaccttcatcaaaggatgtgcaagctgattcagaaaaaggtcgaacttcacgaaatggcagctcttcgaaaagagctgccatctcaagcagcagaccaagctcctctggtgagcacactgatggtcgctcaagcagactagtgtcgagcagtggcggccggttgtctaccacccaaagaattcaacctggcattgatgccaaaccatcttccttttctcgtacatcagtgactaaaggcactcgtgaggaccctctccggagctttgagttcctttctatcaggaagtagtggatgggattgtaaaaagtaaattacttgtcacacggactaccggcgaactgtttgaggaactcttgacattttcgcactcctgtaaatgggaaatgtgtccgatacaacaagtaaagctcaaccaacttccccaatgtgtctcctgtctcgtttttgtttcgagtttctggctgttgtaacgcattttagactcatctaaaaagatgagttttatgtgcgggaattttcttatgtatgagactttggatattctacaataaa

SEQ ID NO: 8224 - DNA, 1901 bp, Flaveria ramosissima
tcttaaaagttagtttcttgatttgggtattgcgcgaaagttttctgtttcatcaacgttggtggttctagggtttttttttcgtatccatcgtcaccgacaaatcttgaagttcaattgttagaacacgagtcttcgtgttaaggttttctggggattttgggcgagtttgtgttgtgggttttgatggatctgagtgcattttggagatcttagtttttttgcggtgaaatttcttcaagtaatttgtagtagttgattatctgattagggtttatttgattgtggatttgggatttcatcatggatcatgtgattggtgggaagttcaagcttggtaggaagattggtagtggatctttggtgaactttattgggagtaaatcttcaaagtaaagaggaagttgcggtcaagctagaaaatgttaagaccaagcacccacagcttcactatgaggcaaaattgtacatgcttcttcaaggcggaaccggtgttccccaccttaaatggattggagttgaaggagaatataatgctatggttatcgatcttcttggaccgagcttagaagatctatttaattactgtaaccgaaaattcacattaaaaacagttttgatgcttgcagatcagttgataaatagagttgaatatatgcattcaagaggtttccttcaccgtgatataaagccagataactttttgatgggtttaggacgaaaggcaaaccaggtttacattatagattacggtctagcaaaaaagtatagggatctccagacacacaagcatataccatacagagaaaacaaaaatctcactggtactgcccgttatgccagtgttaatacccaccttggagttgagcagagcaggagggatgatctggaatctcttggttatgtactcatgtatttcttgagaggaagccttccgtggcaggggctaaaagctgggactaagaagcagaagtatgataaaattagtgaaaagaagatgcttactcctatagaggtgctatgcaagtcttatccaactgaattcacatcgtattttcattattgtcgatcattacggtttgatgacaagccggattattcatacttgaaaaggcttttccgggatcttttcattcgagaaggttatcagtttgactatgtttttgattggactatgttgaagtaccctcaaattggtccaggatccagttctagaggacggacggttggaaaactaccactgaatcctggaccttcggcagaaagggtggaaaaaaccccagtgagacccgaggcccgagatagattctcaggcacagttgagtcattagctaggcgtagcggcttgcatggtgatcactcgagacatagatcttctgaacatgcaacaccaaccaaagaaatgcatggtgactcagataaagcccgaatcacacgaactggtagtacttcaaaaagagcagttgtatcaagcagccgcccaagctcatctggtgagcccaatgaaagccggtcaaaccgtcttgtttcaggtagtggtcgcatatcaaccacccaacggctccattctcaacctgggttcgagtccaagtcatcatctttcacacgggccataccctcatctagaggtggccgtgatgacgcccttagaagctttgaactgcttaccattggcaagaggaaataagaagccgcattttgtcgtgggacccgtttactataattccatttacacctaaaaatttctttacaaaagtattcatccttaatcatgtagactgtatcttacatagggtgatgttcatatgttgtcaaaatgtttatgttgaattgttagaaactggtatttgactttcgtttggtatttaaatgtaatcaaaatgctaattatcttctctgac

SEQ ID NO: 8225 - DNA, 2130 bp, Flaveria ramosissima
tcttatccctaatattttcccctcaaaatccgtcgtctgcttcacttgttttcttcttcctgtagatcctatggactctcaaaccctaaaaccatttcccccttgatttcttcttcatcgatctgattcccaaaatcttcacttttaccatttctcgatcagtaaacaacttaatcgcgtgtatgtttgctatgcattgccgcagttgttgattgtttgatcgattcatcttaaaagttagtttcttgatttgggtattgggcgaaagttttctgtttcatcaacgttggtggttctaggttttttttttcgatccatcgtcaccgacaaatcttgaagttcaattgttagaacacgagccttcgtgttgaagttttctggggattttggcgagtttgtgttgttgggttttgatggatctgagtgcattttggagatcttagtttttttgcggtgaaatttctttaagtaatttgtagtagttgattatcggattagggtttatttgattgtggatttgggatttcatcatggatcatgtgattggtgggaagttcaagcttggtaggaagattggcagtggatcttttggagaactttatttgggagtaaatcttcaaagtaaagaggaagttgctgtcaagctagaatctgttaagaccaagcacccacagcttcactatgaggcaaaattgtacatgcttcttcaaggcggaaccggtgttccccaccttaaatggattggagttgaaggagaatataatgctatggttattgatcttcttggaccgagcttagaagatctatttaattactgtaaccggaaattcacattaaaaacagttttgatgcttgcagatcagttgataaatagagttgaatatatgcattcaagaggcttccttcaccgtgatataaagccagataactttttgatgggtttaggacgaaaggcaaaccaggtttacattatagattatggtcttgcaaaaaagtatagggatctccagacacataagcatataccatacagagaaaacaaaaatctcactggtactgcccgttatgccagtgttaatacccatcttggagttgagcagagcaggcgggatgatctggaatctcttggttatgtactcatgtatttcttgagaggaagccttccttggcaggggctaaaagctggcactaagaagcagaagtatgataaaattagtgaaaagaagatgcttactcctatagaggtgctatgcaagtcttatccaactgaattcacatcatattttcattattgtcgatcattgcggtttgatgacaagccggattattcatacttgaaaaggcttttccgggatcttttcattcgagaaggttatcagtttgactatgtttttgactggactatattgaagtatcctcaaattggttcaggttccagttctagaggacggacggttggaaaactaccaatgaatcccggaccttcggcagaaagagttgaaaaaaccccagtgagacccgaggctcgagatagattctcaggcacagttgaggcattagctaggcgtagtggcttgcatggtgatcactcgagacacagatcttctgaacatgcaacaccaaccaaagaaatgcatggtgactcagataaagcccgcatcacacgaactggtagtacttcaaaaagagcagttgtatcaagcagccgcccaagctcatctggtgagcccaatgagagccggtcaaaccgtctcggttcaggtagtggtcgcatatcaaccacccggctccattctcaacctgggttcgagtccaagtcatcatctttcacacgggccatgccctcatcaagaggtggtcgcgatgatgcccttagaagctttgaactgcttaccattggcaaaaggaaataagaagccgcatttttgtcgtgggacccgtttaccataaatccatttacaccaaaaatttcttttcaaaagattcatccttaatcatgtagactgtatcttacataagggtggatgttcatatgttgtcaaaatgtttatgatgaattgttgaaactggatttgactttggtatttaaatgtaatcaaaatgcaattatcctctccaaaaaaaaatatt

SEQ ID NO: 8226 - DNA, 2175 bp, Panax ginseng
tacaatttaattttatatgtatatatatttgttctgatcaatgacgttggatatgatactttatgaaattagtgttcaatttatcctccgccgttgatgattaggggttttcaataatcgaagttcgatatttgttgggattttttgtgtttaatttgctcaacaaattttatctgttggcattagaatcagtgcagtgtaattgcacatgtcttttatgatccgttggctctcaatttggttgatttgaatgcgttgtgggggttaaattgtttggtgggttaggtataacccgaattggtgttaaatttggcatagatctgagtagaggtaggtccaaaaagaggattgggaatcatggatcatgttgtgggggggaagtttaagctgggaaggaaaattggaagtgggtcttttggtgagctgtatttaggtattaatattcaaagtggagaagaagtggccatcaagctggaaactgtcaagacaaagcaccctcagcttcactatgaatcaaaaatttatatgcttctccaaggaggaacggggattccgaacttcaaatggttcggagtggagggtgagtacaatatcatggttattgaccttcttggcccgagtttggaagatctattcaactattgcaacagaaaactctcactgaaaacagtattgatgcttgcagatcaactaataaatagagttgaatacatgcattcaagaggttttcttcaccgtgacataaagcctgacaactttttaatgggcctagggcgcaaagcaaatcaggtatacgttatcgactttggccttgcaaagaagtatagggatcttcaaactcataagcacataccgtacagggaaaacaaaaatcttacaggcactgctcgctatgctagtgttaacacacacctaggagttgaacaatgcagaagggatgatctggaatctctcggttacgtgcttatgtatttcttaagaggaagtcttccctggcagggtctgaaagccggcaacaaaaagcagaagtatgataaaattagtgaaaagaagatgttaacacctatagaggtgctatgcaaatcatatccttcagaattcatatcatacttccattactgccgatcattacgttttgaagacaaaccagattattcatatttgaaaaggcttttcagggacttgtttattcgcgaaggttatcaatttgattatgtttttgattggaccatattgaagtatcctcagattggggccagttctaaagaaaggaatcctagtgggaatgcaggaccatctgccgaaaagccaggaaggatctcagtaggacaagatattagagaaaaattctcaggtgctgttgaagcattttccagaagaaatacttcaggtcctggtcggcatggtgaacactcctccagacacagaagtttagatgaagtagcttcatccaaggaagtgcaagctgattctgaaaaaggccgaacttctcgaaatggcagctcttcaaaaagagcagccattacaagcagcagcagaccaagctcctctggtgaattcactgacggacgctcgagccgattagtatcaagcattggccgactgtctactacgcaaagaatccaacccgggacagactccaaaccaccaacatattctcgtaatgtggtcaccaagggttctcgggatgatcctcttcgtagctttgatttcctttcaatcaggaagtaaattaatgtttttatggtaaaaagtaaattactcggttctcaaaatggacaaataccattcttcacacttgtaaatgggaagtttagtgtcaagtaaaggtggtctgatctagcagtattatttccgccaccgtaaggagctttagactcctccaaaggtgatgagttttatgcaaaaaatgtgtagctgtaataaatgatgtttgccttgaagattattatttggtgaccttaattcttaaatattagtaaatcaataggcggagggagtattatagtaaaaaaaaaacaaaaaaaaacaaaaaaaacaaaaaaaaacaaaaaaaacaaaaaaaaacaaaaaaacaaaaaaaacaaaaaacaaaaacaaaagaagaagagagagagacacagagagagaccacccccacccccccccccccccccccccccccccccccccccc

SEQ ID NO: 8227 - DNA, 2845 bp, Aristolochia fimbriata
gcttcgcccctcgtttgtgttttttggtttttgctcttctctttctccgtctctgtaaatcgatttggttgccattaaaatcagggaatttgttcttttctagtctcgataaaggcatttgtataaagaaagccaaggtatcgataaaataaagaaagaataatttttttttttaaaaaaaagtgatcgtcccaccagctttttctccttggcattcctttccctttcttcggtgccttttgttcctttttgcaattcgctcctccgggctccgcctctctcgattttttcttattcttgatttctttctgggtttgcctgttaggggttggtgttgccgaattttttcttttttattttatttttggttgaatggggagtttcttgagggggttttgaagtgcggaatttgtggcggggtgtgtagttgttgttgttgttgcagatctgaaggactcgggggcggaaccggcgccgaccgcggatgttttggcggcattaaattttttttggtagagggtaatcggttccttttcgctttgggtttgattgggctccttaatcgtgggtttcaatcgcggtagattgttttggtgaatgtcggcgggtgttatgggaatggtggtttggattcgagggtaggtgtgaaattagggcttcgattcgctggtgatggagggttggggctttgcttcggatgggaaggtggttgcttgggattgattggctgaggtgcggattagggtttccttttcggagttttgtgaatcagaaagattcgtgtccttctttcggacgaggcttttgccaaacggagctgattcttctgttgtcgaaaggatttggtgctatcgggaactgtcctttctctgacctctgagctgcattctcgtggaatctatgaacagacttggcaatcgagctaggtgaattatattagaaaaagctgaacttgtagcttccttcgttccatctcatacgggaattttttgtcactttgcaccatggagcatgtcattggtggaaagtttaaactggggcgtaagattggtagtggatcctttggtgagctttatctaggtgttaacgttcaaaccggcgaggaagtggctatcaagctggaatctgtgaagacaaaacatcctcaacttcattatgaatccaagctatatatgcttcttcaagggggcacgggcattcctcacctcaaatggtttggagtggagggggagtacaatgtaatggccattgatcttcttggacctagtttggaagacttatttaattattgtaatagaaagttcagtctgaaaacagttctgatgcttgctgatcagctgatcaaccgagttgaattcatgcacgcaagggggtttcttcaccgagatattaagccagataactttctgatgggtctaggtcgcagggccaaccaggtctatatcattgattatggtctggcaaaaaaatatcgagacctgcagacacataagcatatcccatacagggaaaacaagaacttgactgggacagctcggtatgcaagtgtaaatactcaccttggagttgaacaaagcagaagagacgatctggaatctcttggttatgtcctaatgtatttcttgagaggaagcctcccttggcagggtttaaaagctggcactaaaaagcagaagtatgataaaattagtgaaaaaaagatgctaacacccatagaggtgctatgcaaatcttatccatctgaattcatttcatatttccactactgtcgttctctgcgatttgatgacaagccagattactcttatctaaaaaggcttttccgtgatctcttcattcgagaaggttatcagtttgattatgtgtttgattggactatcttgaaataccctcaaattggggctaatgcaagatcaaggcagtctggaaaaactggtgtggcagctggtccatctgctgaaagaccttcagtgggacaagaaatccgtgacagattttccggtgctgtcgaggcatttgcaagaagaaatagttctggtctgcatggcgatcactccaaactcaaggtggaagaggcttcatccaaagaagtggcaaatgattcagagagggggcgtggctcatcttctcgtaatggaagtacgtctaagcgagctgtgttgtcaggcagcaggcctagctcctccggtgagactggtgatcagaatattattaggacatcccgaggtctttcttcaagtgtcggtcgtccttcaacctaccaaagagggcaaccagggtatgaggcttcgaggtcagtcacacggactgctgcaaccagaggtacacgtgaggaaaaccccctacgaagttttgagttgctttcaattggtgctgacaagcgaaaatgacaagggattgacagattcaaaggaaaacttgagtacaaaaaataggattggaaaagtcattagctgcttttcctagtgacagttttccttttcattttttactatgttcgaccatgtatcattttagccttggtgctctggtgcttatgtttatatagtgcaaatttgtaatcagctactgtttgcttttgaagattacgcttcctaatattcgttgagaaacattatggtgctttaagaacattttaggttttgcctttatattcttttagtggtgctcctgctgtgctggtactaccgaaagctctgcattgatatttacaatgtgcatgactttcgtttctttttctctttattgttgaaagatgggaacatagtttattagctttatttgtatcatagatagtgatctcatagaagcgttcgacgacccagcagggaaattgttctaaaaa

SEQ ID NO: 8228 - DNA, 1697 bp, Cirsium arvense
tttccggcggtgaatttttgtcaaggaattggatacaagttaatttattcgaatccgctaagggtttagttgtttgggatttcatcatggatcatgtgattggtgggaagtttaagctcgggaggaagattggtagtggatctttcggagagctttatttgggagtaaatgttcaaagtggagaagaagttgctgtcaagctggagtctgttaagaccaagcatccacagcttcactatgaggccaaattgtacatgcttcttcaaggaggaactggtgttccccacctcaaatggataggagttgaaggcgaatacaatgctatggttattgatcttcttggaccaagcttagaagatttgttcaattattgtaatcggaaattcacgttgaaaacagttttaatgcttgcggatcagttgatcaacagagttgaatatatgcattcaagaggtttccttcaccgtgatataaagccagacaactttttgatgggtctaggacggaaggcaaatcaggtttacattattgattatggtcttgcgaagaagtatagggatctgcagactcacaagcatataccatatagggaaaacaaaaatctcacaggcacagctcgttatgccagtgtcaacacccaccttggagttgagcaaagcaggagggatgatctggaatctctcggttacgtacttatgtatttcctgagaggaagccttccatggcaggggttgaaagctggcactaagaagcagaaatatgataaaattagtgaaaagaagatgcttactcccattgaggtgctttgcaaatcttatccttccgaattcatatcatattttcattattgccgatcattgcgatttgatgacaagcctgattattcgtacttgaagaggcttttccgtgatctgttcattagagaaggttatcagtttgactatgtatttgactggactatattgaagtatccccaaattggctccagttctagaggaaggacggctgcaaaatttccattgaaccctggaccatcagcagagagagcagaaaggaccaccccagtgagacaagaggttcgagatagattctcaggtgcagttgaggctcttactagacggaatgggtctggtagcggcttgcataatgatcatcctaggcacagatcttcggagcatgtaacatcgtccaaggatgtgcatggtgatgttgagagaggtcgcatttcacggaatggtagtagttcaaaacgagcagtggtttcaagcagccggccaagctcatctggtgaaccaagtgatggtcgaaccaagcggctaggctcatctggtgaaccaagtgatggtcgaaccaagcggctaggaggctcaggctcaggcagtggtcgcatatcaaccacccaaagacttcactctcaacctgggttcgagtccaaatcatcatcgttcactcgtcctgtagcctcaagaagtggtcgtgatgatgctcttcgaagcttcgagttgttaaccattggcacgggaggtaagagaaagtagagaaacaaacaatctcactttactaaaatatatggtcgtaaaaacctgtatcttttacatttgtttttttcatctttctgtaatccttcctttcacaaagcgaaacctaaaaattggttattggttcgttatttctttctttctttccactctaatgtc

SEQ ID NO: 8229 - DNA, 2171 bp, Olea europaea
tctttatcataattctacgacacactcattttgaaagaattaaacaaaaagcaattatatatacatattttcaatctcatagatagatatctgttcatatattgattgccttttgttctgttttcatttcatttgatcaatgaggatccattatgatcccgcagttaggttttcggtttaagctttatgttgattaatatttcaagaacgtagcttaagaattgaagaattttcctgatagtttttcggtactgatttcttggatccgttttgtggtagtgatttggtaagttttcttgattctgtttgaggggttgacattaattaactagtgggctctggattgctgttgagattggcaatcaagctcctgggagctgtgggtattattgaaatttggtgaagtcttcattgaagagtggtggctgtcgaattctaattatttatcatggatcatgttgtgggtggaaaattcaagcttggtaggaaaattggaagtggttcatttggtgaactctatttaggtgtcaatattcaaaatggagaagaagttgccatcaagctggaatctgtgaagaccaagcatcctcaacttcactatgaatcaaaaatttatatacttctccaaggtggaactggcattcccaacctgaaatggttcggaagtgagggagagtacagtgttatggtaatcgaccttcttggaccaagtctggaagatctcttcaactattgcaacagaaagttctccttgaaaacagtactaatgcttgcagatcaattaattaatagagtggaatacatgcattcaagagggtttcttcaccgtgatataaagcctgataactttttgatgggcttagggcgcaaagcaaatcaggtttacgccattgactttggtcttgccaaaaaatatagggacctccagactcataagcacataccgtacagggaaaacaaaaatcttacaggtactgctcgttatgccagtgtcaacacacaccttggcgttgaacaaagccgaagggatgacttggaatctcttggttatgtccttatgtatttcctgagaggaagccttccctggcaggggttgaaagccggcaccaagaagcagaaatatgacaagattagtgaaaagaagatgttaacccctatagaggttctgtgcaaatcatatccatcagagtttgtatcgtattttcattattgtcgatcattaagattcgaggacaagccagattattcatatttgaagaggcttttccgagatttatttattcgtgaaggttatcaatttgactatgtttttgactggactatattgaagtatcctcagattggtgccagttctagagcacgaaatccgagtgggaatgcagggttaaatgctggaccttctggtgaaagaatggggagaacatcagtggggcaagatattcgagatagattctcaggtgctgttgaggctttttccagaagacatacgtcaggttcaggtcacaggcataggacatcagaagatgtaccttcatcaaaggatgtgcaaccagattcagaaagaggtagaacatcacgaaatggcagctcttcgaaaagagctgccattttaagcagaccaagctcgtctggtgaacccactgatggccggtcaagcagattggtatcgagcagtggccgtttgtctaccacaaaaagaattgggattgaacccaaaccatcatctttctctcgtggtgcagtgaccaaagggactcgtaatgaccctcttcgaagcttcgaattcctgtcaatcaggaagtaagtgaaccggttcttgtaaaaatgtggacgaacgccttctatttaaggaaatctctgcactatcaaatttgtgtgaatggaaaatgggagttacacaataattatcgctcctctctggtcacttttttgtttagaggagttgcctttgtatcgcattctgtgctagtccaagaaaggttcgagttttatgtgcgggaattttctactttgtacaagacaagggtagatggaatcatgttgtttatatttgcatcaatggatgtacatgattgcaacttgaccaagttcaatattgtttccttgaaagtctgcatacttttttcagatgtttaatctaaagaaattttaaatgcaaattttttcactct

SEQ ID NO: 8230 - DNA, 2597 bp, Citrus sinensis
gcctccttaattggtctctctctctcttcccagtttcttagctttttcgccttataattttatttttatttgtctctcttcctcctcttcctcctcgttctcctccttctctgtctcttcaacacgttttcctgtttcctcagaaacactgtcgttgtgtttatttatttatttttcatcaattatcctgatcacgataccaaaaaaaaaacaaaaaaaagaaaagaaaagaaaaactctctttctttcgtttttacttcaattcccgttttactctttgcatttccaatagagagtttctggtcaatgtgcctggattgtttatagaaaattaaattagggtttcggtcctcaattgaagatttggggatcgagcgttgttgaagaaaattttcttgcttttatcggcaactcatcctctttttgggacaattctatgttaatcgaatgcattagatgattccattggtggataatcaataaaaaaggaaaaaaaataaagaaaggggagattttattttatttttgttaatttgacctgccggtgtgttaatttggcaaatctgttatttcatttttactttttatttttttggattcaactgtttggtgggtattgggattttcgacgaccattgtcaaattgagcacaaatctgggttaaataaagctagattgagctagttgtttctatgtttgccgacgggaaattgagaatggaccatgtgattggtggcaagtttaagttggggaggaagatcggtagtggctccttcggagagctttatttaggtgtcaatgtacaaactggagaggaaattgctgtcaagctggaacttgtgaagaccaagcatccacagcttcattacgaatcaaaattgtatatgcttcttcagggaggaactggaattcctcacctcaagtggtttggagttgaaggggactacaatatcatggttattgatcttcttggaccaagtttagaagatttgttcaattattgcaatagaaagttctctttgaaaacagtattgatgcttgcggatcaattaattaatagagtggaatacatgcactcaaggggctttcttcaccgtgatataaagcctgacaatttcttaatgggccttggacgcaaagcaaatcaggtctacataattgactatggccttgcaaagaagtatagggatcttcaaactcataagcacatcccatacagggaaaataagaatctcaccggcacagctcgctatgcaagtgtaaatactcaccttggagttgaacaaagccgaagggatgatttagagtctcttggttatgtccttatgtatttccttagaggaagccttccctggcaaggattaaaagctggcacaaaaaagcaaaaatatgataagatcagcgaaaagaaggtgtcaactccgatagaggtgctctgtaaatcatacccatctgagtttgtatcatactttcattactgtcgatcgttgcggtttgaggacaaaccagattattcatatttaaagaggcttttccgcgacttatttattcgagaaggttttcagtttgactatgtatttgattggactgtattaaagtaccctcagattggttccagctctaaaggaaggcattccagtgggaaggtaggcttaaccccaggaccatctgctgaaagaccagaaaggggttcagttgggaaggagattagggataaattgtctggtgcagttgaagcattttcaagaaaaaatgctgctggtactcctcatcgtgatcatcccagacacaagagttcagatgatggtccttcatctaagcatgtgaaccctgattctgaaaaaggacgaagcttttcccggtatggaagcacttcaagaaaagctgtaatcgcaagcactaaacctggttcatctggtgaattcagtgagtgtcgctctagccgactagtctcaagcagtggccgcttgtctaccacgcaaagattgcaatctgggtatgattccaggcaatcttcatttaatcgcactgctggtggaagaatctgcacccgtgatgatcctattcggagttttgagatgctgtcaatcaggaaatgatgtttatttgatgaatttgtgagaaggtattgcttatgcacgtagtggccgcgaagaattcttgacagttatagtctcacttttgtctatgggataaaacctagtcgaatgccataacaggtcattttgactcataaaaggacgtatcccaatcatttttctgcttcctcttgttttattcattccattttaattgttcctgggagcttcacgtcaatgtaacgtgtcctagactgacggattggagaaaagggaatttctgtattggaatttcatttatctatgtgacttgaatagctgtaatgattactcctattcttatgcttttgagaccgaaagtagtaatgaatctatcatctatgtacttgggcggaaatggggacaattttctttaagatgagagcatgagcttcatccggtttactagtttatttcttgttccaggtgatgctagatcataacaaaaagcttaccttttctttttttcgattctcttat

SEQ ID NO: 8231 - DNA, 2323 bp, Papaver somniferum
ggggagacttagtttatctcaattttcctacctctctcttctcctcgtcttttgtcttctaaattcgttcagatcatatccagatccgtaaatatatctctctcataattatctgcactctctgtaatttttgtacaatttttttgatcttgttgctggattaaagatcagttttattcgatcgatttttttaatcgcatttgacttaacctttttttcttttctaacttttaggaagaattagggtttcaattggatatattggttacagatccaagatattgagtatcagtttgattagggtttcgatttggaggcaaatgcttattttctaaggtgaattaatctcgaggaattactggattgcttaaagaagaggaggaagattattattgtggttgagtatggatgaagaaataggggggagacttagtttatctcaatttcatcaatgacaagtaggaagagcgaatttggttggaaaagtttagctggaagaaggtcataactattaattagagcggattttcgtctctaagattgaattaagggggtaattaactagagaaaaatcatggaaagtgttatcggtggtaagtttaaacttggacgaaagattggaagtggatcttttggcgagctttatctaggtgttaacatacaaactggggaggaggtcgccattaagctggaatctgtaaagaccaagcaccctcaactccactatgaatccaaattgtatatgctccttcaaggaggaacgggaattccccacctgaagtggtttggagttgagacggattataactgcatggttattgaccttctcgggccaagcttggaagacttattcaactactgcaaccggaagtttacgttgaaaacagttcttatgcttgctgatcaattaattaacagagttgaatacatgcattcaaggggttttcttcaccgtgatattaaacccgacaatttcttgatgggtttagggcgtcgagcaaatcaggtatacatcattgactacggccttgcaaaaaagtacagggatcttcaaacccataagcacataccatacagggaaaataagaatctcactggaactgctcgctatgcaagtgtaaatactcatcttggagttgagcaaagcaggagagatgatctggagtctcttggttacgtgctgatgtattttttaagaggaagccttccctggcagggattgaaagctggaaataagaaacaaaaatatgacaagatcagtgaaaagaagatgttaactcctatagaggtgctctgcaagtcatatccgtcagagttcatatcatatttccactattgtcgatcactgaggtttgaggataagccagattactcgtatctgaagaggcttttccgtgatctatttattagagaaggttatcagtttgattatgtctttgactggactgtattgaagtacccccagattggcgcaaattctagaacagcaagggtgcctagtggtagagttggcacgaatgcaggaccttctgctgaaagagtagaaagacctacagtggggcaagagattcgcgaaagattttcaggcgcagtagaagcttttgctagaagaaacagtccaggtcccagtgcacatgctgatcactctaagaacaagaatccagaggattcctcaacatcgagagaggtacttgattctgaaaagttgcgaacttcatctaggaatggcagttcttcaaggagagcaattgcatcaagcagccggcctacttcttctggtgagcctagtgagagtcgaacaagtcgaatactctcaggcagcagcaatcgcctttcaactgcacaaaggacgattcaacctgggctggaatccaaatcaacatcactctctcgcaccgctggttcaaggggtaatcgggatgatcatcttcgaagtttcgagcttctctcaattggcacagagagaagaggaagtaagtagcgagaatcaggaatcatccaaatttggtaataacttgtttcccttttattaattcaagggaaagatccctgtgctgtttgtacaattagttttccaagcattttaaatacctccgatatatgtatattcacaaactctttaagtttccgattttcttaaagccaaatttggaatccattcgcccatcttcatttctcttggatgagtatttcctgtaatcttttttttttgtttttgtttgtgtctttgaaattccgttgtagttcttcttcctccaagaagaggaagatcaccaagatcacctcttttggggaatcgctgaaatgaagatgtttctgtttg

SEQ ID NO: 8232 - DNA, 2175 bp, Solanum phureja
tctctcttcatagctttgttcacagcacacagcatcaaaatcatttgctttctttttctaaaaacaccttttttttcctttctgtttctcactttgcccctcgatctttgcttctttgtccccttttttctgattcctctgtcaaaacaaaccgaaagttttctatttatatacagaagaaaatctacacggtttttgtttctacttttatcctacgttgattacctttttttgttttaattgatcaatgtggatcgatgacttaatttgtgatttagggttctaattctttatgggtatttgaagattgacccgagttttttttttttttgttgaaggatatagctgaataagacagttgttgctgcataatttttaggatttttgttgttgttgttgttgttgggttttgcctcattgtggggtttggattgaaaattgaattgtttaacgatattttggtgtgaaagtattgttcttggcgaaaaaaggtgattattgctgtgaaagtattgtttttggtgaatttgaagagggtgattgaatcaccatggatcatgttgtgggtgggaagtttaagctgggaaggaagattggaagtgggtcttttggtgagctttatttaggtgtgaatttacagaatggagaagaagttgctattaagctggaatctgtcaagacgaggcaccctcaactgcactatgaatcgaaaatttatatgctactccaaggaggaaccgggattcctaacctcaaatggtttggagtggagggcgagtacaatataatggtcattgaccttcttggaccaagtttggaagaccttttcaactattgcaacaggttgtttactttgaaaacagtgttaatgctagcagatcaactcattaatagagttgaatacatgcactccagaggatttcttcaccgtgacataaagccagacaacttcttaatgggcttaggtcgcaaggcaaatcaggtttatgcaattgactttgggcttgccaaaaagtatagggatctccagactcacaagcatataccatacagggaaaacaagaatctgactggaactgctcggtatgcaagtgtcaacacacatcttggagttgagcaaagcagaagagatgatttggaatctcttggttatgtgcttatgtattttcttagaggaagccttccatggcagggacttaaaggtggtactaagaagcagaaatatgacaaaatcagtgagaaaaagatgttaacaccaatagaggtgctgtgcaaatcttatccatctgagttcatatcatacttccactactgtcgatcattaagatttgaagataaacctgactattcatatttgaagaggcttttcagagacttgtttattcgtgaaggctatcaattcgactatgtatttgattggacaattttgaagtatcctcagattggtgccagttctcgaggacgaaatcctagtgggaatgctggactaaatgctgggccatctgcagaaaggccaggaagggcgtcagtggggcaagatattcgggatagatttactggtgctgttgaagcattttccagaaggaatacttctgcagctggtaggcatggggaacactccagacagaggacttcagaggatattccttcatccaaagatgtgcaagctgattcagagagaggccgtagctcgagaaatggaagctcttctaaaagagctgtcatgtcaagcagcaaaccgacctcttctactgaacccacggatagtcgttcaagcagattagtgtcaagcactggccgtctatctaccacacagagaattcagcagggaattgaaacaaaaccatcatcattctcgcgaacttcactcacaaagggcaaccatgataaccctcttcggagctttgaatttctttcaatcagaaagtaagagaatgcacttgtaaagagagaatttctcaatcctatttacggaggatgtctccaagtgctgtaaattagttaatgtgctgtaccttctatatgtgacaattgaagcttatccaacttatcatattccttgtttttgtttctagattagagatgctggccaccatagtgcatttagactcatccaaagaaatgttgagtaaagtgcgagagttttttatatatatatatatgaataaatatatt

SEQ ID NO: 8233 - DNA, 1321 bp, Panax ginseng
ggtaagtttaagcttgggaggaaattgggagtggatcatttggggaggctttatttgggagtaaatgtacaaacaggagaagaagttgcttgtaagctggaatcagctaagactaaacatcctcagctccactatgaatcaaagttatacatgcttcttcagggaggaactggtattccccatctcaagtggtttggagttgaaggagaatacaatgccatggttatcgaccttcttggaccaagccttgaggacttgttcaactattgtaatcggaagtttacgttgaaaacagttttaatgttagctgatcagttaatcaatagagttgaatatatgcactcgagaggttttcttcaccgtgatataaagcctgataactttttaatgggtttagggcgcaaagcaaatcaggtgtacatcattgactacggtcttgcaaaaaagtatagggatcttcaaacacacaagcatataccatacagggaaacaaaaatctcactggaacagctcgttacgcgagtgttaacacccatcttggagttgagcaaagcaggcgagacgatctggaatctcttggttatgtgcttatgtactttttgaggggaagccttccctggcagggtctgaaagctggcacaaaaaacaaaagtatgacaaaattagtgaaaagaagatgcttactcccattgaggttctttgcaaatcttatccatcagaattcatatcatacttccattattgccgttcattgcggtttgatgacaaaccagattattcatacttgaagaggcttttcagggatttatttattagagaaggttatcagtttgactatgtatttgactggactattttgaagtatccacagattggctccagttctagaggacggcaaccagctgggaaattagctttgaatcctggaccatctgcagatagagcagaaaagacgccagtgaaacgagagatgagagatagattctcaggcgcagttgaggcatttgctagaagaaatggttccggtgcaggtttgcatggagatcactcaaggcacagatcttcagacaatgtaccatcatcaaaggatgtgcaagctgacaaagaaagaggacaggtttctcgaaccggaagtgcttcaaagagagctgtcatatcaagcagccggccaagctcctctggtgaacccagcgagaacaggttgaatcggctgggttcaagcagtggtcgtttgtccaccacccaaaggattcaacctggttttgagtccaaatcatcatcgtttactcgtgctgtagcaagaggtggccgtgatgatgct

SEQ ID NO: 8234 - DNA, 1765 bp, Flaveria ramosissima
aaagtttctgtttcatcgacggtggtgattcagggtttttttttttcgatccatcgtcaccgacaaatcttgaaattcaattgttagaacacgagtcttcgtgttgaagttttctgtggattttgggcgagtttgtgttgtgggttttgatggatctgagtgcattttggagatcttagtttttatgcggtgaaatttcttcaagtaatttgtagtagttgattatctgattagggtttatttgattgtggatttgggatttcatcatggatcatgtgattggtgggaagttcaagcttggtaggaagattggcagtggatcttttggagaactttatttgggagtaaatcttcaaagtaaagaggaagttgctgtcaagctagaatctgttaagaccaagcacccacagcttcactatgaggcaaaattgtacatgcttcttcaaggcggaaccggtgttccccaccttaaatggattggagttgaaggagaatataatgctatggttatcgatcttcttggaccgagcttagaagatctatttaattactgtaaccggaaattcacattaaaaacagttttgatgcttgcagatcagttgataaatagagttgaatatatgcattcaagaggcttccttcaccgtgatataaagccagataactttttgatgggtttaggacgaaaggcaaaccaggtttacattatagattatggtcttgcaaaaaagtatagggatctccagacacacaagcatataccatacagagaaaacaaaaatctcactggtactgcccgttatgccagtgttaatacccatcttggagttgagcagagcaggagggatgatctggaatctcttggttatgtactcatgtatttcttgagaggaagccttccttggcaggggctaaaagctggcactaagaagcagaagtatgataaaattagtgaaaagaagatgcttactcctatagaggtgctatgcaagtcttatccaactgaattcacatcatattttcattattgtcgatcattgcggtttgatgacaagccggattattcatacttgaaaaggcttttccgggatcttttcattcgagaaggttatcagtttgactatgtttttgactggactatattgaagtatcctcagattggttcaggttccagttctagaggacggacggttggaaaactaccactgaatcccggactttcggcagaaagagtggaaaaaaccccagtgagacccgaggctcgagatagattctcaggcacagttgaggcattaactaggcgtagcggcttgcatggtgatcactcgagacacagatcttctgaacatgcaacaccaaccaaagaaatgcatggtgactcggataaagcgcgcatcacacgaactggtagtacttcaaaaagagcagttgtatcaagcagccgcccaagctcatctggtgagcccaatgagagccggtcaaaccgtctcggttcaggtagtggtcgcatatcaaccacccggctccattctcaacctgggttcgagtccaagtcatcatctttcacacgggccatgccctcatcaagaggtggtcgcgatgatgcccttagaagctttgaactgcttaccattggcaaaaggaaataagaagccgcatttttgtcgtgggacccgtttacataaatccatttacacctaaaaatttcttttaaaagattcatccttaatcatgtagactgtatcttacataagggtgatgttca

SEQ ID NO: 8235 - DNA, 1598 bp, Euonymus alatus
tactagacaaaataagggtgaattgggcattaatctgggtgttatatctatatcttgtgttgaattgagctcgttgataagaatttgaagatggatcatgtagttggtagcaagttcaagctggggaggaagatcgggagtgggtcctttggagagctctatttgggtgtaaatgtacaaactggggaagaagttgctgttaagttggaacctgtgaaaaccaagcatccgcagcttcactatgagtcaaagttgtacatgcttcttcaaggaggaactggaatcccccacctcaaatggtttggtgttgagggcgactacaatataatggttattgaccttcttggaccaagtttggaagatttgttcaactactgcaacagaaaattttcgttgaaaacagtattgatgcttgcagatcaattaatcaacagagtggaatacatgcactcaagaggttttcttcaccgtgatataaagcctgacaacttcttaatgggcctggggcgcaaagcaaaccaggtatacgtcattgattatggccttgcaaagaagtatagggatcttcagacacacaagcatatcccatacagagaaaacaagaaccttacaggcacagctcgctatgcaagtgtcaatactcatcttggagttgagcaaagcagaagggatgatctggaatctcttggttatgtgcttatgtacttcctaagaggaagccttccctggcagggattaaaagctggtacaaaaaagcaaaagtatgataagatcagtgaaaagaaagtttcaactcctatagaggtgctttgtagatcatacccgactgagttttattcatacttccattactgtcgatcattgaggtttgaagacaaaccagactattcatatctgaaaaggctttttagagatctatttattcgagaaggttatcagttcgactatgtatttgactggactgtgttaaagtaccctcagattggtggcagctctagggggcggaattcgagcgggaaaccaggtttaaatgctggtccatctgcagaaaaaccggaacggatttcagttgggaaggagatccgggaaagattctctggtgctgttgaagcattttccagaaggaatacagcgagtcctaatccacatggtgatttatccaaacacaggatttcagagaaccaacctgatacagagaaaggacgtggttctcgatatggcagctcttcaagaagagctgtccactcaagcagccggcctagttcctctggtgaacccagtgaatctcgctctggccgattactctcaagcagtggccgtctgtctaccacacagagagtacctgggtatgagtcgaagacatcttcctatactcgtggtacagctgccaaaggcgccagggaggatcctcttcgtagcttcgagttcctgtcaatcaggaagtagttggaattggttgttagtaaaaaatattcctaatgcgttaagctgaaatacactcggtgaaaatactgggagttgataagctcatcactcttgtatgttggattacaacctaatgactctcacaggacatttcaattatcttgcgatgtttc

SEQ ID NO: 8236 - DNA, 2005 bp, Helianthus annuus
attgattcgaaaaaaatagtatctttttctgttttttcgatggtttaggttctagggttttttaatttttaattttaattttaatttttattgatctattgtcaccgacagattttgttactgaggtttataagttgttgcattactagattttgtttaagtttagttgtgaaaagcacaaatctttgtatagattttggtgcattttgatggatctgagtgtattttggggatcttagggtttgtgaagtgaaatttgttgattgtctgattagggtttgtttgtttgattggggatttgggatttcataatggatcatgtgattggtgggaagtttaagcttggtaggaagattggtagtggatcttttggagagctttatttgggagtaaatcttcaaagtaaagaagaagttgctgttaagttggaatctgttaaaaccaaacacccacagcttcactatgaggccaagttgtacatgctactgcaaggaggaaccggtgttccccaccttaaatggattggagttgaaggtgaatacaatgctatggttatcgatctactcggaccaagtttagaagatttgtttaattactgtaaccggaaattcactttaaaaacagttttaatgcttgccgatcagttgataaatagagttgaatatatgcattcacgaggtttccttcaccgtgatataaagccagataactttttgatgggtttaggccgaaaggcaaatcaggtttacattatagattacggtcttgccaaaaagtatagggatctccagacgcataagcatataccatacagggaaaataaaaatctcactggtaccgctcgttatgccagtgttaatacccaccttggagttgagcagagcagaagggatgatctggaatctcttggttacgtgctcatgtattttttgagaggaagccttccttggcaggggctgaaagccggcactaagaagcaaaaatatgataaaattagtgagaagaagatgcttactccgatagaggtgctatgcaagtcatatccaacagaattcatatcatattttcattattgtcgatcattgcggtttgacgacaagccagattattcatacttgaaaaggcttttccgggatttattcattcgagaagggtatcagtttgactatgtttttgactggactatattgaagtatcctcaaattggttcgggttccagttctagaggacggacggttggaaaattaccactgactcccgggccttcagcagaaagagcggaaaaaaccccagtgagaccagaggctcgagatagatcctcaggtacgggtgaggcattagctaggcgtaccggtttgcatggtgatcactcaagacacagatcttcagaacacgcaacaccatccaaagaaatggcgagtaaagatcatctgcacggtgactcagataaagcacgcatcacacgaaccggaagcacttcaaaacgagcattgatgtcaagcagcagaccaagctcatctggtgagcccaacgagagcaggtcaaaccggctcggttcaggcagcggtcgcctatcaaccactcaacgtctccattcccaacctgggttcgagtccaagtcatcatctttcacacgcgctgtaccttcatcaagaggtggccgtgacgacgcccttagaagctttgaacttcttacgattggcaaaaggaaataaaactccggtttttgttgcggccttgcggggcccggttgaatacccgtctatcattaaacaatttacgccacgttttctttttaaaagattcatcgttgatctttaagaaagaaacagagactgtatctcactttcgggtggatgttcatatgctgtcgaaatgtttatgttgaagaatcgttgaaacttgatcttgtttttttattttcttcggtgtttaaatgtgtaatcgaaatgcaatcatcttcggaccgcttgtatcttatggtacctcggccgcgaccacgcta

SEQ ID NO: 8237 - DNA, 2031 bp, Vinca minor
ccccttttggttaataatttcctagatttgattatgaattgggtcttcttcttccccaccatgtagattattctaataaaggggatgactttttttcttgattcattgatttatgatatttcttcattttttttttcaagattgaagaatatataaacgaaatcttatttgtaattttttttgtgaattcttgaaatcaaagtttcatatttcaataattggtttttgttttgttgggtagctaaagaaagggtctttcttggagggatttttatttgaaagcttttggtggatctaagggttgatttaaagatttgaaaattgttgggtgaattgacctaagaagatttaatggtcaattgagttccagtataaactgtgaaatcaagaaaagagtgaatattttgtgtttttttgttatttcaagaaaaatattgtgggaaaggtattattgattggagattttaattatggatcacgtcattggtggcaagtttaagcttgggagaaagattggtagtggatcctttggggagctttatctaggagtaaatgtacaaactggggaagaagttgctgtgaaacttgaaccacttaaaactaagcatccacagcttcactatgaatcaaagttgtatatgcttcttcagggaggaactggggttccccaccttaaatggttcggtgttgaaggcgaatacagtgcaatggttattgatcttcttgggccaagcttagaagatttgtttaactattgcaatagaaagttcagtttgaagacagttctaatgcttgctgatcaattaattaatagagttgaatacatgcattctagagggtttcttcaccgtgatattaagccagacaacttcttaatgggtttagggcgcaaagcaaatcaggtatacatcatagactatggtctggccaagaagtatagagatctccaaacacataaacacataccttacagggaaaacaaaaatcttacgggcacagctcgttatgccagtgtgaatacacatcttggagttgagcagagtagaagggatgatttggaatctcttggctatgtactaatgtactttctcagaggaagcctcccatggcagggcttgaaagctggaaataagaagcagaaatatgataaaattagtgagaagaagatgctaacgccaattgaggctctctgcaaatcttatccatctgaattcatatcctattttcattattgtcgatcgctgcggtttgatgataagccagattattcttatctcaaaagacttttccgtgacttattcattcgggaaggttatcagtttgactatgtcttcgactggaccatattaaagtacccacagattgcctcaaattcaagaggacggcagccaatggggagattacctttgaatggaggaccatctttggaaagagtagagaagaacccagtaagacaggagactcgcgatagattctctggcacagttgagacatttactcgaaggagttctggtgctgggttgcacggagatcccttgaggcacagatcttcagacgacgttccatcatccaaggaagtgcaagaggattctgaaagacgtctgaaccgtactggtagtagttcaaagagggctgttatgtcaagcagccgaccaagctcttcaggtgaacctagtgaaaaccgtacgagccggctaggctcaggcattggccgtctctcaacaacacaaaaagttcagcccggatttgaatccaagtcatcgtctttcacgcgagttgctggtacaagaagcaaccgcgatgaaacccttagaagcttcgatctactgacaattggctcgggaaaggaaatgaaaaaaaaagtgtacatataatttgctatcatcagctctcatcgcgaagaagatcaaattgagcttacttcgatgatgtgttgcttaatgaccttaaaaatattcctttaattgaggatggattctttaccattctatgtttcttttttggttagattaatgtatgttaatgagtttc

SEQ ID NO: 8238 - DNA, 1800 bp, Fagus grandifolia
tttgttatctgggtaatctatgaaagcaaggatttttatttactttttacttttttagtatctgggggcgtgttaatttggtaatttgtgggttaatgattggtggttgttgggatatgcacaaataaatgctggattgggcacaaatctgagtgggaaaaagcagtttttttttgaggttgtgggtggaattgtattggagggatttgataatggatcatgtaattgctgggaagttcaagctggggaggaagattgggagtggctcatttggagagctctatttaggtgttaatgtgcaaactggggaggaggtggctgttaagctggaacctgtgaagaccaagcatcctcagcttcactatgagtcaaaattgtatatgcttcttcaaggaggaactggaattccccacctcaagtggtttggagttgagggcgagtataatgtcatggctatcgaccttcttggaccaagtttggaggatttgtttaactattgcaataggaagtttacattgaaatcagttttgatgctcgcagatcaattaattaacagagttgaatacatgcattcaaggggttttcttcaccgtgatattaagcccgacaacttcttaatgggcctagggcgtaaagcaaatcaggtttatgtaattgattatggccttgcaaagaagtatagagatcttcaaactcataagcacataccatacagggaaaacaagaatcttactggcacagctcgctatgcaagtgttaatactcaccttggaattgaacaaagcagaagggatgatctggaatctcttggttatgtacttatgtattttctaagaggaagccttccctggcagggattaaaagctggcacaaaaaagcagaagtatgacaagatcagtgaaaagaagatgtcaactcctatagaggtgctttgcaaatcatatccatctgagtttgtatcctattttcattattgccggtcattgcggtttgaagacaaaccagattattcatatttaaagaggcttttccgagacttgtttataagagaaggttatcaatttgactacgtatttgactggactatattgaagtaccctcagattagttccagctctagaggacggcaacccagtgggaaagcaggtctgaatgcaggcccttctgcagaaagagtggagaggatctcagtagggaaagagatccgagatagattctcaggtgcagttgaagtattttccaggagaaatacctcaggcactagtccacatgatcattccaaacacaggacttatgaagatttagctccgtccaaggacgtgtatcttgattcagagaaaggacgcagttcttctcgatatggcagcacttcaagaaaagctatctcaagtggcaagcaaggttctggtgaacacagtgaaggtcgcacaggacgtatagtctcaagcagtggccgcccatctaccacgcaaagaattcaacctggttacgagtccaagccatcttatactcgcactccagccgctgctagaggcacccgtgatgatcctcttcggagctttgagctcctctcaatcaggaagtaactgaagagagtattttattaagtaagaagatagttgttatgcttttaatgaatatatatatcttctatttgaaaattcttttgaaagttattttctctcttgcacatgggagaccacctaatcgccaacattacagggcatatcacttctcttatttttaaattcctggacttcttctagttctacttcccattttccctcggccaaatatttt

SEQ ID NO: 8239 - DNA, 1728 bp, Daucus carota
ttgtattgggcttggaaagtgaaaaagatagaatcttggagctttttggatggttttgtgtttttctagatctgggcttttttgagttcttgattttgttgaaggtttttgattgttgggttaaggagaaagattgggtttttgtttgtttgttgaggtgattgagttttcgagttgagaaatggagcaagtagtagtcggtgggaagtttaagcttgggagaaagattgggagtggatcatttggagagctttatttgggcgtgaatgtacaaagcggagaagaagttgctgttaagctggaaccagctaagactaaacatccccagctgcactatgaatcaaagttatacatgtatcttcatggaggagctggtgttcctaatctcaagtggtatggagttgagggagaatacaatgctatggttatcgaccttcttgggccaagcttggaagatttgttcaactattgtaatcgaaagttaatgttgaaaaccgttttgatgcttgcagaccaattaatcactagagttgaatatatgcactcaagaggttttcttcatcgtgatataaagcctgataattttttaatggggttagggcgaaaagcaaatcaggtgtatgtaattgattatggccttgctaaaaagtttagggatcttcaaacacataagcatataccctacagggaaaacaagaatctgacaggaacagctcggtatgccagtgttaacacccaccttggagttgagcaaagcaggagagatgatctggaatctttaggttatgttcttatgtattttttaaggggaagcctaccctggcagggtctgaaagctggtactaaaaagcagaagtatgacagaataagtgagaaaaagatgtcaactccagtagaggtgctttgcaaatcttacccatcggaatttatatcatacttccattactgccgttccctgcggtttgatgacaaaccagattattcatatatgaagaggcttttccgtgatcttttcattagagaagggtatcagtttgactatgtatttgattggaccatattaaagtatccacagattggttccagttcaaaatcacggcagccaagtgggaaattacctttaaatcctggacccactatagatagagcagaaaagacaccagtgaagcgagagatgagagatcgattgtctggggcagttgaggcgtttgctagacggaaaggttctagttctggtgctaatctgcgtggtgatcacttaagacacagatcttctgataatgtaccttcatcaaaggatatgcaagccgaaccagtaagaggacgagtttctcgagctgctagtgcatcaaagagggcagtcgcatcaagcagtcggcctagctcctctggtgaacccagtgaaaacaggctaaatcggctgggatcaggcagtggtcgtctgtcgaccacccaaaggatccaacctggttttgagccaaagccatcatcctttacccgagccttaccatcaagaggtggccgtgacgatgctctccggagctttgagctgcttaccattggctcgggaaagaggaagtaagtgttgcaatctgtttgcatctttactgagccagtatgtttctttttactcatcaacatctccaaggaccctccgagcaccatggtatctttactattccaacgaaaaataaagttgaactcgtttcacgttcaactgttttttcc

SEQ ID NO: 8240 - DNA, 1428 bp, Capsicum annuum
ttgttgttggtggtgaaatttattgacatcatggatcatgttgtgggtgggaagtttaagcttggaaggaagattgggagtggttcttttggtgagctttatttaggtgtgaatgtacagaatggagaagaagttgccattaagctggaatctgtcaagacgaagcaccctcaacttcactatgagtcaaaaatatatatgcttctccaaggaggaactggtattcccaacctcaaatggtttggagttgagggagagtacaacgtaatggtcattgaccttcttggaccaagtttggaagacctcttcaactattgcaatcggaagtttactttgaaaacagttttaatgcttgcggatcaactaattaatagagttgagtatatgcactcacgaggatttcttcaccgtgacataaagccggacaactttttaatgggcctaggtcgcaaagcaaatcaggtttacgccatcgactttggtcttgctaaaaagtatagggacctgcagactcacaagcatataccatacagagaaaacaagaatctgaccggtacagctcgttatgcgagtgtcaacacacaccttggagtagagcaaagcagaagagatgatttggaatctcttggctatgtacttatgtattttcttagaggaagccttccatggcagggactgaaagctggtaccaaaaagcagaaatacgataaaatcagtgagaagaagatgttaactccaatagaggcgttgtgcaaatcctatccgtctgaatttgtatcatacttccactattgtcgatcattacgatttgaagataaacctgactattcttatttgaagaggctgttcagagacttgtttattcgtgaaggttatcaatttgactatgtttttgattggaccattttgaagtatcctcagatcggtgccagttctagaggacgaattcctagcggaaatgccggactaaatgctgggccatctgctgaaaaaacaggaagagcatcagttggacaagatattcgcgacaggttttctggtgctgtcgaagcattttcaagaaggaatgcttccggtgcgggaaggcacggggaacactccagacagaagagttcagaggatatgacttcatctaaagacgtgcaagattcagaaagaggacgtacctcgagaaacggaagctcatcaaaaagggctgccatttctggcagcagaccaacttcttccggtgatcccaccatcactgatagtcgctcgagcagactagtgtctagcaacgggcgtgtatctactacacaaagaattcattcaggtatcgaaccaaaaccatcaccattctcacgtaaggggacacgtgatgaccctcttcggagcttcgagttcctttcaatcagaaagtaaaccatgcatgcacttgtaaagagagaa

SEQ ID NO: 8241 - DNA, 1849 bp, Silene vulgaris
ttttttttttgttaatttgattgtgcaaaaataaaataaatcatctgatcactaaaacgtttggtcaatttcacctataaatataaattttataggagaagttagttcatttgtcactgtttcctaagatttgtgttattctagtataatcctaagctatctagggttagaaatgaacatggatcgtgtaattggtggcaagtttaagctcggtcgaaaaatcggtagtggttcatttggggagcttttcttaggcatcaatgtgcagactggtgaggaagtggctgttaagctggaatctgcgaagacaaagcacccccaacttcattatgagtcaaagttgtacctgcttcttcagggaggcacgggtattcctcatctcaagtggtacggggtagacggcgaacacaatgttatggttattgaccttcttggcccaagtttggaagacttgtttaattactgcagccgcaagttttcattgaagactgtcctaatgcttgctgatcaaatgatcaatagagtggagtacatgcattctagaggttttctgcaccgtgatatcaaacctgacaactttttaatgggccttggacgtaaggcaaatcaggtgtatgccattgattttggacttgcaaaaaagtttcgtgatcttcaaactcacaaacacataccgtacagagaaaataagaacctaacagggacagctcgatatgcaagtgtcaatacacatctgggtgttgaacaaagcagaagagatgacctggagtctcttggctatgtgctaatgtattttttgaggggaagtctcccatggcaggggttgaaagccggtaccaaaaagcagaagtacgacaaaattagtgaaaagaaaatgcttacccctattgaggtgctttgcaagaattatccatcagagttcacatcatacttccactactgtcggtctttacggtttgatgacaatccagactattcttatcttaagaggctattcagggatctttttattagagaaggttaccagtttgactatgtatttgattggacaatactgaaatacccacagattggctcaagctctcgtccacggccgacaaccaaaccagctttaaatcctggaccatccgctgaaagagctgatcggacctcagtgggacaagatatccgggataaattttctggggctgtggaggcttttgcaaggaggaatgctcaaggctctggtttgcaaagagatcattcacatcatagatcaatggatgatccaacgtccaaagatatgcaaggtgatcttgaaagaggtcgtacttctcgaaatggcagtacttcaaaacgagctgttgtttcaataagccggccgagctcttctggtggacccagtgacggcagatcgggccagcttctgtcatccagtggtcgtgtttctacgactcaaaggatacagcctggcgtggagtccaggacatcttctcgtgcccgtatttcttcagtaagacctggtagagacgataccttacggagctttgacttcttgtctattggcgccggtcgaagaagttaacaactctgtgtccttttagaaatcacaatcaagcctttcaactatttttcgatgggtttcctttgtttgggttcgctgatcttgagaaatgtaaatgattaaagttcccaattcacgctcaaagagcttaaatggtaccaacttttgttttccatggcgatacttgtgttctggagattttttctttattaaaagccttataaggtgatactctgaatcgttgtaaaataccaacctcgtttgcatcctagaagggagaaaaaggtaagcaaattgtgtttcgga

SEQ ID NO: 8242 - DNA, 2279 bp, Panax ginseng
aagcagtggtatcaacgcagagtaatggggagagtggagtggagtagagagtatattccatcatcaaataattaaaaacacaaaaatgaaaaagaagaaaacaaaataatatccccacacaaattcctcttctccttcttataatttattttctttattctcgcctgctatttatttcctcacatttcattactttctgcaacaaaattcattgttttctcaacacaatttcggttttttctctctgtataatcccttacttctctcccaattgatttgttcgttcatatttcattgtctacaatttaatttatatgtatatatatttgttctgatcaatgacgttggatatgatagtttatgaaattagtgttcaatttatcctccgccgttgatgattaggggttttcaataatcgaaggatgtagttcgttatttgttgggattttttgtgtttaatttgctcaacaaattttatctgttggcatttagaatcagtacagtgtaattgcacacgtcttttatgatccgttgcctctcaatttggttgatttgaacgcgttgtgggggttaaattgtttggtgggttaggtataacccgaattgatgttaaatttggcatagatctgagtagaggtaggtcgaaaaagaggattgggaatcatggatcatgttgtggggggaagtttaagctgggaaggaaaattggaagtgggtcttttggtgagctgtatttaggtattaatattcaaagtggagaagaagtggccatcaagctggaaactgtcaagactaagcaccctcagcttcactatgaatcaaaaatttatatgcttctccaaggaggaacggggattccgaacttcaaatggttcggagtggagggtgagtacaatatcatggttattgaccttcttggcccgagtttggaagatctattcaactattgcaacagaaaactctcactgaaaacagtattgatgcttgcagatcaactaataaatagagttgaatacatgcattcaagaggttttcttcaccgtgacataaagcctgacaactttttaatgggcctagggcgcaaagcaaatcaggtatacgttatcgactttggccttgcaaagaagtatagggatcttcagactcataagcacataccgtacagggaaaacaaaaatcttacaggcactgctcgctatgctagtgttaacacacacctaggagttgaacaatgcagaagggatgatctggaatctctcggttacgtgcttatgtatttcttaagaggaagtcttccctggcagggactgaaagccggcaacaaaaagcagaagtatgataagattagtgaaaagaagatgttaacacctatagaggtgctatgcaaatcatatccttcagaattcatatcatactttcactactgccgatcattacgctttgaagacaaaccagattattcatatttgaaaaggcttttcagggacttgtttattcgcgaaggttatcaatttgattatgtttttgattggaccatattgaagtatcctcagattggggccagttctaaagaaaggaatcctagtgggaatgcaggaccatctgccgaaaagccaggaaggatctcagtaggacaagatattagagaaaaattctcaggtgctgttgaagcattttccagaagaaatacttcaggtcctggtcggcatggtgaacactcctccagacacagaagtttagatgaagtagcttcatccaaggaagtgcaagctgattctgaaaaaggccgaacttctcgaaatggcagctcttcaaaaagagcagccattacaagcagcagcagaccaagctcctctggtgaattcactgacggacgctcgagccgattagtatcaagcattggccgattgtctactacgcaaagaatccaacccgggacagactccaaaccaccaacatattctcgtaatgtggtcaccaagggttctcgggatgatcctcttcgtagctttgatttcctttcaatcaggaagtaaattattgtttttatggtaaaaagtaaattactcggttctcaaaatggacaaataccattcttcacacttgtaaatgggaagtttagtgtcaagtaaaggtggtctgatctagcagtattatttccgagtttctggccactgtacggagctttagactcatctaaaggtgacgagttttatgcaagggaattttccattaaaaatgtgttgctgtaataaatgatgtttgccttgaagattatt

SEQ ID NO: 8243 - DNA, 2301 bp, Rosmarinus officinalis
cggccgggggaatcatcaaatcttttccagacacactctctctcctaatttcgcttttcctctcacatacagcgcacacgcacgaaatccattgttttgctctccctaaactatttgccccgcccccctccttttttcctcctctatttcctcaattctcgctcatctgtctcctctttggattgtttgttatcatcattactttcatagtttttagattcgttcatttgctataataatcatcatagagaaagcttactccgtgtttattttgatcggttgtattctgggttttgatcaatgagatcaatgacgagtgattatgagttcgtgatttagggtttcgtctttccgacgatgtagttcgaggaaaggaggccttgatcgataacttttttctcatttattgattcaattgtggggagccggctttggcattttttgttgcgttatttttggacgtttctgcctcggattcgggttttcttaaaatcccgattgaaggcgtagtcgagtaatttctggagttctggtgaaaatgtggaattcggggttttgtcttaatccggccagttgccatggatcatgtcttgggtggaaaatttaagcttgggaggaaaattgggtgtggttcatttggtgaactctttttaggcgtgaacatacagagtggagaagaagtagccatcaagctggaatcagtgaagaccaagcaccctcagcttcactatgaatcaaaaatttatatgcttctccaaggaggaactggcattcccaacttgaaatggtttggagttgagggcgaatatagtattatggtgatagaccttctggggccaagtctggaagatctcttcaactattgtaaccggaagttttccttgaaaacagtgttaatgcttgcagatcaactcattaatagagtcgagtacatgcactcaagaggattccttcaccgggatataaagcctgataactttttgatgggtttgggtcgcaaagcaaatcaggtttatatcattgactttggtcttgccaaaaagtatagggatcttcagactcataagcacataccctatagggaaaacaagaatctcactggtacggctcggtacgccagtgtcaatacacatcttggggttgaacaaagccgaagagacgacttggaatctctgggctatgtcctaatgtacttcctgagaggcagtctcccttggcaggggttaaaagctggcaccaaaaagcagaaatatgacaagatcagtgagaagaaaatgttaacttctatagaggtgttgtgcaaatcatatccatcagaattcatatcttactttcattattgtcggtcattaagattcgaggacaagccagattattcctatttgaagaggcttttccgtgacctatttattcgtgaaggttaccaatttgactatgtatttgattggactatgctgaagtatccacaaataggttcaagttccagaactaggaatctcactggtaatgctgttgctggaccatctggtgaaagaccaggtagagcatcagtagggcaagatcttcgggataaattctcaggtgcagtcgaggctttctctagaagaaatgctaccagtactggtcggtatggtgaacagtctagacacaggacatctgaagatgtaccttcatcaaaggatgtgcaaccagattcagataaaggccgcacttcgcgaaatggtagctcttcaaagagagcagtttcaagcagcagaccgagctcatctggagaagccattgatggccgcactggcagattggtcccaagtggtggtcgtatatctaccacacaaagaattcaacctggtgctgagcataaaccatcagctttctctcgcacagctaaaggcactcgcgatgatcccttacggagctttgagttcctatctatcaggaagtaacatgaatggtcattttgaaaggtaatctgaagttgacaaatgccgcctatttacgggacccttcgcgttatctaacccttgtaaatgtgaaatgtgttgttgaccattgttgatgctcatccatcctcccatttgagtatgtttttggtgaagagtcattttatgctataacacaatgtgtatgatcatccaaagaattaatgagttcaatgtgcggcacttttctattttcacaagacaaaattgtagctataataagtgtttacctccatcttgtttcaatattcttatattgactaatcctgaattctctactaaaacttcctgattagcccttgatatcaaaattgtagacatg

SEQ ID NO: 8244 - DNA, 2563 bp, Nicotiana benthamiana
gcatttcctcatttttcttgtccttgtcctttgttttttcccgatcccaacccacacgtagaccgcagtatattcattcaatcaatcctctctctctcctcatagcgctcctgcttttccacagcacacagcaaaaatcaaaatcaaaatcaatttgctttcttttcaaagagtccctcctttctctattcctctgtcaaacaaaccaaacagattatataatatttatatagagatacaccagtatctcgtttgtacttatcggttcgtacattgattgtttttattgatcaatggggatcggtgactttacttgtaaattagggtttcgatttgttatggttatttgacgattattagctggcgtttctatttaatcgaaggatgtagctgaattagtgtgttgcttggtccgtaatttctaggaattgggtttctgattgaaattggattgttctaaccgtagtttttgatctttaaagggggtcacttttttctggtgattaattatctgtttggattcatggggaatctctttgttttctaaatttaccgaggtaaaaaaagttgattatcgctgtaaaagtcttgttcttagtaatttcagattgaaatttgtatttttaactatagattctgatccttaaaggtgcttacttttctggggattaattacctttttggattttgggtctttttggggactttctaaatttattgaggttcaatctgagtaacacagcgggtaatcgctgtagaagttttgtttggtaattggggaagaggttgattggatcaccatggatcatgttgtgggtgggaagtttaagctgggaaggaagattggaagtgggtcttttggtgaactttatttaggtgtgaatatacagaatggagaggaagttgctattaagctggaatccgtcaagacaaggcaccctcaactacactatgagtcgaaaatttatatgcttctccaaggaggaaccgggattcctaatctcaaatggtttggagttgagggcgagtacaatataatggtcattgaccttcttggaccaagtttggaagacctcttcaactattgcaacaggaagtttactctgaaaacagtgcttatgctagcagatcaactcattaatagagttgaatacatgcactctagaggatttcttcaccgtgacataaagccagacaactttttaatgggcttaggtcgcaaggcaaaccaggtttacgccattgactttgggcttgccaaaaagtatagggatctccagactcacaagcatataccatacagggaaaacaagaatctgacaggaacagctcggtatgccagcgtcaacacacatagagatacaccacaaagcagaagagatgatttggaatctcttggttatgtgcttatgtattttcttagaggaagccttccatggcagggactgaaagctggtaccaagaagcagaaatatgataaaataagtgagaaaaagatgttaacaccaatagaggtgctgtgcaaatcatatccatctgagttcatatcatacttccactactgccgatcattaagatttgaggataaacctgactattcatatttgaagaggctttttagagacttgtttattcgtgaaggttatcaatttgactatgtatttgattggacaattttgaagtatcctcagatcggtgccagttcaagaggacgaattcctagtgggaacgcgggactaaatgctgggccatctgctgaaagaccaggaaggacgtcagtggggcaagatattcgagacaagttttctggcgctgttgaagcattttccagaaggaatacttcagcggctggtaggcacggggaacactccagacatcggacttcagaggatgtaccttcatctaaagacgtgcaagctgattcagagagaggccgtacctcgagaaatggcagctcttcaagaagggccgctatttcaagcagcagaccaacctcttctggtgaacccacagatagtcgctcaagcagattagtgtcaagcactggccgtctatctaccacacaaagaattcagcagggaaccgaaccaaaaccatcagcattcccccgaacttcagtcacaaagggtacccatgataaccctcttcggagctttgagttcctttctatcagaaagtaaggggatgctcttgtaaacaaaaaatttcctgattgtttgaacatgcaaatcctatttaaggatgtctctagtgctgtaaattggaaatgttttaccttctatgtgacaattgaagctgatccaacttctcatattccttgtttttgttgttaatagagttcctggcgatccatagctcatttagactcatccaaagaaatgttgggtcaagtgcaagagttatatatatatgtgtgggacgggtagcttaataaatattgttgtacgaattgatgtaacttttaccttattcgaatgtctagtggaggaattcttttctgggggtttgaatgcatctttttagttcagccttggaatatttgaaggtcagattgcgcaagtgg

SEQ ID NO: 8245 - DNA, 2284 bp, Solanum lycopersicum
ccccacacgtatattcatttttctctctctcttgatagcttttttcacagcatacagcatcaaaatcatttgctttctttttctaaaaaactcttttttttcctttctatttctcactttgcccctcgatcttcgcttctttgtccccttttttctgattcctctgtcgaaacaaaccgaaacttttccatttatatagaaaatatacgcggtttttgttactactttgtatcctacattcattgcctttttttttgtttttaattgatcaatggggatcgatgacttaatttgtgatttagggttctaattctttatgggtattggagatcgacccgggatttttttttgttgttgaaggatgtagctgaataagacagttgttgctgcataatttttaggatttttgttgttgttgggtcttgcctcattgtggggtttcgattgaaaattgaattttttaacgatatggtgtgaaagtattgttcttggcgaaaaaggtgattattgctgtggaagtattgtttttggtgaatttgaagagggtgattgaatcaccatggatcatgttgtgggtgggaagtttaagctgggaaggaagattggaagtgggtcttttggcgagctttatttaggtgtgaatttacaaaatggagaagaagttgctattaagctggaatctgtgaagacgaggcaccctcaactgcactatgaatcgaaaatttatatgctactccaaggaggaaccgggattcctaacctcaaatggtttggagtggagggagaatacaatataatggtcattgaccttcttggaccaagtttggaagaccttttcaattactgcaacaggttgtttactttgaaaacagtgttaatgctagcagatcaactcattaatagagttgaatacatgcactccagaggatttcttcaccgtgacataaagccagacaactttttaatgggattaggtcggaaggcaaatcaggtttacgcaattgactttgggcttgccaaaaagtatagggatctccagactcacaagcatataccatacagggaaaacaagaatctgacaggaactgctcggtatgcgagtgtcaacacacatcttggagttgagcaaagcagaagagacgatttggaatctcttggttatgtgcttatgtattttcttagaggaagccttccatggcagggactgaaaggtggtactaagaagcagaaatacgataaaatcagtgagaaaaagatgttaacaccagtagaggtgctgtgcaaatcttatccgtctgagttcatatcatacttccactactgtcgatcattaagatttgaagataaacctgactattcatatttgaagaggctttttagagacttgtttattcgtgaaggttatcaattcgactatgtatttgattggacaattttgaagtatcctcagattggtgccagttctagaggacgaaatcctagtgggaatgccggactaaatgctgggccatctgcagaaaggccaggaagggcatcagtggggcaagatattcgggatagatttactggtgctgttgaagcattttccagaaggaatacttctgcagctggtaggcatggggaacactccagacagaggacttcagaggatattccttcatccaaagatgtgcaagctgattcagagagaggccgtagctcgagaaatggaagctcttctaaaagagctgtcatgtcaagcagcaaacaggcctcttctgctgaaccaacggatagtcgctcaagcagattagtgtcaagcactggccgtctatctaccacacagagaattcagcagggaattgaaacaaaaccatcatcattctcgcgaacttcactcacaaagggcaaccatgataaccctcttcggagctttgaatttctttcaatcagaaagtaagagaatgcgcttataaagagggaatttcctgattgatttacggaggatgtctccaagtgctgtaaattagttaatgtgctgtaccttctatatgtgacaattgaagcttatccaactcatcatattccttgtttttgtttctagattagaccatagtgcacttagactcatccaaagaaatattgagtaaagtgcgagagtttttttattaattatatatggataaatatattgtgctacgaaattgatgttgctggagtgcctagtgaaaggagttctaggggtcgatctgaatgcgtctgtttagctctactttagagtatttgattatgggattctgtttta

SEQ ID NO: 8246 - DNA, 1858 bp, Ambrosia trifida
ttttagggatcttgtgttttgtgagttgtaataactaataagtttaattagttaggtagttgtagtagtagtagttgattaatatatatatattgagatttcatcatggatcatgtgattggtggcaagtttaagcttggtaggaagattggtagtggatcttttggagagctttatttgggagttaatcttcaaagtaaagaagaagttgctgtcaagttggaatctgttaagaccaagcacccacaacttcactatgaggccaagttgtacatgcttcttcaaggaggaactggtgttccccaccttaaatggattggagttgaaggagaatataatgctatggttattgatctacttggaccgagtttagaagatttatttaattactgtaaccggaaattcactttaaaaaccgttttaatgcttgcggatcagttgattaatagagttgaatatatgcattcaagaggtttccttcaccgtgatataaagccagataactttttgatgggtttagggcgaaaggcaaatcaggtttacattatagattatggtcttgctaaaaagtatagggatctccagacacacaagcatataccatacagggaaaacaaaaatctcactggtactgctcgttatgctagcgttaatacccaccttggagttgagcaaagcaggagggatgatctggaatctcttggttatgtgctcatgtatttcttgagaggaagccttccttggcaggggctgaaagccggcactaagaagcaaaaatatgataaaattagtgaaaagaagatgcttactcctatagaggtgctatgcaagtcttatccaactgaattcatatcatattttcattattgtcgatcattgcggtttgatgacaaaccagattattcatacttgaaaaggcttttccgggatctattcattcgagaaggctatcagtttgactatgtttttgactggactatactgaagtatcctcaaattggttcaggttccagttctagaggacggacggctggaaaattaccactgactcctgggccttcagcagaaagagcggaaaaaccccagtgaggccagaggctcgagatagattctcaggcacagttgaggcattagctaggcgtacaggtttgcatggtgatcactcgagacatagatcttcagaacatgcaacaccatccaaagaattgcacgttgactcggataaagcccgcatcacacgaactggtagtacttcaaaaagagcagtgatgtcaagcagcagacctagctcatctggtgaggccaacgagagccgatcaaaccggctcggttcaggcagcggtcgcatatcaaccgcccaacgactccattcccaacctgggtttgagtccaagtcatcatctttcacacgagctgtaccctcatcaagaggtggccgtgacgatgcccttagaagctttgaactgcttacaattggcaaaaggaaataagaagccggttttcgttgtgggaccaggtcgaatacccgtctatcgtaaatcaatatacaccacaattttctttttaaaagattcatccttgatcttgaagaaagaaacagactgtctatctcactctagggtggatgttcatatgctgtcaaaatgtttatgccgaaactgtatcttgcttcttactttctttgttgtttaaatgtgtaatcaaaacgcagttttctctcgactgcttgtatcttacggtacaaatgtatttgtacttttaatgctctagattaaggggcatgttctatatgcattctgtaacaaaattttcactcaagatactgtatcatgaaaactaaatgtttcttctttaaaaa

SEQ ID NO: 8247 - DNA, 1623 bp, Ambrosia trifida
gtgctttagtattgctagtatggatctgggtaattaaatattagttgattgtttgaataaggttaggtttgtttgtttgattgattgggggtttattatggatcatgtgattggtgggaagtttaagcttggtaggaagattggtagtggatcttttggagagctttatttaggtgtgaatcttcaaaccaaagaagaagttgctgttaaattggaatctgttaagaccaagcacccacagcttcactatgaggccaaattgtacatgcttcttcaaggaggaactggcgttccacacctcaaatggattggagtcgaaggagaatataatgctatggttattgatcttcttggaccaagtttagaagatttgtttaattattgtaaccgcaaattcactttgaaaacagttttaatgcttgctgatcagatgataaatagagttgaatatatgcattcacgaggttttcttcaccgtgatataaaaccagacaactttttgatgggtttaggacgaaaggcaaatcaggtttacattatagattatggtcttgcaaaaaagtatagggatgcccagacacacaagcatataccatacagggaaaacaaaaatcttactggtactgcccgttatgccagtgtaaacactcaccttggtgttgagcaaagtagaagggatgatctggaatctcttggttatgtgctcatgtattttttgagaggaagccttccttggcaggggttgaaagccggcactaagaagcaaaaatatgaataaaattagtagaaaagaagatgcttactcctatagagatgctatgcaagtcttatccaactgaattcacatcgtattttcattattgccgatcattgcggtttgatgataaaccagattattcatacctgaaaaggcttttccgtgaccttttcattcgagaaggttatcagtttgactatgtttttgactggactgttttgaagtatccccaagctggttcaggttccagttctagagggcggacggttggcaaattaccactgaatcccgggccttcagcagagagagtagaaaaaaccccagtgagaccagaggttagagagagattttcaggcacggtggagtcatttgccaggcgtactggtttgcatggtgattactcaagacacagatcttcagaacacgcaacaccatctaaagaaaaaggtgactcagatagagcccgcatcacacgaaccagtagtacttcaaaaagagcagttgtatcaagcagcagaccaagctcatcaggtgagcctagtgagagccggtcaaaccggctgggttcaggcagtggtcgcatatcaaccactcaaaggctccactctcaacccgggttcgagtccaagtcatcatctttcacacgcgttgcaccctcatcaagaggtggtcgcaatgacgccttaagaagctttgaacttctaactattggcaagaggaaataagaagccgtttttttttgtgggaccctcacgaataaccactgtctctcatttacaacaaaatccttgaaagattcattcttgatcttgtagtcctgaagaaagagattgtatctcactttagggtgaatgttcatatgctat

SEQ ID NO: 8248 - DNA, 1850 bp, Flaveria ramosissima
tcccccttaattccctcttattagattcacccacttcgatctgatttcgaaaaaccttcacttgcatctcttcattcctccattactaaacaacctcaatcgtgtatctgtttacgattcttcatcacctttgagttcttgatcagttatgtgaggtaaacagtgtctcaattcggttattgggcggaagttttctgttctatcgatggtgtaagtttctagggtttttattcgatccaacaataacgacaaattcttcgatggggtttcaaaaggtataatcttgctgatatcgttgaagcacaaatcttttgtagcggaatttgctattgatactggtgtggaggctttgtgtggatctgagtgcgttttggagatcttggaatttgatacggtgaattcttttcaagtgattgattgtttgaatcggattagggcttatttgattgggatttcatcatggatcatgtgattggtgggagtttaagctgggtaggaagattggtagtggatctttggagagctttatttgggagtgaatcttcaaactaaagaagaagttgctgttaaactggaatctgttaagaccaagcacccacagcttcactatgaggccaaattgtacatgcttcttcaaggaggaactggtgttccacacctcaaatggattggagttgaaggagaatacaatgctatggttattgatcttcttggaccaagtttagaagatctttttaattattgtaaccgcaagttcactttgaaaacagttttaatgcttgcagatcagttgataaacagagttgaatatatgcattcaagaggttttcttcatcgcgatataaaacccgacaactttttgatgggcttaggacgaaaggcaaatcaggtttacattatagattatggtcttgcaaaaaagtatagggatgctcaaacacacaagcatataccatacagggaaaacaaaaatctcactggtactgctcgatatgccagtgtaaatacccaccttggtgttgaacaaagcaggagggatgatctggagtctcttggttatgtgctcatgtattttttgagaggaagccttccttggcaggggctgaaagccggcactaagaagcaaaaatatgacaaaattagtgaaaagaagatgcttactcctatagaggtgctatgcaagtcttatccaactgaattcacatcatactttcattattgtcgatcgttgcggtttgatgacaaaccagattattcatacctgaaaaggctttttcgggaccttttcatccgagaaggttatcagtttgactatgtttttgactggactgttttgaagtatccccaatctggttcagcttccagttctcgagggcggacggttggcaaattacccctgaatcccagcccttcagcagaaagagtggaaaaaaccccagtgaaaccggaagttagagatagattctctggcacggtggagtcctttgctagacgtactgctttgcacggtgacaactcaagacacagatcttcagaatattcaacaccatctaaagaagtgaacggtaactcaggtagaccccacatcacacgaaccagcagtacttcaaaaagagcagtcatatcaagcagcagaccaagctcatctggtgagcccagtgagagccggtcaaaccggctaggttcaggcagcggtcgcatatcaaccgctcaaaggctccactctcaacccgggttcgagtccaagtcatcatctttcacacgggctgtaccctcatcaagaggtggccgtgatgacgcccttagaagctttgaactgctaactattgggaagaggaaataagaagtcg

SEQ ID NO: 8249 - DNA, 2426 bp, Mimulus guttatus
catcaatcgtttcctctctcatcccatattccttttctccacacacaaaaacacacacacacacacacacacaccaaaccccattgtctctctctctctctctctctctctctctttctctcacctcgccctctctctctctaattcctcaattttcggtcatctgtctcccctttgaattgttcataatcatttcttatttttttcagattcgttcctgtaataatttcgacagcggtagactttatctactccatatatatatataatataatagaattatccatcttcggttttggtcggtcgattttgggttttgatcaatgaggaggggtcatgagtttgtgaattagagttttcaattagggtttgtctttcaaggatgtaggtcgacggagggaataaaggggaatctcatgatcggtgtttatcttctgttgaattcttggatccactgtggcggatacggagttggcattttatcgcgttgtttcgtacgtttacaggctcgtagtcgggttgttttgaagcccgattagaggctggaattgtcgattattttcggtgtttaggggttaaatttttggaatattgagggttttgttgaattgagtcgattgccatggatcatgttgtcggtgggaaatttaagcttgggaggaaaattgggtgtggttcatttggtgaactctttttaggtgtgaacatacaaaatggagaagaagtagccataaagctggaatcagtgaagaccaagcatccacagcttcactatgagtcaaaaatatatatgattctccaaggaggaacggggattcccaatttgaaatggttcggagttgagggtgaatataatgtcatggtgatagaccttctgggcccaagtcttgaagatctcttcaactattgcaacaggaagtttaccttgaaaacagtgttaatgcttgcagatcaactaattaatagagttgagtacatgcactcaagaggatttcttcaccgtgatataaagcctgacaattttttgatgggcttggggcgcaaagcaaatcaggtttatgccattgactttggtcttgccaaaaagtatagggatcttcagactcataagcacattccgtatagagaaaacaagaatctcactggtactgctcgctatgccagtgtcaatacacaccttggagttgaacaaagtcgaagagatgatttggaatctcttggttatgtcctaatgtattttctgagagggagtcttccctggcagggacttaaagctggcaccaaaaaacagaaatatgacaagattagcgagaagaaaatgcttactcctatagaggtcctttgcaaatcatttccatcagaattcatatcttattttcactattgccggtcgttaagatttgaggacaaaccagattactcctatttaaagcgacttttccgggatttatttattcgtgaaggttaccaattcgactatgtgttcgattggactatgttgaagtatcctcagattggtgcaagttccagatcaaggaatcctaccggtaacgctgttgcgggaacttctggtgagagatcaggaagaacatcagatattcgagatcgattctcaggtgccgttgaagctttctctagaagaaatcctgcaggtccaggtcgacatggtgaaaattttagaaacaagacatcagaagatgtaccttcctccaaagatgtgcaaccggattcagaaaaagggcgtacttcaagaaacggcagctcttcaaggagagcagccatttcgagcagtagaccaaactcatcgggcgatccaagtgatggcagaaccaccagagtggtatcgagcagtggtggtcgaatatccaccactcaaagaatccagccagctggcattgatcataaaccgccgtctttctctcgtactactaaacccactcgtgacgaccctctccgaagcttcgaatttctctccatcagaaagtaaaaattggatcgcgtttttcttttccttaaaagaggtaatgtgaaaggtgaactttaaatacccccaaccctatttatcggaaatcttgttcgcattatctgatcattgtaaatgtaaaatgtgttgtacaccacactagttgatgcttcgttctaccgcgccttttcttttttttttctttttccgagagttgtttttgttgtaaacgccatatgtgcggctgtttttttttttttttttttttttctgtttattaccagacaaaagaattgcctatgtaatttcatcatgtataccgctgcatgtattttcaaatacagtaaatacctaaattgccctgttctaaaagatgggtcaagaatatcttgaaccggactatattggtgatgctggtgggatttattattatacattataaatgttttttgtgcctaaataa

SEQ ID NO: 8250 - DNA, 1966 bp, Olea europaea
ttctcgatcgttttgtttttattgatttctaggatcggctgtgtgtgtgatcattttaatttgcttatagtttttcggggattggtggtgattatctttccgttatcagtggtattctgggtatttttatcccaagtacctgttgaagttgaaaaaatttactctgggagtttgtgtgtgggtatttttagaatttgggagttatttgatcgaattaattgccatggatcacgttgtgggtggaaagtttaagcttggaaggaaaattgggagtggttcatttggtgaactttatttaggtgtaaacattcaaaatggagaagaagtagccatcaagctggaatctgcgaagaccaagcaccctcaacttcactatgagtctaaaatttatatgcttcttcaaggaggaacgggcatccccaacctcaaatggtttggagttgaggggaatataatattatggttatagaccttcttggaccaagtctggaagatctcttcaactattgtaataggaagttctccttgaaaacagtattgatgcttgcagatcaattaattaatagagttgaatacatgcattcaagaggttttcttcaccgtgatataaagcctgacaactttttgatgggcctagggcgcaaagcaaaccaagtatacgtcatcgattttggtcttgccaaaaaatatagggatctccagactcataagcacataccttatagggaaaacaagaatctcacaggtactgctcgttatgccagtgttaatactcatcttggagttgaacaaagccggagagatgatttggaatctcttggttatgtccttatgtatttcctgagaggaagcctcccctggcagggactgagagctggcaccaaaaaacagaagtatgacaagattagtgaaaagaagatgttaactcctatagaggtgctgtgtaaatcatatccattggagttcacatcatattttcactattgtcgatcattaagatttgaggacaagccggactattcttatttgaagaggcttttccgagacttatttattcgtgaaggttaccaatttgactatgtgtttgattggactatattgaagtatcctcaggttggtgccagttcaagaacacgaaactccagtggaaatgcaggggctggaacctctggcgaaagaccaggaagaacatcagtgggacatgacgttcgagacagattctcaggcgctgtcgaaactttttcgagaaaaaatacttcagggtcaggttggcatggtgaacattctagacacaggacatcagatgtaccttcatccaaggatgtgcaaccagattcagaaagaggccaaacttctcgaaatggaagttcttcaaagagagctactatttcaagcaacagaccaagctcctctggtgaacccagattggtatcgagctcccaaaggattcaacctgggattgaacttaaaccatcatctttctctcgtgctgcccccactaaaggtactcgtgatgaccctcttcgaagctttgagttcctctcaatcaggaaataactcaatggttctgtaaaaagtttatatcgtccaatggacagatgccagccatcttttaaggaaatatttgcattctcttattcttttaaatgggaatgcgttttacaccagaattaaacctcgtctggctgtcttcacaacagtattacttcgtattatgaattgtttctgttgtaacgcattgcatactcatacacagaattaatgagtaatgtgttggaatttttctgtttttcgagacaatgatagttgttattcatgttttgctgtatggatccttgccttgtatctttgtcgagttttccttactgggtacgagttgtatttgatgttgcaatgaagagtagatgagaagaatgattggtgttactttttggtaaatggtaattcaatcactttccgaacgtgc

SEQ ID NO: 8251 - DNA, 2141 bp, Panax ginseng
atttcggttttttctctctgtataatcccttacttctctcccatttgatttgttcgttcatatttcattatctacaatttaattttatatgtatatatatttgttctgatcaatgacgttggatatgatagtttatgaaattagtgttcaatttatcctccgccgttgatgattaggggttttcaataatcgaaggatgtagttcgttatttgttgggattttttgtgtttaatttgctcaacaaattttatctgttggcattagaatcagtacagtgtaatgcacatgtcttttatgatccgttggctctcaatttggttgatttgaacgcgttgtgggggttaaattgtttggtgggttaggtataacccgaattggtgttaaatttggcatagatctgagtagaggtaggtcgaaaaagaggattgggaatcatggatcatgttgtgggggggaagtttaagctgggaaggaaaattggaagtgggtcttttggtgagctgtatttaggtattaatattcaaagtggagaagaagtggccatcaagctggaaactgtcaagacaaagcaccctcagcttcactatgaatcaaaaatttatatgcttctccaaggaggaactgggattccgaacttcaaatggttcggagtggagggtgagtacaatatcatggttattgaccttcttggcccgagtttggaagatctattcaactattgcaacagaaaactctcactgaaaacagtattgatgcttgcagatcaactaataaatagagttgaatacatgcattcaagaggttttcttcaccgtgacataaagcctgacaactttttaatgggcctagggcgcaaagcaaatcaggtatacgttatcgactttggccttgcaaagaagtatagggatcttcaaactcataagcacataccgtacagggaaaacaaaaatcttacaggcactgctcgctatgctagtgttaacacacacctaggagttgaacaatgcagaagggatgatctggaatctctcggttacgtgcttatgtatttcttaagaggaagtcttccctggcagggtatgaaagccggcaacaaaaagcagaagtatgataaaattagtgaaaagaagatgttaacacctatagaggtgctatgcaaatcatatccttcagaattcatatcatacttccattactgccgatcattacgttttgaagacaaaccagattattcatatttgaaaaggcttttcagggacttgtttattcgcgaaggttatcaatttgattatgtttttgattggaccatattgaagtatcctcagattgggaccagttctaaagaaaggaatcctagtgggaatgcaggaccatctgccgaaaagccaggaaggatctcagtaggacaagatattagagaaaaattctcaggtgctgttgaagcattttccagaagaaatacttcaggtcctggtcggcatggtgaacactcctccagacacagaagtttggacgaagtagcttcatccaaggaagtgcaagctgattctgaaaaaggccgaacttctcgaaatggcagctcttcaaaaagagcagccattacaagcagcagcaaaccaagctcctctggtgaattcactgacggacgctcgagccgattagtatcaagcattggccgactatctactacgcaaagaatccaactcgggacagactccaaaccaccaacatattctcgtaatgtggtcaccaagggttctcgggatgatcctcttcgtagctttgatttcctttcaatcaggaagtaaattaatgtttttatggtaaaaagtaagttactcggttctcaagatggacaaataccattcttcacacttgtaaatgggaagtttagtgtcaagtaaaggtggtctgatctagcagtattatttccgagtttctggccactgtacggagctttagactcatctaaaggtgacgagttttatgcaagggaattttccattaaaaatgtgttgctgtaactaaatcgatgtttgccttgaagattatttggtgccttaaatattagtaaaccaataggcgagggagtattattgtattgtattcttctatatatgttatgaagctttgttcaaaa

SEQ ID NO: 8252 - DNA, 2130 bp, Tropaeolum majus
aaattattttcatgttggcaaaacctgttgtcaatagtcccactaggttttgtttttctttcatttttcgatttcacggaatccaaatttgttgatctgactgttcaatatattaagtttatctggtcaatgtagtttgatttttttttaaaatttcaaaatcgcgttttgataagcgcttggagagatttggggtttgggttgtaagacaaagttggttttcgaatttgaattgttatttcatattttctgatttgaaaacttaatctttagagagggttctatcttttctatcgtggtttcatttgattaaaatacccagattgtgattttacattgttcaatccacggataacctaaaaaaaagggggggttcttagttttccgaatctgggttgtgttggtttgtaaatctgttttttttaaaaagtctattaagcaacaataattgctaaattcgtcataaatctgggtttagaaaaacaaaaattagaggtttattgagcttttgggattgggtttcgaagagagattggagatggatcacgtgattggtggaaaatttaagttggggaggaagattgggagtgggtcttttggagagctatatctaggggtaaatatacaaactggagaggaagttgctgttaaattggaatctgtgaagactaagcacccacagcttcactatgaatccaagttgtatatgcttcttcaaggaggaacgggaattccccacctcaagtggtttggagttgagggggagtacaatgtcatggttatcgaccttcttggaccaagtttggaagatctctttaactactgcaataggaagttctcgttgaaaacagtactaatgcttgcagatcaactaattaacagagttgaatatatgcactcaagagggtttcttcaccgtgacataaagcctgataactttttgatgggcttggggcgcaaagctaatcaggtgtacgcgattgactacggcctggcaaagaagtatagagatctacagactcacaagcacattccatacagggaaaacaagaaccttacaggcacagctcggtatgcaagtgtcaacactcatcttggagttgaacaaagtcgaagggatgatttggaatctcttggttatgtgctcatgtatttcctgagaggaagcctcccctggcaaggattaaaagctggaacaaaaaagcaaaagtatgacaaaattagtgagaagaaggtttcaacttctattgagtctttatgcaaatcttatccgtctgagtttgtctcatacttccactactgtcgatcattgcggtttgaggacaaaccagattactcatatctgaagaggcttttccgagatttatttattcgagaaggctatcagttcgactatgtatttgactggactgtgttgaagtaccctcagattggttccagctccagatcaaggcatcatacaacaaaacaaggattaagtgccggtccatctgctgaaaagccagaaagaaactcagttgggaaagagattcgcgatagattttctggtgcggttgaagcattttctagaagaaatgtcccaggttctagtccacgcgagtatccaaaacatagaagctcagacgatggaccttcctcaaatcatatgcgtggtggtggtggtgatcaggggcgcagttcttctagatatggcagctcgtctagaaaagcagttatgtcaagcagtaggccaagttcctctggtgaaccaagcgacagtcgaggttcaagccgacttgtctcaagcactggtgctagtggtcgaccatcaaccacacaccgaacacatgcgtcgtctggatatgattctaaaccatcattttctcgcaatgctgcggctaccagaggttcaagccgagatgatcctattaggagctttgaactcctgtctatccgaaagtgaggaaagcttcttcttcttcttttttgatcatttggaaaagaaaaaaaaaccaatcaatcaaatccctaaaatgtgagaactccaaaatgtgaaaaaagtaccggagatatataactcaactctcacgttttgtatatgggatatgatatcagtttgatcatcgccatttagatgtcatttcccccctt

SEQ ID NO: 8253 - DNA, 2064 bp, Elaeis guineensis
atgagcatgcatctgatgcttctattttggttccagtggaaggttaagagttcttgaagggtctctggtgggttgtagacggtaaaggtttctttttcttttaaattcttctgaagtattcgaggattctttgtatagaaggagcagctttttcgtggtgttggatcagtagtttgtctgttttcttgtttggatctcgtcttttattttataaattatcatggaccatgttattggggggaagtttaagctcgggaggaagatcgggagtggctcatttggcgagctctatctaggtgttaatatacagagtggagaggaagtggccatcaaattggaatctgtgaagacaaaacatccccagcttcattatgagtctaaattgtatatgcttcttcagggtggaactggaattccccacttgaagtggtttggtgtggagggagattacaatgtcatggtcatcgatcttcttggaccaagcttggaagatctgtttaattactgcaaccggaagctatcattgaaaacagtacttatgcttgctgatcaattacttaaccgagttgagtatatgcactcaaggggctttcttcatcgtgatattaagccagataatttcctgatgggtttaggtcgcaaagcaaatcaggtttatattattgattatggtcttgcaaaaaaatatagagaccttcaaactcataagcacataccttacagggagaacaagaatcttacaggaacagcaagatatgccagtgtcaatactcatcttggagttgaacaaagcaggagagatgatttggagtctcttggttatgtgcttatgtatttcttaagaggaagccttccctggcagggtttaaaagctggcactaaaaagcagaagtatgataagattagtgaaaagaaaatgcttactccagttgaggtgctgtgcaaatcatatccatcagagtttatttcatacttccattattgtcggtcattgcgttttgaggacaagccagattattcttacttgaagagacttttccgtgacctctttattcgagaaggttatcaatttgattatgtatttgactggacagtattgaagtatccacagattggttccaatcctagagcgagacagcccagtggaagaacaggtggagctattggaccatctgtggaaagggcagaaagaacttcagtagggcaagagattcgtgataggttctctggtgcagttgaagcatttgccaggagacatggttcaggttctggtcgtcatggagaccattcgaagcacaaagctttagaggattcactgttgtcacccaaagagactgcccatgattcagataaaatccgtgcatcatcttctcgaaatggcagcacatcaaaaagggccgtcatttcaagtagccggcccagttcttctgcagatccaagtgatcaattcagtcgcacatgtcggttggtctccagcagcactagcaaccgcccatccaccacccaaagactccatcattctggaccagaggccagggtctcatcacttgctcgaaattcttcaggaagggtttcccgtgatgaccctcctcaccgaagctttgagttcctctcgatcagtggtgagcggaggaagtaaagaggaaagaggtcaactgataaggaactttgctgctcatttaaagaatttgatattctttgccatttcgtcaacattttcatgacgattttatactaattgattctctgttcatatccttttctacccattgggatgagatctgcttaattggcaaaatttcattctcatttgcgtatattcattgcctgaaacccttggtaattcccaattgacggtggtaaggtgcttaagagcaattcaattagcaatctattgtccttacttattcttaaggatcgatcaaggaacagtatattctcatcctcgggctgctcaggccttcttgtgttgtaggcttaaaacagggatgtgcgtgttcctgcaagataattgtttatatgagacttattcaaataaagtactgtttatgccccaaaaaaaaa

SEQ ID NO: 8254 - DNA, 1891 bp, Theobroma cacao
ttgatctctttgaagcttggagctgtcaatttagtaagtcactgaagtttgaggggcgtattggagtatggagcaataaaatgctgaatttgacacaaatctgagtgaaaatagattagattaagctctctggggtattaggtattattgaagagttatttttttgggggctgttgggaatggatcatgtgattggtggtaagttcaagcttggaagaaagattggcagtggctcttttggagaactctttttaggggtaaatgtgcaaactggagaggaagttgctgtcaaactggaatctgtgaagaccaagcatccacagcttcattatgagtcaaaattgtatatgcttcttcaaggaggaacgggtattccccacctcaagtggtttggagttgaggcagattacaatgtcatggtaatcgaccttcttggacctagtctggaagatttgttcaactactgcaacaggaaactctcattaaaaacagtgttgatgcttgctgatcaattgattaatagagtagaatatatgcattcaagaggtttccttcaccgtgatataaagcctgacaacttcttgatgggcctaggacacaaggctaatcaggtatatatcattgactatggtcttgcaaagaagtatagggatcttcagacacataagcacatcccatacagagaaaacaagaacctcacaggcacagctcgttatgcaagtgtgaacactcacctaggagttgagcaaagccgaagagatgatttggaatctcttggttatgtgcttatgtatttcctgagaggaagccttccctggcaggggttaaaagctggcacaaaaaagcaaaaatatgataagattagtgaaaagaaggtatcaactcctatagaggtgctctgtaagtcatatccatctgagtttgtatcatactttcactactgtcgatctttgcggtttgaagataaaccagattattcatatttgaagaggcttttccgagacttgtttataagagaaggttatcagtttgactatgtctttgactggactgttttgaagtacccacagcttggtggcagctcgagagggcggcataccagtggaagagcaggtttagctgcaggaccagctatagaaagaccagaaagaatctcagtgggtagagagattcgggatagattctctggtgcagttgaagcattttccaaaagaaatgtttcgaatactagtcctcgtcgtgatcattctagacacaagactgctgaggatgtaactttgtcaaagcatgtgcaccctgattctgataaaagacgcagttcttctcgatatggtagcacttcaagaagagctgtagcagcgagtaggcctagttcatcaggtgaacccagtgacattcaacagaacagactagtatcgagtggtggtcgcatgtctaccacacaaagaatccaactcgcctttgaggccaaaacatctagtcgtgctgcccctgttagaggaagccgtgatgatcatcctcttcgaagttttgagctgctctcgattaggaaataatggagtttgtaggcagatgcttttaagaagttccaatgtcactgtgtataatggggatatccaccagattgaatggtgctacagctcgtgacttcccttaccacatttgccaatcttttttccaagattatttgagcccccgagagtttatggccattgtaacgtgttaaaggcagcagggaagagaactcattattgggaatcgtatttgtcaaatgcaacttgaatagctgcaataaaacactcttttcatcctttttccccttatcctgaataattaaatttactagttgaacacttgataaagcattaatataaaccttttgaagcggaag

SEQ ID NO: 8255 - DNA, 2032 bp, Papaver somniferum
attagggtttcgatttggaggcaaatgcttatttcctaaggtgaattaatctcaaggaattactggattgcttaaagaagaggaggaagattgttattgtggttgagtatggatgaagaaataggggggagacttagtttatctcaatttcatcaatgacaagtaggaagagcgaatttggttggaaaagtttagctggaagaaggtcataactattaattagaacgaattttttcgtctctaatcgattgaattaagggggtaattaattagagaaaaatcatggaaagtgttatcggtggtaagtttaaacttggacgaaagataggaagtggatcttttggcgagctttatctaggtgttaacatacaaactggagaggaggttgctattaagctggaatctgtaaagaccaagcaccctcaactccactatgaatccaaattgtatatgctccttcaaggaggaacgggaattccccacctaaagtggtttggagttgagacggattataactgcatggttattgaccttctcgggccaagcttggaagacttattcaactactgcaaccggaagtttacgatgaaaacagttcttatgcttgctgatcaattaattaacagagttgaatacatgcactcaaggggttttcttcaccgtgatattaaacccgacaatttcttgatgggtttagggcgtcgagcaaatcaggtatacatcattgactacggccttgcaaaaaagtacagggatcttcaaacccataagcacataccatacagggaaaataagaatctcaccggaactgctcgctatgcaagtgtaaatactcatcttggagttgagcaaagcaggagagatgatctggagtctcttggttacgtgctgatgtattttttaagaggaagccttccctggcagggattaaaagctggaaataagaaacaaaaatatgacaagatcagtgaaaagaagatgttaactcccatagaggtgctctgcaagtcatatccttcagagttcatatcatatttccactattgtcgatcactgaggtttgaggataagccagattactcgtatctgaagaggcttttccgtgatctatttattagagaaggttatcagtttgattatgtctttgactggactgtattgaagtacccccagattggcgcaaattctagaacagcaagggtgcctagtggtagagttggcacgaatgcaggaccttctgctgaaagagtagaaagacctacagtggggcaagagattcgcgaaagattttcaggtgcagtagaagcttttgctagaagaaacagtccaggtcccaatgcacatgctgatcacaagaacaagaacaagaatccagaggattcctcaacatcgagagaggtacttgattctgaaaaattgcgaacttcatctaggaatggcagttcttcaaggagagcaattgcatcaagcagccggcctacttcttctggtgagcctagtgagagtcgaacaagtcgaatactctcaggcagcagtaatcgcctttcaactgcacaaaggacgattcaacctgggctggaatccaaatcaacatccctctctcgcaccgctggttcaaggggtaatcgggatgatcatcttcgaagtttcgagcttctctcaattggcacagagagaagaggaagtaagtaacgagaatcaggaatcatctaaatttggtaataacttgtttcccttttattaattctagggaaagatccttgtgctgtttgtacaattagttttccaagcattttaaatacctctgttacatgtatattcacaaactcttaagtttccgattttcttaaagccgaagttggaatccattcgctgatcttcatttgtcttggatgagtatttcctgtaatccttttttttttgtgaaaggtttgtgtctttgagattccattgtagattcttctccctccaagaagaagaagatcacctctttttgggaatcgctgaaatgaagatgattcttgtttgtaac

SEQ ID NO: 8256 - DNA, 2160 bp, Helianthus annuus
ttgcacaataacatttcccctcaaatccatcatcatctgcttcacttctttcagatcctaatggattctcaaacccctttaatttcttcttcttagattcctcttactccatctgttccccacaaatcttacttttttcgcttcaattctccatcaattaataactttaattgtgtttttgagcagttttgattaattgattacaaaaaatagtatctttttctgttttttcgatggtttaggttctagggtttttttttttttaatttttattgatctattgtcaccgactgattttgttactgaggtttataagttcttgcattactagattttgtttaagtttagttttaaagcacaaatctttgtatagattttggtgcattttgatggatctgagtgtattttggggatcttagggtttgtgaagtgaaatttgttgattatctgattagggtttgtttgattggggatttgggatttcataatggatcatgtgattggtgggaagtttaagcttggtaggaagattggtagtggatcttttggagagctttatttgggagtaaatcttcaaagtaaagaagaagttgctgttaagttggaatctgttaaaactaagcacccacagcttcactatgaggccaagttgtacatgctactgcaaggaggaactggtgttccccaccttaaatggattggagttgaaggtgaatataatgctatggttattgatctacttggaccaagtttagaagatttgtttaattactgtaaccgggaattcactttaaaaacagttttaatgcttgccgatcagttgataaatagagttgaatatatgcattcacgaggtttccttcaccgtgatataaagccagataactttttgatgggtttaggccgaaaggcaaatcaggtttacattatagattacggtcttgccaaaaagtatagggatctccagacacataagcatataccatacagggaacacaaaaatctcactggtaccgctcgttatgctagtgttaatacgcaccttggagttgagcaaagcagaagggatgatctggaatctcttggttacgtgctcatgtattttttgagaggaagccttccttggcaggggctgaaagccggcactaagaagcaaaaatatgataaaattagtgagaagaagatgcttactccgatagaggttctatgcaagtcttatccaacagaattcatatcctattttcattattgtcgatcattgcggtttgatgacaagccagattattcatacttgaaaaggcttttccgggatttattcattcgagaaggttatcagtttgactatgtttttgactggactatattgaagtatcctcaaattggttcgggttccagttctagaggacggacggttggaaaattaccactgactcccgggccttcagcagaaagagcggaaaaaaccccagtgagaccagaggctcgagatagattctcaggtacagttgaagctttagctaggcgtaccggtttgcatggtgatcactcgagacacagatcttcagaacacgcaactccatccaaagaaatgacgagtaaagatcatctgcacggtgactcagataaagcacgcatcacacgaaccggaagtacttcaaaacgagcattgatgtcaagcagcagaccaagctcatctggtgagcccaacgagagcaggtcaaaccggctcggttcaggcagcggtcgcatatcaaccactcaacgtctccgttcccaacctgggttcgagtccaagtcatcgtctttcacacgcgctgtaccctcatcaagaggtggccgtgacgatgcccttagaagctttgaacttcttacgattggcaaaaggaaataaaactccggttcttggtgcggccttgcggggcccggttgaatacccgtctatcattaaacagtttacgccacgttttctttttaaaagattcatcgttgatctttaacaaagaaacagagactggatctcactttcgggtggatgttcatatgctggccaaatggttatggtgaagaatcgttcaaacttgatcttggttttttattttcttccgtgtttaaatgtgtaatccaaatgcaatcatcttcgggaccggttggatcttatgg

SEQ ID NO: 8257 - DNA, 2335 bp, Solanum lycopersicum
aaataattcaaaatcaatccttcttctctctctgtgtgctgcttgcttttccacaaaattaaatttgtttctactttttctgaaaatctttctctctcttctcaatcttccctcatttgtgccatctctttttttttctccattgcaagaattcttgactttttttttgttattgattttcagctgtcaacaggagcttaagaacaccaaatacacatttttaaaaatttgtgcatctggggttgcagaaagattgtttttttttattaatggggtgattttttcttgtaaagatagggtttttattcattgttgggttatttggagatgatgggtgttggtatttgtagaaggatgtagctggacaataattttcttcaaattttgattgatgatttttaggctttcattttttttttttgaaagttgtgaactttaaattgattttgatctctaggggtggtaattggatagatgtatgagtaattttgatggggttaatttgtttgttggatttgctgggattttttgaccaatctaagtggatgaaaatttgagtgaattaattattttggcagttgaaattgttgtttttggtgaaatttcttaagtggggtttttgaaatcaacatggatcatgttgtgagtgggaggtttaagcttggaaggaagattgggagtggttcttttggtgagctttatttaggtgtgaatatacagaatggagaagaagttgccattaagctggaatctgtcaagacaaagcaccctcaacttcattacgagtcaaaaatatatatgcttctccaaggaggaaccgggattcccaatctcaaatggtttggagttgaggttgagtacaatgtgatggtcattgaccttcttggaccaagtttggaagacctcttcaactattgcaataggaagttcactttgaaaacagttttaatgcttgcagatcaactaattaatagagttgagtatatgcactcacgaggatttctccaccgtgatataaagccagacaactttttaatgggcctaggtcgcaaagcaaatcaggtttatgccatcgacttcgggcttgccaaaaagtatagggacctacagactcacaagcatataccatacagagaaaacaagaatctgaccggcacagctcgttatgccagtgtcaacacacaccttggagttgagcaaagcaggagagatgatttggaatctcttggctatgtgcttatgtattttcttagaggaagccttccatggcagggtctgaaagctggtaccaaaaaacagaaatatgataaaatcagtgagaagaagatgttaactccaatagaggtgctatgcaaatcctatccttcagaatttacatcatacttccactattgtcgatcgttacggtttgaagataagcctgactattcatacttgaagaggctgttcagagatttgtttattcgtgaaggttatcaatttgactatgtttttgactggaccattttgaagtatcctcagatcggtgccagttctagaggacggcttcctggtggaagtgccggactaaatgctgggccatctgctgaaagaccaggacggacatcagtcggacaagatattcgagacagattttctggtgctgttgaagcattttctagaaggaatgcttctggtacgggaaagcatggggaacactccagacaaaagacttcagaggacatgacttcatctaaagatgtgcaagctgattcagaaagaggccgtactttgagaaacggaagctcttcaaaaagggctgccatttctagcagtagaccaagctcttctggtgatcccaccatcactgatagtcgatcgagcagactagtgtcaagcaatgggcgtgtgtctaccacacacagaattcattcaggtatcgaaccaaaaccatcaccattctcacgtaaggggacacgtgatgaccctcttcggagcttcgagtttctttcaatccgaaagtagaaaaaaagcatgtcacttgtataaagagagaatttcctgtttgttttggaacattccaatccttttaaagtgttgtatattggaaatgtttctatgtgacaactaaagcttatcccaaacttccaattgctccttgttttggttttgattttagagcttgagttctggccatctgtaaaaacctttcgactcatccaaagaattgatgagcaagaagtgctagagtttcatacatgtacactcagatggtatgtattatgtaataaatattactattgtaccaatgaatattatctttttttttaagtattaggatgaaccttttatcaaa

SEQ ID NO: 8258 - DNA, 2137 bp, Tripterygium wilfordii
agttttggatccataatcggcattctgtatatcgttgtagatttagtttttttgttttgcattttgttgtgatggtcaatgctggcggattttcatctaaattagggttccgattcttggtctgcgattggagttttggaggctagaaccaaaaggatgtagttgagatttggttgtatttttgggctcttgtgtagacattttttgtgtagtttttttttttttttgcttcaaggttggaatttctcggagttgaaggcggaggttcttgcttttccttcaaattgatgatggaaacgtcttagtttttgttggtgggattccgtggattacccgaaaaagggaacgttttttcatccggagggcatgttaatttgggaaatctgttaaggatttcctgttttggggggaaggaggtaattgtggatttggtggtgggttatgggttactagcaaaataagggtgaatggggcattaatctgggtgttatatctttatcttgtgttgaattgagctggtggataagaatttgaagatggatcatgtagttggtagcaagttcaagctggggaggaagatcgggagtgggtcctttggggagctctatttgggtgtaaatgtgcaaactggggaagaagttgctgttaagttggaacctgtgaaaaccaagcatccacagcttcattatgagtcaaagttgtacatgcttcttcaaggaggaactggaatcccccacctcaaatggtttggtgttgagggtgaatacagtataatggttattgaccttcttggaccaagtttggaagatttgttcaactactgcagcagaaaattttcgttgaaaacagtattgatgcttgcagatcaattaattaacagagtggaatacatgcactcaaggggttttcttcaccgtgatataaagcctgacaacttcttgatgggcctggggcgcaaagcaaaccaggtatacattattgattatggccttgcaaagaagtatagggatcttcagacacacaagcatatcccatacagggaaaacaagaacctgacgggcacagctcgctacgcaagtgtcaacactcatcttggagttgagcaaagcagaagggatgatctggaatctcttggttatgtgcttatgtacttcctaagaggaagccttccctggcagggattaaaagctggtacaaagaagcaaaagtatgataagatcagtgaaaagaaagtttcaactcctatagaggtgctttgtaaatcatacccaactgagttttattcgtacttccattactgtcgatcattgaggtttgaagacaaaccagactactcatatctgaaaaggctttttagagatctttttattcgagaaggttatcagttcgactatgtatttgactggactgtgttgaagtaccctcagattggtggcagctctaggggacggcactccagcgggaaaccaggtttaattgctggtccatctgcagagaaaccagaacggatttcagttgggaaagagatccgggacagattctcgggtgcagttgaagcattttccagaaggaatacagctagtcctactccacgtggtgatttatccaaacacaggacttcagagaaccaacctgatacagagaaaggacgcggttctcgatatggcagcagttcaagaagagctgtccactcaagcagccggcctagttcctctggtgaacccagtgaatctcgctctagccgattactctcaagcagtggccgtctgtctaccacacagagagtccctggatatgagtcgaagacatcttcctatactcgtggtacaactgcaaaaggcgtaagggaggatcctcttcgtagcttcgagctcctgtcactcaggaagtagttggaatgatttgttagtaaaaaaatattcctaatgcgttaaacagaaatgcactcggtgaaaatagtggggagttcataagctcatcactattgtatgtgggattacaacctaatgactcacaggacatttccattatcttgccatgtaaacaatgtctctcccacctcatttcttttttctgccttttagaagtttatgaacatcttttagatgcgtccgagaaactaagaagggaaaaaaaa

SEQ ID NO: 8259 - DNA, 2176 bp, Vinca minor
atccccaaagtcatttttcctctctttctccgaccctgatcccctaatttccgcctaatttcttcatcattctttttattctgattcatttattacaacaaaaagctaaaaattccagttctttctttgtataatccagatgcttatgtataacattgattgattgcttctttttttttttcttttttttattgatcaatgaatggttatgaaattagggtttcgctttaattttcttctttattattgcctatctagggtttggattcattcaagcatgtatttgtttttctttcttttctcgatcgacgatctttaggtttttgtatttcctgattatcgattcgcattcggtgtgttttgatccgtcggagagtttgtaaaaatttgggggctagctttttccggtggatttccggctatatcttgcccctgcccctttaataatttttggttgtgcgcatttttgtttaatctgtagtagaaaaagaacttgttgttgggttaattggacgttactgtgggaggaagattgttaaatcaatatggatcacgtggtgggtggtaaatttaagctggggaggaagattggtagcggttcatttggtgaactttatctaggtgtcaatatacagaatggagaagaagtagctatcaagctggaacccgccaagaccaagcaccctcagcttcagtatgagtcgaaaatttacatgcttctccaaggaggaactgggattcccaacctcaaatggttcggggtggagagcgaatacaatgtcatggttattgacctccttgggccaagcttggaagacctcttcaattattgcaacaggaagctctccttgaaatcagttctaatgcttgcagatcagctgattaatagagttgaatacatgcactcgagaggatttcttcaccgtgatataaagcctgacaattttttaatgggcttaggacgcaaggctaatcaggtttacgtcattgactttggccttgcaaaaaaatacagggatctgcagactcacaaacacataccgtacagggaaaataagaacctgaccggcacagctcgttatgctagtgtcaatacgcacctaggagttgaacaaagcaggagggatgatctggaatctcttggctatgtgctcatgtactttctcagaggaagtcttccttggcagggactgaaagctggcaacaagaagcaaaaatatgacaagattagtgaaaagaagatgctaacccccattgaggtactatgtaaatcgtatccatcagagttcatatcatacttccactactgtcgttccttgcgatttgaagacaaacctgactattcatatttaaaaaggcttttccgggatttatttatacgcgaaggataccaatttgactatgtttttgattggacgatattgaagtaccctcaaattggttccagttctagaggaaggaatcctagtggaaatgcaggagtaaatgcaggaccatctgctgaacgaccaggaagaacctcagtggggcaagatattagagagagattctctggcgcagttgaagcattttcccgaaaaaatatttcgagttctgctcggcatggtgaccacataagacacagatcggaggatgtaccttcatcgaaggatgcgcaagctgattcagagagaggccaaacttcaagaaatggcagctcctcaaaaagagctgcaatttccagcagcagaccaagctcctctggtgagcacactgatggtcgctcgggcaaactagtgcccagcagtggcggccggttgtctaccacccaaagaattcaatccaatgttgataccaaaccatctacattctctcgtaaatcacttacgaaaggatctcgcgatgaccctctccggagctttgagttcctctcgatcaggaagtagcagatgtgattagtaaaaagtaaattacttgtacaaatagacaacattagcgatctgtttaaatgcgaaatgtgccctctaccacaaggctcatccatctttcgtgatgtctctctgctgtctcgtttttgttccgagcttctagctgttgtaacgcgttttagactcgtatagaaagatgatgagttttatgtgcgggaattttcttatgtatgagacttcaatagttacaataaatgtcattgtgtttg

SEQ ID NO: 8260 - DNA, 3333 bp, Glycine max
cctcagcaataactcatcgctgccacatttttctccatccgttccctctttctcctcccttttctttactccttcaattcctttgtctttgtcctctcttctcctcttctttctcccttgaaactaagcttttttctcatcacagtaacacacacacacaggcatcaagctttttccatggttgccatatataagcaactttatttccatatcttcctcaaagcctttttttctcctatgcatccttgaaaagggtcccttttttggcaacaagcttatagccccaaagcagatctaaatactcatcttgttctctagctagctatatatcttctccagcaatttccaccgactgtgaccttgtcagaaacagatcctgagaagttttttcaacataaaaggtcttctcagaaacacaacactggacacaagagagagaattgaaggagagggatcgaatttctcccgagtgtgaaatatgccagctggtattatgattccagcaagaaacatgccctcgatgattggaagaaacggaaccgttggtggctttggattatcttcagggctttctcttggccagattgaaaaccataaggcttcggaatctcaaagatctgaagaaatgttccagccaaacctgatggaagctggtcagctccacccactggacatgcctcagaacacttcagagagcgatgtcccaagaatccgtgaagatgactttgacagtgccaccaagtcaggtagtgaaaacctagaaggtgcttccggtgaagaccaagaccctcgtcccaacaagaagaaacgctaccaccgccacactcagcaccagatccaggagatggaagcgttctttaaggagtgtccgcaccctgatgataaacaaaggaaggagctgagtcgagagttagggttagagccattgcaggttaagttttggttccagaacaagcgcactcagatgaagacccaacatgaacgccatgagaacacacagctgagaactgaaaacgagaagcttcgagcagataacatgaggttcagggaagctctcggcaatgcctcgtgtcctaactgtggtgggccaaccgccattggggaaatgtcattcgatgaacatcacttgaggctcgaaaatgctcgcctgagagaagagattgataggatttctgccattgctgcaaagtatgttgggaagcctgtggtgagctatccacttgtttctccttcatctattcctccgcgcccactagagcttgggattggaggtggttttggtggccaacctggaggcactggtggggatatgtatggtggagctgcaggagatcttcttaggtcaataagtggacctactgaagctgataagccaatcataatagagcttgctgttgcagccatggaggagctcattggaatggcgcaaatgggtgagcctctctggttgactaccctggatggcacaactgtgctcaacgaggatgagtacatcaggtcctttcctcgagggattggtcctaaacctgctggtttcaagtttgaagcttcgagggaaacggctgttgttatcatgaaccatgttaaccttgttgagatcctcatggacgtgaaccaatggtccacagtgttcgctggcatagtctcaagagcaatgactttggaagtgttatcaacaggggtggcagggaattacaacggtgcattgcaagtgatgacagcagaagtgcaagtaccttcacctctggtgccaactcgagagagctattttgtgaggtattgtaagcagcacggtgacgggacttgggcagtagtggacgtgtcattggataatttgcgtcctagtccttctgccagatgtagaagaaggccctcaggttgcttaattcaagaaatgcccaatggctactcaaaggtcatatgggttgagcatgtagaagtggatgacagaggtgtccataatctatacaagcagcttgttagctctgggcatgcatttggggcaaaacgttgggttgcaaccttggatcgacaatgtgaaaggcttgctagtgccatggcaacaaacattcccacagtagatgttggagtgataacaaaccaagatgggaggaagagcatgttgaaacttgctgagagaatggttataagcttttgtgctggagtgagtgcatccactgcacacacatggacgacactttctggaactggtgctgatgatgtaagggtgatgacacgtaagagtgtagatgacccaggaaggcctcccggcatcgttctcagtgctgcaacttctttttggcttcctgtgtcaccaaaaagggtttttgaattcctccgcgatgagaactccagaagtgagtgggatattctttccaacggtggagttgtccaagaaatggcacacattgccaatggccgagacactggaaattgtgtctccctacttcgtgtgaatagtgcgaattcaagccaaagcaacatgttgatattacaagagagttgcgcggactcaacaggatcttttgtgatatatgctcctgtagatattgtggcaatgaacgtggttctgaatggaggggacccggactacgtggcccttcttccttcaggatttgctatactcccagatggaaccactgcacatggaggtggcattggtgacactggacatggtggttctctcttgactgtggcatttcaaatattggttgattcggttccaaccgcaaagctttctcttggatctgttgctactgttaacaatctcattgcctgcactgttgagagaattaaggctgctttatctggtgaagttgcttgacctaatggatcatcgtttagaagaaggataaaggggtgcaatgcattttggacaaatggggaggtgttgggaacttcggcttataccaaaaatgatgagaattgagaagtcaagagcgcaccttgcatgatcctttcttagcacccaacacagtgctgagaggattaaggttcgggaattgacttccctggaaatagtacatgctaagagcttaaatcaagaccttagtacttctcttcaccttcaaagactaagtatttatagttagtgttagcttcttctatgattaggttgtagctttgacttgatctctcttatgttccttctattgttttttgtgttttgttagatcaacgcactagccttatggctagtaaatgggaagcttgcaccgttagtgtagtgtttaattaagttctcactacgctacacatgtttgacccttttaaggttttcaaatgaatgttccttccaatttgcccaatctcattcagtaatttaagtctcgt

SEQ ID NO: 8261 - DNA, 3399 bp, Glycine max
gcaataactcatcgctgccacatttttctccatccgttccctctttctcctcccttttctttactccttcaattcctttgtctttgtcctctcttctcctcttctttctcccttgaaactaagcttttttctcatcacagtaacacacacacacaggcatcaagctttttccatggttgccatatataagcaactttatttccatatcttcctcaaagcctttttttctcctatgcatccttgaaaagggtcccttttttggcaacaagcttatagccccaaagcagatctaaatactcatcttgttctctagctagctatatatcttctccagcaatttccaccgactgtgaccttgtcagaaacagatcctgagaagttttttcaacataaaaggtcttctcagaaacacaacactggacacaagagagagaattgaaggagagggatcgaatttctcccgagtgtgaaatatgccagctggtattatgattccagcaagaaacatgccctcgatgattggaagaaacggaaccgttggtggctttggattatcttcagggctttctcttggccagattgaaaaccataaggcttcggaatctcaaagatctgaagaaatgttccagccaaacctgatggaagctggtcagctccacccactggacatgcctcagaacacttcagagagcgatgtcccaagaatccgtgaagatgactttgacagtgccaccaagtcaggtagtgaaaacctagaaggtgcttccggtgaagaccaagaccctcgtcccaacaagaagaaacgctaccaccgccacactcagcaccagatccaggagatggaagcgttctttaaggagtgtccgcaccctgatgataaacaaaggaaggagctgagtcgagagttagggttagagccattgcaggttaagttttggttccagaacaagcgcactcagatgaagacccaacatgaacgccatgagaacacacagctgagaactgaaaacgagaagcttcgagcagataacatgaggttcagggaagctctcggcaatgcctcgtgtcctaactgtggtgggccaaccgccattggggaaatgtcattcgatgaacatcacttgaggctcgaaaatgctcgcctgagagaagagattgataggatttctgccattgctgcaaagtatgttgggaagcctgtggtgagctatccacttgtttctccttcatctattcctccgcgcccactagagcttgggattggaggtggttttggtggccaacctggaggcactggtggggatatgtatggtggagctgcaggagatcttcttaggtcaataagtggacctactgaagctgataagccaatcataatagagcttgctgttgcagccatggaggagctcattggaatggcgcaaatgggtgagcctctctggttgactaccctggatggcacaactgtgctcaacgaggatgagtacatcaggtcctttcctcgagggattggtcctaaacctgctggtttcaagtttgaagcttcgagggaaacggctgttgttatcatgaaccatgttaaccttgttgagatcctcatggacgtgaaccaatggtccacagtgttcgctggcatagtctcaagagcaatgactttggaagtgttatcaacaggggtggcagggaattacaacggtgcattgcaagtgatgacagcagaagtgcaagtaccttcacctctggtgccaactcgagagagctattttgtgaggtattgtaagcagcacggtgacgggacttgggcagtagtggacgtgtcattggataatttgcgtcctagtccttctgccagatgtagaagaaggccctcaggttgcttaattcaagaaatgcccaatggctactcaaaggtcatatgggttgagcatgtagaagtggatgacagaggtgtccataatctatacaagcagcttgttagctctgggcatgcatttggggcaaaacgttgggttgcaaccttggatcgacaatgtgaaaggcttgctagtgccatggcaacaaacattcccacagtagatgttggagtgataacaaaccaagatgggaggaagagcatgttgaaacttgctgagagaatggttataagcttttgtgctggagtgagtgcatccactgcacacacatggacgacactttctggaactggtgctgatgatgtaagggtgatgacacgtaagagtgtagatgacccaggaaggcctcccggcatcgttctcagtgctgcaacttctttttggcttcctgtgtcaccaaaaagggtttttgaattcctccgcgatgagaactccagaagtgagtgggatattctttccaacggtggagttgtccaagaaatggcacacattgccaatggccgagacactggaaattgtgtctccctacttcgtgtgaatagtgcgaattcaagccaaagcaacatgttgatattacaagagagttgcgcggactcaacaggatcttttgtgatatatgctcctgtagatattgtggcaatgaacgtggttctgaatggaggggacccggactacgtggcccttcttccttcaggatttgctatactcccagatggaaccactgcacatggaggtggcattggtgacactggacatggtggttctctcttgactgtggcatttcaaatattggttgattcggttccaaccgcaaagctttctcttggatctgttgctactgttaacaatctcattgcctgcactgttgagagaattaaggctgctttatctggtgaagttgcttgacctaatggatcatcgtttagaagaaggataaaggggtgcaatgcattttggacaaatggggaggtgttgggaacttcggcttataccaaaaatgatgagaattgagaagtcaagagcgcaccttgcatgatcctttcttagcacccaacacagtgctgagaggattaaggttcgggaattgacttccctggaaatagtacatgctaagagcttaaatcaagaccttagtacttctcttcaccttcaaagactaagtatttatagttagtgttagcttcttctatgattaggttgtagctttgacttgatctctcttatgttccttctattgttttttgtgttttgttagatcaacgcactagccttatggctagtaaatgggaagcttgcaccgttagtgtagtgtttaattaagttctcactacgctacacatgtttgacccttttaaggttttcaaatgaatgttccttccaatttgcccaatctcattcagtaatttaagtctcgtggtttatttatttgtgtttgttatttccaccatatataaatgttgaataacatagatgttaatgtgtaaca

SEQ ID NO: 8262 - DNA, 3032 bp, Cajanus cajan
ctaagaagaaactcctcctgtgaaggttttggattgaaaatccattgatagaagagagagagaaagagaggggttgaattgcatagagtgtgaaatatgccagctggtattatgattccagcaagaaacatgccttcgatgattggaagaaacggcaacgttggtggctttggattatcttcagggctctctcttggccagccaaacctgatggaagctagtcatcagcttctcccccttgacatgcctcagaattcagagagcgatgtcccaagaatccgcgaagatgactttgacagtgccaccaagtctggtagtgaaaaccaagaaggtgcttccggtgaagaccaagaccctcgcccaaacaagaagaaacgctaccaccgccacactcagcaccagatccaggaaatggaatcattctttaaggagtgtcctcaccctgatgacaagcaaaggaaggagctgagtcgagagttagggttagagccattgcaggttaagttttggttccagaacaagcgcactcagatgaagacccaacatgagcgccatgagaacacacagctgagaactgaaaacgagaagcttcgagcagataacatgaggttcagggaagctctcagcaatgcctcgtgtcccaactgtggtggaccaaccgctataggagaaatgtcattcgatgaacatcacttgaggctcgaaaatgctcgcctcagagaagagattgataggatttctgccattgctgcaaagtacgtggggaagcctgtggtgagctatccacttctttctcctaattcatctgtgcctcctcgtccactggagcttgggattggtggtggttttggtggccaagctggaggcattggtggggacatgtatggtggagctgcaggagatcttcttaggtcaatcagtggacccaccgaagctgataagcccatcataatagagcttgctgttgcagccatggaggagctcattggaatggcacaaatgggtgagcctctttggttaacttcccttgatggcactgccactgtgctcaatgaggacgagtacatcaggtcctttcctcgtgggattggtcctaaacccgctggcttcaagtgtgaagcttcacgagaaactgctgttattatcatgaaccatgttaaccttgtcgagattctcatggatgtgaaccaatggtccacagtgttctctggcatcgtctcaagagccatgactttggaagtgttgtcaacaggagtggcggggaattacaacggtgcattgcaagtgatgacagcagaattacaagtaccctcacctcttgtgccaactcgagagagctattttgtaaggtactgtaagcagcatggcgaagggacttgggcagtagtggacgtgtccttggataatttgcgtcctagtccttcagccagaagtagaagaaggccctcaggttgcttaattcaagaaatgcccaatggctactcaaaggtcatatgggttgagcatgtagaagtggatgacagaggtgttcataatctatacaagcagcttgttagctcggggcatgcatttggtgcaaaacgttggattgcaaccttagaccgacaatgtgaaaggcttgctagtgccatggcaacaaacattcccacagtagatgttggagtgataacaaaccaagatgggaggaagagtatgttgaaactggctgagagaatggttataagcttttgcgctggagtgagtgcatccactgcacacacatggacaacactctctggaactggtgctgatgatgtaagggtcatgactcgtaagagtgtagatgacccaggaaggcctcctggcatcgttctcagtgctgcaacgtctttttggcttccagtgtcaccgaaaagggtttttgaattcctacgtgatgagaactccagaagtgagtgggatattctttccaacggtggagttgtccaagaaatggcacacattgccaatggacgagacactggaaactgtgtctccctacttcgagtgaatagtgcgaattcaagccaaagcaacatgttgatattacaagagagttgtgcagactcaacggggtctttcgtgatatatgctcctgtggacattgtggcaatgaacgtggttctgaatggaggggaccctgactacgtggcacttctcccttcaggatttgctatactcccagatgggaccactgcacatggaggtggcattggtgacactggacatggtggctctctcttgactgtggcattccaaatattggttgattcagttccaacagctaagctttctcttggatccgttgctactgtcaacaatctcattgcctgcactgttgagagaattaaggctgctttatcttctgaacctgttgcttgacctaatggatatcgtttagaagaaggataaggggtgcattgcattttggagaaatggggagatgttgggaacttcggctttatacaaaagacgatgagaagtcaagagcgcaccttgcatgatcctttcttagcacctcaacacagtgctgagaggattaaggttcgggaattgacttccctggaattagtaaatgctagctaagagcttaaatcaagaccttacttctcttcaccttcccaagactaaatatttatagttagtgttagttttttcaatgtttaggttgtagctttggcgtaacctcttttgttccttctattgttatttgtgttctaggtctcgtcaagcaccagtactatagctagtagttgggaagcttgcaccgtttgtgtagtggttaaattatcactacacctgtttgaccctttttaaggtttaaggttttaaaatgaatgtttctttttcaaattatcaagtctaattcagtaactcaagtctcatgggttattattttgtattttgttatttctagaataacttagggatgaaaatgtgtatctagataacatgatatcatatccgtctttatactcgtatttgaaaaaaaaataaaatcctatttatgtaaa

SEQ ID NO: 8263 - DNA, 2748 bp, Phaseolus vulgaris
atgccagctggtattatgattccagcaagaaacatgccctccatgattggaagaaacggcaacgttgttggctttggattatcttcagggctctctcttggccagattgaaaaccataaggcctcggaatctcaaagatctgtagaaatgttccagccaaacctgatggaagctggtcagcttctccccctggacatgcctcagaacacttcagagagcgatgtcccaagaatccgcgaagatgactttgacagtgccaccaagtcaggaagtgaaaaccaagaaggtgcttctggtgaagaccaagaccctcgtcccaacaagaagaaacgctaccaccgccacactcagcaccagatccaggaaatggaagcattctttaaggagtgtccgcacccagatgacaagcaaaggaaagagctgagtcgagagttagggttagagccattgcaggttaagttttggttccagaacaagcgcactcagataaagacccaacatgagcgccatgagaacacacagctccgaactgaaaacgataagcttcgagctgacaacatgaggttcagggaagctctcagcaatgcctcgtgtcctaattgtggaggaccaaccgctataggggaaatgtcattcgacgaacatcacctgaggctcgaaaatgcacgcctcagagaagagattgataggatttctggcattgctgcaaagtacgtggggaagcctgtggtgagctatccacttctttctccttcatctgttcctccgcgtccacttgagcttgggattggaggacaaaattcaagatttctcttcagcatgtctgaggctgataagcccataataatagagcttgctgttgcagccatggaggagctcattggaatggcacagatgggtgatcctctttggttgactaccctggatggaactaccactgtgctcaacgaggatgaatacatcaggtcttttcctcggggaattggtcctaaacccgctggtttcaagtgcgaagcttcacgggagaatgccgttgttatcatgaaccatgttagccttgttgagattctcatggacgtgaaccaatggtccacagtgttctctggcatagtctcaagagcaatgacgttggaagtgttatcaacaggggtggcggggaattacaacggtgcattgcaagtgatgacagcagaagtacaagtaccttcacctctagtgccaactagagagagctattttgtaagatattgtaagcatcatggtgacgggacttgggctgtagtggacgtgtccctggataatttgcgtcctagtccctcagccagatgtagaagaaggccttcaggttgcttaattcaagaaatgcccaatggctactcaaaggtcatttgggttgagcatgttgaagtggatgacagaggtgttcacaatctatacaagcagcttgttagttctgggcatgcatttggtgcaaaacgttggattgccaccttggatcgacaatgtgaaaggcttgcttgtgccatggcaacaaacattcctacagtagatgttggagtgataactaaccaagatggaaggaagagtatgctgaaactggcagagagaatggttataagcttttgcgctggagtgagtgcatctactgcacacacatggacaacactctctggaactggagctgatgatgtaagggtcatgacacgtaagagtgtagatgacccaggaaggcctcctggcattgttctcagtgctgcaacttctttttggctcccagtgtcaccaaaaagggtttttgaattcctccgtgatgagaactccagaagtgagtgggatattctttccaatggaggagttgttcaggaaatggcacacattgccaatggacgagaaactggaaattgtgtctctctacttcgagtgaatagtgcgaattcaagccagagtaacatgttgatattgcaagagagttgcgcagactcaacagggtcatttgtgatctatgctcctgtagatattgtggcaatgaacgtggttctgaatggaggggaccctgactacgtggcccttcttccttcaggatttgctattctcccagatgggaccactgcacatggaggaagcattggtgacactggaaatggtggatctcttttgactgtggccttccaaatcttggttgattcagttccaacggcaaagctctctcttggatcagttgccactgttaacaatcttattgcctgcactgttgagagaattaaggctgctttatctggtgaagttgcttgacctaagggtcgtttagaagaaggataaagaggtgcactgagaaatgagaaggtgttgggaacttcggcttatagaaaaaaggatgagaagtcaagagcgcaccttgcatgatcctttcttaacactcaacacgagaggattaaggttcgggaattgacttccatggaaatagtaaagtataagagcttaaatcaatgaagacaacacttttcttcaccttccaagactgcgtattaatagttgtttagttgttaatgttagtccttttgtgtttattttattaggttgtagttttgacttaacctctcatgttccttcttcagttgttattatttgtgtttcagctcaagcaccagcactatagcttgcatctttagtgtagtggttaaattatcactacacctgtttgatccttctaaggttttcaaatgaatgttccttccaatttgtcaagtc

SEQ ID NO: 8264 - DNA, 2931 bp, Lotus japonicus
gaattgatcttgtgtgaaatatgcccgctggtattatgatacctgcgatgaacatgccctcaatgcttggaagaaacggtgacgttggtggcagttttggattttcttcaagtctctctctttcccagccgcacctaatggaagctcatcatcagctccaccaccaccttgacatggctcctcagaacaccacctccgagagcgacatcgccgccgcggtgagaatccgtggagaagacgagttcgacagtgccaccaagtccggcagcgaaaaccaagaaggtggcgcctctggaggagaccaggaccctcgtcctaacaagaaaaagcgctaccaccgccacactcagcaccagatccaggaaatggaatcttttttcaaggagtgcccacaccctgatgacaagcagaggaaggagttgagcagggagttagggttagagccattgcaggtcaagttttggttccagaacaagcgcactcagatgaagacacagcatgagaggcaagagaacacgcagcttaggactgacaatgacaagcttcgtgcggataacatgaggttgagggaagctcttagcaattcttcgtgtcctaattgtggtggaccaaccgctattggagaaatgtcatttgatgaacatcacttgaggcttgaaaatgccaggctaagagaagagattgataggatttcagccattgctgcaaagtatgtggggaagccggtggtgagctacccactcctttctccgccatctgctccttcgcgtcctctagaactcggaataggcggctttggaggccaaccaggcgttggtggtgacatgtatggagccggagagcttctcaggtcaatcagtggacctactgaagctgacaaaccaattataatagagctcgctgtcgcagccatggaggagctcattggaatggcacaaatgggtgagcctctttggctgacctcgctggatggcaccacaaccgtgctcaatgaggatgaatacatcaggtcctttccccgaggaattggtcctaagccagatgggttcaagtgtgaggcttcacgagaaacttctgttgtcatcatgaaccatgttaacctggttgagattctgatggatgtgaaccaatggtccacagtgttctctggtatcgtctcaagggcaatgactctagaagtgctatcaactggggtagcgggaaactacaatggtgccttgcaagtgatgacagctgaactgcaagtgccttcacctcttgtgccaactagggagagttattttgtgaggtattgtaagcagcatgctgatgggacttgggcagtggtggatgtgtccttggataatttgcgccctagtccttctgctagatgtagaagaaggccttctggttgcttaatccaagaaatgcccaatggctactcaaaggtcacctgggttgagcatgtagaagtggatgaaagaggtgttcacaatctatacaagcagcttgttagctctggacatgcatttggtgcaaaacgttggatttcaaccttagatcgacaatgtgaaaggcttgctagtgccatggcaactaacattcccacagttgatgttggcgtgataacaaaccaagatgggagaaagagcatgttgaaactggctgagaggatggttataagcttttgtgctggagtcagtgcttccactgctcacacatggacaacaatctccgggactggagctgaaactgatgatgttcgggtcatgacccgaaagagtgtggatgacccaggtaggcctccgggtatcgtccttagtgctgcaacttctttttggcttccagtgccacctaagagggtctttgaatttctccgcgatgagaactctagaagtgagtgggatatcctttccaatggtggagtagttcaagaaatggcacacattgctaacggacgagatactggaaattgtgtctctctacttcgagtgaatagtgctaattctagccaaagtaacatgttaatactgcaagagagttgcacggactctacgggctcattcgtgatctatgctcctgtggacattgttgctatgaatgtggttctaaatggaggggacccggactatgtagcccttctaccttcagggtttgctgtgctcccagatgggaccacagcacatggaggtggcattggcgaaactggccatggtggttcgcttttaactgttgcgtttcagattttggtggattcagttccgacggcaaagctttctcttggatctgttgcgacggttaataatctcattgcttgcactgttgagaggattaaggctgccttgtctggtgaagttgcatgagctttaagtcctatggaactggtaactgatgttcaaggtgaagaaggaccaaaggggtgtattacattttggataattcagaaggcgttgagaaattcggcctataaacaaggaatggggagaagtcaagagcgcaccttgcgtgatcccttctcagaactctaaacagagtactgagaggattaaggttcgggaattgacttccctagatatagtaaatgctataagagctaaaattaagaccttacttctctacaccttctaatcaagactatatatttatagttaattagggttagcttttgtgatgattaaaatgtagctttgatgtaacctctcatgttccttcttctgttgttatttgtgtattttagaacaagcactagcactagctagtaaattggaatctttcccctttagcatatagtggttagcttttctcaccgcacctgatttgtcctttcaagggttttgaaatgggtgtttgcttccattttgccaatgacttcatgtatggggttgctctttttgaccaatgacttcacccaaaaaagaaaggagaagaatttgataaagcaacatttatcat

SEQ ID NO: 8265 - DNA, 3388 bp, Medicago truncatula
ctcatcactgccacaattttcctctccatccgttcactcttatttcctttctcttccttcaattcctttgtcctctcaccttcttcatcgtcttcatcttcttttcttcttctttctctctttaaacaatctactaccttttttaagctagaccgtccaaaaacactcatcaagctttcgttgcttaatttattaccatatacccaactttccataacttcctcaaaaaaaccttctcttcttttttcatattcatctttgaaaaaagtgtcttttctttttacttctttttgtgcaccatagtagatctacattttttcttcctcttctagcttctatctctctttagcaactacccttcctcttgtggcacattaatctcattgaaacaccgctaaagctgacagaagaatctaacaaagaattcatcatctgaaagccatttaaggatctaagaaaagagagagaaaaaattaaaagaaggattttctagttgaagcttttttgattgaaatatgcaagctggtttaatgattccagctagtaacatgcattcaatgatcggaagaaacaacaataacgttggtgtctttggtttatcttcatctctctctttatcccagaaaatgttccagccaaatctaatggaagctggacaacatcatcaacttctaccatttgacatgacacaaaacaacaataatacttcagaaagtgatgttccaagaatccgtgaagatgaattattcgacagtgctacgaaatctggtaacagtgaaaatcaagaagctgctaattctggtgaagatcaagaacctcgtgctaagaagaaacgttatcaccgtcatacacagcatcagatccaagaaatggaagcgttttttaaggaatgtccacaccctgatgacaagcaaaggaaggaactaagcagagagttagggttagagccattgcaagtgaagttttggtttcagaacaaacgtactcaaatgaagactcaacaggagaggcatgagaatacttcacttagaactgaaaatgagaaacttcgcgctgataacatgaggtttagagaagctctaagtaatgcttcttgtcctaattgtggtggaccaactgctatcggagaaatgtcgtttgatgaacatcacttgaggattgaaaattctcgccttcgagaagagattgataggatatctgccattgctgccaagtacgtagggaagccagtggtgagctatccactcctctccccttcatcggttcctcctcgtcctctagaactcggcattggtggtttcggaggacaaccaggaatgggaggagatatgtatggagctggagatcttcttagatcaataagtggaccgaccgaagccgataaaccgatgataattgagctagctgttgctgctatggaggaactcattggaatggcacaaatgggtgatccactttggttgcctacacttgaaggaggttccatactcaatgaggaggaatatgttaggtcttttcctagaggaattggtccaaaaccagctggttttaaatgtgaagcttcaagagaatcttctgttgtcatcatgaatcatgttaaccttgttgagattctcatggatgtgaaccaatggtccacagttttttctggcattgtctcaagagcaatgacattggaagtgctatcaactggggtggcagggaactacaatggtgcattacaagtgatgacagcagaactgcaagtaccttcaccacttgtgccaactagagagagttattttgtaaggtattgtaagcaacatgctgatggaacttgggcagtagtggatgtttctttggacaatttacgccctagtccttctgccagatcaagaagaaggccttctggttgcttaattcaagaaatgcccaatggctactcaaaggttatatgggttgagcatgttgaagtggatgatagaggtgttcataatctatacaagcagcttgttagttctggacatgcatttggtgcaaaacgttggattgcaaccctagatcgacaatgtgaaagacttgctagtgccatggcaacaaacattcccacggtcgatgttggcgtgataacaaaccaagatgggagaaagagtatgttgaaactagctgaaagaatgtgtataagcttttgtgctggagtgagtgcctcaacagcacacacgtggacaacactttcgggtacaggagctgatgatgtaagggtcatgacccgtaagagtgtagatgacccaggaagaccagctggcattgttctaagtgctgcaacttctttttggcttccagtgccaccaaaaagagtttttgaatttcttagagatgaaaactcaagaagtgagtgggatatcctttccaatggtggagttgtccaagaaatggcacatattgctaatggaagagatactggaaattgtgtttctctacttcgagtgaatagtgcaaattcaagccaaagcaacatgttgatattgcaagagagttgtacggatacaacagggtcatttgtgatatatgcacctgtagacatagttgcaatgaatgtggttctaaatggaggggatccagattatgtagcacttcttccatctggatttgctatactaccagatgggacaaccacaaatggaggaggtgttggtgaaactggacatggtggtggatctctattgactgttgcatttcaaatattggtcgattccgttccaacggcaaaactttctcttggatctgttgctacggttaataatcttattgcttgtactgttgagaggattaaggcttctttgtctggtgaagttgcttgaccatcaagtcatctaatttaagaagaagggcaaagggaaaagcattgcattttggataatgaggaggcaaagagaacttaggcttatataaaaaaaacggggagaagtcaagagcgcaccttgcaagatttccttctcaggacgatcaactgaggactgagaggattaaggttcgggaattgacttccttagataatagtaaaagctactccttccgttttaaatataaataaaaagtcaaatgtatttggttcaaatttcaactaaatacattcgactttttagcttatatttaggacaatagggagtaagagctaaaattaagatattctcttcaccttctaagactatatatttatagttgttagtgatatcattttgattatgattaagttgtagctttaatttgatgtaacctctcatgttccttctattgtcatttgtgctttaattagatcttgcactaccatgcaaacagtggttaatttctcattacatgatccgttttatccttctttaaggttttgaagatgtatgatacattccat

SEQ ID NO: 8266 - DNA, 3129 bp, Glycine max
cattaaatgcaattgcaccctctcaatacgctctgcaattactcttcgctgccacattttcctccatctgttccccacttctctctctccttcaatgcccttgtccctctctcttcttcttcttcttcttcttctcactttctctctgtaacaccttctcttcatgatatagcttcttcaccttttttttctttcttttctttgttaccatatataagtaaactagattccataactgtcccaagcccttccttcaaaagggtcctctcttttcaacccaaaacagatctacaccttcatcttccaccaccactctcactgaatccaagggctcaacctcttaagctttttctctatccaagaacctcttaagagagagaaagaataagagaaagagaaagtgagagagccaattctacatttgttggtggtggtttttgaggcatgtgaaatatgcaagccggtattatgatgattccggcgagaaacatgccttcgatgatagcaagaaacaacaacgttgtagggttttttggatcatctgcacttttcactcttgcccagccgaacctgatggacgcgttggagatgggtcagaacacttccgagagtgaggttcctcgaatcctagaagacgagttcgacagtgccaccaagtccggtagtgaaaaccatgaaggtgcctctggtgaagaccaagaccctcgtcccaacaaaaagaagcgttaccaccgccacacccaacaccagatccaagaaatggaagcttttttcaaggagtgtccgcacccagatgacaagcaaaggaaggaactgagcagggagttagggttagagccattgcaggttaagttttggtttcagaacaagcgtactcagatgaagacacagcacgagcggcatgagaatacaaatctcagaaccgaaaacgagaagcttcgagcagataatatgaggtatagggaggctcttagcaatgcttcgtgtcctaattgtggtggaccaaccgctataggagaaatgtcattcgatgaacatcacttgaggcttgaaaacgcaaggctaagagaagagattgatcgcatctcagcaattgctgcaaagtatgtagggaagccagtggtgaactattcaaatatttctccttctctccctcctcgtccgttagaactaggggttggtggtgctggttttggaggccaaccagggattggtgtggacatgtatggagctggggatcttcttaggtcaattagtggacccactgaagctgataagccaataatcatagagctagctgttgcagctatggaggagctcattgggatggcacaaatgggtgagcctctttggttaactacccttgatggcacatccactatgctcaatgaggatgagtacattaggtcttttcctcgagggattggtccaaaacctagtggcttcaaatgtgaagcttcaagagaaactgctgttgttatcatgaaccatgtcaacctcgttgagattctcatggatgtgaaccaatggtccacagtgttctctggtatagtctcaagagccatgactctggaagttctatcaacaggggtggctgggaactacaatggtgccttacaagtgatgacagcagaactacaactacctacaccacttgtgccaactcgcgagagttattttgtgaggtattgtaagcaacatgcagatgggacttgggcagttgtggatgtttctttggataatttgcgcccaggtccttcagccagatgtagaagaaggccttctggttgcttaattcaagaaatgccaaatggctattcaaaggtcacatgggttgagcatgtagaagtggatgatagaggtgttcacaatctttacaagcagcttgttagctctggacatgcatttggtgcaaaacgttgggttgcaaccttagatcgacaatgtgaaagactcgctagtgccatggcaacaaacattcccactgtagatgttggcgtgataacaaaccaagacgggagaaagagcatgatgaagctggctgaaagaatggtgataagcttttgtgctggagtgagtgcttccactgctcacacatggacaacactctctgggaccggtgctgatgatgtaagggttatgaccagaaagagtgtggatgaccctggaagaccccctggcatagttctcagtgctgccacttctttttggcttcctgttccacctaaacgagtctttgacttcctccgtgacgaaaactctaggaatgagtgggacattctttccaatggaggagttgtccaagaaatggcacacattgcaaacggaagagacacaggaaactgtgtatctctacttcgagtaaatagtgcaaattcgagccagagcaacatgttgatattacaagagagttgcaccaattcaacaggctcttttgtcatttatgctccggtggacattgttgcaatgaatgtggttctaaatggtggagacccagattacgtggcacttcttccttcagggtttgctattctccctgatggaaccacatcgcataatggaagtggtggcattggcgaaactggccctagtggttctctcttaaccgttgcgtttcaaatattggtggattctgttccaaccgcgaagctttctcttggatctgtggccactgtgaacaatctcattgcatgcactgttgagagaatcaaggcttctttgtctggtgaacctgcttgatcagagcttcaagacttttggattctgcgttgcagtttacaagaaggatcaacgggacgcattgcattgtggaaaattaaaaagttggtgttgaacctcggcttatattacaaagacggggagaagtcaagagcgcaccttgcatgattccttctcagtgccccaaaagagttctgagaggattaaggttcgggaattgacttccctagctagatatagtaaacgttaagagcacattttaagatcttgctaccctttaccatttccaagactaaaatatatatatagctagctaggattaaccttttgagtaactagggtttaacattaatgtaaaactcttgtctttttcaatatctgattttgtgtgatttagaagtagtagcaccg

SEQ ID NO: 8267 - DNA, 3332 bp, Glycine max
atttgcatttgcattgcaccgtcaactcgcaaaatatttataagttttatactacaccaaaccaaaaaatatgctgcgtctctttctctctcccctctctagcaattacacctcttttgccctccattaaatgcaattgcaccctctcaatacgctctgcaattactcttcgctgccacattttcctccatctgttccccacttctctctctccttcaatgcccttgtccctctctcttcttcttcttcttcttcttctcactttctctctgtaacaccttctcttcatgatatagcttcttcaccttttttttctttcttttctttgttaccatatataagtaaactagattccataactgtcccaagcccttccttcaaaagggtcctctcttttcaacccaaaacagatctacaccttcatcttccaccaccactctcactgaatccaagggctcaacctcttaagctttttctctatccaagaacctcttaagagagagaaagaataagagaaagagaaagtgagagagccaattctacatttgttggtggtggtttttgaggcatgtgaaatatgcaagccggtattatgatgattccggcgagaaacatgccttcgatgatagcaagaaacaacaacgttgtagggttttttggatcatctgcacttttcactcttgcccagccgaacctgatggacgcgttggagatgggtcagaacacttccgagagtgaggttcctcgaatcctagaagacgagttcgacagtgccaccaagtccggtagtgaaaaccatgaaggtgcctctggtgaagaccaagaccctcgtcccaacaaaaagaagcgttaccaccgccacacccaacaccagatccaagaaatggaagcttttttcaaggagtgtccgcacccagatgacaagcaaaggaaggaactgagcagggagttagggttagagccattgcaggttaagttttggtttcagaacaagcgtactcagatgaagacacagcacgagcggcatgagaatacaaatctcagaaccgaaaacgagaagcttcgagcagataatatgaggtatagggaggctcttagcaatgcttcgtgtcctaattgtggtggaccaaccgctataggagaaatgtcattcgatgaacatcacttgaggcttgaaaacgcaaggctaagagaagagattgatcgcatctcagcaattgctgcaaagtatgtagggaagccagtggtgaactattcaaatatttctccttctctccctcctcgtccgttagaactaggggttggtggtgctggttttggaggccaaccagggattggtgtggacatgtatggagctggggatcttcttaggtcaattagtggacccactgaagctgataagccaataatcatagagctagctgttgcagctatggaggagctcattgggatggcacaaatgggtgagcctctttggttaactacccttgatggcacatccactatgctcaatgaggatgagtacattaggtcttttcctcgagggattggtccaaaacctagtggcttcaaatgtgaagcttcaagagaaactgctgttgttatcatgaaccatgtcaacctcgttgagattctcatggatgtgaaccaatggtccacagtgttctctggtatagtctcaagagccatgactctggaagttctatcaacaggggtggctgggaactacaatggtgccttacaagtgatgacagcagaactacaactacctacaccacttgtgccaactcgcgagagttattttgtgaggtattgtaagcaacatgcagatgggacttgggcagttgtggatgtttctttggataatttgcgcccaggtccttcagccagatgtagaagaaggccttctggttgcttaattcaagaaatgccaaatggctattcaaaggtcacatgggttgagcatgtagaagtggatgatagaggtgttcacaatctttacaagcagcttgttagctctggacatgcatttggtgcaaaacgttgggttgcaaccttagatcgacaatgtgaaagactcgctagtgccatggcaacaaacattcccactgtagatgttggcgtgataacaaaccaagacgggagaaagagcatgatgaagctggctgaaagaatggtgataagcttttgtgctggagtgagtgcttccactgctcacacatggacaacactctctgggaccggtgctgatgatgtaagggttatgaccagaaagagtgtggatgaccctggaagaccccctggcatagttctcagtgctgccacttctttttggcttcctgttccacctaaacgagtctttgacttcctccgtgacgaaaactctaggaatgagtgggacattctttccaatggaggagttgtccaagaaatggcacacattgcaaacggaagagacacaggaaactgtgtatctctacttcgagtaaatagtgcaaattcgagccagagcaacatgttgatattacaagagagttgcaccaattcaacaggctcttttgtcatttatgctccggtggacattgttgcaatgaatgtggttctaaatggtggagacccagattacgtggcacttcttccttcagggtttgctattctccctgatggaaccacatcgcataatggaagtggtggcattggcgaaactggccctagtggttctctcttaaccgttgcgtttcaaatattggtggattctgttccaaccgcgaagctttctcttggatctgtggccactgtgaacaatctcattgcatgcactgttgagagaatcaaggcttctttgtctggtgaacctgcttgatcagagcttcaagacttttggattctgcgttgcagtttacaagaaggatcaacgggacgcattgcattgtggaaaattaaaaagttggtgttgaacctcggcttatattacaaagacggggagaagtcaagagcgcaccttgcatgattccttctcagtgccccaaaagagttctgagaggattaaggttcgggaattgacttccctagctagatatagtaaacgttaagagcacattttaagatcttgctaccctttaccatttccaagactaaaatatatatatagctagctaggattaaccttttgagtaactagggtttaacattaatgtaaaactcttgtctttttcaatatctgattttgtgtgatttagaagtagtagcaccggcactagttggtgggaaaatttgcatttagtacgcagtctaatctcaccaaacctcctttttgaataggttttgaaatg

SEQ ID NO: 8268 - DNA, 3059 bp, Glycine max
ctctgtaacacctcttcatgccatagcttctttttcttttcttttttaccatataagtaaacattttttttttcaaaactgtcccaaacccttccttcaaaacggtcatctcttttcaacccaaaacagatctacaccttcatcttctactcccactctcactgaaaatccaagggctcaacttcttaagctttttctctatccaagaacctcttaggagagagaaagtgatatatatagagagagaaagagtcaattctacatatacttgttggtggtggtttttgaggcatgtgaagtatgcaagccgttattatgatgattccggcgagaaacatgccttcgatgatagcaaggaacaacaacaacgttggagggttttttggatcatcttcatcacctttcactcttgcccaggtcgcaataatcataatgttccagccgaacctgatggacgcgttggagatgggtcagaacactcccgagagtgagattcctcgaatccgtgaggatgagttcgacagtgccaccaagtccggtagtgaaaaccatgaaggtgcctccggtgaagaccaagaccctcgtcccaacaaaaagaaacgttaccaccgccacacccaacaccagatccaagaaatggaagcttttttcaaggagtgtccgcacccagatgataagcaaaggaaggaactgagcagggaattagggttagagccattgcaggttaagttttggtttcagaacaagcgtactcagatgaagacacaacacgagcggcacgagaatacaaatcttagaaccgaaaacgagaagcttcgagcagataacatgaggtatagggaggcacttagcaatgcttcgtgtcccaattgtggtggaccaactgctataggagaaatgtcattcgatgaacatcacttgagacttgaaaacgcaaggctaagagaagagattgatcggatttcagcaattgctgcaaagtatgtagggaagcctgtggtgaattattcaaatatttctccttctctccctcctcgtccattagaaattggtgttggtggtgctggttttggaggccaaccagggattggtgtggacatgtatggagctggggatcttcttaggtcaatcagtggacccactgaagctgataagccaataatcatagagctagctgttgcagctatggaggagcttattggaatggcacaaatgggtgagcctctttggttaactacacttgatggcacatccactatgctcaatgaggatgagtacattaggtcttttcctcgaggtattggtccaaaacctagtggcttcaaatgtgaagcttcaagagaaactgctgttgttatcatgaaccatgtcaacctcgttgagattctcatggatgtgaaccaatggtccacagtgttctctggtatagtctcaagagccatgactctagaagtgttatcaacaggggttgccgggaactacaatggtgccttacaagtgatgacagcagaactacaactacctacaccacttgtgccaactcgtgagagttattttgtaaggtattgtaagcaacatggagatgggacttgggctgttgtggatgtttctttggataatttgcgcccaagtccttcagccagatgtagaagaaggccttctggctgcctaattcaagaaatgccaaatggctattcaaaggtcacatgggttgagcatgtggaagtggatgatagaggtgttcacaatctttacaagcagcttgttagctccggacatgcatttggtgcaaaacgtttggtagcaaccttagatcgacaatgtgaaagactcgctagtgccatggcaacaaacattcccactgtagatgttggtgtgataacaaaccaagaagggagaaaaagcatgatgaagctggctgaaagaatggtgataagcttttgtgctggagtgagtgcttccactgctcacacatggacaacactctcagggacaggtgctgatgatgtaagggttatgactcgaaagagtgtggatgaccctggaagaccccctggcattgttctcagtgctgccacttctttttggcttcctgttcctcctaaacgagtctttgacttcctccgtgacgaaaactctaggaatgagtgggatattctttccaatggtggagttgtccaagaaatggcacacattgcaaacggaagagacactggaaactgtgtatctctactacgagtaaatagtgcaaattcaagccagagcaacatgttgatattacaagagagttgcaccgattcaacaggctcttttgtaatttatgctccagtggacattgttgcgatgaatgtggttctaaacggtggagacccagattatgttgcacttcttccttcagggtttgctattctcccagatggaaccacatcgcatggaagtggtggtggcgtcattggcgaaactagccctagtagtggatctctcttaactgttgcctttcaaatattggtcgattctgttccaaccgctaagctttctcttggatctgtggccactgtcaacaatctcattgcatgcactgttgagagaatcaaggcttctttgtctggtgaacctgcttgagcttcaaggcttttggattctgcgtttacaagaaggatcaaagggacacattgtatggtggaaaatcaaaaggtggcgaggaacctcggcttatattacaaagacggggagaagtcaagagcgcaccttgcatgattccttctcagtactccaaaagagttatgagaggattaaggttcgggaattgacttccctagatatagtaaacgttaagagcacattttaagatcttgctaccctttaccatttccaagactacatatatagccagctaggattaaccttttgagtaactagggtttaacattaatgtaaaactcttgtctttttcaatttctgattttgtgtgatttagaagtagtagcactggcactagttggtgggaagtttgcatttagtacccagactaatttctcaccaaacctccttttttaaaa

SEQ ID NO: 8269 - DNA, 2802 bp, Phaseolus vulgaris
tgtgtgaaaaatacaaggcagtattatgattccggcaagaaacatgccctcgactatagcaaggaagaacaataaccttggtgggttcggatcatcttcaactttcactctcgcgcagccgaacctgatggaagcgttggagatgggtcagaacacttcggaaagtgaggtccctcgaatccgtgaagatgagtttgacagtgccaccaagtctggtagtgaaaaccatgaaggtgcctctggtgacgaccaagaccctcgtcccaacaaaaagaagcgttaccaccgccacacccaacaccagatccaggaaatggaagcattcttcaaggagtgtccacacccagatgacaagcaaaggaaagaactgagcagggaattaggtttagaaccattgcaggttaagttttggtttcagaacaagcgtacccagatgaagacacagcacgagcggcatgagaatacacagcttagaaccgagaatgagaagcttcgagcagataacatgaggtatagggaagctcttagcaatgcttcgtgtcctaattgtggtggaccaacggctataggagaaatgtcatttgatgaacatcacttgaggcttgaaaatgcaaggctaagagaagagattgataggatttcagcaattgctgccaagtatgtagggaaacctgtggtgaattattcaaatatctcccctactcttcctcctcgtcctctagaacttggagttggtgctggttttggaggccagccagggattggtgtggacatgtatggagctggggatcttctgaggtcaatcagtggacccactgaagcagataaaccgataataatagagctagctgttgcagctatggaggagctcattggaatggcccaaatgaatgatcctctttggttaactacacttgatgctacctccactatactcaatgaagacgaatacatcaggtccttccctagaggaattggcccaaaacctactggcttcaaatgtgaagcttctcgagaaagtgctgttgttatcatgaaccatgtcagcctcgttgagattctcatggatgtaaaccaatggtccacagtgttctctggtatagtctcaagagccatgactctggaagtggtatcaacgcagagtggccattacggccgggaactacaatggtgccttacaagtgatgacagcagaattgcaattacctacacctcttgtgccaactcgtgagagttattttgtaaggtattgtaagcaacactctgatgggacttgggcagtggtggatgtgtctctggataatttgcgtccaagtccttcagccagatgtagaagaaggccatctggttgcttaattcaagaaatgccaaatggctattcaaaggtcatatgggtggagcatgtggaggtggatgacagaggtgttcatagtctttacaaacagcttgttagctctggacatgcatttggtgctaaacgttgggttgcaaccttagatcgacagtgtgaaagactcgcaagtgcgatggcaacaaacattcccacggttgacgttggtgtgataacaaatcaagaggggagaaagagtatgatgaagctggcagaaaggatggtgataagcttttgtgctggagtgagtgcttccactgctcacacatggacaacactgtctgggactggtgctgatgatgtaagggtgatgacccgaaagagcgtggatgaccctggacgaccccctggcatcgttctcagtgctgccacttctttttggcttccagttccacctaaacgggtttttgactttctccgtgacgagaactctaggaatgagtgggacattctttccaatggtggagttgttcaagaaatggcacacattgcaaatggacgagatactggaaactgtgtgtccctacttcgagttaatagtgcaaattcaagccagagtaacatgttgatattgcaagagagttgcacagattcaaccgggtcctttgtcatttatgctccagtggatattgttgcaatgaatgtagttctaaatggaggagacccagattatgtcgcacttcttccttcagggtttgcaattcttccagatggaactatatctcatgaaactggacctggtggatcccttttaactgttgcatttcaaatactggttgattcggttccaacagctaagctttctcttggatctgttgccactgtcaacaatctcattgcatgcactgttgagaggatcaaggcatctttgtctggtgaaactgcttgatgagagcttctacactttggattgtgcaaatgttgtagtttagaagaaggatgagagtcacaattcattgtgttgtggaaaatgaaaaggtggtgaggaacttcggctgaaagatgggaagaagtcaagagcgcaccttgcatgatcccttctcagtaccccaaaagagttatgagaggattaaggttcgggaattgacttccctacatatagttaaggttaagagctcatgatattaagaccttgctaccctaccctttacaatttctaagactaaaacatgtagctagctagctaggattaaccttttgagtaactagggtttatctttattgtaaactcttgtcttttttttcaattctgattttgtgtgatttagaagtagttccggcactagttggtgggaagttagtttgcatctaatacacaagctactttctcactaaactttctttttaaaagaagttttgaaattaatgcatggatgtgttctttctgcaagtaaattcaaactcagttaact

SEQ ID NO: 8270 - DNA, 2321 bp, Manihot esculenta
gggttcgtgggtaactgaaatatgccagccggagtaatgattccggcaagaaacatgccgtcgatgattgggactaatgggagtgttggtgggttcggatcaacttcagggctttcacttggtcagccaaacatgatggacagtcagcttcaccatctggatatgactcaaaacacctccgaaagcgatttagttcgactcagagatgaagaatttgacagtactaatactaaatccggcagcgacaaccatgaaggtgcatccggcgacgatcaagatccacgccccaaaaagaagcgatatcaccgccatactcagcatcagatccaagaaatggaagctttcttcaaagagtgtccacacccagatgacaagcaaaggaaggagctaagccgtgaattagggttggagccattgcaggtcaagttctggttccagaacaaacgtacccaaatgaagacccaacatgagcgccatgaaaatacacagcttcgaactgagaacgaaaagcttagggctgataatatgaggtatagagaagctcttagcaatgcttcgtgtcccaattgtggaggtcctactgctattggtgagatgtcctttgatgaacatcatttgaggctagaaaacaccagattaagagaagagattgatagaatttcagccattgctgctaagtatgttggaaagcctgtggtgaactatcctcttttatcatctccaatggctccacgacctctcgaacttggggttgggaatttcggagcacagccaggaattggaggggacatttatggagctggagacttgcttaggtcaataggtggacatagtgatgctgataagcccatgataatagagcttgcagttgcagccatggaggaacttatcagaatggcacagatgggtgagccattatggatgagcagccttgatggaacaaatgctgtactaaatgaagatgaatacattaggatcttccctagaggaattggaccaaaaccttctggttttaaatgcgaggcttcaagagaaactgctgtggttatcatgaatcacatcaacctggttgagtatctcatggatgtgaatcaatggtctactgtgttttctggcattgtttcaagagccatgactttggaagtactatctacaggagtagcaggaaactacaatggagccttgcaagtgatgacggctgaatttcaactgcctactccacttgttcctactcgagagagctactttgtaaggtactgtaaacaacatgcagaagggacttgggctgtggttgatgtttccttggacaacttaagacctagtccggcagcaagatgccggagaaggccatccggatgcctgattcaagaaatgcctaatgggtactcaaaggttacatgggttgaacatattgaagtggatgatagaggtgttcataatctatacaagcaactagttagctcaggccatgcctttggagcaaaacgttgggttgctaccctggataggcaatgtgaacggctagcaagtgccatggcaactaacattccaactggcgatgttggagtaataacaaatcaagaagggagaaagagcatgctgaagctggcagaaagaatggtaataagcttctttgctggagtgagtgcatctactgctcatacatggacgacattgtctggaactggggctgatgatgtgagagtcatgacaagaaagagcgtagatgatcctggtaggcctcctgggattgtgcttagtgctgcaacttccttctggcttcctgttccacctaaaagggtttttgattttctccgtgatgagaattctcgaagtgagtgggatattctatcaaatggaggagttgtccaagaaatggcacatattgctaatggaagagatactggcaattgtgtgtcccttcttcgagtaaatgtaagtgacacacagagtgcaaattctagccagagcaacatgctgattttacaagagagttgcactgacccaacagcctctttcgtcatctatgcaccagttgatattgttgccatgaatgtagtacttaatggtggagacccagattatgtggctctccttccttcaggatttgctattcttcctgatggaaccaccacacatggaggaggaatcggcgaatcgggttctggtggatctcttctaacagttgcttttcaaattttagttgattcagttcctacagccaaactttctcttggatcggttgcaactgtgaacaatttgatcgcttgcactgttgagaggattaaggcagctttatcttgcgagaccgcatgaactac

SEQ ID NO: 8271 - DNA, 3491 bp, Citrus clementina
atttcctccattgatactttcttcatcatcttcttcttcttcttcttcttcttcttcacttttcctgttccttttctcactttttttttttctcttttcactctctatttctctaaccttttaccctaatttctctaaaaaaccacataagctagcacttcccataaaagctcaatcatcaaacccaccacaaaaaccaatttaaaacccttaacgcagtagctttacaagcaacaaagatagagctaaagtcagtagtataaggaaaggaaacgccggttttgtgatagacagagaaagcatagttggattctccgtgatcttcgttctcccccaaaaccaaggacacactgagtagctagactgaaaacatgccaaccggagtaatgattccggcaagaaacatgccgtcgacgatcggtcgtaacgggaatgttggtggacttggatcatcctcaggactcaccctcagtcagccaacaaacatgatggaagggcagcttcatcctctagacatgacccaaaacacatctgaaagcgaaatggcacgtttaagagaagaagaattcgacagtactaaatctggaagcgaaaatcatgaaggcgcttcaggtgatgaccaagaacagcgtcctaataagaagaagcgatatcaccgccacactcagcaccagatccaagaaatggaagctttcttcaaagagtgtccacacccagatgacaagcaaaggaaagagttgagccgtgaattagggttagagcctttgcaagtcaaattctggttccaaaacaagcgcactcaaatgaagacccaacatgagcgccatgagaacacacagcttcgaaccgagaatgaaaagcttagggctgacaatatgaggtacagagaagctcttagcaatgcctcatgtcccaattgtggaggccctactgctataggagagatgtcttttgatgaacatcacttgagacttgaaaatgctcgattaagagaagagattgatcgcatctcagcaattgcggcaaagtatgttggcaagcctgtggttaactacccgcttctctctccaccggtaccttctcgtccccttgaactagctgttggtaattttggtgctcagccaggcattggaggcggtgagatgtatggagctgctgatcttcttaggtcaatcagtgccccgactgaggctgataaacctatgataattgagctcgcagttgcagccatggaagaacttatcagaatggctcagatgggtgaacctctatggatgactagccttgatggcacggcggctgtactaaacgaagatgaatacgttaggacttttcctcggggaatcggacctaaaccaactggattcaaatgcgaggcttctcgagaaactgccgttgttatcatgaaccacattagccttgttgaaattctaatggatgtgaatcagtggtcaactgtgttttctggcattgtttctagagctatgactctagaggtattatcaacaggcgttgcagggaattacaatggagccttacaagtgatgactgcagaatttcaagtcccttcgccactagttccaactcgtgagagttactatgtgagatactgtaagcaacatggagaaggaacttgggctgtagttgatgtctccttggacaacttacgccccagtcctgcagttagatgccggagaaggccatcaggatgtttaatccaagaaatgcccaatggatactccaaggttacatgggttgagcatgttgaggttgatgataggggtgtacataatctatacaagcagctagttagcactggcaatgcatttggggcaaaacgctgggttgctaccctagatcgacaatgtgaaagacttgcaagtgtcatggcaaccaatattccaactggagaagttggtgtgataacaaatcaagatgggaggaagagtatgctgaagctcgctgaaagaatggtaataagcttttgcgctggagtgagtgcttcaactgctcatacgtggacgacattatctggaactggagctgatgatgtaagagtcatgactagaaagagcgtagatgacccaggcagacctcctggcattgtactaagtgctgcaacctccttctggcttcctgttccaccaaaacgagtttttgattttcttcgtgatgagaacaccagaagtgagtgggatattctgtcaaatggcggagttgtccaagaaatggcacacattgcaaacggccgggatacaggaaattgtgtgtctttactaagagtgaacagtgccaattcaagccagagcaacatgctgattttacaagagagctgcactgatccaacggcctcttttgttatctatgctcctgttgatattgttgccatgaatgtcgttcttaacgggggagaccccgattatgttgcccttctaccctctggatttgccatacttcctgatggaacttcattgcacggggccaacattggtgaggctgcttccggtggatctctactaactgttgcatttcagattttggtagattcagttcctacagcaaagctgtcgcttggttctgttgctactgttaacaacttgattgcttgcactgttgagaggataaaggcttctctgtcatgcgagtctgcatgaccccttaaagcttcaattttagaaagatcaacagaagaaggaaaaaagaaggaaaacaacatcaagaaacaacaaaagtgatgggaaatatcggcttatagatgatggggttaaagtcaagagcgcaccttacatgaccctcttttgtttatggtgctggatgtggtgcttctttaagaaaagtgaaacatcctagggcatattcaaagtatgtgaggattagaggttcgggtattgactttcccaaacatgagtaaaattaagcaaatgaattataaagaccttgttaactttgtggctagggttttaattatttaggtttttgtgttaagtgcggtttagttccttattttatgttcttttttccttctttttttttttgttattttgtgtgttttcgaagctctagtgggtgtgcaagggctcactcctactagcagacattggcttcctttttcccaatttcagagcttttgaaatggactgccttctttttttgcctgcttattttcgctttctttgttaacatattagtatgagtttccttttacatcatttattgaccttattcttcaaatgggatttaatatggtgacggggaccaactctggtcagtaatccaaagtatttcaaaaaaaattaaaaacaactcaaaattggcccgaatcgtgaattaaattggccctaataaatttcatgtttttacgaacaactcaaaattttgacttggctccttacaggacacggccttcattccttttacttttggatcgtatttagaagtagatggaagaataatcaagaatcaagataaagtagacggtgccttcatttacc

SEQ ID NO: 8272 - DNA, 3490 bp, Citrus sinensis
atttcctccattgataatttcttcatcttcttcttcttcttcttcttcttcttcttcactcttcctgttccttttctcactttttttttttctcttttcactctctatttctctaaccttttaccctaatttctctaaaaaaccacataagctagcacttcccataaaagctcaatcatcaaacccaccacaaaaaccaatttaaaacccttaacgcagtagctttacaagcaacgaagatagagctaaagtcagtagtataaggaaaggaaacgccggttttgtgatagacagagaaagcatagttggattctccgtgatcttcgttctcccccaaaaccaaggacacactgagtagctagactgaaaacatgccaaccggagtaatgattccggcaagaaacatgccgtcgacgatcggtcgtaacgggaatgttggtggacttggatcatcctcaggactcaccctcagtcagccaacaaacatgatggaagggcagcttcatcctctagacatgacccaaaacacatctgaaagcgaaattgcacgtttaagagaagaagaattcgacagtactaaatctggaagcgaaaatcatgaaggcgcttcaggtgatgaccaagaacagcgtcctaataagaagaagcgatatcaccgccacactcagcaccagatccaagaaatggaagctttcttcaaagagtgtccacacccagatgacaagcaaaggaaagagttgagccgtgaattagggttagagcctttgcaagtcaaattctggttccaaaacaagcgcactcaaatgaagacccaacatgagcgccatgagaacacacagcttcgaaccgagaatgaaaagcttagggctgacaatatgaggtacagagaagctcttagcaatgcctcatgtcccaattgtggaggccctactgctataggagagatgtcttttgatgaacatcacttgagacttgaaaatgctcgattaagagaagagattgatcgcatctcagcaattgcggcaaagtatgttggcaagcctgtggttaactacccgcttctctctccaccggtaccttctcgtccccttgaactagctgttggtaattttggtgctcagccaggcattggaggcggtgagatgtatggagctgctgatcttcttaggtcaatcagtgccccgactgaggctgataaacctatgataattgagctcgcagttgcagccatggaagaacttatcagaatggctcagatgggtgaacctctatggatgactagccttgatggcacggcggctgtactaaacgaagatgaatacgttaggacttttcctcggggaatcggacctaaaccaactggattcaaatgcgaggcttctcgagaaactgccgttgttatcatgaaccacattagccttgttgaaattctaatggatgtgaatcagtggtcaactgtgttttctggcattgtttctagagctatgactctagaggtattatcaacaggcgttgcagggaattacaatggagccttacaagtgatgactgcagaatttcaagtcccttcgccactagttccaactcgtgagagttactatgtgagatactgtaagcaacatggagaaggaacttgggctgtagttgatgtctccttggacaacttacgccccagtcctgcagttagatgccggagaaggccatcaggatgtttaatccaagaaatgcccaatggatattccaaggttacatgggttgagcatgttgaggttgatgataggggtgtacataatctatacaagcagctagttagcactggcaatgcatttggggcaaaacgctgggttgctaccctagatcgacaatgtgaaagacttgcaagtgtcatggcaaccaatattccaactggagaagttggtgtgataacaaatcaagatgggaggaagagtatgctgaagctcgctgaaagaatggtaataagcttttgcgctggagtgagtgcttcaactgctcatacgtggacgacattatctggaactggagctgatgatgtaagagtcatgactagaaagagcgtagatgacccaggcagacctcctggcattgtactaagtgctgcaacctccttctggcttcctgttccaccaaaacgagtttttgattttcttcgtgatgagaacaccagaagtgagtgggatattctgtcaaatggcggagttgtccaagaaatggcacacattgcaaacggccgggatacaggaaattgtgtgtctttactaagagtgaacagtgccaattcaagccagagcaacatgctgattttacaagagagctgcactgatccaacggcctcttttgttatctatgctcctgttgatattgttgccatgaatgtcgttcttaacgggggagaccccgattatgttgcccttctaccctctggatttgccatacttcctgatggaacttcattgcacggggccaacattggtgaggctgcttccggtggatctctactaactgttgcatttcagattttggtagattcagttcctacagcaaagctgtcgcttggttctgttgctactgttaacaacttgattgcttgcactgttgagaggataaaggcttctctgtcatgcgagtctgcatgaccccttaaagcttcaattttagaaagatcaacagaagaaggaaaaaagaaggaaaacaacatcaagaaacaacaaaagtgatgggaaatatcggcttatagatgatgggggtaaagtcaagagcgcaccttacatgaccctcttttgtttatggtgctggatgtggtgcttctttaagaaaagtgaaacatcctagggcatattcaaagtatgtgaggattagaggttcgggtattgactttcccaaacatgagtaaaattaagcaaatgaattataaagaccttgttaactttgtggctaggattttaattatttaggtttttgtgttaagtgcggtttagttccttattttatgttcttttttccttctttttttgttgttattttgtgtgttttcgaagctctagtgggtgtgcaagggctcactcctactagcagacattggcttcctttttcccaatttcagagcttttgaaatggactgccttctttttttgcctgcttattttcgctttctttgttaacatattagtatgagtttccttttacatcatttattgaccttattcttcaaatgggatttaatatggtgacggggaccaactctggtcagtaatccaaagtatttcaaaaaaaattaaaaacaactcaaaattggcccgaatcgtgaattaaattggccctaataaatttcatgtttttacgaacaactcaaaattttgacttggctccttacaggacacggccttcattccttttacttttggatcgtatttagaagtagatggaagaataatcaagaatcaagataaagtagacggtgccttcatttacc

SEQ ID NO: 8273 - DNA, 3720 bp, Theobroma cacao
tatcctccttcctttctctccctctcccctctctcttccccttctctatcttcttcttcttcttcttctgcttctcccctcgcccccccaccccctcctcccttttttcttcttctttatatatatgtcactttcttgcttgaccctatctctttttgcacctcaaactcctacttcttaccagtaaagctcaaaccaaaaccgcctgctatacctctttcgaagcactcactggcgatttaccggcaacagagtttttttaggcctaaacagatccaaaccgctcctccttcctgtggcttttctagggttcttctttattaggcaaagctaaagagggaaaggaaagaagttaggtttcgagacagacaaggaaggcataactggattctccgtgatcttcgttgggacgttattttaaatatttgtttttatttaggcgttttagcttgatttttgtctgtcaaggaccgtatcaaatttgtcaacacataacttttttttctagattctctctcgcttgtacattggcacgtaagaatcagatattcttgagggataattaaatataaaccgaaggagagagacaatcttttcagctgcccaaaaaaaaccagagtcagctttgtctctcactgttagagaatctagggaaaacatatcagtctctaaagggtattctcaactcaaatcgaaggacactgaagtagtggtgaagaaggcaaaagctatatctgtatatgaacaaatattgcttagggcttttgggattctgaaatatgccagccggagtaatgattccggcaagaaacatgccgtcgatgattagtgggaacgggaatgttggtggttttggaacatcatcaggactcacccttggtcagcctaacatgatggaaggtcaactccaccctctcgagatgacccaaaacacatccgaaagcgagattgctcgaatgagagacgaggaattcgacagtacaaccaaatccggtagcgagaaccatgaaggtgcctctggggatgatcaagaccctcgtcccaaaaagaagcgctaccatcgccatacccagcatcagatccacgaaatggaggcatttttcaaagagtgtccgcacccagatgacaagcaaaggaaagaacttgggcgtgagttagggttagagccattgcaagtgaaattttggttccaaaacaagcgcacccaaatgaagacccagcatgagcgccaagagaacacacagcttcgtaccgagaacgaaaagctaagggctgacaacatgaggttcagggaagctctgagcactgcctcatgcccaaattgtggaggtccaactgctgtaggacaaatgtccttcgatgaacaccatctcagacttgaaaatgctcgattaagagaagagattgatcgcatatcagcaatagctgcaaagtatgttggcaagccagtggtgaactatcctcttctttcgtctcctatgcctcctcgaccacttgatttcggtgcacaacctggaactggggagatgtacggtgctggggatcttcttaggtcgatcagtgcgcctagtgaggctgataagcccatgattattgagcttgcggttgcggctatggaggaactaatcagaatggctcagatgggtgaacctttatggatgaccagccttgatggcacaacctcgatgctgaatgaggaagagtacattaggacgtttcctagaggaattgggccaaaacctactggcttcaaatgcgaagcttcaagagaaactgctgttgttatcatgaaccacattaaccttgtcgagattctcatggatgtgcaccaatggtcaactgtgttctcgggaatagtttcgaaggcttcgactttggatgtcttgtcaacaggggtagcagggaattataatggagccctgcaagtgatgacagctgaatttcaagttccttcacctcttgttccaactcgtgagagttattacgtaagatattgcaaacagcatgcagagggaacttgggctgtggttgatgtttccttggataacttacgccctagtccaacagtgagatgccgaagaaggccatcggggtgcttaattcaagaaatgcccaatgggtactcaaaggttacatgggttgagcatgtagaagttgatgatagaggtgttcacaatctgtacaagcagctggtaagctccggccatgctttcggagcaaaacgttggattgctactttagatcgacagtgtgagaggcttgcaagtgttatggctactaacattcccactggtgatgttggggtcataacaaatcaagatgggagaaagagtatgctgaagctagctgagcggatggtaataagtttctgcgcaggagtgagtgcctctactgctcacacatggactacattatcaggaactggggctgatgatgttagggtcatgactagaaagagtgttgatgatccaggcagacctcctggcattgtgctaagcgctgcaacttccttctggcttcctgtttcacccaagagggtatttgatttcctccgagatgagaattctcgaagtgagtgggatattctttctaatggtggagttgtccaagaaatggcacacattgctaatggtcgggatacaggcaattgtgtttcactacttcgggtaaatagtgcaaattcaagccagagcaacatgctgattttacaagagagttgcgctgatccaacagcctctttcgtaatctatgctcctgtcgatattgttgcaatgaatgtagtgctaaatggaggggatccggactacgtggcccttcttccctcaggctttgctattctgcccgatggaactacagcaagtgcaggtggcattggtgatgccggctctgctggttctcttctgactgttgcatttcagattttggtcgactctgttcctactgcaaaactttctcttggatcggttgcaacagttaacaatttgattgcatgcactgttgaaaggataaaggcttcactgtcatgcgagaatgcatgatctgccatagccttaaattgtagctagctagcgattaacagaagaaggaaagaagggaaggtaactaaatgtaagaacaatggtgttgacgaattttggaattatagaagatggggagaagtcaagagcgcacctagcatgatcctctttgacatggtgaccttttgtttggggggcatgaagaaagtgaccttaagcaaattcatcaagtgttccaagagttagaggttcgggaattgacttccccaaggaagaaaaactaaaaacaaaaccaaaagtgaatgcaaagaactttatagagtgtccgtattataaaaggagtttgacttttatgctcagtagggtttttagagtcttgtataagtaatgggattttagttcccctttttccttctgccctttgtttgtttgtgtttcttaagcactaatgggtgaaaagctctcacaccttctagcagacaattcctttttttattgttttttctttccatttgaagagctttttgaaatggatattgctgttgtcattcctgctctcttttgggttccttttattgtaactagctagtccattgccttattacattgtctgttgttcatttttggcaaatattcatgatgccttgagccacatcaaactcaatgaattcactcctggtattgcaaatggattgcaaaaaat

SEQ ID NO: 8274 - DNA, 3917 bp, Ricinus communis
cttcttcctctttggttcttcatcttcttcgtttttcttttttggtttacctcttactctctatacctacttcttaccataaaagttcttgccaaagctgccctggaacccacctcaagatcccccgaaaactgctctcggattcacaagaaagatagacatatagagagagctaaagggagaaaggagacagtgaagacaaagttggatttttggtgatcttagctgggcgttacaactatatatttatatagatatttttctatttgcttttggggggcttagccagaattttatctttgtcaactctatctttcttgtattatattctgtctctcttacattggtacgtgagaacaaagatatatagagtccagagagagagactcatttcagcggcaaaacagaaaaaccaaagtcagcccttgccagagaatctatatatgaaaaccctactttctctctctaatctctatataaagttaaaaagaaacaaactccaatccccaagacccgcttagtagagtgagagaagcagatatctagctattatctgtgtagtttcacacttcgcagcctgcttactagggttcgtgggttgcgaaatatgcctgccggagtgatgaatccggcgagaaacatgccgtcgatgattgggagtaatggaaatgttggtgggtttggatcctcttcagggcttacccttggtcagccaaacatgctgatggagggccaacttcaccatctggacatgactcaaaacacatccgaaagcgatttagctcgaattagagatgaagaatttgacagtactaatactaagtccggcagtgataaccatgaaggtgcttccggtgatgatcaagatccacgccccaacaaaaagaagcgttaccatcgccatacgcagcatcagatccaagaaatggaagctttcttcaaagagtgtccgcacccagatgacaagcaacggaaggagctgagccgtgaattagggttagaaccattgcaagtcaaattttggttccaaaacaaacgcacccagatgaagactcagcatgagcgccatgaaaacacacagcttcgaactgagaatgaaaagcttagggccgacaatatgaggtatcgagaagctcttagcaacgcctcttgtcctaattgtggtggcccaactgctattggtgaaatgtcttttgatgaacatcatttgaggctcgaaaatgctagattaagagaagagatcgatcgtatttcagccatcgctgcaaagtatgttggcaagccagtggtgaattatcctcttctatctgctccaatgcctccccgcccgcttgaacttggtgttgggaatttcggagctcagcctggcattggaggggagatgtatggagctggagatttacttagatcgataagtgcacctagtgaggctgataaacccatgataatcgagctcgcagttgcagccatggaggaactccttagaatggctcagatgggtgaaccattatggatgagcagtcatgatggaacaaattctgcgctaaatgaagacgaatacatcaggatttttcctcggggaattggacctaaacctgctggttttaaatgcgaggcttccagagaaactgctcttgttatcatgaatcacatcaaccttgttgagtatctcatggatgtgaaccaatggtcgactgtgttttccgggattgtctcaagagcgatgacactggaagtattatcaacaggagtagcagggaactacaatggagccctgcaagtgatgacggctgaattccaacttcctactccacttgttccaactagggagagttactttgtaaggtactgtaagcaacatgccgaagggacttgggcagttgttgatgtttccttggacaatttacgccctagtccggctgcaagatgtcgaagaaggccatctggatgcttaattcaagaaatgcctaatggatactcgcaggtgacgtggattgaacatgtggaagtggatgatagaggtgttcatagcctatacaagcagctagttagctcaggccatgcttttggggcaaaacgttgggtagctaccttagacaggcaatgcgagcgccttgcaagtgccatggcaactaacattcccactggtgaagttggtgtgataacaaatcaagaagggaggaagagtatgttgaagctggcggagagaatggtgataagcttttgtgctggagtgagtgcatccactgcgcatacatggacaacactatcaggaactggggctgatgatgtaagggtgatgacacgaaaaagtgtggatgatcctgggagacccccagggattgtgcttagtgctgcaacttccttctggcttccagttccaccaaaaagggtttttgattttcttcgtgacgagaactctcgaaatcagtgggatattctatcgaatggcggggttgtccaagaaatggcacacattgctaatggcagggatacaggaaactgtgtgtctcttcttcgagtaaatagtgcgaattcgagccagagcaacatgctgattttgcaagagagttgcacagatccaacagcctcttttgtcatctatgcgcctgttgacatcgtcgcgatgaatgtggttcttaatggtggggatccagattatgtagctcttctcccctcaggatttgccattcttcctgatgggaccactgcgcatggtggaggcattggtggtgaatccgtgtcagcaggtggatctcttctgactgttgcttttcagatactggtcgattcagttcctacagcgaaactatctcttggctcggttgcaactgtcaacaatttgatcgcttgtactgttgagaggattaaggctgctttgtcgtgcgagaatgcctgagctccaaattgttttatattcatacagttcttaactgaagaaggaaacaaagagaggaaatgagaaacaaaaagatgtgaagattatatatatagaaaagatggagagagaagtcaagagcgcacctcagatgatcattttgcactaagggatggtttttgtttagggttagagggaaacagactaagcatttcatcactagcgttgaaatgaattagaggttcgggtattgacttctccatatgaaaaaaagaatcctaagttataattagaccttattgtacaaggttgagctatctatccccttttcttccaacttaacaatgtagtttagagaggcagctactgggttttcctttgctttcctttttgctttgtgcaagtagctaattaaattctgtcctctttatttccttcttcaagttgtagtgtgtgttctctgaagcatcagtaagtggaaaagaagctcacatttactgataaaacatttgctcccccccacccccccccccccccccccccccccccccccccccccccccccccccccccccccccccccccccccccccccccccccccccccccccccccccccccccccccccccccccccccccccccccccccccccccccccccccccccccccccccccccccctcttttttcccatcttaagagctttaaaaaatagactacttttcttacttgtcttgttagtttctggagtctttcttttagtattttgccttgtccagttctaggtatgtttctttacagttattctaagcaatttgttggggattagtagttggtgataatggcagctgttttgccttcatattcttctgctggagcaagccttcaactgccctaaaatgaaattgctctgttcactagaaattcttatatatacttggcaactacatcatctctaaataaaatcaattacatgttgttctttattaaatattaatttatttatcattattaattatcataattaaaaaccaac

SEQ ID NO: 8275 - DNA, 2807 bp, Cajanus cajan
tatgccaaccggaattatgattccggcgagaaacatgccctcgttgatacaaaggaacaacaacgttggtgggtttggatcatcttcaccttttagtattcttacccagattgaaaaaccataaggctccggaaaccttaaagatctgcagcaatgttccagtcgaacctgatggaggcgttggagatgggtcagaacacttctgagagtgaggttcctcgaatccgtgaagatgagttcgacagtgccaccaagtctggtagtgaaaaccatgaaggtgcttctggtgaagaccaagaccctcgtcccaacaaaaagaaacgttaccaccgccacacccagcaccagatccaggaaatggaagcttttttcaaggagtgtcctcacccagacgacaagcaaaggaaggagctgagcagggagttagggttagagccattgcaggttaagttttggtttcagaacaagcgtactcagatgaagacacaacacgagcggcatgagaatacacagcttagaaccgaaaacgagaagcttcgagcagataacatgaggtatagggaggctctcagcaatgcttcgtgtcctaattgtggtggaccaaccgctataggagaaatgtcattcgatgaacatcacctaaggcttgaaaatgcacggctaagagaagagatcgataggatttcagcaattgctgcaaagtatgtagggaagcctgtggtgaactattcaaatatttctccttctcttcctcctcgtccactagaacttggggttggtgctggttttggaggccaaccagggattggtgtggacatttatggtgctggtgaccttcttaggtcaattagtggacccaccgaagctgataaaccaataatcatagagctagccgttgcagctatggaagagctcattgggatggcacaaatgggtgagcctctttggctaactacccttgatggcacttccactatgctaaatgaggatgagtacatcaggtccttccctcgaggaattggccctaaaccctctggcttcaaatgtgaagcttctagagaaaccgctgttgttatcatgaaccatgtcaacctcgttgagattctcatggatgtgaaccaatggtccacagtgttctctggtatagtctcaagagccatgaccctggaggttctatcaacaggggtggccgggaactacaatggtgccttacaagtgatgacatcagaactacaactacctacacctcttgtgccaactcgtgagagttattttgtaaggtattgtaagcagcatgctgatgggacttgggcagttgtggatgtgtcgttggataatttgcgccctagtccttcagccagatgtagaagaaggccttctggttgcttaattcaagaaatgccaaatggctattcaaaggtcacatggattgagcacgtggaagtggatgacaggggtgttcataatctttacaaacagcttgttagctctggacatgcatttggagcaaaacgttgggttgcaaccttagatcgacaatgtgaaaggcttgctagtgctatggcaacaaacattcccaccgtagatgtcggagtgataacaaaccaagaagggagaaagagcatgatgaagctagctgaaagaatggttataagcttttgtgccggtgtgagtgcttccactgctcacacatggacaacactctctggaacaggagctgatgatgtaagggtgatgaccagaaagagtgtagatgaccctggaagacctcccggcatagttctcagtgcagccacttctttttggcttccagttccacccaaacgagtctttgactttctccgtgacgaaaactctaggaatgagtgggacattctttccaatggtggagttgttcaagaaatggcacacatagcaaatggaagagatactggaaactgtgtctctctactacgagtaaatagtgcgaattcaagccagagcaacatgttgatattgcaagagagttgcaccgatacaaccggttcttttgtcatttatgcaccggtggatattgttgccatgaatgtggttctaaatggaggagatccagattatgttgctcttcttccttcagggtttgctattctgccagatgggacaacaacgcatggtagtggtattggtgaatctggacctggtggatctcttcttactgttgcctttcaaatattggttgattcggttcctactgctaagctttctcttggatctgttgctactgtcaacaatctcattgcatgcactgttgagagaatcaaggcttccttgtccggtgaaggtgcttaagcttcaagactttggattcagtgtgtttgaaagaagggatgaaaggttgtggagattaaatgaaaaggtggtgaggatcttcgggttacattacaaagattagggagaagtcaagagcgcaccttgcatgatcccttctcagcacttaccccaaaagagttgtgagaggattaaggttcgggaattgacttccctagatacaatagtaaacgttgagagcgattaattattatgaccttgctaccctttaccatttccgagactacataactagctagctaggattaaccttttcagtaactagggtttaacttttgatgtaaactcttgtcttctttttcaattcttattttgtgtgatttaattagaagtagtagtagtagcatgctccggcactagttggtgggaagtttgcatcaatacaccaccaccaccttttttaaaggttaatttgaaattgatgtgttcctttatgcgat

SEQ ID NO: 8276 - DNA, 3668 bp, Cicer arietinum
tgcgccatctactctacccaaagccaaaagttacactaaacaaatctctctctctctctctctctcatagtctctctcatcaatgcatactagcaattactacacaccactttcgcccaccattaaatgcaattgcaccatctcaatacgctcagcaataactcatcactgccccatttttctccacatcctctttcttcttcttcttcttcttcttcttccctttctttcttccttcttcaattccttagtcctctcaccttcttcacttccttcatctttttttttcccttccctttaaacaacctttaataatttttttaagctagaccatatagctacccaacttaatttccataactgcctcaaaaccttctttttcatattcatctttgaaaaaggttcctttcctttttacttgctttttagtaccaccatagtagatctacatttttatagcttctctctaacaactaccttccctcttcgtgacacattagcatcgttgagacagcgtcaaatctgacagaatctaagaaagaattcatcttcagaagcccttttcatcgtgtatattttaaggatctaaaaaatccacaaacaaaagaaaaaagaataatttttggttaatgcttttggattgtgaaatatgccagctggtttaatgattccagcaagaaacatgccttcaatgatcggaacaaacaacgttggtagtttcggattttcttcatctctttctcttagccagattgaaaacaataagccttcggaatcttaaagatctgtagaaatgttccagccaaacctaatggaagctggacatcatcatcaacatcaacttctaccacttgacatgcctcaaaacacttcagaaagtgatgttcctagaatccgtgaagatgaattgtttgatagtgctacaaaatctggcagtgaaaatcaagaaggtggtggtgcttcaggtgaagaccaagaacctcgtgctaaaaagaaacgttaccaccgccatactcaacatcagatccaagaaatggaagctttctttaaggagtgtccacaccctgatgacaagcaaaggaaggaactaagcagagagttagggttagagccattacaagtgaagttttggtttcaaaacaaacgtactcaaatgaagactcaacaagagaggcatgagaacacacaactaagaactgagaatgagaagcttcgtgctgataacatgagatttagagaagctcttagcaatacttcttgtcctaattgtggtggaccaactgctattggagaaatgtcttttgatgaacatcacttgaggcttgaaaatgctcgcctaagagaagagattgataggatatcaggcatagctgcaaagtacgtaggtaagccagtagtaagctatccactactttcgccttcatctgtacctcctcgtcctctagaactcggaatgggtggtttcggagggcaagcaggcgtaggtggagacatgtatggaggtggagatcttcttagatcaatcagtggaccaactgaagctgataaaccaatgataatagagctagctgttgctgctatggaggaactcattggaatggcacaaatgggagatcctctttggttgactacacttgaaggcggtttgatacttaatgaggaggaatatgttaggtcttttcctcgaggaattggtcccaaacctgctggtttcaagaatgaagcttcaagagaaacttctcttgtcatcatgaatcatgttaaccttgttgagattctcatggatgtgaatcaatggtccacagtattttctggtattgtttcaagagcaatgacattggaagtgctatcaactggtgtggcaggaaattacaatggagcattacaagtgatgacagcagaactacaagtaccatcaccacttgtgccaacaagagagagttattttgtaaggtattgtaagcaacatggtgatggaacatgggcagtagtggatgtttctttggacaatttgcgtcctagtccttctgccagatgtagaagaaggccttctggttgcttaattcaagaaatgcccaatggttactcaaaggttatatgggttgagcatgtagaagtggatgatagaggtgttcataatctatacaagcagcttgttagctctggacatgcatttggtgctaaacgttggattgcaaccttagatcgacaatgtgaaagacttgctagtgccatggcaacaaacatccccaccgttgatgtcggcgtgataacaaaccaagatgggagaaagagtatgttgaaactagccgaaagaatgtgtataagcttttgtgctggagtgagtgcttctacagctcacacgtggacaacactgtcgggtactggagctgatgatgtaagggtcatgacccgtaaaagtgttgatgacccaggaaggccagctggcattgttcttagtgctgccacttctttttggcttccagttccacctaaaagagtctttgaatttctccgagatgaaaactcaagaagtgagtgggatatcctttccaacggtggagttgtccaagagatggcacatattgctaatggacgagacactggaaattgtgtctccctacttcgagtgaatagtgcaaattcaagccaaagcaacatgttgatattacaagagagttgtacggacacaacagggtcatttgttatatatgctccagtagacatagttgcaatgaatgtggttctaaatggaggggatccagattatgtggcacttcttccttcaggttttgctatacttccagatggaacaacaacaacaacaacaaatggaagtgctgaaagtggccatggtggtggatctcttttgactgttgcatttcaaatattggttgattctgttccaactgcaaaactttcacttggatctgttgctactgttaataatcttattgcttgtactgttgagaggattaaggcttctttgtctggtgaagttgcttgaccatcaactctaatggaacatgcatatgttaaggaggttaaaaggggattcattgcaatttggataacgaggaggtgtagggaacttaggcttatataaaaaaatggggagaagtcaagagcgcaccttgcaacattccttctcgacacatcaacatagtattgagaggattaaggttcgggaattgacttcgctatataaaatagtaaaagctaagagctaaaattaaaatttcttactctcgtcaaaataaaatattaacaaaaattgtatttaaaaagttaatgtatccgatctgaaatttagatcagataaaataatttttcaaatactttttaatttatattttattttgaagggagtaattgtcttcaccttctaagactacatatctataattagtgatatcattttgattatgattaagttgtagctttgatgtaacatctaatgttccttccattgttattttgtgctttagatcgatcatgcactagcatgcacaatggtgaatttatccttttttaacgttttgaaatggatgttgcattccattttgcttagtctatttcagtaacttagatctcttgatttcttattaattttgtgtttgttatttatgatataaatgttagaaaaaggctaagtggtttaatgtgtc

SEQ ID NO: 8277 - DNA, 3537 bp, Glycine max
caagataccagcacttagtagcaatttagtagcatttgtttggtagccgtcattcgttgcattgcaccgtcaactcgcaaaaaatttattagtagttttatacaccaaaaatatgctgcgtctctttctctctcccctctctatcaattacacctcttttgccctccattaaatgcaattgcaccctctcaatacgctctgcaattactcttcgctgccacattttcctccatttgttccccacttccctctcctccttcaatgcccttgtccctatctcttcttcttctcctcactttctctctgtaacacctcttcatgccatagcttctttttcttttcttttttaccatataagtaaacattttttttttcaaaactgtcccaaacccttccttcaaaacggtcatctcttttcaacccaaaacagatctacaccttcatcttctactcccactctcactgaaaatccaagggctcaacttcttaagctttttctctatccaagaacctcttaggagagagaaagtgatatatatagagagagaaagagtcaattctacatatacttgttggtggtggtttttgaggcatgtgaagtatgcaagccgttattatgatgattccggcgagaaacatgccttcgatgatagcaaggaacaacaacaacgttggagggttttttggatcatcttcatcacctttcactcttgcccagattgagaaactataatcctctctccggaaccttaaaagatccgtagcaataatcataatgttccagccgaacctgatggacgcgttggagatgggtcagaacactcccgagagtgagattcctcgaatccgtgaggatgagttcgacagtgccaccaagtccggtagtgaaaaccatgaaggtgcctccggtgaagaccaagaccctcgtcccaacaaaaagaaacgttaccaccgccacacccaacaccagatccaagaaatggaagcttttttcaaggagtgtccgcacccagatgataagcaaaggaaggaactgagcagggaattagggttagagccattgcaggttaagttttggtttcagaacaagcgtactcagatgaagacacaacacgagcggcacgagaatacaaatcttagaaccgaaaacgagaagcttcgagcagataacatgaggtatagggaggcacttagcaatgcttcgtgtcccaattgtggtggaccaactgctataggagaaatgtcattcgatgaacatcacttgagacttgaaaacgcaaggctaagagaagagattgatcggatttcagcaattgctgcaaagtatgtagggaagcctgtggtgaattattcaaatatttctccttctctccctcctcgtccattagaaattggtgttggtggtgctggttttggaggccaaccagggattggtgtggacatgtatggagctggggatcttcttaggtcaatcagtggacccactgaagctgataagccaataatcatagagctagctgttgcagctatggaggagcttattggaatggcacaaatgggtgagcctctttggttaactacacttgatggcacatccactatgctcaatgaggatgagtacattaggtcttttcctcgaggtattggtccaaaacctagtggcttcaaatgtgaagcttcaagagaaactgctgttgttatcatgaaccatgtcaacctcgttgagattctcatggatgtgaaccaatggtccacagtgttctctggtatagtctcaagagccatgactctagaagtgttatcaacaggggttgccgggaactacaatggtgccttacaagtgatgacagcagaactacaactacctacaccacttgtgccaactcgtgagagttattttgtaaggtattgtaagcaacatggagatgggacttgggctgttgtggatgtttctttggataatttgcgcccaagtccttcagccagatgtagaagaaggccttctggctgcctaattcaagaaatgccaaatggctattcaaaggtcacatgggttgagcatgtggaagtggatgatagaggtgttcacaatctttacaagcagcttgttagctccggacatgcatttggtgcaaaacgtttggtagcaaccttagatcgacaatgtgaaagactcgctagtgccatggcaacaaacattcccactgtagatgttggtgtgataacaaaccaagaagggagaaaaagcatgatgaagctggctgaaagaatggtgataagcttttgtgctggagtgagtgcttccactgctcacacatggacaacactctcagggacaggtgctgatgatgtaagggttatgactcgaaagagtgtggatgaccctggaagaccccctggcattgttctcagtgctgccacttctttttggcttcctgttcctcctaaacgagtctttgacttcctccgtgacgaaaactctaggaatgagtgggatattctttccaatggtggagttgtccaagaaatggcacacattgcaaacggaagagacactggaaactgtgtatctctactacgagtaaatagtgcaaattcaagccagagcaacatgttgatattacaagagagttgcaccgattcaacaggctcttttgtaatttatgctccagtggacattgttgcgatgaatgtggttctaaacggtggagacccagattatgttgcacttcttccttcagggtttgctattctcccagatggaaccacatcgcatggaagtggtggtggcgtcattggcgaaactagccctagtagtggatctctcttaactgttgcctttcaaatattggtcgattctgttccaaccgctaagctttctcttggatctgtggccactgtcaacaatctcattgcatgcactgttgagagaatcaaggcttctttgtctggtgaacctgcttgagcttcaaggcttttggattctgcgtttacaagaaggatcaaagggacacattgtatggtggaaaatcaaaaggtggcgaggaacctcggcttatattacaaagacggggagaagtcaagagcgcaccttgcatgattccttctcagtactccaaaagagttatgagaggattaaggttcgggaattgacttccctagatatagtaaacgttaagagcacattttaagatcttgctaccctttaccatttccaagactacatatatagccagctaggattaaccttttgagtaactagggtttaacattaatgtaaaactcttgtctttttcaatttctgattttgtgtgatttagaagtagtagcactggcactagttggtgggaagtttgcatttagtacccagactaatttctcaccaaacctccttttttaaaaggttttgcaatggatttttcctttccgcgagtaagatgacacccattaattaacataattaactactaacttgttattttttactcgctacctaaatatttgatgatgaaggtggcagtgatgggttatgtgcgg

SEQ ID NO: 8278 - DNA, 3260 bp, Vitis vinifera
cttgattctctgtcttcttctccccttccttcccttttcttttctctctcttcatctctatccctagcggtcgttgctctctccataaaagctccagacctcacatcctgagaccctcttctggatccataaacactggtttctccggccacgcgatggatccggggccttgtctgctcatgggctgttttgcaatattgggaggaagagagagaaagggagattagggcatagttggattctccgagatcttcgtgggggttacattttttttttcgttttgttgaaattagtctggttttagactgtcaaaggccgtataaaaaaattgtcaaccctactcgctttctggtgggatggcacgtattaagagatagactttgagacctctttttcaaaggcaaaaaccatagtcagcactgcctgtttgttacttgtaataatcccatttgcttgctcagatagctgcagagaatctctcaaagcactgcccttaaacccactataacataagagaaagtccacttattgaggctggttagggcttctgggtgtgaaatatgccggcgggaattatgattccggcgacccatatgccgtcaatgatgggaagaaatgggaatgttgctgcttatggatcttcctcaggactcagtcttggccagccaaatatgatggacggccagcttcacccactcgacatgactcaaaacacatcggaaagtgaaatcgccaggctcagagaggatgattttgacagcaaatctggcagtgaaaaccatgaaggtgcctccggagatgaccaagatcccaaccaacgccccaagaagaagcgctaccatcgccacactcagcatcagatccaggaaatggaagctttcttcaaggagtgtccacacccagatgacaagcaaaggaaggagctgagccgtgaattagggttagagcccttgcaggtcaaattttggttccaaaacaagcgcacccagatgaagacccagcatgagcgccatgagaacacacagcttcgcagcgagaatgaaaagctccgtacagagaatttgaggtaccgggaagctctgagcaacgcttcctgtcctaattgcggaggcccgactgctataggagagatgtcatttgatgaacatcatctgagattggagaatgctaggttgagggaagagattgatcggatctcggcaattgctgcaaagtatgttggcaaaccagtagtgaactatcctcttattcctcaggttcccacccgtcccctcgatctaggggttggaaactttggggcacagccaggattaggaggcgagctgtttggagccagtgaccttcttaggtcaatcaatggaccgactgaagctgacaaaccaatgataattgagcttgcagttgcagctatggaggagctattccgaatggctcagatgggggaacccttgtggcttccaagccttgatggcacaaccaccgaactaagcgaagatgaatatatcaggtcattcccaaggggaattggaccaaaacctccaggatttaagtgtgaagcctcgcgagaaaccgctgtcgttatcatgaaccatattagcctggttgagattctcatggatgtgaaccagtggtctaccgtgttttccggcattgtttcaagagctatgaccctggaagtactatcaactggagttgcagggaactataacggagcctttcaagtgatgacagctgaattccaagtaccttcacctctagttcctactagagagagttactttgtgaggtactgtaagcagcatgctgatggaacttgggcagtggttgacgtttccttggacaatttacgtcctagtccggtggtgagatgtcgaagaaggccatctggatgtttaatacaagaaatgcctaatggatattcaaaggttacatgggttgagcatgttgaagttgatgatcgaggtgttcataatatatataagcagttagttaactctggtcttgcatttggggcgaaaagatgggtcgctactttagaccgccaatgcgagcgtcttgcaagtgccatggcaacaaacattcctacggtgataacaagtcaagaagggagaaaaagtatgttgaagctggctgaaagaatggtgataagcttttgtgctggagtgagtgcctctacagcccacacatggacgaccctatctggaagtggcgctgatgatgttagggttatgacccggaagagcgtggacgatccaggcaggcctcctgggattgtgctaagtgctgctacttcattctggcttccagttccgccaaagagagtatttgattttctccgtgatgagaattctcgcagcgagtgggatattctctcaaatggtggggttgttcaagaaatggcacatatagcgaatggtcaagacacaggcaactgtgtatctctgttacgggtaaatagtgcaaattcaagccagagcaacatgttgatattgcaagaaagctgtactgattcaacagcctctttcgtgatttatgctcctgtcgatgttgttgccatgaacatggtactgaatggaggggatccagactatgttgctcttcttccctcaggatttgcaattcttccagatggaaccacagctcatggaggagtcataggtgaagttgggtctggaggatctcttctaaccgtggcatttcagatattggttgattcggttccaacggcaaaactctctctagggtcggttgcgactgttaacaatctcatcgcttgcactgtcgacaggattaaggctgcagtctcgtgtgagaacgcatgaactgcaaagcttgaaatattgttatgaactcaagaaggagaaaaggaaagcaggtaaagaaacaaaggtgaggaggattttcagcttatagaagatggggagaagtcaagagcgcaccttactggtattgtcccaagatggaaaagacaattaccttatttcattaagaatttgcaaggattcgaggttcgggtattgacttcccaaaacaaagtacaatgagtttcatataagtcacatagttttgagcttcccctcacctttctaactttgtcaattagggttagggttagggttttaatacttcatttctgtccaaccttttttcctacttaaatctcctgttgtttgtgtgtgtgtgtttttttttaagtagtgggttgaagagctaacacccactagcagacattggcttctttttcccattttaatgctttg

SEQ ID NO: 8279 - DNA, 2314 bp, Prunus persica
ggtttgaattatgccggccgggcttatgattccggcacgaaacatgccgtcgatgattggtagcaatgggaatattagcggctttggatcatcttcaggacttactcttggtcagccaaacttgatggaagctggccatctgcacccgctggacatggcccaaaacacatcagagagcgacattgcccgaatccgagaggatgacttcgacagcgctaccaaatccggcagcgacaacccggagggcggttccggtgacgaccaagatcctcgcccgaaaaaaaagcgttaccaccgccacactcagcatcagatccaagaaatggaagctttcttcaaggagtgtccccacccagatgacaagcagaggaaggaactgagccgggaattaggtttggaaccattacaagtgaaattttggtttcaaaataagcgcacccaaatgaagactcagcacgagcgtcatgagaacacacaacttcgtaacgaaaacgaaaagcttcgtgccgataacatgaggtacagagaagccctaggcagtgcctcttgtcccaattgtggtggcccgacagctatcggagagatgtcatttgacgaacaccatctgagacttgaaaatgctcgattacgagaagagattgaccgtatatcagcaatagctgcgaagtatgtaggcaaaccagttgggaattaccctcttctgtcttcacctgttccttctcgcagtccacttgatcttggggttgggagcttcgggggtcagccgggcatggcaggagagatgtatggaggtggagaccttctgagatctatcagtggacctaatgaggcagacaaaccactgataatcgagattgcagtggcagccatggaagagctaatcagaatggctcaaatgggtgaacccttgtggatgaccagccttgatggcaacaccaccgtgttcaatgaagatgagtatatcagaacattccctcgtgttgctccaaaaccaagcaatcatttcaaatgtgaagcttcgcgcgagagcgctgtagttatcatgaaccacatcaaccttgttgagattctcatggatgtgaatcagtggtcgactgtgttttctgggattgtgtcgagagctatgactctggaagtgctgtcaactggagtggctggaaattacaatggagccttgcaagtgatgacggcagaatttcaagtaccctcaccacttgttccaactcgtgagagttattatgtgaggtactgcaaacagcatattgatggcacttgggctgtggtagatgtctccttggacactctgcgccctaatcctgcaccaaggtcatgccaaagaaggccctctggatgtctcatccaagaaatgccaaatggatactcaaaggttacatgggttgagcatgtcgatgtggatgaacgtggtgttcacaatctgtacaagcagctggttaactccggcaacgcatttggggcaaaacgatgggttgctaccttggaccgtcaatgtgaacgtcttgccagtgccctggcatcaaacatccctactggtgatgttggtgtgattacaaatcaagaaggcagaaaaagcatgttaaaattggctgaaaggatggtcataagcttctgtgctggagtaagcgcatcaaccactcacacatggacaacgctgtctgggaccggggctgatgatgttcgggtgatgacccgaaagagcgtggatgaccctggcaggcctcccggtattgtgctcagcgccgccacatctttctggcttccagttcctcccaaaagggtatttgaattcctccgtgatgagaactctcgtaatgagtgggacattctttccaatggtggaattgttcaagaaatggcacacattgctaatggtcgcgatactggaaattgcgtctctctactgcgagtaaatgtagcttgatcttattagtgcgaattcaagccagagcaacatgctgatactgcaagagagctgtacagaccaaacagcttcctttgtgatttatgctccagtggacattgttgccatgaatgtggtactaaatgggagtgaccctgactatgttgctcttcttccttctggctttgccatccttccagatggaggaggcatgggggattctggctctggtggttcccttctcactgttgcctttcagattctggttgattctgtccccaccgccaagctctctctcgggtcggtggcaacagttaacaatctgattgcttgcactgtggagaggatcaaagctgcattgtcttgcgacactgcatgaatttcatgacataactt

SEQ ID NO: 8280 - DNA, 3567 bp, Prunus mume
tctcgttctctctcatagcaattacacctttctctcccaccattaaatgcaattgcaccctctcaatacgctctgcaattactcctcgctgccatacttttctccctctgcccccctttccccttccttggccttctccctttcctgaatcacttctcttcatcttcatcttcttctccttcctcttcttcagcttcaacttccaaaacctattagtactacataccaaatacaaacctctaatacaccaaacccgtaagccggaaaaccactttttgtgtcaccaaacagtggtttcccggcaccaagttcagcccaaatccggatctaaagcctctctttctagggcttttgatcaagcgcacccaacatcatatacatacactgctaggttacgacaagcacataaggaaacttgggtgttactgttgaatactccgagatattcgtgggcgttatgtgtgttttttcatttggatttagactgatttttggtccgtcaaaagccgtataacaatcgtcaacccttatcttaatttcttcatattcgttctctctatttcttcacctacgtacaaaacaaaacaaaaaccagatagatatggctgaagagtaagtgtgagagtgtgcgaagacaaaaccccattttgtcagctccttgtctctttgtttttcacatgaaaagttcgcattagccccttgtccagatcagcctcacagaacctaaaacaagctcaaatagaacaccccctgcattggtgtgtgagaaattataacctctaaaatttttgcaaattcaggtttatatttgggcattttccagggtttgaattatgccggccgggcttatgattccggcacgaaatatgccgtcgatgattggtagcaatgggaatattagcggctttggatcatcttcaggactcactcttggtcagccaaacttgatggaagctggccatctgcacccgctggacatggccccaaacacatccgagagcgacattgcccgaatccgagaggatgacttcgacagcgctaccaaatccggcagcgacaacccggagggcggttccggtgacgaccaagatcctcgcccaaaaaagaagcgttaccaccgccacactcagcatcagatccaagaaatggaagctttcttcaaggagtgtccccacccagatgacaagcagaggaaggaactgagccgggaattaggtttggaaccattacaagtgaaattttggtttcaaaataagcgcacccaaatgaagactcagcacgagcgtcatgagaacacacaacttcgtaacgaaaacgaaaagcttcgtgccgataacatgaggtacagagaagccctaggcagtgcctcttgccccaattgcggtggcccgacagctatcggagagatgtcatttgacgaacaccatctgagactcgaaaatgctcgattacgagaagagattgaccgtatatcagcaatagctgcgaagtatgtaggcaaaccagttgggaattaccctcttctgtcttcacctgttccttctcgcagtccacttgatcttggggttgggagcttcgggggtcagccgggcatggcaggagagatgtatggaggtggagaccttctgagatctatcagtggacctaatgaggcagacaaaccactgataatcgagattgcagtggcagccatggaagagctaatcagaatggctcaaatgggtgaacccttgtggatgaccagccttgatggcaacaccaccgtgttcaatgaagatgagtacatcagaacattccctcgtgttgctccaaaaccaagcaatcatttcaaatgcgaagcttcgcgcgagagcgctgttgttatcatgaaccacatcaaccttgttgagattctcatggatgtgaatcagtggtcgactgtgttttctgggattgtgtcgagagctatgactctggaagtgctgtcaactggagtggctggaaattacaatggagccttgcaagtgatgacggcagaatttcaagtaccctcaccacttgttccaactcgtgagagttattatgtgaggtactgcaaacagcatgttgatggcacttgggctgtggttgatgtctccttggacactctgcgccctaatcctgcaccaaggtcatgccaaagaaggccctctggatgtctcatccaagaaatgccaaatggatactcaaaggttacatgggttgagcatgtcgatgtggatgaacgtggtgttcacaatctgtacaagcagctggttaactccggcaacgcatttggggcgaaacgatgggttgctaccttggatcgtcaatgtgaacgccttgccagtgcactggcatcaaacatccctactggtgatgttggtgtgattacaaatcaagaaggcagaaaaagcatgttaaaattggctgaaaggatggtcataagcttctgtgctggagtaagcgcatcaaccactcacacatggacaacgctgcctgggaccggggctgatgatgttcgggcgatgacccgaaagagtgcggatgaccctggcaggccggtattgtgctcagcgccgccacatctttctggcttccagttcctcccaaaagggtatttgaattcctccgtgatgagaactctcgtaatgagtgggacattctttccaatggtggaattgttcaagaaatggcacacattgctaatggtcgcgacactggaaactgcgtgtctctacttcgagtaaatagtgcgaattcaagccagagcaacatgctgatactgcaagagagctgcacagaccaaacagcttcttttgtgatttatgctccagtggacattgttgccatgaatgtggtactaaatgggagtgaccctgactatgttgctcttcttccttctggctttgccatccttccagatggaggaggcatgggagattctggctctggtggttcccttctcactgttgcctttcagattctggttgattctgtccccaccgccaagctctctcttggatcggtggcaacagttaacaatctgattgcttgcactgtggagaggatcaaagctgcattgtcttgcgacactgcatgaatttcatgacataactttagttaatttttagtgttttgaggtgaaggaaggaaggtgaaaggagagaacacagagacacagatggtggtaagggatttgggcttatacacaggaggagagagagaagtcaagagcgcaccttacatgatccttaatttgtaacttaattaagagattaggggttcgggatttgacttcctcgaacgatgttaaaggcaaattaagcgcttaagaccttatttttaggatatttgaactttcctttcagttttcttcaaccttggattcaggattagggttttgcaatggatattgcttttctatgtctgatcgtttaagaatttctttttgggaatttttttttttaaaaaaaaaaaggcttttgcttaggtaattttctttcaaactgttgtgtctttattgaatttagacatttgctgattttgttatgaagttacttttagttt

SEQ ID NO: 8281 - DNA, 3285 bp, Lupinus angustifolius
gaaaacgcgttattctttttccaattttcactcttggaacctacttatttccctcaaaaacaccaatctggtcaaatctgcatattttgtacacagtttttatatcaaaatcaattttttcatgaacatagtagtatatctaaaataattaaaaaaatgttggtgctattttgatcctttgttttctgagtatagtatgctatatttgggtattgtttttgttagatttaaaaataagagtttggaatcttaaagatcagtagataatgttccagccaaacatgatggaaggccttcaccatttggacatgactactcagaacacttcagagagtgatatccctataatccgcaacgatgagtttgacagtggcacaaaatccggcagcgaaaatcatgacggtggtgcctccggcgaggaccaagatccacgtcctaataagaagaagaagcggtaccaccgccacacccaacaccagatccaagaaatggaagctttcttcaaggagtgtcctcaccctgatgacaagcaaaggaaggagctgagtagagaattggggttagagccattacaagtcaagttttggtttcagaacaagcgtactcagatgaagacacaacatgagcgccatgagaacacacaacttaggactgaaaatgataagcttcgtgcagataacatgaggtaccgggaagctcttaccaatgcttcttgtcctaattgtggtggaccaactgctataggagaaatgtcatttgatgaacatcaactgaggcttgaaaatgctcgcctaagagaagagattgatagaatttctgctatagctgccaagtacgtagggaagccagtggtgaattatccacttctttcatccccatctgttcctccacgttcactagaacttggagttaatggtgcttttagtggacaacaaggtggcattgatatgtatggatctggagatcttctaaggtcaataaatgggcccactgatgctgataaaccaatcataattgagcttgctgttgcagccatggaggagcttattggaatggcacaaatgggtgagcctctttggttgaccacacttgatggctccaccactgtgctaaatgaggatgaatatgttaggtcttttcctagagggattggacctaaacctaatgggttcaagtgtgaagcttcacgtgaaactgctgtggttatcatgaaccatgttaaccttgttgagattctcatggatgcgcaccaatggtctacagtgttctctggtatagtctcaagagctatgactctagaagtgctatcaacaggagtggcagggaactacaacggtgctttgcaagtgatgacagcagaattacaagtaccaacacctcttgtgccaactagagagagttactttgtgaggtattgtaagcagcaccctgatggaacatgggcaatagttgatgtgtcattggataatttgcgccctagtccttcttctaaatgtagaagaaggccttctggttgtttgattcaagaattgcctaatggctactcaaaggtcatatgggttgagcatgtggaagtggatgatagaggtgttcataatctatacaaacaacttgttagctctggacatgcatttggtgcaaaacgttggattgcaaccttggatcgacaatgtcaaaggcttgctagttccatggccacaaacatgcccaccgtagatgttggcgtgataacaaaccaagaaggaaggaaaagcatgttgaaactggctgagagaatggtaataagcttttgtgctggagtgagtgcttcaactgcacatacatggacaacattatcaggatcaggaacaggtgctgatgatgtaagggtcatgacacgtaaaagtgttgatgatcctggaagaccacctggtattgttcttagtgctgcaacttctttttggcttccagtgtcacctaaaagagtctttgaattcctccgtgatgagaattcaagaagtgagtgggatattctttccaatggtggagttgttcaagaaatggcacatattgccaatggaagagacactggaaatagtgtttctctacttcgagtgaatagtgcaaattcaagtcaaagcaacatgttaatattacaagagagttgcactgattcaacaggttcttttgtaatttatgctcctgtagatattgctgcaatgaatgtagttctcaatggagggcacccagactatgtagcccttcttccttctggttttgctatactccctgatgggactacaacacatggaagtagcattgttgaaaatgatcatggtggttctcttttaactgttgcatttcaaatattggttgattcagttccaacagctaaactttcacttggatctgttgctactgttaataatcttattgcttgtactgttgagagaattaaggcttcccttactggggaagctgcttgagcttcagaactaatggaacttgtgtttagaagaaggatatatatataagagggtggcattgcattttggaaaaagaggaggtgttgagaactttggcctatatacaagagtgaaggtagaagtcaagagcgcaccttgcataatccattctcataatctcaacaacaaagtgctgagaaaggattaaggttcgggaattgacttcccaagattatattataaaaatgctaagagcttaaattaagaccttatttctcttcatcttctaaagacaacatgtttaattatagttgttattattagctttttcaataacttagttattattattagggtgtagctttaacgtaaccctcttatattaattccttcttgaattgttaatttctttagaagcactagcactatagctagtaaatggtggaaacttttgcctctagcatagtgttttgtccttttttaagggttttgaaaatgggtgttgcttccattctgcttagtcttattcagtaacttagatctctttattatttatgtattcgttatgtgacataaatgaatagcatagatggtaatgtgtcacaaataagataaagttttggagaatcaatcaatttcgtaatatagattaaaagggtaagttatcttatgtatcaaattatgggcatgttatcaatttctacatcaacctgacctgtgtatttctacatcaaattatgaggccatgattaatttgctctttatggatattgtactctctctttgaccaaagattaagaatctacgtgaaaaggaaattagtaaaatgtatttatcattg

SEQ ID NO: 8282 - DNA, 3187 bp, Populus trichocarpa
ttttatatttgattttggggtttagtcagatattacctgtaaaaatcgtcaactcgaccttctttatatattctctgtctctttcgtacgtacgtaagaaccagataggcgtagaaagggagaaaccaattctcctacggggaaaaagagaacgatagtcagcctgcctgttttctatactctctagaaaatccgtgagaaacccactctctatgatctaagaccatatataacagtagagtcaaaaggagagtgagttaagctacctataaggcacagacacacaaatatatattcctatatacaacgtttcttagggttcgtggcttgtgaaatatgccagccggagtaatgattccggcaagaaacatgccatcaatgatcggggttaatggtaatgttggtgggtttggatcatcctccggacttgctcttggtcagccaaacatgatggaaggtcacgagtttcatcatctagacatgacacacaacacatctgaaggcgacatgactcgaattagagatgaggaatttgatagtaccaacacaaaatcaggcagtgagaatcaagaaggcgcttcaggtgatgatcaagacccacgccccaaaaagaagcgctaccatcgccatacccagcatcagatccaagaaatggaagctttcttcaaagagtgtccacacccagatgacaagcaaaggaaggagttaagccgagaattagggttagagcctttgcaagtcaagttttggttccaaaataagcgtacccaaatgaagacccagcatgagcgccatgaaaacacacagcttcgaaatgagaatgaaaagcttagggctgacaacatgcggtacagggaagctcttagcaatgcctcgtgtcctaattgcggagggcctactgccataggagagatgtcctttgatgaacatcatttgagacttgaaaatactagattgagagaagagattgaccgtatttcagcaattgctgctaggtatgttggcaagcctgtggtgaactatcctgttctatcgcctccaatgcctccacgtccagttgaccttggtgttgggaattttggtggacaaccaggcttaggaggggatatttatgaagctggagacctactaaggtctattagtgcacctactgaggctgataagcccatgataattgagcttgcagtggcagccatggaggaactaattagaatggctcaaatggatgaacctttatggatgaacagccttgatggaattgatgcagtgttgaatgaagatgaatacataaggatattccctcatggtattggtcctaaacctactggttttaaatgtgaggcttcaagagagtctgctgttgttatcatgaaccacatcaaccttgtcgagtatctgatggatgtgaatcagtggtctacattgttttctggcattgtctcaagagctttgactttagaagtgctatctacaggagttgcagggaactacaatggagccttgcaagtgatgacagctgaatttcaacttccaactccacttgttcctactcgtgaaagttactatgtcaggtactgtaaacaacatgctgatgggacttgggctgtggttgatgtttcattggacagtatacgccctggtccagcagcaagatgtcgaagaaggccatctggatgtttaattcaagaaatgcccaatggttactcgaaggttacatgggttgaacatgtagaagtggatgatagaggtgttcataatctatacaagcatctagttagctcaggacatgcattcggggcaaaacgttgggtcgcaaccctaaaccggcaatgcgagcgccttgccagtgccatggcaacaaacattcctgctggtgatgctggtgttattactaatcaagaaggaagaaagagtatgatgaagctggcagagagaatggtgataagcttctgtgctggcgtgagcgcctctaccgcccacacatggactacactatctgggactggagctgatgatgtcagggtcatgacaaggaagagtgtagatgatccagggaggcctcctgggattgtgcttagtgcagcaacttccttctggcttccagttccaccaaagagggtttttgattttctacgtgatgagaacacccgtaatgagtgggatattctatcaaatggtggggttgtccaagaaatggcacacattgctaatggccgggatacaggcaactgtgtatctctaatccgagttaatagcgcgaattcgagccagagcaacatgctgattttgcaagagagttgcactgatcaaacggcctctttcgtaatctatgctcctgttgatattgttgcaatgaacgtggtgcttaacggcggggatccagattatgtggcacttcttccatcagggtttgctatttttcctgatggaaccgcagcgcatggagtaggcatggatgaatctgggtctacaggaggatctcttctaactgtcgcgttccagattctggttgattcagttcctacagcaaaactgtctcttggctcagttgcaactgttaacaacttgattgcatgcactgtggagaggattaaggcttccttatcatgcgaatctgcatgatctttgaaggttaatttatagttcattaccagagaaggaaaaacgagggaaattttgtgaaaaaactcaaagttggtttcgattttgggtgatagaagaatgggagaagtcaagaacgcacctcacataattcttttttgcctcatggctttcgttttgggcaagaataattaagaaccaaagcataccatgagtgagaaaagatgttagaggttcgggaattgacttcgccaaacaaagtaaagggcaaatatagaccagaccccttgtaatattccgaggttgatctactacttttccccttcttcttaacttagttgttagggtttttttaggcttgtgagacctctccgtacttctcctccacttgttattttgtttgtgtcttggagcactagtgggtgaaaagctcacaccccctagtagacaatggtttctgcttttctactctttcccatcttaagaacttttggaatagacagacttcttttgtatttattattggtttgaattgtcttcaccatatttaaacctgggtttattttcatatgatccgcagtcttca

SEQ ID NO: 8283 - DNA, 2261 bp, Cucumis sativus
tcatgcccgccggaattatgacaccggcgagaaacatggggtcgatgattggaagaaatgggaataatgatgttgctggattttcctctccttctggacttcctttttctcagccaagcattatggatgctcaccttctccctctagacatccctcaaaacacttcggaaagcgatcttgctcgaatcagagatgacgacttcgacagtgctactaaatccggcagcgataacaaccatgagctcgtgtccggtgatgaccaagatcctcgtcctaaaaagaagcgttaccatcgtcatactcaacatcagatccaagaaatggaagcgttcttcaaagagtgtcctcaccctgacgacaaacaaagaaaggaattaagcagggaattagggttagagcctttgcaagtcaaattttggttccaaaacaaacgcactcaaatgaagaatcaacacgagaggcatgagaatactcaacttcgaacagaaaatgagaagcttagagctgataacatgagatatagagaagccctaagcaatgcttcatgccctaattgtggtggccctactgccattggtgaaatgtcttttgatgaacatcatcttagactcgaaaatgcccgtctccgcgaagagatcgatcgcatatcagcaatagctgcaaaatacgtagggaagccagtggtgaactaccctctactttctccatcagtcccatctcgtccactagagttaggaatggccaacttcggaccacaacccggcctgggaggaggagacatctatggctccgccagcgacctaatccgatccatcagtgccccaacggaggccgataaaccaatgatcattgagctagccgttgcagccatggaagaactaactagaatggctcaaatgggtgagccattgtggatgactacactggatggctccacccatatgctcaatgaagatgagtacttaagaacgtttccaagaggcattggtcctaagccttctgggtttaaatgtgaagcctctcgtgaatcggctgttgtcatcatgaaccacattaacctagtcgagattctcatggacgtgaatcaatggtcgactttattttctggaattgtgtctagagctatgacacttgaagttctatcaactggtgttgctggaaattacaatggtgctttgcaagtgatgacgtcggaatttcaagttccatcgccactagttccgactcgcgaaagttactacgttagatattgtaagcagcatggagacgggacgtgggtggtggtggatgtttcgttggatgatttacgccctacacctggtgttcgatgtagacgaagaccttccggttgtttgatccaagaaatgccaaatggttattcaaaggttacatgggttgagcatgtagaagtggatgatagaggagttcataatctttacaagcaactagtgagctctggccaagcttttggggctaaacgctgggttacaactttagaccgccaatgtgaacgactcgccagtgccatggccactaacattcctactgtgataacgaatcaagaagggagaaagagtatgttgaagctggctgagagaatggtgataagcttttgtgctggagtgagcgcctccacaactcacacatggactactttgtcgggtactggtgcggacgatgttcgagtcatgactagaaagagcatcgacgacccgggaagacctcatggtattgtccttagtgcggcaacttccttctggcttcctgttccacccaagagaatcttcgattttcttcgagatgaaaactctcgcagtgagtgggacattctttccaacggcggagtagttcaagaaatggctcacattgccaacggccgcgacactggcaactgcgtttctctcctacgagtaaacagcgcaaattcaagccaaagcaacatgctaatcttgcaagaaagctgcacagacccaacagcctcattcgtgatctacgcaccagtggacgtagtagcaatgaacctcgtcctaaatggtggcgatcccgactatgtagcactactcccctcagggtttgccattcttccggatggcggaggcggagagggtgtttcgggagggtcgttgttgacagttgcatttcaaatactggtggattcagtgccaaccgcaaaactgtcacttgggtcagttgcaacggtaaacaatctgatagcttgtacggtggaaaggataaaagcttcattatcatgtgagaatgca

SEQ ID NO: 8284 - DNA, 2293 bp, Citrullus lanatus
gttcaatatgcctgccggaattatgacaccggccagaagcatggcgtcgatgattggaagaaatgagaataatgctgctggatttgcctctccttctggatttcctctttctcagtcaagcatgatggacagtcatctcctccccttagacatccctcaaaacacttccgaaagcgaccttgctcgaatccgagacgatgacttcgacagtgccactaaatccggcagcgacaacaaccctgaccttgtctccggtgacgaccaagatcctcgtcctaaaaagaagcgctatcatcgtcatactcaacatcagatccaagaaatggaagcgttcttcaaggagtgtcctcaccctgatgacaaacaaagaaaggaattaagcagggaattagggttagagccgttgcaagtcaaattttggttccaaaacaaacgcactcaaatgaagaatcaacacgagcggcatgagaacactcaactcagaacagaaaatgagaagcttagggctgataacatgagatacagagaagctcttagcaatgcctcgtgccctaattgtggtggccctactgccattggtgaaatgtcttttgatgaacatcatcttagactcgaaaatgcccgtcttcgagaagagatcgatcgcatttcagcaatagctgcaaaatacgtagggaagccagtcgtgaactaccctctactttctccaccagttccagctcgcccactagagctaggaatgggcaacttcggaccacaaccaggcctcggaggaggagacctctacagctcggccagcgacctgatccgatccatcagcgccccaaccgaggctgataagccaatgatcatcgagctagcagttgcagccatggaagagctgactagaatggctcaaatgggggagccattgtggatgactagccttgatggctccacccatgtgctcaatgaagatgagtacttgagaacgtttcctagaggcattggtcctaagccttctgggtttaaatgtgaagcctctcgtgaatctgctgttgtcatcatgaaccacattaacctagttgagattctcatggatgtgaaccaatggtcgactttattttctggaattgtgtctagagctatgacacttgaagtattatcaaccggagttgctggaaattacaatggagctttgcaagtgatgacgtcggaatttcaagttccatcgccattggttccgacccgggaaagctacttcgttagatattgtaagcaacatggggatgggacatgggcggtggtggatgtttcgttggatgatttgcgccctacccccggagttcgatgtagacgaagaccttccggttgtttgatccaagaaatgccaaatggttattcgaaggttacatgggttgagcatgtagaggtggatgatagaggagttcataatctttacaagcaactagtgagctctggccaagcttttggggccaaacgttgggttacaactttagatcgccaatgtgaacgacttgctagtgccttggctactaatattccaactggggatgttggagtgataacgaatcaagaaggaagaaagagcatgttgaagctggctgagagaatggtgataagcttttgtgctggagtgagcgcctccacaactcacacatggaccactttgtcgggtacgggtgcagacgatgttcgagtcatgactcgaaagagcatcgacgacccgggaagacctcctggtattgtcctcagtgctgcaacttccttctggctccatgttccacccaagagaatcttcgatttccttcgagatgaaaactctcgcagcgagtgggacattctttccaacggtggagtagttcaagaaatggcccacattgccaatggccgtgacactggcaactgcgtttctctcttacgagtaaatagcgcaaattcaagccaaagcaacatgctaatcctgcaagaaagctgcacggacccaacagcctcatttgtgatctacgctccagttgacatagtagcaatgaacgtcgtcctgaacggcggtgatcccgactacgtagcacttctcccctcaggctttgccattctccccgacggcgctggcggagagggcgtttccggtgggtcgttgctgacggttgcatttcaaatcctggtggattcagtgcccacggcaaaactgtcacttgggtcaattgcaacggtaaacaatctgatagcttgtacggtggagaggataaaagcgtcattatcatgtgagaatgcataaccaaaaaagaaaaaa

SEQ ID NO: 8285 - DNA, 2536 bp, Arachis hypogaea
ttcgacagcgccaccaagtccggcagcgagaaccaagaaggtggcgcctccggcgaggaccaagacccccgccctaacaagaagaagcgttaccaccgccacacccagcaccagatccaggaaatggaagcattctttaaggagtgtccgcacccagatgacaagcaaaggaaggaactgagccgtgagttagggttagagccattgcaagtgaagttttggttccagaacaagcgcactcaaatgaagacgcaacatgagaggcacgagaacacgcagttaaggacagagaacgagaagctgagagcggataacatgaggtatagggaggctcttagcaatgcctcttgccccaactgtggtggaccaaccgccattggagaaatgtcttttgatgaacatcacttgaggcttgaaaatgccaggctaagggaagagattgatcggatttctgccattgctgcaaagtacgtggggaagccagtggtgaactacccactcctttcatcatcctcagttccagcacgtccgttagaactcggcattggtggtttcggtgggcaagcgggcatgggtggcggcgacatgtacggaggaggtggagccggagatcttctgaggccaataagtgggcccactgaagcagacaagccaatgataatagagctggccgtagcggccatggaggagctgattgggatggcacagatgggtgagcctctttggttgaccacacttgatggtgccaccactgtgcttaacgaggatgaatatgttagatctttcccccgtggaatcggacccaaacctaatggattcaaatgtgaggcttcacgagaaaccgctgttgtcatcatgaaccatgttaaccttgttgagattctcatggatgtgaaccaatggtcgacggttttctctggaatagtttcaagagcggtgactctagaagttctatcaacaggggtagcaggaaactataacggtgccttgcaagtgatgacggcggagttacaagtgccttcgccgctggtgccaacaagagagagctatttcgtaaggtattgtaagcagcacgcggacggcacgtgggcagtggtggacgtgtcgttggacaatttgcggcctagtccttcggccaggtgcaggagaaggccttctggttgcttgattcaagaaatgcccaacggctattccaaggtcatatgggttgagcacgttgaagttgatgacagaggcgttcatagtctctataagcagcttgttagctctggtcacgccttcggtgccaaacgctggattgcaaccttggatcgccagtgtgaaaggctcgctagtgccatggccactaacattcccaccgttgatgttggagtgataacaaaccaagaagggaggaagagcatgctgaaactggcggagagaatggtgataagcttttgtgctggagtgagtgcttcaacggcgcacacgtggacaacgctttctggaacgggtgcggatgacgtcagagtcatgacacgtaagagtgtggatgaccctggaaggccacctggcattgttctcagtgctgctacttctttctggctcccagtacctcctaaaagggtctttgaattcctccgtgacgagaattccagaagcgagtgggacatcctttccaatggtggagttgttcaagaaatggcacatattgctaatggaagagatactggaaattgtgtctctctccttcgagtcaatagtgcgaattcaagccagagtaacatgttgatattgcaagagagttgcacggattcaactgggtcatttgtgatctatgccccagtggacattgttgccatgaatgtggttctgaatggaggagatcctgactatgtggcgcttcttccttctggcttcgctattcttccggacgggacaacgccggacggaggcagcgaagccggtggacatggtggttctctcttaactgttgcgtttcaaatactggttgattccgttccaaccgccaagctgtctcttggttctgttgccactgttaacaaccttattgcttgcactgttgagagaattaaggcttctttatctggagaagctccttcataaagaaaacctatgttgtattagaagaaggaaaatggggggtgcattgcattttggagaaatgatggaggaaggtgtatgtttgggaagttcggcttatacacaaaacaagctaaggaaatggggggagaagtcaagagcgcaccttattgcatgaacccttctttgcacatcgatcatcaccaactttatatgatcagtgcttagaggattaaggttcgggaattgacttcccttgaatattattataccaaacaagctatatatcgagctaagaggcttcgattaagaccttaattactacttcattctcttcttcgttcatcaccttctcaagacaaaacaacataattaatattttattcttagctagggtttaatttttattgttgttcttagcttttttggatatgtaactggcgtctagctttaa

SEQ ID NO: 8286 - DNA, 2776 bp, Quercus alba
atctgtagatatgttccagcctaacatgatggatggtcagctccaccagctagacatggctcaaaacacatccgagagtgatttagcccgaattcgagacgatgaatttgacagtgctactaaatctggtagcgaaaaccatgaaggtgcctccggtgacgaccaagatccacggcccaacaaaaagaagcgctaccaccgccacactcagcaccagatccaggaaatggaagcattctttaaggagtgtccacatccagatgacaagcaaaggaaagaactaagccgtgaattagggttggagccattgcaagtcaaattttggttccaaaacaagcgcacccaaatgaagacccaacatgagcgtcatgaaaatacaaatctgagaactgagaacgaaaagcttcgggccgataacatgaggtacagagaagctcttagcaatgcctcatgtcccaattgtggtggtccaactgcaataggagagatgtcctttgatgaacatcatttgagactcgaaaattcccgattaagagaagagattgataggatttcagcaattgctgcaaagtatgttggcaagccagttgtgaactaccctcttctttctccaccggtcccaacccggccactagaccttggagttgggagttttggtgggcagccaggcattggaggagagatgtatggtgctggagaccttcttaggacgatcaatgcaccaaccgaagctgataaacctatgatcattgagcttgcggttgcagcaatggaggaactaatcagaatggctcaaatgggggaacccttatggatgacaaatcttgatggcacctcaatgataaatgaggatgaatatattaggacatttcctcgtgggattggaccaagaccatccggcttcaaatgcgaagcttcacgagaaactgctgttgtcatcatgaaccacatcaaccttgttgagattctaatggatgtgagtcagtggtctactgtgttttctgggattgtctcaagagctatgactctggaagtattatcaactggagtggcaggaaattataatggtgcactgcaagtgatgacagcagaattccaagttccctcacccctcgttccaactcgggagagttattatgtgaggtactgtaaacagcatgctgatggtacttgggcagtggttgatgtttccttggataatttgcgccctagtccggcagtgaggtgccgaagaaggccttctggttgtttgattcaagaaatgcccaatggatattcaaaggttacatgggttgagcatatagaagttgatgatagaggtgttcacaatctatacaagcagcttgttagctcaggtaatgcattcggtgcaaaacgttgggtagcaaccctagaccgacaatgtgagcgtcttgcaagcgccatggcaacaagcattcccaccggtgatattggagtcataacaaatcaagaaggaagaaagagtatgttgaaactggctgagagaatggtgataagcttttgtgctggagtgagtgcctctactgcacacacatggacgacattgtctggaactggggcagatgatgtaagggtcatgacccgaaaaagcatagatgatccaggcagacctcctggcattgtgctaagtgctgctacttccttctggcttcctgttccaccaaaaagagtttttgattttctccgtgatgagaactctcgaagcgagtgggacattctttcaaatggtggagttgtacaagaaatggcacatattgctaatggcagggaaacaggcaactgcgtatctctacttcgagtgaatagtgcaaattcaagccagagcaacatgttgatattacaagagagttgcactgacccaacagcctctttcgtgatttatgcaccagttgatattgttgcaatgaatttagtactaaacggtggagatccagattatgtggcactacttccttcaggatttgctattctccctgatggaacaatggctcatgaaggaggcattggtgaggctactacatctggaggatctctcctcactgttgcttttcagattttggttgattcagttcctacagcaaaactttctcttgggtcagttgcaactgttaacaaccttattgcttgcaccgttgagaggattaaggcttctttgtcttgcgagaacgcatgatctacaaaccctaaattcaagtgattaacagaagcaagaaaaggaaaggaaattaagagaaacaaattaaggtgatgaagaatttcttctttatacaagatgggcagaagtcaagagcgcaccttacatgatcctttctaagcagtttacaaaagcttaagcgcaaggattaggggttcgggtattgacttcttcaaacaatttaaagagctaaaaaagcttaacaccttattattatgaatagggttgaactttcttttaccttttcttaacttggtagttagggttagggttttgcatgagtgaaagcttataaagtgcttcacttatttccttctttgtttgttgttcggtcgtgtgtttttgaaacaccagtgggtgaagaacctcacacctactagcaaatttttcttttattttcttttttgtttacaattttaagatcttttgaagtggatattgcttccgtagattattatgtctttgtgttcgaagttgatttgtctgattgtacttagcaagttatacgtgcgtgattatgtaggtatggttaactttttaatatatatgcaatcatgcaag

SEQ ID NO: 8287 - DNA, 3704 bp, Cannabis sativa
agttctaagcaaaacgtaaaatactactgttaagacacgtttggatactccgagatcttcgagggcgttacatatatagcctttttttttttgtttgtttgtagaattttatttgtttggttaatgtttttatttttccccaaaagccaaatccaaattgtcaacccttatctttatatgatactcctgtagagatttttacctttccaaacaccccctaaaaaatgaagcacaaactaattgtcacctcagtccattttactttgtaaaaggtttttgtttagttaagagtagcacactactactgtcaaagaatctaagattaaaagtagtagtcagaactcttcttttgacttaatccttttaaagatataaaaaatatctatatataatatataaagagtacgaaagcagcatagttttccagagaaaatattgcagtagtgaactcatttttcgaagaaaggacggttgaaaaaacattttagggtttctggggttttcaacatgccggccgggatcataattccggcgagaaatatgccgtcgataatcggacggaatggaaatattggtgggtttggttcatcttcaggacttactcttagtcagccaaacatgatggaaggaagtggtcaccagcttcttcatcccctagacatgaccgcacagaataccacctccgaaagcgatctcaacgctcgtctcggccgagacgacgacgttttcgacagcgcaactaaatcgggtagcgaaaaccaagacggtggtgcctccggcgacgaccatgaccagcagcgtcccaagaagaaacgctaccatcgccacactcagcatcagatacaagaaatggaagcattcttcaaggagtgtccacatcctgatgataagcaaagaaaggagctgagccgggaattagggttagagccattgcaagtcaaattttggtttcaaaacaagcgcactcaaatgaagacccagcatgaacgccacgaaaacactcaactccgcactgaaaatgataaactaagagctgacaatatgaggtacagagaagctttgagtaacgcctcgtgccctaactgtggtggcccaaccgcaataggagagatgtcctttgatgaacaccatttgaggctcgaaaatgcccgtctaagagaagagattgatcgtatttctgcaatagctgctaagtacgtagggaagcctgtggttagctacccaatcctttcatccccagctacccctcgtccactggaactcggagttggaaactttgggagtcaggcgaccatgggaggagagatgtatggaggaggtggttcaaccggagatctactgaggacgatgagtgcaccaaatgaggctgataagccaatgataatagagcttgctgttgcagccatggaggaactgataaggatggcccaaatgggagagcccttgtggatgaccagcctggatggagcgagtgctgtgctgaacgaggatgagtacgttcgtacattccctcgaggaataggacccaagcctgctggtttcaaatgcgaagcttctcgtgagactgccgtcgttatcatgaaccacattaaccttgttgagattctcatggatgtcaatcaatggtcgactgttttctctggtattgtttcgagagcaatggctttagaagtcctctcaactggagtcgctggaaatttcaatggagctttgcaagtgatgacagctgaatttcaagtgccttcaccgctggttccaactcgtgagagttactatgtaaggtactgtaaacaacatgcggatgggacttgggcagttgttgatgtttctctcgacaacctacgtcctagtccagctgtcagatgccgaagaaggccttccggttgccttatccaagaaatgcctaatggatactctaaggtgacatgggttgagcatgtagaagtggatgatagaggtgttcacaatctgtataagcagctagtcaactcgggccatggatttggtgcaaaacgctgggttgccactttggatcgtcaatgtgaaagactagctagtgccatggcaaccaacattccaaccggtgatgttggtgtgataacaaaccaagaagggagaaagagtatgttgaaattggctgagagaatggtgataagcttttgtgctggtgtgagtgcctccaccactcacacatggacaacactctcaggaaccggagctgatgatgttcgggtcatgacccgtaagagcgtcgacgatccaggcaggcctcctgggattgtgttaagtgctgctacttcattctggcttcctgttccacccaaaagagtctttgatttcctccgtgacgagcattctcgaagcgagtgggatattctttccaatggtggagttgttcaagaaatggcacacatagcaaatggtcgtgaaactggaaactgcgtgtctctacttcgagtaaatgtttgtatttataatttgagtgccaactcgagccaaagcaacatgctgatattgcaagagagctgcactgatcaaacggcgtcgtttgtgatttatgctccggtggatattgttgcgatgaacgtggtgcttaacggcggtgatcctgactatgtggctctacttccgtctggatttgccattcttccagatgggtccggtggtggtggtgatgggattgtggaaccttgctcttccggcggctctctgctcactgttgcgtttcagattttggttgactcggtccctacagctaagctttctcttggatcagtcgcaactgttaacaatcttattgcttgcaccgtcgagaggattaaggcttctttgtcatgcgacactgcataatatcacagtcctacctagctaccttcataataattgttttttgcagtcatatttgatagaagaagatggtcgaaattagtgaaaagcagcaggggaaagaaaaagaagtaagataaagaaatctaaggtgttgaggaaatgcaaatattttggagaagtcaagaacgcaccttacatgatcctttcttagcatttcaaatttcgagttttgcaaggattataggggttcgggtattgacttcatcgaacacattatgtagaaaagaagaaggccttggaatttatgttattgtacttggaatgtcaatttcggagaaatttatgttattgtacttggaattttcttttttttttttttgaaagaacaaacagttcagttgaagagataactatcacaacacgtgactcctccctatagtaaacaccgttgaaatgaccattattccaggccatttttgctacactatccgttgattgattgtcaattctcttaataaaaacaattacagacatcaaaaaaaaaaaaaaaaatcaagcaagattccaaatttctaaaatcaggggtctagctttccaacaaggagggaactgcatattctctaaggccttcaccaccactagggcatctgaggcaatggcatcttctctagcctccccactgcaaggcccgccaccccatctttccaagaagcatcagtcaaacatatatatagaactagaagtggacgggatctttgaatgcagcaaagtaactgagtttcctgcaacaaactgatcttctgcaatactctgaattgataaggactcctcaaatcttaaattaattcttaatctacatgtcataatatctagta

SEQ ID NO: 8288 - DNA, 2304 bp, Malus domestica
ttgaagtatgcaagccgggcttattattccggcgagaaacatgccttccatgatgggaggcaatgggaacattactgggtttgcgtcaacttcaggactcacacttggtcagccaaatatgatggacgccagtaatctgcacccgctagacatggctccaaacacctctgaaagcgacattcctcggttccgagatgatgacttcgacagtgctaacaaatccggcagcgacaaccctgaaggcggttcgggtgatgaccaagaaaaccctcgacccaaaaagaagcgttatcaccgccacactcagcatcagatccaagaaatggaagcgtttttcaaggaatgtccccacccagatgacaagcagaggaaggaactgagccgggaattaggtttggaaccattacaagtcaaattttggtttcaaaacaagcgcacccaaatgaagactcagcatgagcggcatgagaacacacaacttcggaacgaaaacgaaaagctccgtactgataacatgaggtacagagaagcgctaggtaatgcctcatgccccaattgtggcggcccaacagttctaggggagatgtctttcgacgaacaccatctgagactcgaaaatgctcgattacgagaagagattgatagtatatcagcgatagctgcgaagtatgttggcaaaccattaggaacctaccctctcatgtcttctccagttccttcccgtggtcaacttgatcttggggttgggaactttggtggtcagccaggcatgggcggtgagatgtatggtgctggagaccttctcaggtcaatcagtgcaccaagtgaggtagacaagccaatgataattgagcttgctcttgcagctatggaggaactcttcaaaatggcccaaatgggtgaacctttgtggatgacaagctttgatggcaccacaaccatactcaatgaagatgagtacatcaggacattccctcgtggaatcgggccaaaacaaaacggcttcaaaactgaagcttcgcgtgagagtgcagttgttatcatgaaccacattaaccttgttgagattcttatggatgtgaatcaatggtcgactgtgttttctgggattgtgtcaagagctctgacccttgaagtcctatcatctggcgtgcctggaaattacaatggagccttgcaagtgatgacggcagaattccaagttccttcaccacttgttccaactcgtgagagttattatgtaaggtactgcaaacagcatgccgatggcacctgggctgtggttgatgtttcattggacgacttgcgccccaatcctgagcctagatcttgtcaaagaaggccctcgggatgcctaattcaagaattgccaaatggatattcaaaggttacatgggttgagcatgctgaagtggatgaaagaggtgttcacaacctctacaagcagctggttagctccggccatgcatttggcgcgaaacgatgggttgccaccttggaccggcaatgcgaacgtctagctagtgcaatggcatcaaacatccctactggtgatgttggagtgattacaaatcaagaagggagaaaaagcatgctaaaattggctgaaagaatggtgattagcttctgttctggagtgagtgcatcaaccactcacacatggaccacactgtctggaaccggtgctgatgatgtccgggtgatgacccgaaaaagtgtggatgatcccggaaggcctccaggtattgtgctcagtgccgccacatctttttggcttccagttcctcccaaaagagtctttgagtttctccgcgatgagaactcccgcagcgagtgggatattctttccaatgggggaattgttcaagagatggcacacattgcgaatggtcatgacactgggaattgcgtgtctctactacgagtaaatagtgccaattcaagccagagcaacatgctgatactgcaagagagctgcactgacccaacagcttcctttgtgatttatgcaccagttgacattgttgccatgaatgtggtgctgaatgggagtgaccctgattatgttgcccttcttccttctgggtttgctatactcccggatggagccgacattggagactctggctctggtggtggttcccttctcactgttgcttttcagatcttggttgattcaatcccaactgctaagctgtctctcgggtcggttgcaacagttaacaatcttattgcttgcactgttgagaggatcaaagctgcattgtcatgcgacaatgagtgaacttcatgacccaattagtt

SEQ ID NO: 8289 - DNA, 3456 bp, Gossypium raimondii
ctctcaacacgatctgcaataactattcgctgccacaatttcctctatctgtttccctctatctccttcctcttctcccttctttcatcatcatcttcttcttcatcatcctcttctttgtatcagttactttcttgcttgatcccctccccaccaacaccaactttttataccattcaacctcacacccaaacagcctgttttacttctttcaaacaacacttagcagtttacagtaaacaagtctttttttttcccagaacagatcctaattctctcttcttccttgggctttcctagggttcatctttattagggaaagccgaagagacaaacatagaaagcatagttggattctccgtgattttcgctggaacgtgttttctttctttctttctttcatttgcctggttttttgtctgtcaagtaccgtatcaaatttgtcaacatttttctttatagatgctgtctggctttcatattggcacgtaagagtaggatattcttcgaggataaatacacaaatatataaaccgaagaagagagagagagagagagagtaactttcgagctgcccaaaagaaaaaaaaccacagtcagctttgtttctcactgttggggaatctaaaaggtcatctcaactcgaatcaaaggacagtttaagtagtgtgaagaagggcaagaaacaatatatatatctgttctagtgctttttggattctgaaatatgctggccggagttatgattccggcgagaaacatgccgacgatgataagtggaaacggaaatgttagtggttttgggacatccttacttgttcagccaagcaatatgatggaaggtcaactccaccctctggagtccgaaagtgaaattggtcgaatgagagatgatgagttggacagtacaaccaaatctggtagcgaaaaccatgaagctgcctctggtgatgatcaaaatcctcgccctaataaaaagaagcgttaccatcgccatacacagcaccagatccaagaaatggaggcctttttcaaggagtgtcctcacccagacgacaagcaaaggaaggaacttgggcgtgagttagggttagagccattgcaggtgaaattttggttccaaaacaagcgtacccagatgaagacgcagcatgagcgccacgaaaacacacaactacgaactgagaacgagaagctaagggcagacaacatgaggtatagggaagctttaagcactgcttcatgccctaattgtggaggtccaactgctgtaggacaaatgtcctttgatgaacaccatctcaggcttgaaaatgctcgactaagagaagagattgatcgaatatcagcaatagctgcaaagtatgttggcaagccagtggtgagctaccctcttctttcgtctcctatgactccacggccatttgaatttggtgcacaacctggcactggggatatgtatggtgctggggatcttcttaggtcgatcagttcaccttcggaagccgataagccgattattatcgagcttgcggtggcagcaatggaggaactagttagaatggctcagatgggtgaacccttatggatgaccagccttgatggaacaacgtatgtgctgaacgaggaagaatacatcaggactttccctagaggaattgggcccaaacctaccggcttcaaatgcgaagcttcaagagaaactgccgttgtaatcatgaaccatattaaccttgtggagattctcatggatgtgaatcagtggtcaacggtgttttcgggaatagtttcaaaggcttcaactttggatgttctttcaacagggatagcaggcaattataatggagcccttcaagtgatggcaactgaatttcaagttccgtcaccacttgtgcccactcgtgagagctattacgtaagatactgcaagcaacatgcagagggaacttgggcagtggtcgatgtttccttggataatatacgccctagtccaacagctagatgccgaaggagaccgtctggatgcctaattcaagaaatgcccaacgggtattcaaaggttacttgggtcgaacatgttgaagtcgacgatagtggcgttcacagtctttacaagcagctcgtaagcaccggccatgctttcggagcacaacgttggatcgctactttagaccgacagtgtgagaggctcgcaagtgtcatggctactaacgtacccaccggtgacgttggagtgataacaaatcaagatgggagaaagagtatgctgaagctagctgagagaatggtgatgagtttttgtgccggagtgagtgcgtcgaccgcgcacacttggacgacattatcagggacaggggccgatgatgtaagggtgatgactagaaaaagcgtggatgatccaggtagaccacctgggattgtgctaagtgctgccacatccttttggcttcctgtttcaccaaagagggtattcgatttcctccgagatgaaaattctcgaagtgagtgggatattctttcaaatggtggagttgtccaagaaatggcacacatagccaatggtcgggacacaggcaattgtgtttcactacttcgagtaaacagtgcgaattcaagccagagtaacatgctgattttacaagaaagttgtacagacccaacggcctctttcgtgatctatgccccggttgatattgtcgcgatgaatgtcgtcttaaatggaggtgacccggactatgtcgctcttctcccttccggttttgctattctaccagatggatcaactattacagcaacgacttcgagtgccggtggtggcattgacactgatgcggccggcagctccagtggatcccttttaactgttgcgtttcagattttggtcgactcggttccaactgcaaagctttctcttggatcggttgcaacagttaacaatctgatcgcttgcaccgttgaaaggataaaagcatctttgtcatgcgagaatgcatgaagtagctcagctttaaatgatagctaactagataaggaacggaaaaagggaaggtaactaaatttgaagaaaattagtgagttgaggaattttgggattatagaaaaacgaaagggagaagtcaagagcgcaccttgcatgatcctatatgacatgtttgacttttgttcgaggctgagaaatttcaattgacttggacaaaattcatcaagtctagaggttcgggaattgacttccccaaaaagaaaaaaacgaatgaatgaatgaaataggagttgtatagttttgttttatgtaatgggattttagttcccttttttccttcttcccttagtttattttgtgtttctaatgctctcacacgtctacttctaccagacagtttttttaatttgttactatcgtttctttttctttttgaggcatttaaaagctttttttttttaaatgggtttcgttta

SEQ ID NO: 8290 - DNA, 3326 bp, Cicer arietinum
cattttcctccatctgttccccactttctctctatcctccttcaatgctctctctctcttcttcatcttcttctttctctccctctaatgtaaaactaccgtttctttcttctaaccttttattattcctataatattattaatatcaaggatctctcttcttcttttttcatcaactttataatcttcttaacgtagatctaccctttacatctctcttagtcctgataatgaaatatatatgagctcaatttcttaagtgaaaactgaggcaaccctccgaagcaaaagaaaaagagaaagagagagagagagaaacattccctctatgatagtagaggaattaataacaacgttggtgtgtgtgtttggtttatcttcatcttcgattctcactcacccttggacagattgaaaaagcataagtcttgggaatcatccatcataaaagatcaagtaaatataatataatgtttcagtcaaacttgatggaaggtggtcagttccatccattagagatgattcaaaacacttcagaaagtgatgtcatccctcgaatccgtgaagatgagtgctttgaaagtgccacaaaatcttgcagtgaaaaccatgaaggtggtggtgcttccggtgaagaccaagaaccaaagcctaaaagaaaacgttaccaccgtcacactcagcaccagatccaagaaatggaagctttcttcaaggagtgtccacacccagatgacaagcaaagaaaggagttaagcagagaattagggttagagccattgcaggttaagttttggtttcaaaacaaacgtactcaaatgaagacacaacatgaacggtcagagaacacacaacttagacaagaaaatgaaaaacttagggcagataacatgaggtatagggaagcacttagcaatgcttcatgccctaattgtggtggtcctactgctataggtgaaatgtcttttgatgaacatcatttgaggcttgaaaatgcaaggcttagagaagagattgataggatttcagcaattgcagccaagtacgtaggaaaaccagttgtaaactattcaaacattgcagcatctcttccaccacgtccattagaacatggagttggtgctggttttggaaaccaacaaggacttggcatggacatatatggaactagtggtgatcttctaagatcaataagtgggcccactgaagcagacaaaccaataataattgagttagctgttgcagctatggaagagctaactggaatggcacaaatgggtgaacctctttggttaactacacttgatggtgctgctaatgtccttaatgaagatgaatatgttaggtcttttccacgtggaattggacctaaacctaatggatttaagtgtgaagcttcaagagaaacttgtgttgttattatgaatcatgttaacctcgttgagattctcatggatgtgaaccaatggtcaacagtttttgctggtattgtttcaagagccatgactgttgaagtgttgtcaactggtgtggcagggaactacaatggtgctttacaagtgatgacagcagagcttcaagtaccatcacctcttgtcccaactcgtgagagttattttgtgagatattgcaaacaacatacagatggaacatgggctgttgtggatgtttctttggataatcttcgtccaaatccttcttcaagatgtagaagaaggccttctggttgcttaattcaagaaatgccaaatggttactcaaaggtaacatgggttgagcatgtggaagttgatgatagaggtgttcataatctatacaagcagcttgttagtactggaaatgcatttggtgcaaaacgttgggttgcaacattagatagacaatgtgaaaggcttgctagctcaatggctacaaacattccaactgtagatgttggtgtgataacaaaccaagaagggaggaagagtatgatgaaactagcagagagaatggtgatgagtttttgtggtggagtgagtgcatcaacagcacacacgtggacaacattagcaggaacaggagctgatgatgttagagtgatgacacgtaagagtgttgatgatcctggaagacctcctggtattgttcttagtgctgccacttctttttggcttcctgttccacctaaaagagtttttgatttccttcgcgatgaaaactcaagaaatgagtgggatattctttccaatggtggagttgtacaagaaatggcacacattgcaaatggacgagatactggaaattgtgtctctctacttcgagtaaatagtgcaaattcaagccagagcaacatgttaatattacaagagagtctaacagattcaacaggatcatttgtaatatatgcaccggtagacattgttgcaatgaatgtagttctaaatggaggagatccagattatgtagcacttcttccatcaggatttgctatcctctctgatggaaatggaaatggaattggtgatgaaaatggacaagctggtgtttgtggtggatcacttttaactgttgcatttcaaatattggttgattctgttccaactgctaaactttctcttggatctgttgctactgttaatagtcttattgcttgtactgttgagagaatcaaggcttctttgtctggtgaaactgcttaattcagcttcaagattaatgattttgagtttacaaggataaaggaggaagcattgcattgaagaaaaatcaagagggtggtgaggaacttaattaggcttaaattacaaaattagggagaagtcaagagcgcaccttgcatgatccttttttagaggattgattaattaaggttcgggaattgacttccctagatatagtaaattttgagctaacacaatggccttgccacccatgaattatcttttgttattagactaaatacatatagttagggccagactattggttaactaattagggtttagttttgatgaaactcttaattattttctttctttaattgtttgttatttgtgtgttttagaagtgggaccagcaaagtgtgaggtttgtacctaagacacaacactgcttaatttctcacctttccccttttaggattttgaaatggatttgttccattctctactagtgaaattgacatattgtttcatgatttaattaatatttatatttgctatgacacaaatattgaatgatgaaggtggttgagtgaactttagggatagtgtagcatataattaacatatgtttaatgtaaagtacctttaattaatatcatagtatggccaggctattaattatcg

SEQ ID NO: 8291 - DNA, 3802 bp, Populus trichocarpa
ggtagccgtcattcgttgcaccatacactctactagggggggaattaaaaaaaccaaacgagctctttctctttccatggcaattacacctctccaccattaaatgctattgcaccctctcaagacgctctgcaataactccttgctgccacaattttctctttctcttcgcttccattgctttcttcgcttcccaggtccctttgattcttcatcttcttcttgctttctacttttttttttaatttttttcccagtctttttcttgccttgactctatctccatatcccacacacctacttcttaccatagaagttcttaccaaaatctactgagaaaccacaaaagcagacccaaatactgctctcttttccacaagataacctcaaaaccagatccaaaaaaaaaaaacagaaaagaaaaatcttctcagtcaagactttcatttttattcttttggcaagtaaatttcttgtattgatagagctaaagaaggaaaggaaactgggaaggcaaatttggattctccgtgatcttagttgggcgttatgtgggatttatgtttggatttttgggtttagtcagatttttatctgtcaaaaattgttaacttaaacttcttatatactctctctctcttacatatatgtacgtaagaaccagataaacgtggagagacagaaacccatttctacggtaaaagagaaccatagtcagccctgtctgtttttctaaactctgatagaaaatccgtgaaaaaaaatccattccctctgatccaagaacatatataagtagtagagtaagaaaggagagggagttaagctatctataagacacacacacatttacatatttatacatagtatatacaacttcattagggtttgtggattgtgaatatgccagcgggaatgatgattccggcaagaaacatgccatctatgattggggttaatggaaatgctggtgggtttggatcgtcttcaggacttgctcttggtcagattgaaaaacaataagcttcaggaatcttaaagatctgtagataatgttccagccaaacatgatggaaggtcagcttcaccgtctagacatgacacaaaacacacctgaaggcgacatggctcggatcagagatgatgaatttgatagtaccaacactaaatcaggcagtgagaaccaagatggtgcatccggtgatgatcaagatccacgccccaaaaagaagcgttatcatcgccacactcagcatcagatccaagaaatggaagctttcttcaaagagtgtccacacccagatgacaagcaaaggaaggagttaagccgagaattagggttagagccattgcaagtcaaattttggttccaaaataagcgcacccaaatgaagacccagcatgagcgccatgaaaacacacagcttcgaaatgagaatgaaaagcttagggctgacaacatgcggtacagagaagctcttagcaatgcctcgtgtcctaattgtggagggcctactgccattggagaaatgtcctttgatgaacatcatttgagactggaaaatgccagattaagagaagagattgaccgtatttcagcaatcgctgctaagtatgttggcaagcctgtggtgaactatccacttatatcggctccgatgcctccacgtccacttgaccttggtgttgggaattttggtggacagccaggcattggaggggagatttatggagctggagacctacttaggtcgataactgctcctactgaggctgataagcccatgataattgagcttgcagttgcagccatggaggagctagttagaatggcccaaatggatgaacccttatggatgggtagccttgatggaacaaatgcagtattagatgaagatgaatacgtaaggatatttcctcgtggtattgggcctaaacctactggttttaaatgtgaggcttcaagagagtctgctgttgttatcatgaaccacatcaaccttgttgagtatctcatggatgtgaatcagtggtctacattgttttccggcatagtctcaagggctttgactttggaagtgttatcaacaggagttgcagggaactataatggtgccttgcaagtgatgacggctgaatttcaacttccaactccacttgttcctacccgagaaagttactttgtgaggtactgtaaacaacatgccgatggtacttgggcagtggttgatgtttcattggacaatttacgccctagtccgggagctaggtgtcgaaggaggccatctggatgtttgattcaagaaatgcttaatggatactccaaggttacatgggttgaacatgtagaggtggatgatagaggtgttcataatctatacaagcaacttgttagctcaggacatgcattcggggcaaaacgatgggtggcaaccctagatcggcaatgcgagcgccttgccagtgccatggcaacaaatattcctgctggcgatgttggtgtgattactaatcaagaagggagaaagagtatgatgaagctggcagagagaatggtgataagcttctgtgctggagtgagcgcctctactgctcatacttggactacactatctggaactggagctgatgatgttagggtcatgacaaggaagagtgtagatgatccagggaggcctcctgggattgtgcttagtgctgcaacttccttctggcttccagttcctccaaaaagggtttttgattttcttcgtgacgagagcactcgaaatgagtgggatattctatcaaatggtggagttgtccaagaaatggcacacattgctaatggccgggatacaggcaattgtgtatctctacttcgagttaatagcgcgaattcgagccagagcaacatgctgattttacaagagagttgcgctgatcaaacagcctctttcgtaatctatgcaccggttgatattgttgcaatgaacgtcgtacttaatggaggcgatccagactatgtagcacttcttccttcagggtttgctgttcttcccgatggaactggagcgcatgtaggaggcatggaggaggctgcaggtggatctcttctaactgttgcattccagattttggttgattcagttcctacagcaaaactatctctcggctcagtggcaactgttaacaacttgattgcctgcaccgtggagaggattaaggcttctttatcatgcgaatctgcatgaatttgaaggttaatttagagttcattaaccagaggaggaaaaaagaggggaaatttgagaaaaacacaaagatggtggccattttggcttttatagaagaagattaatgggagaagtcaagagcgcaccttgcatgcctcatggtttgcgataagggaaagactactagttagcaaccaaagcataccatgggggatcagaaaggacgttagaggttcgggaattgacttcgccaaacaaagtaaaaaggaaagaccttaaaatattaatccaaggttgaactactgctccttttccccttctttaacttattagttagggttttgtgccccgatagtacttcaagttttatctgctctctagatctctctttttccctcctctacttgttaatttgtttgtgttttgaagctcacacctcaagagcttttggaatagacttcctttgttaagccttgttctctctttgaatttgttataattagtctccttttgatttgtcttggctatgtttaaacttgggtttactttctcaaaatgctgcaatcttgagtgattatcaatatcaa

SEQ ID NO: 8292 - DNA, 3323 bp, Gossypium raimondii
attgcaccctctcaatacgctttgcattaactctttggcagccacaattttctccatttcttcactctatcttcttcatcttcatcttcttcttcttcttctcctttatcttctgcaacttcatctccttcgtatgtcactttgttcctacacctacgccccttaaaacctacttcttatatatacctttatagctcatacggtaaagcctgctttcgcaggaaaaccattagctacaggtaacgagggctggaagcagatccgtatctcctcctttccctgtggcttttcgagggttctactttattagacatagccgacgaacggaaaaggaaagagagttggtttggagactgacaaagaaggcatagttggattctccgtgatcttggttggaacgttacatatgaggggaatttttcaaaatcgtcaacatttcaacattcttcttctatagattctctcctgctcctacattggcacggcttttgggattctgaaacatcatgccagccggagtaatgatcccggcaagaaacatgccctcgatgatcaccggaaacgggagcgttagtggttatggaacatcctcaggacttactcttggtcagataatgttccagcagcctaacaacgtgatggaaggtcaactccaccctcttgagatgacccaaaacgcttctgaaagtgaaattgctcgaatgagagacgaagaatttgacagtacaaacaaatctggtagcgaaaatcatgaattaggtggctctggagacgatcaagatcctcgtcccaacaaaaagaagcgttatcatcgccatacccagcatcagatccaagaaatggaggcatttttcaaagagtgtccacacccagatgacaagcaaaggaaggagcttgggcgtgagttagggttagaaccgttgcaagtcaaattctggttccaaaataagcgcacccaaatgaagactcagcatgagcgtcacgaaaacacacagctgcgaactgagaacgagaagctaagggctgacaacatgagatatagggaagctttgagcactgcttcatgcccaaattgtggaggtccaactgctgttggacaaatgtcatttgatgaacatcatctcagacttgagaattctcgattgagggaagagattgatcgtatatcagcaatagctgcaaagtatgtgggcaagccagtggtgaactttcctctactttcatctcctgcgcctcctcgaccatttgatttcggttcacaacctgtcactgaggagatgtatggtgttggggatcttctcaggtctattagtgcaccttctgaggccgataagccaatgattattgagcttgcggtggcagctatggaggaactggttagaatggctcaggtgggggaacctttatggatgaccagtcttgatggtaccacctgtatgctgaatgaagaagagtatattaggacttttcctagcggaattgggccaaaacctactggctttaaatgcgaagcttcaaaagaaactactgttgttatcatgaaccacattaaccttgttgagattctcatggatgtgaaccagtggtcaactctgttttcgggaatagtttcgaaggcttcaactttggatgttctctcaacaggagtagcagggaattataatggagcccttcaagtgatgacagctgaatttcaagttctttcacctcttgttcccactcgtgagagttattatgtaagatactgcaaacagcatgcagagggaacttgggctgtggttgatgtttccttggatactatacgccccagtcccactgtgagatgcagaagaagaccatctggttgcctaattcaagaaatgcccaatggctactcaaaggttacatgggttgagcatgtagaagtggacgatggaggtgttcacaatctgtacaagcaactggtaagctccggccatgctttcggagcaagacgatgggtttctactttagatcgacagtgtgagaggcttgcaagtttaatggcttctaacattcccaccggcgatgttggggtgataacaaatcaagatgggagaaagagtatgctgaagctagctgagcgaatggtaatcagtttctgtggaggagttagtgcctctacagcacacacgtggacgacattatcgggaactggggctgatgatgtaagggtgatgacccgaaagagtgtagatgatccaggtagacctccagggattgtgcttagtgctgcaacgtcgttttggctccctgtttcacctaagagggtttttgatttcctcagagatgagcattctcgaagtgagtgggatattctgtctaatggcggagctgtccaagaaatggcacacattgctaatggtcgggatccaggcaattgtgtttcactacttagagtaaatagtgcaaattcaagccagagcaacatgctgattttacaagagagttgcactgatccaacagcctcttttgtgatctatgctcctgttgatattgttgcgatgaatgttgtcctaaatggaggggatccggactatgttgctcttcttccctcgggtttcgcaatactgcctgatggaatgactgtgactgacgtaggaatggctgattccggcgggtctagtggatctcttctaactgttgcatttcagattttggtcgattctgtgccgacggcaaaactttctctcggatccgttgcaacggtaaacaatttgattgcatgcaccgttgaaaggataaaggcatctctgtcatgcgataatgcatgaacttaccacagctttaaatcgtagctatcttagctagagattaacttaagcagtaaaaaagggaaggtaaattaacattaagaacgatggggttgaggaattcgatcttggaattatagaaaaggaggggagaagtcaagaacgcaccttgcatgagcctctttgacatgttggacttttgtttggggagccaagaaactgaaataagcaaattcatcatttgttcaagagttagaggttcgggaattgacttcccccaagaaaaaaagtgaatgcaaaaacttcatatatagacctttattgtaaaagggggattttaacttaatgtttagggatttaaatttttgtacaagtaattggatttctagttcccttttaccttcttccccttcaattgattgtgtttcttgaatgaaagtattttgaatgtttgtattactgttcgggaagattaaaatttttatggtcatcctcaacaatgttatctttatgtttgacttatattcttttccaaagctgcagtatacctta

SEQ ID NO: 8293 - DNA, 2865 bp, Eucalyptus grandis
agaggatataatcagtatttgcttcacttttggaactagggtttctagcttcttcgttaacatgccagctggaatcatgattccggcaaggaacatgtcgtcatcgccgatgatcggatccaatggaaatgccagtgggtatggatcgtcttccgggctcaccctcggtcagccaaacatgatggaaagccttcatcatcatcagcttcaccaccccttagacatggctcatcagaccccgtcagagagcgaacttgctcggctccgagatgaagagttcgagattagcacaaagtcggggagcgaaaaccaggaaggtcaatctggagacgacatgcaggatcttcagcgtcccaataagaagaagcgataccatcgtcacacccagcatcagatccaagagatggaagctttttttaaggaatgtccgcatccagatgacaagcagaggaaggaactcagccgtcaattaggcttagagcctttgcaagtcaagttttggttccaaaacaagcgcactcaaatgaagacacagcacgagcgcggcgagaacacgcagctccgagcggagaatgacaagcttagggccgacaatatgaggtacagggaggcactaagtaatgccacatgtcccaactgtggagggccgacagccatcggagagatgtcattcgatgaacaccacttgagattggaaaatgcacgtctaagagaagagatcgatagaatttcagctatcgctgccaagtatgtgggcaagccagtggtgaactatcctcttctttccccttcggctccacctcgtccacttgacctcggagtcggaggttttgggggtcaatctagcgtaggaggagaaatttatggagctggagaccttctcaagtcaattggcgccccgacagaagccgacaagccaatgatcattgagctggcggtcgcagccatggaggaattgatcaggatggcccagatgggagagcccctctggagtgagagcttggatggcaattcatcaagtgtgctaaatgaagatgagtacatgaaaacatttcctcggggtatcgggccaaagcctgctggatttaacaccgaagcttcacgagaaagtgctgttgtcattatggatcacatcaaccttgttgagattctcatggatgtgaatcaatggtcgacagttttctccagcattgtctcacgagctgcaacattggaagtactatcaacaggagtagctggcaactacaatggagctttgcaagtgatgacagctgaatttcaagttcctacaccacttgttccaactcgcgaagtctactttgttcggtactgtaaacagcacggtgatggggcttgggctgttgttgatgtttccttggacaatgtacgcccaagcccgattgtcaggtgccgaagaaggccttcaggatgtgtaattcaagaaatgccaaatggatattccaaggttacatgggttgagaatgtggaagtggatgatagaggagtccacagcttatacaagcagcttgttaattctggtcacgcccttggggctaaacggtgggtcgccaccttagatagacaatgtgaacgccttgccagtgccatggcaacaaatattcctaataccgatgtcggagtgataacgagtcaagaaggaagaaagagcatgctaaaactagccgagagaatggtgataagcttctgcgccggagtcagcgcatctacagctcacacatggacgacattatcagggacaggtgccgacgatgtgagggtcatgaccaggaaaagtatagacgatccgggtagaccccccggtatagtactgagtgctgcgacttctttctggcttccggtgcagccaaatagagtcttcgatttcctccgtgatgagaattctcgaagcgagtgggatattctctcgaacggaggggtggttcaagaaatggcgcatatcgcaaatggcagggacactggcaactgtgtatctctactacgagtaaatagtgctaactcaagccaaagcaacatgctgatcttgcaagagagttgcaccgactctgccggttctttcgtaatttacgctccagtggatatcgtcgctatgaatgtggtactgaacggtggggatccagattatgtcgcgcttcttccttcagggtttgcaatactgcctgatggttcggccatgcaaggtggcaatgatcaacagggagtgggatctggtggtgggtctctcctcacagtggcattccagattctggttgattcagttcctactgctaagctctctcttgggtcagttgcgactgttaacaatttgatcgcttgcactgtcgagaggatccgggcttcattatcgtgtgaaagtgcataactctgcagtctaatgtccaggagccgaattgcagtgctctgcagatgtaggacatcacagaagcaacgttaagaaagaactcgcagcttttgatgttcaagcagaaacatcagcttatatcgaatttggagaagtcaagatcgcaccttacttgcaaggattaaggggttcgggtattgacttcccaggaaaaagtgaaggcagggaaactaacacgaaacattacatttcctgagtttcgacttctcttttgaccaagttttgagaacttctgtagtttaagctttagcttagagcggtagtggtaaagttttcagttgcgtgatccatcaaaagttcctttgggttatttttttcttgatcctctctcaaagtaaccccccactgcaactgtcaatgatatgaacaatactggtccatttgtttttctcactttttctctctgatgtgctaatgtccaagcaaattctaatttggctcctgaa

SEQ ID NO: 8294 - DNA, 2741 bp, Gossypium hirsutum
atagattctgtctcgctttgtacatcagcacataagaatcttcgaggataaaatatatactatatataaatcccaaggagccaaaacaaaaatacacacacacaccccagagtcaactttgtctctcactgctagagaatctaaagagaacgtagtctctctcacttaaatcaaaacacagatttaagaagtgtgaagaagctatctatatgtgaataaagatcgtttctggactatgccggccggtgtaatggttccggcgagaaacatgccgtcaatgatcagtggaaacgggaatattggtggcttcggaactatctcaggactttcccttggtcagcagcctaataacaacatgatggaaggtcagctccacccttttgagatgacccaaaacacttctgaaagtgaaattgctcgaatgagagatgaagaattcgacagtgcactcaaatctggtagcgaaaatcatgaaggtgtgtctggggaagatgatcaagatcctcgtcctaacaaaaagaagcgttaccatcgacatacccagcatcagattcaacaaatggaggcgtttttcaaagagtgcccacacccagatgacaagcaaaggaaggaacttgggcgtgtattagggttagaaccattgcaagttaaattttggttccaaaacaagcgcacccaaatgaagacccagcatgaacggcaagagaactcgcaacttcgagccgagaacgaaaagctaagggctgataacatgagatatagggaagctcttagcactgcttcatgcccgaattgtggtggtccaactactgtaggacaaatgtcctttgatgaacatcatctcaggcttgaaaatgctcggttaagagaagagattgatcgtatatcagcaatagctgcaaagtatgttgggaagccagtggtgagttatcctcttctctcttctcctatgactcctcgaccacttgatttcggttcacaaactggctccggagagatgtatggtgctggggaacttcttaggtcgataaatgcgcctgcggaggctgataagccaatgattattgagcttgccgttgcagctatggaggaactagttagaatggctcaagtgggtgaaccattgtggatgaccagtcttgatggctcaacctccgtgcttaatgaagaggagtatattaggacttttcctagaggaattggaccaaaacctaccggcttcaaaggcgaagcttcaaaagaaacttgtgttgtaatcatgaaccacattagcctcgttgagattctcatggatgtgcaacagtggtctactgtgttctcggcaatagtttcaaaggcttccactttggatgtcctatcaacagggattgcagggaactataacggagccctacaagtgatgacagctgaattccaagttccttcacctcttgttccaacccgagagagttattatgtaagatactgcaaacatcatgcagagggaacatgggctgtggttgatgtttcattggataatatacgccctaatccagcaatgagatgccgacgaagaccatctggatgtttaattcaagaaatgcccaatgggtactcaaaggttacatggattgaacatgttgaaattgacgatcgaggtgttcacaatctttacaagcagctagtaagttcgggccatgctttcggagccaaacgttggattgctactttggatcgacagtgtgagaggcttgcaagtctcatggctactaacattcctactggtgatgctggggtcataacaaaccaagatgggaggaagagcatgctgaagctagccgagcgaatggtgatcagtttctgtgccggagtgggtgcctcgacagctcacacatggacgacattatcgggaactggggcggatgatgtaagggtaatgaccagaaagagtgtggatgatccaggcagacctcctgggattgtgctaagtgctgctacttccttctggcttccagtttcacccaagagggtattcgatttcctcagagatgagaattctcgaaatgagtgggatattctttctaatggtggagttgtccaagaaatggctcacattgctaatggcagggatacaggcaattgtgtttcactacttcgagtcaatagtgcaaattcaagccaaaccaacatgctgatattacaagagagttgcactgatccaacagcttcatttgtaatctatgctcctgtcgacgttgttgcaatgaatgtggttctaaacggtggcgaccctgactatgtcgcccttcttccatcgggtttcgctattcttccggatgggagtagtgggagcactggaagcggcatggctgatgcgggtggcagctctggtggatcacttctaactgttgcgtttcagattttggtggactcagttcctactgcaaaactatctcttggatcggttgcgacagttaacaatttgattgcatgtacggttgaaaggataaaagcttctctatcatgcgagaatgcatgaactggcacagccttcatggtttaggtaccaagaaaagggaaggtaattaaattaagaagaatggtgattgaggaattttggaattttagaatatgggggagaagtcaagagcgcaccttgcatggtcatgtgtttaagagttagaggttcgggatttgactttcccaagataaaagaaatatttactaccagcaaacaatgacctttattttatttgaagtag

SEQ ID NO: 8295 - DNA, 3291 bp, Gossypium raimondii
ccttaccctccattaaatgcaattgcaccctcgcaatacgctctgcaataactctttgctaccacaaatttcttcatctcttcccccttttatctccccctcttccttccttctccaactccatctcctactcctgctttttgtgtatatctatatcactttcctgcttcacctcaccacctacttcttacaccattaaacctcaactccagtcacaactgccaaccacttcctcttcttcctggggagtttcttttgttaggcaaaatcccaagacagaaagggaagaagaagctggttttgagagatatgtagacagacaaggcatagttggattcccttagatcgtcgtcgggacattctgtctcgctttgtacatcagcacataagaatcttcgaggataaatatatactatatataaatcccaaggagccaaaagaaaaaacacaccagagtcaactttgtctctcactgcttgagaatctaaagagaacgtagtctctctcacttaaatcaaaacacagttttaagaagtgtgaagaagctatctatatgtgaataaagatcgtttctggactatgccggccggtgtaatggttccggcgagaaacatgccgtcaatgatcagtggaaacgggaatattggtggcttcggaactatctcaggactttcccttggtcagcagcctaataacaacatgatggaaggtcagctccacccttttgagatgacccaaaacacttctgaaagtgaaattgctcgaatgagagatgaagaattcgacagtgcactcaaatctggcagcgaaaatcatgaaggtgtgtctggggatgatgatcaagatactcgtcctaacaaaaagaagcgttaccatcgacatacccagcatcagattcaagaaatggaggcgtttttcaaagagtgcccgcacccagatgacaagcaaaggaaggaacttgggcgtgtattagggttagaaccattgcaagttaaattttggttccaaaacaagcgcacccaaatgaagacccagcatgaacggcaagagaactcgcaacttcgagccgagaacgaaaagctaagggctgataacatgagatatagggaagctcttagcaccgcttcatgcccgaattgtggtggtccaactgctgtaggacaaatgtcctttgatgaacatcatctcaggcttgaaaatgctcggttaagagaagagattgatcgtatatcagcaatagctgcaaagtatgttgggaagccagtggtgagttatcctcttctctcttctcctatgactcctcgaccacttgatttcggttcacaaactggctccggagagatgtatggtgctggggaacttcttaggtcgataaatgcgcctgcggaggctgataagccaatgattattgagcttgccgttgcagctatggaggaactagttaaaatggctcaagtgggtgaaccattgtggatgaccagtcttgatggctcaacctccgtgcttaatgaagaggagtatattaggacttttcctagaggaattggaccaaagcctaccggcttcaaaggcgaagcttcaaaagaaacttgtgttgttatcatgaaccacattagcctcgttgagattctcatggatgtgcaccagtggtctactgtgttctcggcaatagtttcaaaggcttccactttggatgtcctatcaacagggattgcagggaactataacggagccctacaagtgatgacagctgaattccaagttccttcacctcttgttccaacccgagagagttattatgtaagatactgcaaacatcatgcagagggaacatgggctgtggttgatgtttcattggataatatacgccctaatccagcaatgagatgccgacgaagaccatctggatgtttaattcaagaaatgcccaatgggtactcaaaggttacatggattgaacatgttgaaattgacgatcgaggtgttcacaatctttacaagcagctagtaagttcgggccatgctttcggagccaaacgttggattgctactttggatcgacagtgtgagaggcttgcaagtctcatggctactaacattcctactggtgatgctggggtcataacaaaccaagatgggaggaagagcatgctgaagctagccgagcgaatggtgatcagtttctgtgccggagtgggtgcctcgacagctcacacatggacgacattatcgggaactggggcggatgatgtaagggtaatgaccagaaagagtgtggatgatccaggcagacctcctgggattgtgctaagtgctgctacttccttctggcttccagtttcacccaagagggtattcgatttcctcagagatgagaattctcgaaatgagtgggatattctttctaatggtggagttgcccaagaaatggctcacattgctaatggcagggatacaggcaattgtgtttcactacttcgagtcaatagtgcaaattcaagccaaaccaacatgctgatattacaagagagttgcactgatccaacagcttcatttgtaatctatgctcctgtcgacattgttgcaatgaatgtggttctaaacggtggcgaccctgactatgtcgcccttcttccatcgggtttcgctattcttccggatgggagtagtgggagcactggaagcggcatggctgatgcgggtggcagctctggtggatcacttctaactgttgcgtttcagattttggtggactcagttcctactgcaaaactatctcttggatcggttgcgacagttaacaatttgattgcatgtacggttgaaaggataaaagcttctctatcatgcgagaatgcatgaactggcacagccttcatggtttaggtaccaagaaaagggaaggtaattaaattaagaagaatggtgattgaggaattttggaattttagaatatgggggagaagtcaagagcgcaccttgcatggtcatgtgtttaagagttagaggttcgggatttgactttcccaagataaaagaaatatttactaccagcaaacaatgacctttattttatttgaagtaaccctttttttcctttggaattattaactggcaccttttaatttctttttcctttttagattatgatttagttaaacttccttgaatattaaaaacaaaatgtttaatgcatttcacaatgcttttgtcaatgttatatttgtatttttatgctataaataaacaacacagcagaaaggctgattaagtgaaagaaattacattagg

SEQ ID NO: 8296 - DNA, 2994 bp, Fragaria vesca
gttctgattgaattctggtctggcaagaaaaccgtgtcctaaattgtcatcgactcaaccctatatatttgctctcctcggacactctctctacctcactgagtactaaaccagataggtttttgagtgagagatactctggcctttgcaaagacaaaactattttgtcagctctctgtctcttcttgttaacctgtgaaatttcacatttttctcaaaaccactgtcagagaatcaactctagctcaaagctttaaacgacccttcatatcaatctagctagccctacacaaaagaaccccccagaaatgcactgtgttttaaggtactagtctagggtttctgggtgttgaaatatgcccgccggtattatgattccagcgagaaatatgccttcgatgatgggaagcaatggaaatcttggtgggtatggatcatcttcaggacttactcttggtcagccagcaaacatgatggaagctggaggtcatttcggaaacccactggagatgatagctactcagaacacatcagaaagcgagctgaatgcacgtttaggtgatgatttcgacagtgctacaaaatctggcagcgagaacctggaaggaggtggctccggcgacgatggacaagaccctcgccctaacaagaagaagcggtatcaccgtcacacccagcatcagatccaagaaatggaagctttcttcaaggagtgtccacaccctgatgacaagcaaaggaaggaactgagtcgagagttaggtttggaacctttacaggttaaattttggttccaaaacaagcgcacccaaatgaagacgcagcacgagaggcatgagaacacaaaccttcgtaatgaaaatgaaaagctaagagctgataacatgagatatcgagaggcactgagcaatgcatcatgtcctaattgcggaggcccaacggctattggagagatgtcattcgatgaacatcatttgagacttgaaaatgcccgattaagagaagagattgatagaatatcagcaattgctgctaaatacgttggcaagccagtggggaactatcctcatatgtcttcaccagttccacctcaccgcagtccacttgatcttggagtgggaaacatgggaaccagtcctcacggcttcttattaaactcagacatgtatacctctggagacattatgcggtcaatcggtgcaccaagtgaggcagataagcccatgattattgagcttgcagttcaagcgatggaggagctaattcgaatggctcaaattggcgaacctttgtggatgaatagcattgatggatcaaccactgtgctcaatgaggatgagtatattcgaacatttcctcgaggaattgtaccaaagcaatctggattcaaatgtgaagcttcgcgggagagtgctgttgtcattatgaaccataataaccttgttgaaattctcatggatgtgaatcaatggtcaactgtgttttcggggattgtatcaagagctatgacactggatgtgctatcaactggagtagcaggaaattacaatggagcattgcaagtgatgacagcagaattccaagtaccttctccattggttccaactcgagagagttattttgtgaggtactgtaagcagcatgtcgatggcacttgggcagtagttgatgtctccttggacaaccaacgcggctatacatctactctgaaatcctgtcaaagaagaccttctggttgtctcatccaagaaatgccaaatggatactcaaaggttacttggattgagcatgttgaggtggatgaaagaggtgttcacaatctgtacaagcaactggttaactcggggaatgcatttggtgcaaaacgatgggtggcaaccttggatcgccaatgtgagcgtcttgccagcgccttggcgacaaacatccctactggtgatgttggtgtgataacaactcaagaagggaggaagagcatgctgaagctggccgagagaatggttattagtttctgtgctggagtgagtgcatctaccactcatacatggaccacattgtctggaacaggggctgatgatgttcgtgtgatgacccgaaagagtgttgatgatccaggaaggcctccgggtattgtgcttagcgctgctacctcattctggcttcctgtgcctcccaaaaaggtgtttgagttccttcgtgatgagaactccagaaatgagtgggatatcctctccaacggtggcgttgtgcaagaaatggcgcacatagccaacgggcgtgacaccgggaactgcgtgtcacttcttcgtgtaaatagtgccaattctagtcagagcaacatgctcattctgcaggaaagctgcactgactcaacggcatcatatgtcatctatgcccctgtggacatagttgccatgaatgtcgttctgaatggcagtgacccggactatgttgccctgctaccatctgggttcgccatactcccagatggaactagcgggagcaacagcggggaagctgaatctggagggtccttgttgactgttgccttccagatcctggtggattcagttcccaccgcaaagctgtccctggggtctgtggcaacagtcaacaacctcatagcgtgcacagtggagaggatcaaggcctcattgtccttggacaacgaagcctgatcagctcttgctgttttaacacagtttttgtttatgtagggagctgaagggaaggaaaggaaagaagcaacgatggtggtgaggaattcagcttaaaccagaagaggggagaagtcaagagcgcaccctacatgatccttttcaaatgaagggattagagttagaggggttcgggaattgacttcctcgatgtcaaggacaaaaattaagctactaaaccttaattatttctgagttgtaattttctttcttttcaccttcgttaactttgtactcagaattatagtcttggctcaattaagcggggtttaagctc

SEQ ID NO: 8297 - DNA, 2796 bp, Trigonella foenum-graecum
gattcttactctttgacagattgaaaaacaacaaggtttgggaattataagatctgaagaacgctaaaaaagccgaaacaacgtttcagtcaaacctattggaagctggtcagttccatccattagagatgatgcaaaacacttcagaaagcgatgtgcctcgaatccgtgaagatgaatgcttcgaaagtggcacaaaatcttgcagtgaaaccatgaaggtggtgctgcttctggtgaagaccaagaacaaccacgtcccaaaagaaaacgttaccaccgccacactcagcaccagatccaagaaatggaagccttcttcaaggagtgtccacacccagatgacaagcaaaggaaggagttaagcagagagttagggctagagcctttgcaagtcaagttttggtttcaaaacaaaaggactcaaatgaagacacaacatgaacgttcagagaactcacagctaaaggcggagaatgataagcttaggactgataacatgaggtatagggaagcacttagcaatgcttcatgtcctaattgtggtggtcctacagctataggtgaaatgtcatttgatgaacaacatttgaggcttgaaaattcaaggctaagagaagagattgatcgaattacagcaatggcagccaagtacttaggcaaaccagtggcaaactattcaccatctctcccaccacgtcaagaaattggttttggcaaccaacaagggattggtactatggacatatatggaactggtggcgatcttttaaggtcaattagcgggccgaccgaagcagacaaaccaataataatagaattagctgttgcagccatggaagagcttattgggatggcacaaatgggggatccactttggttaagtactacacttgatggagctgctattgtgcttaatgaagatgagtatgttaggtcatttcctcgtgggattggacctaaacctaatggtttcaaatgtgaagcttctagggaaactagtgttgttatcatgaatcatgtcaaccttgttgagattctcatggatgtgaaccaatggtcaacagtgtttgctggtattgtttcaagagctatgactgtggaggtgttgtcaactggagtggcagggaactacaatggtgctttacaagtgatgacagcagagtttcaagtaccttcacctcttgtgccaactcgtgagagttactttgtaaggtattgtaaacaacatacggatgggacatgggctgttgtggatgtgtctttggataatctgcgccctagtccttcatctagatgtcgaagaaggccttctggttgcttaattcaagagatgccaaatggttactcaaaggtgacatgggttgagcatgtagaagtggatgaaaggggtgttcataatctatacaagcagcttgttagcactggccatgcatttggtgcaaaacgttgggttgcaactttagatcgacaatgcgaaagacttgctagctccatggccacaaacattcccaccgtagatgttggcgtgataacaaaccaagaaggaaggaagagtatgttgaagctagcagagagaatggtgataagtttttgtggtggagtgagtgcttcaacagcacatacatggacaacactatctggaacaggagctgatgatgtgagagtgatgacacggaagagtgtcgatgatcctggaagaccacctggtattgttcttagtgctgctacttctttttggcttcctgttccacctaaacaagtctttgatttccttcgtgatgaacactccagaaatgagtgggatattctttccaatggtggaacggtccaagaaatggcacacattgcaaatggacgagatacaggaaattgtgtctctctacttagagtaaatagtgcgaattcaagccagagcaacatgttgatactacaagagagtgtaacagattcaacaggctcatttgtgatctatgcaccagtagacattgttgcgatgaatgtggttctaaatggaggcgatccggattatgtagcacttcttccatcaggatttgctatcctccctgatggaaatggagcaactggaggagcaactggtggtggtggatcccttttgactgttgctttccaaatattggttgattctgttccaactgctaaactttctcttggatctgttgctactgttaatagtcttattgcttgtactgttgagagaatcaaagcttctttatctggtgaaagtgcttgagtttcagcttcatgactagtaatggattttgagattacaagaacaaagggagatgcattcaattgttggaaaaatcaaaaggtggtgtgaggaagtattaggcttaatttacaaaatggggagaagtcaagagcgcaccttgcaaagtcctttcttagaggtttaattaaggttcgggaattgacttccctagatatattaaatgttgaccttactacccccatcaactattcttagactaattacatatggttaggaccagtcttttctttagcttaggctttagttttgaattaaactcttttaattaatttccctatcatttaattgttatttatgtttttagaagagggaccatcattatgtgaggtttgaacctaagacacaccattgcttaatttctcattatatcctctttcctctttaggattttgaaatggatttgtttcattcctccaattgaaattgacatattttctcttgtgatttaatatttgtatttcttttatgacccaaatattgaatgatgaaggtggttgagt

SEQ ID NO: 8298 - DNA, 2757 bp, Trifolium pratense
gagtacatggggagtcaaacttgttggaagctggtcagtttcatccgttagagatgatgcaaaacacttcagaaagtgatgttcctcgaatccgtgaagatgaatgttttgaaagtgccacaaaatcttgcagtgaaaatcatgaaggtggtgctgcttctggtgatgaacaagaaccacgtcccaaaagaaaacgttaccaccgccacactcagcatcagatccaagaaatggaagctttcttcaaggaatgtccacacccagatgacaagcaaaggaaggagttaagcagagaattagggttagagccattgcaagttaagttttggtttcaaaacaaaagaactcaaatgaagacacaacatgaacgttcggaaaattcacagcttagagcagaaaatgaaaagcttagaacagataacatgaggtatagagaagctcttagcaatgcttcatgtcctaattgtggtggtcctacagctataggtgaaatgtcttttgatgaacatcatttgaggcttgaaaatggaaggctaagagaagagatcgatcgaatttcagcaatcgcagccaagtacgtaggaaagccggtggtaaactattcaaacatttcaccatctctcccaccacgtccagaaattggttttgttggtaacaaccaaggaattggtggtatggaaatgtatggaacaagtggagatattctaaggtcaatcagtggacctactgaagcagataaaccaataataatagaactagctgttgcagctatggaagaacttattggaatggcacaaatgggtgatccactttggttaagtactacacttgatggagctgttactgttcttaatgaagatgaatatgttaggtcgtttcctcgcggaattggacctaaacctaatggttttaagtgtgaagcttctagagaaactagtgttgttatcatgaatcatgtcaaccttgttgagattctcatggatgtgaaccaatggtcaacagtgtttgctggtattgtttcaagagctatgactgtggaagtgttgtcaactggggtggcaggaaactacaatggtgctttacaagtgatgacagcagagtttcaagttccatcaccacttgtgccaactagagagagttactttgtaaggtattgcaaacaacatactgatgggacatgggcagttgtggatgtttctttggataatttgcgccctagtcctacatctagatgtagaagaaggccttctggttgcttaattcaagagatgccaaatggctactccaaggtgacatgggttgagcatgtagaagtggatgatagaggtgttcataatctatacaagcagcttgttagcactggacatgcatttggtgcaaaacgttgggttgcaactttagatcgacaatgtgaaagacttgctagctccatggcaacaaacattcctaccgtagatgttggcgtgataacaagccaagaagggaggaagagtatgatgaaactagcagagagaatggtgataagtttttgtggtggagtaagtgcttcaacagcacatacatggacaacattatctggaacaggagctgatgatgtcagagtgatgacacgtaagagtgttgatgatcctggaagacctcctggtattgttcttagtgctgctacttctttttggcttcctgttccacctaaacaagtctttgattttcttcgtgatgaaaactcaagaaatgagtgggatattctttccaatggtggagtagtccaagaaatggcgcacattgcaaatggacgagataccggaaattgtgtgtctctcctaagagttaatagtgcaaattcaagccagagcaacatgttaatattacaagagagtctaacagattcaacaggttcatttgtgatatatgcaccagtagacattgttgctatgaatgtagttctaaatggaggagatccagattatgtagcacttcttccatcgggattcgctatccttcccgatggaaatgcaattggaaatggtgaaaatggaggacaagctgctggtggtggaggatcacttttgactgttgcatttcaaatattggttgattctgttccaactgctaaactttctcttggatctgttgcaactgttaatagtcttattgcttgtactgttgagagaatcaaagcttctttgtctggtgaaggtgctgcttgagttgagcttcatgactaatatgtggattttgagtttacaaggagaaaatggattatgcattgctttgaagaaaaatcaaaaggtggtgaggaacttaattaagcttaattaatttacaaaaatggggagaagtcaagagcgcaccttgcaaaatcctttcttagaggattattaattaaggttcgggaattgacttccctagatatagtaaatgttgagctaacacttatcaccttactaccctatcaatgtttcttaagactaaattagatataattagggtcactattttgtttaactaattaggctttagttttgaagtaaacctctcttaattatttgttttagatgtgggaccagcattgtatgaggtttgcacctaagacataccattgcttaatttctcattataactattttccctttttagaattttgaaatggatttatttcattcctctcttaagtgaaattgacatgttttgtcttattatttaatatatatatttgtattttaattgctatgacccaaatattgaatgatgaaggtg

SEQ ID NO: 8299 - DNA, 2636 bp, Trigonella foenum-graecum
aaaatcaagaagctgctaattcaggtgaagatcaagagcctcgtgctaagaagaaacgttaccatcgtcacacacagcatcagatccaagaaatggaagctttttttaaggaatgtccacaccctgatgacaaacaaaggaaggaactaagcagggaattagggttagagccattacaagtgaagttttggtttcagaacaaacgtactcaaatgaagactcaacaggagaggcatgagaatacttcacttagaaccgagaatgataagcttcgtgctgataacatgaggtttagagaagctctaagtaatgcttcttgtcctaattgcgggggaccaactgctatcggagaaatgtcgtttgatgaacatcatttgaggctcgaaaatgctcgccttagagaagagattgataggatcgctggcattgctgcgaagtacgcagggaaggcagtggtgagctatccactactttctccttcatcggttcctccacgtcctctagaactcggcattggtggttttggaggacaaccaggaatcggaggagaaatgtatggagccggagatcttcttagatcaataagtggaccaactgaagccgataaaccaatgataattgagctagctgttgctgctatggaggaactcattggaatggcacaaatgggtgatcctctttggttgactacacttgaaggaggttctatactcaatgaagaggaatatgttaggtcttttcctagaggaattggtccaaaaccagctggttttaagtgtgaagcttcaagagaaacttctgttgtcatcatgaatcatgttaaccttgttgagattctcatggacgtgaaccaatggtccacagttttttctggaattgtctcaagagcaatgacattggaagtgctatcaactggggtggcagggaactacaatggtgcattacaagtgatgacagcagaattacaagtaccttcaccacttgttccaactagagagagttattttgtaaggtattgtaagcaacatgctgatggaacttgggcagtagtggatgtttctttggacaatttacgccctagtccttctgccagatctagaagaaggccttctggttgcttaattcaagaaatgcccaatggctactcaaaggttatatgggttgagcatgtagaagttgatgatagaggtgttcataatctatacaagcaacttgttagttctggacatgcatttggtgcaaaacgttggattgcaaccttagatcgacaatgcgaaagacttgctagtgccatggcaacaaacattcccacagtcgatgttggcgtgataacaaaccaagatgggagaaagagtatgttgaaactagctgaaagaatgtgtataagtttttgtgctggagtgagtgcttcaacagctcacacgtggacaacactttcgggtaccggagccgatgatgtaagggtcatgacccgtaagagtgtagatgacccaggaagaccagctggtattgttctaagtgctgcaacttctttttggcttccagttccaccaaaaagagtttttgaatttcttagagatgaaaactcaagaagtgagtgggatatcctttccaatggtggagttgtccaagaaatggcacatattgctaatggtcgagatactggaaattgtgtttctctacttcgagtgaatagtgcaaattcaagccaaagcaacatgctgatattacaagagagttgcacggacacaactgggtcattcgttatatatgcccccgtagacatagtcgcaatgaacgtggttctaaatggaggggatccagattacgtagcgcttcttccatctggatttgctatacttccagatggaacaacaacaacaacaacatcacacggaggtggcggtggtggagaaattggacatggtggtggatctctattgacagttgcatttcaaatattggttgattctgttccaaccgcaaaactttctcttggatctgttgctacagttaataatcttattgcttgtactgttgagaggattaaggcttctttgtctggtgaagttgcttgaccatcaagtcatctaatgtataacataagttaagaagaagggcaaagggaaaagcattgcattttggataatgaggaggcaaagagaacttattaggcttatataaaaatgatggggagaagtcaagagcgcaccttgcaagatttccttctcagaacgatcaaccgatgactgagaggattaaggttcgggaattgacttccttagataatagtaaacgctactccttccgttttaaatataaacaaaaagtcaaatgtatttggttcaaatttaaactaaatacatttgactttttgatttatatttaagactataaggattaagagctaaaattaagatattctcttcaccttccaagactataaatctttagttgttagtgagatcaatcattttgagtatgattaagttgtagctttaatttgatgtaacctctcatgttccttctattgttatttgtgctttaattacatcatgcactaccatgcaaacagtggttaatttctcagtacatgatctgttttatccttttttaaggttttgaaatggatgatg

SEQ ID NO: 8300 - DNA, 2700 bp, Lupinus angustifolius
gttcagatcaaaaaacaataagcatttagaaatttaaagatcgatagagatatgttccagccaaatctgggtcagtttcacaacgcacttgacaacatggctcagaacacttctgaaagtgatatcccgagaatggatgagtttgacaggtctggtagtgaaaaccaggaaggtgcatctggtgaagaccaagaaccaagcgcaaagaagaagagacgctttcaccgccacacacaacaccagatccaagaaatggaagctttcttcaaggagtgtccacaccctgatgacaagcaaaggaaggaactgagccgggagctagggttagagccattgcaggttaagttttggtttcagaacaagcgcactcagatgaagacccaacatgagcgccatgagaacacccagctcagaaacgaaaatgacaaacttcgagctgaaaacataaggtacagggaagcttttagcaatgccgcatgtcctaattgtggtggacaaacttctattggagaaatgtcatttgatgaacatcacttgaggtttgaaaatgcaaggctaagagaagagattgatcgcatttctgcaattgctgccaagtacgtgggaaagccagtggtgaattactcaaacctttccccttctcttccttcacgcccattagaacttggaactggtggcggttttggtggccagccagctgggattggtggtggtgatatgtatggaggtggtggagattttctaaggtcaattagtgggcccactgaatctgataagccaataataattgagcttgctgttgcagctatggaggagcttattgggatggcacaaatgggtgagcctctttggttgaccacccacacccatgatggcacttccattgtgctaaatgaagatgaataccttaggtcatttcctagaggaattggcccaaaacccactggcttcaaatctgaagcttctagagaaactactgttgttatcatgaatcatgtcaaccttgttgagattctcatggatgtgaatcaatggtccacagtgttctctggtattgtctcaaaagcgatgactctggaagtgctatcaacgggggtagcagggaactgcaatggtgccttacaagtgatgacagcagaactacaagtaccttcacctcttgtgccaactcgtgagagttattttgtaaggtattgtaaacaacatgtggatgggacttgggcagtagtggatgtttctttggataatttgcgccctagtccttcacctagatgtagaagaaggccttctggttgcttaattcaagaaatgcccaatggctactcaagggtaacatgggtggaacatgtggaagtggttgatagaggtgttcataatctttacaagcagcttgttagctctggaaatgcatttggtgcaaaacgttgggttgcaaccttagatcgccaatgtgaaaggcttgctagtgccatggcaacaaacatacccacagtagatgttggtgtgataacaaaccaagaagggaggaagagtatgctgaaattggctgagagaatggttataagcttttgtggtggagtgagtgcttctactactcacacatggaccacactgcagactgggacagggtctgatgatgtaagggtcatgacccgaaagagtgtagatgacccaggaagaccccctggtattgttcttagtgctgcaacttctttttggcttccagttccacctaaaagagtttttgatttcctccgtgatgagaattccagaaatgagtgggatattctttcaaatggtggagttgtccaagaaatggcacacattgcaaatggacgagaaactggaaattgtgtatctttacttagagtgaatagtgccaattcaagccagggtaacatgtcaatattacaagagagttgcagtgattcaacatgctcttttgtaatctatgctccagtagatattgttgcaatgaatgtagttctaaatggaggagacccagattatgtagcccttcttccttcaggatttgcaatcctcccagatgggtcaacaacacatggaaatggcattggtgaaactgggtctggtgggtcacttttgactgtggcatttcaaatattggttgattcagttccaacagctaggctttctcttggttctgttgctactgttaataatcttattgcttgcactgttgagagaatcaaggctgcattatctcctgaacttcaagattaatacattctgagtaagaagaaggataaaggggatgtcattgtgtttattcaagaaatagagaagtcaagagcgcaccttgcataattccttctcaacacttcaaaagagtgatgaaaggattaaggttcgggaattgacttccctaattttagtaaatacttaatagcttcttaaattaagacccttattactcttcaccatttctatgacttattatattacagttaggtaagcagagatgacatactgtcatgtaaacttttatatttcttctcccttttagagattttgatatggatttgttaagctatattgacattcactaaactcaatcactccttgtttttgagatggttaagcaattttttttatcccaacagaatactaggaggactcaccctttgatgatgataaaaaagtgataaaatattgatgcacactttctagaagcttcca

SEQ ID NO: 8301 - DNA, 2309 bp, Euphorbia peplus
acatatctttatcgatgagtcgtggagtatacctacttattaccataaaagttgcctagaaaatcagtataaaaggagccacaaaatccttgttctagaaaaatatgccagccggagtaatgattccggcgagaaacacgccttccatgatctcctcatatgggaatgttggtggctttggatcttccggtcttaaccttactcagccaaatctgatggacactcagcttcaccatctggacatgactcataacacatccgaaagtgatttagtccggctcagggacgatgaatttgatagtatcaacacaaaatcgggtagcgataacccggaagggggctcgggtgacgatcaagatccacgccctaacaagaaaaagcgttatcaccgccatactcagcatcagatacaagagatggaatctttcttcaaagagtgcccgcatcccgatgacaagcaaaggaaggaactcagtcgtgaattagggcttgaaccgctgcaagtaaagttttggtccagaataagcgcacccaaatgaagactcagcacgagcggcatgagaacacacagctgaggactgagaatgaaaagctgagggcagataatatgaggtatagagaagcacttagtaatgcttcatgccctaattgtggagggcctactgctattggtgaaatgtcttttgatgaacatcacttgaggcttgaaaatgccagattaagagaagagatagatcggatatccgccattgctgcaaagtatgtaggaaagccagtggtgaattatccacttctttcttctccacttgctccacggcctctggaacttggggttggaaatatgagtgggattggtggtgaaatgtacggacctggcgacttgcttagatcaataggtgcaccgagtgaggcagataaacctatgattattgagctagctgttgcagccatggaggagttcattagaatggctcagatgggtgaacctttgtggctaactaatcttgatggaactaactgtatgttgaatgaagatgaatatgttagaatcttccctagaggaattggacctaagcctaccgggttcaagtgcgaggcttccagagaaacctgtgttgttattatgaatcatatcaatcttgttgaatatctcatggatgtgaaccaatggtccacagtgttctctgggattgtctcgaaagccatgacctatgaagtactatcaactggagttgcaggaaactataatggagctctccaagtgatgacagcggaatttcaacttccaactccactagtacctactagagaatcttactttgtaagatactgcaaacaacatgcagaaggaacatgggctgttgtggatgtttccttggacaacataagacctagtccggccgcaagatgtcggagaacggccctctggatgtcttaattcaagaaatgcctaacggatactcgaaggtcacatgggtggaacatgtggaagttgatgatagaggagtccattctctatacaagcaattagttagctcgggggacgcgtttggggcaaaacgttgggtagctacacttgataggcaatgtgaacggctagcaagtgcaatggcaagtaacattcctacgagtgaggtaggagtaataacaaatggagaaggaagaaagagcatgttgaagcttgcggagcgaatggtgataagcttttgtgccggagtgagcgcatcgacagcacatacatggacaacattatcaggaacaggagcagatgatgttagggttatgactagaaagagtgttgatgatccgggtagacctcccggtattgttcttagtgctgctacttctttctggctccctgtccctcctacccgtgttttccattttcttcgtgacgacaactcccgcagtgagtgggatattttatcaaatggtggacttgtccaagaaatggcacatatagctaatggccgggacactggcaactgtgtttctcttctaagggttaatagtgcgaactcaagtcagagcaatatgctgatattacaagagagctgcacagactcaacagcctcatttgtgatctatgcaccggttgatatagtagcgatgaatgtagtacttaatggaggcgatcctgattacgtggcacttcttccttctggattcgctattcttccggatgggactgccaccgcacaaggtggggcaaggaggagggattgtgggggaacccgagactggaggtggatctttattaacagttgcatttcagatattagttgactcagttcctactgcgaagctct

SEQ ID NO: 8302 - DNA, 2602 bp, Trifolium pratense
catccgttagagatgatgcaaaacacttcagaaagtgatgttcctcgaatccgtgaagatgaatgttttgaaagtgccacaaaatcttgcagtgaaaatcatgaaggtggtgctgcttctggtgatgaacaagaaccacgtcccaaaagaaaacgttaccaccgccacactcagcatcagatccaagaaatggaagctttcttcaaggaatgtccacacccagatgacaagcaaaggaaggagttaagcagagaattagggttagagccattgcaagttaagttttggtttcaaaacaaaagaactcaaatgaagacacaacatgaacgttcggaaaattcacagcttagagcagaaaatgaaaagcttagaacagataacatgaggtatagagaagctcttagcaatgcttcatgtcctaattgtggtggtcctacagctataggtgaaatgtcttttgatgaacatcatttgaggcttgaaaatggaaggctaagagaagagatcgatcgaatttcagcaattgcagccaagtacgtaggaaagccggtggtaaactattcaaacatttcaccatctctcccaccacgtccagaaattggttttgttggtaacaaccaaggaattggtggtatggaaatgtatggaacaagtggagatattctaaggtcaatcagtggacctactgaagcagataaaccaataataatagaactagctgttgcagctatggaagaacttattggaatggcacaaatgggtgatccactttggttaagtactacacttgatggagctgttactgttcttaatgaagatgaatatgttaggtcgtttcctcgcggaattggacctaaacctaatggttttaagtgtgaagcttctagagaaactagtgttgttatcatgaatcatgtcaaccttgttgagattctcatggatgtgaaccaatggtcaacagtgtttgctggtattgtttcaagagctatgactgtggaagtgttgtcaactggggtggcaggaaactacaatggtgctttacaagtgatgacagcagagtttcaagttccatcaccacttgtgccaactagagagagttactttgtaaggtattgcaaacaacatactgatgggacatgggcagttgtggatgtttctttggataatttgcgccctagtcctacatctagatgtagaagaaggccttctggttgcttaattcaagagatgccaaatggctactccaaggtgacatgggttgagcatgtagaagtggatgatagaggtgttcataatctatacaagcagcttgttagcactggacatgcatttggtgcaaaacgttgggttgcaactttagatcgacaatgtgaaagacttgctagctccatggcaacaaacattcctaccgtagatgttggcgtgataacaagccaagaagggaggaagagtatgatgaaactagcagagagaatggtgataagtttttgtggtggagtaagtgcttcaacagcacatacatggacaacattatctggaacaggagctgatgatgtcagagtgatgacacgtaagagtgttgatgatcctggaagacctcctggtattgttcttagtgctgctacttctttttggcttcctgttccacctaaacaagtctttgattttcttcgtgatgaaaactcaagaaatgagtgggatattctttccaatggtggagtagtccaagaaatggcgcacattgcaaatggacgagataccggaaattgtgtgtctctcctaagagttaatagtgcaaattcaagccagagcaacatgttaatattacaagagagtctaacagattcaacaggttcatttgtgatatatgcaccagtagacattgttgctatgaatgtagttctaaatggaggagatccagattatgtagcacttcttccatcgggattcgctatccttcccgatggaaatgcaattggaaatggtgaaaatggaggacaagctgctggtggtggaggatcacttttgactgttgcatttcaaatattggttgattctgttccaactgctaaactttctcttggatctgttgcaactgttaatagtcttattgcttgtactgttgagagaatcaaagcttctttgtctggtgaaggtgctgcttgagttgagcttcatgactaatatgtggattttgagtttacaaggagaaaatggattatgcattgctttgaagaaaaatcaaaaggtggtgaggaacttaattaagcttaattaatttacaaaaatggggagaagtcaagagcgcaccttgcaaaatcctttcttagaggattattaattaaggttcgggaattgacttccctagatatagtaaatgttgagctaatactattatcaccttactaccccttcaatcaatgtttcttaagactaaattagatatataattagggtcactattttgtttaacttaggttttaattttgaagtaaacctctcttaattaattgttattatttgtgttttagatgtgggaccagcattgtatgaggtttgcacctaagacataccattgcttaatttctcatcataactattt

SEQ ID NO: 8303 - DNA, 3323 bp, Medicago truncatula
gcaatgcaattaaaccaccatttaatgcaattgcaccctctcaatacgctcttcaattactcctcttccatttcttcctctatctgttccccactctctctctttcttccttcaatgctctctctctctctctaaaaaacaaccgtttctttcttctaacctttcacttttttattcccattttaaccttctcaaaaccagcatctctcttcttttctcaacaagtttatagtatagtcttaacatagatctatatcttcttctttcaactctttatatcattcatttctggttaagttttgtaagaaagagataatcctgaactgaaaaaggagcaaactcttgcagattataagcaagaaaaaagagaaagaagcatgctttatgtgataaagattagtaacgttggtgtgtttagatcaacatcatttttgattctaactctttgacagtttgaagaactacaacaaggcttgggaattataagatctgaagatagataagaagacagaaaacaatgtttcagtcaaacctcttggaagctggtcagttccatccattagagatgatgcaaaacacttcagaaagcgatgttcctcgaattcgagaagatgaattcgaaagtggcaccaaatcttgcagtgaaaaccatgaaggtggtgctgcttctggtgaagaacaaggaccacgtcctaaaagaaaacgttaccaccgccacactcagcaccagatccaagaaatggaatctttcttcaaggagtgtccacacccagatgacaagcaaaggaaggagttaagcagagagttagggcttgagcctttgcaagtcaagttttggtttcaaaacaaaaggactcaaatgaagacacaacatgaacgttcggagaattctcagttaagagcagataatgaaaagcttagagctgataacatgaggtatagagaagctcttagcaatgcttcatgtcctaattgtggtggtccaacagctataggtgaaatgtcatttgatgaacatcatttgaggcttgaaaatgcaaggctaagagaagagattgatagaatttcaacaatggcagcgaagtacgttgggaagccagtggtgaactactcaaacatttcaccatctctcccaccacgtacggaaattggtttcggcaacccacaagggattggtactatggacatgtatggagccagtggagatattctaaggtcaattagtgggccgaccgaagctgacaaaccaattataatagaattagctgttgcagctatggaagagcttattgggatggctcaaatgggtgatcctctttggctaagaactacacctgaaggagctgctaccgtgcttaatgaagatgaatatgttaggtcgtttcctcgtgggattggacctaaacctaatggtttcaaatgtgaagcttcgagggaatctagcgttgttatcatgaatcatgtcaaccttgttgagattctcatggatgtgaaccaatggtcaacagtgtttgctggaattgtttcaagagctgtgactgtggaggtgttgtcaactggagtggcaggaaactacaatggtgctttacaagtgatgacagcagagtttcaagtaccttcaccccttgtgccgactcgtgagagttactttgtaaggtattgtaaacaacatcctgacgggacatgggcagttgtggatgtgtctttggataatctgcgcccgagtccttcatctagatgtagaagaaggccttctggttgcttaattcaagagatgccaaatggttactcaaaggtgacatgggttgagcatgtagaagtggatgagaggggtgttcataatctatacaagcaacttgttaacactggagatgcatttggtgcaaaacgttgggttgcgactttagatcgacaatgtgaaagacttgctagctccatggcaacaaacattcccaccgttgatgttggggtgataacaaaccaagaagggaggaagagtatgttgaaactggcagagagaatggtgataagtttctgtggtggagtgagtgcttcaacagcacacacatggacaacactgtctggaacaggagccgatgatgtgagagtgatgactcgtaagagtgtcgatgatcctggaagacctcctggtattgttcttagtgctgctacttctttttggcttcctgttccaccaacacaagtttttgaatttcttcgtaacgagaactccagaactgagtgggatattctttctaatggtggagttgtccaagaaatggcgcacattgcaaatggacgagatactggaaattgtgtgtctctccttagagtaaatagtccaaattcgagccagagcaacatgttaatactacaagagagtgtaacagatgcaacaggctcatttgttatctatgcgccagtagatatggttgctatgaatgtagttctaaatggaggagatccagattatgttgcacttcttccatcaggatttgctatcctctctgatggaaatggaaatggagtcggcggtgaaactggaggaggagtaggagctggtgctggtggtggtggatcccttctgaccgtcgcttttcaaatcttggttgattctactccaactgctaaactctctcttggatcagttgctactgttaatagtcttatcgcttgtactgttgagagaatcaaagcttctttatctggtgaaagtgcttagttgagcttcaagactaataatggattttgagcttacaaggatgaagaggttgcattgcttatggaaaaaaaatcaaaaggtggtgaggaacttaattaggcttaatttacaagaatgggatgaagtcaagagcgcaccttgcaagatcctttctaagaggatttaattataaggttcgggaattgacttcccctaggtatattaaatgttgacctaaccctatgtgaccttactacccaatcaaaatttcttttggactaattagatatggttaggaccagtcttttgtttagcctaggctatagttttgaagtatcatttaattgttatttatgtgttttagaagcattatgtgaggtttgaacctaagacacaccattgctttaatttctcattataactcttttcctctttaggattttgaaattgatttgtttcattcctccaagtgatattgacgtatatttgtcttgtgatttaatatttgtagtatttcttttatgacctaaatattcaatgatgaaggtggttgagttaagtttagggatatagtctatcatataattaatagaggttaaatgtgaagtacctttaattaata

SEQ ID NO: 8304 - DNA, 3284 bp, Eucalyptus grandis
ccctctctccatctgtgcttccttcctccatcatcttcttcttcctctctctctctctctctctctctctctcgccaagaagaggattctgagttagggttccaccagagcacagaataaccggaggcagatctcccctcatcgttctatatatattttgccattttatttctcagagtaagtccagtagttctcatccaagtttagtttgcattcgtttatttttttggcaataatctctcatgaagttatcagtggcgatactttgcagaaatctttctatcttcttgtgcttgaatagacagatctaacaaagatttctacgcactacccttgattttttttgtttacatattatgttatccttgcttaatttcgccgttctctcccttcttgcagagcgtggatggaccaatataaaatgaaacgaaaacgaaacgcaacgttctatagttgaaaaagacgacataggaagagaaagagaaatagatagagagagagagagagatagagagagagggagagattagggggcgttacccttttcttttttcgttttcatttttcttcctgatttttggttgtgtcacagtagaggacagcgtcgagagaaatttgtcaacccttatctctgcacttttctcgtgtcttcggcacgtaagagtgaaacaggcatggactaactcgcctcccaaaaaaaaaaaaaaaaaaaaaagagaatcccataccttaattgtttttcaacggcaacacttagaccaaagtcaagacttgcctggctctctctctctctctctctctctctctctctctctctccccaacttgcagtgacctcatatttagtcccattctcagacctccagacacaatcttcaacaagttgcagccctaaaatcaccactgttcatacgaggaaaacccaagagaatactgagaaaaatgcctgcccgaatcatgattccagcgagagacatgtctcctatgatcggcatcagcggaaacgcaggcggcttcgggattgctcagattgaaaacccataagcgtttggttgggaatctttaaaggagatacctatgatggacatattccagcaaaacttgatggagggcggtggtggtccaccgcttcaccctctagacatggtgcagaatccgtcggagagcgagcttgctcgcctccgggaggacgacttcgatagcaccaagtctggcagcgacaaccatgaggagccgccctccggcgacgatctgcaggatgagcgccggaagaagaagcgctaccatcgtcacacccagcaccagattcaagaaatggaagcatttttcaaggagtgtccacacccggatgataagcaaaggaaggaactggggcgtcaattagggcttgagcctttgcaagtcaagttttggttccaaaacaagcgcactcaaatgaagacccaacatgagcgccacgagaacacgcagctccgcagcgagaacgagaagctccgggctgataacatgaggtaccgggaagcgctcactaacgcttcctgtcccaactgtggaggcccgactgccataggagagatgtccttcgatgaacatcacttgaggcttgaaaatgcacgtctgagagaagagattgataggatatcagcaatagctgcaaaatatgtaggcaagccgatagcgaactaccctcttcttccttcttcggtccctcctcgcccacttgagcttggttttggaagtttctcgggccagtcaggtgtcgggggtgacatttatggcagcggggacttattcagatcaatccctgcaccaactgaagccgagaagccgatgattatcgagctggccgtggcggccatggaggaactaatccgaatggcgcaggagggagagcccatgtggattgcaggacccgatggctcttcaagcgtgctgaatgaagacgagtacattcgcgcatttcctcgtgggatcgtaacaaaccccaccggatttaagcgcgaagcctcacgacaaaccggggtcatcatcatgaatcacatcaatcttgttgagattctcatggatgtgaaccagtggtccactatattctcaagcatcgtgtcaagagctatgactttggaagtactatcaactggggtggcagggaattacaatggagccttgcaagtggtgacggctgaatttcaagttccgtcgccgcttgttccgactcgggaagtttatttcgtccgctactgcaaacaacatagggatgggacttgggcagtggttgatgtttctttggacactttacgcccaaacccagcagttcgatgccgcaggaagccttcaggatgtctaattcaagaaatgccgaacggatactctaaggtcacatggcttgagcatgtggaagtagatgatagaggagtgcataacctatacaagcaacttgttggctctggccatgctttcggggccaaacgctgggttgctacgttagatcgacaatgtgaacgtctcgcaagtgccatggcaactcatattcctagcggagatgttggtgtcataacgagtccggaagggagaaaaagcatgatgaagctggctgagaggatggtaataagcttttgtgccggagtcagcgcatctacagctcaaacatggacgacattatctggaaccggagcagacgacgtgcgtgtgatgactcggaaaagtgtggatgatccgggcaggcctcccggaatagttctgtgtgctgccacttccttctggctgccagtttcccccaagcaggtcttcgatttccttcgtgacgagaattctcgaagtgagtgggatattctctcaaatggagggattgttcaagaaatgggtcacatcgccaatggccgggacaccggcaactgtgtgtctctgttgcgagtaaatagtgcaaattcaagccaaagcaacatgctgatattgcaagagagctgcactgatgcgacaggctctttcgtggtatatgctccggttgatatcgtcgcgatgaatgtggttctaaatggcggagatcccgattatgtggcacttcttccctcggggttttccattcttcctgatggctcgcaaggcagtggcgaagtggcatccggtggatctctcttgactgttgcatttcaaattctggtcgattcagtcccaactgctaagctttctctgggatcggtcgcaactgttaacaatttgattgcttgcactgttgagaggattagggcttctttatggtaagtcaaaaatcatctcatctctttcttt

SEQ ID NO: 8305 - DNA, 1481 bp, Glycine max
aaaatatttacaaaatgaaagaaatttaaattaagacaattaaaatattgtatatttgaatttcctaaaaaaaaatttaaatccttcatctaaacacaatgttaaactatatgtgtaaagcgtacaaatatattttttcatatatccgtttcccaccaatttagaattcgaatcgtatcccatgtgtctaaaagtctcaattttccctccacaatttaaatgtccctctaaaccaaatcaaatcaaagctacgctcctaatctcaaaatccctctataaatattgaatgaatgccttccctttttctcataccaaactatggcttcttcttctccttcgtccctctcactggacactgccaaagacctttcccactcgtttagtgaggttcatgtcatcatcggtcccatgttcgctggcaagacaactgcccttcttcgtcgcatcaaatccgaactcaacgctgccaataatgtggcgttgttaaaatcgagcaaggatacaagatatgcaattgactcggttgtgacgcacgatgggattaaatttccttgttgggcgttaccggatctgttgtcgttcagagaaaaatacggagaggatgcttatcaaaagttggatgtgattggcatagacgaggctcagttttttgtagatctatacgagttttgctgcaaggctgctgatgaagatggcaaaaccgtaattgttgcaggcctggatggtgattacttaaggagaagctttggctcagtccttcacataattccacttgctgaatcagtgaccaaactaacagcacgttgtgaactgtgtggcaaacgtgcttttttcaccttgaggaagacagagcagagagagactgaactaattggtggagctgatgtgtatatgccggtttgtcgccttcactacatcaacagccaagttgctgagaggagtgttctcgaatctgaaaatgagaaaactgattcccttcttgaggcagctacagatgtttaagggttattgggaaattggcttgtatgtggcctatcatgcctttgttcgactgagacaggcataaatgaatctaacttaatctattagtttttagagtttaatatataagtattaatacggtaaaatagttttatatttttatttaataataaattactgtttaaattattttaaaatttagtaaattaattattttttataagttgtgattcgatgattttgtaattttttgcattattaatgtacaattttttttttcttgttttcatcacccttttgtatacgtacttgagtttgttaatgctcatttgctatgttacatgtttttccttggtgccttgtagaaaaattcgatgactctattgtctatcctttctttgacgtatccatccacttgaagtcaggaaactgctgaacaatatttaaaagcgagtcaaaaacagttgttaaaatattttttttaattggtttatgaattt

SEQ ID NO: 8306 - DNA, 858 bp, Glycine max
ccctttttctcataccaaactatggcttcttcttctccttcgtccctctcactggacactgccaaagacctttcccactcgtttagtgaggttcatgtcatcatcggtcccatgttcgctggcaagacaactgcccttcttcgtcgcatcaaatccgaactcaacgctgccaataatgtggcgttgttaaaatcgagcaaggatacaagatatgcaattgactcggttgtgacgcacgatgggattaaatttccttgttgggcgttaccggatctgttgtcgttcagagaaaaatacggagaggatgcttatcaaaagttggatgtgattggcatagacgaggctcagttttttgtagatctatacgagttttgctgcaaggctgctgatgaagatggcaaaaccgtaattgttgcaggcctggatggtgagtacttaaggagaagctttggctcagtccttcacataattccacttgctgaatcagtgaccaaactaacagcacgttgtgaactgtgtggcaaacgtgcttttttcaccttgaggaagacagagcagagagagactgaactaattggtggagctgatgtgtatatgccggtttgtcgccttcactacatcaacagccaagttgctgagaggagtgttctcgaatctgaaaatgagaaaactgattcccttcttgaggcagctacagatgtttaagggttattgggaaattggcttgtatgtggcctatcatgcctttgttcgactgagacaggcataaatgaatctaacttaatctattagtttttagagtttaatatataagtattaatacggtaaaatagttttatatttttatttaataataaa

SEQ ID NO: 8307 - DNA, 1043 bp, Phaseolus vulgaris
atcaaacccacgctcttcatgacagaaccgctctataaatatggagtgaagcttctcctattttctcgtgatcaacagaacccaaacaccccttttgtttctcaatggcttcttccttttccctctcaccagactccaaagccctttctcactcatctggtgaggtccatgttattgtgggccccatgttcgctggcaagaccactgcgcttcttcgtcgtatcaaatccgagctcaacgctgccaggaatgtggtgatgttgaagtcaagcaaggatacaagatatgcgactgactcggttgtgacgcacgatgggattaaatttccttgttgggcgttacccaatctgttgtctttcagagaaaaatatggccacgatgcttatcagaagttggatgttattggcatagacgaggctcagttttttgaggacctatacgagttttgctgcaaggctgctgatgaagatggtaaaactgtaattgttgcaggcctggatggtgattacttaaggagaagctttggctcagtgcttcacataattcctcttgctgattctgttaccaagttaacagctcgttgcgaactatgtggcaaacgtgcttttttcaccttgaggaagacagagcaccaagagactgaactcattggtggggctgatgtctatatgcccgtttgtcgccttcattatatgaacagtcaggttgctgagaggattgttctccaatctcaagctgtcaaaactgattcccttcttgagccaactgcagatgtttaatgctaattggaaattggcttgcatgtgttcccccaccatgcttcattcattggtcagactcatgttggtctgaatctcactaatgtatttgctttatcagccttctgtttatatttaaaagtcgagacctagaggttataacattgagacacattatgattgactttcattgacatatatggttggtcatggaacaagatatccttaactaatttagtatgatttgacgttgatgattttttaaattggttggttgttacccat

SEQ ID NO: 8308 - DNA, 908 bp, Vigna unguiculata
ctttcaatggcatattcttcttcttctctttccctctcaccagacaccaaagacctttctcacccatctggtgaggttcatgttattgtgggccccatgttcgctggcaagaccactgcgcttcttcgtcgtatcaaatctgagctgaacgctgtcaggaatgtggtgatgttgaagtcaagcaaggatacacgatatgcgattgactcggttgtgacgcacgatggggttaaatttccttgttgggcgttaccgaatctcttgtctttcagagaagaatatggccacgatgcttatcagaagttggatgtgattggcatagacgaagcacaattttttgaggacctatacgagttttgctgcaaggctgctgacgaggatggtaaaactgtaatcgttgcaggcctggatggtgattacttaaggagaagctttggctcagtgcttcacataattcctctagcagattctgtaaccaagttaacagcccgttgcgaagtatgtggcaaacgtgcttttttcaccttgaggaagacagaggaccaagagactgaacttattggtggagctgatgtctatatgcccgtttgtcgtatgcattacatgaacagccaagttgcttaaaggattgttcttcaatctcaaactgtcaaaaccgattcccttcttcagtcagctgcagatgtttaaggctcatcggaatttttcttgcatgcttcattgatgcatttgctttatccgccttctgtttatatttaaaagtttatgtatagatgcagtttcttcatgctcctttcttatcttttatgctacttatttgctttttctggaactcaggaaacagtgtaacaagtttaggcagttaattgaatgcatcttcaggattatttttcaaaaaaaaaaaaaaa

SEQ ID NO: 8309 - DNA, 1127 bp, Cajanus cajan
tcaaatcaaatcaaagccacgctcccaacccaattcctctataaatattgaataattgttgcgcctttttcattcaccaaaaccaaacacgcctttaaccactgcaactgtttcctctatggcttcttcttcggtttcattcgacgctgccaaggacacgtttggcgaagtccatgttattgtgggccccatgttcgccgggaaaaccactgcccttcttcgtcgcatcaaatcggagctcaacgccaaaaggagtgtgacgttgttgaaatcgagcaaggacacacgatacgcaattgactcggttgtgacgcacgatggggttaaatttccttgctgggcgttacccgatctcttgtcttttagagataaatatggccatgatgcttatcaaaagttggatgttattggcatagacgaggctcaattttttgatgacctttatgagttttgctgcaaggctgctgatgaagatggtaaaacagtaattgttgcaggcctggatggtgattacttaaggagaagctttggctcagtgcttcacataattccacttgctgattctgtgaccaagttaacagctcgttgtgagctatgtggcaaacgtgcttttttcaccttgaggaagacagagcagagagagactgaactaattggtggggctgatctctacatgcctgtctgtcgcctacactacatgaacaaccaagttgctgagaagtgtgttgttcaatctcaaaatgttaaaagtgattcccttcttgaagcaattgcagatgtttaaggggttgttggaagttggcttgcatgtggcctctaccatgtttaatttttcatagagccataattgaatctcaatgtttttcttatatcacccttctgttcatatttaattatatatatgtatttcagtttcttaaatcttaatgctccttcatgttatgttacttctggtgcctgccatttgggtggctctattgtttgtccttttcttttgacgtatctatctacttgaagtcaggaaactgcaaaacaagtgtaggggaattatttgaatgcagcttgatggttttccctttgtttatttgaatctgcatcttgaatcaatcgatccacatgttgccaaa

SEQ ID NO: 8310 - DNA, 955 bp, Glycine max
ctttttctctctctctagggtttcgaaaatgttctccggctcccagttcgacgccaccaccgccttctccggcggcggtttcatgtcttctcagccgtctaccctcaacgattcctctcccgcgccgtcaaaaagccgcgaaactcagggtttggtgccagtgacagtgaagcagataagcgaggcctctcaatccggtgatgaaaagtcgaatttcgtgatcaacggtgtagatctgaacaatgtaacactgcttgggatggtgtttgagaaagttgagagaaatactgatgtcaattttgttttggatgatggaacaggacgcatcaaatgtcgaagatgggttaatgaggcttttgacacaaaggaaatggaggcagtgatgaatggtatgtatgttcgtgtttatgggcatttgaaaagttttcaaggtgttaagcaacttgtcaccttctccgccaggcctgtcacaaattttgatgagatcccttttcactttattgattgcatacataaccatcttcgctccaaaataaagatggaaggaatcacttcttcaaatccttcatctggctcatctttgaacactcctggcaaaagtgcaccaaatggatctcaggcaccatcatcaaatccagtaagtgcacagcatagcgtggatggacttaagggtattgataaattgattatggactacctggagcagcattcagatatgtcagatggacgtggaatacatgttgatgaactatcacgggagctcaagcttccaatggaaaagatcaagttgtcgttgaagactcttgcagatgatggagaaatatactccaccatagatgacgaccattacaaaaaagcttgatattttatgtaatctgaggaatatagctaaggattaataggatatgaaccatgacctattttgataactttcgagatttgtagatatgtttct

SEQ ID NO: 8311 - DNA, 1153 bp, Glycine max
gaaaaagggaaacatccttggcgggaatctacataaaaaggaaacccacttcacataaccaacaacattactccacttccgtttctttttctttttctctctctctagggtttcgaaaatgttctccggctcccagttcgacgccaccaccgccttctccggcggcggtttcatgtcttctcagccgtctaccctcaacgattcctctcccgcgccgtcaaaaagccgcgaaactcagggtttggtgccagtgacagtgaagcagataagcgaggcctctcaatccggtgatgaaaagtcgaatttcgtgatcaacggtgtagatctgaacaatgtaacactgcttgggatggtgtttgagaaagttgagagaaatactgatgtcaattttgttttggatgatggaacaggacgcatcaaatgtcgaagatgggttaatgaggcttttgacacaaaggaaatggaggcagtgatgaatggtatgtatgttcgtgtttatgggcatttgaaaagttttcaaggtgttaagcaacttgtcaccttctccgccaggcctgtcacaaattttgatgagatcccttttcactttattgattgcatacataaccatcttcgctccaaaataaagatggaaggaatcacttcttcaaatccttcatctggctcatctttgaacactcctggcaaaagtgcaccaaatggatctcaggcaccatcatcaaatccagtaagtgcacagcatagcgtggatggacttaagggtattgataaattgattatggactacctggagcagcattcagatatgtcagatggacgtggaatacatgttgatgaactatcacgggagctcaagcttccaatggaaaagatcaagttgtcgttgaagactcttgcagatgatggagaaatatactccaccatagatgacgaccattacaaaaaagcttgatattttatgtaatctgaggaatatagctaaggattaataggatatgaaccatgacctattttgataactttcgagatttgtagatatgtttctggatgaattgatcttttatgctcgaactaaaagaatcacttctgttaacgcttaatgatgttagattgctttttgaaaaaaatgtattttcaatttttttatttcttg

SEQ ID NO: 8312 - DNA, 1324 bp, Glycine max
cttcggcgaattggcactggtctctttgccgaacttcagcgttttggtttgggagggaaaattctaaaacctaaaaaatttcaatctcaatcaactcaacgtctgtgatcccaatcgatcacatttaataccacccttcaggattaggtagtaattccgttcccttgaataaataacatgagcaccacagtgcaaagaactccaagatccagcaggcattctttatttttccaggatttggcttcacctgtttctgcccgtagaggaaaattttcgagtccaggtcaagcagctgcagtatcttcactatggcgtgagaactttggtagttcagaccttcctccgcctcctgttttcaccttggaagacagatccgatttttctcctgaatcaggcatactagattatcaaatatcccctgaggctaagtcagacactagaactcccatccaaacttcaaataaggagttttcaactccactgaaaagcaaatctgaggccagcacatcttatgctttgagaggggtacaacaaaaccaacagggctcgccgggtttgagttggtggtcacctacaactgcaaagagtgttggggaacaagatgagaagggaagaagttcgccagttgagggtgtggttcagcctggtgctctgataactcttcctccaccgctggaagtggcaaggcctgaggttcaaagaaattctttgccagcagggaatctcaatgaggaagaatgggtaactgtgtatggattttcccccggtgatactaacatggtgttaagggagtttgaaaaatgcggtgaaattttgaaacatgttcctggtcctagagatgctaactgggtgcacattttgtatcagaatcgatctgatgcccataaagctctcaacaagaatggaatgcaaattaatggagtactaattgttggtgtgaaactgttggatcccatgcaacgccaagctttaaatgaaaggcttaagaatcagggatttatgccgttacctctagcctctgccagaaactcagaagtgagcacattgaaagctccttctcgaccttactatctgcagaatggcaactcaactgcacggcagactggaggaaccattgcttccccaacaaaatcattggtgtccaagatcatggacttgatgtttggagtctaaattagctgttctgctgaatcaaactaatatctttctgtttgttgtaagcaatgattttattctctcgattattcatactttttgaagtgttcggcatgtcttgttcattgaattgagttggaatgtttactctatggatctcaattgtcag

SEQ ID NO: 8313 - DNA, 1477 bp, Glycine max
gaattagggttttgaaatgaaaattttaaataggacttgttattacaaaatacaattgcattgctccttcggcgaattggcactggtctctttgccgaacttcagcgttttggtttgggagggaaaattctaaaacctaaaaaatttcaatctcaatcaactcaacgtctgtgatcccaatcgatcacatttaataccacccttcaggattaggtagtaattccgttcccttgaataaataacatgagcaccacagtgcaaagaactccaagatccagcaggcattctttatttttccaggatttggcttcacctgtttctgcccgtagaggaaaattttcgagtccaggtcaagcagctgcagtatcttcactatggcgtgagaactttggtagttcagaccttcctccgcctcctgttttcaccttggaagacagatccgatttttctcctgaatcaggcatactagattatcaaatatcccctgaggctaagtcagacactagaactcccatccaaacttcaaataaggagttttcaactccactgaaaagcaaatctgaggccagcacatcttatgctttgagaggggtacaacaaaaccaacagggctcgccgggtttgagttggtggtcacctacaactgcaaagagtgttggggaacaagatgagaagggaagaagttcgccagttgagggtgtggttcagcctggtgctctgataactcttcctccaccgctggaagtggcaaggcctgaggttcaaagaaattctttgccagcagggaatctcaatgaggaagaatgggtaactgtgtatggattttcccccggtgatactaacatggtgttaagggagtttgaaaaatgcggtgaaattttgaaacatgttcctggtcctagagatgctaactgggtgcacattttgtatcagaatcgatctgatgcccataaagctctcaacaagaatggaatgcaaattaatggagtactaattgttggtgtgaaactgttggatcccatgcaacgccaagctttaaatgaaaggcttaagaatcagggatttatgccgttacctctagcctctgccagaaactcagaagtgagcacattgaaagctccttctcgaccttactatctgcagaatggcaactcaactgcacggcagactggaggaaccattgcttccccaacaaaatcattggtgtccaagatcatggacttgatgtttggagtctaaattagctgttctgctgaatcaaactaatatctttctgtttgttgtaagcaatgattttattctctcgattattcatactttttgaagtgttcggcatgtcttgttcattgaattgagttggaatgtttactctatggatctcaattgtcagaatatatggcattttaatatatcaatcttatggatggttatagtatagaagaacagtactcattagcctatgttttgagaaatgaga

SEQ ID NO: 8314 - DNA, 1499 bp, Vigna unguiculata
ggatacatagaattgctccttggggaggtggtctctttttgctgaacttcagcgttttggtttgggagggaaaataccaaaacatcaaaagttgagtctcaatcaactcaacatttgattgcattcaaattcatttccatataccaggtattaattcagttgttcgaaatataacatgagcactactgtgcaaagaactccgagatccggtagacagtctttatttttccaggatttagcttcacctgtttctacccgtagaggaaaagtttcaagtcctggtcaggcagctgcagtatctgcactatggcgtgagaactttggcagttcggaccttcctcctccaccagttttcaccttggaggacaggtctgatttttctcctgaatcaggcatactagattatcaagtatcacctgagattaagtcagacaccagaactcccatccaaacttctaatagggaattttcaactcctgggaaaagcaaatctgaggctagcacatcttatgctttgagaggggtacaacaaaaccagcagacctcaccgggtttgagttggtggtcacctgcaactgcaaagagtgttggggaacaagatgagaagggaaaaagttcaccagttgagggtgtggttcagcctggtgctttgataactctccctccaccgctggaagtggcaagacctgaggttcagaggaattcgttgccagctggcaatctcaatgaggaagaatgggtaactgtatatgggttttcacccggtgatactaacatggttttaagggagtttgaaaaatgtggtgaaattttgaaacatgttcctggtcctagagatgctaactggttgcacattttgtatcagaatcgatccgatgcacataaagctcttaacaagaatggaatgcaaattaatggagtactaattgttggtgtgaaactgttggatcccatgcaacgccaagctttaaatgaaagggttaacaatcagggatttatgcccttacctctaccctctgctagaaactcagaagtgagcacattgaaagcgcctactcgaccttactatcagcagaatggcaactccactgcacgtcagactggaggaaccattgcttccccaacaaaatcattggtgtccaaaatcatggacttgatgtttggagtctaaattagttgttcggctgaatcaaattaagtatatcattctgttttgttgtacgcaatgattttattttcttcgtgcaccttgaagaagttcggcatgtcttgttcattggattgagttggaatatttactctttggatctcaattgttagaatttgtggcattttagcgtatcaattttatcgataactacactacacagatcagtactactcctgtgttttgagaaacgagaacacaatatataactaaaatgcccatgcacttgagattttgggtagagcgtaatgatgtttgatttattcattttggaagtgtagttatgttcaat

SEQ ID NO: 8315 - DNA, 1572 bp, Cajanus cajan
ggcgttaacaaaagaagagagagagaaaatgagaattagggttttgaaatgtaaaatttaaatagaagcaaaagtgtttcgtattacaaatacaattcacattttccccttcggcgcggtggtctattttctcagcgttctggtttgggagggaaaattgtaaaagcccaaaaattgagtctgaatcgatcacattcacaactcaaccttcaattccacccaccaggatcagatattagttccagtcccttaaatagagaatataatatgagtactacagtgcaaagaactccaagatccggtaggcagtctttatttttccaggatttagcttcacctgtttctgcctgtagaggaaagttttcaagtcctggtcaggcagcagcagtatctgcactatggcgtgagaacacttccgaccttcctccacctcctgttttcaccctggaggacagatcagacttttctcctgaatcaggcatactagattaccaaatgtcccccgagcctaagtcagacaataaaactcccattcaaacatcaaatagggaattctcaactccagtgaaaagcaaatctgaggccagcacatcttatgctttgagagggttacaacaaaaccaacagggctcgccaggtttgagttggtggtcacctacaactgcaaagagtggtggggacagagatgagaagggaagaagttcgccagttgagggtgtggttcagcctggtgctttgataactcttcctccaccactggaagtggcaaggccagaggttcagagaaattctctgccagcagggaatctcaacgaggaagaatgggtaactgtatacggattttctccaggagatactaacatggttttaagggagtttgaaaaatgtggtgaaattttaaaacatgttcctggtcctagagatgctaactggatgcacattttataccagaatcgttctgatgcacaaaaagctctaaacaagaatggaattcaaattaatggagtactaattgttggtgtgaaactgttggatcccatgcaacgtcaagctttaaatgaaaggcttaacaatcaaggattcatgcccttacctctaccctctactagaaactcagaagtgagcacactgaaagctccttctcgaccttactatctgcagaatggaaactcaactgcacggcagactggaggagccattgcttccccaacaaaatcattagtgtccaagatcatggacttgatgtttggagtctaaattagatgttctgctgaatcaaactaatattgttctgtttgttgtaagcaatgagtttactcggttattcatacactatgtaagaagttcggcatgtcttgttcattgggttgagttggaatgtttactctggatttcaattgtcagaatttatggcattttaacattgcaatcatatggatgactatacaataaatcagtacttgttagcgtatgttttgagaagtgagaacataataatatataactacatgatgtaaatctgatcattgtccaggcagtagagattttggataagagcagaatgacgtttat

SEQ ID NO: 8316 - DNA, 1734 bp, Phaseolus vulgaris
tcacaatgaaaaatacaaggaaataaagaagagaaaggagaaattagggttttgaaatgaaaaatttaaaacgactaacagcactattacaaaatacatagaattgcccccttcgacggagcgctccctcttttgagcttcagcgttttggtttgggagggaaaataccaaaacctcaaaaatcgagtctcaagcaactcaacatttgtgatcacatttgattgcattcaaacccatttacatccaccaggtattaattccgttgttaaatatatagaccatgagcactaccgtgcaaagaacaccaagatccggtaggcagtctttatttttccaggatttagcttcacctgtttctactcgtagaggaaaaacttcaagtcccggtcaggcagctgcagtatctgcactatggcgtgagaactttggtagttcagaccttcctccaccacctgttttcaccttggaggacagatcagacttttctcctgaatcaggcatactggattatcaagtatcccctgagattaagtcagacattagaactcccgtccaaacttataatagggaattttcaactcctgggaaaagcaaatctgaggctagcacatcttatgctttgagaggggtacaacaaaaccaacaggcctcaccgggtttgagttggtggtcacctgcaactgcaaagagtggtggggaacaagatgagaagggaagaagttcaccagttgagggtgtggttcagcctggtgctttgatcacccttcctccaccgctggaagtggcaaggcctgaggttcaaaggaattctttgccaactgggaatctcaatgaggaagaatgggtaactgtatatgggttttcaccaggtgatactaatatggtcttaagggagtttgaaaaatgtggtgcaattttgaaacatgttcctggtcctagagatgcaaattggatgcacattttgtatcagaatcgatctgatgcacataaagctcttagcaagaatggaatgcaaattaatggagtactaattgttggtgtgaaactgttagatcccatgcaacgtcaagctttaaatgaaaggcttaacaatcagggatttatgcccttacctctaccctcagctagaaactcaggagtgaacacattgaaagcacctgttcgaccttactatccgcagaatggcaactctgcacgccagactggaggaaccattgcttccccaacaaaatcactggtgtccaaaatcatggacttaatgtttggggtttaaatgagctgttcggctgaatcaaactaaatattattctgttttgttgtaagcaatgattttactttcttcatgcaccttgaagaagttcggcatgtgttcatcggattgagttggaatatttactctttggatcccaattgttagaatttgtggcattttagcttatcatttttatggataacttcactacggattattactcctgtgtttgagaaacgagaccacaatatataacttaatgtcgatgtaaatctgatgattgctcgtgcacttcagattttggaatagagcatgatggtgtttaatttatgtagctcgatctgacgcagtgggaggaaggctttggttattgtagtctaggaacctatgctttccatgtgtgatgattttgtaaactatttttacaagtttttggtgtggtatggtttgatttcaggtactggagtttcaaggatgcacgt

SEQ ID NO: 8317 - DNA, 1658 bp, Cicer arietinum
gaaaaggaaaaacgaagagagaaaaggagaattagggtttagaaatgatatagcgtaatttaaaaaaataaaataaaaataaaaatacgattgtaagagagttatttgcttcaagtttcgggtttaggagggaaaatttcataaaatcctcaaattcagaatttcaatcggttcagttcagctattcaggaccttcaatacgatccgccaccatcaccaccagatataaactctattacttgaaatatatagtatattaatatgagcaccacagtgcaaagaactccaagatctggtagacagtcattatttttccaggatttagcttcccctgtttcttcccgccggggaaagtttcctagtccaggacagtcaggtgcaacttcttctctatggcgcgaaaactttggtaattcagaccttcctccgcctcctgtttttaccttggaagacagatcggatttttctcctgaatcaggcatactggattaccaaatatcacctgagactaagtcagacaacaaaactcctacccaaactccaaatagagaattttcgactccagcgaaaggtaaatctgaggccagcacatcttatgctttaagaggggtgcagcaaaaccaacagagctcaccaggtttgaattggtggtcaccggcaactgcaaagagtggcggtgaacaagaggagaaaggaaggagttccccagttgagggtgtggttcagcctggtgctttgattactcttcctccaccactagaagtggcaaggcctgaggtccagagaaattccttgcctgcagggaatctcaacgaggaagaatgggttacattatatggattttctccttgtgacactaatttggttttaagggagtttgaaaaatgtggtgaaattttgaaacatgttcctggtcctagagatgctaactggatgcacattttgtatcagaatcgatctggtgcacaaaaagctcttaacaagaacggtatgcaaattaatggggtcctaattgttggcgtgaaacccttggatcccatgcaacgtcaagctttgaacgaaaggcttaacaatcaaggatttatgcccttacctctaccctctggtagaaactcagaagcaagcacatcaaaagctctttctcgaccatattatccgcaaaatggaagctcaactacaaggcagactggtggtaccattgcttccccaacaaaatcattggcgtccaagatcatggatttgatgtttggagtctagattagctgttctggtgaatcaaactatatcattcattctgttttattataagcaatattttactcagttattcataccctctgaagagggtttgctgtgttttgttcattggatttgagttggaatatttactcttttggtcggattttatggcatcttagcattgcgatgttatgagtggctatgatccgcatttgctggccaaatgttatgagagatgggattataatatacggacataaatgagtctaaagttgatttgtttgattcatgtagtttatctcacttacattgttgtttttgttcatctcatatcagaaaaacttatgtggccttaaaacttgaaaggatgaacaggttatttgtatttggaagtcactaacggaaattttgaagatgaa

SEQ ID NO: 8318 - DNA, 1585 bp, Arachis hypogaea
acaaaacagtataatagaaaagagttgagacgttattgcaacggagcagctgagttgagctaaggagcgctttggtttgattttgggagggaaattttctaaaaccccccaaaaattggactcaaaatctcgtctcttctgaaatctgaatccattgcatcgctcttcaaccttcgctcccatatttccagctagtaatttgattctgcgagattaagaatataacatgagcaccacagtgcacaaaactccaaagtctggtagacagactttgtttttccaggatttagcctcgcccgtttctgccaggagaggaaagttttcaagtccgggacaggcagctgcagtatctgctctgtggcgtgagaattttggtggttcggaccttccacctcctcctgttttcaccttggaagacaggtcagatttttctcctgaatcaggcttaccggattaccaaatatccccggagtctaaatccaatattaggactccagttcaagcttcaaatagagaattttcaactccattgaaaagcaaatccgaggccagcacatcttatgtgttaagaggggtgcaacaaagccagcagagctcaccagggttgagttggtggtcacccacaactgcaaagagtgccggagaacaagatgaaaagggaaggagttcaccagttgagggtgtggttcagcctggtgctcttataactctccctccgcagctggaagtagcaaggccagaggttcaaaggaattctttgccagctgggaatctcaatgaggaagagtgggtgactgtttatggattttctccaggtgatactaatttggttttaagggagtttgaaaaatgtggtgaaattttgaaacatgttcctggtcctagagatgctaattggatgcatattttatatcagaatcgttctgattcccagaaagcccttaacaagaatggagtgcagctcaatggagtcctaatagttggtgtgaaacccttggatcccatgcaacgtcaagcattggatgaacggcttaaccatcagggatttatgcccttacctctaccgtctgctagaaattcagaatcaagtacgctgaaagcttcatctcgaccctactatctgcagaatggcaactcaagtgcccggcaaactggaggagccattgcttctccaacaaaatcattggtgtccaagatcatggatttgatgtttggagtctagatgagctgtaatggtggatcatactatatcattctgttttgtttttagcaatgggtgactctttcagctatacaaatgttgttaagaagtttggcatgcattctggatttgagttggaatgtttactctttagatgctagtgattggaatttatttcttcataatgtttcattcttattggataactataggtcaaagtctttgtagctatgtttttggaatatcatatattaactacaggttcatcaatggttctgtaaagctggccaatactctaggtatttgagattacggtggtcctgttaaatggtaaagggaatgaaaattgtagcctctaaaatcaaagaggatgcagcatgtgag

SEQ ID NO: 8319 - DNA, 1863 bp, Trifolium pratense
ttcattgctagagaacacaacactatacaacgttctgaattctgatcggagttgaaaaacgaaggggagaattagggttttgatttaggagggaaaattctaaaacccttaaattcacaatttcaattccttcagttccacattcagaattcaaaacccttcgtttcaactcgccactaccaccaagatattgactctattccctgtaagatataatataataatatgaacaacacggtgcaaagaactccaaggtctggtagacaatcattgtttttccaggatttagcttcccctatttcttcccgccggggaaagttttctagtccgggccagtcaggtgcatcttcttctctatggcgtgaaaactttggtggtaattcggaccttcctccgcctcctgttttcaccttggaagacagatcagacttttctcctgaatcaggcatattggattaccaaatatctcctgagactaagtcagacaataaaactcccgtgcaaactttaaatagggaattttcaactccagcgaaaggcaaatccgaggccagtacatcttatgctctaagaggggtgcagcaaaaccaacaaggctcgccgggtttgaattggtggtcacctgcaactgcaaagagtggcggtgaacaagaagagaaaggaaggagttctccagttgagggtgtggttcagcctggtgctttgattactctacctccaccactagaagtggcaaggcctgaggtccagagaaactccttgcctgcagggaatctcaatgatgaagaatgggtaaccgtatacgggttttctccatatgatactaatttggttttaagggaatttgaaaaatgtggtgaaattttgaaacatgttcccggtcctagagatgccaactggatgcacattttgtatcagaatcgatctgctgcacaaaaagctcttaacaagaatggaatgcaacttaatggagtccttattattggcgtgaaacccgtggatcccatgcaacgtcaagctttgaccgaaaggcttaacaatcaaggatttatgcctttacctctaccctctgctagaaactcagaagtaagcacatcaaaagctccttctcggccatattatctgcagaatggcaatgcaaccacaaggcagactggaggtaccattgcttccccaacaaaatcattggcgtccaagataatggacttgatgtttggagtctagattatctgttatggtgtaatcgaactgtaccatcctgttttattataagcaattttttactctttcagttattcataccctctgaagaggttcggcgtgttatgttcattggatttgagttggaatgtttacttttttgattggatttttggcatcttagcattgaaatgttatgaatggctatgatcagtacttggtgaccaaatgttttgagaaaacgggatcatcatacatgggtatgggatacaggttgattaatgttaatgtaaaatctgctcattgcgcagggcacttaagattttggacagaaatgaatgtaatgttgatttgtttcattcccatagttcatctacttggattgttgtttttgtttatgatgcacttgacattttgatgttcattcacatcagaaaaacttatctgcccttaaaaagttgatacaaaaacagtggatacttatttgtgtttggaaattattaactagttacttgctaattccaattgcaaacggtaaattgtttgaaacaacatataatcgttaagtatttatttcatggctgtgaagtttttgacacaatacttctttgaaggcttcgaaccaagattggattaatttcgagtttgggccctgtcttgaag

SEQ ID NO: 8320 - DNA, 1764 bp, Trifolium pratense
ttcattgctagagaacacaacactatacaacgttctgaattctgatcggagttgaaaaacgaaggggagaattagggttttgatttaggagggaaaattctaaaacccttaaattcacaatttcaattccttcagttccacattcagaattcaaaacccttcgtttcaactcgccactaccaccaagatattgactctattccctgtaagatataatataataatatgaacaacacggtgcaaagaactccaaggtctggtagacaatcattgtttttccaggatttagcttcccctatttcttcccgccggggaaagctttctagtccaggtgcatcttcttctctatggcgtgaaaactttggtggtaattcggaccttcctccgcctcctgttttcaccttggaagacagatcagacttttctcctgaatcaggcatattggattaccaaatatctcctgagactaagtcagacaataaaactcccgtgcaaactttaaatagggaattttcaactccagcgaaaggcaaatccgaggccagtacatcttatgctctaagaggggtgcagcaaaaccaacaaggctcgccgggtttgaattggtggtcacctgcaactgcaaagagtggcggtgaacaagaagagaaaggaaggagttctccagttgagggtgtggttcagcctggtgctttgattactctacctccaccactagaagtggcaaggcctgaggtccagagaaactccttgcctgcagggaatctcaatgatgaagaatgggtaaccgtatacgggttttctccatatgatactaatttggttttaagggaatttgaaaaatgtggtgaaattttgaaacatgttcccggtcctagagatgccaactggatgcacattttgtatcagaatcgatctgctgcacaaaaagctcttaacaagaatggaatgcaacttaatggagtccttattattggcgtgaaacccgtggatcccatgcaacgtcaagctttgaccgaaaggcttaacaatcaaggatttatgcctttacctctaccctctgctagaaactcagaagtaagcacatcaaaagctccttctcggccatattatctgcagaatggcaatgcaaccacaaggcagactggaggtaccattgcttccccaacaaaatcattggcgtccaagataatggacttgatgtttggagtctagattatctgttatggtgaatcaaactgtaccatcctgttttattataagcaatattttactctttcagttattcataccctctgaagaggttcggcttgttatgttcattagatttgagttggaatgtttactcttttgattggatttttggcatcttagcattgaaatgttatgaatggctatgatcagtacttggtgaccaaatgttttgagaaaactgggatcatcatatatgggtatgggatacaaagttgatcaatgtttatgtaaaatctgctcattgcgcaggcacttaagattttggacagaaatgaatgtaatgttgatttgtttcattcccatagttcatctacttggattgttgtttttgtttatgatgcacttgacattttgatgttcattcacatcagaaaaacttatctgcccttaaaaagttgatacaaaaacagtggatacttatttgtgtttggaaattattaactagttacttgctaattccaattgcaaacggtaaattgtttgaaacaacatataattgtaagtatttat

SEQ ID NO: 8321 - DNA, 1601 bp, Trifolium pratense
tagggttttgatttaggagggaaaattctaaaacccttaaattcacaatttcaattccttcaattccacattcagaattcaaaacccttcgtttcaactcgccactaccaccaagatattgactctattccctgtaagatataatataataatatgaacaacacggtgcaaagaactccaaggtctggtagacaatcattgtttttccaggatttagcttcccctatttcttcccgccggggaaagttttctagtccaggacagtcaggtgcatcttcttctctatggcgtgaaaactttggtggtaattcggaccttcctccgcctcctgttttcaccttggaagacagatcagacttttctcctgaatcaggcatattggattaccaagtatctcccgagactaagtcggacaataaaactcctgtgcaaactttaaatagagaattttcaactccagcaaaaggaaaatctgaggccagtacatcttatgctttaagaggggtgcagcaaaaccaacagggctcgccgggtttgaattggtggtcacctgcaactgcgaagagtggtggtgaacaagaagagaaaggaaggagttctccagttgagggtgtggttcagcctagtgctttgattactcttcctccaccactagaagtggcaagacctgaggtccagaggagttccttgcctgcagggaatctcaacgaggaagaatgggtaacagtatacggattttctccatatgatactaatttggttttaagggagtttgaaaaatgtggtgaaattttgaaacatgttcctggtcctagagatgctaattggatgcacattttgtatcagaatcgatctgctgcacaaaaagctcttaacaagaacggaatgcaaattaatggagtcctaattattggcgtgaaacccgtggatcccatacaacgtcaatctttgaccgaaaggcttaacaatcaaggatttatgcctattcctctaccctctgctagaaacccagaagtaagtacatcaaaagctcctacccggccatattatctgcagaatggcaacgcaactacaaggcagaccggaggtaccattgcatccccaacaaaatcgttggcgtcccagataatggacttgatgtttggagtctagattatctgttctggtgaatcaaactgtaccatcctgttttattataagcaatattttactctttcagttattcataccctctgaagaggttcggcgtgtaatgttcattggatttgagttggaatgtttactcttttgattggattttttggcatcttagccttgcaatgttatgaatggctatgatcagtaatttgtggccaaatgttttgagaaatgggatcatcatatattggcatgagatacagatacatgttgatcaatgtttatgtaaaatctgctcattgtgcaggcacttaagattttggacagaaatgaatgtaatgttgatctgtttcattccggcagttcatctacttgaatgttgtttttgtttatgatgcactttagattttgatgttcattcacatcagaaaaacttatagttgatacataaacagcgatactta

SEQ ID NO: 8322 - DNA, 1433 bp, Trifolium pratense
cagatattgactctattcgctgtaatatgtcatataataatatgaacaccacagtgcaaagaactccaaggtctggtagacaatcattgttttttcaggatttagcttcccctatttcttcccgccggggaaagttttctagtccaggacagtcaggtgcatcttcttctctatggcgtgaaaactttggtggtaattcggaccttcctccgcctcctgttttcaccttggaagacagatcagacttttctcctgaatcaggcatattggattaccaaatatcccctgagactaagtcagacaataaaactcccgtgcaaactttaaatagggaattttcaactccagcgaaaggcaaatccgaggccagtacatcttatgctctaagaggggtgcagcaaaaccaacaaggctcgccgggtttgaattggtggtcacctgcaactgcaaagagtggcggtgaacaagaagagaaaggaaggagttctccagttgagggtgtggttcagcctggtgctttgattactctacctccaccactagaagtggcaaggcctgaggttcagagaaactccttgcctgcagggaatctcaatgatgaagaatgggtaaccgtatacgggttttctccatatgatactaatttggttttaagggaatttgaaaaatgtggtgaaattttgaaacatgttcccggtcctagagatgccaattggatgcacattttgtatcagaatcgatctgctgcacaaaaagctcttaacaagaacggaatgcaaattaatggagtcctaattattggcgtgaaacccttggatcccatacaacgtcaatctttgaccgaaaggcttaacaatcaaggatttatgcctattcctctaccctctgctagaaacccagaagtaagtacatcaaaagctcctacccggccatattatctgcagaatggcaacgcaactacaaggcagaccggaggtaccattgcatccccaacaaaatcgttggcgtcccagataatggacttgatgtttggagtctagattatgttttattataagcaatattttactctttcagttattcataccctctgaagaggttcggcgtgtaatgttcattggatttgagttggaatgtttactcttttgattggattttttggcatcttagccttgcaatgttatgaatggctatgatcagtaatttgtggccaaatgttttgagaaatgggatcatcatatattggcatgagatacagatacatgttgatcaatgtttatgtaaaatctgctcattgtgcaggcacttaagattttggacagaaatgaatgtaatgttgatctgtttcattccggcagttcatctacttgaatgttgtttttgtttatgatgcactttagattttgatgttcattcacatcagaaaaacttat

SEQ ID NO: 8323 - DNA, 1638 bp, Medicago truncatula
atagcgagagaacgcaacgttctgaaattgaaaaacgaagaggagaattagggttttgaatcgggagggaaaattctgaaacccttaaattcacaatttcacattctgaatcggaactcttcacttcaattcgccaccaccaccagatattgactctatttgctgaaatatataatataataatatgagcaccacagcgcaaagaactccaaggtctggtagacagtcactattttttcaggatttagcatcccctgttaatgcccgccggggaaagttttccagtccaggccagtcaggagcatcttcttctctatggcgtgaaaactttggtaattcggaccttcctccgcctccttttttcaccttggaagacagatcagacttttctccagaatcaggcatactggattaccaaatgtctcctgagactaagtcggaccataaaactcccatccaaactccaaatagagaattttcgactccagcgaaaggcaagtccgaagccagcacatcttatgctttaagaggggtgcagcaaaaccaacaaggctcgcttagtttgaattggtggtcgtcacctgcaaagagtggtggtgaacaagaggagaaaggaaggggttctccagtcgagggtgtggttcagcctggtgcattgattactcttcctccaccaccagaagtggcaaggcctgaagtccagcgaaattccttacctgcaggaaatcttaacgaggaagaatgggtaacagtatatggattttctccaaatgatactaatttggttttaagggagtttgaaaaatgtggtgaaattttgaaacatgttcctggccctagagatgctaactggatgcacattttgtatcagaatcgatctgctgcacaaaatgctctcaacaagaatggaatacaaattaatggagtcctaattattggtgtgaaacccttggatcccatgcaacgtcaagctttgaccgaaaggcttaacaatcaaggatttatgcccctacctctacccactgctaggaactcagaagtaagcacatcaagagctccttctcggccatattatctgcagaatggcaatgcaactacaaggcagactggaggtaccattgcttccccaacaaaatcctttgcatccaagatcatggacttgatgtttgcagtctagattatctgttttggtgaatcaaactgtaacatcctgctttattataagcaatattttactcagttattcataccatctgaagaggttcggcctttagtgttcattggatttgagctggaatatttactcttttgattgaatcttatggtatcttaattcttaacactgcaatcttatgaatggctatgatcagtacttggtggtcacatgttttgagaaatgggatcataatatatggatacaggttgatcaatgtttatgtaaaatttgctcattgtgcagacacttaagagtgtaatgtttatttgtttgagtgatgcaattcatctcacttggatttttgtttttgtttagatgactggtcagccaatcccctaaaacacgggctttaccaaaagcatccggtagtgcattttgacagatttgaacatcccctaaggggacaatttgagaaatcacct

SEQ ID NO: 8324 - DNA, 1285 bp, Trifolium pratense
tgtaagaaaatcttacgatttgtttattgcgagagaacacaaaacaacgttctgatcggagttgaaaaacggaaaaacgaaggggagaattagggttttgatttaggagggaaaattcttaaaccctaaattcacaatttcaattcgttcacttccacattcataattcaaaaacccttcacttcaactcgccaccaccaccaccgccaccgcgccaccaccaccaccgccaccgccactaccagatattgactctattcgctgtaatatgtcatataataatatgaacaccacagtgcaaagaactccaaggtctggtagacaatcattgttttttcaggatttagcttcccctatttcttcccgccggggaaagttttctagtccaggacagtcaggtgcatcttcttctctatggcgtgaaaactttggtggtaattcggaccttcctccgcctcctgttttcaccttggaagacagatcagacttttctcctgaatcaggcatattggattaccaagtatctcccgagactaagtcggacaataaaactcctgtgcaaactttaaatagagaattttcaactccagcaaaaggaaaatctgaggccagtacatcttatgctttaagaggggtgcagcaaaaccaacagggctcgccgggtttgaattggtggtcacctgcaactgcgaagagtggtggtgaacaagaagagaaaggaaggagttctccagttgagggcgtggttcagcctagtgctttgattactcttcctccaccactagaagtggcaagacctgaggtccagaggagttccttgcctgcagggaatctcaatgaggaagaatgggtaacagtatacggattttctccatatgatactaatttggttttaagggagtttgaaaaatgtggtgaaattttgaaacatgttcctggtcctagagatgctaattggatgcacattttgtatcagaatcgatctgctgcacaaaaagctcttaacaagaacggaatgcaaattaatggagtcctaattattggcgtgaaacccttggatcccatacaacgtcaatctttgaccgaaaggcttaacaatcaaggatttatgcctattcctctaccctctgctagaaacccagaagtaagtacatcaaaagctcctacccggccatattatctgcagaatggcaacgcaactacaaggcagaccggaggtaccattgcatccccaacaaaatcgttggcgtcccagataatggacttgatgtttggagtctagatt

SEQ ID NO: 8325 - DNA, 1784 bp, Lupinus angustifolius
taaatgtcgtttcaaaatgaaagaggaaggggaattagggtttgaaaatgagaggagtagcttatttatatagtacaaataatagagtcgttattaccaattgtcccttttgcagcggagaagaggagcgaggtcacttttggtttgggagggaaatttgtaatataatcccaaaaaaaaattcctcacaatttacgatctcaatcaacgggacaaattttcaacattcaacatcaccaagatttaatttctcttctgtgaagtaagaaatataacatgagcactacagtgcaaaaaactccaagatctggcaggcagtcattatttttcaaggatttagcttcacctgtttctacccggagaggaaaattttcgagtccaggccaggcagctccagcttctactccatggcgtgagaactttggtggttcggaccttccaccacctcctttttacactttggaagatagatcagacttttctcctgaatccggtataccagattaccaggtatccccagagactaagtcagaccctagatctccaatccaatcttcaaatacggaattttcaactccattgaaaagcaaatcagaggccagcacatcttatgctttacgtggagtgcagcaaaaccatcaggactcaccaggtttgaattggtggtcacctgtacctgcaaagagtggcagtgagcaagatgacaaggggacgagttcaccagttgagggtgtaatacagcctggtgctttgattactcttcctccaccactggaagtggcaaggcctgaggtccaaagaaattccttcccagcagggaatctcaatgaggaagaatgggtaactgtttatggattttctccatatgatactaatttggttttgagggaatttgaaaaatgtggtgaaattttgaaacatgttcctggacctagagatgctaactggatccacattttgtaccagaatcgatctgatgcccaaaaagctcttaacaagaatggaatgcaaattaatggagtcctaatagtaggtgttaagccgttggatcccatgcaacgccaatctttgaatgaaaggcagaacaatcaggaatttatgcctttgcctctatcctctgctagaatttcagaaacaaacacattgagagcttcttctcgaccctattatcttcagaatggtaactcagctgttcgccaggcaggaggtaccattgcttctccaacaaaatcattggtgtccaaggtcatggatttgatgtttggagtctagatttagctgttctggtgaatcagcctatttcattctgttttgttgtaagcaatgattctactttctgctattcacacaatgccggagttgaggcatatctttgtaggatttgagttgtggaacatttgccctttggatcttcgtttttggaatttctggcatctaacatttgcagttatattgggaaacttggtagccatatgattttagattataaatctttacggtgtcatattacactctatgacatggactaaggtcgaatgcttcaatgagtttccatgaaactattttaacttcacaagtattctagtgagtgtagttcattaccctaaaccttgcaacatgttcagcacataaaaaatattgcatggctatgactatgagtgcatattttcatagtcgtgcttagtgatagatcaatataattcattattcaaaacgaaaataaaacaacatattattttgtttacttgtacaaataacaaatgtattcaaattgattattataa

SEQ ID NO: 8326 - DNA, 1454 bp, Quercus alba
tttttaaaaaacacatcgttttcgtttttggttccatttggtactacaactacaagctctgcgctgagctctgcttctataacttttgggagggaaaattagctcagcaaaaaaaaaaaaaaaggaaaaaaccccaatatcaaaacattacaaaccaacccatttcaccaaaaccctaatctctctctcgccagaggctgcatttcattctaaaaatattgtaagatgagcaccacagtacagagaactcccagatctgggaggcagtcgttgttttttcaagatttggcatctccagtttctgcccggagagggaagttttcaagtccaggtcaggcagcagcagtatctgccctgtggcgtgagaattttgctgggtcagatcttccgcctcctcctgttttcaccttggaagaccggtcagatttttctcctgaatctgggattccagattacccattatctccagaagccaaatcagaccccagaactcctgtccagagttccggacgggacatctcaactccagggaaaaacaaatcagaggcaagcacttcttatgccctgatgggtgcacagcaaaaccaacagggttcagcgggtttgaattggtggtcacctgcaaagagtggcagtgagcaagaagataaaggtaagagttcgcctgttgagggtgtggttcagcctggtgctttgatcacacttccacccccaagggaagttgcaagaccggaggtacagaggaattgcttgcccacaggtgacctcaatgaggaagaatgggttactgtctatgggttttccccatctgatacgaatttagttttgagggagtttgaaaagtgtggtgtgattttgaaacatgttccaggtccaagagaagctaactggatgcacattctatatcagaatcgatttgatgctcagaaggctctcagcaagaatggcatgcaaatcaatggggtactaattgtaggtgttaagccattggatccaatgcaacgccaggctttgagtgaaagggtcaacaatcagggatttatgactttacctcctcaaccgtccacaaaatcctcagaactgaacacattgaaagccccctctcgcccctattatcttcaaaatggcagtaccaatactcggcagtcaggaggtgccattgcttccccaacaaaatctttggtgtctaaaatcatggatctgatgtttggagtttaggctggtttactggttttatgccatctaggttatagccaatatgctacttccaaggcaatttactatacgtatgagagtttcagcacttgtaagcttgaatcaggtttttcttttgctatttttctcctggtgggaaatgcttgattttttctttattgaaattgtacaagactgaaagtaccattcaccctggatagttcatttgtgaaagtatttaaagagaagaatttgaattt

SEQ ID NO: 8327 - DNA, 1267 bp, Castanea mollissima
ctaaatcaaaacattacaaaccaacccatttcaccaaaaccctaatctctctctcgccagaggcttcatttcattctaaaaatattgtaagatgagcaccacagtacagagaactcccagatctgggaggcagtcgttgttttttcaagatttggcatctcctgtttctgcccagagggggaagttttcaagtccaggtcgggcagcagcagtatctgctttgtggcgtgagaattttgcagggtcggatcttccacctcctcctgttttcaccttggaagaccggtcagatttttctcctgaatctgggattccagattacccattatctccagaagccaaatcagaccccagaactcctgtccagagttctggtcgggacatctcaactccagggaaaaacaaatcagaggcaagcacttcttatgccctgatgggcgcacagcaaaaccaacagagttcggcgggtttgaattggtggtcacctgcaaagagtggcagtgagcaagaagataaaggtaagagttcgcctgttgagggtgtggttcagcctggtgctttgatcacacttccacccccaagggaagttgcaagaccagaggtacagaggaattgcttgcccacaggtgacctcaatgaggaagaatgggttactgtctatgggttttccccatctgacacgaacttagttttgagggagtttgaaaagtgtggtgtgattttgaaacatgttccaggtccaagagaagctaactggatgcacattctatatcagaatcgatttgatgctcagaaggctctcagcaagaatggcatgcaaatcaatggggtactaattgtaggtgttaagccattggatccaatgcaacgccaggctttgagtgaaagggtcaacaatcagggattcatgactttacctcctcaaccgtccacaaaatcctcagaactgaacacattgaaagccccctctcgcccctattatcttcaaaatggcagtaccaatactcggcagtcaggaggtgccattgcttccccaacaaaatctttggtgtctaaagtcatggatctgatgtttggagtttaggctggttaactggttttatgccatctaggttataagccaatatgctacttccaaggcaatttactatacatatgagagtttcagcacttgtaagcttgaatcaggtttttcttttgctatttttctcctggtgggaaatgcttgatttttcttttctggaattgtacaagactgaaagtacca

SEQ ID NO: 8328 - DNA, 2847 bp, Glycine max
atcaacttgttggaatgggaagagtgacggtttactatgagaccaagattacaatattagtttagaaatttaaaaaaaaaaaaaagaaaaaggaaaggtggcccctcatgaaattcactgcttgtcgttgaatacctgtcatgatccagaatacaccgtactggcagtaattacgtctgcccaaattattcaatactcttaaccatcctagaccaaactcattcacacatggtgtcctatgtatgtctgtgtgccacctttttcgtcttatataatataataatctcttcagatgcaccactcttccctcacacccttcactactaacaatgcaggtaacagacgttattctactgggcctgtgcttgctcttcctccgctggtggtggcgccgatggtccaccaccggcggaggcccgaagaacctccctccaggcccgcccggatggcccatagtcgggaacctcttccaagtgatcctgcagcgccgtcatttcatttacgtgatccgcgatttacataaaaaatacggcccaatcttcaccatgcagatgggtcagcgcacgttgataatcgtgagcagcgcggagctcatccacgaggcgctgatccagcgaggcccattattcgcgagcaggcccaaagactcccccatccggctgatcttcagcgtggggaagtgcgccatcaactccgccgagtacggccctctctggcgcaccctaaggaagaacttcgtgaccgagatgatcacccctctgaggataaaacagtgcagctggatacgaaaatgggccatggaggcccacatgagaaggatccaacaagaggcccgcgagcaagggtttgttcaagttatgagcaactgcaggctcaccatctgcagcatcctcatctgcatctgcttcggcgccaagatcgaggagaaaagaatcaaaagcatagagagcattttgaaagatgtcatgctcatcacgcttcccaagcttccagatttcttaccggttttcactccgttgttccgccgtcaggtgaaggaagctgaggagttaaggaggaggcaggtggagctgttggcgccgttgataaggagcagaaaggcttacgtggagggaaataacagtgacatggcgagtcctgttggtgctgcttacgtggactccttgtttggtttggaggtgcctggacgaggacgcttgggggaggaggagctcgtgacgctagtgtcggagattatcagcgccggcacggacacaagcgccaccgcgctggagtgggcgctgcttcatttggttatggatcaagagattcaagagaggctgtacagggagattgtggggtgcgtggggaaggatggtgtggttacggagagtcacgtggagaagatgccttacctgagcgccgtcgtcaaggagactttccggagacatccgccgagccacttcgtgctgtcgcacgccgccacggaggagacgaagctgggagggtatacggtgccgaaggaggcgagcgtggagttttacacggcgtggttgacggaggatccgagtatgtgggaggatccgaatgagttccgacccgagaggtttatgagtggggatggggttgacgtggacgtgacggggacgaaaggggtgaggatgatgccgttcggtgttgggaggaggatttgcccagcgtggacaatggggattttgcatataaatatgctgctggctaagatggtgcatgctttccactggctgcccaatcccaactctccacccgacccgactgagaccttcgctttcactgttgtcatgaacaaccctctcaagccacttattgtgccacgatccatttaacttatacttatagtgctccttctctgcaaactaaggaatatatctgcttctaaaataacatatgagcacaaggcttttttggaagattgctgattgcagtttgttgccatcgaattccaaccttcgtttatcgcataagatattgcacaattttattgtaatggagcggaactccttccaatgtgcgtctcgtccggtctatattagtgaaggtggtatctatatacttactcctttttttcttctttttaattgtcggattttcaaacaatttctatttctatttatttttatttataaaatttaatatcacatttattattcattttatgaattatgcttctttttttttaattaatttacacatgtatttaatgtagagtaaaaaaatgtgtgaaataaatttttttataattattttattagaatccataaaatttattacatttatcgatttctacaaaacaatcttaaaaaaaaaacagataaaaatgaacggacgaaggtagtgagatatcaatttttttatgtttgcattattgcatgtgagttcatgaaaatacgaggtagtagggatatttaattcgtcttcgattttgaagacaaaaattttcgtatttatatctattgcaatatgagataagaggttgtgtttgacatatcaacatatatagtatataagatatgattaaaaaaaggctatattagagggggaaattgtggaaaaagtggtatacatttgtcctggccgggtagtttaggcatgtacatagcataagcattatagaaaccttgtaataaaaaccaactaaaagtagataataaaaagagtagctcaaatgtttaaaggtggcgaaaaagatttgagaaaaactatatatagtaaattaagataatacttaggaaggatttagatgtttataatttgtatatagacatgattaatgacagaatattgtgacataatttcatataattgaccctctacctaatggaaaaaagc

SEQ ID NO: 8329 - DNA, 2927 bp, Glycine max
aaaaaaacctctgctgtggtcaatataaaacaaagaccactgaacatcgtttggtggcatatgatttaatgttgtaaaaaatcaacttgttggaatgggaagagtgacggtttactatgagaccaagattacaatattagtttagaaatttaaaaaaaaaaaaaagaaaaaggaaaggtggcccctcatgaaattcactgcttgtcgttgaatacctgtcatgatccagaatacaccgtactggcagtaattacgtctgcccaaattattcaatactcttaaccatcctagaccaaactcattcacacatggtgtcctatgtatgtctgtgtgccacctttttcgtcttatataatataataatctcttcagatgcaccactcttccctcacacccttcactactaacaatgcaggtaacagacgttattctactgggcctgtgcttgctcttcctccgctggtggtggcgccgatggtccaccaccggcggaggcccgaagaacctccctccaggcccgcccggatggcccatagtcgggaacctcttccaagtgatcctgcagcgccgtcatttcatttacgtgatccgcgatttacataaaaaatacggcccaatcttcaccatgcagatgggtcagcgcacgttgataatcgtgagcagcgcggagctcatccacgaggcgctgatccagcgaggcccattattcgcgagcaggcccaaagactcccccatccggctgatcttcagcgtggggaagtgcgccatcaactccgccgagtacggccctctctggcgcaccctaaggaagaacttcgtgaccgagatgatcacccctctgaggataaaacagtgcagctggatacgaaaatgggccatggaggcccacatgagaaggatccaacaagaggcccgcgagcaagggtttgttcaagttatgagcaactgcaggctcaccatctgcagcatcctcatctgcatctgcttcggcgccaagatcgaggagaaaagaatcaaaagcatagagagcattttgaaagatgtcatgctcatcacgcttcccaagcttccagatttcttaccggttttcactccgttgttccgccgtcaggtgaaggaagctgaggagttaaggaggaggcaggtggagctgttggcgccgttgataaggagcagaaaggcttacgtggagggaaataacagtgacatggcgagtcctgttggtgctgcttacgtggactccttgtttggtttggaggtgcctggacgaggacgcttgggggaggaggagctcgtgacgctagtgtcggagattatcagcgccggcacggacacaagcgccaccgcgctggagtgggcgctgcttcatttggttatggatcaagagattcaagagaggctgtacagggagattgtggggtgcgtggggaaggatggtgtggttacggagagtcacgtggagaagatgccttacctgagcgccgtcgtcaaggagactttccggagacatccgccgagccacttcgtgctgtcgcacgccgccacggaggagacgaagctgggagggtatacggtgccgaaggaggcgagcgtggagttttacacggcgtggttgacggaggatccgagtatgtgggaggatccgaatgagttccgacccgagaggtttatgagtggggatggggttgacgtggacgtgacggggacgaaaggggtgaggatgatgccgttcggtgttgggaggaggatttgcccagcgtggacaatggggattttgcatataaatatgctgctggctaagatggtgcatgctttccactggctgcccaatcccaactctccacccgacccgactgagaccttcgctttcactgttgtcatgaacaaccctctcaagccacttattgtgccacgatccatttaacttatacttatagtgctccttctctgcaaactaaggaatatatctgcttctaaaataacatatgagcacaaggcttttttggaagattgctgattgcagtttgttgccatcgaattccaaccttcgtttatcgcataagatattgcacaattttattgtaatggagcggaactccttccaatgtgcgtctcgtccggtctatattagtgaaggtggtatctatatacttactcctttttttcttctttttaattgtcggattttcaaacaatttctatttctatttatttttatttataaaatttaatatcacatttattattcattttatgaattatgcttctttttttttaattaatttacacatgtatttaatgtagagtaaaaaaatgtgtgaaataaatttttttataattattttattagaatccataaaatttattacatttatcgatttctacaaaacaatcttaaaaaaaaaacagataaaaatgaacggacgaaggtagtgagatatcaatttttttatgtttgcattattgcatgtgagttcatgaaaatacgaggtagtagggatatttaattcgtcttcgattttgaagacaaaaattttcgtatttatatctattgcaatatgagataagaggttgtgtttgacatatcaacatatatagtatataagatatgattaaaaaaaggctatattagagggggaaattgtggaaaaagtggtatacatttgtcctggccgggtagtttaggcatgtacatagcataagcattatagaaaccttgtaataaaaaccaactaaaagtagataataaaaagagtagctcaaatgtttaaaggtggcgaaaaagatttgagaaaaactatatatagtaaattaagataatacttaggaaggatttagatgtttataatttgtatatagacatgattaatgacagaatattgtgacataatttcatataattgaccctctacctaatggaaaaaagc

SEQ ID NO: 8330 - DNA, 1783 bp, Phaseolus vulgaris
ccacacccatcccaccttcttcatgttatataaccacttcatatgcaccattctccctcacccctatgcttccaacaatgcacctaaacgacctccttctcctcgccttcgccttcctcttcctctgttggtggtggcgccgctgcaccaccaccgggggtggccccaagaacctccccccggggccgcccggttggcccatcgtggggaacctcttccaagtcatcctgcagcgccgtcacttcatctacgtcatccgcgacttacgtaaaaagtacggcccaatcttcaccatgcagatgggccagcgcacgttgatcatcgtcaccagcgcggacctcatccacgaggcgctcatccagcgtggcccactgttcgcgagccggccccaagactcccccatccgtctcatcttcagcatggggaagtgcgccatcaactccgccgagtacggccctctctggcgcaccctgaggaagaacttggtgaccgagatgatcaccccgctgaggattaagcagtgcgggtggataagaaaatgggccatggaggcccatatgagtaggatccaaaaggaggcccgtgagcaaggtttcgtggaagtgatgagcaactgcagactcaccatctgcagcatcctcatctgcctctgcttcggcgccaagatagaggagagacgaatcaagagcatagaaagcatcttgaaggatgtcatgctcatcacgcttccaaagcttccagactttttgcccgtgttcacgccgttgttccggcgccaggtgaaggaagccagggagttgaggaaaaggcaggtggagctgttggcgccgttgataaggagtagaaaggcctacgtggaggggagcttctcgggaagtgagatggccagtccggtgggtgctgcttacgtggactcgttgttcgagttggaggtgcctggacgaggacggttaggggaggaggagctcgtgacgctggtatcggagattatcagcgccgggacggacacgagcgcaaccgcggtggagtgggcgctgtttcatttggtgacggatcaagagattcaggagaggttgtataaagagattgtggagtgtgtggggaaggaaggggtggttaaggagagtgacgtggagaggatgccctacctgagcgccgtggtgaaagagactttccggcgtcacccgccgagccacttcgtgctttcccacgctgccactgaggatactaagctgggagggtatacggtgccgaagaacgcgagtgtggagttttacacggcgtggttgtcggaggatccgaatatgtgggaggatccgaatgagttccgacccgagaggtttttgagcggggatggagttgacgtggacgtaacgggaacaaaaggtgtgaggatgatgccgttcggtataggaaggaggatttgtccggcgtggactttaggcatcttgcatataaacttgttactggctaagatggtccaggctttccactggttgcccaatccaaactccccacccgacccggctgagacattcgctttcactgttgtcatgaagaaccctctgaaggccgttattgtgcctcgatccatttaatttcacaaacactttatttctcgttttttttaccaaactaggttaattttataaattaattaataaaataaataaaattttaaaaaatcattgaaatgagtgagttgtaatcaaatttaagtttgaagttaattatcctaagtcgtgtgagcgagtataatacaatttttttcatgtgtcaactt

SEQ ID NO: 8331 - DNA, 1945 bp, Cajanus cajan
cctcactcattcattgttttcttctcactatcactaacaagtaacaatgcagctaataacagacctcattctcctggctctggccttcctcttcctccgctgctggtggcgctactgctccaccaccggcgcagggcccaagaacctcccgccaggcccgccggggtggcccgtcgtcgggaacctcttccaagtcatcctgcagcgccgccacttcatctacgtggtccgcgatttacgtaaaaagtacggccccatcttcagcatgcagatgggccagcgcacgttgatcatcgtgaccagcgcggacctgatccacgaggccctaatccagcgaggcccgcagttcgcgagccggcccaaagactcccccatccggctcctcttcagcatggggaagtgcgccatcaactccgcggagtacggcccgctgtggcgcactctgaggagaaactttgtgagcgagatgatcagcccgctgcggataaagcagtgcgggtggatacgaaaatgggccatggaggcccacatgaggaggatccagaaggaggcccgggagttgggcttggtggaggtgatgagcaactgcagactcaccatctgcagcatcctcatctgcctctgcttcggcgccaagatcgaggagaaccgaatcaaaagcatagagagcattctgaaagacgtcatgctcatcacgcttcccaagcttccagacttcttgcccgttttcacgcccttgttccgccgccaggtcaaggaagccaaggacctcaggaagagacaggttgagctcttggcgccgttgattcgcaaccgcaaggcttacgtccagggcaagttcgagggtgctcacatggccagtcctgttggcgctgcttacgtggactccttgttcggcttggaggttcccggtcgtggacgcttgggggaggaggagcttgtcacgctggtctccgaggttatcagcgccgggacggacaccagcgccaccgcgctcgaatgggcgctgcttcatttagttatggaccaggagattcaggagagattgtatagagagattgtggagtgtgtggggaaggacggtgtggttacggagagtgacgtggagaagatgccttacctgagcgccgtcgtcaaggagactttccggcgccacccgcccagccactttgtcttgtcgcacgccgccaccgaggagaccaagctcggcgggtataccatcccgaaggaggcgagtgtggagttttacacggcgtggttgacggaggatccgaatatgtggaaggatccgaatgagttccgacccgagaggtttttaaccggggatggggttgacgtggacgtgacggggacgaaaggggtgaagatgatgccgttcggcatcggaaggaggatttgtccagcttggagtcttggcattctgcacataaacttgttgctggctaaaatggtgcatgcttttcactggttgcccatacccaataacccccccgaccccactgagactttcgctttcactgttgtcatgaagaaccctctcaaggctgttattgtgcccagatccatttactgaaaacgtgcgtgataaaataacatgcgcagaaacgaggtacctaggttcttttttattggctgttcccgatgattgctcatccttgcacttcccatcaatttctatattatttataaataggctaatagatatttagtcatagtatatggtataaatatattgcacatgcaattttcttcttccaatgtgcgtctctgctacataatgaaggtcatctaatcatatattatatatatatagtatactatccaactttttttatttgcgtcccatgttgggctcatcaaactctacgcctatatctatgtccttccattttgaagaccaaaattttcttaattatatctattgcaatatgagataagagcctgt

SEQ ID NO: 8332 - DNA, 2056 bp, Cicer arietinum
cctcattcactatcattcatgttatatatgtgggcaaatacctctctaccttaccactactatactttcaactctcactactatatctctctttctttcttcatctttgcttctcaatggagctagtagacattataatgctcttttttgccctcgccttcctccgttggtggtggcgccgctggtccaaaaccggtggcggtgccaaaaacctcccacctggaccaccgggatggccaatcgttggcaacctttttcaagtaatcctccaacgtcgtcctttcatttacgtcgttcgcgatttacgtgaaaaatacggcccaatcttcacaatgcaaatgggccagcgcactttgataatcgtgacaagctctaaccttatccacgaagccctaatccaacgaggcccgcagttcgcaagtaggcccaaagactcacccatccgccttatcttcagcatgggaaagtgtgccatcaattccgctgaatacggcccactctggcgctccctccgtcgtaacctcgtcaccgaaatgatatcaccacttagagtaaaacaatgcagttggattcgtaaatgggccatggaggcccatatgaaaaggatccaacaggaggcccacaaaaacggcttcgtcgaaataatgagtaactgcagactcaccatttgtagcatcctcatatgtctctgtttcggcgcgaaaataacggaggaaagaatcagaaaaattgaaagcgttctaaaagacgttatgctcattacacttccaaagcttccagactttttacccgttttaacgccgttattccgtgggcacgtgaaggaagcgaggaaactgagaaagatacaggtggagcttttagcgccgttgattaggaaacggaaagcttacgtggaaagcgacggaaaatgtggagatccggaaatggtgagtccggtaggtgctgcttacgtggactcgttgtttgcgttggaagttccgggaagaggaaaattaggagaagaagagttagttacacttgtgtcggagattatgagtgccggtactgacacgagcgctacggcggtggaatgggcgttgcttcatttagtgatggatcaagagattcaagagaggttatatagagaaattgttgattgcgttgggaaatgcggtgttattttggagagcgatgttgaaaagatgcattacctcggtgctattgtgaaggaaactttccggcgtcatccaccgagtcattttgtgctttcgcacgcggctacggaggagacggaacttggtggttacactgttcccgcggatgcgagtgttgagttttacacagcttggttgactgaagatccgaatatgtgggaggatccgaatgagtttcgaccggagaggtttttgaatggggatggagttgatgtggatgtgacgggaactaaggaggtgaagatgatgccgtttggtgttggaaggaggatttgtccggcttggactttggggattttacatataaacatgttgttggctaaaatggtgcttgcttttaggtggttaccggttccgaattccccacccgacccgactgagacttttgctttcactgttgttatgaagaaccctctcaaggctgttattgttcctagatccatttaagttactcttactattacttcattgtttgcattatctcttgcaaaccttaatgccatgagtaatcacttaatttactaaattaattaatatttagtgcttcataagaatagtaacttggcagaatacacggtggcttgctccattgctagtgtgtgttattggtatactactgttacattagtaattttcatgtaagaaattcatatatgtggtctctcggtttataaaggtcaaattttcttttatatagacttatataatgtagtcacctactatatatatatatatatatttcattttttggatgagaatattaattttgtactccatcatcatgttcatgttcaaggatcacttatatcctactatttacactgattttttgtttagataaatgattgatgaatgtttaa

SEQ ID NO: 8333 - DNA, 1960 bp, Lupinus angustifolius
cataccccataccttatacttcacactcttcacctccaacttagtaacctagctacctcttctccttgcaaccactcattacttattcaatggaattaatagacattcttctactcttcttcaccttcctattcctcctatggtggtggcgattctgttccgctaccactcacaaggggtcgaagaatctcccacctgggccaccgggatggccaatagtgggaaatctcttccaagtgatcctacaacggcgtcatttcatctatgtgatccgtgatttacgtaaaatatatggcccaatcttcaccatgcaaatgggtcaacgaaccttgataatagtcacaagcgctgaccttattcacgaagcccttattcaaaggggacccttgtttgcaagccgtcctaaggactcacccattcgcctcatcttcagcatgggcaagtgcgccatcaactccgccgagtatggcccgttatggcgctcccttcggcgcaacttcgtgacggagatgatatctccgttgaggataaagcagtgcagctggataaggaaatgggcgatggaaggccacatgaggaggatcgaagaagaagcacgtgacaagggttttgttgaagtaatgagtaactgcaggctcacaatatgcagcatccttatatgtctatgctttggtgcaaagatcacagaggatagaatcaaaagtattgagagtattttgaaggatgttatgctcgtcactcttcccaagcttccagatttcttgcccgtcttgacgccgttgttccagaagcaagtgagagaggccaagaagctgaggaagaaacaggtggagttggttgcgccattgataaggagcagaaaagagtacgtggagagtaacggaaagttagaaaatgatgaaatggtgagtccagtgggtgcagcttatgtagactctctgtttgaattggaagtaccaagtagaggaaggttgggagaggaagagcttgtgacattggtttctgagattatcagcgccgggacagacacgagcgccacggcggtggaatgggccctacttcacttggtgatggagcagaagatccaagaaagattgtatagcgagattgtggagtgtgtggggaagaatggggaggttctggagagacacgtggagaaaatggcttacctcggagcagttattaaggaaacattccggcgacatccaccgagtcattttgtgctgtcacatgctgccacgtcagagacagagttaggtggatatagaataccgaaggacgcaagtgttgagttttacacggcgtggttatcggagaatccagagatgtgggaggacccgaatgagttccgacccgagagattcttaaatggggatggtgttgacgtggacataactgggaccaaaggggttaaaatgatgccgtttggtgttgggagaaggatatgtccagcgtggacacttggagtgttgcatattaatatgttacttgcaaagatggttcttgctttcaaatggttacccattcctaattccccacccgacccgactgagacctttgctttcactgttgtcatgaagaatcctctcaaggctcttattgtccctaggtccatttacccatcataatatcaaattgtactattcattattttgaatgaactcatagtttcaatttattaacatgtgatcaatggcttgaatggttgaccagactcgtgtaatgtaactttatatgttaaataagatccgtaattagccatgcagtttggctcaaatatatatggtacgtgttacgttcaatcaaagccatgtagggaccagcatgttattcaaagaggaattagaagctttaaaaattaaacatacaggagagttgtacttttagcttcatacaaagatgtatattcccatcctatacatgtagggtattacttgtttaagcccaacttagctacagt

SEQ ID NO: 8334 - DNA, 1548 bp, Lotus japonicus
cttctctcttctctgaaactatggagctactagacatactcatgctgcttttagccatcgtgttcctctgctggtggtggcgttactggtccaccaccggcggaggagcaaagaacctgccaccagggccacccgggtggccaatcgtgggcaacctctttcaggttgtcttccaacgccgccacttcatctacgtagtccgcgacctacgtaaaaaatacggcccaatcttcaccatgcaaatgggccaacgcaggctcatcatcgtgaccagctcggacctcatccacgaggcccttatccaacgcggcccacagttcgcgagcaggcccaaagactcccccatccggctcatcttcagcatgggcaaatgcgccatcaactccgccgagtacggccccctctggcgctccctccgccgcaacttcgtcaccgagatgatctccccgctaaggatcaagcagtgcagctggatcagaaaatgggccactgaagcccacatgaggagaatccagcaagaagcccgcgacttgggctttgtcgaggtcatgagcaactgcaggctcaccatttgcagcatcttaatctgcctctgttttggcgccaaaatcactgaggaaagaattcgaagcatcgaaagcgtgatgaaggatgtcatgctcatgacgctgcccaaactccctgatttcttacccatcttaacaccgctctttcggcggcaggtggaggaagcgaagaagctgaggaagacacaggtggagctgttggcgccattgataaggaagaggaagagttacgtggagagcgatgggaagttgagggatccggagatggtgagtgcggtgggggctgcttacgtggactcactgttcgcgctggaggtgccagatcgtgggaggttaggtgaggaggagctggtgacgctggtgtcggaggtgatcagcgcggggacagacaccagcgcgacggcggtggagtgggcgctgctacacctcgtgatggaccaggggattcaggagaagctctacaaggagatcgtcgggtgcgtgggaaaaggcggcgatgtgaaggaagctgatgtcgagaaaatgccttacctcagcgccatcgtgaaggagacattccggcgacacccgccgagccacttcgtgctatcgcacgccgcgacggaggagacggagctgggtggctacaccgtgcctaaagacgcgagcgtggagttttacacggcgtggttgtcggaggatccggacatgtgggaggatccggatgagttccgacccgagaggtttctgatcggagacggtgtggacgcggacattacggggacgaaggcggtgaggatgatgccgttcggcgccgggaggaggatttgtccggcgtggacgctgggtgtgctgcatataaacatgttgctggcgaagatggtgctcgcttttcagtggctgccggttcccggtgccccacccgacccgagtgagacatttgctttcactgttgtcatgaagaaccctcttaaggctgttattatcccaagatcaatttaat

SEQ ID NO: 8335 - DNA, 1657 bp, Trifolium pratense
acactcgtcaaccttctcacatttactctttctttacttctcaactatggagctcatagacttcattatgctctttttcgcccttgccttcttccgttggtggtggcaccgctggtcaaaaatcggcggtggcgccaaaaatcttccacctggaccacctgggtggccgattgttggcaacctcttccaagtcatcctccaacgtcgtcctttcatgtatattgttcgtgatttacgtctaaaatacggtccaatcttcaccatgcaaatgggtcagcgcacgttgattatagtcacgagcgctgacctaatccatgaagctctaatccaaagaggcccacagttcgctagccggcccaaagactctcccattcgccttatcttcagcatgggaaagtgtgccatcaactctgccgagtacggtccactttggcgttccctccgccgcaaccttgtctcggagatgatatcaccacttagagtgaaacagtgcagttggattagaaaatgggccatggaagctcatatgagaaggatccaaagagaagcccaagaaaacggttttgttgaagtaatgagtaattgcagactcaccatttgtagcattctcatttgtctatgttttggtgccaaaataacagaggaacgaatcagagacattgagagtgttctcaaagaggttatgcttattacacttccgaagcttccagattttttaccagttttaacaccgttgttccgtggacatgtcaaggaagcaagaaagctaaggaagaaacaggtggagctaatagcgccgttgattaggaatcggaaagcttacgtggacagcgatggaaaatgcggagatccagagatggtgagtcccattggtgctggttatgttgattcgttgtttggtttggaagttcccggtagaggaagattgggagaagaggagttggttacgcttgtctcggagattatcagcgctggtactgacacgagtgctacggcgattgagtgggcgttgcttcatttagtgatggatcaagatattcaagagaggttgtatagggaaattgttggatgtgttgggaaatgtggtgttgttatggatagtgatgttgaaaaaatgccttatcttggtgcaattgtgaaagagactttccggcgtcatcctccgagtcattttgtgctttcgcacgcagctacggaggagacaaagcttggtggatacaccgtgccagcggatgctagtgttgagttttacactgcttggttgtctgagaatccagatatgtggaaggatccggatgagtttcgacccgagaggtttttaaacggggatggagtggatgtagatattacaggaactaaagaggtgaagatgatgccttttggtgcggggaggagaatttgtccggcatggacattaggaactttgcatataaacatgttgttggcgaaaatggtgcttgcttttaggtggttgccggttccgaattccccacctgacccgaccgagacatttgctttcactgttgtcatgaagaatcctctcaaggctgttattgttccaagatccatttaagttggtttattattacacttacatatactttatcaatggcataatgctagtaatttgttaactcaattaattaatatttttagt

SEQ ID NO: 8336 - DNA, 1992 bp, Trifolium pratense
actcgtcaactttctcacatttactctctttctttctttacttctcaacaatggagctcatagacttcattatgctctttttcgcccttgcctttttccgttggtggtggcaccgctggtcaaaaaccggcggtggcgccaaaaatctcccaccaggaccacctgggtggccgattgtcggcaacctcttccaagtcatcctccaacgtcgtcctttcatgtatattgttcgtgatttacgtctaaaatacggtccaatcttcacaatgcaaatgggtcagcgcacattgattatagtcacgagcgctgacctaatccatgaagctctaatccaacgaggcccacagttcgctagccggcctaaagactctcccattcgccttatcttcagcatgggaaagtgtgccatcaactctgccgagtatggtccattatggcgttccctccgccgtaacctcgtctcggagatgatatcaccacttagagtgaaacagtgtagttggatcagaaaatgggctatggaagcccatatgagaaggatccaaaatgaagcccatgaaaacggttttgttgaagtaatgagtaattgcagactcaccatttgtagcattctcatttgtctttgttttggtgccaaaataacagaggaacgaataagagacattgagagtgttctcaaagaggttatgcttattactcttccgaagcttccagattttttaccagttttaacgccgttgttccgcggacacgtcaaggaagcaagaaagctacggaagaaacaggtggagcttatagcgccattgattaggaatcggaaagcttatgtggacagcaacggaaaatgtggagatccggagatggtgagtcccattggtgctggttatgttgattcgttgtttggtttggaagttcccggtagagggaaattgggagaagaggagttggttacgcttgtctcggagattatcagtgccggtactgacacgagtgcaacggcgattgagtgggcgttgcttcatttagtgatggatcaagagattcaagagaggttgtatagtgaaattgttgggtgtgttgggaaatgtggtgttgttatggatagtgatgttgaaaaaatgccttatcttggtgcaattgtgaaagagactttccggcgtcatcctccgagtcattttgtgctttcgcacgcggctacggaggagacaaagcttggtggatatactgtgccagcagatgcgagtgttgagttttacactgcttggttgactgagaatccggatatgtggaaggatccggatgagtttcgacccgagaggtttttaaatggagatggagtggaggtagatattactggaactaaagaggtgaagatgatgccgtttggtgcagggaggaggatttgtcccgcatggacattggggactttgcatataaacatgatgttggcgaaaatggtgcttgcttataggtggttgcccgttccgaattccccgcccgacccgactgagacatttgctttcactgttgtcatgaagaatcctctcaaggctgttattgttcctagatccatttaagttggtttggtttacggaacaggatttggtgcagtaaatatttcacgcagtttcgaatctcagccatccgatcataaatgaatggtttagattacaaacagctaattttattaatatataatctgagccgtttgattttaatctaacgatcgaaatccaaaacagcgtgaaactgcgtgcaaattgcactgcaggaaatccaaatccttggtttactacacttacatatactttatcattggcataatgctagtaatttgttaactcattaatcaatatttttagcagtgctccacaagactagtgttcagggccacttaattggtccatatgctggcttattagtatactattggtattgaatttgtaatatttcatgcaacaattagtttcatgtgtgatgcttgctaatagg

SEQ ID NO: 8337 - DNA, 1658 bp, Trifolium pratense
actcgtcaactttctcacatttactctctttctttctttacttctcaacaatggagctcatagacttcattatgctctttttcgcccttgccttcttccgttggtggtggcaccgctggtcaaaaatcggcggtggcgccaaaaatcttccacctggaccacctgggtggccgattgttggcaacctcttccaagtcatcctccaacgtcgtcctttcatgtatattgttcgtgatttacgtctaaaatatggtccaatcttcaccatgcaaatgggtcagcgcatgttgattatagtcacgagcgctgacctaatccatgaagctctaatccaaagaggcccacagttcgcgagccggcctaaagactctcccattcgccttatcttcagcatgggaaagtgtgccatcaactctgccgagtacggtccactttggcgttccctccgccgtaacctcgtctcggagatgatatcaccacttagagtgaagcagtgcagttggatcaggaaatgggccatggaagcccatatgagaaggatccaaagagaagcccatgaaaacggttttgttgaagtaatgagtaattgcagactcaccatttgtagcattctcatttgtctatgttttggtgccaaaataacagaggaacgaatcagagacattgagagtgttctcaaagaggttatgcttattacacttccgaagcttccagattttttaccagttttaacaccgttgttccgtggacatgtcaaggaagcaagaaagctaaggaagaaacaggtggagcttatagcgccgttgattaggaatcgaaaagcttatgtggacagcgacggaaaatgcggagatccagagatggtgagtcccattggtgctggttatgttgattcgttgtttggtttggaagttcccggtagaggaagattgggagaagaggagttggttacgcttgtctcggagattatcagcgctggtactgacacgagtgctacggcgattgagtgggctttgcttcatttagtgatggatcaagagattcaagagaggttgtatagggaaattgttgggtgtgttgggaaatgtggtgttgtaatggatagtgatgttgaaaacatgccttatcttggtgcaattgtgaaagagactttccggcgtcatcctccgagtcattttgtgctttcgcacgcagctacggaggagacaaagcttggtggatacaccgtgccagcggatgctagtgttgagttttacactgcttggttgtctgagaatccagatatgtggaaggatccggatgagtttcgaccggagaggtttttaaatggggatggagtggatgtagatattacaggaactaaagaggtgaagatgatgccttttggtgcggggaggagaatttgtccggcatggacattaggaactttgcatataaacatgttgttggcgaaaatggtgcttgcttttaggtggttgccggttccgaattccccacctgacccgaccgagacatttgctttcactgttgtcatgaagaatcctctcaaggctgttattgttccaagatccatttaagttggtttattacacttacatatactttatcattgccataatgctagtaatttgttaactcaattaattaatatttttagt

SEQ ID NO: 8338 - DNA, 598 bp, Glycine max
aacatttgataagtcacgcgcggcgccatagcgtgtgatcctaaattaaaccctagctagaggagagggtttaaagctctgaagcttctttcttcttctccaattaagatcgcagagagagatggggagtgacagcgaggcagagaaggagaagaagaagatgcttgcgctcgctcccattgctaaaccccttgccggaaagaagctttgcaagcgaaccctaaaacttgttcgtagagctgccgaacacaaatgcctgaaaagaggagtgaaggaggttgttaaaagcataaggagaggtcataaaggattgtgtgtgattgctgggaacatatcgccgattgatgtcatcactcatcttcctattctctgtgaagactctgacattccttatatttatgtcccatctaaagaagatcttgcaggcgcaggagcaacaaagaggcctacttgctgtgttctggtacagacaaagcctgcaaagggagaaatagagcaaggggaacaagagaaactaaagtcagattatgatcaagttgtgtcggaagttactgagcttacaacttcactattttgaaacaagcacacatgtatgtgt

SEQ ID NO: 8339 - DNA, 758 bp, Cyamopsis tetragonoloba
ttagggtttgcattttgggtaataagtcattatttgggatggtacatctcttatataattttatatacatctttacttagattgatgaaagacattaattgcaccattgccagcggtgatccctgccatctataacaagattgtgaccactaacatacttagactcatcacttgccgagtaaagtgcaggaaagatggggagcgacagcgaggcagaaaagtcggtgcagaaagagaaggagaggaagaagatgcttgcgctggctcccattgcaaaaccccttgccgggaagaagctttgcaagcgaacgctaaagcttgttcgtagagctgctgagcacaagtgcttaaagagaggagtgaaagaagtggttaaaagtattaggcgaggtcataaaggattgtgtgttatagctgggaacatatcaccaattgatgtcatcactcatgttcctatcctgtgtgaagagtctgacattccctatatatatgtcccatctaaggaagaccttgcaactgcaggagcaacaaagagacctacttgctgtgttttggtaatgaccaagcctgcaaagggtgaattagaacaaggggcgcaagaaaaactaaagtcagattatgatcaagttgcatcggaggttaatgagcttacagcttcacttttttgaaacagtcacacatgtatctgtactgttccagctgtattaacgttgacagtggtgtaccttaacaatcaattgatgtttggattttatttt

SEQ ID NO: 8340 - DNA, 1057 bp, Glycine max
ggagtggggcgagtgataaacatttgataagtcacgcgcggcgccatagcgtgtgatcctaaattaaaccctagctagaggagagggtttaaagctctgaagcttctttcttcttctccaattaagatcgcagagagagatggggagtgacagcgaggcagagaaggagaagaagaagatgcttgcgctcgctcccattgctaaaccccttgccggaaagaagctttgcaagcgaaccctaaaacttgttcgtagagctgccgaacacaaatgcctgaaaagaggagtgaaggaggttgttaaaagcataaggagaggtcataaaggattgtgtgtgattgctgggaacatatcgccgattgatgtcatcactcatcttcctattctctgtgaagactctgacattccttatatttatgtcccatctaaagaagatcttgcaggcgcaggagcaacaaagaggcctacttgctgtgttctggtacagacaaagcctgcaaagggagaaatagagcaaggggaacaagagaaactaaagtcagattatgatcaagttgtgtcggaagttactgagcttacaacttcactattttgaaacaagcacacatgtatgtgtactgtttgttccagttggattaacatgtggtattagtgtaccttacaatcaattgatgtgtggattttattatttttctgtcttgcttatcattttcttgtcatttagtctaccactgccttgatcaatacaacttcatggctttaccatgaggatggctgaagcaatcttgattagaacttagaatcttctctttggtcatagttctctacaatttacagggtttaggattttgatcttctttttctttctttgattcgtaatcgcatctagagggtgggctgtcgaggtaaatgtttctgaaagaagcttattggatgtgtggtgaattaagaaagaccgattttttcaccattcctcaattactggagattgttaatcctttataagttggtggttcggttagagagggaaagggatgacttgtataaattatgcaaa

SEQ ID NO: 8341 - DNA, 712 bp, Glycyrrhiza uralensis
gagataaaccctaaattaaacctttgctcgtgagagtgcaaaaccctgacatccccaaatctctttcatcggagcatagagagagtgagagatggggagcgacagtgagggagagaaatcggtgcagaaagagaaagagaggaagaagatgcttgcgttggctcccattgcaaaaccccttgctgggaagaagctttgcaagcgaacactaaagcttgttcgtagggctgctgaacacaaatgcttaaagagaggagtaaaggaggtggttaaaagtataaggcgaggtcacaaaggattgtgtgttatagctgggaacatatctccaattgatgtcatcactcatgttcctattttatgcgaagagtctgacattccttatgtatatgtcacatctaaagaagaccttgcaactgcaggagcaacaaagaggcctacttgctgtgttttggtgatgaccaagcctgcaaagggtgaaatagagcaaggggaacaggagaaattaaagtcagattatgatcaagttgtgtccgatgttactgagcttacatctacacttttttgaaacaagcacaaatgtatctctactgttggttacagctaaattaacatgtcggcagtgtaccttacaatcaattgatgcatggattttattgttttcctatttggctcgtcactttcttattatgaaggttattgctgccttatcttg

SEQ ID NO: 8342 - DNA, 589 bp, Glycine max
ttctccaattaagatcgcagagagagatggggagtgacagcgaggcagagaaggagaagaagaagatgcttgcgctcgctcccattgctaaaccccttgccggaaagaagctttgcaagcgaaccctaaaacttgttcgtagagctgccgaacacaaatgcctgaaaagaggagtgaaggaggttgttaaaagcataaggagaggtcataaaggattgtgtgtgatagctgggaacatatcgccgattgatgtcatcactcatcttcctattctctgtgaagactctgacattccttatatttatgtcccatctaaagaagatcttgcaggcgcaggagcaacaaagaggcctacatgctgtgttctggtacagacaaagcctgtaaagggtgaaattgagcgaggggaacaagagaaactaaagtcagattatgatcaagttgtgtcggaagtaactgagcttacaacttcactattttaaaacaagcacacatgtatgtgtacagtgtgttctagctggattaacatagtcagcaacctgggcctatattttgtaatttttattcaaagagcaaagaaccaaatgaa

SEQ ID NO: 8343 - DNA, 728 bp, Glycine max
gagggtttaaagctctgaagcttctttcttcttctccaattaagatcgcagagagagatggggagtgacagcgaggcagagaaggagaagaagaagatgcttgcgctcgctcccattgctaaaccccttgccggaaagaagctttgcaagcgaaccctaaaacttgttcgtagagctgccgaacacaaatgcctgaaaagaggagtgaaggaggttgttaaaagcataaggagaggtcataaaggattgtgtgtgatagctgggaacatatcgccgattgatgtcatcactcatcttcctattctctgtgaagactctgacattccttatatttatgtcccatctaaagaagatcttgcaggcgcaggagcaacaaagaggcctacatgctgtgttctggtacagacaaagcctgtaaagggtgaaattgagcgaggggaacaagagaaactaaagtcagattatgatcaagttgtgtcggaagtaactgagcttacaacttcactattttaaaacaagcacacatgtatgtgtacagtgtgttctagctggattaacatagtcagcaacctgggcctatattttgtaatttttattcaaagagcaaagaaccaaatgaagtgccatgaactcattatttagtgtaactcacaatgcagacaagcaagttgacgaagaaattttgcaccatcatgttttgtcatccaaaattgctatatcacccattt

SEQ ID NO: 8344 - DNA, 732 bp, Phaseolus vulgaris
gggttcttcctcattttccaattgagagcgcagagagagagacagagacagagatggggggaagcgacagcgaggtagagaaatcggcgcagaaggagaaggagaagaagaagatgcaggctctcgctcccatcgctaagccccttgctgggaagaagctttgcaagcgtaccctaaaacttgttcgcagagccgctgaacacaaatgcttaaagagaggagtcaaggaggtcgttaaaagcattcgcagaggccaaaaaggattttgtgttatcgctggcaacatttcacccatcgatgtcatcacccatgttcccgttctctgtgaagagtctgacattccatacgtatatgtcccatctaaagaagaccttgcaggtgcaggtgcaactaagaggcctacttgctgtgttttggtacagacgaaacctacaaagggtgaattagagcaaggggaacaagagaaactaaaatctgattatgatcaagttgtatcggaagttaccgagcttacagcttcacttttttgaaacaagcacacatgtatctgtactgtttgttccagatggattctcatgtgttggtagtgtatcttagagtgaattgatgtatgaattttcttattttccttgcttatcagttttttatcatatagtttaccttcattcactgagttcatccttttcccacgactaaaggctgaaatatcttgattggaatttagaatcttct

SEQ ID NO: 8345 - DNA, 827 bp, Cajanus cajan
atgctgggtcttactgaataatcattttttgttacccgtattagccagagtaaacatttggtaagtctaaacctgaatcctgaataaaaccctagttagccagaaagagggtttttgaaggttcttcgtttccgaattgagagcagagagagagatggggagcgacagcgaggcagagaagtcggcgcagaaagagaaggaaaagaagatattggcgctgtctcccattgctaaacccctcgccggcaagaagctttgcaagcgaacccttaaacttgttcgtagagcttctcaacacaaatgcttaaagagaggagtcaaggaggtcgttaagagtatacggagaggtcaaaaagggttgtgtgtcatagctgggaacatatcacccattgatgtcatcacacatgttcctatcctctgtgaagaggctgacattccatacatatatgtcccttccaaagaagagcttgcaggcgcaggagcaacgaagaggcctacttgctgtgttctggtaacgacaaagcctgcaaagggtgaaatagaacaaggggaacaagagaagctaaagtcagattatgatcaagttgtatcagaagtttctgaggttacagcttcacttttttgaaacaagcacacatgtatttgtactgtttgctccagcttaattaacttaggcaggaacctgtgcctatatttgtagttttatttttcaaagagcaaagaaccaaatgaagtgccgcgaactcattatttagtataaactcaaatactgctttagcgccacagtacagagaagcaagttggtggaggttttttgcaccatcgtg

SEQ ID NO: 8346 - DNA, 801 bp, Cajanus cajan
gagtggcccaaataaatgtaaatcctgaataaaaccctagttagccagaaagagggtttttgaaggttcttcgtttccgaattgagagcagagagagagatggggagcgacagcgaggcagagaagtcggcgcagaaagagaaggaaaagaagatattggcgctgtctcccattgctaaacccctcgccggcaagaagctttgcaagcgaacccttaaacttgttcgtagagcttctcaacacaaatgcttaaagagaggagtcaaggaggtcgttaagagtatacggagaggtcaaaaagggttgtgtgtcatagctgggaacatatcacccattgatgtcatcacacatgttcctatcctctgtgaagaggctgacattccatacatatatgtcccttccaaagaagagcttgcaggcgcaggagcaacgaagaggcctacttgctgtgttctggtaatgacaaagcctgcaaagggtgaaatagagcaaggggaacaagagaaactgaagtcagattacgatcaagttgtatcagaagtttctgaggttacagcttcacttttttgaaacaagcacacatgtatttgtactgtttgctccagcttaattaacttaggcaggaacctgtgcctatatttgtagttttatttttcaaagagcaaagaaccaaatgaagtgccgtgaactcattatttagtataaactcaaatactgctttagcgccacagtacagagaagttactgaggttactgcttcacttttttgaaacaagcacacatgtatgtgctgtgtttgtc

SEQ ID NO: 8347 - DNA, 796 bp, Vigna unguiculata
ggattttccaattgagagcgcaaagaaagactgagagagagagatgggtagcgacagcgaggcagagagatcggcggtgaaagagaagaagaagacacagtctttagctcccatcgctaaaccccttgccggcaagaagctttgcaagcgtaccctaaaacttgttcgcagagccgccgaacacaaatgcttaaagagaggagtcaaggaggtcgttaaaagcattcggagaggtcataaaggattctgtgttatcgctggcaacatttcaccgattgatgttatcacccatgttcccgttctctgtgaagagtctgacattccatacatttatgtcaattctaaagaagaccttgctggtgcaggagcaacaaagaggcctacttgctgtgttttggtgcagacgaaacctgcaaagggtgaattagagcaagcagaacaagagaaactaaagtctgactacgatcaagttgtggcggaagttaaggagcttgcagcttcacttttttgaaacaaccacacatgtatctgtattctttgttctagatggattcgcatgtcgtggtagtgtatcatacattgaattgaagtatgagtttaattgttttcctatcttgcttatcagtttcttatcatatagtttgccactaccctgatcatttcactgggttcatccttttgcctcgtggaaaggctgaattagtgctgattacaatttagaatgttttagttggttataattttctacgatttataaagggtttggatcatgaatcttagaagaggatggtttgcg

SEQ ID NO: 8348 - DNA, 802 bp, Lotus japonicus
ttaggtttttaatatgggcccaattttaagcccaacgttgaatgggcctgactataaaacccggaatggcccaacaaaaactgaaggttataaagcaaatgcattcgtaccctaatttataaaccctagttagggagagtgtgaagtgctgaaatccccaaattttcattcattctcaggaactcagagagagatggggagcgacagtgaaggagaaaagtcggtgcagaaggagaaggagaggaagaagctgcttgcggtggctcccattgctaaaccccttgctgggaagaagctttgcaagcgaacactcaagcttgttcgtagagctgctgaacacaaatgcttgaaaaggggagttaaggaggtggttaaaagtataaggagaggtcacaaagggttgtgtgttatagctggaaacatatccccgattgatgtcatcactcatgttcctgtcttgtgtgaagaatctgacgttccatatgtgtatgtcacgtctaaagaagaccttgccagtgcaggagcaacaaagaggcctacttgctgtgttttggtgctgaccaagcctgcaaagggagaaatggagaaaggggaacaagagaaactaaagtcagattatgatcaagttgtgtcagatgttaccgagattacagcttcacttttttgaaacaagcacaaatgtatctgtactgttggctccagttggattaacaatctattgatgtatggattttgatataattctatgtggctctacattttgttgctatttaaactgtacctcccttctttgatcaatcta

SEQ ID NO: 8349 - DNA, 781 bp, Arachis hypogaea
ccccccctatcccctgtgtgccttggcagtctcagaagcagtggtatcaacgcagagtacggggggaccttcacttccaccatcgtcttcgcggcagagagagagagagagagagaatggggagtgacagcgaagcagagaagtcggcgcataaggagaaggagaggaagaagatgcttgcacttgctcctattgcgaagccccttgctggcaagaagctctgcaagcgaaccttgaagcttgttcgtaaggctgctgaacataagtgcttgaagagaggagtaaaggaagttgtcaaaagcataaggcgtggtcataaaggagtgtgtgttatagctgggaacatatcacccattgatgtgatcactcacgttcctatcttgtgtgaagaggctgacattccctatgtttatgtcccctccaaagaagatcttgcaagtgctggagcaacaaagaggcctacttgctgtgtgttggtgatgaccaagcctgcaaagggagaactggagaaaggggagcaagagaaactgaagtcagattatgatcaagttgtaactgaaattaatgagattgcagcttcacttttttgaaatcagtaatacatgtatttatgcccgctgtaccagttggcggttgggttaacgttatcagtagtgtaccttttgcaatcaatttatttggcgtcgtttttctagatgggtaaaaaaaagaaaaaaaacaaaagtactctgcgttgataccactgcttctgagactgccaaaggcacacagggggataggc

SEQ ID NO: 8350 - DNA, 700 bp, Arachis hypogaea
ggtatcaacgcagagtacgggggaccttcacttccaccatcatcttcgcggcagagagagagagagagagaatggggagtgacagcgaagcagagaagtcggcgcataaggagaaggagaggaagaagatgcttgcgcttgctcctattgcgaagccccttgctggcaagaagctctgcaagcgaaccttgaagcttgttcgtaaggctgctgaacataagtgcttgaagagaggagtaaaggaagttgtcaaaagcataaggcgtggtcataaaggagtgtgtgttatagctgggaacatatcacccattgatgtgatcactcacgttcctatcttgtgtgaagaggctgacattccctatgtttatgtcccctccaaagaagatcttgcaagtgctggagcaacaaagaggcctacttgctgtgtgttggtgatgaccaagcctgcaaagggagaactggagaaaggggagcaagagaaactgaagtcagattatgatcaagttgtaactgaaattaatgagattgcagctacacttttttgaaatcagtaatacatgtatttatgcccgctgtaccagttggcagttgggttaacgttatcagtagagtaccttctgcaatcaatttatttggcgtcgtttttctagatgggttaaaaaaaaagaaaaaaaacaaaagtactctgcgttgataccac

SEQ ID NO: 8351 - DNA, 668 bp, Amsonia hubrichtii
cggaatctctgtcttctaaaaccctagtggcctcccttccgccatcgggaaaaaccctaatctgctgcgtgcttttccgggagctgaaaacagagaaaatcggatatgggaagtgatagtgaagcagagaaatcggcgcagaaagagaaggagaagaaaaagctattagctcttgctcccattgctaaacctctcgctgggaagaaactctgcaaacgcactctcaaactcgtccgtcgtgctgcggaaaacaagtgcttgaagagaggggtgaaggaggtggtgaagagcatacgccgtggtaataaaggattgtgtgttatagctggaaatatatctcctattgatgttatcacccacgttccaatcctttgcgaagatgctgatattccttacgtctatgtgccctcgaaagaagatcttgcaaatgcaggagctaccaagaggccaacttgctgcgttttggtgctaacaaaacccacgaagggagtacttggccaggaggaacaagaaaagctgaaggcagattatgatcaggtcgtatcagaagtcaaagagctggctacatcagtattctagatgataggattatcttttaatatgttgtattaaatcctagttgataacgtcggatgctgtgttcttatatcaatcttctttaagcagaa

SEQ ID NO: 8352 - DNA, 789 bp, Rosmarinus officinalis
ggccagagagccagaaaattctaaaaccccggcgtctctttcttctaaaaccctagtggcctcagttccgccatcgacagagcctctgcttcttgctttttcggaaactgagaacagagtaatccgaagatgggaagtgatagtgaagcagagaaatcggcacagaaagagaaggagaagaagaagctattggcacttgctcccattgctaaacctctcgcagggaagaagccctgcaaacgcacgttcaaactcgtacggcgagccgcagaaaacaagtgcttgaagagaggggtgaaggaggtggtcaagagtatacgccgtggtaataaaggattatgtgttatagctggaaatataacacctattgatgttatcacccacgtaccaatcctctgtgaagatgctgatattccttacatctatgtgccttcaaaagaagatcttgcaagtgcaggagccaccaagaggccaacttgctgcgttttggtgctaacaaagcccacgaagggggaacttgggcaggaagaacaggaaaagctgaagtcagactatgatcaggttgtatcagacgtgaaagaacttgcaacatctgtattctagatgataggattatcttttaatttattgtactaaattcatcatgtacctcattttagtttataatgctttatgatgtgttctaaagcttattccaaaatcagaattgcctgttggccattttctattcctctacagggtggaatttagtgaaattgaattgaaatcctactttatgcaagtgccctc

SEQ ID NO: 8353 - DNA, 662 bp, Acacia harpophylla
ggcgttccacgaccgtcattctttcacttccaggaagagatggggagcgataccgaagccgaaaagtcggtacagaaggagaaggaaaaaaagaagatgctaggcctgtctcctattaccaagcctctggctgggaagaagctctgcaagcgtactcttaaacttgttcgtcgagcttctgaacacaagtgcttaaagagaggagtaaaggaagtggttaaaagcgtaaggcgtggtcataaagggttatgtgttatagctggcaatatatcacctattgatgtgatcactcatcttcctatcttatgtgaagaatctgaaatcccatacatatatgtcccctcgaaagaagaccttgcaagtgcaggagtgaccaagaggccaacttgttgcgttttagtgatgaccaagcctgctaagggggaattagataaaggggaacaagaaaaactaaagtctgattacgatcaggttgtatcagaaatcaacgaggttaatgcttctcttttctgaagtacgaattcacttgtactctgttcgggccagttaaagtattttactttggacaaattgctgatattttctatcaaattatcccccgccgtgtttttgttgaccaagattttttttatacaagtttattgctgggcggtcaaaaaaaa

SEQ ID NO: 8354 - DNA, 627 bp, Actinidia deliciosa
ctaaaaccctaaataaaccaccagaagctgcgtcacttcctagagagagaaatatgggaagcgatagcgaagcagagaaatcggcgcagaaggagaagaagaaggtgttagctctggctcccatcgcaaaacccctcgccggcaagaagcttaacaaacgcatcttcaaactcgttcgccgagctgcaggacacaaatgcctaaagagaggggttaaggaggtcgttaaaagtattcgccgcgggaacaaaggattatgcattatagcagggaacatatctcctattgatgtcatcactcatgttccaatcttatgtgaagagtctgacattccctatatttacgtgccatcaaaagaagatcttgcgaatgctggagccaccaagaggccaacatgctgtgttctagttctaaccaagcctgccaagggggagcttgcccaggaggaacaagaaaagctgaaatctgattacgatcaagttgtatcagatgtttctgaacttgcttcctctctgttctgaagaacacaaaattacaagtctcgcattttccatttgatcatgtatgctctattgtggttgatatacaagttatttatatatttttggaaggccaagcagcatgctg

SEQ ID NO: 8355 - DNA, 585 bp, Capsicum annuum
ccctgcttgtacttcaacagagagagagatgggtagcgatagcgaagtagagaagtcggtacagaaagagaaagagagaaagaagctattagctttagctcctattgctaagccgctcgctggaaagaaactcagcaaacgtaccttcaaactcgttaggcgagctgcggaacataagtgcttgaagagaggagttaaagaggtggttaagagtattcgacgtggtcaaaaaggattgtgtgttatagctggaaacatttctcctatagatgtcattactcatgttccaatactatgtgaggaagctgatataccatacatctatgttccctcaaaagaagatcttgcaaatgctggagccactaagaggccaacttgctgcgttttggtatcgacaaagcctactaagggggaacttaggcaggaagatcaagagaaactgaaagaagattatgatcaagttgtatcagaaattcgcgaaataactgcctccttgttttgacattgagggggtttcgcttagttccctgtacttaactctgcaccatttcatctctactttattctggaacacgctgtttaaac

SEQ ID NO: 8356 - DNA, 781 bp, Cucumis melo
tctaaaaacccaagcgtagcggtctccgtcgtcgtcgtcaaaatctcatttttctccggcagttccatcttcaaatcctcttacggaggcaatgggaagtgatagcgaggcagagaagtcgcgtcaaaaggacaaagaaaaggagaagaagaagctgttggctcttgctccaattgccaaaccccttgccggcaaaaagctctgcaagcgtaccctcaagctcgttcgcaaagctgctgagtataagtgcctgaagcggggtgtgaaggaggttgtcaaaagcataaggcgcggtcaaaaaggattgtgtgtaatagctggaaacatttcccccattgacgtgatcactcatgttccaatcttatgtgaagaatcagatattcgttacgtatatgttccctccaaggaagatcttgccaatgcagggtcaacgaagaggccaacatgttgtgtgctggtacaaacaaagccaaacaaaggggagcttggatcaactgaacaagagaaactcaaagctgactttgaccaagttgtagctgaagtatcagaacttactagcactcttttttgaaaagtaaagttgttttctttaacttctctcaatgtacttgtagcatttctcttcaaactggctagtgtactctgttttaccctcaaatttgtttggtcttatgccatttctactcaatcatctctccccaatattaatatatatatataacttattccaaatcatcttgtagagaagcaatcgacagcatccggtgcgtacggatcttgt

SEQ ID NO: 8357 - DNA, 803 bp, Citrullus lanatus
cattctcatcttaaaccctagtaataaagaagagcagaggccaaaaacccgagcagacagcagtctccgtcgtcgtcacaaacccctttttctccggcagttccgttctcaatcctcttatcggaagcaatggggagtgacagcgaagcagagaagtcgcatcaaaaggacaaagaaaaggagaagaagaagcggttggctcttgcaccaattgccaaaccccttgccggcaaaaagctctgcaagcgtaccctcaagcttgttcgtaaagctgctgagtacaagtgcttgaagcggggagtaaaggaggttgtcaaaagcataaggcgcggtcaaaaaggattgtgtgtaatagctggtaacatttcccccattgacgtgatcactcatgttccaatcttatgtgaagagtcagacattcgttacgtatatgttccatccaaggaagatcttgccaatgcggggtcgaccaagaggccaacatgttgtgtgctggtacaaactaagccaaacaaaggggagcttggatcaactgaacaagagaaactcaaggctgactttgaccaagttgtagctgaagtatcagaacttactagtactcttttttgaaaagtaaagctgttttttttttttttgtttttttcaatttctctaaatgtacttgtagcttctctgttctcttcaaactggttagtgtactctgttttactttcaaatttgtttggtgttatgccatttctagtgcaatcatctggcgcaatattattatatatacatacaacttatccaacaaaacaagcaaa

SEQ ID NO: 8358 - DNA, 1037 bp, Cannabis sativa
atacgtgtggtgggaggatagcacgtgttaaggctgacacttaagccgcttaaaccctagaaaacagagaaaccctagtctcattctcttctgccataactcatcgaaggacactgtgtgaacagaagaagaaaatgggaagcgatagcgaagtagagaagtctcatcagaaggagaaagaaaagaagaagatgcaagctctcgctcccattgccaaacctctagctggcaagaagctttgcaagcgaaccctaaagctagtccgtagagctgcggagcacaaatgcttgaagagaggagtaaaagaggtggtcaaaagtataagacgtggccaaaagggagtatgtgttatagctgggaatatttctcctattgatgtcatcactcatgttccaattttgtgtgaagaagctgaaattccctatgtatacgtcccctcaaaagaagatctggcaaatgcaggggccacaaagaggccaacttgctgcgttctggtaatgaccaagcccgccaagggagaactgagcccagaggaactggaaaaactaaagtcagattatgaccaggttaaaacagaggtttctgaacttgcatctacacttttctgagagaagtaatattgttgcctttcttgtactcgtagttgtttagcgtagcttcttttatgcttttcccttgatgtagtactttcatttgcaaatgtgtctgtggctcggttttgtatcataatgttttctttcccagtcatctttatttgattttttattgcaaactttggatgtctattttaagagatagcgactagtgaatttgcatatctcatattaatagggacattaatctatactactggccaaaagaaagaattcattatggtaaaattgtatgttcattcattacatggggtttgacattttttcagttgcaagcatgcaaatgttatgtcgagtaatttggtaacgtttttgttaaaatttgattttgaaaaatataaatttattctataattatttttgtttttttaattttaaaaataa

SEQ ID NO: 8359 - DNA, 646 bp, Lupinus angustifolius
gcttcaattcacgagagagagagagaaatgggtggaagcgatagcgaggtagagaagacggcgcagaaagagagagagaagaagaaggtgcttgctttggcaccaattgcaaaacctctcgctgggaagaaactatcgaagcgaactcttaagcttgttcgtaaagctgctgaacacaaatgcttaaagagaggagtgaaagaggttgttaaaagcataagacgtggtcataaagggttatgtgttatcgctgggaacatatcacccattgatgttattactcatgttcctattctgtgtgaagaatctgaaattccatatgtttatgttcactctaaagaagaacttgcaactgcaggagcaacaaagagaccaacttgctgtgttctggtaacgaccaagcctgcaaagggtgaactagaccaaggggaacaagagaaactgaagtcagattatgatcaagttgcagcggaaatttctgagattacagcttctcttttttgaacaagcaaacatgtatctgaacctctttgttattccgtgattgtcagtagtgtaccttagaatcaatcgatgttatgtttggattttatcatttttatatttggctcagcactagctttttataaatattgctacttagtat

SEQ ID NO: 8360 - DNA, 683 bp, Coffea canephora
ggcacaaagctccgccatcgcaaaaacctgcacctgctttaccatcgtctttttctctgccctgaaacaaaaaatggccaaggcagaaatgggaagcgatagtgaagcggagaaaacggcgcagaaggagaaggacaagaagaagttagcggggcttgccccaattgctaaacccctggccggtaaaaaactctgtaaacgcaccctcaagctcgtccgacgtgctgcagagcacaagtgcttgaaaagaggggttaaagaggtagtgaaaagtattcgccgcggcaataaaggattatgtgttatagctggaaatatatctcctatagatgttatcactcatgttccaatcctgtgtgaagaatctgatattccatacatctatgtgccctccaaagaagatctagctaatgcaggaaccaccaagcggccaacttgctgtgttttggtgctaactaaacccacaaaaggggaacttgggcaggaggaacaagagaagcttaaggcggaatatgatcaagtcacatcagatgtaactgaacttgctaactccatgttctagatcaaggactttatttgtattaaatcgtcatgcactctagtgtggagattatgcctgattctatctctaatttatcacatgttttacccaaggagagaagcatcttcactacaaaaaaaaa

SEQ ID NO: 8361 - DNA, 752 bp, Euonymus alatus
gtcttgccataactccgtcaccctccccttcactctgcttatgcttcccacttcagacgacaacgcacacgctaatacgcgagggtagagagagagtaagagggagggagagagatgggaagcgatagcgaagcagaaaagtcactgaagcaagagaaggagaagaagaaagtcttggctttggctccgatagcgaaaccccttgccgggaagaagctctgcaagaggactctcaagcttgtccgtaaagccgctgaacagaaatgcgtgaagagaggagtcaaggaagtggtcaaaagtattcggcggggaaataaaggattatgtgttattgccgggaacatatctcctattgatgttatcacgcatgtaccaatcttatgtgaagaagctgatatcccatacatatatgtcccctcgaaagaagatcttgcaaatgcaggagccaccaagagacccacatgctgtgtactggtgcaaaccaagcctacaaagcttgaacttgggcaggaggtgcaagaaaaattaaaggcagactacgaccaggtagtgtcagatgtgaatgaacttgctgcctctcttttctgatggaaagtaaccaaatccttgtgttgtcgatggttttttttttggatggttggctctctgtatttaagctctagaccagagcgaggatttgttctaatattttgttggtctcaaattttctgaaatgaaatcaaggtttgatttgggttgcactcccttggtgc

SEQ ID NO: 8362 - DNA, 889 bp, Humulus lupulus
tcttttccttttatctctcggccagaactcatcgaaggactgtgtgaaagcggaagaaaaaaatgggaagcgatagcgaagtagagaagtctcatcagaaggagagagaaaagaagaagatgcaagctctcgctcccattgctaaacctctggcgggcaagaagctttgcaagagaaccctgaagcttgtccgtagagctgctgagcacaaatgcttgaagagaggagtaaaagaggtggtcaaaagtataagacgtggccaaaagggagtatgtgttatagctgggaacatttctcctattgatgtcatcactcatgttccaattttgtgcgaagaagcagaaattccctatgtttacgttccctcaaaagaagatctagcaaatgcaggggccacaaagagaccaacttgctgtgttttggtaatgaccaagcctgccaagggagaactcagctcagaggaactggaaaaactaaagtcagaatatgaccaggtaaaagcagaggtttctgaacttgcagccacacttttctgagaagtaattttgttgcccttcttgtactcgtagctgcttagcttagcttcttttatgctttttccttgatgtagtactttcaattgcactgtggcttggttttgtatcataatgttttctttcccagtcatctttattttatttttattggaaacattggatgtctgatttaagtggtagcgactagtgaatttgcatatcccaattcaaagaggtgatcaggatgtgatggtcttcagaaatccatttgtgaccttgagtttcttgacacttctcaatcgcgtttatgttcaagtctccgcgactaatcgcgattgtgttcaatcgcgttcgcttctcattccaatctgttc

SEQ ID NO: 8363 - DNA, 800 bp, Ipomoea batatas
tttacaaagggcctggactggagactacgccgcgccttgcggtcgacactagtgggctccaaaaaattcggcacgaggctaagttctacgcttctccctccacgtctgccctcgctaatcactcctctcacctagtcacctaacctcggtctcgccggaagcctggtcgcccctcagccagtcactcctcagtaagacagagagagagagagagagagatgggaagcgacagcgaaacagagaaaagtgcgcaaaaggagagggagaagaagaaagtcttggcccttgcccctattgcaaaacccttagccggtaaaaagctcagcaagcgcactttcaaactcgtccgacgagctgcggagctcaagtgcttgaagagaggtgtgaaggaggtggtcaaaagcattcgtcgtggccacaaagggttttgtgtgattgcggggaacatatctccaattgatgtgatcacccatgttcctatcctatgtgaagaatctgatataccatatgtttatgttgcatcaaaagaagatcttgcaaatgctggagctacaaaaaggccaacatgctgtgtattggtgttaacaaagcctgctaaaggagaactcagcccggaggatcaagaaaaattgaaaggagattatgatcaggctgtggccgaagttcgtgagctaacatcatctatgttttgaattttagttcgtgagctaacatcatctatgtttcgaattttgtggttttgaagtttgtacttagaaatgtactctgcttcatttgttagtgattgctaaattatcatc

SEQ ID NO: 8364 - DNA, 855 bp, Rosmarinus officinalis
cggccgggggagaaaaggggcgtaaaataaaaggttcgaaaataaattataggtccttttagtctttcagtctttaatacccacgctgctaactcttctcctaaaaccctagttgttcttccatcctagaaccccaaacccaaaattagtctctcgctcacacacaaatgggaagcgacagcgaggttgagaaatctgcgcagaaggagagggagaagaagaagctcttggctctcgcccccatcgccaagccactcgccggcaaaaagctctgtaaacgcaccctcaaacttgttcgccgagctgcggagcacaagtgcttgaagagaggagtcaaggaggtcgtcaaaagtattcgccgcgggaacaaaggaatatgtgttattgctgggaacatatcacccatagatgtcatcactcatgtcccaatcttatgtgaagaagctgatataccatatgtctatgttccatcgaaagaggacctcgcaaacgcaggagctaccaagaggccgacttgctgtgttcttgtgtcaaccaagcccgccaagggagaaatcgggcaggaggagcaagagaagttgaagggagagtatgatcaggttgcatccgacatatctgaacttgcaaacacaatgttttaggcagtgtaccaaatattacattacagtctgtctacctctatgaggcgtttatgctttacttgagataatgcatttttcccctgcttgttcgattctcgagtttatatattacctctaagaattctagcaattcttgacttcttgtttatgtgtagagggtaaatggggcgaaatgacaaatcacttgagcccgtatatattttctaggtagaag

SEQ ID NO: 8365 - DNA, 1047 bp, Amorphophallus konjac
ggcccaaagcagaccccgagaggaaagcggcagcggcactgcggcgacggcggtactgccagcaggagaaggtagagagagataaaggaggacggagttgtgaaggaagtggggaaggacgaagagcgggagatggggagcgacagcgagacggagaagtctgtgaaggacaagaagaagctgacggcgctggcgcccatcgccaagcccctcgccggcaagaagctgtgcaagcgcaccttcaagctcgtgaggagggctgctgaacataaatgtctgaaaagaggagtgaaggaagtggtgaagagcatccgacgtggacacaaggggttgtgtgtgatagctggaaacatttctccgattgatgtgattacacatgttccaatattatgtgaagagtctgatgtcccgtacatttatgttccttcaaaggaggatcttgccacggcaggagccaccaagaggcctacttgctgtgtgctggtactgaccaagccaaccaaaggggacatgggtcaggaggagcaggagaagttgaagtctgattacgctcaagttgaagccgaagtcaaggaactcgcggcattcctctattgaggaaagcagaaatagaaccagatgcgggtctgtatcgtgatttaaaaacattgttctatgcctcgagaccttccaagatcactggcgagagatgttttttttacttggccttgtgtgggaccggcgtctgcatctcggttgtgaagttaaaaagaggtccatagtgtcatttgcggatgtgtccagtggtgtggcaaagtgatgtgacatgccagtgtctagccgctgttgtagctctgggttttctagtcgcaggtggtgttgtctggaagcttctttttaatttagaagagctcgttaaatttatacccgggaatgtataagattgtagtttcgctgattgcatgggttgctattacaggaaacttgctgcgtgcgtgcgtacgcgcttcgcagacaactaaaaaagagcgtgcatgtgaaacgaggtcattttgacatccccgaagg

SEQ ID NO: 8366 - DNA, 916 bp, Theobroma cacao
cacattattattggttgtacattcatagattctctctcttggcagtgctccgtttttgcattgttagcggaaaagagagagagagggaaatgggaagcgatagcgaagtagagaagacgcaacagaaggagaaggagaggaagaagatgttagctgttgctcccatcgcaaagcccctcgctggcaaaaagctctctaagaaaaccctcaagctcgttcgcagagccgctgagcacaagtgcttgaagagaggagtaaaggaagtggttaaaagtattcggcgtggtcataaaggattatgtgttatagctggaaacatatctcctattgatgtcataactcatgttccaatcctatgtgaagaggctgacattccctatgtttatgttccctcaaaagaagatcttgcaactgcaggagctaccaagagaccgacatgctgtgttctggtgctaaccaagcccactaaaggggaactaggccctgaggatcaagaaaaaataaaggctgattatagccagatagtagcggatgtaactgagcttacaaccacccttttttaattaacgaaatttttgttgttgtgcttgttatctaagcttttgatgatggcaccctagtttctgcttcttatgcaatgtgctttagttgatacttattgtagtatactgctatttacttcttctttcttggtatttggctatctgctttaactagggaggctccggatgaaaactttcttttacttactttaaccctcctggcctttacagatgtgtcaatggtgcgagtacaaaactcgtgactttgctctcgctacttcattcccatgcagtgtgactcgttacttagcgtgcatcaccaacgttccgctccgttgcttcaactaaatggtttgcttcaataagttattctt

SEQ ID NO: 8367 - DNA, 669 bp, Manihot esculenta
agctcttctgtcccttacactcaagagtcagagaaagattgaaagaggagatatgggaagtgatagcgaagcagagaggtcgcagaagcaggagaaggacaagaagaagattttggctctgtctcctatcgccaagccccttgctggtaaaaagctctgcaaaagaaccctcaagttagttcgccaagctgctgaacacaaatgcttgaagagaggtgtgaaagaggtggttaaaagcattcggcgtggtcataaagggttatgtgttatagctgggaatatatctcccatagatgtaatcactcatgtcccaatcttgtgtgaggagtctgacattccttatgtatatgttccctcaaaagaagatcttgcaaatgcaggagctaccaagagacctacgtgttgtgttctggtgttaaccaagcctcctaagggagaactagtccaggaggaacaggagaaattgaaggaagacttttctcaagttgcagctgatgtatctgaacttaactcctctcttttctagtggagaaaatggtagttattgtagtttgggtgatgtaatatacagttgttgaagtgattttgttgcggttggataatgtaacaaagcttttctccccatcaatggtaatgatttttaggaaattattaaatgcactggaatac

SEQ ID NO: 8368 - DNA, 652 bp, Cucumis sativus
cgtcgtcgtcaaaatcccatttttctccgatagttccatcttcaatcctcttacggaggcaatgggaagtgatagcgaggcagagaagtcgcgtctaaaggacaaagaaaaggagaagaagctcttggctcttgctccaattgccaaaccccttgcgggcaaaaagctctgcaagcgtaccctcaagcttgttcgcaaagctgctgagtataagtgcttgaagcggggtgtaaaggaggttgtcaaaagcataaggcgcggccaaaaaggattgtgtgtaatagctggaaacatttcccccattgacgtgatcactcatgttccaatcttatgtgaagaatcagaaattcgttacgtatatgttccctccaaggaagatcttgccaatgctgggtcgacgaagaggccaacatgttgtgtgctggtacaaacaaagccaaacaaaggggagcttggatcaactgaacaagagaaactcaaagctgactttgaccaagttgtagccgaagtatcagaacttactagcactcttttttgaatagtaaagttgtttctttatcttctctcaatgtacttgtagcatttctcttcaaactggttagtgtactctgttttaccctcaaatttgtttggtcttattccatttcaactc

SEQ ID NO: 8369 - DNA, 731 bp, Euonymus alatus
agtcttgccataactccgtcaccctctacccttcactctacttatgcttcccacttcagacgacaacacacacgctaatacgcgagcgtagagagagagtaagagggagggagagagatgggaagcgatagcgaagcagaaaagtcactgaagcaagagaaggagaagaagaaggtcttggctttggctccgattgccaaaccccttgccgggaagaagctctgcaagaggactctcaagcttgtccgtaaagccactgaacagaaatgcgtgaagagaggagtcaaggaagtggtcaaaagtattcggcggggaaataaaggattatgtgttattgccgggaacatatctcctattgacgttatcacgcatgtaccaatcttatgtgaagaagctgatatcccatacatatacgtcccctcgaaagaagatcttgcaaacgcaggagccaccaagagacccacatgctgtgtactggtgcaaaccaagcctacaaagggagtacttgggcaggaggtgcaagaaaaattaaaggcagactacgaccaggtagtgtcagatgtgaatgaactcgctgcctctcttttctgatggaaagtaaccaaatccttgtgttgtcgttggttgttttcttggatggttggctctctgtataccagagggaggatttgttctaatattttgttggtcccaaattttctgaaatgaaatcaaggttcgatttgggttgc

SEQ ID NO: 8370 - DNA, 691 bp, Sarracenia psittacina
acagagtagagggcgagcggcacgccagagagagagagaaataccctagtcctctatccccaaatctctactcacgtccctcgccgaaactcttgttctccagtttgctcccgagagatagagagaggagatagagagataatgggaagcgatagcgaagcagagaagacggcgcagaaggagaaggagaagaagaagatgttagctctggctcccattgccaaaccccttgctggcaagaagctctgtaaacgcactctcaagcttgtccgccgagctgctgaacaaaaatgcctgaagagaggagtcaaggaggtagttaaaactattcgccgcggtaacaaaggattctgtgttattgcggggaacatatcacctattgatgtcatcactcaccttccaatcttatgtgaagaagctgacattccttatgtttacgtgccatcaaaagaagatcttgcaaatgcaggagcaacaaagaggccaacgtgctgcgtcttggtgctaaccaagccgacaaagggggaaattagccaggaggaacaagaaaagctgaaggcagattatgatgcagttgtaacagatgcttctgaacttgcttcctctatgttctgaacgacgttgctgtattcagttctgcatttttttatttattttggcaaaacagcaggaaagtgcagtaccttttttc

SEQ ID NO: 8371 - DNA, 620 bp, Tripterygium wilfordii
gagatgggaagcgatagcgaagcagagaagtcacagaagcaagagaaggagaggaagaaggtcatagctttggctccgatcgccaaaccccttgccgggaaaaagctctgcaagaggactctcaagcttgtccgtaaagccgctgaacagaaatgcgtgaagaggggagttaaggaagtggtcaaaagtatcaggcggggcaataaaggattatgcgttattgccgggaacatatctcctattgatgttattactcatgtaccaatcttatgtgaagaatcagagatcccatacatatatgtcccctcgaaagaagatcttgcaaatgcaggagccaccaagagaccaacatgctgtgtactggtgctaaccaagcctacaaagggacaacttgggcaggaggagcaagaaaaattaaaggcagactacgaccaggttgtatcagacgtgtccgaacttacttcctctcttttctgatggaaaacaactaaatccttgcacctcttcaaagcccacttcatttaggctcctttcattccccatgttggtttgatgttctctgtctttacaagtaacaatatgaacaagtatattagtaatatcatatgaagctttgaccc

SEQ ID NO: 8372 - DNA, 525 bp, Fraxinus spp
cgggccgggggaccccaacttcgtctgcctctcttaacgaaaaactaggaacagagagagatgggggagcgatagcgagacagagaaaagtgcccataaagagagagagaagaagaagttactggctcttgcgcccatcgctaaacccctcgccggcaaaaaactctgcaaacgcacccttaaacttgttcgccgagctgccgagcataaatgcttgaagagaggcgttaaggaggtggtcaaaagtattcgccgaggaaacaaaggattatgtgtcatagctgggaacatatcaccaatcgacgttatcactcatgttcccatcttatgtgaagaatctaacattccttatatctatgttacctcgaaagaagatcttgctaatgcaggagccaccaagagaccaacttgctgtgttcttgtgctaaccaagcccaccaagggagaaattgctcaggaggaacaagaaaagttgaagggagattacgatcaggtttcatcagaagtatctgaactagctaattc

SEQ ID NO: 8373 - DNA, 934 bp, Gossypium hirsutum
ataacaataactaataataataaagcttaagctaacagcctcttgcctagtggagcataagagtaaaaataataacgataaagcttaagccctgggaacttgtacactaattcgggcaatcacttaacaattcttcacgttgcagtagttatattgtgtacactctcgttgtgtttttagttaattttgcattgttaaagagaaatggggagcgatagtgaagccgagaagtcgcagcagcggaaggagaaggagaagaagaagatgttagctgttgctcccattgcaaagccactcgctggcaaaaggctgtgtaagaaaaccttcaagctcgtccgcaaagctgctgagcacaaatgcttgaagagaggagtaaaggaagtggttaaaagtattcgtcgtggtcataaaggattatgtgttatagctggaaacatatctcctattgatgtcataactcatgttccgattctatatgaagaggcagacattccctatgtttatgttccttcgaaagaagatcttgcaactgcaggagctaccaagagaccaacgtgctgcgttctggtgctaaccaagccaaccaaaggcgaactagacccttcagaacaagaaaagataaaggccgattatagccaggtagtagcagatatatctgagcttacatcctcactcttttaagaaattgtgttgtcatatatatatgtaagctttgatgtttagattctatcttctgcttctctaggcgatgtgctttactgagttgatacttcattgtaactatgtatctggcttagctttcattttaacccacctctgtctttatttagttaaattctcatccctttctctcaaatgtgtaatggttaaaaaaaaacacatgaaatgtatcagaattacgtttcctgcttggcctgtgaataaattattgttt

SEQ ID NO: 8374 - DNA, 2152 bp, Euonymus alatus
tcagaacccaacttatattttaaagtcatcgagacgagtaacggcagaccaaattaaggctgtcatatccaaagaacacacagaaaggacagaggaaacttatgacatatatcttctgccacctggtgaagaccctgaagcttgtcaatcatacctgaggatgaggaatagggatggaaaatacagtctaatgtttgaggagtgggttacagatagtccatttataatatcaccaaggataacttttgaagttagtgtgcgccttcttggtgggctgatggctttggggtatacaattgcaagtatccttaaaagaagcagccatatcttcactgatgaccgggtgtgtgtgaaaactgattggttagaacaactaaatcgccattatgttcaggtgcaagggaaagaccgtttggatgttaaatttgtagctgagcagctgggtcttgatggttcatatgttcctcgcacttacatagaacaaatacagcttgagaagcttgtcaatgatgttatggcattgccagatgatttgaagacaaagcttagtattgatgacgatatggcttcaagccccaaagaagccctttctcgtgcctccacagataggagaaataagtatctcagccggagcgtatcactttcaaatcaacgagagaaaatctttcaaagcttacaagacttgctgttaataatccaaggttcgacggaagagcacctgaatctcctgccccgcttgcaaaccagggagccattactcaactctctgaacaacttaccacattgagtgagaggatggatgagttcacatcacgcattgaagagataacttccaagttttctgccagggaagtttcagctagccagcaaaacttagtgttgcccgctgaagcatgtaatggatcaggaccaacttctcttttcgtggctggcttgaataatggttcgttaatgccccactctacatccgcttcgcaactggcaagggaacctcctgtgatggaagagattctccagattagtcgggggcaacggcaaatcgtacatcaactagacaccttcagtaatctgttgcatgaatatgtgggagaaagaagtagccaagacagaacaaatgggacagacagagctgtttccatcagtattccactgccaattcttcttactgttgctgttggtgggttaggagtgctgttgtttcgtggattcctgtcccgaaagtgatcaccctgatgggcaccttaaagcaatcgttcatagtgaaatccttgtccatagtaataaataataccattactaagtttgagatttggaggtcagagcttttacaagtccagaatatcttccaatttcatgaaaatatgataatactgctgttgacggcatctatcttgttcataacaacttgtaaagactaagaaaatcaaaccaaaaaggggcatgaaaggagcctaaatgaaatggctttgaagcaatacaaggatttagttgttttccattagaaaagagaggaaacaagatcagacacgtccgataccacctggtcgtagtctgccttcaatttttcttgctcctcctgcccaagttctccctttgtaggcttggtttgcaccagtacacagcatgttggtctcttagtggctcctgcgtttgcaagatcttctttcgaggggacgtatatgtatgggatctcagcctcttcacataagattggtacatgcgttataacgtcaataggagatatgttcccggcaataacacataatcctttgtttccccgcctaatacttttgaccacttccttaactcccctcttcacgcatttctgttcagcggctttacggacaagcttgagagtcctcttgcagagcttcttcccggcaaggggtttggcgatcggagccaaagctatgaccttcttcctctccttctcttgcttctgtgacttctccgcttcgctatcgcttcccatctctctctctctctcccactctctacgctcgcctattagtgtgtgttgtctgaactctagtgggaagcaggagcagaatgagaggtggaggataatggcggagttatagcagagtttactagggtttggtttgcttcaagggtttagagaacacacagcgcaaagttcccagcccggccg

SEQ ID NO: 8375 - DNA, 828 bp, Quercus alba
gaaacaaaaaccctagtttcagtgtctccgctaatacattacacaccaagcttagcctcagagaaaaaaaaaaaaaatagggaagcgatagcgaagcagagaagacgcagcagaaggagaaggagaggaagaagcttctagccctcgcccccattgccaaaccccttgctggaaagaagctctgcaagcgcaccctcaagctcgtccgcagagctgctgagcacaaatgcttgaagagaggagtaaaggaggtggttaagagtatcaggcgtggtcataaaggaatatgtgttatagctgggaacatatcacctattgatgtgattactcatgttccaatcttatgtgaagaggctgacattccctatatatacgttacctcaaaagaagacctcgcaaatgcaggggccactaaaaggccaacatgctgtgttctcgtgctaaccaagcctacaaaaggagaattaggtgcagaggaacaggaaaaactaaatgaagactataagcaggttgctgcggaagtgtctgaacttgcatcaactattttctgaagtagaacaaagcatttgtactttatttaagctggtagaatatcttgctgtttcatgtaatcttttgaagtgggtagaggtagagatgttttccatatgtccaagcatttggggtgtcttttgtgtgttaagagcaagcaatgtaggttcatagagcttagatccaacttttgaatcactaagataaacacattggtgctagctaattgtcttggacgcgtacttttaaatatgaggctagaaagctttattatgttcaaaaaaaaagacacgcgag

SEQ ID NO: 8376 - DNA, 654 bp, Manihot esculenta
gcccttctctgcattacacacagagagcttgggagaggagatatgggaagtgatagtgaaacagagaggtcgcagaagcaggagaaggacaagaagaaaatactggctctttctcctatcgccaaacatcttgctggtaaaaagctctgcaaaagaaccctcaaattagttcgcagagctgctgaacacaaatgtttgaagagaggagtaaaagaagtggttaaaagtattcggcgtggtcataaagggttatgtgtcatagcggggaacatatctcccatagatgtaatcacccatgtcccgatcttgtgcgaggaggctgatataccctatatatatgttccatcaaaagaagatcttgcaaatgcaggagccaccaagagacctacatgttgtgttctggtgttaaccaagcctactaagggagaactagcccaggaggaacaagagaaactaaaggcagagctttctcaggttgcagctgatgtgtctgaacttacctcttctcttttctagtggacaaagtgacagttattgtagtttcagctgatgtaatatgtagttatgagtgtgatttttgttccggttggataatgaaccaaaacatttttttttaatcaattataattgtagttgagttgtaatagttgctcc

SEQ ID NO: 8377 - DNA, 665 bp, Ricinus communis
gacggaccgcaaaaaccctagtcttcacataactttcactgcgccagagagagagaagagagatgggaagcgatagtgaagcagaaagatcgcataagcatgagaaggagaagaaaaagattatagctttatcacctattgccaagccacttgctggcaaaaagctctgcaagagaactctcaagctagttcgcaaagctgctgaacacaaatgcttgaagagaggagtgaaagaggtggtcaaaagtatccgtcgtggtcataaagggttatgcgtcatagctggcaacatatctcctattgatgtaatcactcatgttccaatcttgtgtgaagaggcagacattccatatgtatatgttccctcaaaagaagatcttgcaaatgctggagttaccaagaggcctacatgttgtgttctggtgttaaccaagcctcccaagggagaaattccccaggaggaacaagagaaacttaaggcagatttttctcaggttgcggcggatgtgtctgagcttgcatcctctcttttctgatcaacaacatgacacatttaatgtagcttttatccaatttttaaacttgatgttggctgatgtaatatgtagttgttaatgtcgtctattgcatttggataagttgccaagatttttgctctgtttcct

SEQ ID NO: 8378 - DNA, 715 bp, Castanea mollissima
gggaagcgatagcgaagcagagaagacgcagcagaaggagaaggagaggaagaagcttctagccctcgcccccattgccaaaccccttgctggaaagaagctctgcaagcgcaccctcaagctcgtccgcagagctgctgagcacaaatgcttgaagagaggagtaaaggaggtggttaaaagtataaggcgtggtcataaaggattatgtgttatagccgggaacatatcacccattgatgtgattactcatgttccagtcttatgtgaggaggctgacattccctatatttacgttacctcaaaagaagacctcgcaaatgcaggggccactaaaaggccaacatgctgtgttcttgtgctaaccaagcctacaaaaggagaattaggtgcagaggaacaggaaaaactaaatgaagactataagcaggttgctgcagaagtgtctgaacttgcatcaactattttctgaagtagaacaaagcatttgtactttatttaagctggtagaatatctcgctgtttcatgtaatcttttgaagtgggtagagctgttttccttatgtccaagcattcggggtgtctattgtgtgttaagagaaagcaatgtaggttcatagagcttagatccaacttttgaatcactaagatatacacattggtgctagctaattgtcttggacaagtactatgatgctagaaagctttattatgt

SEQ ID NO: 8379 - DNA, 661 bp, Sarracenia psittacina
agagagagaaataccctagtcctctatccccaaatctctactcacgtccctcgccgaaactcttgttctccagtttgctcccgagagatagagagaggagattaagagatcatgggaagcgatagcgaagcagagaagacagcgcagaaggagaaggagaagaagaagatgttagctctggctcccattgccaaaccccttgctggcaagaagctctgtaaacgcactctcaagcttgtccgccgagctgctgaacaaaaatgcctgaagagaggagtcaaggaggtagttaaaactattcgccgcggtaacaaaggattctgtgttattgcggggaacatatcacctattgatgtcatcactcaccttccaatcttatgtgaagaagctgacattccttatgtttacgtgccatcaaaagaagatcttgcaaatgcaggagcaacaaagaggccaacgtgctgcgtcttggtgctaaccaggccgacaaagggggaaattagccaggaggaacaagaaaagctgaaggcagattatgatgcagttgtaacagatgcttctgaacttgcttcctctatgttctgaacgacgttgctgtattcagttctgcatttttttatttattttggcaaaacagcaggaaggtgcagtaccttttttc

SEQ ID NO: 8380 - DNA, 785 bp, Eucalyptus grandis
gcgactgtctctgcttcttccgacttcacagagagagagagagagagagagagagagatggggagcgacaccgaagcggagagagcgcagaaggagaaggagaaggagaggaagaaggtggcggcgctggcccccatcgcgaagcccctcgccggcaagaagctctgcaagcggaccctcaagctcgtccgtcgagctgctgagcagaaatgcttgaaaagaggtgtgaaggaggtggtcaagagcatcaggcgcggtcacaaaggattatgcgtcattgctggcaacatatcacctattgatgtgatcactcatgttcccattctatgtgaagaaaatgatatctcctatatatatgttccctcgaaggaggatctagcaaacgcaggagcaacaaagaggccaacatgctgtgttctggtacttacaaagccaactaagggtgaattaggcccagaagagcaagaaaaaataaaggctgattatgaccaagttgtaacagaagtatctgaacttacctccactcttttttaaaacgtcgccatccttagggatctgcttcttttatgttcattactttgctagttatggttattgtattgtctgtgtagcccactcgtctctgcagttttttggcgccacggcacatctataaaatcatgtatgcgcatcttaagcagttgccacaaaagctggtaaagcaatatcagtacaacggattgtgcttttagagtgtcatgaacagtaatacaaatgaattcttgcaacatcgatttgcctacaaa

SEQ ID NO: 8381 - DNA, 495 bp, Vinca minor
ggaagtgatagtgaagcagagaaatcggcacagaaagagaaagagagtaagaagaagatatcagcacttgctcccattgctaaacctctcgctggtaaaaaactctgcaaacgcaccatgaaactcgtccgtaaagctacggaaaataagtgtttgaagagaggggtgaaggaagttgttaagagtattcgccgtggtaataaaggattatgtgtcatagctggaaacatatcacctatcgatgttatcacccacgttcccgtcctatgtgaagatgctgatattccttatatctatgtgccctctaaagaagatctcgcaaatgcaggagccaccaagaggccaacttgctgtgttttggtgctaacgaagcctacaaagggggaacttggccaggaggaacaggaaaaattgaaggcagattatgatcaggttgtatcagaagtcaaggaactcgcaacttctgtaatctagatgatagggataatctttcag

SEQ ID NO: 8382 - DNA, 711 bp, Catharanthus roseus
tcggcacgaggctcaagtccgccatcgacagagcttctcttcttcttccggaactgaaaataaagaaaagccgaaaatgggaagcgatagtgaaacagagaaatcggctcataaagagaaggataagaagaagctatcagcgcttgctcccattgctaaacctctcgccggaaagaaactcagcaaacgaaccttcaaactcgtacggagagctgcggaaaacaagtgcttgaagagaggagtgaaggaggttgttaagagtatacgccgtggtaataaaggattgtgtgttatagctggaaatatatcacctattgatgttatcacccacgttccagtcctctgtgaagattctgacattccttacatctatgtgacatcaaaagaagatcttgcaagtgcaggcaccaccaagaggccaacttgctgcgttttggtgctgacgaaacccacgaagggggaacttagccaggaggaacaggaaaagctgaaggcagattatgatcaagttgtatcagaagtcaaagagcttgcaacttctgttttctaaaggataggattatcttttaatttcctgtattaaattcattatgaatccagttttagttggtaatgccttgtgttgtgtacttcatcaatcttttcaaggagaaaatcatattcagaaatcagaattgcctattgttggtcattatctatttcacttgctgg

SEQ ID NO: 8383 - DNA, 832 bp, Cocos nucifera
acataagccctcgtgtctttggacccttaaaacccctccagcgcgcttcgagaacactccccaactcacccgtagcggagaaagagaggggaggcagaacgcagggagggagaggaagatggggagcgacagcgagaccgagaaatctatcaaggagaagaagaagatgatggctgtcgccacgatcgcgaagcctctcgctgggaagaagctctccaagcggaccctcaagctcgtccgaagagcttctgaggctaagtgtttgaaacgaggagtaaaggaagtagtgaagagtattcgtcgcggtcataaaggattgtgtgttatagcaggaaacatttccccaattgatgtgatcacacatgtgcccatcttatgtgaggaagctgatatcccatacatatatgttccttcaaaagaggatctcgcaactgctggggtcaccaagaggcctacatgctgtgtattggtactaaccaagccaaccaagggggaattggcccaggaggtccaggagaagctacaggctgatttcgaccaggttgtagcagaggtgaaggagctgacatcctccctcttctgaaaaggaagaacaaaaattatttttatgtgcgacatgtccaattattttgttggctctatttgatatgagctgtcaatgtccatgggcaagaagcagatgctgtacgttcttgtaggggaccaaagagcaaagttgttccagtttgttcttgttatttcttgtttgtcgaacgtgagggatgtattagctggttgctggatcccaggcattgttatgtttcggtgataggttggtttgtgagcatttttt

SEQ ID NO: 8384 - DNA, 680 bp, Panax ginseng
cccctcgcctccccctccctcccctccgctctcacataataaaccctactcctcaatttttagggcgagaagaaagagaggagagataaagagaaatgggaagcgatagtgaagcagaaaagtcagcacacaaggagaagaagaaggtgttagctttggccccaattgctaaaccccttgccggcaagaagctctccaagcgtgccctcaaactcgtccgccgagctgccgagcaaaaatgcttgaagagaggtgttaaggaggtggttaaaagcatccgtcggggtaacaaaggattatgtattatagcagggaacatttctcctattgatgtgataactcatgttccgattttatgtgaagaggctgaaataccctacatttacgtcaactccaaagaagatcttgcaaatgctggtgccaccaagaggccaacatgctgtgttttggtgctaaccaagcccaccaagggggaactttctcaagaagaacaagaaaagttgaaatccgactatgatcaagttgtatcagatgtgtctgagcttgctagttctatgttttaagatctcaaagcagactatgatgtctgtacttttccatattgaagtactctttgttttggctgatatatatggatgtttcacgtacagcaatgaattaattattagcttacattctgc

SEQ ID NO: 8385 - DNA, 921 bp, Prunus mume
gcagaaggtaggattgtgcgagacttgagagagacagagagagtgaaaaatcctggtctccagaaagaaagaagaggaagagagagatgggaagcgatagcgaagtagagaagacggcgcaaaaggagagggagaggaagaagatgcaggctcttgctcccatagccaaaccccttgccggcaagaagctctgcaagcgaaccctcaagcttgtccgcagagctgctgagaacaaatgcttgaagagaggagtgaaggaggtagtcaaaagcataaggcgaggccaaaaggggttatgtgttattgctgggaacatttctcctattgatgtgatcactcatgttccaatcttgtgtgaagaggctgaaattccatatctttatgtgccctcaaaagaagatcttgcaaatgcaggggccaccaagaggccaacttgctgtcttctggtgatgaccaagccttccaagggggaattaggccaagaggaacaagataaactaaaggcagattatgaccaggttgtaggagatgtttctgaacttcaatcctcccttttctgaaggctggaaacattttacttgcctttgtcctgattatcttatttgaggttattttccttttttttaatccctctgactgatgggccttgtactttgttttagaaaaaattaaaatgtgcttgtttgtgtaactattgaagtggaacgttaggcataattggttttctttattgaacttgagacccctgttcatcacaagttagctatgaggttccaaaggactctgttctctctctctctctctctctctctctcagattgcaatatggctttcagatttggttgatccatatgcaattcatcattttctatattctagacttatttatatattttgacaaaaaagagcacttatcttgga

SEQ ID NO: 8386 - DNA, 669 bp, Prunus persica
aggtttgtgcgagacttttgagagagagtgtaaaatcctagtatccagaaagaaagaagaggaagagagagatgggaagcgatagcgaagtagagaagacggcgcaaaaggagagggagaggaagaagatgcaggctcttgctcccatagccaaaccccttgccggcaagaagctctgcaagcgaaccctcaagcttgtccgcagagctgctgagaacaaatgcttgaagagaggagtgaaggaggtagtcaaaagcataaggcgaggccaaaaggggttatgtgttattgctgggaacatttctcctattgatgtgatcactcatgttccaatcttgtgtgaagaggctgaaattccatatctttatgtgccctcaaaagaagatcttgcaaatgcaggggccaccaagaggccaacttgctgtcttctggtgatgaccaagccttccaagggggaattaggccaagaggaacaagataaactaaaggcagattatgaccaggttgtaggagatgtttctgaacttcaatcctcccttttctgaaggctggaaacattttacttgcctttgtcctgattatcttatttgaggttattttcctttttttaatccctctgactgatgggccttgtactttgttttagaaaaaattaaaatgtgcttgtta

SEQ ID NO: 8387 - DNA, 719 bp, Sarracenia psittacina
agagagagaaataccctagtcctctatccccaaatctctactcacgtccctcgccgaaactcttgttctccagcttgctcccgagagatagagagaggagattaagagatcatgggaagcgatagcgaagcagagaagacagcgcagaaggagaaggagaagaagaagatgttagctctggctcccattgccaaaccccttgctggcaagaagctctgtaaacgcactctcaagcttgtccgccgagctgctgaacaaaaatgcctgaagagaggagtcaaggaggtagttaaaactattcgccgcggtaacaaaggattctgtgttattgcgggaacatatcacctattgatgtcatcactcaccttccaatcttatgtgagaagctgacattccctatgtttacgtgccatcaaaagaagatcttgcaaatgcaggagcaacaaagaggccaacgtgctgcgtcttggtgctaaccaagccaacgaagggggaaattagccaggaggaacaagaaaagctaaaggcagattatgatgcagttgtatcagatgcttctgaacttgcttcctctatgttctgaacgacgttgccatattctgttctgcattttttatttattttggcaaaacagcaggaaagtagagtaccttttttcctgttcatctgtatgttctcaaaacatgcgttactgaatttaatgaatgatttcatttcat

SEQ ID NO: 8388 - DNA, 582 bp, Tabernaemontana elegans
cgagaaaccctactctgcttcgtgcttttccggaaactcaaaacagagaaaatcaaagatgggaagtgatagtgaagcagagaaatcggcgcacaaggagaaggagaagaagaagctattggcagttgctcccattgctaaacctctagccgggaaaaactcggcaaacgcaccctcaaactcgtacgtcgagctgcggaaaccaagtgcttgaagagaggggtgaaggaggtggtgaagagtatacgccgtggtaataaaggattgtgtgttatagctggaaatatatctcctattgacgttatcacccatgttccaatcctctgcgaagatgctgatattccttacatctatgtgccctcaaaagaagatcttgcaaatgcaggagccaccaagaggccaacttgctgtgttttggtgctaacaaagcccacgaagggggttcttgcccaggaggaacaggaaaagctgaaggcagattatgagcaggtcgcatcagaagtccgagaacttgcgtcatccgtattctagataataggattacctttaatttgttgtgctaaattcatcatgtacccatac

SEQ ID NO: 8389 - DNA, 746 bp, Cucurbita pepo
agaagacagcaatctccgtcgtcgtcgtcacaaattcctctccggcagttccattttggatactctcatcggaagaaatggggagtgatagtgaggtagagaagtcgcataagaaagacaaagaaaaggagaagaagaagctgtcggctcttgcaccaattgccaagccccttgccggcaagaagctctgcaagctcaccctcaagcttgttcgcaaagccgctgagcataagtgcttgaagcgaggggtaaaggaggttgtcaaaagcataaggcgtggtcagaaaggattgtgtgtaatagctggaaacatatccccattgatgtgatcactcatgttccaatcttatgtgaagaggcagatattcgctacctatatgttccttccaaggaagatctcgccagtgcaggttcgaccaagaggccaacatgttgtgtgctggtacaaaccaaaccaaacaaaggggagcttggatcaactgaacaagagaaactcaaggctgattatgatcaagttgttgcagaagtatcagaatttacgagaacccttttctaacgagtaaagctttgtttttccttttttgtaactttctcaagcattttcctccaaacttgtcgtgtactctgtattactttcaaagttgtttgatcctacgccaccttgacaactagtgtgactggtctagacgtgattttttaagaaattagttgtacaaaattatgggagggagttttgacaactaatc

SEQ ID NO: 8390 - DNA, 688 bp, Vaccinium corymbosum
gacagcgaagcagagaagtcggcgcagaaggtgaaggagaagaagttgttgctagcacttgccccaatcgctaaaccccttgctggcaagaagctctccaaacgcatcttcaagctcgttcgccgagctgcaggacacaagtgcctgaagagaggagttaaagaggtcgttaaaagtattcgccgtggtaacaaaggattgtgcgttatagcagggaacatatctcctattgatgtcatcactcatgttccaatcttatgtgaagagtctgacattccctatatatatgtgacatcaaaagaagatcttgcaaatgcaggagctaccaagaggccgacatgctgtgttctagttctaaccaagccggccaagggggagcttgcccaggaggaacaagaaaagctgaaggcggagtacgatcaagtagcatcagatgttactgaacttgcttcctctatgttttgatgaactccacaaatgtattgagtattgcatttccccaattactgctgtgcgcgctattttgatttgatatatcatgtgatatttttacatgttgcgaaagccaagaaactgtatcccaaaagcttggggttgttcctaaatctcgtttctatccctctagaagttttataaagttgtcatctgttttgttggtgctactttccgtgcttggttgttaagattt

SEQ ID NO: 8391 - DNA, 975 bp, Citrus clementina
gctgccaaaaccaaattatcagcgcccataactgaaaaagaaaaaccctagtctctgtttcgtgcaattcattgagaactgaaaaaagaaaatgggaagcgacagcgaagcagagagaaccccacataaagatgagaagaagaagattgttagtcttgctcccattgctaaacctctagctggcaagaagctctccaaaagaaccctcaagcttgtccgtcgagctgctgaacacaaatgcttgaagagaggagtgaaggaagtggtcaaaagtatccgccgtggtcataaaggattatgtgttatagctgggaacattagtccaattgatgtcatcactcacgttcctatcttatgtgaagagtctgatattccctacatttatgttgcttcaaaagaggatcttgcaaatgcaggtgccacaaagaggccaacatgctgtgttttggtgctaactaagccaactaagggagaactaggacaagaggaacaagataagttgaaagctgattataccctcgttgtagaggatgtgaaggaactggcatcctctcttttctgatgaactagacttaaagccaacaaagatgattgtgcttacagatatgtttgatttcgaaccttccctttctagctgagtaatgtactctagttttgtcgaatgtaaaatgcagtttgcctctgttgcatgagatggttggttttcatgtctcatatgtgggtatattgcttttatttttatttttttaagagcaaactgcgaaataatctaatttttagtgcaaatctctggaaatattgttggtatatattcttttatgctcttatttccctttccaagcaactttcactgatgattacttccagtgaatccagcataatagctagaggcctaacgcgcatgaatgcagaggaatggtcattgttcccagtgaggaaccccaccggaaccacttgttggaaacaaataatggg

SEQ ID NO: 8392 - DNA, 892 bp, Citrus sinensis
aagaaaatgggaagcgacagcgaagcagagagaaccccacataaagatgagaagaagaagattgttagtcttgctcccattgctaaacctctagctggcaagaagctctccaaaagaaccctcaagcttgtccgtcgagctgctgaacacaaatgcttgaagagaggagtgaaggaagtggtcaaaagtatccgccgtggtcataaaggattatgtgttatagctgggaacattagtccaattgatgtcatcactcacgttcctatcttatgtgaagagtctgatattccctacatttatgttgcttcaaaagaggatcttgcaaatgcaggtgccacaaagaggccaacatgctgtgttttggtgctaactaagccaactaagggagaactaggacaagaggaacaagataagttgaaagctgattataccctcgttgtagaggatgtgaaggaactggcatcctctcttttctgatgaactagacttaaagccaacaaagatgattgtgcttacagatatgtttgatttcgaaccttccctttctagctgagtaatgtactctagttttgtcgaatgtaatatgcagtttgtctctgttgcatgagatggttggttgtcatgtctctcatatctgggtatattgcttttatttttatttttttaagagcaaactgcgaaataatctaatttttagtgcaaatctctggaaatattgttggtatatattcttttatgctcttatttccctttccaagcaacttttactgatgattacttccagtgaatccagcataatagccagaggcctaacgcgcatgaatgcagaggaatggtcattgttcccagtgatgaaccccaccggaaccacttgttggaaacaaataatggg

SEQ ID NO: 8393 - DNA, 805 bp, Cucurbita pepo
agacgcccatatacgtcctcctcacaaatccctctttgctccggcagttctatttcatccaacccaatggggagtgacagcgaagcagagaagtcgcatctgaaggacaaagaaaaggagaagaagaagctgttggctcttgcaccaattgctaaaccccttgccggcaagaagctctgcaagcgcaccctaaagcttgttcgtaaagctgctgaatacaagtgcttgaagcgggggtgaaggaggtggtcaaaagcataaggcgcggacaaaaagggttttgtgtaatagctggaaacatatcccccattgatgtgatcactcatgttccaatcttatgtgaagaggcagacattcgctacgtatatgttccttccaaggaagatcttgccaatgccgggtcgaccaagaggccaacatgctgtgttctgatacaaactaagccaaacaaaggggagcttggatcaactgaacaagagaaactcaaggctgagtttgaccaagttgtagcagaagtgtcggaacttacaagtagtgttttctgaagggtaaaagccattgttctctaacttaccctcaatgtacctgtagctttcttctgcgaattggttagtagtgtactctgtttcacttaaaatttgattggcctatgccatttctactgcaaccttctatctccgttgatattttccatctagtccagtagtcacgtttgaacgttcttagtttctcagattgcgcagaatccagtcggtggattgatattcttgtaagaaactgagtgattcaatagaattggccagag

SEQ ID NO: 8394 - DNA, 897 bp, Eucalyptus grandis
agttgtgcgcggactcaacaggaaggaagagagcaacccctggagtacccggccgaccatttgtccgaggctgcgcgaggtgttgccgcgagagagagagagagatgggaagcgacagtgaagccgagagatcgcagaaggagaagaagaagatgcaggcgctcgcccccatcgctaagcccctcgccggcaagaagctcggcaagcgcgccctcaagctcgtccgcagagctgctgaagacaaatgcttgaaaagaggcgtgaaggaggttgttaaaagcatccggcgcggtcacaaaggagtatgcgtcattgctgggaacatatctcctatcgatgtcatcactcatgtccctattctgtgcgaagagtccgacattccctacatctatgttccatcgaaagaagatctagcgaatgcaggtgccaccaagaggcctacatgctgtgttctggtgctaacaaagccaacaaagggtgacttaagtgccgagaaacaggacaaactgaaagcagagtatgatcaagttgtcaatgatatttccgagctgacttcctccttgttctgaacatcaagaagaaatgcagtaacaactccaccgccgttttttttttttttttttttgagttcatactctttggttggatgtaaacagtggtgttgtaacacagccacacagtggcaaaatggatgtaaacagggcgtggtcaattgcttgtatttccactacctggtcgttatgacaatcatttttgcgtttagactggcgatgaggatggaagactcttcgaatgtaggttttctggaattcaaatgaaggtttcagtttgaactgccttagtgtggtgtacttctgatgttgctgactttctgcattacttcctagtatttggaaa

SEQ ID NO: 8395 - DNA, 877 bp, Elaeis guineensis
cttaaaaacccctccagcgcgcttcgcgaacgctccccaacccacccgtggcggagaaagagaggcgagacagaacgcggggagagagagagagatggggagcgacagcgagaccgagaaatgtatcaaggagaagaagaagatgatggctgtcgccccgatcgcgaagcctctcgccgggaaaaagctctccaagcggaccttcaagctcgtccgaagagcttctgaggctaagtgtttgaaacgaggagtaaaggaagtagtaaagagtattcgtcgcggtcataaaggattgtgtgttatcgcaggaaacatttccccaattgatgtgatcacgcatgtgcccatcttatgtgaggaagctgatattccatacatatatgtttcttcaaaagaggatctcgcaactgctggggttaccaagaggcctacatgctgtgtattggtgctaaccaagccaaccaagggggaattggcccaggaggtccaggagaagctacagggtgattacgaccaggttgcagcggaggtgaaggagctgacatcatccctcttctgaaaagggagaacaaaaattatccttatgtgctacatgtccaattattttgttggttctatttgatatgagctgtcaatgtccatgggcaacaagcagatgctgtacgttcttgtgggggaccaaaaagcaaagttgtttctgtttgttcttgttatttcttgtttgtcgaacatgatggatatattagctggatactggatcccagtcattgttatatttcgctgataggtttgtttgtgagcattttttttaaagattttattatatttcgaacgaaaaaaaaaaactaaagtagacgtactcgacggaacgacacac

SEQ ID NO: 8396 - DNA, 605 bp, Petunia hybrida
cctagtctctctcttctcactttcacaaaacaaagagaaatctgagtattaaaagtaaaaaatggggagcgatagtgaagtagagaaatcagcacaaaaggaaagggagaagaagaaggtgttggcattagcccctattgccaaaccccttgctggtaaaaaacttcacaaacgcatcttcaaacttgtccgccgagctgctgagaagaagtgtatgaagagaggtgttaaagaggtggttaagagtattcgccgcggtcaaaaaggagtgtgtattatagctggaaatatttctccgatagacgtcattacccatgttccaatcctctgcgaggaagctgaaataccatatatctacgtcaactctaaagaagatcttgcaaatgccggagccaccaagaggccaacttgttgtgttttggtacagacaaagcctgccaagggggagcttagccaggaggatcaagagaaactgaaagaagattatgatcaagttgtaacagaagtccaagaaatggcatcatccatgttctaattatcaacattatgatattgagtttgtacttaattagccagtactcagctttgctcgatgttaatggctc

SEQ ID NO: 8397 - DNA, 606 bp, Platanus occidentalis
actcagggaggtagagagagtgagagatgggaagcgatagcgaaactgagaagtcgcagaaggagaggaagaagatgttggctctcgcaccgatagcgaaacctctagcagggaagaagctctgcaagagaactctcaagctcgtcaggaaagcttctgaatccaaatgcctgaagagaggagtcaaggaggtggctaaaagtatccggcgtggtaacaaaggtttttgcgttatagctggaaacatttctcctattgatgttattacacatgttccaatcttatgtgaagaggctgacattccctatgtgtatgttccctcaaaggaagatcttgctacggctggagcgaccaagaggcctacatgttgtgttttggtgctaaccaaacccacgaagggggaactgggccaggaggaacaagaaaatttgaaggcagattatgcccaagttgtgtcagatgtggctgaactcacatcctccctgttttgaagagctaactgaacaattcactcattctgctaatggtggttatgtctggtttcttttgttttttgttttatcatgttatgtgctatttatataaatactgttttggttgggggaa

SEQ ID NO: 8398 - DNA, 965 bp, Populus trichocarpa
tttcgtttttttacccttcttgtttaattttatgcttcactaattaaagaatccctagccgttgattttttcgttctaaatttcttcacaacgaaaggtccagatcaacaggtctaacaaatgttaaaaccctagaaaacaaaataaaaccctaaactctaccattccccgccacccaccttcgcctgttgatttccagctgcagagagagagagagagagacagacagagatgggaagtgatagcgaaacagagagatcaaacataaaagagaagaagaagataacaagcttggctcccattgccaaacccttagctggcaaaaaactctgcaaacgaactctcaagctcgttcgtaaagcatccgaatcaaaatgcttgaagagaggagtgaaggaagtagtgaagagcattcgtcgtggccataaaggattatgcataatagctggaaacatttcaccaatcgatgtcattactcatgttcccatcttatgtgaagagtctgacattccttatgtttatgttacttctaaagaagacctcgctagtgctggggccaccaaaaggcctacttgttgtgttctagtgttaaccaagcctaccaagggggagataggcaaggaggatcaagaaaaattgaaggcagattatgatcaagttgtttctgatgtatctgaacttacttcctcacttttttgaaagacaaacgcagctgtggtgtgttttcttttgctaactaatgctaccagtacactcgccttcgtggtttctatttcttatggtctgattaaatttacttgcctttgaaatgggacaagaatctattggtgttattttctttgatatggagtagaatcctatttagctgactgacgactactttcctattgaaatgcttgatatattttaaatgattgaactcaatatcagcttcattgctttaagcatattgcgatggtgaaaac

SEQ ID NO: 8399 - DNA, 938 bp, Solanum tuberosum
gcttaaaccctagcagcaattagccaaattcatcttcctcataaaccctagtcgctgcttttctttcgagaagaaggaagggaaaaaataaagcagagaggtgtacgagaagaggagggagaaatgggtagcgacagcgaagtagagaagagtggacaaaaggagaagaagaaggtgtttgctttagctcctattgctaaaccccttgctggaaaaaaactcaacaaacgcatcttcaaacttgttaggcgagctgctgagaaaaaatgcttgaagaggggcgttaaagaggtggtgaagagtattcgacgaggtcaaaaaggagtgtgtgttatagctggaaatatttctcctattgatgtcatcacccatgttccaatcctgtgtgaggaagctgaaataccgtatatctacgtgtcctcgaaagaagatcttgcaaatgctggagccacgaagagaccaacatgctgtgttttggtgcaaacaaagcctgccaagggagaacttagccaggatgatcaagagaaactgaaaacagattacgatcaagttgtatcagaagttggtgaaatggcatcctcgatgttctgagtatcaactacattaagatatcggagtttgtacctaattccctagtactcaaaacttttgtaatggctctctagtattagtcttttcaagctgagctacttctttttttccccttgccccgtctaaattctggaacatgattcaaagctgctgctatgtatcgatatccaagtattgctctattgtgtgtgaattggttgcaggctggtggtccgattagaaaacgtgccatcagcatgaagtaagtagatatgcagcagtagtgtgacaatttagtaaaatgggaacaagaaatatttattttgatatttgttatgggtaaaagaactaaaaaaaaaaaaaaaaaa

SEQ ID NO: 8400 - DNA, 661 bp, Chenopodium quinoa
aggagagagaaaatgggaagcgatagtgaagctgagaagtcggctcacaaggagaagaagaaggccatagctctcgcccccattgctaaacctcttgctggcaaaaagctctgcaaacgcacttacaaacttattcgccgagctgctgagcacaaatgtttgaagagaggagtgaaggaagtcgttaagagtatcagacgcggtcataaaggaatttgtgtgattgctggaaacatatcgccaattgatgtcatcactcatgttccaatcctatgcgaagaatcagaaattccttacgtatatgttccttctaaagaagatcttgcaagcgccggggctactaagcgaccaacctgctgtgttttggtgctaaacaagccagcaaagggggagctaagccaggaagatcaagaaaaattgaagtcagaatctgaacaagtttcatcagagattcgtgaattgacatcatctatgttttgaaaaatccttttgcttgaatagaaagtgatctgagaattgcttaggattgttttttgtactcttttctgatgtgataatataatcaatgacccaaaacttctctctgtatcattttttatgtggaagagtatgctagttgccgtctttatgtgtatgtgcgtttaccttgagcaaacaggca

SEQ ID NO: 8401 - DNA, 923 bp, Solanum phureja
tagagcttaaaccctagcagcaattagccaaattcatcttcctcataaaccctagtcgctgcttttctttcgagaagaaggaaggaaaaaaaaagcagagaggtgtacgagaagaggagggagaaatgggtagcgacagcgaagtagagaagagtggacaaaaggagaagaagaaggtgtttgctttagctcctattgctaaaccccttgctggaaaaaaactcaacaaacgcatcttcaaacttgttaggcgagctgctgagaaaaaatgcttgaagaggggcgttaaagaggtggtgaagagtattcgacgaggtcaaaaaggagtgtgtgttatagctggaaatatttctcctattgatgtcatcacccatgttccaatcctgtgtgaagaagctgaaataccgtatatctacgtgtcctcgaaagaagatcttgcaaatgctggagccacgaagagaccaacatgctgtgttttggtgcaaacaaagcctgccaagggagaacttagccaggatgatcaagagaaactgaaaacagattacgatcaagttgtatcagaagttggtgaaatggcatcctcgatgttctgagtatcaactacattaagatatcggagtttgtacctaattccctagtactcaaaacttttgtaatggctctctagtattagtcttttcaagctgagctacttctttttttccccttgccccgtctaaattctggaacatgattcaaagctgctgctatgtatcgatatccaagtattgctctattgtgtgtgaattggttgcaggctggtggtccgattagaaaacgtgccatcagcatgaagtaagtagatatgcagcagtagtgtgacaatttagtaaaatgggaacaagaaatatttattttgatatttgttatgggtaaaagaacta

SEQ ID NO: 8402 - DNA, 779 bp, Cicer arietinum
ataaaccctaaattaaaccaagcttgacatttgtgagaccgtaaaaccctaaatttcaaaaacacatttcaccggagcagagtgtgatggggagcgacagtgaaggagagaaatcggtgcaaaaagagagagagaagaagaagatgcttgcgttgtctcccattgctaaacctcttgctgggaagaagctttctaagaaaacactcaagcttgttcgtagagcggctgaaaacaagtgcataaagagaggagtaaaggaggtggttaagagtataaggcgaggtcaaaaaggtgtttgtgttatagctggtaacatatcgccaatcgatgtcatcgctcatgttcctgttttgtgtgaagaggctgagattccgtatgtatacgtactatctaaagaagaccttgcaaccgcaaccgcgggagtaactaagaggcccacttgttgtgttctagtgatgacaaagccttcaaagggtgaactagaacaaggagtacaagagaaactaaaatcagagtttgatcaagttgcatccgaaatcactgaacttacaacttcactgttttgaaaccaacacaaatgttgtactttaggttacaatggttcaacatatgggcagtgtactgcaatcatttgatctatgggtttagctatttttctattttcttattataaaggttgtttgatcaatcccctggtatcaaacgagggaaactgaaaattctcacctatcttgattagttagattttgcaagaaaaattgtgtacactaattatacta

SEQ ID NO: 8403 - DNA, 662 bp, Heritiera littoralis
cacattgcagtagtgtacattctctctctttaaagtgctctgtttttttcgttgttagagaaaaagagagatagagaaaatgggaagcgatagcgaagcagagaagacgcagcaggaggagaaggaaaggaagaagatgttagctgttgctcccattgcaaagcccctagctggcaaaaagctctgtaagagaaccttcaagctcgtccgcaaagctgctgagcacaaatgcttgaagagaggagtaaaggaggtcgttaaaagcattcgacgcggtcataaaggattatgcgtaatagctggaaacatatctcccattgatgtcataactcatgttccaatcctatgtgaagaggctgacattccctatgtttatgttccctcgaaagaagatcttgctactgcaggagataccaagagaccaacatgctgtgttctggtgctcaccaagcccaccaaaggggaactaggccctgaggaacaagagaagataaaggccgattatagccagatagtagctgatatatctgagcttacatcttcccctttttttaattaacaaaataaaaaaattagttgtgctattcacataagctttgattttgttcttccaattttcttggttcccagggaatgtgcttgcttattgtagtatgctgcaa

SEQ ID NO: 8404 - DNA, 728 bp, Rosa hybrid cultivar
agcgagagagcaaaaccctagtctccacagagagtaaaagaagagagggatggggagcgatagcgaagtagagaagtcgcaccagaaggagagagagaggaagaagacacaggctcttgctccgatagcgaagcccctcgccggaaagaagctcggaaagcgaactctcaagcttgtccgcagagccgctgaacacaaatgcttgaagagaggagtgaaggaggtagttaaaagcataaggcgaggtcaaaagggattatgtgttatagctgggaacatttctcctatcgatgtgatcactcatgttccaatcttatgtgaagaggctgaaattccatatgtttatgtgtcctccaaagaagatcttgcaaatgcgggggcaaccaagaggccaacatgctgcgttctggtgataactttgctgcctagggtgagttggcacaagaagaacaagagaaactaaaggcagattatgatcaggttgcaggagaagtttctgagcttttttcctccactcttttctgaaggctggaaaaatttacttgcccctgtactactgactatcttgtatgaggtttttcctttttagtgcctcgagtgctgggctatgtagtttgtttcagcaaattttaagacacaatgtgtttgtttgtgtacctattggagtagaacatcagcagatttgattttctccatggaatatgagatccttgtttaaaaaaaaaaaa

SEQ ID NO: 8405 - DNA, 930 bp, Spinacia oleracea
agccaagcccatcaataaaatccttagcccaccacgacataacccacccaccaaaaagcataacataaaactcatctttttaacccctctaaaaccctcccctgtcatcacccaaatcacataaaccctaatttccgccatctctgctactcaccacctttagacgagcgagaaagaggagagagaaaatgggtagcgacagtgaaacggagaagtcagcgcacaaggagaagaagaaggccatagctcttgctcccattgctaaacctcttgccggcaaaaagctctgcaagcggacctacaaacttattcgcagagctgctgagcagaagtgcttgaagagaggagtgaaggaagttgttaagagtatcagacgcggtcacaaaggaatttgtgtgattgccggaaacatatccccaatcgatgtgatcactcatgttccgatcttatgtgaagaatcagaaattccttacgtatatgttccttctaaagaagatcttgcaagtgctggggctactaaacgaccaacctgctgtgttttggttctaaacaagccagcaaagggggaattaagccaggaagaacaagaaaaattgaaatcagaatctgaacaagtttcatcagagatccgcgaattgacgtcatctatgttttgagatagccttttgtttgaatgtgaagatgatctgagaaatgcttagtttgatttttgtactcgtttttcttatgtagtaatataattaatgaccagaaacatggctctgtatcatttttacatggtaagaatatgctagttaccgtctttggatgtgtttaccttgactttagcaatggacaagttactcgactagaaagagaaaatgtacaaaagacgcttgcgttggtaagcagatgtagacgggaagtgcagaagagaatggaataagttca

SEQ ID NO: 8406 - DNA, 719 bp, Antirrhinum majus
aaatactctctctctctctctctctctctgctcctccgcgcacacacacacacacacacacacagatgggaagtgacagcgagattgagaaatcagcgcagaaagagagggacaagaagaagatattagctctcgctcccatcgccaaaccactagccggtaaaaagctctccaagcgcacgctcaaactcgtgcgccgcgcagcagagaataaatgcctcaagaggggagttaaggaggtcgtcaagagtattcgacgcggtaacaaaggagtatgtgttatagcggggaatatatcgcctatcgacgtcattacgcacgttccgatcttgtgtgaggagtccaacataccgtatgtgtatgttacgtccaaggaagaccttgctaatgctggagctacaaagaggccaacatgctgtgttctggtgatgacaaaacctgccaaaggggaacttgctcaagagcaacaagagaaattgaaggcagagtatgaccaggttgcatcagacatatctgaactggccaactcaatgttttgatgaacgggagtagattttacgtattttaggcttgtacgctttatttgaactatctcatctttttgtgttacgccttgtgtattttgaaagagacatctattaaaatgaaggatcttgtgacttgattggtatctaagtgcataaaaatgggcaatggctatttgtgccttgtattgcttt

SEQ ID NO: 8407 - DNA, 803 bp, Gossypium hirsutum
aatttccgccatatgctttctttcacattatagacatttatttcctcccaattattttcatcgttagggagaacgaaaatagaaatgggaagcgatagcgaagtagagaagacgcagcagaaggagaaggagaggaagaagatgttagctatagctcccatcgcaaagccccttgctggcaaaaagctctccaagaaaacccttaagctcgtccgaaaagcatctgagcacaaatgcttgaagagaggagtaaaggaagtggttaaaagtattaggcgtggtcataaaggattatgtgttatagctggaaacatatctcctattgatgtcataactcatgttccgatcctatgtgaagaggctgaaattccatatgtctatgtttcttcaaaagaagatcttgcaacagcaggagctactaagagaccaacatgctgtgttttggtgctaaccaagcccaccaaaggtgaactcgccatcgaggaacaagaaaagatgaaagccgattatagccagatagtatcggatgtatctgagcttacatcatcccttttctaattaactcagaaaaaaaaaattgttgtgcttgtcatataagcattgttgttgacaatcttattttcctgcagctcaggtaatggtgctttgtccccggcatttgactatctgttcaaaaccttttgttttacttcttttaacccgcttcttttaagtgtttattcagtgaagtcattggctttttaatagttaagtcataatctatcccctgaacttgaacacttctctagtgttggtacttaaaa

SEQ ID NO: 8408 - DNA, 862 bp, Gossypium hirsutum
attatagacatttatttcctcccaattattttcatcgttggggagaaagaaaatagaaatgggaagcgatagcgaagtagagaagacgcagcagaaggagaaggagaggaagaagatgttagctatagctcctatcgcaaagccccttgctggcaaaaagctctccaagaaaacccttaagctcgtccgaaaagcatctgagcacaaatgcttgaagagaggagtaaaggaagtggttaaaagtattcggcgtggtcataaaggattatgtgttatagctggaaacatatctcctattgatgtcataactcatgttccgatcctatgtgaagaggctgaaattccatatgtctatgtttcttcaaaagaagatcttgcaacagcaggagctactaagagaccaacatgctgtgttttggtgctaaccaagcccaccaaaggtgaactcgccatcgaggaacaagaaaagatgaaagccgattatagccagatagtatcggatgtatctgagcttacatcatcccttttctaattaactcggaaaaaaattttgatgtgcttgtcatataagcattgttgttgacaatcttattttcctgcagctcaggtaatggtgctttgtctccggcatttgactgtctgttcaaaaccttttgttttacttcttttaacccgcttcttttaagtgttttattcagtgaagtcattggctttttaatatttaagtcataatctagcccctgaacttgaacacttttctaatgttggtacctgaaagaattttttcttggtaccttaacatgtattctgttaaaaccaaaaataaataaataaataaggggtaatatgctatttgatgcct

SEQ ID NO: 8409 - DNA, 835 bp, Gossypium raimondii
ctttctttcacattatagacatttatttcctcccaattattttcatcgttagggagaacgaaaatagaaatgggaagcgatagcgaagtagagaagacgcagcagaaggagaaggagaggaagaagatgttagctatagctcccatcgcaaagccccttgctggcaaaaagctctccaagaaaacccttaagctcgtccgaaaagcatctgagcacaaatgcttgaagagaggagtaaaggaagtggttaaaagtattaggcgtggtcataaaggattatgtgttatagctggaaacatatctcctattgatgtcataactcatgttccgatcctatgtgaagaggctgaaattccatatgtctatgtttcttcaaaagaagatcttgcaacagcaggagctactaagagaccaacatgctgtgttttggtgctaaccaagcccaccaaaggtgaactcgccatcgaggaacaagaaaagatgaaagccgattatagccagatagtatcggatgtatctgagcttacatcatcccttttctaattaactcggaaaaaaaaaattgatgtgcttgtcatataagcattgttgttgacaatcttattttcctgcagctcaggtaatggtgctttgtctccggcatttgactatctgttcaaaaccttttgttttacttcttttaacccgcttcttttaagtgttttattcagtgaagtcattggctttttaatatttaagtcataatctagcccctgaacttgaacacttttctaatgttggtacctgaaagaattttttcttggtaccttaacatgtattctgttaaaaccaaaaa

SEQ ID NO: 8410 - DNA, 652 bp, Vitis vinifera
ttgtctggtatttgctgaaactctcgggagtgagtgagtgagttgagttcttgagagggacagagagagatgggaagcgacagcgaagcagagaggtcagcgcacaaggagaaggagaagaagaagttgtcggctttggctccaattgccaaacccctcgctggcaaaaagctttgcaagcgtaccctcaagctcatccgtagagctgctgagcacaaatgcttgaagagaggagtgaaggaggtggttaaaggtatcagaaggggggacaagggattttgtgttatagcggggaatatcactcctattgatgtcattactcatgttccaatattatgtgaagaggctgacataccctatgtgtatgttccctcaaaagaagatcttgcaaatgcaggctccactaagaggccaacatgttgtgttcttgtgctaaccaagcccaccaagggagaacttggccaggaggaacaagaaaaattaaaggcagagtacacccaggttgtatctgatgtatctgggctgacttccacccttttctgaagtgcaaaacaactgctgcgcatattattaatgtactaaattttggttgatataacatttagttgttcatgcatcgtttgaagtgggaaatagacaaaagcattgcttt

SEQ ID NO: 8411 - DNA, 994 bp, Mimulus guttatus
tcgacactgctcgtctaaaaccctagtccctccgccattacagaaaaaccccccacctccacctcaatcactcgccggcacacacactcagaagagatgggaagcgacagcgagactgagagaagcgcgcagaagcagagggagaagaagaagctagcggcgcttgcccccatcgccaaaccgctcgccggcaaaaagctctgcaaacgcacactcaaacttgttcgcctagctgcggagcacaaatgcttgaagagaggagttaaggaggtcgtcaaaagcattcgccgcggcaacaaaggaatatgtgttattgcggggaacatatcacctatagacgtcatcactcatgttccgatcttgtgcgaagaagttaacattccgtacgtctatgttccgtcaaaggaagaccttgctaacgcgggtgccacaaagaggccgacttgctgtgtgctggttctaacaaagcctgctaaaggtgaactcggccaggaggaacaagagaagttgaagggagaacacgacctcgtcgcaacagaaataactgaattggccaactccatgttttgatttgtgctgctaaaaaacattacattttgtcaagtctgtattcttagattttgttaggtgtgtaagcttttagttgagataatattcaaatttttgtcctttattggctttttaaaaatcggatttcttagacaagacgaatacgaggaaagccacaagagtgcaaatttaattaaaattcaaactactaaggcaaatcaaattgaatgcactatgattgtgtgttcacatggtcatattctatactacatgatttatacatagtagtactgatatggccatgtgacatttaaatagttgtttattaaaatttattagttgttttagtattggttgcaggaagacaacatgtaatggttgtataatgtatgtgtttctgtatgtagagaaacatgccaattttatttattgagttggactttgg

SEQ ID NO: 8412 - DNA, 875 bp, Chenopodium quinoa
gactgttgtttaggtagaaaatgtgtttgttaatattgttttagaaatattacccgctaattaccgatcaggcctaagaaacataacacaaaagcaggctaattctaggcctatgaatagaccctcagcccaattcaacaaaagccagcctcctaaaacctttgtcttccaccttctataacccccttcttctcatacccctaaatcacataaacctaaaccctaattttcttccgccatctctgcaacagcaccatcaatcaagcgagaggagagagaaaatgggaagcgatagtgaaactgagaagtcagctcacaaggagaagaagaaggccatagctctcgctcccattgctaaacctcttgccggtaaaaagctctgcaaacgcacttacaaacttattcgccgagctgctgagcacaaatgtttgaagagaggagttaaggaagttgtcaagagtatcagacgcggtcataaaggaatttgtgtgattgctggaaacatatcgccaattgatgtcatcactcatgttccaatcttatgcgaagaatcagaaattccttacgtatatgttccttctaaagaagatcttgcaagcgctggggcaactaagcgaccgacctgctgtgtgttggtgctaaacaagccagcaaagggggaactaagccaggaagatcaagagaaattgaagtcagaatctgaacaagtttcatcagagattcgtgaattgacatcatctatgttttgaaaaaccctttagcatgaatagaaagatgatctgagaaatgcttaggattgtttttgtactctttcttgatgtagtaatataatcaatgaccccaaacttctctctgtatcatttttatgtggtaag

SEQ ID NO: 8413 - DNA, 672 bp, Silene vulgaris
ccatattccgccattccatctccttcaacctcaaaccttcacaaaaacctaaaaaatgggaagcgacagcgaaacagagaaatcacaccagaaggagaagaagaagacacctgttactcttgctcctattgctaaacctcttgctggcaagaaactctgcaaacgcaccttcaaacttgttcgccgagctgctgaacataagtgtttgaagagaggtgtcaaggaagttgttaagagcattcgtcgtggcagtaaaggagtatgtgtgattgcaggaaatatttcccctattgatgttatcactcatgttccaatcttatgtgaggagaacgacattccttacatctatgtccctactaaagaagatctcgcaagtgcgggggcaacaaagcgaccaacctgctgtgttttggtgctacagaagcccacaaaaggtgaactaagtcaggaggatcaagaaaaattgaaggcagattatgatcaagtcgcatctgaagctcgcgaattagcatcatctatgttctgagaagtcgcctccctcttgattgagtggaatcaattttatgttattagaaatgggtagttcttgttttgtaaccttatcgtgatgtaagttatgactcgaaatacgattttatgcttggtattagtacttgttttaatctaaatccc

SEQ ID NO: 8414 - DNA, 817 bp, Nicotiana tabacum
cttttccctaccacaaaaaacaagagaccagtagcttctgtagaaatgggtagcgatagcgaagtagagaaaagtgcacaaaaggagaagaagaagctgttggccttagcccctattgccaagccccttgctggaaaaaaactcaacaaacgtatcttcaaacttgttcgccgagctgcggagaaaaagtgtttgaagaggggcgttaaagaggtggtaaagagtattcgacgcggtcaaaaaggagtgtgtgtcatagctggaaatatatctcctatagatgtcatcacccatgttccaatcctgtgtgaagaagctgagataccatatgtctatgtctcctcaaaagaagatctagcaaatgccggagccaccaagcggccaacttgctgcgttttggtacaaacaaaacctgccaaggggggacttagccaggatgatcaagagaaactgaaagctgattatgatcaagttgtatcagaagtcggtgaaatggcatcctcgatgttctgattatcaacattatgatattgaagtttgtacctatttctcctgtactcagcttttgtaacgaatctagtatttaatcttttgaagctgagctgcgccttttcttaactttgcgtctagattctgtaatgtcgtccaaaggtgctgctatttattcatatccaagtattctccattttgtgtgtgacttgttgcaggctcgtggttaattattgcgcaatggatacagtagcagtgtgacaatattatagtccctctatctaacgctgggttatttatttatttattctgacttttgtacgtggga

SEQ ID NO: 8415 - DNA, 622 bp, Lupinus angustifolius
attgttgttttttggagagagaaagaaatgggtggtagcgacagcgaggtagagaagaaaaaggtgcttgctttggctcctattgctaaacccctcgctgggaagaagctttcaaagcacactcttaagcttgttcgtaaagctgcacaacacaagtgcttaaagagaggtgtcaaagaggttgttaaaagcataaggcgtggtcataaagggttatgtgttattgctgggaatatatctccaattgatgtcatcactcatgttcctatattgtgtgaagagtctgaaattccctatgtatatgttcagtctaaagaagaccttgcaactgcaggagcaacaaagaggcctacttgctgtgttttggttatgaccaagcctacaaagggtgatctagatcaaggggaacaagagaaactaaagtcagattatgatcaagttgcagcggaaattactgagattacagcttcacttttttgaacaagcaaacatgtatttgtattggttgttcttgcttaattaacctcgtcagcaatgtaccttagaattaatcaatgttatgtttggattttatcattttgctatctggctcaccattttctttatataaatatttgctatg

SEQ ID NO: 8416 - DNA, 661 bp, Solanum phureja
cttaaaccctagtgatatcgcgttccaacttctccccatttcgttaaaccctacaccgacgccctgcttttgcttttacgttcaagagagatatgggtggtagtgatagcgaagtagagaaaacggcacaaaaagaggagagaaagaagctaatggctatagcccctattgctaaaccactcgctggtaaaaaactcagcaaacgaaccttcaaactcgttaggcgagctacggaacataaatgcttgaagagaggagttaaagaggtagtgaaaagtattcgtcgcggtcataaaggattgtgtgttattgctggaaacatttctcctatcgatgtcattactcacgttccactcctatgtgaggaagctgatataccatatatttatgttccttcaaaagaagatcttgcaagtgctggagccactaagaggccaacttgctgcgttttggtattgacaaagcctactaagggggaacttgggcaagaagatcaagagaaactgaaggaagagtatgatcaagttgtatcagaaattcacgaaaccacctcctccttgttttgataaacaaaattatgatctattgatggtttcacttaattgccctctacttagttttggaacatgtttatgtatctgctatttatctacgtcaccat

SEQ ID NO: 8417 - DNA, 605 bp, Eutrema halophilum
gtggagggagggagggagagagaaagagatggggagcgacagcgaagcagagaaggtgcacctaaaggagaagaagaaggtagtagctttggctccgattgctaaacctcttgccggcaaaaagctatgcaaacgaaccctcaagcttgttcgcacagctgctgaaaacaaatgcgtgaagagaggagtgaaggaagtggttaagagcattcgccgtggccacaaaggagtctgtgtcatagctggtaatatatctcctattgatgtcataactcatgtcccgatcttgtgcgaagagtcaaacatcccttacgtctatgttccctcaaaggaggatctcgcaactgctggagcaaccaagcggccaacatgttgcgttcttatcctaacaaagcctgcgaaaggagaactaagcccgaaaattcaagagaaactcaagacagactatgatcaagttgttgaagatgtcaaagaacttgcttcttctactgtctattaggattgcattaggatttaggatatacaaattgctctttactgtctcatgtctcattgcactctctatttttcgtccatgtctgccagaaaaaagtatttgagttttc

SEQ ID NO: 8418 - DNA, 598 bp, Arachis hypogaea
aaggagaaggagaggaagaagatgcttgcacttgctcctattgcgaagccccttgctggcaagaagctctgcaagcgaaccttgaagcttgttcgtaaggctgctgaacataagtgcttgaagagaggagtaaaggaagttgtcaaaagcataaggcgtggtcataaaggagtgtgtgttatagctgggaacatatcacccattgatgtgatcactcacgttcctatcttgtgtgaagaggctgacattccctatgtttatgtcccctccaagaagatcttgcaagtgctggagcaacaaagaggcctacttgctgtgtgttggtgatgaccaagcctgcaaagggagaactggagaaaggggagcaagagaaactgaagtcagattatgatcaagttgtaactgaaattaatgagattgcagctacacttttttgaaatcagtaatacatgtatttatgcccgctgtaccagttggcagttgggttaacgttatcagtagagtaccttctgcaatcaatttatttggcgtcgtttttctagatgggttaaaaaaaaagaaaaaaaaacaaaagtactctgcgttgataccactgctt

SEQ ID NO: 8419 - DNA, 644 bp, Aquilegia formosa
atggaaagtgatagtgaagcagagaaatcagcacacaaggaaaggaagaagattcaagctttagctccaattgctaaacctttagcaggaaagaagctttctaagaaaactctcaaactcgttagaaaagctgctgaatcaaaatgcttgaagagaggagtaaaggaggttgttaagagcattcgccgtggtaacaaagggctatgtgttattgctggaaacatttcaccaattgatgttatcacacatgttccaatcttatgtgaagaggctgatataccatacgtgtatgttacttcaaaagaggatcttgcaacggctggagccaccaaaagacctacttgttgtgtgctggtgctaaccaagcctacaaagggagagcttgctcaggaggaacaagagaaactaaaggccgattacactcaagttgtttcagatgtctctgaactgacaagcactcttttctgaagagcaaatgagattcgtgactcccttcactagttttcttgattttggtttcatgtaccataggatagcatattcaggacactgatgtttgtgtgttcagaaatattgttgtcgggctaaattctagaattcaaacatgtgtcatgtgtatctgagtattaatatttactgcaagc

SEQ ID NO: 8420 - DNA, 746 bp, Gossypium hirsutum
ttctttcacattctaatagttataaagtcttgttgtcgtctttgtagtgctctgtttagaaagagaaagagatagaaatgggaagtgatagcgaagcagagaagactcaacagaaggaaaaggaaaggaagaagatgtttgctatttcacccattgcaaagcccctcgctggcaaaaagctctctaagaaaaccctcaagtttgtccgcaaagccgctgagcacaagtgtttgaagagaggagtaaaggaagtagttaaaagtattcggcgtggtcataaggggttatgtgttatagctggaaatatatctcccattgatgtcataactcatgttccaatcctgtgtgaagaggctgacattccctatgtttatgttccctcaaaagaggatcttgcaactgccgggtctaccaagagaccgacatgctgtgttctggtgctaaccaagcccacaaaaggggaactaagtcccgaggaacaagaaaagttaaaagcagattatagccacattgtagaggatgtatctgagctcacatcctctatgttttaagttaacaaaaaagttgtcattataacatttgatattgacatcctcttattttacttccagggggggaatatgctttactacttgttactattgtgtatcatgctgccatttactactacgtcaaattgcctagaaactgaacaaatataatcaaagacgcagttaattgaaggatcttaatctccaaaaaaaaaa

SEQ ID NO: 8421 - DNA, 780 bp, Fagopyrum esculentum
tccaaagtaaaaacctcgcagtttctttcgtctcccgactcctcccccatttttcgtaaaccctagttcgccgtcgctactactattacgaaacagagtaggagatggggagcgacagcgaaactgagaagtcgggaaaggataagaagaaagtgattgctttagctcccattgctaagcctcttgctggtaaaaagctctgcaagaaaaccttcaagctcgtccgcaaagctgctgagcacaagtgcttgaaaagaggggttaaggaagtcgttaagagtatcagacgtggtaacaaggggttttgtgtgattgctgggaacatttctcctattgatgtcataacccatcttcccattttgtgtgaagaagccgaaattccttacatttatgttccttccaaagaagatcttgcgaatgcgggagccaccaagagaccaacatgctgtgttctggtgatgacaaaaccaacaaagggagaactagcacaggacgagcaggagaaactcaaagctgattatgatcaagttgtatcagatgttcgtgaagttgctgcttctttgttctgatgagattcagattatccatgcctgtctttggtgtatttttttgttttcgttgaaatgagtagtgataattgacaatgtagttaactagttatatcaaatctcgtatgtgggatcgtgcccaaaattgtcttctccctagtacagctcctactagaatcttggcctcgttccacctttccttacaagaaatgatgcaccaacctttttaaac

SEQ ID NO: 8422 - DNA, 709 bp, Actinidia deliciosa
cgaagcccttcctccagtttgcttaatagagagagtggaatgggaagcgatggcgaagcagataagacggcgcagaaggagagggagaagaagttgttagctctggctcccatcgccaaaccccttgctggcaagaagctctgcaaacgcaccttcaagcttgtccgccgagctgctgaacacaaatgcctgaagagaggagtgaaggaggtagttaagagtattccccgcggtaacaaaggattatgtgtaattgctgggaacatatctcctattgatgtcatcactcaccttccaatcttatgtgaagaggctgacattccctatatatacgtgccagcaaaagaagatcttgcaaatgcaggagccaccaagaggccaacttgctgcgtcctagtgcaaaccaagcctaccaagggggaacttgcccacgaggaacaagaaaacctgaaggctgattacgatcaagttgtatccgacctttccgaccttgctgcttctatgttctgaaggacaacgcaatgttgactataacattttcagttttgttggtaccaaggggttcccgtcccgtttcacgttccaaatgggcctaaccaacgagacaagcgaacatacatttttccccttcccgtacccattttatgtcatgctaaaacagggcattataacagatcactctcctagttttattgcccaaaaaaaaaaa

SEQ ID NO: 8423 - DNA, 562 bp, Chenopodium quinoa
ctgcaacagcaccatcaatcgagcgataggagagagaaaatgggaagcgacagtgaaactgagaagtcggctcacaaggagaagaagaaggccattgctctcgcccccattgctaaacctcttgccggcaaaaagctctgcaaacgcacctacaaacttattcgcagagctgctgagaacaaatgtttgaagagaggagtcaaggaagttgttaagagtatcagacgcggtcataaaggaatatgtgtgattgctggaaacatatcgccaattgatgtcatcactcatgttccaatcttatgcgaagaatcagaaattccttacgtatatgttccttctaaagaagatcttgcaagcgccggggctactaagcgaccgacctgctgtgttttggtgctaaataagccagcaaagggggaactatgccaggaagatcaagaaaaattgaagtcagaatctgaacaagtttcatcagagattcgtgaattgacatcatctatgttttgaaaaaccctttagcatgaatagaaagatgatctgagaaatgcttaggattgttttt

SEQ ID NO: 8424 - DNA, 690 bp, Nicotiana tabacum
cccctcatgcggccgctgacagagtagaaatgggtagcgatagtgaagtagagaaaagcgcacaaaaggagaagaggaagctgttggccttagctcctattgccaaaccccttgctggaaaaaaactcaacaaacgcatcttcaaacttgttcgccgagctgcggagaaaaagtgcttgaagaggggcgttaaagaggtggtaaagagtattcgacgcggtcaaaaaggagtgtgtgtcatagctggaaatatatctcctatagatgtcatcacccatgttcccatcctgtgtgaagaagctgagataccatatgtctacgtctcctcaaaagaagatctagcaaatgccggagccaccaagaggccaacttgctgcgttttggtacaaacaaagcctgccaagggggaacttagccaggaggatcaagagaaactgaaagcagattatgatcaagttgtatcagaaatcggtgaaatggcatcctcgatgttctgattatcaacattatgatttttaagtttgtacctatttcccctgtactcagctttagtaacgaatctagtatttaatcttttgaagctgagctgcacttgtttctttttttccttttgcgtctttattcatatccaactattctccattttgtgtgtgacttgttgcaggctcgtggttaattattgcgcaatgg

SEQ ID NO: 8425 - DNA, 757 bp, Solanum lycopersicum
cagcaattagcctaattcatcttcctcataaaccctagtcgctgcttttctttccagaagaagaaaaaaaccccagaaagtttacgggaagaggagggagaaatgggtagcgatagcgaagtagagaagagtggacaaaaggagaagaagaaggtgtttgctttagctcctattgctaaacctcttgctggaaaaaaactcaacaaacgcatcttcaaacttgttaggcgagctgctgagaaaaaatgcttgaagaggggcgttaaagaggtggtgaagagtattcgacgaggtcaaaaaggagtgtgtatcatagctggaaatatatctcctatagatgtcatcactcatgttccaatcctgtgtgaggatgctgaaataccatatatctacgtttcctcaaaagaagatcttgcgaatgctggagccaccaagagaccaacatgctgtgttttggtgcaaacaaagcctgccaagggagaacttagccaggaggatcaagagaaactgaaaacagattatgatcaagttgtatcagaagttggtgaaatggcatcctcgatgttctgagtatcaataacattaggatatcggagtttgtacctaattccctactattcaaaacttttgtatggctctctagtattagtctttccaatctgagctacttctttcttccccttgctctaaattctggaacatgattcaaagctgctgctatgtatcgatatccaagtgttgctctatcgtgtgtgaa

SEQ ID NO: 8426 - DNA, 848 bp, Trigonella foenum-graecum
gttagacaattacacgtagtctagaaaccctaattaaaacccaagcttgacacttgagagaccgtaaaaccctaattcccaaatcactttcaccgaaccacagagagaaatgggcagcgacagtgaaggtgagaaatcggtgcagagggagaaggagaggaagaagatgcttgctctagctcccattgcaaagcctcttgctgggaaaaagctttccaagaaaacactcaagcttgtcaaaagagctgctgaaaacaaatgcataaagagaggagttaaggaggtggttaaaagtataaggcggggtcaaaaaggagtgtgtattatagctgggaacatatcacccattgatgtcatcactcatgttccgatactatgcgaaaataatcagattccatatgtatatgtcccatctaaagaagaccttgcaactgcaggagcaacaaagaggcctacttgttgtgttttagtgatgaccaagccttcaaagggtcaactatctcaagaggtacaagagaaactaaagtcagagtatgatcaagttgcagccgagtgtactgagcttcagtctacacttttttgaaaacaaacgcaaatgtatctgtactgttgttggctacaatggattaacatattggcaatgtaacttgcaatcattttgatctatggataatgatctttctatttccttattataaaggttgttgcttgcttattttttatcaatccactggtgttgtgtctgtccagctacggaggctgaaaattatgaaagaaaattatttagtgtttcatcctcgaactatcagtgggtgactcagaaatttaggtctggaatgttatttgtc

SEQ ID NO: 8427 - DNA, 590 bp, Valeriana officinalis
gaggctgtgctgctctgatatctaacagcgatgggaagtgatagtgaagcagataagtcggcacagaaggagaagaagagttttgctttggctccgattgccaagccacttgccggcaagaagctttccaagcgcgccctcaagctcgttcgacgagctgcggagaagaaatgcttgaagagaggagttaaggaggttgttaagagtatacgacgtggcaacaaagggttatgtattttggcaggaaacatctctccaatagatgtgattactcatttgccgatattatgtgaagaggctggaataccttatatctatgtaaactctaaagaagatctggcgaatgcaggagctactaggaggccaacttgctgtgtgctagtgcaaacaaagcctagcaagggagaaattgcacaagaagatcaagaaaagttgaaggaagattatgatcaagttgtatccgatgttaatgagttagcaacatctatgttctagactttttaaccttatttttgtgctatttgtaccttttaccccttgtctaaactctgttcaactttagttattaatgaaatattcttgagctttgt

SEQ ID NO: 8428 - DNA, 666 bp, Plantago ovata
tcctccttcagctctcactcgtccaaacagtctttcacctctcttctcaaacaaaacgctcagccaggaaaatgggaggaagtgacagtgaaatcgacaagtcagcacagaaggagcgggagaagaagaagatcttagcccttgctcccattgctaaaccactcgccggcaagaagctctgcaaaaagacccttaaacttgttcgccgagctgcggagaacaagtgtttgaagaggggtgttaaggaagttgttaagagtattcgacgcggtaacaaaggaatttgtgttattgctggcaatatatccccaatcgatgttatcactcatgtcccgattttgtgcgaagaatctgatgtgccatatgtctatgttacctcaaaggaagaccttgctaatgccggagctaccaagaggccaacctgctgtgttctggttcaaacaaagcccaccaagggagaaatagaccaagagaaactggagaagttgaagggagagtatgaccaagttgcatcggatatttctgaattagccaactctatgttttagattattaggagaaggaatgtaccttatattttgttggcttgtaagtccttcagtttctagtttaaattaggcgtacatcatgactcttttattttctccgtctctatatttgtaaaat

SEQ ID NO: 8429 - DNA, 601 bp, Solanum tuberosum
gcttaaaccctagtgatatcgcgttccaacttctccccatttcgttaaaccctacaccgacgccctgcttttgcttttacgttcaagagagatatgggtggtagtgatagcgaagtagagaaaacggcacaaaaagaggagagaaagaagctaatggctatagcccctattgctaaaccactcgctggtaaaaaactcagcaaacgaaccttcaaactcgttaggcgagctacggaacataaatgcttgaagagaggagttaaagaggtagtgaaaagtattcgtcgcggtcataaaggattgtgtgttattgctggaaacatttatcctatcgatgtcattactcacgttccactcctatgtgaggaagctgatataccatatatttatgttccttcaaaagaagatcttgcaagtgctggagccactaagaggccaacttgctgcgttttggtattgacaaagcctactaagggggaacttgggcaagaagatcaagagaaactgaaggaagagtatgatcaagttgtatcagaaattcacgaaaccacctcctccttgttttgataaacaaaattatgatctattgatggtttcactt

SEQ ID NO: 8430 - DNA, 743 bp, Fragaria vesca
gtgtgagaaaaaccctagtctccaagagagaggaaaagaagagagagagagagagagagagagatgggcagcgatagcgaaatggagaagtcacaccagaaggagagagagaggaagaagacgcaggctcttgctccgattgcgaagcctctcgccgggaagaagctcgggaagcgaactctcaagcttgtccgcaaagctgctgaacacaaatgcttgaagagaggagtgaaggaggtggttaaaagcataaggcgaggtcaaaaggggttatgtgttatagccgggaacatttctcctattgatgtgatcactcatgttccagtcttatgtgaagaggctgagattccatatgtttatgtgtcctccaaagaagatcttgcaaatgcaggggcaacaaagaggccaacatgctgtgttctggtgataaccaagccaaccaagggtgagttagcacacgaagaacaagagaaattaaaggcagaatatgatcaggttgcgggagaagtttctgaactttattcctccacacttttctgaaggctggaaaaatttacttgcccttgtactactgactatcttgtatcgaggtttttcctttttagtgcctctgagtgcgctgggctatgtagtttgtttcagaaaatattaagacagaaatgtgtgtttgtgtacctattggagtagaacatcagcatatttgattttctaatgggaagtatgagatccttgttttactcgtt

SEQ ID NO: 8431 - DNA, 956 bp, Musa acuminata
cgctcctaaaaccttagccgccccacctcctcctctgcctcctcccgtctccgccgtccgttgttcttcttcgctccggtcgatcttttacgaacccgtcggtagaccgagagcgagagggatggggagcgacagcgaggttgaaaagtctgtgaaagagaggaagaagatgatggccgttgcccccatcgccaaacccctcgccggcaagaagctctgcaagcgcaccctcaagctcgtccgacgagctgctgaggcgaagtgcttgaaacggggagtgaaggaagtagtaaagagtgtccgccgtggccagaaaggattgtgtgttattgctggtaacatttcccctattgatgtgattactcatgtgcccatcttattggaggaagctgatattccctacatatatgttccttcgaaggaggatcttgcagttgctggggtcaccaagaggccaacatgctgtgtactggtcatgaccaagccaaccaaaggggagctggcccaggaggtgcaagagaagttgcagggagacttcaaccaggtcgcagcagatgtgaaagagatggcatcctccctcttctgagattggggaacgtttaagctcaccttacgtgccatctatgcttcttggttgttccgtataatctgacttgccaacatgctcagcgttgtgtttatgagtcaccatcacataatggtggtgtatcattagcagtgttttaaatatttgcagtagtcgatctaaatacctgtgcatgagctttatctacccctttcgttactagtcttactcttccctcagctgtgcagtgattgtagaagcttgatgttgcggatacagatggagaaatgggttgatggtagttgaaagtggtggaattctggttcattgtcaggttttgttgttagtctattgactggtaacgtcatgtcagtccaagaattcaagatat

SEQ ID NO: 8432 - DNA, 714 bp, Gossypium hirsutum
cccttaaatgctgatgatgcataaaccctaatttccgccatagctttctttcacattctaatagttataaagtcttgttgtcttatttgtagtgctctgtttagaaagagaaagagatagaaatgggaagtgatggcgaagcagagaagactcaacagaaggaaaaggaaaggaagaagatgttagctatttcacccattgcaaagcccctcgctggcaaaaagctttctaagaaaaccctcaagtttgtgcgcaaagccgctgagcacaaatgtttgaagagaggagtaaaggaagtagttaaaagtattcggcgtggtcataaggggttatgtgttatagctggaaatatatctcccattgatgtcataactcatgttccaatcctgtgtgaagaggctgacattccctatgtttatgttccctcaaaagtggatcttgcaactgcagggtctaccaagagaccaacatgctgtgttctggtgctaaccaagcccacaaaaggggaactaagtcccgaggaacaattaaagttaaaagcagattatagccacattgtagaggatgtatctgagctcacatcctctctgttttaagttaacaaaaaagttgtcattgtaacatttgatattgacatcctcttattttacttccagggggggaatatgcttttattacttgttactattgtgtagcatgctgccatttactacc

SEQ ID NO: 8433 - DNA, 573 bp, Euphorbia peplus
tgcttgctttttcccctgcagagagagaacaatgggcagtgatagcgaagcagagcgctcgcacaaacaggacaaggagaagaagaaggttatagctctttctcctattgccaagcctcttgccggaaaaaagctctgcaaaaaaaccctcaagctagttcgaagagctgctgagcataaatgcttgaagagaggagttaaggaggtcgttaaaagtattcgacgtggtcacaaagggatgtgtgtcatagctggaaacatatctcctattgatgtaatcactcatgtgccagtcttgtgcgaggaggctgaaatcccctacatatatgttccctcaaaagaagatcttgcaaatgctggagccaccaagaggcctacatgttgtgttctggtgctaaccaagcctcccaagggagaattagcccaggaagaccaagagaaaataaaggcagaattttctcaggtcacagcagaagtggctgaactcacctcagcacaattttagttattgtattcaacttgctttttggttcatgtaatatgcggttgttaatgtgttatgttgcagttgga

SEQ ID NO: 8434 - DNA, 730 bp, Fagopyrum esculentum
accctttttcttaagccctagcaagttgtctgtaaatcgccgacgctactgctattacgaaacacagtacgagatggggagcgacagcgaaactgagaagtcgggaaaggataagaagaaagtgactgctttagctcccattgctaagcctcttgctggtaaaaagctctgcaagaaaaccttcaagctcgtccgcaaagctgctgagcacaagtgcttgaaaagaggggttaaggaagtcgttaagagtatcaggcgcggtaacaaagggttttgtgtgattgctgggaacatatctccaattgatgttataacccatcttcccattttgtgtgaagaagccgaaattccctacatttatgttccttccaaagaagatcttgcaaacgcgggagccaccaagagaccaacatgctgtgttctggtgatgacaaaaccgacaaagggagaactagcacaggacgagcaggagaaactgaaggctgattatgatcaagttgtatcagatgttggtgaagttgctgcgtctatgttctgatgagattcagattatccatgcctgtctttggtgtatttttgttttcattgaaatgagttgagataattgacaatgtagttaactagttatatcaaatctcttgtgcgatcttgccaaaaattgtattcctagtacagctcctattagaatcttggcctcattccacgttcattaaagataaatgatccacta

SEQ ID NO: 8435 - DNA, 850 bp, Linum usitatissimum
ggaaccagcaaaaccctaatctccagcttcctccgccatctttgcctccaagctcacagccactactgtaacgaaatgggaagcgacagcgaaacggagaagtcgcagaagaaagaaaagaagacgactccagtaactctagctcctatcgctaagcccctcgccggaaagaagctctgcaagcggacattcaagctcgtccgcagagctgctgataacaagtgtttgaaaagaggagtgaaggaggttgtcaagagcatcagacgtgggaataaagggatatgcatcattgccgggaacatatctccgatcgatgtcataactcacgtcccaatactgtgtgaagaggctgaagttccatacttttacgttccttcaaaagaagatcttgcaactgcaggaaacacgaagaggcctacgtgctgcgttttggtccagatgaagcctgccaagggagagttggctaaagaagaacaagagaagttgaagtctgattatgatcaagttgtagctgatgtatctgaactcagttcttctcttttctgatcaccaccaaaatgctttgtactatgacctttgacattgaatctgccttttcactttaatgatatggtttgttgagaaatcgttgagtttttagacgtgggcaagcagtcgtgggagagctcaaacagctgagaagacttcgagtttttcctgtgtatattagacattagttatgatgagtttaactagttcttttttatgttgggtatacaagttagtcgggtcttcaatttcaaacttgattccccatgcaaacaaaaagttccaggcttaattgttcattgtgtgagatcttgtactttat

SEQ ID NO: 8436 - DNA, 795 bp, Linum usitatissimum
gaaatataaaattggcgacagctacaaacaacgagctgaaccagtaaaaccctaacctccagcctccgccatctttgcctccaagctcacaacacctactgtaacaaaatgggaagcgacagcgaaatggagaagtcgcagaagaaagaaaagaagacgactccggtaactctagctcccatcgccaagcccctcgctgggaagaagctctgcaagcggactttcaagctcgtccgtagagctgctgataataagtgcttgaaaagaggagtgaaggaggttgtcaagagcattcgacgtgggaataaagggatatgcatcattgccgggaacatatctccgatcgatgtcataactcacgtcccaatactgtgtgaagaggctgaagttccatacttctatgttccttcaaaagaagatcttgcaactgcaggaaacacgaagaggcctacgtgctgcgtgttggttcagatgaagcctgccaagggagagttggctaaagaagaacaagagaagttgaagtctgattatgatcaagttgtagctgatgtatctgaactcagttcctctcttttctgatcaccaccaaaatgcttgtaatgacctttgacattgaatctgccttttcactttaatgatatggtttcttgagaaaacattgagttcatttcatttagatatgggcaagcagccatgggagagctcaaatagttcaagtagttgaaaagacttgagaaatgtagttaggatggcaaaatgtgtgtcaacgaacataaataaattcatcaaattagc

SEQ ID NO: 8437 - DNA, 804 bp, Linum usitatissimum
cggggatcagtcatctctctaaaaccctgcattataaaggaagagacgaacagaaattttcaactatccaaaaccctaatttccgacttcgattcaacggtgaaaatgggcagcgacggcgaaggcgaaaaatcgcagaagcgggaggagaagacgaaaaaggcgataactcttgctccaattgccaagcccctcgctgggaagaagctctccaagaaaactttcaagctcgtcaagagagctgctgaacataagtgcttgaaacgaggagtgaaggaggtagttaagagcattcgacgtggtcataaagggatatgcattattgctgggaacatatctccaattgatgttattactcatgttccaatcttgtgtgaagaggctgaaatcccatacttttatgtttcttcaaaagaagatcttgctaccgcaggaaacacaaagaggcctacttgctgtgttctggttcaaactaaaccccccaagggagagatacctaaggaggagcaagagaagttgcagtcagattatgatcaagttgtagctgatgtctctgaactcaccacctctctattctgatcacaatgctgcgattcttgtaaacccttataaaacagtcaaaatccatcctactctatctgcgtattgatatgtagtttgaaagctgatgatagctaggatagtaactgttgtgcttctgattgtgatatatcaatgagtaagaaagttgtcctcctttgattgcttccttcatccctgtgctcttttgagccattcttggaatctatcaaagtctggcttgat

SEQ ID NO: 8438 - DNA, 924 bp, Zingiber officinale
gcacccgtttacgccgcctcggccgtaagttcctcacaaaccttggtcgatccggtatcttacgggaattgtcgagatcgacaaggaggtatacagggatggggagcgacagtgaaaatgagaagtcgctgaaggataggaagaagttgatggccgtcgccccgatcgccaaacccttagccggaaagaagttatgcaagcggagcctcaagcttgtccgacgagctgctgaggctaagtgcttgaaacgtggagtgaaggaagtagtgaagagcgtgcgccgtggtcaaaagggattgtgtattattgctgggaatatatctcctattgatgtgattacccatgttcccatcttactggaggaagctgatattccatatatatacgttccttcaaaagaggatctcgcagttgctggagtcaccaagaggccaacttgctgtgtattggttacaactaaaccaactaaaggggagttgacccaagacgtgcaagagaagctgcagtcagattacaaccaggtcgtagcagatgttaaggagctcacagcttccctcttctgaatgtgtcaaaactttccaagtcactcatgtttgcagtttttacttatgagcaaattctccccgctttagttacaagcctaaatccttagttatttattgttgcttgatataagacagtaatatgggacggttggctgggctttggctagtatctgtgttgattaagcttcgtcagctggtcttgatattaagttagccttgattttggataccaatcattgatttttccaactgtctcactatccagacgcaagagtttgcatgatatccaccactggatgtggtttagtaggaattttatgtaatcttggtattaaacatggaatagaagcccttgttgagtattataaggtaaaaaaaa

SEQ ID NO: 8439 - DNA, 795 bp, Triphysaria pusilla
atcaatcactcattcacacacatacacacagtagagagaatgggaagcgacagcgagacagagaaatcttcgcacaaggagagagagaagaagaagatatcagctctagcccccatagccaaaccgcttgccggtaaaaagctctccaaacgcaccctcaaacttgttcgccgagctgcagagcacaaatgcttgaagagaggagttaaggaggtcgtcaaaagcatccgccgcggaaacaaaggattatgtgttattgcggggaacatatcaccaatagacgtcatcactcatgttccgatcctatgcgaagaatctgacatcccttatatctatgttcaatcaaaagaagaccttgctaatgcaggagccactaagaggccgacttgctgtgtgctggtgttgcaaaagccgaccaagggggaacttggccaggaggaccaagagaagctcaagggagaatacgagcaggttgcatcggatatatccgaagtggttaactcaagtatttaatgtgcttttagaacattttattttggaatatgtacttttacatttgttaggattgtgagcttatgactgagatattgcattttccccttagttagcttctttctacatcacttgagtcttttgttaccatgacgagtttacactcttgtcattgcatttagagggtgtttgactaagcttgcttgaaagagcttataagcttgtacatcgtatacgatgtttttaagagcgtataagatatactaaaattctttatttcttgtaactaaaaaaaaaaaaaaa

SEQ ID NO: 8440 - DNA, 647 bp, Cleome spinosa
ggctttgaggcggagagagagagagatgggaagcgatagcgaagctgagaggtctcagatgaaggagaaggagaaggagaagaagaagaaggtattagctttggctccgatagcgaaacctctcgccggcaagaaactctacaaaagaaccctcaaggttgtacgcacagctgctgaaaacaaatgcttgaagagaggagtgaaggaagtggttaaaagcattcgccgcggcaataaaggattgtgcgtcatagctggaaatatatctcctattgatgtcataactcatgtcccgatcttgtgtgaagatgctgatatcccatacatctatgtcccatcgaaagaggatctagcaacggcaggagccaccaagaggccaacatgttgcgttctggtgctgacaaaacccgggaagggagagctaagccaggaagtgcaagagaaactgaagacagagtatgaacaagttgtaggagatgttaaagagcttgcctcttctgttgtgtaagagattgctccattactgcttctgttcaaatagattacaatctgaacgtgatggttggattttcggctacgatgatccttagctaatgatgttgatacaaaaaaaatatctaccaaggaaactcaagtgttcctttctc

SEQ ID NO: 8441 - DNA, 670 bp, Carthamus tinctorius
cctttagcctctgtttagagatagtgtgtgtgtgtgtgtgagagagagagagagatgggaggaagcgatagcgaaggtgatagatcagcgcataaggagaaagagaagaagaagttgctggctttggcccctatcgctaagcctctcgccggcaaaaagctctccaaacgtactcttaagctcgtccgcaaagctgctgaacacaagtgcttgaagagaggagtcaaggaggttgttaagagtatcagacgcggtaacaaaggagtttgtgttattgctgggaacattaccccaattgacgtgataactcatgttccaatattgtgcgaggaggcggacataccatatgtctatgtgtcgtcaaaagaagatcttgcaaatgcaggtgctaccaagcggccaacgtgctgtgttttggttctaacgaaaccgacaaaaggggagcttggagaagaagaacaacaaaagctgaaagcagaatacgatcaagttgcttcagaagtaactgaactcgctgctactttgttctaaacgccatgtttgtagcttctctttttttcttcttttcgttcatatggcacacttcattttaatggtctctgttgcagcatactagtgtgccttgaaaatgcttgattatacagtaagatgttgatggtttaaagatttt

SEQ ID NO: 8442 - DNA, 554 bp, Zinnia violacea
attcgcggccgcgaattctttggcctccttaattctcaaacctaaaatcaaactcaaaaaatgggagcaagtgacagtgaagcagagaaatcagcactcaaggagaagaaaaagcttcaagctttagccccaattgctaaaccccttgctggcaaaaagctttccaaacgcaccctcaaacttgttcgcaaagctgctgaacataagtgtttgaagagaggtgctaaagaggttgtgaagagtatcagacgtggtaataaaggtgtgtgtgttattgctggaaatataactccaatcgatgtgataactcatgttccaatcttgtgtgaagaggcagatataccctatgtttatgtttcatcaaaagaagatcttgccaatgcaggtgcaacgaagaggccgacgtgttgtgttctggttctacccaagccgactaagggggaaattgctagaggaagacaaagaaaaactgaaaagtgaatacgatcaagttgctacagaaatcacttcacttgctgcttctatgttttgaacacaattgtttgtattcatgt

SEQ ID NO: 8443 - DNA, 680 bp, Malus domestica
cggaagagagtgaaaaatcccagtctccagaaagcttagagagaaaaagagagaggagagagagagggagggagagagatagagagggagatgggaagcgatagcgaagtagagaagtcagcgcagaaggagagggagaagaagaagctgcaggctctcgctccggtagccaaaccgctcgccggaaagaagctctgcaaacgaaccctcaagctcgtccgtaaagctgctgagcacaaatgcttgaagaggggagtgaaagaagtggtgaaaagcataaggcgtggtcaaaaggggttttgtgttatagctgggaacatttcgcctattgatgtgatcactcatgttccaatcttatgtgaagaggctgaaattccatatgtttacgtgccttcaaaagaagatcttgcaaatgccggtgccaccaagaggccaacctgctgtgtcctggtgacaaccaagcctaacaagggggcactctcccaagaggatgaagataaaataaaggaaaattacgacgaagttgtaggagaggtcaaagaacttcacgccaaccttttctgaaggctgggaaaacacttgcccttgtaccgactatcttatttgaggttttttattttttgtggcctctgaatgctgccgttgtacttcgttttagaaaattttagaatctgcttgtt

SEQ ID NO: 8444 - DNA, 691 bp, Persea americana
gaccagttcatctctttctcagcagcctaaaccctcttctttttgtggggagggagagagagagagagatgggtagtgatagcgaaacagagaaatccctcaaggagaagaagaagctgatggctcttgccccaatcgccaaacctctcgccggcaaaaagctttgcaaaaagaccctcaaactcgtcaggaaagcttctgaatctaaatgtttgaagagaggagtgaaggaagtggttaagagcattcgaaggggtcacaaagggttgtgtgtaattgcagggaacatttctccaattgatgtgatcacacatgtccccatcttgtgtgaagaagctgaaataccatacatatacgttccctcaaaggaggatcttgccactgcaggagccaccaagaggcctacgtgctgtgttttggtgctaccaaaacccatcaagggggagctgggccaagaggaacaagaaaagttggaggaagattatagcaaagtcgcatcagatttgaaggaacttgcatcctcccttttctgaaggagtacaattcaactgctgtgtgttattgggtgcagttgttttggtttttgtactgcgatgatcctgtcattaaaaggaaaacgtgtaatattcattccttgggtgggatgttccaaagattatcagacgtgaatggactcatatcctagtttcta

SEQ ID NO: 8445 - DNA, 889 bp, Fagus grandifolia
ctggaccttggctgtcactcagttcctagtctcctccgctaacacgcacagcaagcgtacaaaaccaaaaccgcaccagctttcccaacagtacagagaaagaaaagcgcaaaatgggaagcgatagcgaagcagagaagtcgcagcagaaggagaggaagaaggtggtagccctcgctcccattgccaaacccctcgccggcaagaagctctgcaagcgcaccctcaagctcgtccgcaaagctgctgagcacaaatgcttgaagagaggagtaaaggaggtggttaaaagtataaggcgtggtcataaaggaatatgtgttatagctgggaacatatcacctattgatgtgattactcatgttccaatcttatgtgaagaggctgatattccctatgtatatgttacctcaaaagaagaccttgcaaatgcaggggccactaaaaggccaacatgctgtgttctggtgctaaccaagcctaccaagggagaattagctccagaggaacaggataaactacaagcagaatacaaacaggttgcggtggatgtgtctgaacttgcatcatctcttatctgaagtacagaacaaaagtatttgtgctttattgaagctggtatattatctggctgtttcatgtaatcttttgaagtgggtagagctgtttttcttatgtccaagcatttaggggtatctattgtgtgttagagcaagcttctgtaggttcatagagcttcgatccaactttggagacactaagattagtacattgggtctagctaattgtattggacacggtacttttaattatgatgctagaaaactttattttgttcattttctcagtccttttcattttctgctcttttcttcacagcacatgaaat

SEQ ID NO: 8446 - DNA, 970 bp, Cedrus atlantica
cttcagtcatttacgtttctgcagtctgctcctcagcaagaatcagcattctgcaactctatctccattcactgcacggactgtggaaatcctaagtgacacgcgcaacggatttggtagcaagcagcgcaggcggatttagaagtgaagtggccaattacactccaatcacaacaaatatttactgcaagggcgcatgtgtattgtgtgaagaaattgtgaaagtattcattgatttatctgataataaaaatggggagcgatgtagagacggagaagacgccaaaggataaggagaagcggaagatgctgatgttgtcgcccatcgcccgccctctcgcagggaagaagctttgcaagagaaccctcaagctcgttcgacgagcttccgaggctaagtgtttgaagcgtggagtaaaagaagtggtgaagtccatcaggcggggaaagaaaggattgtgtgttattgctgggaacatctcaccaattgatgtaattacacatgtacctattttgtgtgaagaagccgacattccctatatatatgttccatcgaaagaggatcttgcaggtgcaggagccactaagaggccaacatgttgtgttttagtgcttacaagccctactaaagggagccttagtgaggaggaagataaaaaattgaaagaggactacaatgaagtggtgaaggaagtgcgggagctggcgacgtctttcttctaacaaaagttggcgcactgatatttttatcaacttcatttataaatcactctggccttgcttaatttgaagtggaactgatggtaatataagtagtgagttggcatgtaaaaggctcactgctaaatgcgttgagtttgtcaaatacagttgaagtagtgaagtgaattttcgggatggggaggccctctaaacctttgttgaagtccttgagaagcttcccatgttcactctggatagccaaagtgat

SEQ ID NO: 8447 - DNA, 669 bp, Centaurea maculosa
ggaggaagcgatagcgaaggagatagatcagcgcataaggagaaagagaagaagaagttgcaggctttggcccctatcgctaagcctcttgccggcaaaaagctctccaaacgcactcttaagctcgttcgcaaagctgctgaacacaagtgcttgaagagaggagttaaggaggttgttaagagtatcaggagaggcaacaaaggagtttgtgttattgctgggaacattaccccaattgacgtgataactcatgttccaatattgtgtgaggaggcggacataccatatgtctacgtgtcgtcaaaagaagatcttgcaaatgcaggtgccaccaagcggccaacatgctgtgttttggttctaacgaaaccgacaaaaggggagcttgcagaagaagaacaacaaaagctgaaagcagaatacgatcaagttgcttcagaagtaaccgaactcgctgctactttgttctaaatgctatgtttgtagcttctcttttttcttcttttcgttcatatggcacacttaattgaaaatgtttgatctctgttgcagcgtactaatgtcccttgaaaatgattgattatacaatcgatgttgaaaaccttgatggtttaaagattttcaagaagttcaattaagatgtgaaacataacttagatcggttag

SEQ ID NO: 8448 - DNA, 814 bp, Gossypium raimondii
cttaaatgctgatgatgcataaaccctaatttccgccatagctttctttcacattctaattgttataaagtcttgttgtcttatttgtagtgctctgtgtagaaagagaaagagatagaaatgggaagtgatggcgaagcagagaagactcaacagaaggaaaaggaaaggaagaagatgttagctatttcacccattgcaaagcccctcgctggcaaaaagctttctaagaaaaccctcaagtttgtccgcaaagccgctgagcacaaatgtttgaagagaggagtaaaggaagtagttaaaagtattcggcgtggtcataaggggttatgtgttatagctggaaatatatctcccattgatgtcataactcatgttccaatcctgtgtgaagaggctgacattccctatgtttatgttccctcaaaagtggatcttgcaactgcagggtctaccaagagaccaacatgctgtgttctggtgctaaccaagcccacaaaaggggaactaagtcccgaggaacaattaaagttaaaagcagattatagccacattgtagaggatgtatctgagctcacatcctctatgttttaagttaacaaaaaagttgtcattataacatttgatattgacatcctcttattttacttccagggggggaatatgcttttactacttgttactattgtgtagcatgctgccatttactaccacgtcaaattgcctagaaactgaacaaatataatcaaagacgcagttaattgaaggatcttaatctaccaaacatcagaaatgcaaatttgtaggattttgg

SEQ ID NO: 8449 - DNA, 783 bp, Mimulus guttatus
aaatcaaatattataacactatcggcttctctaaaaccctaatcccttttcccttccacacagaaacccccctttctcttctttctgcgccaatttccatacatagcagagatgggaagcgatagcgagactgataaaacagcgcagaaagtgagggagaagaagcagatgtcggctcttgcacccatcgccaaaccgctcgccggaaaaaagctctccaaacgcaccctcaagcttgttcgtcgagcggcggagcagaagtgcttgaagagaggagttaaggaggtggtcaaaagtattcgtcgcggcaataaagggatatgtgttatagcagggaatatatcacccatagatgtcatcactcatgttccaatcttgtgtgaagaagctaacataccgtatgtctacgttacatcaaaggaagatcttgcaaatgcaggggccactaagcgtccgacttgctgtgtgctggtgctaacaaagccggtcaagggtgaactcggtcaggaggaacaagagaaactgaagggagattatgaccaggttgcttcagacttgtctgaactggctaactccatgttttgagaaaatcagtcattgtatcatcaaggttgtattttatattagtttatgcaaaattaattgcaattatcatccagagtagtgtttggaaacatggatttaagtactaatttttattgattttcttgtttaaaacattggaaaatgtacatgtgagatttggtattttcattgaatgagtattgataaggtaaaataaat

SEQ ID NO: 8450 - DNA, 679 bp, Nicotiana benthamiana
cccttctaggaaaagccacatatactactaattcatcttcctcataaaccctagtttctgcttacccttccaaaaaaaaaacagagaccagtagcttcggtagaaatgggtagcgatagcgaagtagagaaaagcgcacaaaaggagaagaagaagctgttggccttagctcctattgccaaaccctttgctggaaaaaaactcaacaaacgcatcttcaaacttgttcgccgagctgcggagaaaaagtgcttgaagtggggcgttaaagaggtggtaaagagtattcgacgcggtcaaaaaggagtgtgtgttatagccggaaatatatctcctatagatgtcatcacccatgttccaatcctgtgtgaagaagctgagataccatatgtctacgtctcctcaaaagaggatctagcaaatgtcggagccaccaagaggccaacttgctgcgttttggtacaaacaaaacctgccaagggggaacttagccaggaggatcaagagaaactgaaagctgattatgatcaagttgtatcagaaatcggtgaaatggcatcctcgatgttctgattatcaacattatgatttttaagtttgtacctatttcccctgtactcagctttagtaacgaatctagtattttatcttttgaagctgcgctgcacctgtttctctc

SEQ ID NO: 8451 - DNA, 722 bp, Orobanche aegyptiaca
taagagagagagagatgggaagcgacagcgaaactgagaaaactgcgcagaaggagagggagaaaaagaaccgcttggctcttgcccccatagccaaacctctagccgggaagaagctctccaaacgaaccctcaaacttgttcgtcgagccgcggaacacaagtgcttgaagagaggagttaaggaggttgtcaaaagtattcgccgcggaaacaagggaatatgtgttattgctgggaacatatcaccaatagatgtcatcactcatgttccaatcttatgtgaagaatctgaaattccgtatatttacgttcaatcaaaagaagatcttgctaatgcgggagccaccaagaggccgacttgctgtgtactggtgctaccaaagccgaccaagggggaactcggccaggaggaacaagacaagttgaagggggaatatgaccaggttgcgttggatatatccggaatcgctaactcaatgttttgatttgctggacattacattgtgaagtatgtatctttatatttgttaggaatgtgagctacactgtttgagaggatgaatttttaaatttgcttatttctacatgtcttcaattactattaagaatctcatatgttagtttgtctatgaattgttggggttacaaatagctagagctcatgcacttccaaaaccatgtagtttatgggtgagcttgtaagctatttaaaacagttt

SEQ ID NO: 8452 - DNA, 833 bp, Euphorbia esula
gaagtgcccctttctaaattgccgccatcactgatattggaaaactgaaaactcttcctttccccggcgagataaccatgggcagtgatagcgaagcagagcggtctcagaaacaggagaaggagaagaagaaggtcatagctctttctcctattgccaaaccccttgccggaaaaaagctctgcaaaaaaaccctcaagctagttcgaagagctgctgagcataaatgcttgaagagaggagttaaggaggtggttaaaagcattcgacgcaataacaaagggttgtgtgttatagctgggaatatatctcctattgatgtgatcactcatgtgccagtcttgtgtgaggataatggaattccctacatatatgttccctcaaaagaagatcttgcaaatgccggggcaaccaagaggccgacatgttgtgttctggtgctaacgaagcctaccaagggagaattagcacaggaagaacaagacaagttaaaggctcaactatctgaggtttctgctgatgtggctgagctcacctctgcacttttttagtcattatcttcaatttcgtctcatgtaatatgcagttgtttaatttgttatgtaactgactggatatttgccaaagccaaaaaaagaaagaagaaactgatgttcacctttttctttttctaccatttggaaattggtattgaattattatagtgtcttgtattattaggacaactagcttgccttttttttttttttgtggaaactagctcgccttttcaaatagcagtgttaattatgcaaatatcatattaatggtgatttataaacaatttcaattgc

SEQ ID NO: 8453 - DNA, 696 bp, Helianthus annuus
tgggaggaagcgatagcgaaggagatcgatcagcgcataaggagaaggagaagaagaagctactggcattggctccgatcgctaaacctctcgccggaaaaaagctctccaaacgcactctcaaactcgttcgcaaagctgctgaacataaatgcttgaagcgtggagttaaagaggttgttaagagcatcagacgcggtaataaaggagtgtgtgtgattgctgggaacattagtccaattgatgtgattactcatgttccagtattgtgcgaggaggccgacataccgtatgtttatgtttcgtcgaaagaagatcttgcgaatgcaggcgccactaagaggccaacatgctgcgttttggttctaaccaagccggcaaaaggtgaacttggcgaagaagaaggacaaaaactgaaaacagaatatgatcaagttgcttcagaagtatctgaactgactgctggtatgttttaagcctacgcctaaacatgtgttatagacacgtcttttcgaccaatgaatatctatatatttggttgacgtggcatttttcctagatgaaaatggttcaggtgtgaaaatgttttgttagtatgactcaatggttttaactatgtgaatcatgtaaggcaagagatggttatttactcaaattttggctttatctacccatgtgttatcgacacaacatttt

SEQ ID NO: 8454 - DNA, 1631 bp, Centaurea maculosa
ccagtgcagccatccatcctctctatttgtgttgcattcctttgtgttttcgggaacgttgttactggtcaatttaccagatttaataacttgacattgcctcaaggtgtaacgggtcctgaatcagctgcatttcgtggactcacagctgaaggtccttttacaaccgtcactgatggtagaattttgaaatatcaaggccctaacatcggttttgtggattttgcgtacacttcaccagcaaggacaaagcaattttgtgatggtaccacagatcctgacaagggtccaatatgcggaaggccccaggctcttagttttcaacctttaaccggccttctctatatagccgatgcttatttgggccttctcgttgtaggccctaacggcgggcttgcaactcagctcgccggtggtttcaagtttctgaccggcgttgacgttgacttgttaaccggccttgtttattttagcgatgccagtttgacgtacgaaatcagaaatactacacaaccgggatttcagcctgattcaacagggaggttgttgcgctacaacccacttacgagagaagtgtcggttttgttgagtggtctatcgggtgggggcggccctgcggtgagcgtggatagcacgttcgttcttgtatcagaggtaaacggaatgcgggttttaaaatatttcttggtcgggcctagggcaaatacggcacaacatttgctaaatattgatgggaatcctaataaaataaaacgagctgaaagattgggagagttttgggtggcggtttcaaatggactacaaccacgtaggcctacgatcacacctcaaggattgctgatcaattcgaatggggtcgtattgcaaacggtgatgtttgataaagagttcttcaataaaactataagcttggttcaagagcaaagtggaagactttatgtaggctctcgtttaaccaatttcattggtgtctattctaactaggcacctatatattgtaccactaaataaggttgatagagagagagatgggaggaagcgatagcgaaggagatagatcagcgcataaggagaaagagaagaagaagttgcaggccttggcccctatcgctaagcctcttgccggcaaaaagctctccaaacgcactcttaagctcgttcgcaaagctgctgaacacaagtgcttgaagagaggagttaaggaggtcgttaagagtatcaggcgaggcaacaaaggagtttgtgttattgctgggaacattaccccaattgacgtgataactcatgttccgatattgtgcgaggaggcggacataccatatgtctacgtgtcgtcaaaagaagatcttgcaaatgcaggtgctaccaagcggccaacgtgctgtgtcttggttctaacgaaaccgacaaaaggggagcttgcagaagaagagcaacaaaagctgaaagcagaatacgatcaagttgcttctgaagtaaccgaactcgctgctactttgttctaaatgctatgtttgtagcttctcttttttcttcttttcgttcatatggcacacttcattttaatgatctctgttgcagcatactaatgtgccttgaaaatgcttgattatacagtcgatgttgatggt

SEQ ID NO: 8455 - DNA, 754 bp, Cirsium arvense
gacaggcacgtgagaagcacgcccctctccctctgttccttccctctttcacgatctccttaaaccctaacaacaaactcagaaaaaaaccctaactctgttttagagaaagagagagagagagtgtgtgtgtgagagagaaagagatgggaggaagcgatagcgaaggcgatagatcatcgcataaggagaaagagaagaagaagttgctggctttggctccaatcgctaagcctctcgccggcaaaaagctctccaaacgcactcttaaactcgttcgcaaagctgctgaacacaagtgtttgaagagaggagttaaggaggttgtcaaaagtatcagacggggtaataaaggagtttgtgtaatcgctggcaacattaccccaattgatgtgataactcatgttccaatattgtgcgaggaggcggacataccatatgtctatgtgtcatccaaagaagatcttgcaaatgcaggtgccaccaagcggccaacatgctgtgttttggttctaacgaaaccgacaaaaggggagcttggagaagaagaagaaaaaaagctgaaagcagaatacgatcaagttgcttcagaagtaaccgaactcgctgctactttgttctaaatgctatgtttgtagcttctcttttttcttcttttcgttcatatggcacactttattttaatggtctctgttgcagcataccaatgtgccttgaaatgcttgattatacagtcaatgttgatggtttaaag

SEQ ID NO: 8456 - DNA, 480 bp, Nicotiana benthamiana
gtagaaatgggtagcgatagcgaaatagagaaaagcgcacaaaaggagaagaagaagctgttggccttagctcctattgccaaaccccttgctggaaaaaaactcaacaaacgcatcttcaaacttgttcgccgagctgcggagaaaaaatgcttgaagaggggcgttaaagaggtggtaaagagtattcgacgtggtcaaaaaggagtgtgtgttatagccggaaatatatctcctatagatgtcatcacccatgttccaatcctgtgtgaagaagctgagataccatatgtctacgtctcctcaaaagaagatctagcaaatgccggagccaccaagaggccaacttgctgtgttttggtacaaacaaagcctgccaaggaggaacttacccaggaggatcaagagaaactgaaagcagattatgatcaagttgtatcagaaaaacttgctgcgttttggtacaaacaaaacctgcca

SEQ ID NO: 8457 - DNA, 731 bp, Helianthus annuus
ctaattttgtttgtgtttaacaaaaaatgggaggaagcgatagcgaaggagatcgatcagcgcacaaggagaaggagaagaagaagctactggcattggctccgatcgctaaacctctggccggaaaaaagctctccaaacgcactctcaaactcgttcgcaaagctgctgaacataaatgcttgaagcgtggagttaaagaggttgttaagagcatcagacgcggtaataaaggtgtgtgtgtgattgctgggaacattactccaattgatgtgattactcatgttccaatattgtgcgaggaggccgacataccatatgtttatgtttcgtcgaaagaagatcttgcgaatgcaggcgccacaaagaggccaacatgctgtgttttggttctaaccaagccggcaaaaggtgaacttggcgaagaagaaggacaaaaactgaaaacagaatatgatcaagttgcttcagaagtatctgaactgactgctggtatgttttaagcctactcacacctaaacatgtgttatagacacgtcttttagaccaaccaatgaatatttatatatttggttgacgtggcatttttcctagatgaaaatggttcaggtgtgaaaatgttttgttagtatgactcaatggttttaactatgtgaatcatataaggcaagagatggttatttactcaaattttggctttatctacccatgtgttatcgacgcaacatttt

SEQ ID NO: 8458 - DNA, 714 bp, Helianthus annuus
ctaattttgtttgtgtttaacaaaaaaatgggaggaagcgatagcgaaggagatcgatcagcgcataaggagaaggagaagaagaagctactggcgttggctccgatcgctaaacctctcgccggaaaaaagctctccaaacgcactctcaaactcgttcgcaaagctgctgaacataaatgcttgaagcgtggagttaaagaggttgttaagagcatcagacgcggtaataaaggagtgtgtgtgattgctgggaacattactccaattgatgtgattactcatgttccaatattgtgcgaggaggccgacataccgtatgtttatgtttcgtcgaaagaagatcttgcgaatgcaggcgccactaagaggccaacatgctgcgttttggttctaaccaagccggcaaaaggtgaacttggcgaagaagaaggacaaaaactgaaaacagaatatgatcaagttgcttcagaagtatctgaactgactgctggtatgttttaagcctactcacacctaaacatgtgttatagacacgtcttttagaccaaccaatgaatattcatatatttggctgacgtggcatttttcctagatgaaaatggttcaggtgtgaaaatgttttgttagtatgactcaatggttttaactatgtgaatcatgtaaggcaagagatggttatttactcaaattttggctttatctacccatgtg

SEQ ID NO: 8459 - DNA, 2059 bp, Glycine max
ttgaaattgatacagagctgagagcatcaaggaatagaatagaagattcatttttccattttgatatggaagctgatgtttctattatttttgccgcgttttcaaaaccctaaattgaagaaatcccaatttcccctcctctctctctgctttggatgattttcaaccaaaaatctgtgcttttgtgcttttcgaatcttttgctctgatgggtacttccaatcttctattgttcttctctctggtgagtctgtgtgctatggcggcttccaaggtggttcttattgggaataatatcactctctccttcgatgatattgaagctaattttgccccaacagtcaaaggttctggagaatatgggatcttatatttggcagaaccactggatgcatgtacagaattgacaaataaagttgaacaacttcccaatgcgagttcaccttttgctttggtggttagagggggatgtagctttgaggaaaaagtcagaagggcacaaaaggctggcttcaaagctgtaattgtctatgacaatgaagatggtggcatcttggttgcgatggcaggaaattctgctggtataaaaatacacgctgtatttgtatctaaagcttcaggtgaaatactaagcaaatatgctgggttgactaatgtggaaatatggctcattccaacttttgaaaactcagcgtggtctatcatggcaatttcatttatttccctgctagctatgtctgcggtgctggccacttgtttcttcgtccgcaggcatcgcataagaagagaaaggcctcgagctcctcttgttcgtgaatttcatggtatgagtagtcgcctagtgaaagcaatgccaagtttgatatttactgctgttttggaagataactgtacatcaagaacatgtgctatatgccttgaagactattgtgttggtgagaagctcaggattctgccctgctgtcacaagtttcatgctgcctgtgtggattcgtggcttacttcatggagaaccttttgtccagtttgcaagcgtgatgctagatccggcttaactgatccaccaccttcagaatccacacccttgctctcatcaaccccagcatctatggcatcgtctgtcttatcttctgcaagatcatcgctagcttcatcttcagccatacaaattgcccggacagcatctatggcatcctctgccttaccttctgcgagatcatccctagcttcctcttcggcaatacaaattgcccgggcagcttcacagaccccatctgtttctcgtaaccactccatagccagtacaccttatgttcagccatctcttaggtcctcctaccatcaatccccctccctaagtatcagccgaagctccgtagatcttaggaatgcatcccaaagatctctagcttctcacttgaattcaccacgttccatgggatacccgtctttgtcatctcttaactcgcggtacatgtctccacacattccaagtccaagcaatgcttcggtgagctatatgggctcatccagtcatcaacaacatcctctccgctatagtgagtcagctgcaagcttctccccatttgcatcgacacactcccttccggaatgttaaattgttcaattgattatatcatatgattgagacacgtccatgcagttgaaccagtaattgccaagtcttgaactaaaaggtgaccatggatgactggtcgatatttgggcgtagcatttcctcctttgtctcctctggcatttgacttccttcttggcacctggtgtacattgtagcttctctgtggtgttagtttcatttttacatgtgctggttggcgagcttgcatacagtcactagtgtgtattgtttgtactttggatattgatgttttcatggccttgatgtcaaagtatagtcaactgctaacaagagaaatgttgggctgaagtaagaagagttctttaagttctttctagtcatgagagatcatgtgatgtgatactctagtgttatctatacttgatcatctaattgcaaaagtgagtaataatacttgta

SEQ ID NO: 8460 - DNA, 2475 bp, Glycine max
aattacctttgatatttaccaatttccacatcaaacttgcttatccacgtacgatttggaactttctgaatacatgctgctgaaatattttttttggggatataatattgattactatttattttatcttctgatattatatttccaatttgctgtcaaaacattattatcgatcaatttgaaattgatacagagctgagagcatcaaggaatagaatagaagattcatttttccattttgatatggaagctgatgtttctattatttttgccgcgttttcaaaaccctaaattgaagaaatcccaatttcccctcctctctctctgctttggatgattttcaaccaaaaatctgtgcttttgtgcttttcgaatcttttgctctgatgggtacttccaatcttctattgttcttctctctggtgagtctgtgtgctatggcggcttccaaggtggttcttattgggaataatatcactctctccttcgatgatattgaagctaattttgccccaacagtcaaaggttctggagaatatgggatcttatatttggcagaaccactggatgcatgtacagaattgacaaataaagttgaacaacttcccaatgcgagttcaccttttgctttggtggttagagggggatgtagctttgaggaaaaagtcagaagggcacaaaaggctggcttcaaagctgtaattgtctatgacaatgaagatggtggcatcttggttgcgatggcaggaaattctgctggtataaaaatacacgctgtatttgtatctaaagcttcaggtgaaatactaagcaaatatgctgggttgactaatgtggaaatatggctcattccaacttttgaaaactcagcgtggtctatcatggcaatttcatttatttccctgctagctatgtctgcggtgctggccacttgtttcttcgtccgcaggcatcgcataagaagagaaaggcctcgagctcctcttgttcgtgaatttcatggtatgagtagtcgcctagtgaaagcaatgccaagtttgatatttactgctgttttggaagataactgtacatcaagaacatgtgctatatgccttgaagactattgtgttggtgagaagctcaggattctgccctgctgtcacaagtttcatgctgcctgtgtggattcgtggcttacttcatggagaaccttttgtccagtttgcaagcgtgatgctagatccggcttaactgatccaccaccttcagaatccacacccttgctctcatcaaccccagcatctatggcatcgtctgtcttatcttctgcaagatcatcgctagcttcatcttcagccatacaaattgcccggacagcatctatggcatcctctgccttaccttctgcgagatcatccctagcttcctcttcggcaatacaaattgcccgggcagcttcacagaccccatctgtttctcgtaaccactccatagccagtacaccttatgttcagccatctcttaggtcctcctaccatcaatccccctccctaagtatcagccgaagctccgtagatcttaggaatgcatcccaaagatctctagcttctcacttgaattcaccacgttccatgggatacccgtctttgtcatctcttaactcgcggtacatgtctccacacattccaagtccaagcaatgcttcggtgagctatatgggctcatccagtcatcaacaacatcctctccgctatagtgagtcagctgcaagcttctccccatttgcatcgacacactcccttccggaatgttaaattgttcaattgattatatcatatgattgagacacgtccatgcagttgaaccagtaattgccaagtcttgaactaaaaggtgaccatggatgactggtcgatatttgggcgtagcatttcctcctttgtctcctctggcatttgacttccttcttggcacctggtgtacattgtagcttctctgtggtgttagtttcatttttacatgtgctggttggcgagcttgcatacagtcactagtgtgtattgtttgtactttggatattgatgttttcatggccttgatgtcaaagtatagtcaactgctaacaagagaaatgttgggctgaagtaagaagagttctttaagttctttctagtcatgagagatcatgtgatgtgatactctagtgttatctatacttgatcatctaattgcaaaagtgagtaataatacttgtaaaattttcgtagcttgcattgctaatagattatcagttttaaaccatgggggcaaattaggtatcctatttgatctgtggaaaattcatcatatatagatacttgtaaattgaattttctagagagtgcgtgaaattttaggtttctatttctttttttctccatttctattgatttgaaaaaatatacggtactcagtttaatgtgtataatgtcaattttatttattactccaaaa

SEQ ID NO: 8461 - DNA, 2306 bp, Cajanus cajan
tccacgtaccatttggaacttttgaagacattctgatatcgatttatttatttttggtatatattgatttgttctttattttatcttctgatattatatttcttattttgctgtcaaaacattattagcgatcaatttgaaacagagcagagagaatcacagaatagaagaacagaagattcattttttttctttttgagatggaagctgatgtttctatcatttttgctgcgttttcaaaaccctaagtttcagaaatcccaatttctcctttcctctttctgctttggatgatttttaaccgaatatttgtgcttttgtgctttccgaatcttttgctttgatgggtacctcgaatcttctcttgttcttctctttgttgagtctgtgtgctatggcggcttccaaggtggtgctgattgggagtaatatcactctctccttcgatgatattgaagctaattttgccccaacaatcaaaggttctggagaatatggggtcttgtatttagcagagccgcttgatgcgtgtacagaactgacaaataaagttgaacaactacccaatacgagttcaccttttgctttggttgttagagggggatgtagctttgaggaaaaagtcagaagggcacaaatggctggcttcaaagctgtaattgtctatgacaatgaagatggcggtgtcttggttgcaatggcaggaaattctgctggtataagaatacatgctgtatttgtatcaaaagcttcgggtgaaatactaaagaaatatgctgggttgactaatgtggaaatatggctcattccaacttttgaaaactcagcatggtctatcatggcaatttcatttatttccctgctagctatgtctgcggtgctggcaacttgtttctttgtccgccggcatcgcataagaagagaaaggcctcgagcttctcttgttcgtgaatttcatggtatgagtagtcgtctagtgaaagcaatgccaagtttgatatttactgctgttttggaagataactgtacatcaagaacatgtgctatatgccttgaagactattgtgtcggtgagaagctcaggattctgccctgctgtcacaagtttcatgctgcctgtgtggattcttggcttacttcatggagaaccttttgtccagtttgcaagcgtgatgcaagaactggcttaactgatccaccaccttcagaatccactcccttgctctcatcaagcccagcatctatggcatcctctcttgcatcttctgtgagatcgtcactggcttcatcttcagcaatacaaattgtccggacagcttcacagaccccatctgtttcccgaaaccactccatatctagtacaccttatgttcagccatctctcaggtcctcctaccatcaatccccctccctaagcatcagccgaagctctgtagatcttaggaatgcatcccaaagatcgctagcttctcacttgaattcaccacgttccacgggatatccatctttgtcttctcttaactcgaggtacatgtctccacatattccaagtccaagcaatgcttcagtaagttatctcggttcatccagtcatcaacagcatcctctccgatatagtgagtcagctgcaagcttctcaccatttgcatcaacacactcccttccggaatgttaaattgttcaaattgattatatcatatgattgagatgtccatgcagttgaagcaatgattgcccagtcttgaactaaaatgtggccatgtgatgtgatgactggtaacgagtcctgtgcaatgctttggcgttccctatctctatctcctttggcacctggtgtactttgtagcatctctgtgatgttagtttcattttcatgtgctggttgaggttcttgcatttttaggttggcgagcttgcgtacagaatttgcgtgtattgtttttactttgaatattgatgttttcatggccttgatttcaaagtcaactgctaacaaaagaatgttgggctgtacagacagattgaagttagaaaagttgtttatgttctgtccaactaagttatgagatcatgtgatactctagtgttacctgtactcgagcatctaatttgaacagtgagtatcaataatacatgtaaaattttcagaggatgtagctttgctgccaaatgggggtaacatataggactcgtgggattttcccattctaatattatgatattttcttttagcaccaataggcgatcacgggaagattcattagccatatatttttaatacatttgtggcatacccagttatagta

SEQ ID NO: 8462 - DNA, 2068 bp, Phaseolus vulgaris
aacattattattagcaatcaatttggaacagaaaaagattataacagaaggatcgtggaatggagatttagaacattcagttttttctgagatggaagctgatgtttctattatttttgctgtgttttcaaaaccctaaatttcaaaaatcccaatttattattctgcccctttccctctttccctcgaatgatttccaacaaaaaatctgtgcttttttcttaacgaatcttttgctctgatgggtacgttgaatctactctttttcttctctttggtgagtctgtgtgctatggctgctgcgaaggtggtgcttattgggaacaatataactctatccttcgatgatattgaagcaaattttgctccaacagtcaaaggttctggacaatatggggtcttatatttggcggagccacttgatgcgtgtacagaactgacaaataaagttgaacgacttctcaatgtgagttcaccttttgctttggtggttagagggggatgtagctttgaggagaaagtcagaagggcacaaaaggctggcttcgaagctgtaattgtctatgacaatgaagaagacggtgtcttggttgcgatggcaggaaattctgctgggataagaatacatgcagtatttgtatctaaagcttcgggtgaaatactaaagaaatatgctgggtggactaatgtggaaatatggctcattccaacttttgaaaactcagcatggtctatcatggcaatttcatttatttccctacttgcaatgtctgctgtgctggccacttgtttctttgtccgcaggcatcgcataagaagagaaaggcctcgaggttctcttcgtgaatttcatggtatgagtagtcgcctagtgaaagcaatgccaagtttgatatttactgctgttttggaagacaactgtacatcaagaacatgtgctatatgccttgaagactattgtattggcgagaagatcaggattcttccctgctgtcacaagtttcatgctatctgtgtggattcttggcttacttcatggagaaccttttgtccagtttgcaagcgtgatgcaagaactggcttaactgaaccaccaccttcagaatccacacccttgctctcgtcaagctcagcagcctctgtcttatcttctgtgagatcatcactagcttcatcttcagcaatacaaattgcccggactgcttcgcagacctcatctatttctcgtaaccactccattgccagcacacctcattttcatccatcacttaggtcctcctaccatcaatccccctccctaagcatgagccgaagctcagtagatcttaggaatgcatcccaaagatctctagcttctcacttgaattcaccgcattccatggggtatccctctttgccatcccttaactcaaggtacatgtctccatatattccaagtccaagcaatgcttcagtgagttatttgggttcatccagtcatcaacaacatcctctccgttatagtgagtcagctgcaagcttctcaccatttgcatcgacacactcccttccggaatgttaaattgtttcgttatatcatatatgactaaaaggtggccatgtgatgaccgatgctctagtggactagtcccatgcgatgctttggcattcctcacctatgtctcctctagcatttgacttccttattggcacctggtgtacattgtagcttctcctgtgatgtttagtttcatttatatgtgctggttgaggttcttacatttttagggtggtgagtttgcgtacagtcaatcgtgtgtattgtttttacttgaaatcttgatgttttcatggctttgatttcaaagtatagtcaactactaacaagagaatgttgggctgtatagacagattgaagtcatacgagttccttatgttctgtctcatggatttgtccaactgaatgatgagagatcatctgatactctggtgttacctatactcgatcatctaattgcaacattattatcaattatgcatgtaaaattttctgtgggtgtataatataatagatatgctattgctggca

SEQ ID NO: 8463 - DNA, 2020 bp, Vigna unguiculata
aatagacgattagaacacattcagttttttcttttggagatggaagctgatgtttccattattttttatgcgtttccaaaaccctaaattgcaaaaatcccaatttatcattctctagctttccctcggatgattttcaaccaaaaatctgtgtttttttttgcttaacggatcttttgctttgatgggtacgttgaatctactcttgttcttctctttggtgagtctatgtgctatggctgctgcgaaggtggtgcttattgggaacaatattactctgtccttcgatgatattgaagctaattttgctccaacagtcaaaggttctggagaatatggggtcttatatttggcagagcctcttgatgcgtgtacagacctgacaaataaagttgaacgacatcccaatgtgagttcaccttttgctttggtcgttagagggggatgtagctttgaggagaaagtcagaagggcacaaaaggctggcttccaagctgtaattgtctatgacaatgaagaagacggtgtcttggttgcaatggcaggaaattctgctgggataagaatacacgcagtatttgtatctaaagcttcgggtgaaatactaaagaaatatgctgggtggcctaatgtggaaatttggctaattccaacttttgaaaactcagcatggtctatcatggcaatttcatttatttccctacttgcaatgtctgccgtgctggccacttgtttctttgtccgcaggcatcgcataagaagggaaaggcctcgggcttctcttgttcgtgaatttcatggtatgagtagtcgcctagtgaaagcaatgccaagtttgatatttactgctgttttggaagacaactgtacatcaagaacatgtgctatatgccttgaagactattgtgttggcgagaagatcaggattcttccgtgctgtcacaagtttcatgctgcatgtgtggattcttggcttacttcatggagaaccttttgtccagtttgcaagcgtgatgcaagaactggcttaactgatccacctccttcagaatccacaccgttgctttcatcaagcccagcatctatggcatcctctgtcttatcttctgtgagatcatcactagcttcatcttctgcaatacaaattgctcggacagcctcacagaccacatctgtttctcgtaaccactctattgccagtacaccttatgttcatccatcaccatcacttaggtcctcctaccatcaatcaccctccctaagcatgagccgaagctcagtagatcttaggaatgcatcccaaagatctctagcttctcactttaattcaccacattccatggggtatccttctttgccatcccttaactcaaggtacatgactccgtatattccaagtccaagcaatgcttcagtgagttatttgggttcatccagtcatcaacaacatcctctccgttatagtgagtcggctgcaagcttctcaccatttgcatcgacacactcccttccagaatgttaaattgttcaatttcattatatcatatgattgaagtgtccatgcacttgaaccagtaattgccaagtcttgaactaaaaggtggccattgatgactgatgctgtagtggactactcctatgcgacactatggcattcctgatctgtctcctttggcatttgacttccttattggcacctggtgtacattgtagcttctcttgtgatgttcagtttcatttacatgttctggttgaggttcttacgtttttaggttggtgagtttgcgtacagtgaatcgtgtgtattgtttttgctttgaatttgatgttttcatggcttttatttcaaagtatagtcaactactaacaagaaaatgttggactgtagattgaagtcatagagttctttatgttctgtcttatggatttgtccaactgaatgataagagatcatgtgatactctggtgttacctgtacttgatcatctaattgcaacatgattatcaattatgcatgtaa

SEQ ID NO: 8464 - DNA, 1931 bp, Glycine max
cgaggtcaaaatcgtttaaaacccttaaaccctgcgacgccgtttctcgtcatctctctctccggtgctccgttgtccgacgagaccgaagccgtgtctcgtgagcagatgggtgagattaaagagaacgttcctcttccgaagaccaagccttccactgaacaggacgttacggatgagctagacctgagaatgaagaagtatcttagaggagaaggtgctaatttggagggtttgaaggataaaaagctgaagggtcaactagctgctaaggaagacttatatggaaaatctgctaaagctgctgctaaggctgagaagtggcttatgcctagtgaaggaggttatttggaggctgaaggcttggagaagacatggaggatcaaacaggaggcaatagctcacgaagtagatatctcaagctcaaggaaacaatatgatattattttaccagaacttggtccgtacactctggattttacttcaagtggccggtatatggctgtgagtggtcgtaagggccatctgggaattgtggacatgataaatctgagcataattagagagtttcaggtaagggaaacagtgcgtgatgtcgcatttttgcataatgagctcttttttgctgctgcccagaaaaagtacccatacatctataatcgagaaggcacagaacttcactgcctcaaggaacatggtccagtgttaaggcttcagtttctggaaaaccattttctcttggcttcaatcaacaagtttggacaacttcgttatcaggacgttacaatgggttccatggtcggtaattttcgaactggcttaggacgtacaaatgtaatgcaagtgaaccccttcaatggggttgtttccttaggtcactcaggtggtactgttaccatgtggaagccaaccagtgcttctcctcttgtcaagatgctatgtcatcatgggcctgtctcagcactggcatttcattcaaatggcctcttgatggccactgccgggaaagataaaaaaattaagctttgggacttgaggaaatttgaggttcttcaaaccttaccaggtcatgcaaatactctggattttagtcaaaaaggcttgcttgcttgcggtaatggttcattgatacagattctgcgtgatgtttctggtacacaaaattattccaagtatatgactcattccatggtgaaaggttaccagataggaaaattggtatttcggccatatgaagatgttctaggcatagggcattccatgggctggtctagtattcttactccaggagcaggagaacccaactttgactcatgggttgcaaacccgtttgaaacttctaagcagaggagagaaaaggaaatacggtctcttcttgataagcttccacctgagactatcatgctggatcccagcaagattggtacggtgaaaccaagaagagagaggccaacaaagcaagagagggaggctgaaatagaagctggcgttgaagcggctaagggcatgaaactgaaaaagaagacaaaaggaagaaacaagccaggtaaaagggtacagaaaaagcaagaggcagtttctagagtgaagaggccctacttggagcagaaaattcaagaagaggaaagcatatcaagaaagaagcagaaaactagtgaggatgttgaactaccaaaatcactacagcgctttgctcgtaaaaaagcatcatcatgatttaactgtccaatagagtctcgtattcgtctttactttccatcctgttgattttaagcttcttgtttgtattttttgttgcatttcatatttgtagcctttttagcctttgatgtgatgttttcggcctttaaagtaaaggcatgtccaaattttgccttaccgacccttgattagagtcttttttaatattataagaatctttacctttacat

SEQ ID NO: 8465 - DNA, 1944 bp, Glycine max
gagcagcgaggtcaaaatcgtttaaaacccttaaaccctgcgacgccgtttctcgtcatctctctctccggtgctccgttgtccgacgagaccgaagccgtgtctcgtgagcagatgggtgagattaaagagaacgttcctcttccgaagaccaagccttccactgaacaggacgttacggatgagctagacctgagaatgaagaagtatcttagaggagaaggtgctaatttggagggtttgaaggataaaaagctgaagggtcaactagctgctaaggaagacttatatggaaaatctgctaaagctgctgctaaggctgagaagtggcttatgcctagtgaaggaggttatttggaggctgaaggcttggagaagacatggaggatcaaacaggaggcaatagctcacgaagtagatatctcaagctcaaggaaacaatatgatattattttaccagaacttggtccgtacactctggattttacttcaagtggccggtatatggctgtgagtggtcgtaagggccatctgggaattgtggacatgataaatctgagcataattagagagtttcaggtaagggaaacagtgcgtgatgtcgcatttttgcataatgagctcttttttgctgctgcccagaaaaagtacccatacatctataatcgagaaggcacagaacttcactgcctcaaggaacatggtccagtgttaaggcttcagtttctggaaaaccattttctcttggcttcaatcaacaagtttggacaacttcgttatcaggacgttacaatgggttccatggtcggtaattttcgaactggcttaggacgtacaaatgtaatgcaagtgaaccccttcaatggggttgtttccttaggtcactcaggtggtactgttaccatgtggaagccaaccagtgcttctcctcttgtcaagatgctatgtcatcatgggcctgtctcagcactggcatttcattcaaatggcctcttgatggccactgccgggaaagataaaaaaattaagctttgggacttgaggaaatttgaggttcttcaaaccttaccaggtcatgcaaatactctggattttagtcaaaaaggcttgcttgcttgcggtaatggttcattgatacagattctgcgtgatgtttctggtacacaaaattattccaagtatatgactcattccatggtgaaaggttaccagataggaaaattggtatttcggccatatgaagatgttctaggcatagggcattccatgggctggtctagtattcttactccaggagcaggagaacccaactttgactcatgggttgcaaacccgtttgaaacttctaagcagaggagagaaaaggaaatacggtctcttcttgataagcttccacctgagactatcatgctggatcccagcaagattggtacggtgaaaccaagaagagagaggccaacaaagcaagagagggaggctgaaatagaagctggcgttgaagcggctaagggcatgaaactgaaaaagaagacaaaaggaagaaacaagccaggtaaaagggtacagaaaaagcaagaggcagtttctagagtgaagaggccctacttggagcagaaaattcaagaagaggaaagcatatcaagaaagaagcagaaaactagtgaggatgttgaactaccaaaatcactacagcgctttgctcgtaaaaaagcatcatcatgatttaactgtccaatagagtctcgtattcgtctttactttccatcctgttgattttaagcttcttgtttgtattttttgttgcatttcatatttgtagcctttttagcctttgatgtgatgttttcggcctttaaagtaaaggcatgtccaaattttgccttaccgacccttgattagagtcttttttaatattataagaatctttacctttacataaaaaat

SEQ ID NO: 8466 - DNA, 1941 bp, Cajanus cajan
acccagcgacgccgtttctcgtcattctctttctctctctctctgtgtctctctccgctgttccgccgccagctccgtcgtcgaaagagtccgaagccgcgtctcgagacaagatgggtgagagtcaagagaacgatgctcttccagagaacaagcctcccaccgaacaggaaatttctgatgaactagacctgagaataaagaagtatctcagaggagaaggtgctaatctggaggttttgaaggataaaaagttgaagggtcaactagctgttaaggaagaattatatggaaaatctgcaaaggctgctgctaaggctgagaagtggcttatgcctagtgaagggggttatctggaggctgaaggcatagagaagacatggaggttcaaacaggaggcaataagtcgtgaagtagacatctcaagctcaaggaaccaatatgatattgttttaccagaacttggtccatacacactggattttacttcaagtggccggtatttggctgtgggtggtcgcaagggccatctgggaattgtggacatgataagtctgagactaattagggagtttcaggtaagggaaacagtccgtgatgtggcattcttgcataatgagctcttttttgctgctgcccagaaaaagtattcatacatctataatcgagaaggcacagagcttcactgcctcaaggaacatggtccagtattgaggcttcagtttctagaaaatcattttctcttggcttcaatcaacaaattaggacaacttcgatatcaggatgttacaatgggtaccatggttggtaattttcgaactggcttaggacggacaaatgtgatgcaagtaaaccccttcaacggggttgtttctttaggtcactcaggtggtactgttaccatgtggaagccaaccagttcttctcctcttgtcaagatgctatgtcatcatgggcctgtctcagcactggcatttcactcaaatggccacttgatggccactgctgggaaagataaaaaaattaagctttgggacttgaggaaatttgaggttcttcaaacactaccaggtcatgcaaataccctggattttagtcaaaaaggcttgcttgcatgtggtaataattcatcaatccaggttctgcgagatgtttctggtacacaaaattattctaggtacatgactcattccatggtgaaaggttaccagataggaaaattagtatttcgaccatatgaagatgttctgggcataggtcattccatgggctggtccagtattcttattccaggagcaggagaacccaactttgactcgtgggttgcaaatccgtttgaaactaataaacagagaagagaaaaggaaatacggtctcttcttgataagcttccacctgagactatcatgctggatcccagcaagattggtactgtaaaacccaaaaaagagaagacagcaaagcaagataaagaggctgagatagaagctgcccttgaagcagctaagggcataaaactgaagaacaaatcgaaaggaagaaacaagccaggtaaaaggatgcagaaaaagcaagaggcaattgcaagagtgaaaaggccctacttggagcagaaaattcaagaagaggaaaacatatcaagaaagaagcagaaaaatagtgagggtgttgaactaccaaaatctttacagcgttttgctcgtaaaaaggcatcttcatgatttaactgtccatttgagttttgttttcgtctttctattttcaccatattatttttaagcgtcttatttgtatttttttgttgtcattttatatttgtagcttattttagcttttgatgttgattttttttttttgccttttaattaaaggcatgtctaaattttgtttaaagaccctttgattagaacaatttttaatgttaaaaaaattgtccaaaaa

SEQ ID NO: 8467 - DNA, 1920 bp, Phaseolus vulgaris
gataatattgctttgcaggatgtttctgacgagcttgagttgagaatgaagaagtatctcagaggagaaagtgctaatttggaggttttgaaggataaaaagctgaagggtcaactagctgctaaggaacagttatatggaaaatccgcacaagctgctgctaaggccgagaagtggcttatgcctagtgaaggaggttatctggaggctgaaggcttggaaaagacatggaggatcaaacaggagacaatagctcatgaagtagatatctcaggctcacggaaacagtatgatattattttaccagaacttggtccatacactctggattttacttcaagtggccggtatatggctgtgggtggtcgtaagggccatataggaatagtggacatgataaatctgagcctaattagagagcttcaggtaagggaaacagtacgtgatgtggtattcttgcacaatgagctcttttttgctgctgcacagaaaaggtatccatacatctacaatcgagaaggcacagagcttcactgccttaaggaacatggtccagtgttaaggcttcagtttctgaaaaaccattttctcttggctacaatcaataagtttgggcaacttcgctatcaggatgttacaatgggttcaatggttggtaattttcgaactggcgtaggacgtacaaatgtgatgcaagtaaaccccttcaatggggttgtttctttaggtcactcagctggaactgttaccatgtggaagccgaccagttctgctcctcttgtcaagatgctatgtcatcacgggcctgtctcagcgctggcatttcactcaaatggccacttgatggccactgcagggaaagataaaaaagttaagctttgggacttaaggaaatatgaggttcttcaaaccttacctggtcatgcaaatactctggattttagtcaaaagggcttactttcttgcggtaatggttcattgatccaggttctgcgagatgtttctggtacacagaattattccaggtacatgactcattccatggttaaaggttaccaggtagaaaaattagtatttcgaccatatgaagatgttttaggtatagggcattccatgggttggtctagtattcttattccaggagctggagaacccaactttgactcatgggttgcaaacccgttcgaaacttccaaacagaggagagaaaaggaaatacggactctacttgataagctcccacctgagactatcatgttggatcccagcaagattggtacggtgaaaccaaaaggaaagaggccaacaaagaaagagaaggaggctgagatagaagctgccgttgaagctactaagggcaagaaactgaagaagaagacaaaaggtagaaacaagccaggtaaaatgatacagaaaaagcaagacgccattgctagagtgaagaggccctacatggagcagaaaattcaagaagaggaaaacgtgtcaagaaagaagcagaaaactagtgttgaactaccaaaatctttacaacggtttgctcgtaaaaaggcatcgtcgtgatctaactttcccgtagtcttgtattctatattactgttctcccttttgattataagcttgtatttttttgttgcccttcatatttgtagccctttagcctcgaagttggcgtttttgtgcctttttgtgaggggcatatccaaattttgccttagagagaccccttgattagagtttctttaatattaaagtcttctttacctacacaaaatattgatcggaaaactttctgaagttttaatgattgtctggatttgtgtaaagagcaggtgtcactcgagtatcctttcaaaaaggtgacatttactctttactatttgaaaactgatagtaaaaatagttgagcagtaaaaaaga

SEQ ID NO: 8468 - DNA, 2040 bp, Cicer arietinum
agaaaattgtaattgcatacccttgtaaaatattatattacgacattacccccgataaacctcaaaagaaattgcaacagaaaaaatcgttcaaaactccaactaaaccctctcacctgcggcgtcctctctccctcagcaccgtcgccttgttgcgacagatagagattgcagctccgtctcagtgcgacatggaggagactcacgataacgatactcttccaaataacaatccttccactgtacaggacataactgatgaactagaactgagatcaaagaagtatctcagaggagaaggtgcaaatttgaagggtttaaaggataaaaagctcaggactcagttatctgctagagaacagttatatggacaatctgcaaaggctgctgccaaaactgagaaatggcttatgcccagtgatggaggttatttggaggctgaaggcatagaaaaaacatggaggatcaaacaggagacaataggtcgtgaagtagatatcttaagttcaaggaaccaatatgatattactttaccagaccttggtccatatactctagactttacttcaagtggccggtatatggctgttggaggccgtaagggccacctagcaattgtggacatgatgaatctgagcctgatcagagagattcaggtaagagaaaccgtacgtgatgtggtatttttacataatgagctcttttttgctgccgctcagaaaaagtatccatacatatataatcgtgacggcacagagcttcactgcttaaaggaacatggtgcagtgttgaggcttcagtttctggaaaatcattttctcttggcttctaccaacaaatttgggttgcttctttatcaggatgttacaatgggtacaatagccgggaaatatcgaactggtttaggacgtacaaatgtaatgcaagtaaacccttacaatggggttgtttctttaggtcactcagctggtacagttactatgtggaaaccgaccagttcttctccccttgtcaagatgctatgtcatcaagggccagtctcggccctcgcatttcactcaaatggccacttaatggccactgctgggaaagataaaaaaattaagctttgggacttgaggaagtttgaggcttttcaaacattaccaggccatgcaaatactttggagtttagtcaaaaaggtttgcttgcttgtggtaatggttcatatatccaggttctaagagatgtttctggtgcacagaactattcaaagtacatgactcattccatggtaaagggttaccagattggaaaattagcttttcgaccatatgaagatgttttaggcatagggcattcaatgggatggtctagtattcttattccaggagcaggagaacccaactttgattcatgggttgctaacccatttgaaacacctaaacagagaagggaaaaggaaatacattctcttcttgataagcttccacctgagacaatcatgttggatcctagcaaaattggtacagtgaaacaaaccagaaaagagaagctaactgtgcaagagagagaggctgagatagaagctgctgttgaagctgtcaagggcaaaaaactgaaaaagaaaacaaaaggaagaagtaaggctggtaaaattatgccgaaaaagcaagatgcaattgccactgcaaagagaccttacttggagcagaaaattcaagaagaaaaagacatatctagaaagaaacagaaaactaacgagggagttgaactaccaaaatctttacagcggtttgctcgtaagaaaccatcatcataaagatttaaaactaaactttgtccaattaagtcaccatttttttttttgcttttattgttttctaagctttttatttgtatttcgtgttgtatttgatatctgtagcctttacccttagaaattgatatatattgcctttcaagtaaagcatatccaaattttgcctttatttcccttgttcatttttatcttcaatattcatatacattctttaactataaatgaaaacctgaaaaca

SEQ ID NO: 8469 - DNA, 2125 bp, Lupinus angustifolius
ctcttaaccccgccgcagcatttatcctctccttcttttgctcactctctctcttcctccctccgccgccatctctgtcgtatctaatctccgccgccaccaacttcaccggaaaagatggatgagaatcatgagaatgacgcccttacaacccccaaaccttccactgaacacgacattgctgatgagctaaatttgaaaatgaagaagtatctcagaggaaaagttaatgatttgggggctttgaaagataaaaagctcaggactcaactgactatcagagaagaattatatggaaaatcggcgaaagctgctgccaaggccgagaagtggcttatgcctagtgagggaggttatctagagcctgaaggcatagagaagacatggaggattaaacaagatgcaatagctcgtgaagtagatatcagaagctcaaggaaccaatacgatattgtattaccagatcttggtccatacaccctggattttacttcaagtggccggtatatggctattggtggtcgtaagggccatctgggaattgtggacatgattaatctgagcctagtcagagagcttcaggtaagagaaacagtgcgtgatgtggtattcttgcataatgagctcttttttgcggctgcccagaaaaagtatctttacatctataatcgtgaaggaacagaacttcactgcctcaaggaacatggtgcagtgttaaggcttcagtttctggaaaatcattttctcttggcttcagtcaacaaatttgggcagcttcattatcaggatgttacaatgggtgccatggttggcaattttcgaactggcttaggacgtacgaatgtgatgcaagtgaacccctttaatggggttgttggtctgggtcactcaagtggtacagttacaatgtggaagccaaccagttctgctcctcttgtcaagatgctatgtcatcgtggacctgtttcagcgctggcatttcactcaaatggccaattaatggccacggccgggcaagataaaaaagttaaaatttgggacttgaggaaatttgaggttcttcagacattacccggccatgcaagtagtttggatttcagtcaaaaaggcttgcttgcttgcagtaacggttcatttatacaggttctgagtgatgcttctggtacacacaactattctaagtatatgactcattccatggtgaaaggataccaaataggaaaattagcgtttcgaccatacgaagatgttttaggcatagggcattcccagggatggtctagtattcttatcccaggagctggagaacccaactttgactcatgggttgcaaatccatttgaaacatctaaacaaagaagagaaaaggaaataaggtctcttcttgataagcttccaccggagactatcatgctggatccgagcaagatcgggacagtgcaaacaactaaaaaggagaagaaaacaaaacaagagagagaatctgagatggaagctgctgttgaagatgttaagggcagaaaaatgaagaacaaaacaaaaggaagaaataagccaggaagagtggcacacaaaaagcaggaggcacttgctaaagtgaagaggccttacatagagcagaaagttcaagaggaagaaaacgtatcaaacaagaagcagaaaactagtgagggagttgaactaccaaaatcattacagagatttgctcgaaaaaaggcctcgtcatgatttaactgtgaaatgaagtcacattatgcttctttcccctgcttcttcatatctatgtttgttatacctttgatatatgtctccaaagcctttgttattcgctgcatttcgggtaaagatgcaggaatttttgtcttggattcctctgtttagttatgttttgttttattttatttcaagtatcatgcttaattgtcatctaaaatttaggaaaaatctattatttcattgacaatggcatatttatatagaattcttccaacttttcagattgaaatatattacaagctttttcaatgtaaatatacaaatagctatatcattaatgtacttctttactgtagcaaccttaagaattgtaaggcttgctggtattagtgtatacatgcaactttcg

SEQ ID NO: 8470 - DNA, 1953 bp, Lupinus angustifolius
acctccttcttcttcttctcactctcccttcctccgtcgcaacctccgtcgtatctaatctccgccgccactcacttcaccggaaaagatggatgagagtcatgagaatgacgcccttacaaaccaaaaaccttcgactgaacaggacattgctgatgagctaaatttgaaaatgaagaagtatcttagaggaaaagttaatgatttggagggtttgaaagataaaaagctcaagactcaactgactatcagagaagaattatatggaaaatcggcaaaagctgctgccaaggccgagaagtggcttatgcctagtgagggaggttatctggagcctgaaggcatagagaagacatggaggattaaacaagatgcaatagctcgtgaagtaaatatcataagcgcaaggaaccaatacgatattgtattaccagatcttggtccatacaccctggattttacttcaagtggccggtatatggctattggtggtcgtaagggccatctgggaattgtggacttaattaatctgagcctaatcagagagcttcaggtaagagaaacagtgcgtgatgtggtattcttgcataatgagctattttttgcggctgcccagaaaaagtatacttacatctatagtcgtgaaggaacagaacttcactgcctcaaggaacatggtgcagtgttaaggcttcagtttctggaaaatcattttcttttggcttcagtcaacaaatatgggcaacttcattatcaggatgttacaatgggcgctatggttggcaattttcgaactggcttaggacgtacgaatgtgatgcaagtgaacccctttaatggggttgttggtttaggtcactcaaatggtacaattacaatgtggaagccaaccagttctgctcctcttgtcaagatgttaagtcatcgtgggcctgtcttggcgctggcatttcactcaaatggccaattaatggccactgccggtctagataaaaaggttaaaatttgggacttgaggaagtttgaggttcttcagacattaccaggccatgcaagtagtttggatttcagtcaaaagggtttgcttgcttggagtaatagttcatttgtacaggttctaagggatgcttctggtacacacaactattctaagtatatgactcattccatggtaaaaggttaccaaataggaaaagtagcatttcgaccatacgaagatgttctaggcatagggcattcccagggctggtctagtattcttataccgggagcaggagaacccaactttgactcatgggttgcaaatccatttgaaacatctaaacaaagaagagaaaaggaaataaggtctcttcttgataagcttccacccgagactatcatgctggacccaagcaaaatcgggacagtgcaaacaacgaagaaggagaagaaaacaaagcaagagagagagtctgagatggaagctgctgttgaagatgttaagggcaaaaaactgaagaacaaaacaaagggtagaaataagccaggaagggtggcacacaaaaagcaggaggcccttgctaaagtgaagaggccttacatagagcagaaagttcaagaggaagaaaacacatccacgaagaagcagaaaactagtgagggagttgaactaccaaaatcattacagagatttgctcgaaaaaaggcgtcgtcatgattaaactgtaaaatgaagtcacattatgcttctttccccttcttcttaatatctgtgtttgctattacctttgatatatgtctccaaagcctttgatatttgcagccttttgtctagaaggtgcagggaaatttttgtctgggattcctctatttagtgtagtatgttttgaatttttatttcaagtattttgcttaactgtcatataaaagttaggaaaaatctattattcattcacaatggcatatttatat

SEQ ID NO: 8471 - DNA, 1881 bp, Medicago truncatula
cacagacggaggcagatatcgttcaaaaccccaaataaaccctttcttcttcaccgccgctctctctctctgcaccgtcgtcttccaccagaaagagattgcagctgcaccagtgcaagatggaagaaactcacaacaacgatgctctttcaaataacaagccttccactgaacaggacatagctgatgagttagagcttaggtcaaagaagtatctcagaggagaagctgctaatttaaagggtttaaaagataaaaagctcaagagtcagttaattgctaaagagaaattatatggacaatctgctaaagctgctgctcaggctgagaagtggattatgcccagcgaaggaggttatatagaggccgaaggcatagaaaagacgtataggattaagcaggagacaatagccaaggaagtagatatctcaagctcaaggaaccaatacgatattactttaccagagcttggtccatatacaatagactttacttcaagtggccggtatatggctattggtggtcgtaagggccacctagcaattatggacatgatgaatctgagcctgatcagggagcttcaggtaagagaaactgtgcgtgatgtggtattcttacataatgagctcttctttgctgctgcccagagaaagtatccatacatatataatcgggacggcacagagcttcattgcctaaaggagcatggttcagtgttgaggcttcagtttctggaaaaccattttcttctggcttctaccaacaaatttgggatgcttctttatcaggatgttacaatgggtacaatagctgggaaatatcgaactggtttaggacgcacaaatgtgatggaattaaacccttacaatggggttgtttctttaggccactcagccggtacagttactatgtggaaaccaaccagttcgtctccccttgtcaagatgctatgtcatcaagggccagtctcggctctggcatttcactcaaatggccacttaatggctacagccggggtagacaaaaaaattaagctttgggacttgaggaaatttgaggcttttcaaacattaccaggccatgcaaatactttggagtttagtcaaaaaggcttgcttgcttgtggtaatggttcatatatccaggttctgagggatgtttctggtgcacagaactattcaaggtacatgactcattcaatggttaagggataccagataggaaaattagcttttcgaccatacgaagacgttctaggcataggacattcaatgggtttgtctagtatccttattccaggagcaggagaacccaactttgattcatgggttgcaaacccatttgaaacacctaaacagagaagagaaaaggaaatacgatctcttcttgataagcttccacctgagacaatcatgctggatcccagcaagatcggtacggtaaaatattctaaaacagagaagccaactgcgcaagagatagaggctgagatggaagctgctgtggaagctgtcaagggcaaaaaactgaaaaagaaaacaaaaggaagaagcaaggctggtaaaataatgccgaaaaagcaagatgcaattgccaatgcaaagaggccttacttggagcagaaaattcaagaagagaaaaacctagctaaaaagaaacaaaaaactaatgagggaggtgaactgccgaaatctttacagcgatttgttcataagaaaccatcatcataactaaactttggccaattaattcagttttgtttttgtcttttcatgttttttctaagtcttttattgtatttgctgtgttgttttgatatttgtagcctttggccttagaaatcgatatttattattgcctttcaggtaaggcagatcaaat

SEQ ID NO: 8472 - DNA, 1932 bp, Arachis hypogaea
aagtagcaacagcaaaacccccaaataaaccctccaacacatcggcgccgtttcgaagacccacatacactctcttccgccacctcgtccactacctccgtcgtcctccgaagctgaatcatcatcttctctctctctctctctctctctctggggccaaccatggacgaagcacaagacaaccatgctattattaccaagaaaaaaccttccgctaatcaggacatctccgatgagttagatctgaaaataaagaagtatctcagaggagaagctgcttcttttgaggatttgaaagataggaagctcaagcgtcaactatctgttagagaagaattatatggcaatgccgcgaaagctgctgccaaggcagaaaagtggcttatgcctaacgagggaggttatctggaggctgaaggcatagagaagacatggaggatcaaacaggaggctatagcgaaagaagtaggtcttgtaaacttaaggaaccaatacgatattgttttaccagatcttggtccatataccctggattttacttcaagcggccgttatatggctgttggtggtcgtaaaggccaccttggaattgtggacatgataaatcttaacctaatcaaagagattcaggtagcagaaacagtgcgtgatgtggtattcttgcataatgagctctttttcgctgctgcccagaagaagtttgtttacatgtataatcgagacggaactgaaattcgctgcctcagggaacatggtgcagcattaaagcttcagtttctgaaaaaccattttctgttggcttcagtcaacaaatttgggcaacttcattatcaagatattacaatgggtgagattgtgggtaattttcgaacaggcctgggacgcacaaatgtgatgcaagtgaaccccttcaatgcagttgttggtctgggtcacgcaggtggtacagttacaatgtggaagccaactagttctgctccccttgtgaaaatgctatgtcatcatgggcctgtttcagcactagcattccaccctaatggccacttaatggccacagcgggtaaagataagaggattaagctttgggacttgaggaaatttgagcctcttcaaacgttaacgggccacgcaaacacactggattttagtcaaaagggcttgcttgcttgtggtgttggttcgtttgtacaggttctgaatgatgtttctgggacgcagaactattctaagtacatgactcattcgatggcgaaaggttaccagataggaagattagcttttcggccgtatgaagatgttctagccattggccattccatgggttggtctagtattcttattccaggtgccggagaacccaacttcgacacatgggttgccaatccatttgaaacatctaaacagcggagagagaaggaagtgcggtctcttcttgataaacttccacctgagactatcatgctggatccaagcaagattggtacggtgaaatctacgtatagagagaaaccgacaaagcaagagagggaggctgaagttgaagccgcagttgaagctgccaagggcacaaaactgaagaacaaaacaaaaggaagaaataagccaggtaaaaagatacagaagaagcaggatgcaattgctagagtgaagaggccttacttagaggagaagattaacgaggaacaaaagatatcccataagaagcagaaaactagtgagaacattgatttaccaaaatctttacagaggtttgctcgtaagaaatcatcatgatatagagttcaggtttctgagttattgtatttgttgtcacatttgatatcaattgtatccaaaggcctatgatattgaaatatgccttccaagttaaaggcataaccaaaattttgccttcgtttgccttaatttatattttagtcttcgtttgtacca

SEQ ID NO: 8473 - DNA, 1170 bp, Solanum phureja
ctctgttttgtccaaattcccttcctttacttcattttttctgcatatttctctcaaaaaaagaaacaattcaagatgaatgatttgatgacaaaatctttcacaagctacattgatctgaagaaagccgccatgaaagatgttgaagctagtccagatttggaaatgggtatgacccaattggatcaaaatctcactgctttcttagaagaagcagaaaaggtgaaattggagatgaattcaatcaaggagattcttcgtcggttacaggacactaatgaagaaagcaagtcgctacacaaacctgaagctttgaaatcgatgcgtgatagcataaattcagatattgtagctgtgttgaagaaggctagagctattagatctcagctggaagagatggaccgatccaatgcgattaacaggcggctttctgggtgtaaagaagggacattggtcgataggactcgatctgctgtaactaatgggcttaggaagaagcttaaggaacttatgatggagtttcagggactgaggcagaggatgatgactgagtataaggagactgttggaagaagatattttactgttactggtgaacacccagatgaagaagttattgacaagatcatttctagtggaaatggtcaaggtggtgaagaatttctttctagagcaattcaggagcatgggagggggaaggtgttggaaacagtggtggagatacaggaccgtcatgacgcagcaaaggagatagaaaggagcttgcttgagctgcaccagatattcttggacatggcagtgatggttgaggcacaaggagagaaaatggatgatattgaacaccatgtggtgaatgcagcccattatgttaatgatggagccaagaacctcaagactgcaaagaagtatcaaaagagcagcaggaaatgtatgttcattggagttatagttctcctaattctgatcctggtagtcatcatccccattgccaccagtttcaccaaatcttgaatagccagccccattggggcttggtttcattctttatattctttttagcagttactttgatcactctcgtgagaaattcatgtatgtttgttattctatttgtcactagttagtccttttgatagggctatgaaccttaatggatttgttgttacaaaa

SEQ ID NO: 8474 - DNA, 1144 bp, Nicotiana benthamiana
tgtcactgcaaattctctctcctttccttccattttgaattcagactcatttctttcaaatcattcaaaatgaatgaccttatgaccaaatctttcacaagctacattgatttgaagaaagcagcgatgaaagatgttgaagctggtccagatttggaaatgggtgtaacccaaatggatcagaatctcactgcttttttagaagaagcagagaaggtaaaactcgaaatgaattcaatcaaagatatccttcgccgtttacaagacataaacgaagaaagcaagtcactgcacaaacccgaagctttgaaatctatgcgaaatcgcataaactcagatattctagctgtgttaaagaaggctagagctattaggtcgcagcttgaagaaatggaccggtctaatgcaattaaccggcggctttctgggtgtaaagaaggtacaccggttgataggacacgatctgctgttacgaatgggcttaggaaaaagcttaaggagctaatgatggattttcaggggttaaggcagaggatgatgactgagtataaagaaactgttgggagaagatattttactgtgactggtgagcatccagatgaagaagtcattgaaaagattatttctagtggtaatggtcaaggtggtgaagaatttctttctagagctattcaggagcatgggaggggaaaggtgttggaaacagtggtagagatacaggaccgacacgatgcggctaaggagatagaaaagagcttgttggagctgcaccagatattcttggacatggcagtgatggtagaggcacaaggagagaaaatggatgatattgagcaccatgtgatgaatgcagcacagtatgttaatgatggaactaaaaaactcaagactgcaaaagactaccagaagagcagcggaaaatggatgtgcgttgccattataattctcctaattctcatccttgtagttatcatccccattgctaccagtttcatcaaatcttgaagtgaaggcaccattcagctgttatttcattcttatattctttttttagcaattaatttttgtcactctcgtgagaattatgtgtggttatattacatatagtagtaagtctgctgtaagacccattaataatagattt

SEQ ID NO: 8475 - DNA, 1210 bp, Capsicum annuum
aatcactgcaacaatctctatctgttttaaaaaattctccttctttacttgattttctcgcttatctctcaaaaacaaaattcacgatgaatgatttgatgacaaaatctttcactagctacgttgatttgaagaaagcagcgatgaaagacgctgaatccggtccagatttggaaatgggtatgactcaaatggaccaaaacctcactgctttcttagaagaagctgaaaaagtgaaagttgaaatgaattcgatcaaagacattcttcgtcgtttacaagacacgaacgaagaaagcaagtccttaaccaaacccgaagctctgaaatcgatgcgtaatcttataaattcggatattttagctgtgttaaagaaggcaagagctataaggtctcagctggaagagatggaccggtctaatgcaataaaccggaggctttcggggtgtaaggaagggacgccggtggataggactcgatttgcagtgacgaatgggctgaggaagaagcttaaggaacttatgatggattttcagggactgagacagaggatgatgagtgagtataaggagactgttgggagaaggtactttaccgtgaccggtgagcagccggatgaagaggttattgacaagattatatctagtggaaatggtcaaggtggtgaagaatttctttctagagctattcaggagcatggaaggggaaaggtcttggaaacagtggtggagatacaggaccgtcatgatgcggctaaagaaatcgaaaagagcttgcttgagctgcaccagatattcttggacatggcagtgatggttgaggcacaaggagagaaaatggatgatattgagcaccatgtggtgaatgcagcccagtatgttaatgatggaaccaagaacctcaagactgcaaaagaatatcagaagagcagcaggacatggatgtgcattggcattataattctcctgattctgatcctggtagtcatcatcccaattgctaccagtttcactaaatcttgaagaggccccatgggggatacaactgagcttgtttgctagcgtttccattctttatattcttttgtagcagttactttgatcactctcgtgagaattatgtgtatggtttagtagaacaaggttgttattctatattttattctgtgtgaaccttaatagatttgccgttttcgttaacatatcttctg

SEQ ID NO: 8476 - DNA, 1142 bp, Nicotiana benthamiana
gtgtctcactgcaaattctggtctcttttcttcattctcaaattcttccactttgaattcacacccatttgtttgaaatcatttaagatgaatgaccttatgaccaaatctttcaccagctacgttgatttgaagaaagcagcaatgaaagatgttgaagctggtccagatttggaaatgggtatgacccaaatggaccaaaatctcactgctttcttagaagaagcagagaaggtgaaactcgaaatgaattcaatcaaagatatccttggccggttacaagagacaaacgaagaaagcaagtcactgcacaaacccgaagctctgaagtctatgcgaaatcgcataaactcagatattgtagctgtgttaaagaaggctagagctattaggtctcagcttgaagaaatggaccggtctaatgcaataaaccggcggctttcagggtgtaaagaaggtaccccggttgataggacaaggtctgctgttacgaatgggcttaggaaaaagcttaaggagctaatgatggattttcaggggctaaggcagaggatgatgactgagtataaagaaactgttgggagaagatactttactgtaactggtgagcacccagatgaagaagtaattgagaagatcatttctagtggtgaggaatttctttctagagcaattcaggagcatgggaggggaaaggtgttggaaacagtggtagagatacaggaccgctacgacgcggctaaggagatagaaacgagcttgctggagctgcaccagatattcttggacatggcagtgatggtagaggcacaaggagagaaaatggatgatattgagcaccacgtaatgaatgcagcacagtatgtcaatgatggaactaagaatctcaagactgcaaaagactaccagaaaagcagcagaaaatggatgtgcattgccattataattctcctaattctcatccttgtagttatcatccccattgctaccagtttcagcaaatcttgaagtgataatcagctgttatttcctttttagcaattactttttgtcactctcgcgagatggttatatatactagaaggctgttagtattacatatatatactaactcactagtccttgtgataggaggactaaaa

SEQ ID NO: 8477 - DNA, 1266 bp, Tabernaemontana elegans
ctcacttctcatctgaaaatctctcgaaaatctttctagctttctccacgaaatcaaatttgagtttaatccacagccacaaacatgaatgatttgatgacaaaatcgttcacaagttatgtggatctgaagaaggaagccatgaaagatcttgaggcaggtcgagatctggagatggggatgacccagatggatcataatctcagtgcatttctcgaagaagcagagaatgtgaagaaggagatgaattttatcaaagacgtcttgggtcgtttacaagaggccaatgaagaaagcaagactctgcacaagccagaagccttgaaatcgcttcgaaaccgcattaatgcagatattttggcggtgctgaagaaggctaaggctattaaatctcagctggaggagatggacaggtccaatgccttgagcaggcgtctctctgggtgtaaagagggcacccctgttgatcgtactaggtctgcggtcactaatggcctcaggaagaagctcaaggagctgatgatggactttcaagggctgagacagaggatgatgaccgagtacaaggagactgttggtagaagatacttcactgtgacgggggagaacccggatgaagaagtcatagagaagatcatttccagtggaaatggccatggtggtgaggaactcctgtctagggccatacaggagcatgggaggggaaaggttctggaaactgtggtggaaatacaggacaggtatgatgcagcaaaggagatagagaagagtttgctagagctgcaccaaatatttctggatatggcagtaatggtggaggcacaaggggagcagatggatgacattgaacagcatgtgctgaatgcagcccagtatgtgagtgatggaaccaagaatctcaagactgcaaagaattaccagaagagcagcaggagatggatgtgcattggtgtaattcttcttcttgtgctcattcttgtggtcataatccccattgctaccagtttcagcaaatcttgaatttcattggattctagtacagagaattcttctattctttcatctgttagatgatagaatggtggcatagttctttgcctgcctagagaaagtccttgtttaggactggtcttatgaagggtgattaaaatgaattatgtggcattaatcatggctcttctatagtaaaggtaaatttcattcacaacattgtcctgattttgtacatgatcctcgaaatatttgtaccttttttctgaaaacttc

SEQ ID NO: 8478 - DNA, 1151 bp, Antirrhinum majus
aaaatctcaacgttctctctcttcaaacactcatccaaatcaaggatgaacgatttaatgactaaatccttcacaagctacgtcgatctgaaaaaagaagctatgaaagacctcgaattaggccccgatatcgaaatgggcataacccaagtcgaccacaacctcaccgcgttcctcgaagaagccgagcaagtcaagctagaaatgaactcaatcaaagaggttctgatccgattagacgaatccaacgaagaagggaagactcttcacaagtccgaagctctaaaatcccaccgtgcccgaatgaacgacgatgttttgtcagttttgaaacgggccagggccataaagatccgattggaggaaatggataggtcgaatgaagtgagtaggaggctttcgggttgtaaaacgggtaccttggtggataggacccgatccgcggtcactaatggcctgaggaagaagctgaaggagttgatgatggagtttcagagcctgaggcagaagatgatgacggagtataaggaaacggtagggaggaggtattataccgttacgggagagaatccggatgaagaggttattgacaagattatttctaacggtggtgaggagttcctgtctagagctatacaggagcacggaagaggaagagtgttggagaccgtggtggagatacaagaccgccacgatgctgccaaggaaatcgagaaaagcctgctggagctccaccagatattcctcgacatggcggtgatggtagaggctcagggcgagaaaatggacgatattgagcaccatgtgatgaatgctgcacagtacgtgagcgacgggacgaaaaaccttaagactgcaaaagattaccagaagagcagccgccggtgtatgtgtattgggatcatacttcttcttgtgctcattcttgttgtcatcatccccatagccaccagtttcagcaaatcctgaggttttctgtgatgtagggtgatgatggaggattcttttattcttttggcttcactgttgtgtgaggaatgttgttgttcaagtgtggttgaagggagtggtccttgttttgggactgataataggctatttgtgttgtaatattttttgttaaataaaaagcattatcatgacttgtttcc

SEQ ID NO: 8479 - DNA, 2249 bp, Rosmarinus officinalis
cacacacacaaacaaaagcaaaatcacgatgaacgatctcatgaccaaatccttcaccagctacgtcgatctaaagaaagaagccatgaaagacctcgagtcgggtcgggacctcgaaatgggcgtgactcacgctgaccacaacctcaccgcattcctcgaagaagccgagcaagtcaagcaagagatgaactcaatcagagagatcttggcccggttgcaagactctaacgaggagggcaagactcttcacaagcctgaggccctcaagtcgctccgggcctgcatcaatgaggatgtcctgtcagtgctgaaacgggcccgggggattaggacccggttggaggagatggatcgctccaatgccgccaaccggaggctctcaggctgcaaggagggcacccccatcgaccggactcgctcggccgtcaccaacggcctcaggaagaagctcaaggaactgatgatggacttccaagggttgcggcaaaggatgatgacggagtataaggagaccgttgggagacggtacttcaccgtcaccggggaacaacctgatgatgaggtcatcgacaagatcatatccagtggcgacggaaacggtggggaagagttgctctccagagccattcaggagcatgggagggggaaggtggtggagacggtggtggagatacaggaccggcacgatgcggccaaggagattgagaagagcctgctggagctccaccagatattcctcgacatggcggtgatggttgaggcgcagggcgagcagatggacgacatcgagcaccacgtcatgaacgcagctcagtttgtcagcgacggaacaaagaacctcaaggttgctaaagatcaccagaggagcagcaggcgctgtttgtgcatcggaatcatactgcttttagccctcattcttcttgtcgttatccccattgccaccagtttcggggggggggggggggggggggggggggggggggggggggggggggggggggggggggggggggggggggggggggggggggggggggggggggggggggggggtttatgttttgcttcactaccgtgagatgaatgtactagcttttatctttcgagttccattaatatataattccgtgtaatatttgcgtacgtgacaaataaattttatttaaaggcagacttgaatgtacatacactacctaaaagtaagaagaagcctcagttctttgaaatggaggcttacttccttttcatcttaacagttggggcgtttttggaggaggaaacgccaccattctttgctgcctcttcatcttcttcgtcaaagctctctgtcctgtctgaggacacttcttcttcttcaggatttttgacagctgggggtggtctggtgagcttattgcggggcttgatagttgaggcgtttttagaggaggaaacgccactattctttgccgcgtcttcatcttcttcgccaaagctctcagtcctatccgaggacacttctttttcagattttttgacagctgggggtcgtctggagagcctatccgaggacacttcttcttcaggaaaattttcagcagagagcctattgcgtaccgctctcagttttgctttcttggagttcaacacctgaacaaactttgcatagatttcagattcaaactctgatttctcactgctgagtttttcactttgcgctaggcatttttcagcctccagtttgagcttgtcaaatgattgcgatttccatacaacctcctcactcagctttatgttagcatccacaagaaagtccaacacattcactgtggtctttttgctattgggtgaaggttggcatttccaccgccattccagtatcataccttccttctcaaacgtccacgatagccgtttgcatccgtctccagcatccgagaacccgtaaatcgacccgggttgctgaaacccgagatacctctcggccaagtcaatgtagtacgacaccgtttgatcccaatacaccgatctattcttcacctcttcctcagtagcatggcaagtccaagcttggaggccgtcggttatggaaaggtcgaagcgggtcgggtaccacgtacccttcacaaaaatgggttcgggtccgctgccgcccattggtatttcaagttttaagcatgtgtgcttcggcgtttccatttttcttgacgatgaatttctgcgagcttactgtgcgtgctgtgtggaggaagcttttgagagagagg

SEQ ID NO: 8480 - DNA, 1160 bp, Vitis vinifera
atcttgtgtcaagaccatcttcctcttcttcatcttcttcctcaatttacggagaatcttgcttcgggcttctcaattcattcaattctttgaagatgaatgatctgatgacaaaatcgttcatcagctatgtggatctgaagaaggaagccatgaaggacttggaagcgggtcctgaatatgatctgcagatgtccggaacccagatggacaggaacctgggtttgttcttggaggaggccgagaaggtgaagcaggagatgggtttgattagagagattttggggaggctgcatgaggccaatgaagagagcaagtccctgcacaagcctgaggctctgaaatcactgcggaaccgaatcaatgccgatatcattggggtgcagaagaaggccagagccatcaagtctcagctcgaggagatggaccgcgccaatgctgctaatatgaggctctcaggttacaaagagggtactccggtgtacaggactagggctgcggtcacgaatgggctgaggaagaagctcaaggagctgatgatggactttcaggggctgaggcagaggatgatgacggagtacaaggagacggtggggaggcggtattttacagtgacaggggagtaccctgatgaggaggtgatagagaagattatatcgaatggggaagggggtgaggagtttttggggagggcgatacaggagcatggaagagggaaggtgttggagacagtggtggagatacaggacaggcatgacgcggctaaggagatagagaagagcttgttggagctgcaccaggtgtttctggacatggcaataatggtggaggcgcagggggagcagatggatgacattgagcaccatgtgatgaatgcagcccagtacgtcaaggatggaacgaagaatctcaagactgccaaagactaccagaggagcagcaggaagtgcatgtgtttgggtgttatacttctgctgatactaattcttatagtggtcatccccattgctaccagttttagcaactcttaaacgagctttgagagtttatttcactctcttgttgtgaatgatttagtgcttggtgttcatacgctggtccttgttcctgggactagtgggtttactttctcaaatacaatgtttcttctgattccccta

SEQ ID NO: 8481 - DNA, 1302 bp, Mimulus guttatus
agcaaatcgattttcgtctctctctcactcaaactctctctctctctcacacacacacactccaaacactctctctctctctagacacaagctaaaatcaaagatgaacgatttgatgacaaaatcattcacgagctacgtggatctgaagaaagaagcgatgaaggatctcgaatcgggtccggatctggaaatgggcataaccaaacccgaccaaaacctaaccctgttcctcgaaggagccgagcaggtgaagacggagatgaactcaatccgagaaatcctggcccgactccacgaatcaaacgaggagggcaaaaccctccacaagcccgaagccctcaaatcactccgcgcccgccaaaatggcgacgttttctccgtcctgaagaaggctcgtgcgatcaaggcgcgtctggaggatatggaccggtccaacgccgccaacaggcgcctctccggctgcaaatcgggcactccggtggaccggacccgaaccgccgtcacgaacgggctgaggaagaagctgaaggagctgatgatggattttcagggtttgcggcagaggatgatgtccgagtataaggaaactgtagggaggaggtattttactgtaactggagagaatcccgatgacgaagttatcgagaagattatctccggtggcgacggcaatggcggtgaagaattcttgtccagagccattcaggagcatgggaggggaaaagtgatagagacggtggtggagatacaagaccgccacgatgccgccaaggagatagagaagagcctattggagctccaccagatattcatggacatggcggtgatggtggaggctcaaggggagcaaatggacgatatcgaacaccatgtgatgaatgccgcccaatacgtcggagacggaacgaaaagcctcaaggtcgctaaagagcatcaaaagagcagtaggaggtgtttgtgcattgggattatacttctccttgtgcttattattattgttattattcccattgccaccagtttcggtaaatcttagaacaatttttcttttttcccgacgaatattgtgcttgtgtgtgtgtgtgtgtgtgtgtaattctttgattctttgtttttaatttcttgatattcactctcgtgagatgcaagttagctgttcttcaagtgtggattttgcttttctagtgtttaagtttgttcatttatatgatattacttcatgtaattatcatatattaatgctcactattactatatagttcgtataaacggtttgccgaaatttttagactggaatgg

SEQ ID NO: 8482 - DNA, 1680 bp, Solanum phureja
aaaattagctagtactgtactacaatttcctcagatcaattccctttaagaccccatagaaatttcagtgtaaattgtgataaagaaatatagtatggaggcaattaatgcagtaagattgacacctctctctgttctttctgataggagaaatgaggccaagaaaatcccatcacaccctatttctttcccattcaagaatctttgttcagttgagaatttatcaagaaatgttcaagggggtttagtacttgtatcatcagttctaaatacaggcttagctaaagcattaacatatgaggagacacttgagcaatctgcaacaagcccaggtgctgagtttgatgcaactgcagttgtggaaactgtgaccacttttgcatcagagaatcctataattatagctggtggatttgctgctttggctttgccaattgttctgtttcaggttcttggaaagccacctaagtcatggggtgttgagtctgctaagacagcttatgcaaaattggcagatgatgcaggtgcacagttgcttgatataagagcacctgcagaattgagggaagtggggagtcctgatattaggggtttgaagaagaaaccagttactgttgtttataagagtgaagataagactggtttcttaaaaaagctgtctttgaagttcaaggagcctgagaatactacattgttcattctagacaaatttgatggaaactctgaactggttgcggagttagtcacagaaaatggatttaaagctgcttatgcaatcaaagatggtgctgaaggaccccggggatggctgaacagcagccttccttggattcttcctaagaaaacattgggtcttgatctgagcaatctgtctgatgctcttgatggtgttcttggggaaggttctgatgctgttactgtaggcttaggtgttgcagcagctgctggtcttgggattttagccttctcagaggtagaaataattctccaactgttgggttcagctgcacttgtccaactggttagcaagaaactcctgtttgcagaggacagaaagaaaactctgcaacaagttgatgagttcctctccactaaggttgctccaaaggaactggtagatgagattaagcaaatagggaaggctcttcttccagactcggtgagtagcaatgctctacctgcacctgtagaggcaagccctgctgcagccaccagcactgttgaggaaactgaatcagttgctaaggaggatattgcaccgcctaaagtagaagcaacttccccgcctactccagaagtcaatgcagtccctaacgctgaagtcaaaactgatgcactacctgaaagttcaaggccactctcgccttatcctaattatcctgatctcaagcctccaacatcgccgatgccttcacaaccatagaactggacatgcaggctgccatatagtctagttaacaacaagcatagctagctatagcctagtttggaatggaagctcctactctgtgaaattttgaatattacataacattcatttgaagaaaatttctctagtgccagtagagatcatagttctcaacactttaatatgtcttgtattccatctttgtagaatattattggatatcatgtagatacaaagctttatcagttgtttacaaataaaattacatttta

SEQ ID NO: 8483 - DNA, 1843 bp, Nicotiana benthamiana
tagctagaaaacttccaatcaactcttcctgagaccccatagaaattccactataatttgtgataaagtattatgctatggaggccattaatgcagtaagagtgacacctctctctgttctatctgatagaagaaatgaatccaagaaaatcccatcacaccccatttctttcccattcaagaatctttgttcagtagaaagtttatcaagaaatgttcaagggggtttagtacttctatcctcagctctaactacaggtttagctaaagcattaacatatgaggaggcactagagcaatctacaaccagtcctgctgctgactttgatgcaactgcagttgttgaaactgtgaccacttttgcatcagacaatcctttggttatagctggtggagttgttgctttggctttgccattggttctgtttcaggttcttgaaaagcctaagtcatggggtgttgaatcagctaagacagcttatgcaaaattgggagatgatcaaagtgcacagctgcttgatataagagcacctgctgaattgagggaagtgggaagtccagatataaggggtttgaaaaagaaggcagttacagttgcttataatggtgaagataagcctgggttcttaaaaaagctagctttgaagctcagggatcctgagaatactacattgttcattctggacaaatttgatgggaactctgagctggttgcagagctagtcacagcaaatggatttaaagctgcttatgcgataaaaggtggtgcggaaggaccccgaggatggctgaacagtggccttccttggaatgctcctaagaaaacattaagtcttgatctgagcaatctgtccgatgctctagatggtattcttggggaaggttctgatgctgttactgtaggcttaggtgcagctgcagctgctgggcttggacttttagccttctcagaggtagaaacaatactgcaactgttaggttcagctgcacttatccaactgattggcaagaaactcctgtttgcagaggatagaaagctaactctgcaacaagttgatgagtttctttctactaagattgctccaaaggagcttgtagatgagattaagcaaatagggaaggctctccttccagagacggtgagtagcgatgctctacctgcacctgcagaggcaagccctgctgcagccaccggcactgttgagaaaaccgaatcggttcctcagggtgatattgcaccacctaaagtagaagcaagttcccagactactccagaagtcaattctatcgctaacgcagaagtcaaggcagatgcactacctaaaagttcaaggccactttcaccttatcctaattatcctgatttcaagcctccaacatcgccaatgccttcacaaccatagagctggacttgcagactgccatatatccaaggcagagcagacctcatattctagtttgcaatgcaagctcctcatttcataacattttgaatattacatgacatgcatttgagagaaaattgcagtgccagtagatatcctgattcccaacactattatgtccttatcttccatcttaatttgtagcatattcttgtgattttaccaatacattttcttttatgcagacatgtgagagcataatgaacaaggatatcaaacttgaatatcattaaccttcaaatagcttatctacacttggactatgccattttgcttctcgtttgtctatcagcttggatattgaaaaagagtatttctcaatatttgagtctctacggatatctatttaaaatcatcaggtgatggggtttacaagctgaggaaaataaattaaattc

SEQ ID NO: 8484 - DNA, 1777 bp, Nicotiana benthamiana
gtagatatcaatcaaaattagctagtattacaattttctcatcttatggtatagctagaaaacttccaatcaacgctccttgagaccctatagaaatctactattaattgtgataaagaattatgctatggaggccattaatgcagtaagattgacacctctctctgttctatctgatagaagaaatgaacccaagaaaatcccatcacatcccatttctttcccattcaagaatctttgttcagtagagagtttatcaagaaatgttcaagggggtttagtacttctatcctcagctctaactacaggtttagctaaagcattaacatatgaggaggcattagagcaatctacaaccagtcctgctgctgactttgatgcaactgcagttgttgaaactgtgacaacttttgcatctgacaatcctttggttatagctggtggagttgttgctttggctttgccattggttctctttcaggttcttgaaaagcctaagtcatggggtgttgaatctgctaagacagcttatgctgaattgggagatgatgaaagtgcacagttgcttgatataagagcacctgctgaattgagggaggtgggaagtccagatataaggggtttgaagaagaaatcagttacagttgcttataagggtgaagataagcctgggttcttaaaaaagctagctttgaagttcaaggatcctgagaatactacattgttcgttctagacaaatttgatgggaactctgagctggttgcggagctagtcacatcaaatggatttaaagctgcttatgcgataaaagatggtgccgaaggaccccgaggatggctgaacagtggccttccttggaatgctcctaagaaaacattaagtcttgatctgagcaatctgtccgatgctctagatggtattcttggggaaggttctgatgctgttactataggcttaggagctgctgcagctgctgggcttggacttctagccttctcagaggtagaaacaatactgcaactgttaggttcagctgcacttatccaactgattggcaagaaactcctgtttgcagaggatagaaagctaactctgcaacaagttgatgagtttctctctactaagattgctccaaaggagcttgtggatgagattaagcaaatagggaaggctctccttccagagacggtgagtagcaatgcgctacttgcacctgcaaaggaaggccctgctgtagtcaccgacactgttgagaaaactgaatcagttcctcaggaggatatatcaccacctaaagtagaagcaagttcccagcctactccagaagtcaattctgtcgctaacgcagaagtcaaggcagatgcactacctaacagttcaaggccactctcaccttatcctaattatcctgatttcaagcctccaacatcgccaatgcctgcacaaccatagagctggacttgcaggctgccatatatctaaggcatagcagacctcatattccagtttggctgagaattaccatagcttcattttataaagttttgaatattacatgacatgcatttgagagaaaaattatagtgccactagatatcctaattctcaacactattatgtccttatcttccctcttaatttgtaacatattcttgtgagtttaccaatgcattttcttttatgcagacctgtgagagcatggtgaacaaggatatcaaacttgaatatgtatttctcaatatatgagtctacggatatctattttttaaatcctca

SEQ ID NO: 8485 - DNA, 700 bp, Solanum phureja
gacacgtggcactaatctctcccatctccaaaactacaacactctctctttccccaaattttccctttctctccaaaaaaaaacaaatcaatggcttctccaaccctaattaccccatccacatcaacccccaaatccctcatcactccaatccgatcaaaactcatctcctccgtcaccaccaccaccaccgccctccgccgccgcgaattcctctctctgtcagccggaatcctctctccatcccttctccttcccgccacgtcagcattcgcggctaccgacgaggaatacgtgaaggaagcgtcggaagtgatacagaaggtgagatctacgttgaatatggataaaggagatccgaacatagctgattcagttgctgagttaagagaagcgtcgaattactgggttgctaagtacagaagagagaaggctttgttgggtcgggcttcgtttcgtgatatatattcggcactgaatgctgtttctggccattatgttagtttcgggccgactacgcccattccggcgaaaagaaaggtcagaatcttggaagaaatggatacggctgagaaggctttacagagaggaagataagaaacccaatattattattttttggtattatttaaattttcctataattattttctgactatgaaaattttatttttatgataaagatgaggaagttggattt

SEQ ID NO: 8486 - DNA, 608 bp, Solanum tuberosum
ggcttctccaaccctaatcaccccatccacatcaacccccaaatccctcatcactccaatccgatcaaaactcatctcctccgtcaccagcaccaccaccaccctccgccgccgcgaattcctctctctgtcagccggaatcctctctccatcccttctccttcccgccacgtcagcattcgcggctaccgacgaggaatacgtgaaggaagcatcggaagtgattcaaaaggtgagatctacgttgaatatggataaaggagatccgaacatagctgattcagttgctgagttaagagaagcgtcgaattactgggttgctaagtatagaagagagaaggctttgttgggacgggcttcgtttcgtgatatatattcggcactgaatgctgtttctggccattatgttagtttcgggccgactacgcccattccggcgaagagaaaggtcagaatcttggaagaaatggatactgctgagaaggctttacagagaggaagataagaaacccaatattatttttttttggtattatttaaattttcctatatttattttctgactatgaaaattttatttttatgataaagatgaggaagttggattt

SEQ ID NO: 8487 - DNA, 794 bp, Nicotiana benthamiana
gtcattagtccaaccttctccattcaccgttccccctttacaccaaaactgcaacactctctctttcatcaactttccttctcctccaacaaccaaacaaaaccatgtcttctccaaccctaatcaccccatccacctccaccccaaaaccccttacccctatccgatcaaaactgtcctccaccaccaccaccgccaatgccgctaccgtctcagcctctctcccatccacccgccgccgcgaattcctctctctagctgccggaatcctctctccggcattgctcctacctgccacgtcagcatttgctgcttccgacgaggagtacgtgagagaagcttcggaagtgattaagaaagtgaggtccacgctctctatggagaaaggtgatccgaacatagctgattctgttactgatttaagagaggcttcaaattattgggttgctaagtatagaagagagaaggctttattgggccgggcctcattccgtgacatttactcggccctgaatgctgtttcgggccattatgttagttttgggccgaccacacccattccggcgaagagaaagcagagaatcttggaagagatggacactgctgagaaggctttacagaggggaagataaaacagaaatttacttttgtagatgtttggcaatttttttgggtataattctgaaattcctatatttaaatttctgactatgaaattgaaagtataaatatgaggattcactatttgcttgcaagttatgttgctataaaactaactaaaaggttagtcgtta

SEQ ID NO: 8488 - DNA, 729 bp, Nicotiana benthamiana
aactttccttctccaacaacaaaagaaccatggcttctccaaccctaataaccccatccacctccaacccaaaaccccttacccctatccgatcaaaactctcctctaccaccactgccaccgtctcagcctctatctcatccacccgccgccgtgaattcctctctctggctgcaagaatcctcgctccggcattgctcctacctgccacgtcagcattcgctgcttccgacgacgagtacgtgagggaagcttcggaagtgattaagaaagtgaggtccacgctctctatggagaaaagtgatccgaacatagctgattctgttactgagttgagagaggcttctaactactgggttgctaagtacagaagagagaaggatttgttgggccgggcctcattccgtgacatttactcggctctcaatgctgtttcgggccattatgttagctttgggccgaccacacccattccggctaaaagaaagcagagaatcttggaagagatggacactgctgagaaggctttacagaggggaagataaaagagacagctacttttgtagatgtttggtgattttttttttttgggtataattctgaaatttctatatttaaatttctgactatgaaattgaaagtataaagatgaggattccctatttgcttgcaagttatgttgcttgttaccctaaaactaagtaaaatgtttgtcgtaatttagataaa

SEQ ID NO: 8489 - DNA, 633 bp, Nicotiana tabacum
cttctccaaccctaataaccccatccacctccaccccaaaaccccttacccctattcgatcaaaactctcctctaccaccaccgccaccgtctcaacctctgtctcatccacccgccgccgtgaattcctctctctggctgccggaatccttactccggcattgctcctacctgccacgtcagcattcgctgcttccgacgaggagtacgtgagggaagcttcggaagtgattaagaaagtgaggtccacgctctctatggagaaaagtgatccgaacttagctgattctgttactgagttgagagaggcttctaattattgggttgctaagtacagaagagagaaggctttattgggccgggcctcattccgtgacatttactcggccctcaatgctgtttcgggccattatgttagctttgggccgaccacacccattccggctaagagaaagcagagaatcttggaagagatggacactgctgagaaggcttacagaggggaagataaaagagagagctacttttgtagatgtttggtgatttttttggtataattctgaaatttctatatttaaatttctgactatgaaattggaagtataaagatgaggattcactatttgattccac

SEQ ID NO: 8490 - DNA, 482 bp, Solanum melongena
tcaatggcttctccaaccctaatcaccccatccacatcaacccccaaaccccgtatcacccctatccgatcaaagctcatctccaatgccgtctctctcccgtccactaccaccgtccgccgccgcgaactcctctcgctggcagccggaatcctctctccgtcattcctcctccccgccacgtcagcactcgccgcttccgacgaggagtacgtgagggaagcatcggaggtgatccagaaggtgagatctacgttgaacatggataaaggcgatccgaacatagccgattctgttgctgagctgagagaggcgtccaattactgggtagcgaaatacagaagggagaaggctttattgggccgggcttcgtttcgtgatatatactcggccctgaatgctgtttcgggccattatgttagttttgggccgactacgcccattccggcgaagagaaagatgagaatattggaagaaatggc

SEQ ID NO: 8491 - DNA, 734 bp, Solanum phureja
aaattattcatctgccttcaattttaccttttcgaaagctacataatcatcgaaaaaaaactgtttttgagctaattgcttcatactcaatggccgttttttcaagaaatgtgtttgtaatggcaattctgttttccagtctattgagcttcacagaagccagagaccatttggttggtggaaaaactgattcttggaaaatcccatcctccgaatcggattccctcaatcgttgggctgaaaaatcgcgattcctagttggagattctcttgtgtggaagtatgatggagcaaaagattcagttttggaagtgagcaagagggattatgtgacatgtaacacatcaagtccaattgcaatgcataatgatgggaacacaaagatagtgttagaacattcaggggcatattattttattagtggtgtgaaagggaattgtgaacaaggacaaaaattggttgtggtgacattatctaagaggagatacgcggatgcaccagtaccgtctccggtagaatttgatggtccagctatagctcctactagcaatactgttagtttgaaggctagtttggttgtggcttttggggttttagtaggcttttggctttgaagtgattttaatttttttaattattggataggtggtgggtggccttcttggtcattaataactctttaattatattcttttatttatttaatttgttgtttactttgtctcaatattaaa

SEQ ID NO: 8492 - DNA, 716 bp, Solanum tuberosum
attattcatcggccctcaattttcctttttgaaagctacataataataatacgtcgaaaaaagctgtttttgagctaattacttcatactcaatggccggtttttcaagaaatgtgtttgtaatggcaattctgttttccagtctattgagcttcacagaagccagagatcatttggttggtggaaaaactgattcttggaaaatcccatcctccgaatcggattccctcaatcgttgggctgaaaaatcgcgattcctagttggagattctcttgtgtggaagtatgatggggcaaaagattcagttttggaagtgagcaagagggattatgtgacatgtaacacatcaagtccaattgcaatgcataatgatgggaacacaaagatagtgttggaacattcaggggcatattattttattagtggtgtgaaagggaattgtgagcaaggacaaaaattggtagtggtgacattgtctaagaggagatacgcggatgcaccagtaccgtctccggtagaatttgatggtccagctatagctcctactagtaatgctgttagcttgaaggctagtttggttgtggcttttggggttttagtaggcttttggctttgatgtgattttaattttttttaattattggataggtggtgggtggccttcttggtcattattactctttaattatattctttattattaacttgtgtttac

SEQ ID NO: 8493 - DNA, 643 bp, Solanum melongena
ctaaaacaaatctttcttccaccctcaaattccctttaagaagaaagctacgttatccatcgaaagaaaaaatcaattttttagctaatagtttcataccaaatggcctttttttcaagaaatgtgctttcttcttcagtagtggcagttctgtttttccttctgttgagcttcacagaagccagagaccatttggttggtggaaaaactgattcttggaaaatcccatcttctgaatcggattccctcaatcgttgggctgaaaaatcgcgattcctcgttggagattctcttgtgtggaaatatgatgggaaaaaagactcagttttggaagtgagcaagagggattatgtgacatgtaacacatcaagtccaatatcagtgcacaatgatggtgacaccaagatagtgttggaacattcaggggcacactatttcataagtggagcaaaagggcattgtgagcaaggacagaaattgattgtggtgacattgtctgagaagaacacgaggagattcgcgaatgcaccagcaccttcaccagtagaattagaaggtcttgcaccagctcctagtagtaatgctgttagtttgaaggctagtttggttgtggcttttggggttatggtgggattttgggttt

SEQ ID NO: 8494 - DNA, 1601 bp, Solanum tuberosum
gggagtccactttctccctcaatcaaatggctatggttttttctccattaacatcaagtgggtgtagtagttattgcaatcttggattaagctggaaatcgtcgagcttgtttgtggaattagggtttctttcaaatgggtcaaaaggggtttctgctaaacccgcaaagctcaatgctagtaaagtttttcgggcttgtgcttcttcttcttcctctgatccacttttggtgaaggctgcaagaagagaacaggtgagtcgcccgcctgcatggatgatgcgtcaagcgggaaggtatatggctgtttacagaaagcttgcggagaaacatccatccttcagagagagatcagagacaactgatctcattgtggaaatttctttgcagccctgggaagcttttcatccagatggagtaatcatcttttcggacatacttaccccactacctgcatttggtgtccaatttgacattgaagatgtaagaggcccagtcattcagtctcccattcgttctgaagagggattgaaatcattgcactctattgacttggagaaactacaatttgtgggagactcacttaggattttgaggaaggaggttggagagcaagctgcaattttgggttttgtcggagctccttggacaattgctacctacatagttgaaggtggtacaactcgtacgtatacgaagattaaggacatgtgccataccgctcctcatgttttgagagctttgttatctcatttatcaaaagcaattgctgagtatattgtgtatcaagtggagtctggagctcattgcatccaaatatttgattcatggggtggacaactcccacctcatatgtgggactgctggtcaaagccttatattgatgagatagttggtataattaaaagaaagtgcccacaaacacctcttgtgctctacattaacggaaatggtggacttcttgaacggatgaaaacaactggagttgatgtaattggacttgactggacagtggatatggcagatggaaggaggcgactaggaacagatattggtatacaggggaatgtggatcccgctaccttgttttgtcctcttcctgcattgacagatgaaattaaaagggttgtcaagagtgcagggactagtggtcacatcctcaatcttggccacggtgtgctcgtgggtacacctgaagaagccgtagctcacttctttgatgttgctaagagcttcgattttgacaaggttgaggatcatgtatctgaggcagacaaagttgtagcttgaagacaacaattttgtaatgcaggctggaagtgagcctaggatgcttggttcaccttaggtcctttaaattggtagaggagactaatgcttgtgaataaactagcatctttatttaatcttttttcttcgaaatatcgagcaaatttgttatattattagttattctatcagaatggaagttgtctttgtgtgacatataggtcacggattcaagttgtagaatcaatcacttggggtatggctctttcctggaccttacgtaaacgcgggatgtattagttcttctatcattttatcttattataagtaaaa

SEQ ID NO: 8495 - DNA, 1465 bp, Solanum phureja
attagccagtttataaagggtgatccaataagggggaaaacaagaaagataaggagagcagagggagtccactttctccctcaatcaaatggctatggttttttctccattaacatcaagtgggtgtagtagttattgcaatcttggattaagctggaaatcgtcgagcttgtttgtggaattagggtttctttcaaatgggtcaaaaggggtttctgctaaacccgcaaagctcaatgctagtaaagtttttcgggcttgtgcttcttcttcttcctctgatccacttttggtgaaggctgcaagaagagaacgggtgagtcgcccgcctgcatggatgatgcgtcaagcgggaaggtatatggctgtttacagaaagcttgcggagaaacatccatccttcagagagagatcagagacaactgatctcattgtggaaatttctttgcaaccctgggaagcttttcatccagatggagtaatcatcttttcggacatacttaccccactacctgcatttggtgtccaatttgacattgaagatgtaagaggcccagtcattcagtctcccattcgttctgaagagggattgaaatcattgcactctattgacttggagaaactacaatttgtgggagactcacttaggattttgaggaaggaggttggagagcaagctgcaattttgggttttgtcggagctccttggacaattgctacctacatagttggaggtggtacaactcgtacatatacgaagattaaggacatgtgccatactgctcctcatgttttgagagctttgttatctcatttatcaaaagcaattgctgagtatattgtgtatcaagtggagtctggagctcattgcatccagatatttgattcatggggtggacaactcccacctcatatgtgggactgctggtcaaagccttatattgatgagatagttggtataattaaaagaaagtgcccacaaacacctcttgtgctctacattaacggaaatggtggacttcttgaacggatgaaaacaactggagttgatgtaattggacttgactggacagtggatatggcagatggaaggaagcgactaggaacagatattggtatacaggggaatgtggatcccgctaccttgttttgtcctcttcctgcattgacagatgaaattaaaagggttgtcaagagtgcagggactagtggtcacatcctcaatcttggccacggtgtgctcgtgggtacacctgaagaagccgtagctcacttctttgatgttgctaagagcttcgattttgacaaggttgaggatcatgtatctgaggcagacaaagttgtagcttgaagacaacaattttgtaatgcaggctggaagtgagcctaggatgcttggttcaccttaggtcctttaaattggtagaggagactaatgcttgtgaataaactagcatctttattt

SEQ ID NO: 8496 - DNA, 4861 bp, Capsicum annuum
ttgaaactttttctctttcatttttggccccttttttttgtcagtttagccagtttatatagagtgacactagtagccaaaaaaagaaagataaggagagggagaaaacattaacttctctcttttcttccctcaaaaaaattctcatttagtattagctatggctttttctccattaacaagtgggtgtagtaattattgcaatgttggaattggttggaaatcatcaagctggtttgtgcaatttgggtttttttcaaatggggtttctgctaaacctacaaagaacaatggtagtaaaggttttagggtgtgtgcctcttcttcttcttcctctggtataaatcttggaccttgtagtttacttttgcttctccactttgtgggattatactggctatgttgttgttgttgtaatagtatagcagtagcagtagtagtaaatgccgggtagtagtagttggctatgttgttgttgttgttgtaatagtagtagtagtaaatgcccagtaggtgtagttggctgatcccaacttgcttggactaaggcgtaattgttgttcttgttgttgttgtagtagtagtatagtaaatgccgggtaggtatagttggccagtcccaacttgtttggactaaggcgtgattgttgttgttgttgttgttgtaatagtagtactagtaaatgccgggtaggtgtagttggccgatcccaacttgtttgaactaaggcatgattgttgttgttgtagtagtagttcggaaacagcctctctagctcggaggtaggggtatggtctatgtacactttaccgtctctagaccccactttgtggaattgtactggttttgttgttgttgtaatagtcgtagtagtagcagtagtagtaaatgccgggtaggtgtagttggccgatcccaacttctttggactaaggcgtgattgttgttgttgttgttgtagtagtagtagtacagtagtagtaaatgccgggtaggtgtagttggccgatcccaacttctttggactaaggcgtaattgttgttgttgttgtagtagtagtagttcggaaacaacctctctagctctgaggtaggggtatggtctgcgtacactttaccgtctccaccgtctccagaccccactttgtggaattgtactggctatgttgttgttgtaatagtagtagtagtagtagtagtaataaatgtcgggtaggtgtagttggtcgatcccaacttgtttggactatagcgtaattgttgtagtagtagtagtggtggtgagtactcccgctgtggtaaacctggttgcgactaaggtgtactttcatcgttttagttgttgtagtagtagtagtagtagtagtagtagtaaagagtactcccttgtcccaaagtaaatgagagggtaggtgtgggaaggttgaagtacctaattttcaggcatgattccgtaattcttgaataagtttacatatttaggaactatatcaaggtcttattgtaaaatgtagtaatattgaaaacccatagtcaaaggaaattttgtttgattatgtaataagctcaaatctggtaaagttgctgccatgtgaccaggaggtcacgggttcaagccttggaaacagcctctggcagaaatgcaaggtaaggttgcgtacgatacacccttgtggtggggcacttccccggacaccgtgcatagcggtagctttagtgcaccgggctgcccttttttttttatgtaataagctcaaatgaagaagtgaggattcatataaccggccccaacttgtttgggattaaggtgtaattgttgttgttgtcctagtagtagtagtagtactaaggagtattccttctgtcttaaagtaaatggcagggtaggtataggtgggcttaagtacccaattttctgtgtgcatttggtcccgattacgtaattttgggtttagattacatattttaggagctagatcaaggtattattgtaaaatatagtaatattgaaaaaccatattcaaagaaaattttgtttgactatgtaatagtacctcaggagtaaaatgagatggaaggagtagcatctgcttacctttcggtatagattttgctaagatcctcggacctaggaaactacagttctggtttgatatcgagtgaatcaggatcttacgtctcaggaaatggacttcaaggtggatggaattgtatatcatgtttgatgatggaaaggaaaaaagagcattatgcaggatcaagcttcctcaagcttgagccttaactactttagtacaaccatgggtgcacattgttagtgaagagagagagagagagagagagtactacacatggatacttcctatgttgcttggatcaacaggtgcgcgttggattctccaatactagtgtatttttggagaacccgacatgtatgcagcattgaaagtgacgagtccccgcaagttaggatacttgtgtggaaatggtccatagttcttaattagagtttctatggaaaaggtgagaagctagagaagttgttagatggatcactttattcagttgtcttaaaattgttgttacaagtaaagctacaactttttgtcaggatttagaatggaacttatggtgtcttatgtttctttgtgcacttatcaatttggtcgttgctatctagcattacattttctcaaatgcttttatcactcttaaaacttggtttccaagttggccttgttacttgttactgtgaaatgtcaatgatatcttttacttgatcgataaaaaacttggtctaaaaatagagtacctttacagttatatcttgatcactatgatgtgtactggttgtttcattttagtaccttcctatcgatatgtaatatatttatatatatattttttgagaaggttacgatatgtaatatacatgcagaccctttcaagagggcaatggtataacttgttttatccttctggatattagtaactagcttatgattgtgcctctggtagaatattagatcaaatgttgttgatgtcgtagtctttaagaaagtgtgtccagcggtcaattactccctctctttcataataagcaaatgctgagattgacttaaaatggtgctctagtccctgattcttggtgttaactgttggtagtagaactgcatagttacaattattttcccctaaaaatgcaaaatctctctctttattagagtgcatggtgtttatatgtctataagctccttcttccctttgcgctggaggtggggggactaggtcaaactatcaggtttcggtggcacctcacttcagttcatcttccggattctttgtgggacactcaactttgtgcttccaaatgtactgtttttcagatccacttttggtgaaggctgcaagaagagaacgggtgagtcgtccacctgcatggatgatgcgtcaagcgggaaggtatatggctgtttacagaaagcttgcggagaaacatccatccttcagagagagatcagagacaaccgatctcattgtggaaatttctttgcagccttgggaagcttttcatccagatggagtaatcatcttttcggacatacttacccccctgcctgcatttggtgtccaattcgacattgaagacgttagaggcccagtcattcagtctcccattcgttctgaagagggattgaaatcattgcactccattgacttggagaaactacaatttgtgggagactcacttaggattttgcggaaggaggttggagaccaagctgccattttgggttttgtcggcgctccttggacaattgctacctacatagttgaaggaggtacaactcgcacgtatacgaaaattaaggacatgtgtcatactgctccgcatgttttgagggcgctgttatctcatttatcgaaagcaattgctgagtatattgtttatcaagtggagtctggagctcattgcatccagatatttgattcatggggtggacaactcccaccgcatatgtgggactgctggtcaaagccatatattgacgagatagttagtacaatcaaaagaaagtgcccccaaacaccgcttgtcctctacattaatggaaacggtggacttcttgaacggatgaaaacaactggagttgatgtaattggacttgactggacagtggatatggcagatggaaggaagcgactgggaaccgatatcggtatacaagggaatgtggatcccgctaccttattttgtcctcttcctgcattgacagacgaaattagaagggttgtcaagagtgcagggaccaggggtcacatcctcaatcttggccacggcgtgctcgttggtacacctgaagatgccgtcgctcacttcttcgacgttgctaaaagtttcgatttcgacaaggttgaggatcatgtatctgaggcagataaagttgtagcttgaagacaacaattttgtaccaacaactgatgtgcagtggagtctttgttcatttagtagctggcctaggatggagaccattaattgtattactttgaaatattgaacaaatttgttcttctattataacggaagcgttgacgcgatgataaagttgttctcgtgcgacctacaggtcacctgttcgagccgcgtaatcggttactgtgctacggcttacatcacaccttcttggggagtgagacttctccggaacgtgcaacaacatacctagtgaattcccaccttgtggagtctggggaggatagaatgtatgcaaatcataccactacctccgaagacgtagagagaatgtttccgatagactctgggctcaggatgcagagacattctccggaacgtgcaac

SEQ ID NO: 8497 - DNA, 2409 bp, Solanum phureja
cctactactataaatattacacacctaaaactttcttgaaaaactcaacgtgtccaatccttatccttcttttttgttttgttttcaagaatcgaattgggtaattgtaaaacaacccaagattggattttttttcactgtgtaggaatttggttttgatctgagagtaagagagatggagggtgtagattacttggctgatgagaggaagaaagctggatttgatgtggatgagatgaagattgtttgggctggttctcgtcatgattttgaactgacagatcgtatctctaagcttgttgctaatgatcctggcttcagtaaggagggaagaactatgcttcctaggaaagagctattcaagaacactctaaggaaggcagcatatgcatggaaacggatcattgaacttcgtctatctcaagaggaagccactatgttaaggcgttacgtagatgagcctgcttttactgatcttcattggggaatgtttatacctgccttaaaaggacagggcacagataaacagcaggaaaagtggctgccgttggcttacaagatgcaaataattggctgttatgctcaaactgaacttggtcatgggtccaatgtgcaaggccttgagaccactgccacatttgatcctcaaacagatgaatttgtcattcatagtccaacattgacgtcaagcaagtggtggcctggtggattgggtaaagtatctacccatgctgttgtgtatgctcgtcttataacagatggtaaagactatggggttaatggttttattgtccaactacggagtttggaggaccacaaacctcttccaggtgttactgttggagacattggaatgaaatttgggaatggagcatacaattccatggataatggggtgttaagctttgatcatgtgcgcattccaagagatcaaatgttgatgagggtttcacaagttacaaaggaaggaaaatatgttcaatctgatattccccgacaacttctttatgggactatggtatatgtacggcaatcaattgtatcagatgcttcccttgcaatgtctcgggctgtgtgcattgcaaccagatacagtgccgttcgtagacaatttggctctcagaatggtggacaagaaactcaggtgattgactacaaaactcagcaaaacaggctcttccccttgttggcttctgcatatgccttcagatttgttggtgagtggctgaaatggttgtacactgatgttacccaaagacttgcagcaaatgatttctcaacattgcctgaggcacatgcatgtaccgcaggattgaagtctttgaccaccagtgccactgctgatggaattgaagaatgccgaaagttatgtggaggtcatggttatctttgtagcagtgggcttccagaattatttgccgtttatgtccctgcctgtacttacgaaggagataatgtcgtgctacagctacaggttgcaaggtttcttatgaagaccgtttcacaactgggcactggaaagaagccagtaggtaccgtatcttatatgggaagaattgaacagttgatgcaatgtcgttctgatgtgaaacaagccgaggactggctgaaacctagtgcagtattggaggcatttgaagcaaggtctgccaggatgtctgttgcctgtgctaagaatcttagcaagtttgagaatcaagaagaaggctttgcagaactagcagctgatttagttgaagcagcagttgctcattgtcaattaattgttgtgtccaagtatatcgagaagttgcaacaaaacattcccggtaaaggggttaagcaacagctggaggtgctttgtggcatctactcgctcttccttcttcacaaacatcaaggagattttctcgggacaggctacatcacctcaaagcaggggtctcttgctaacgaccagctcagagccttgtattcccagcttcgtccaaatgctatatcgctggttgatgcatttaactataccgatcactaccttgattcaattcttggacgttatgatggaaacgtgtatccaaaactgtatgaggctgcatggaaggatcctctcaacaaatcagacatagcagatggcttccacgaatatattaggccactactcaagcagcaactacgaactgctaagctgtgaagcgcaagaaatagtggaactgttgttctgtgctgtgccaataaactagattttgaaatagcaacatcctttatggactataaagtggtgactgaatattttgttgttttgaataagattattgaacttttgaaaggaaactgttatgtatgctttagctttttttcctcccagaattatgaataagaatagattgattttttgcctcaaatatgagttccctggtatttggagtcttt

SEQ ID NO: 8498 - DNA, 2048 bp, Capsicum annuum
tggttttgatctgatagagtgagtgagataatggagggtgtagattacttagctgatgaaaggaagaaagctgaatttgatgtggatgagatgaagattatttgggctggttctcgtcatcattttcaactctctgatcgtatctctaagcttgttgctaatgatcctggtttcagtaaggagggcaggaccatgcttcctaggaaagagctattcaagagcactctaaggaaggcagcatatggatggaaacggatcattgaacttcgtcttactgaagaagaagctactgtgttaaggcgttacgtagatgagcctgctttcactgatcttcattggggaatgtttatacctgccataaaaggacagggcacagatgaacagcagaaaaagtggctgccattggcccaaaagatgcaattaattggctgttatgctcaaactgaacttggtcatgggtccaatgttcaaggccttgaaaccactgccacatttgatccacaaacagatgaatttgtcattcatagtccaacattgacgtcaagcaagtggtggcctggtggattgggtaaagtgtccacccatgctgttgtgtacgctcgtcttataacagatggtaaagattatgggattaatggttttattgttcaattacggagcttggaggaccacaaacctcttccaggcgttactgttggagacattggaatgaaatttgggaatggagcatacaattccatggataatggagtactaagatttgatcatgtgcgcattcctagagatcaaatgttgatgagggtttcgcaagttactaaggaaggaaaatatgttcaatctgatgttccccgacaacttctttatgggaccatggtatatgtacggcaaacaattgtagcagatgcttcccttgcgatgtctcgggctgtgtgtattgcaaccagatacagtgccgttcgtagacaattcggctctcagaatggtggacaagaaactcaggtgattgactacaaaactcagcaaaacaggctcttccccttgttggcttctgcatatgccttcagatttgttggtgagtggctgaaatggttgtacacggatgttacccaaagactgcaagcaaatgatttctcaacattgccggaggcgcatgcatgtaccgcaggattgaagtctttgaccacctctgccactgctgatggaattgaagaatgccgaaagttatgtggaggtcatggttatctttgtagcagcgggcttccagaattatttgccgtttatgtccctgcctgtacatacgaaggagataatgtcgtgctacaactacaggttgcaaggtttcttatgaagaccgtttcacaactgggcactggaacgaagccagttggtaccacttcttatatgggaagaattgaatacttgatgcaatgtcgttctgatgtgaaacaagctatggactggatgaaacctagtgcaatagtggaagcatatgaagcaagggctgccaggatgtctgttgcctgtgccaagaggcttagcaagttcgataatcaagaagaaggctttgcagaactagcagctgatttagttgaagcagcagttgctcattgtcaattaattgtagtctccaagtttgttgagaagttgcaacaagacattcccggtaagggggttaagcaacagctggaggtgctttgtggcatctattccctctaccttcttcacaaacatcaaggagattttcttgggactggctacatcacctcaaagcaggcgtcactggctaatgaccagctcagagccttgtattctaagcttcgtccaaatgctatatcgctggttgatgcatttaactataccgatcactaccttggttcaattcttggacgttatgatggaaacgtgtatccaaagctgtacgaggctgcatggaaggatcctctcaacgattcagatgttgccgatggcttccatgaatatgtcaggccactgctcaagcagcaactacgaactgctagactgtgaagcaagaactgcagcagatatac

SEQ ID NO: 8499 - DNA, 2434 bp, Nicotiana benthamiana
ctactgctataaatagcgcgcacacaaatcgtttcttggaaagctcaaacgtgttcaatccttatcttcttttgttttttctcctcgttttttccaagaatcgaattggggtatttgttaaaacaaccaaagattggatattttttcattctgtgcaagattttttgggttttgatctgagaggaatagatggagggtgttgattatttggctgatgagaggagaaaagctgagtttgatgtgaatgagatgaaggttgtttgggctggctctcgccataattttgaattatcagatcgcatctccaagcttgttgctaatgatcctggcttcagtaaggaaggcagaactatgcttcccaggaaagaactatttaagaacacgctaagaaaggccgcatatgcatggaaacggatcattgaacttcgtctttctgaagaagaagcagctaagttaaggcattttgtagatgagcctgccttcaccgatcttcattggggaatgtttataccggccataaaaggacagggcacagatgaacagcagaaaaagtggttgccattggcctataagatgcaaataattgggtgctatgctcaaactgaacttggacatgggtccaatgtgcaaggccttgagaccactgccacatttgatcctcaaacagatgaatttgtcgttcacagtcctacattgacatcaagcaagtggtggcctggtggattgggtaaagtctctacccatgctgttgtgtatgctcgccttataacaaatggcaaagactatgggattaatggttttattgtccaactacgaagcttggaagaccacaaacctcttccaggtgttactgttggagacattggaatgaaatttggaaacggggcatacaatactatggataatggggtattaagatttgatcatgtgcgtattccaagagatcaaatgctgatgagggtttcacaagttacaagggaaggaaaatatgtccaatctgatgttccccgacaactcctttatgggaccatggtatatgttcgtcaaacaattgtagcagatgcttccagtgctttgtctcgggctgtgtgtattgcaaccagatacagtgctgttcgtagacaatttggttctcagaatggtggacaagaaattcaggtgattgactacaaaactcagcaaagcaggctcttccccttgttggcttctgcatatgccttcagatttgttggggagtggctgaaatggttgtacactgatgtgacccaaagattgcaagcaaatgatttctcaacactgcctgaggcgcacgcatgtacagcgggattgaagtctgtgactactactgccactgctgatggaatagaagaatgccgaaagttatgtggaggtcatggctatctatgtagcagtgggcttccagagttatttgccgtttatgtccctgcttgtacatacgaaggagataacatcgtgctactactacaggttgccaggtttcttatgaagaccgtttcacagctgggctctggaaagaagccagtgggtaccatatcttacatgggaaaaattgaacacttgatgcaatgccgttctgatgtgaaacaagccaaggactggctgaaacctagtgtggtgctggaagcttttgaagcaagggctgccagaatgtctgttgcttgtgctcagaatcttagcaagtttgataatccagaagaaggctttgcagaacttgcggctgatttagctgaagcagcagttgctcattgtcaattaattgtcgtctccaagtttatcgagaagttgcaacaagacattcccgggaaaggggttaagcaacagctggaggtgctttgcggtatctattccctcttccttcttcacaaacatcaagcagattttctcgggactggctatatcacctcaaagcaggcatcacttgctaatgaccagctcagagccttatattccaagcttcgtccaaatgctatatcgctggttgatgcatttaactataccgatcacttccttgattcgatccttggacgttatgatggaaacgtgtatccgaaactatatgaggctgcatggaaggatcctctcaaccaatccgatatagctgacggcttccatgaatatattaggccattactgaagcagcaactgcgtgctgctcgactgtgaaggaagaattacatatatttatagctgttgtattgtgctgtgccaataaactcaaatttgaaataccatctttctttttggtgatggcctcctttatgacttgcatagcggtgatttaagcagtaaaataagagtaatgaactgttgaaaggaaactgtaatgtatgttcaatattttcccctcccagaactatgaaagaaaatagattatttttttgcctcaaaatgagttccctggcattagaacctt

SEQ ID NO: 8500 - DNA, 2463 bp, Nicotiana benthamiana
aagagtgtctgcataagctcccactacaactactaccgctataaatagcacacataaatcgtttcttggaaaactcaaacgtgttcaatccttatccttcttcttttttctactttttttattcaagagtttaattgggtatttgttaaaacaaccaaagattgcatcttttttcattctgtgcaagattttttggttttgatctgagaggaaaagatggagggtgttgattatttggctgatgagaggagaaaagctgagtttgatgtgaatgagatgaagattgtttgggctggttctcgccataattttgaattatcagatcgtatctccaagcttgttgctaatgatcctggcttcagtaaggaaggcagaactatgcttcctaggaaagaactatttaagaacacgctaagaaaggccgcatatgcatggaaacggatcattgaacttcgtctttctgaagaagaagcagctaagttaaggcattttgtagatgagccttccttcaccgatcttcattggggaatgtttataccttccataaaaggacagggcacagatgaacagcagaaaaagtggttgccgttggcctataagatgcaaataattgggtgctacgctcaaactgaactcggacatgggtccaatgtgcaaggccttgagaccactgccacatttgatcctcaaacagatgaatttgtcattcatagtcctacattgacatcaagcaagtggtggcctggtggattgggtaaagtctctacccatgctgttgtgtatgctcgtcttataacaaatggtaaagactatgggattaatggttttattgtccaactacgaagcttggaggaccacaaacctcttccaggtgttactgttggagacattggaatgaaatttggaaacggggcatacaatactatggataatggggtattaagatttgatcatgtgcgtattccaagagatcaaatgctgatgagggtttcacaagttacaagggaaggaaaatatgtccaatctgatgttccccgacaactcctttatgggaccatggtatatgttcgtcaaacaattgtagcagatgcttccagtgctttgtctcgggctgtgtgtattgcaaccagatacagtgctgttcgtagacaatttggttctcagaatggtggacaagaaattcaggtgattggttataaaacccagcaaagcaggctcttccccttgttggcttctgcatatgccttcagatttgttggggattggctgaaatggttgcacactgatgtgacccaaagactgcaagcaaatgatttctcaacactgcctgaggcgcatgcatgtacagcaggattgaagtctttgactactacttccactgctgatggaattgaagaatgccgaaagttatgtggaggtcatggctatctatgtagcagtgggcttcctgagttatttgccgtttatgtccctgcctgtacatacgaaggagataacaccgtgctactactacaggttgccaggtttcttatgaagaccgtttcacagctgggctcaggaaagaagccagtgggtaccatatcttatatgggaaagattgaacacttgatgcaatgccgttctgatgtgaaacaagcccaggactggctgaaacctagtgtggtgctggaagcgtttgaagcaagggctgccagaatgtctgttgcttgtgcccagaatcttagcaagtttgataatccagaagaaggctttgcagaacttgcggctgatttagctgaagcagcagttgctcattgtcaattaattgttgtctccaagtttatcgagaagttgcaacaagacattcccgggaaaggggttaagcaacagctggaggtgctttgcggtatctattccctcttccttcttcacaaacatcaagcagattttctcgggactggctatatcacctcaaagcaggcatcacttgctaatgaccagctcagagccttatattccaagcttcgtccaaatgctatatcgctggttgatgcatttaactataccgaccacttccttgattcaattcttggacgttatgatggaaacgtgtatccgaaactgtatgaggctgcatggaaggatcctctcaaccaatccgatatagccgacggcttccatgaatatattaggccagtactcaagcagcaactgcgtactgctcgactgtgatggaagagttacatatatttatagctgttgtattgtgctgtgccaataaactaaaatttgaagtaccatatttcttttggatgatggcctcctttatgacttacatagcggtgatttaagcagtaaatcactaaatctttgattgaataagatttatgaactcttgaaaggaaattgtgaaactgtagtgtatactcagtatttttccctcccaggactatgaaagcaaatagattaaatttttgcctcaaa

SEQ ID NO: 8501 - DNA, 2353 bp, Olea europaea
aatcgaaaaattcacgaaattcaagaaggctagcgttttctgggaaaatggagggggtggattatcttgtggatgagaggaagaaggctcagttcgatgtggatgctatgaaaattgtatgggctggctctcgccatgcctttgaagtttctgatcgaatttcgaagctcgttgccggtgatcctgctttccggaaggatgacagaactatgcttccaaggaaagaattgtttaagaatactcttaggaaggcagcttatgcatggaaacgaattattgaacttcgtctatctgaagaagaggcatcaaaattaaggttttatgtggatgaacccgcttttaccgatcttcattggggaatgtttgtacctgccataaagggacagggcactgatgaacagcagcaaaaatggttgcccttggcctataagatgcaaataattggctgctacgcacaaactgaacttggtcacggctcgaatgtacagggtcttgaaaccactgcaacatttgaccctaagactgatgaattcataattcatagtccgacattgacttcaagcaaatggtggcctggtggactaggtaaagtctccactcatgctgttgtttatgcacgcctcattacagatggtaaagaccaaggagttcatggctttattgtccaactacggaacttggaggaccataatcctcttccaggaataacccttggtgatattggaacaaaatttggaaatggagcatacaataccatggacaatggtgtgttaagatttgatcatgtacgtattccgagagaccaaatgttgatgagggtttcacaggttacaagggaaggaaaatatatgcaatctgatgtaccccggcagttggtctatgggaccatggtatatgttcgacaaacaattgtagccgatgcgtcatgtgctttgtcacgagctgtttgtattgctaccaggtatagtgctgtccgtaggcaatttggatcacagaacggtggacctgaaactcaggtcattgactacaaaactcagcaaagtaggctcttccctttgctagcttctgcctatgctttcagatttgttggtgaatggctaaattggctatacacggatgtgacccagaaacttcaggccaatgacttctcaacattgcctgaggttcatgcatgcactgcagggttgaagtctctgactacttctgccactgctgatggaatcgaagaatgtcgaaaattatgtggaggccatggttacctctgtagcagtggacttccagagttatttgcagtttatgttcctgcttgtacatatgaaggagacaacattgtgttgcttctacaggttgctaggtttctcatgaagacagtttcacaactgggaactgggaaaaagccagtgggtactatagcttatatgggacgagttgaatatctaatgcaatgccgttctgatgcacaaaatgctgtagactggctaaagcctagcatagtattggaggcatttgaggctagggctgccagaatgtctgttgcttgtgctcaaaatctgagcaagttcgccaatccagaagaaggttttgccgagctagcagctgatttagttgaggcagcagtcgctcactgccaattaattgttgtctcaaagtttattgagaagttgcaacaagacattcctggtaaaggggtcaagaaacaattggaggtgctatgtggtatctattacctatccctccttcacaagtaccagggtgatttcattgctaccagctgcataagccctaagcaggcttcacttgctaatgatcagctcagagccttatattctcaggttcgtccaaatgctatagctcttgttgatgcgttcaactataccgaccactacctgggatcaattcttggctgttatgatggaaatgtatatccaaaactatatgaggcagcatggaaggatcctctaaacgaatcagatatacctgatggctatcacgagtatatcaggcctctgcttaagcaacagctccgtgctgctagactatagagtattttgcatcagaacatgttcattttctcataatagctctagcttttgctctattctcatgtatgagaaatcttgccaaataatggcaaaagcagagattcttgcccggattcgctccgtgcctgtacttgtttttgttgtcataattatcaacacttaatggtcaaagcgagccctttattgagattgtttagtcttagtatgttggacatgtaaacaaattgtgatgtgaacctgcataggcaaacactacggaacctacgaacaagatgtaaatctttccaagaaagttaaagcaaggttttgga

SEQ ID NO: 8502 - DNA, 2320 bp, Amsonia hubrichtii
tgcgtctatacatacagtatatatatagtagtcggaaactacctcgggaagcacgaatttggtggttgacccttatcaatattcatattatcatccatcatttgtatatacataaaatcattattttccattagagaaatcggccagacagggatttttgcttgtgattgtgcgtctgaatcgagtttctgaaagaattttgaggacatggcgggactggattacttggccgatgagaggaagaaggcacagttcgatgtggatgaaatgaagatcgtctgggcaggctctcgccatacgtttgaactctcagatcggattgccaagctcgtcgctaatgatcctgcctttgcaaaggatgaaaggactatgctaccaagaaaggaattattcaagaatactcttagaaaggcagcttatgcgtggaggagaatcaatgaacttcgcctctctgaggaagaggcatctaaacttcggttttatgtggatgaacctgcttttactgatcttcactggggaatgtttgtgcctgtcataaaaggacagggcactgatgaacagcagcgaaaatggttgcctttggcttataagatgcaaataataggatgttatgcacagactgaacttggtcatggctctaatgtacaaggccttgaaaccactgcaacatttgatcctcaaacagatgaatttataattcacagtcctacattgacatcaagcaaatggtggcctggtggcttgggtaaagtatccacacatgcagttgtctttgctcgtcttataactgatggccaagaccatggcgttcacggttttattgtccaactacggagtttggaggaccataagcctcttcaaggtataactgttggtgatattggaatgaaatttggtaatggagcatacaacaccatggataatggagtgctaagatttgatcatgtccgtattccacgaaatcaaatgttgatgagggtttcacaagtaacaagagaaggaaaatataaacaatcagatgttcctcgccagctggtctatggaacaatggtttatgtccgtcaaacaattgtacaagatgcatcatcagccttgtcacgagctgtttgcattgcgacgaggtacagtgctgttcgtcgacaatttggttcacaaaacggtggaccagaaacccaggtgattgattacaaaactcaacaaagtaggctctttcctcttctggcttctgcttatgcctttagatttgctggtgaatggcttaactggttatacacggatgtgacacaaagactacaagcaaatgacttctcaacattgccggaagttcatgcatgtactgcgggtttgaagtccttgaccacttctgctactgctgatggtattgaagaatgccgaaaattatgcggtggccatggctatctttgtaccagtgggcttccggaattatttgcagtttatgtccctgcttgcacatatgaaggagacaacactgtgctgctgctacaggttgccaggtttctgatgaagactgtttcccagctggggtctaggaaacagccaggggggacgatcgcatacatgggaagaattgagcatctgatgcagtgtcgttgtaatgtgcaaaatgccgaggattggttgaatcctaatgcagtgttggaggcatttgaggctagagctgctagaatgtccgtctcctgtgccaaaaagttgagcaagtttgctaaccaagaagaaggctttgccgaactatcagctgatttggttgaggctgcagttgctcattgtcagttaattgttgtctccaagttcatagagaaactgcaacaagatattccaggcaaaggtgttaagcaacagctaaaagcactttgtggcatttattacctatcccttcttcacaagtatcagggtgattttcttgccgccagctgcatcaccccaaagcaggcttcactagctaacgatctcctcagggcattgtattcacaggttcgtcccaatgccattgctctagttgatgcattcaactacactgatcacttccttggttcaattctgggtcggtacgacggaaacgtgtatccgaaactttatgaagctgcatggaaggatcctttgaacgactctgtcgtccctgatggctatcatgaatacatccgaccccttctgaaggaacaacttcgtactgctaaactgtaaagattataggtatactgttgttccttttcggtaaaaataagcttgtcctaggactttgaagttagagagaaatttatgtgggttgtcagtactatttagttatgattctagaaaacat

SEQ ID NO: 8503 - DNA, 2271 bp, Tabernaemontana elegans
gcacaaactctgctttttgatccttgtcaataatcggattatccatattcctatcagagaaatctctgagatttcgatatttgcgtgggattttgtgtctgaattgggttggctgaaacgattttgaggacatggctgcagtggattacctggccgatgagaggaagaaggcacagtttgatgtgggagagatgaagatcgtttgggcaggctctcgccacacctttgaagtttcagatcggatgtccaagctggtcgctaatgatcctgccttttcaaaggatgacagaaccatgctaccaagaaaggaattattcaagaatactcttagaaagacagcttatgcatggaagagaatcaatgaacttcatctatctgaggaagaggcatctaaacttcggttttttgtggatgaacctgcttttactgatcttcactggggaatgtttctgcctttcgtaaaagcacagggcactgatgaacaactgcgaaaatggttgcctttggcctataagatgcaaataataggatgttatgcgcaaactgaactaggtcatggctctaatgtgcaaggccttgaaaccactgcaacatttgatcctcagacagatgaatttataattcacagccctaacttgacttcaagcaaatggtggcctggtggtttgggtaaagtatccacacatgcagttgtctttgctcatcttataactgatggccaagactatggcgttcacggttttattgtccagctacggagtttggaggatcataggcctcttccaggtataactgttggtgatattggagtgaaatttggtaatggagcgtacaacaccatggacaatggagttctaagatttgatcatgtgcgtattccaagaagtcaaatgttgatgaggttttcacaagttacaagagaaggaaaatatatgcaatcagatgttcctcgccagctggtctatggaacaatggtttatgtccgtcaaacaattgtacaagatgcatcatctgccttgtcgcgggctgtttgcatagcaacaaggtatagtgctgttcgtcgacaatttggttcggcaaatggtggaccagaaacccaggtgattgattataaaactcaacaaagtaggctctttcctctgctggcttctgcttatgcctttagatttgttggtgagtggcttaaatggttgtacacggatgtgacacaaagacttcaagcaaacgacttctcgacattgcaagaggctcatgcatgcaccgcagggttgaagtccttgactacttctgctaccgctgatggtattgaagaatgcagaaaattatgtggtggccatggctatctttgtaccagtgggcttccagaattatttgcagtttatgtacctgcttgcacatatgaaggggacaacactgtgctgctgctacaggttgccaggattcttatgaagactgtttcccagctggggtctgggaaacagcccgtggggacaatagcttacatgggaagaattgaacatctgatgcagtgtcgctgtaatgtgcaaactgccgaggattggttgaatcctagtgtagtgttggaggcatttgaggcaagagctgctagaatgtctgtttcctgtgccaaaaagctgagcaagtttgctaaccaagaagaaggctttgctgaactatcagctgatttggttgaggcagcagtggctcattgtcagttaattgttgtatccaagttcattgagaaactgcaacaagatatcccgggcaagggtgtcaagcaacagctaaaagcactttgtggcatttactacctattccttcttcacaagcaccacggtgattttcttgcaactggctgcatcaccccgaagcaggcttcactagctaatgatctcctcagggcattgtattcacaggttcgtcccaatgccatcgcacttgttgatgcattcaactatactgatcactaccttggttcaattcttggttgctatgatggaaacgtgtatccgaaactttatgaggctgcatggaagaatcctttgaacgactcggacataccggatggttatcatgaatacatccggcctctcctgaagcaacagcttcgtgctgctaaactctgaagattatagcaggtagtatactgttgtacccccactcactggtaaataaacttagccaaggactgtaagtgccatttatttatttatgattctagaaaaagtacttcattcgggtgcttataatacttgtccaaattggaagcac

SEQ ID NO: 8504 - DNA, 2293 bp, Rosmarinus officinalis
cgttatttgcttgtgattgtgcgtctgaatttcagttgtctgaaggaattttgagaacatggccggagtggattacttggccgacgagaggaagaaggcacagttcgatgtggatgcaatgaagatcgtctgggcaggctctcgccacgcctttgaagtctcagatcgggtgtccaagctcgtcgctaatgatcccgcctttgcaaaggatgagagaactatactacctagaaaagagttattcaagaacactctcagaaaggcagcttatgcatggaagagaatcaatgaacttcacctatctgaggaagaggcatctaaacttcggttttacgtggatgaacctgcttttactgatcttcactggggaatgtttgtgcctttcataaaaggacaggggactgatgaacagcagcgaaaatggttgtctttggcctataagatgcaaataataggatgttacgcccaaacagaactaggtcatggctctaatgtgcaaggccttgaaaccactgcaacattttatcctcagacagatgaatttgtaattcacagtcctacattgacttcaagcaaatggtggcctggtggtttgggtaaagtatccacacatgcagtcgtctttgctcgtctcataactgatggccaagactatggtgttcacggttttatcgtccaactacggagcttggaggatcataaacctcttctaggtataactgttggtgatattggaatgaaatttggtaatggagcatacaacaccatggacaatggagtactaagatttgatcatgtgcgtattccaagaaatcaaatgttgatgaggttttcacaagttacaagagatggaaaatataaacaatcagatgttcctcgccagctggtctatggaacaatggtttttgtccgtcaaacaattgtacaagatgcatcatctgccttgtcgcgggctgtttgcattgcgacaaggtatagtgctgtccgccgacaatttggttcgcaaaacggtggaccggaaacacaggtgattgattataaaactcaacaaagtaggctctttcctctgctggcttctgcatatgcctttagattcgttggtgagtggcttaaatggctatacatggatgtgacacaaagacttcaagcaaatgacttctcgacattgccggaggctcatgcatgcaccgcagggttgaagtccttgactactgctgctaccgctgatggtattgaagaatgcagaaaattatgtggtggccatggctatctctgtaccagtgggcttccagaactgtttgcggtttatgtccctgcttgcacatatgaaggagacaacattgtgatgctacttcaggttgccaggtttctgatgaagactgtttcccagctgggatctgggaaacagctagtgggaacaattgcttacatgggaagaattgaacatctgatgcagtgtcgttgcaatgtgcaaaatgccgaggattggttgaatcctagtacagtgttggaggcatttgaggcaagagctgctcgaatgtctgtttcttgtgccaaaaagttgagcaagtttgctagccaagaagaaggctttgctgaactatcggctgatttggttgagacagcagttgctcattgtcaattaattgttgtctccaagttcattgagaaactgcaacaagacattctgggcaagggtgttaagcaacagctaaaagcagtgtgtggcatttattacctacaccttcttcacaagcatcagggtgattttcttgccaccagctgcatcactccaaagcaggcttcactagctaatgatctcctgaggacattgtattcacaggttcgtcccaatgctgtttcacttgttgatgcattcaactacactgatcacttccttggttcaattcttggtcgctacgacggaaatgtatatccaaaactttatgaggctgcatggaaggatcctttgaacgactccgacatacctgatggctttcatgaatatatccggcctcttctgaagcaactgcgtcgtgctgctaaactatgaagattataggtatactgttgtatcttctcagtggtaataaacttatcctagaaggacattgaagtcacagaggaaccgaggagaatcgccagttacatttagtaggaacatactacattcctgtgcttgtgtaactgggaccacaagattgagattactggcatagtggcattcttttctttttcattcaataaagttgaacttttggcttatactatccaagtttactgttgtacattt

SEQ ID NO: 8505 - DNA, 2387 bp, Valeriana officinalis
acattttgctctctattatttccttttttttcatctctgcctggtagctgaaaccttcgagatagattcaatttcaatccaggttttaggtttgcttttgtgaaatttttgatataaggagttatggagggtgttgattacttagccgacgagagacgtaaaggtcaattcgatgttgatgaaatgaagatcgtttgggccggttctcggcacacctttgaagtttccgatcgaattgcaaagctagtagctaatgatcctgcctttcggaaggataacaggactatgatggacagaaaggaattgttcaaaaacacactcagaaaagctgcttatgcatggaaacggattcttgaacttcgtctatcagaagaagaagcagctatgttaagaaattatgtagatgaacctgcctttactgatcttcactggggaatgtttgtaccggctattaaaggacaaggcactgatgagcagcaacaaaaatggctaccacttgcttacaaaatgcaaattattggttgttacgcacaaactgagcttggtcacggctccaatgttcaaggtcttgaaacaactgctacgtttgatcctaaaactgacgagtttatcattcatagtcccacactgacttcaagcaaatggtggcctggtgggttggggaagatagcgacgcatggtgttgtttatgctcgtctaataacagatggcaaagaccatggagttcatggtttcattgttcagctgcgaagtttggaagatcatttgcctcttccaggaatcaccgttggagatatcggaatgaaattcggaaatggagcatacaacaccatggataatggtgtactgcgatttgataatgttcgcatcccgagatctcaaatgttgatgagggtctcacaagttacaagggaaggaaaatataagcaatcagatgtcccaaggcagctagtatatggaacaatggtatacgttcgtaagacaattgtgcttgatgcttcaattgctttatcacgcgccgtgtgtattgctactcgctacagtgctgttcgtaggcaattcggttcccaaaatggtggattggaaacacaagtgattgattacaaaactcaacagaataggctattcccattgttagcttcagcttatgcgttcagatttgttggtgagtggctgaattggttgtacactgatgtcacacaaagattacaagcaaacgatttcacgacattgcccgaggctcatgcttgcacggctggtttgaagtctttgaccactactgccacagctgatgcaattgaggaatgtaggaaattatgtggagggcacggttatttatgctctagtggccttcctgaactctttgctgtttatgttcctgcctgtacatatgaaggagataatgttgtgttgctccttcaggtcgcaaggtttcttgttaagactgtatctcagctcggttctggaaagaaaccgtcagggaccacggcctatatggctcgaatggaacagctgatgcaatctcattcagatgtacagaaagccgaagattggctaaagccgaatgcaatattggaggcatttgaagcaagagctgctcgaatgtcagttgcttgcgctcgtaacttgagcaaatttgcaaatgttgaagaaggatttgcggagttatcagctgatttagtggaggcagccgttgcgcattgtcaattaattgttgtttccaagtttattgataaaatgaaggaagagataccggggaaaggagttaaacaacagttggaggtgttatgtaatgtatatgcattgtttcttcttcacaagtatcaaggcgattttctcgctactggctccatcaccccgaagcaaggtgcccttgcaaatgaccaactcagatctttatactctcaggtccgtccaaacgcgatctcactagttgacacatttaattacacggaccactacctcggttcaattcttggttgttacgacggaaatgtgtacccaaagctctacgatgcagcttggaaagatcctttaaacgactctgttgtgcccgatggcttccatcagtatgttcgccctattctcaagcaacaactacgtacctctaagctctaaaatatggattaaaagttaatatatactccgtatattcatatatatataataactctattcctatatgattataaataaagtacatgtttagtgctattcaaaattagaactttgctttcagtctattgtctgcacatttttctgatctttttgggttcatatcgctgatgtcttttcttgttgtaatacgcgtttgattgtaaagttctgttattaacaaggtatagaattatataccgtactattcaattgtataaactttttttgat

SEQ ID NO: 8506 - DNA, 2212 bp, Vinca minor
ttttctaagcgagaaatctgtaggaaagaaggaatttttgtgaggaagatggcggaaatcgattacttgagcgatgaaaggaagaaggcggaattcgatgttgatgaaatgaagatagtttgggcaggctcttcccacaactttcaactttcagatcggatttctaagctcgtcgctaatgatcctggttttgcaaaggatgggagaactatgctacccagaaaggaattattcaagaatactcttagaaaggcaacttatgcatggaagagaatcaatgaacttcgtctatctgaggaagaggcgtctaaactgcggttttatgtggatgaacctgcttttactgatcttcactggggaatgtttgtgccttttataaaaggacagggcactgatgaacagcagaagaaatggttgtcgttggcccataagatgcaaataataggatgttatgcgcaaactgaactaggtcatggctctaatgtgcaaggcctggaaaccactgcaacatttgatcctcagaccgatgaatttgtgattcatagtcctacactaacttcaagcaaatggtggcctggtggtttgggtaaagtatccacacatgcagttgtatttgctcgtcttataactggtggcaaagattacggcgttcacggttttattgtccaactacggagtttggaggatcataaccctcttccaggtgtaactgttggtgatattggaatgaaatttggtaatggagcatacaacactatggacaatggagtactaagttttgatcatgtgcgcattccaagagatcaattgttgatgaggttttcacaagttacaagagatggaaaatataaacaatcagatgtgcctcgccagctggtttatggaacaatggtttatgtccgtcaatcaattgtccaagatgcatcatctgccttgtcacgagctgtttgcattgcaacaagatatagtgctgttcgtcgacaatttggttcgcaaaatggtggaccagaaatccaggtgattgattataaaactcaacaaagtaggctctttcctctgctggcttctgcttatgcctttagatttgttggtgagtggctcaactggttatacacggatgtgacaaaaagacttcaagcaaatgacttctcaacattgccggaggctcatgcgtgcactgcagggttgaagtccttgactacctcttttaccgctgatgctattgaagaatgcagaaaattatgtggtggtcatggctatctttgtagcagtgggcttccagaattgtttgctgtttatgtccctgcttgcacatatgaaggagacaatactgtgatgctgctacaggttgcaaggtttctgatgaagactgtttcccagactgttgcccagctgggatccggtaaacagctagttggaacaattgcttacatgggaagacttgaacatctgatgcagtgtcactgtaatgtgcaaaacgccgaggattggttgaatcctagtgcggtgatggaggcatttgaggccagagctgttagaatgtctgtttcttgtgccaaaaggctgagccagtttaccaaccaagaagaaggctttgccgaaatatcagctgatttggtggaggcagcagttgctcattgtcaattaattgttgtctcaaagttcatcgagaaactgcaacaagacatcccaggcaagggtgtcaaggaacagctaaaagcactttgtggggtttactacctattcctcctccacaagcaccatggcgattttcttgccacaaactgcattactccaaagcaggcctcactagctaatgatctcctgaggtcattgtattcacagatccgtcccaatgctatcgctcttgttgattcattcaactataccgaccactaccttggttcaattcttggtcgttatgatggaaatgtatatccgaaactttacgaggctgcctggaaggatccgttgaatgactctgttgtaactgatggatatcatgaatacatccggccgctcctgaagcaacagcttcgtactgctaaactgtgaaacattataggtatttatgctgttgtacccttttagtggtaaataaaatttatcctactagaaggattatgaaattgtagaacttaggagaattgccagtaacatttatttatattcggagaaatagacttcatttataagtatactactacatcta

SEQ ID NO: 8507 - DNA, 2474 bp, Lippia dulcis
ctcacaccgcatcgaaatcctcgggaacatcatcactacgtgtgcaaatccttatcgcaagaactctctctccctaccgcaatacttatataccgaattatccgttcttatatattgatcactcagatcaattgggatattgatctgtagattattagcttgtctttgttgtttatctgggagaaaatggagggagtggatcatctagctgatgagaggaaaaaagcggcgtttgatgtggagggtatgaagattgtctgggctggctcgaggcacaccttcgaagtctgcgatcgtatttccaagctcgttgctaatgatcctgcattccggaaggatgacagaactatgctggcaagaaaagagttattcaaaaatactcttaggaaggcagcctgtgcatggaaacggattattgatcttcatctatccgaagaagaggcatctaagttaagattttttgtggatgaaccagcatatactgatcttcattggggaatgtttgtgccagccataaaaggccagggtactgatgagcagcagaaaaaatggttgccattggcctataagatgcaaataattggctgctatgcgcaaactgaacttggtcatggctccaatgtgcaaggcctcgaaaccactgctacattcgatcctcatactgatgaatttgtgattcatagtcctacattgacttcaagtaagtggtggcctggcggactaggaaaggtgtccacacatgctgttgtttatgctcgtctcattatagatggtaaagacaatggtgttcatggtttcattgtccaactacgtagcttagaggaccatagacctcttccaggaataacagttggtgatatcggaatgaaatttggaaatggagcatacaatactatggacaatggagttttgagattcgatcatgttcgcattccacggaatcagatgttgatgagggtcttgcaggtaacaagggaaggaaactgtaaacaatcagatgtgccacgccaattagtttatgggactatggtatatgtccgacaacaaattgtagcagatgcttcttgtgctttatcaaaagctgtttgtattgctacaaggtatagtgctgtacgtagacaatttggatcacagaatggtgggcctgaaactcaggtcattgactacaaaactcagcaaagcagacttttccccttgctggcatctgcttatgcctttagatttgttggtgaatggctacaatggttgtataaggatgtaacacaaaagttgcatgccaatgacttctcaacattgcctgaagctcatgcttgcactgcagggttgaaatccttgactaccactgctactgctgatggaatcgaagaatgtcgtaagttatgtggcgggcatggttacctgtgcagcagtggacttccagaattatttgcagtttacgttccagcgtgtacatatgaaggagacaacactgtcctgcttttacaggttgctaggtttctcgtgaagactgtctctcagcttggaactggtaaaaagccagttgggacaattgcttatatgggaaagattgagcatctaatcgaatgccactgtgatgttcaaagagcgggggattggttaaaacccagccaagtattggaagcatttgaagcaagagctgctagaatgtctgtttcctgtgcccaaaatctgagcaagtttgctaaccctgaagaaggctttgcagagctatctgctgatttagttgaggctgcagttgctcactgtcaattaattgtcgtctccaagtttattgcgaaactagaacaagagattccaggtgaaggggtgaggcaacaattggaggcgctttgtggtatttattacctctcccttcttcacaagcaccaaggtgatttccttgctactagctatctcacccctaagcaagctgcacttgctaacaatcagctccgagcattgtattccaaggttcgtccgaatgccatagcccttgttgattctttcaattacaccgaccacttcctcggttcaattcttggccgctatgatggaaatgtttatcccaaactttatgaggcagcttggaaggatcctttgaatgaatcggttatacctgatgggtaccacgaatacgttaggcctttgctcaagcagcagctgcatactgccagactgtaaaatgtagatcctaagatttgttgacgttcaaatgtgcatcaataaagatggtggaggggaagttgtttctttgagatgattgctcttcttagactgccatcgctaatatattttcatgttgtttcttgtattctgtattggaggagatacttgagcttacaccaaaggcaataactagattggatgaattgttggatgggtatgaggtgatcttgtcaaggaaatatcaatatcaatgttattatgggtgaatattatattactttatgggtaattaaatgttatattaaact

SEQ ID NO: 8508 - DNA, 1947 bp, Solanum tuberosum
atcaggcagaggacgagacagaacgcagaaaaaacgtgtccaatccttatcctttctattttttcaagaatcgaattgggtatttgtaaaacatctaaagattggattttttttcactgtgtagaatttggttttgatctgagagtaagagagatggagggtgtagattatttggctgatgagaggaagaaagctggatttgatgtggatgagatgaagattgtttgggctggttctcgtcatgattttgaacttacagatcgtatctctaagcttgttgctaatgatcctggcttcagtaaggagggaagaactatgcttcctaggaaagagctattcaagaacactctaaggaaggcagcatatgcatggaaacggatcattgaacttcgtctatctcaagaggaagccactatgttaaggcgttacgtagatgagcctgcttttactgatcttcattggggaatgtttatacctgccttaaaaggacagggcacagataaacagcaggaaaagtggctgccgttggcttacaagatgcaaataattggctgttatgctcaaactgaacttggtcatgggtccaatgtgcaaggccttgagaccactgccacatttgatcctcaaacagatgaatttgtcattcatagtccaacattgacgtcaagcaagtggtggcctggtggattgggtaaagtgtctacccatgctgttgtgtatgctcgtcttataacagatggtaaagactatggggttaatggttttattgtccaactacggagcttggaggaccacaaacctcttccaggtgttactgttggagacattggaatgaaatttgggaatggagcatacaattccatggataatggggtgttaagctttgatcatgtgcgcattccaagagatcaaatgttgatgagggtttcacaagttacaaaggaaggaaaatatgttcaatctgatattccccgacaacttctttatgggactatggtatatgtacggcaatcaattgtatcagatgcttcccttgcaatgtctcgggctgtgtgcattgcaaccagatacagtgccattcgtagacaatttggctctcagaatggtggacaagaaactcaggtgattgactacaaaactcagcaaaacaggctcttccccttgttggcttctgcatatgccttcagatttgttggtgagtggctgaaatggttgtacactgatgttacccaaagacttgcagcaaatgatttctcaacattgcctgaggcacatgcatgtaccgcaggattgaagtctttgaccaccagtgccactgctgatggaattgaagaatgccgaaagttatgtggaggtcatggttatctttgtagcagtgggcttccagaattatttgccgtttatgtccctgcctgtacttacgaaggagataatgtcgtgctacagctacaggttgcaaggtttcttatgaagaccgtgtcacaactgggcactggaaagaagccagtaggtactgtatcttatatgggaagaattgaacacttgatgcaatgtcgttctgatgtgaaacaagccgaggactggctgaaacctatgcagtattggaagcatttgaagcaaggtctgccaggatgtctgttgcctgtgctaagaatcttagcagttgagaatcacgaagaaggcttgcagaactagcagctgatttagttgaagcagcagttgctcattgtcaattaaattgtggtctccaagtttatcgagaaattgcaaccaaaacattcctgcgtagagggattaagcaacagctggagagtgctttgtggcatctattcgtcttcccttctttcacaacattccagcagaatttctctggacaaggctacatcactttcaaagcaggggttcgcttgcttaacgaaccagtcaagagccttgttattcccagtt

SEQ ID NO: 8509 - DNA, 2200 bp, Rosmarinus officinalis
tgctgctgatctgagcgaaaatggcgggagtggactatctagctgatgagaggaagatggcggagttcgatgtgaactccatgaagattgtgtgggctggttctcgtcacgccttcgaagtttcggatcgaatttccaagcttgtggcaaatgatccggcatttcaaaaggataacagacctatgctgccaagaaaggaattgtttaaaaatacacttaggaaggcagcttatgcatggaaacgtatcattgaacttcgtctatcagaagaagaggcatctaagctaaggtttttcgtggatgaaccagcttatactgaccttcattggggaatgtttgtaccagctttaaaaggtcaatgcactgatgaacagcagagcaagtggttgccattggcttataagatgcaaataattggctgctatgcccaaactgaacttggtcatggctccaatgtgcaaggtcttgaaaccacttctacgtttgatcctcaaactgatgaatttgtgattcatagtcctacattgacctcaagtaaatggtggcctggaggactgggcaaagtatccacacatgctgtagtatatgctcgtctcattacagatggcaaagaccatggtgttcatggttttattgtccaactacggagcatggaggaccataaaccacttccaggaataactgttggtgatattggaatgaaatttggaaatggagcatacaataccatggacaatggtgtactgagatttgatcatgttcgtattccaagagatcagatgatgatgagggtatcacaggtgacaagagaaggaaaatttaagcaatcggatgtgccacggcagttagtttatgggactatggtatatgttcggcaacagattgtggcagatgcttcttgtgctttatcgaaagctgtttgtattgctactaggtatagtgctgttcgtagacagtttggatcacagaatggtggacctgagactcaggtgattgactacaaaactcagcaaaacagactttttccactgctggcttctgcttatgcctttagatttgttggtgaatggctaaaatggctttacactgatgttactcaaagactgcaagccaatgatttctcaacattgcctgaggttcatgcatgcactgcaggattgaagtccttgactactactgccactgctgatggaattgaagaatgtcggaagttatgtggaggccatggttacctctgtaccagtgggcttcctgaattatttgcagtttatgttccagcttgtacgtatgaaggagacaatgttgttttgcttctacaggttgctaggtttctcatgaagactgtatcccaaatcggaagtggcaaacagccagttgggactattgcttatatgggaagagttgaacatctattaaaatcccgctgcagtgtccaaagagctgaggattggttaaatcctagtcaagtgttggaagcttttgaggcacgagctgctagaatgtctgtttcctgtggtcaaaatctaagcaagttttctaatcctgaagaagggtttgctgagctatcagctgatttagttgaggcagcagtggcccactgtcaattaattgttgtctccaagtttcttgagaaactgctacaagatatacccggtgaaggggtgaagcaacaattacaagcagtatgtggcatatattacctctccctgctccacaagcaccaaggcgacttcctcgccaccggctacatcacccctaagcaggcagcacttgctaacgatcagctcagggcattgtatgccaaggttcgtccaaatgccattgctctggttgattcattcaattacacggaccacttcctaggttctattctgggctgctatgacggaaatgtttatcctaagctgtacgaagctgcaaagaacgatcctttgaatgatacagttgtgcctgatggctaccatgagtacttgaagccattgcttaagcaacaactccatagtgctaaattgtagaaatctatggtcgatacattccgaataagagcgtcgaattatgaccaccaataatttaactttgtttcggataagaaagtaaaatttagtctatttgaatttgcatatgtatattgttaacctgattatatgtgagaatatttctctagctattgtgctactgttcagagcagaaatattttcat

SEQ ID NO: 8510 - DNA, 2395 bp, Triphysaria pusilla
aaatcaacgtgtgcaaaattttatcgcaaactctctctctctctaattatttccaacctactcaaccactcgcacataccagaattaaaaccatctgctcggcttatatattctgatttctcacatcaattaagagcatatactttaatttattagcactgtttcttgttatagatctgaagtaaaatggagggagtggattacctagctgatgagaggaagaaggcggagttcgatgtggaggccatgaaggttgtctgggctggctcaccgcacaacttagaagtttttgatcgtatttctaagctcgtcgccgatgatccagcattccggaaagatgacagaactatgcttccgagaaaggaattatttagaaatactcttaggaaggcagcttatgcatggaaacgaattgttgaacttcgtctctcagaagaagaggcatctatgttaagattttatgtggatgaaccagcttataccgatcttcattggggaatgtttataccagccattaaaggccagggcactgatgaacaacagaaaaagtggttgcctttagcctataagatgcaaataatcggctgctatgctcaaactgaacttggtcacggctccaatgtgcaagggctggaaaccacttcaactttcgaccctcacacggacgaatttgtaatccacagtcctacattgacttcaagcaaatggtggcctggcggactgggcaaagtgtccacacatgccattgtttatgctcgtctccttataaatggtaaagaccatggcgttcatggctttattgtacaattacggagcttggaagaccatacacctcttccggggatcactgttggtgatattggaatgaaatttggaaatggagcatacaacaccatggacaatggtgtgttgcgatttgatcattttcgtattccaagaaatcagatgttgatgagggtttcggaggtgaccagggaagggaaatataagcaatcagatgttccacggcagttggtttatgggactatggtatatgtccgacaaagaattgtagcggatgcttcttgttatttatcgagagctgtttgtattgctacaagatatagtgctgtacgtagacagtttggacggcagaatggtggacctgaaactcaggtcattgattacaagacccaacaaaacagacttttccccttgttggcttctgcttatgcctttaggtttgttggagaatggcttgaatggttgtacatggatgtaacaaaaagattgcaagccagtgacttctcgacattgcctgaggctcatgcatgcactgcagggttgaagtcccttaccacttctgtcactgctgatggaattgaagaatgtcgaaagctatgtggaggtcatggttacctttgcagcagtggccttccagaattgtttgcagtttatgttccagcatgtacatatgaaggagacaatgttgtcctacttctacaggtagctaggtttcttataaaaaccgtctcccagcttggaactggcaaacagcctgtaggaacgattgcttatatgggaagaattgaaaatttaatgcaatgccgctctagtgctcaaagagctgaggattggtcaaacactagtcaagtattggaagcatttgaggcaagagctgctagaatgtccgcttccgttgctctaaatctgagcaagtttactaaccctgaagaaggctttgcagagctgtcggctgatttggttgaggcagcagtcgctcactgccaattaattgtcgtctccaaatttatcgagaagcttgaacaagatattcctggtgaaggggtgaaacaacagttagaggcattgtgtggtatttatagtctctctcttctccataagcaccagggggacttcctggctaccagttatgtcactcctaagcaggctgcacttgctaacgatcagcttagatcattgtatactaaggttcgtccaaatgccattgctctagttgacgcattcaattacagtgaccacttcctgaattcgatattgggtcgttatgatggaaatgtttacccaaagctttacgaggcagcttggaaggatcctttgaatgaatctgttgtgcctgatggctacctagagtacgtgaggccgttacttaagcaacagctccatactgcaaggttgtagacctttttaatttgattcacacaataaactctcggtcaaaaataaagttggtgatacggaatttggttatcttttgacatttttttatctgcgtttgatgcatggaacagaaatatgaatattttaaacttttttctgcttgcatattctttattgtatttggtagtaaataaagtgttttgtatgatgctgcatttggatcatgatgatgcat

SEQ ID NO: 8511 - DNA, 2558 bp, Rosmarinus officinalis
ctaagccgaaaacaaaatgtgcgtcaattttcacagacacacaataattacgagtagttgcaattattttacattatcgtcatctactataaatgcagacattgagaactacgtatgccaaattatcatcgcaaatctttccctctctcttcatattcccaaaatattcctagagacaccgatttctcagaagatttgaggccaatttgtttgttaatttgttagcaatatcagtaatactgctgctgatctgagcgaaaatggcgggagtggactatctagctgatgagaggaagatggcggagttcgatgtgaactccatgaagattgtgtgggctggttctcgtcacgccttcgaagtttcggatcgaatttccaagcttgtggcaaatgatcccgcatttcgaaaggatgacagacctatgctgccaagaaaggaattgtttaaaaatacacttaggaaggcagcttatgcatggaaacgtatcattgaacttcgtctatcagaagaagaggcatctaagctaaggtttttcgtggatgaaccagcttatactgaccttcattggggaatgtttgtaccagctttaaaaggtcaatgcactgatgaacagcagagcaagtggttgccattggcttataagatgcaaataattggctgctatgcccaaactgaacttggtcatggctccaatgtgcaaggtcttgaaaccactgctacatttgatcctcaaactgatgaatttgtgattcatagtcctacattgacctcaagtaaatggtggcctggaggactgggcaaagtatccacacatgctgtagtatatgctcgtctcatcacagatggcaaagaccatggtgttcatggttttattgtccaactacggagcatggaggaccataaaccacttccaggaataaccgttggtgatattggaatgaaatttggaaatggagcatacaataccatggacaatggtgtactgagatttgatcatgttcgtattccaagagatcagatgatgatgagggtatcacaggtgacaagagaaggaaaatttaagcaatcggatgtgccacggcagttagtttatgggactatggtatatgttcggcaacagattgtggcagatgcttcttgtgctttatcgaaagctgtttgtattgctactaggtatagtgctgttcgtagacagtttggatcacagaatggtggacccgagactcaggtgattgactacaaaactcagcaaaacagactttttccactgctagcttctgcttatgcctttagattcgttggtgaatggctaaaatggctgtacacggatgtcactcaaagactgcaaagcaatgatttctcaacattgcccgaggttcatgcatgcactgcaggattgaagtccttgactactactgccactgctgatggaattgaagaatgtcggaagttatgtggaggccatggttatctctgtaccagtgggcttcctgaattatttgcagtttatgttccagcttgtacgtatgaaggagacaatgttgttttgcttctacaggttgctaggtttctcatgaagactgtatcccaaattggaagtggcaaacagccagttgggactattgcttatatgggaagagttgaacagctattagaatcccgctgcagtgtccaaagagctgaggattggttaaatcctagtcaagtgttggaagcttttgaggcaagagctgctagaatgtctgtttcctgtggtcaaaatctaaacaagttttctaatcctgaagaagggtttgctgagctatcagctgatttagttgaggtagcagtggctcactgtcaattaattgttgtctccaagtttcttgagaaactgcaacaagatattcctggtgaaggggtgaagcaacaattacaagcattatgtggcatatattacctctcactgctccacaagcaccaaggcgacttcctcgccaccagctacatcacccctaagcaggctgcacttgctagcgatcagctcagagcattgtatgccaaggttcgtccaaatgccattgctatggttgattcattcaattacacggaccacttcctgggttctattctgggctgctacgacggaaatgtttatcctaaactttacgaagctgcaaagaaggatcctttgaatgatacagttgtacctgatggctaccatgagtacttgaagccattgcttaagcaacaactccgtagtgctaaattgtagaaatctatggtcgatacattcccataaaagcgttggattatgaccaccaataatttaactttgtttcagagaagaaagtaaaatgtagtctatttgaatttgcatatgctaagcctattataaatgagaatatctctcaagctattctgcatttgttcagagcagaaatattttcatggtagagagcttatcatcacttgttcttaatggttaagtataatttttgggactcggatggttattttggatgagttgttgattgataatgtatctatttataatatgattaaggatttactgaat

SEQ ID NO: 8512 - DNA, 2512 bp, Mimulus guttatus
acaaaccgacgtgtgcaatatccttatcgctagttttctctcttctcattcgcaaaaacaaaacgtagatatatatacagctatagatactacgtatacatacataaaattgtacgatcccttactccaattgagagagagagagagagagagagagattttgatatagttattgttagtctgtaaattagtagcagcattgctgttgtttgtttatctgaagaaaaatggattatttagccgacgagagaaagaaggctgtattcgatgtggattccatgaagattgtctgggctggatcgcggcaggccttcgaagtttccgatcgtatttccaagctcgtcgccgccgatcctggatttcggaaggatgacaggccgatgctaccgaggaaggaattgttcagaaatactcttaggaaggcagcttatgcatggaaacggattatcgatcttcgtctatcagaagaagaagcatctagattaaggttttatgtggatgaaatagcatatactgatcttcattggggtatgtttgtaccggccctaaaaggtcagggtactgacgaacagcaggcaaaatggttgccgttggcatataagatgcaaataattggctgctacgcgcaaactgagcttggtcatggctccaatgtgcaaggtcttgaaaccactgcaacatttgatgctgataaagacgaatttgtaattcatagtcctacattgacttcaagcaaatggtggcctggtggactaggaaaagtgtcaacacatgctgttgtttatgctcgtctgattacagatggaaaagaccatggcgttcatggttttattgttcaattgcggagcttggaggaccatacacctcttccaggaataaccgttggtgatattggaatgaaatttggaaatggaggctacaatacaatggacaatggagtgttgagatttgatcatgttcgcattccaaggaatcagatgttaatgaaggtttcacaggtgacaagagaaggaaaatataagcaatcagacgtgccacggcagttagtttatggcactatggtatttgtgaggcaacaaattgtaaaagatgcttcttgtgctttatcaagagctgtttgtattgccacgagatatagtgctgtacgtagacagtttggatcacagaatggtggatctgaaactcaggtcattgattacaaaactcaacagagcagacttttcccattgctggcttctgcttatgcctttagatttgtgggtgaatggctggaatggctgtacaaggatgttattcaaagattgcaagccaatgacttctctacattgcccgaggctcatgcatgcacagcagggttaaagtccatcactacttctatcactgctgatggaatcgaagaatgtcgaaagttatgtggaggacatggttacttatgcagcagtgggcttccagaactatttgcagcttatgttccagcttgtacatatgaaggagacaacactgtcctgcttttgcaggtagctaggtttctaatgaagactgtctcccagcttggatcaggcaaacagccagtaggaacaactgcttatatgggaagacttgaacatctaatgcaaagccgttgtactgctcaaagagctgaggattggttaaagcctagtcaagttttggaagcttttgaggcaagagctgctaaaatgtccgtttcctgtgctcagaatctgagcaaattcagtaaccctgaagaaggctttgcagagctgtcagctgatttggttgaggcggcagttgctcactgtcaattaatcgttgtctccaagtttattgagaaactgcaacaagatattcccggtgaaggagtgaagcaacaactagaggcactttgcggtatatattacctctcacttcttcacaaacaccagggcgactttctagccactagttatctgacacctaagcaggccgtacttgctaacgatcagctcagagccttgtatgccaaggttcgtccgaatgcaatagctcttgttgatgcattcaattacacggaccattaccttggttcgattctgggcagatatgatggaaatgtttaccccaaactttacgaggcggcttggaaggaaccattgaatgaatcggttgtacctgatggctacaaagagtacattaggcctctgcttaagcaacagctccatagtgctcgattgtagacttttttcgattcgatatatgacgaatggtgtataccaattaaagttagacccatcgcaataaaataaagatctcgatcatgtgggataaatatgtagtagtttttgtatttgagtaaaacaaagcttgagttcatcaagtgtgcattatgaatgtcaagcagagtttgatttatgtacttgccaatttcgagtacagatttgattgattaatattcatgttgttcttattcttttttagttgttaaataaaataaactgtacgaaatttttccacaaaaaaaaatcttattttttta

SEQ ID NO: 8513 - DNA, 2506 bp, Panax ginseng
ctaaagccctggcaggtccaagtcaggtccggcctattgtgcatgtctgacatccactcatcccaatctacgatcccaagttcgtcttttctgccggacgactcgtaggaggtgagaagacgaagaggaagaagaaggaagagtaaatggagggtgtagatcacttggctgatgaaaggaggaaggctcagttcgatgtggagtctatgaaaatcgtttgggccggttcgcttcacgcttttgatgtctccgatcgcatgtccaagctcgttgctaatgatcctgcttttcggaaggatgaaaggactatgcttgctagaaaggagttgttcaaaaacactcttagaaaagcagctcatgcatggaagcgggtcaatgaacttaaactaacttatgaagaggcaactaagctaaggttttttgtggatgaaccttgctataccgatcttcattggggaatgtttgtacctgctataaaaggacaaggcaccgaagaacagcaagagaaatggttgccgcttgcccacaaaatgcaaatcattggctgctatgcacaaactgaacttggtcacggctccaatgtacaaggtcttgaaaccactgcaatatttgatccccaaacggatgagtttgttattcacagtcctacattgacgtccagcaaatggtggcctggtggtttgggtaaagtatccactcatgctgttgtttatgctcgtcttataactgatggtcaagaccatggggtacatggttttattgtccaattgcggagcttggaggatcactcacctcttccgggtataactgttggtgatatcggaatgaaatttggaaatggagcatacaacacaatggacaatggtgtgttaagatttgaccacgtgcgtatacctcgaaatcaaatgttgatgcgagttttgcaggtttcaagggaagggaaatgtacacactctgatgttcctcggcagctaatttatgggactatggtatatgttcggcaaaccattgttgctgatgcttcccttgctttatcaagggcagttactatcgccacaaggtatagttgtgtgcgtagacaatttggttcgcagaatgggggccctgagactcaggtgattgactataaaactcagcaaaataggctcttccctttgctggcttctgcctatgccttcagatttgttggcgaatggttacattggttgtacatggatgtgacggaaagattgcaagctgatgacttctcaacactgccagaagctcatgcatgcactgctgggctcaagtctttgactacaactgccacttctgatgcaattgaagaatgtcgaaaattatgcggaggacatggctacctatgtagcagtggccttcctgaattatttgcagtttatgcccctgcctgtacgtatgaaggagacaacatggtgctgcttctacaggttgcaaggtttctagtgaagactgcatctcagctggggactggaaaacagccagtaggaacgacatcttatatggggcgagctgaacatctgatacaatgtcattctaatgttgaaacagctgaagattggctaaagcctagtgcagttctggaggcatttgaagcaagggcatttagaatggttgttgcctgtgctcagaacttgagccagtttgcaaacccagaagaaggatttgcagaactgtcggctgatttagcagaggtagcagttgctcactgccaattaattgtagtttccaagttcattgataaactgaaacaagacattcctgggaagggggtaaaacaaatgttagaggtgctctgtaatgtatattcgctgtttcttcttcacaagtaccagggtgattttctcgctactggcagcatcacgaccaagcaggcttcactggcaaatactcaattgagaaatttgtattcccaggtccggccaaatgcagttgcgcttgttgattcattcaattacacggatcacttccttggttcaattcttggccgttatgatggaaatgtatatccaaagctttacgaggcagcatggaaggatccactgaatgattcggttgttcctgatggctaccatgagtacgttaggcctttgcacaagcaacagctacatatggctaggctgtaaaacaatatttgaaactgttattcatgtcctaataaaaggttcccttatgatataccccacttggagggaacgaacgatgactactgtgtcataatagtgctatataatattattttttcctaggtaacttatttgttcctcaagttagaaggccgaataatagaggattgattgaaactgaatagaaggatggacaattcttggttatctaattcatgatttgagggactaaaaaaaaaaacaaaaaaaaaaaaaaacaaaaaaaacaaaaaaacaaaaaaaaaaaaacaaaaaacaaaaaacaaaaacaaaacaaacaacaagagagacacacacagagacacacccccccccccccccccccc

SEQ ID NO: 8514 - DNA, 2756 bp, Plantago ovata
aattaaaatcattgccaatctctaattctctattgggagaaacttacttgcggaagaaagaaacaacaccaccaacctccatggattatctagctggtgagaggaacaaggccgagttcgatgtggagacgatgaagattgtttgggccggttcgcgcgaagcttttcaagtttccgatcgtatctctaagctcgtcgctgatgatccagttttccgaaaggataacagaacaatgctagccagaaaggaattgttcaaaaatactctcaggaaggtagcccatgcatataaacgaattcatgagcttcgtctgtcagagcaggaggcatcccaattcagattttatatggatgaaccagcctacacagatcttcattggggaatgtttgtaccagccataaagggccagggtactgatgagcagcagcaaaagtggttgccattagcctataagatgcaaataattggatgttatgcacaaacagaactcggacatggctctaatgtgcaaggtctagaaaccactgcaacatttgatccacatacagatgaatttgtaattcacagtccaacattgacttcgagcaagtggtggcctggtggacttggcaaagtgtccacccacgctgttgtttatgctcgtctaatcttacacggtgaagactatggtgttaatggatttattgtccaactgcggagcttggaggaccatactcctcttccaggagtaacagttggtgatattggaatgaaatttggaaatggagcgtataacacgatggacaatggagtactgagatttgatcatgttcggattccaagaaaccaaatgctaatgaaggtttcacaggttacgagggatgggaagtataagccttctgatgttccacgacagttggtttatgggactatggtatatgtccggcaaacaatagtagcagatgcttcccgtgctttatcaagagcagtttgcattgctacaaggtacagtgcagttcgtaggcaatttggatcagtgaatggtgggcctgagacacaggtcattgattataaaactcagcagagcagacttttccccttgttggcttctgcatacgcctttagaattgttggtgaatggttaacttggctgtacactgatgtgacccaaagactgaaagctaatgatttctcaacattgcctgaggctcatgcatgcaccgcagggttgaaatcactgaccacttcgtgcactgctgatggaatagaagaatgtagaaagctgtgtggtggccatggctatctatgcagcagtgggcttccggagttatttgcagtttatgttcctgcctgtacatacgagggagataatactgtcctgcttctacaggtagctaggtttctcatgaagactgtctcccaacttgggagtggtaaacagccagtagggacaatttcctatatgggaaacattgaacatctgatgcaaactcgttgtgatgttcaaacagctgaggattggttaaaacctggtctggtattggaggcatttgaggcaagagctgctagaatgtctattaattgtgctaaaaatctgagcaagtttgctaatccagaagaaggctttgcggagctttcagctgatttggttgaagctgcagcagctcattgtcaacttatcattgtctccaagttcctcgataagctgcagcaaaacattcctggtaaaggtgtcaagcaacagctggagacattatgtggtatatattatctacatctccttcacaagcaccagggagattttctcgccaccagctacctcacgcctaagcagtctgcactcgctaacgatcagctcagagctctgtacacaaaggttcgtccaaatgctattgctcttgttgatgcatttagttacactgatcacttccttggttcgattcttgggcgatacgatggaaacgtttatcctaaactttacgaagcagcatggaaggatccgttgaatgaaactgtggtgccagatggctaccatgaatacttgaagcctttgctcaagcaacagctgctccatagttccagaatgtagtagtaacggtgtattatctacatcacgttagagaggtgaataagatgagtgtggaaataaatttgcttacccgaagaccatccttcgtggcaaactaacttattactgtatgaacatgcccagactgcccttatcatttgagaagagaacaaaacggcataactctaggtctatccaaagttgaaaattaaatgcttaatttactcccaactgttacatgtgttataattgtattgttgatcaagatatgaatgctttggttaagttaaggtgtcaacattggtcaagggcgtgtaagtataaattattgctcaagtctgatggccaattaaaatttgagtaagattgaacttgtaaacgtagcaaaaaaaaagaaaaaaaacaaaacatgtcggccgggctccctcaccaccccagggcaacacagtctcgagaaccgctctgcctgcgacgccagcctcgacgtagctaagaagctgctcgtattcgaggtcgtgtcattcagtttcttccttttctcgtctcttgtggcacagggcttgaagttggcgattaatctgttgaatagtaaagatgtggatgagatctttagagcgcatattaatctcaaggtgttgaggttcggtatgcttgcgtctgcgattggttctgtcatgggttgcttgttcctgatgttgtcgatggtta

SEQ ID NO: 8515 - DNA, 2176 bp, Panax ginseng
acgaagaggaagaagaaggaagagtaaatggagggtgtagatcacttggctgatgaaaggaggaaggctcagttcgatgtggagtctatgaaaatcgtttgggccggttcgcttcacgcttttgatgtctccgatcgcatgtccaagctcgttgctaatgatcctgcttttcggaaggatgaaaggactatgcttgctagaaaggagttgttcaaaaacactcttagaaaagcagctcatgcatggaagcgggtcaatgaacttaaactaacttatgaagaggcaactaagctaaggttttttgtggatgaaccttgctataccgatcttcattggggaatgtttgtacctgctataaaaggacaaggcaccgaagaacagcaagagaaatggttgccgcttgcccacaaaatgcaaatcattggctgctatgcacaaactgaacttggtcacggctccaatgtacaaggtcttgaaaccactgcaatatttgatccccaaacggatgagtttgttattcacagtcctacattgacgtccagcaaatggtggcctggtggtttgggtaaagtatccactcatgctgttgtttatgctcgtcttataactgatggtcaagaccatggggtacatggttttattgtccaattgcggagcttggaggatcactcacctcttccgggtataactgttggtgatatcggaatgaaatttggaaatggagcatacaacacaatggacaatggtgtgttaagatttgaccacgtgcgtatacctcgaaatcaaatgttgatgcgagttttgcaggtttcaagggaagggaaatgtacacactctgatgttcctcggcagctaatttatgggactatggtatatgttcggcaaaccattgttgctgatgcttcccttgctttatcaagggcagttactatcgccacaaggtatagttgtgtgcgtagacaatttggttcgcagaatgggggtcctgagactcaggtgattgactataaaactcagcaaaataggctcttccctttgctggcttctgcctatgccttcagatttgttggtgaatggttacattggttgtacatggatgtgaccgaaagattgcaagccaatgacttctcaacactgccagaagctcatgcatgcactgctgggctcaagtctttgactacaactgccacttctgacgcaattgaagaatgtcgaaaattatgcggaggacatggctacctatgtagcagtggccttcctgaattatttgcagtttatgcccctgcctgtacgtatgaaggagacaacatggtgctgcttctacaggttgcaaggtttctagtgaagactgtatctctgctggggactggaaaacagccagtaggaacgacatcttatatggggcgagctgaacatctgatgcaatgtcattctaatgttgaaacagctgaagattggctaaagcctagtgcagttctggaggcatttgaagcaagggcatttagaatggttgttgcctgtgctcagaacttgagccagtttgcaaacccagaagaaggatttgcagaactgtcggctgatttagcagaggtagcagttgctcactgccaattaattgtagtttccaagttcattgataaactgaaacaagacattcctgggaagggggtaaaacaaatgttagaggtgctctgtaatgtatattcgctgtttcttcttcacaagtaccagggtgattttctcgctactggcagcatcacgaccaagcaggcttcactggcaactactcaattgagaaatttgtattcccaggtccggccaaatgcagttgcacttgttgattcattcaattacacggatcacttccttggttcaattcttggccgttatgatggaaatgtatatccaaagctttacgaggcagcatggaaggatccactgaatgattcggttgttcctgatggctaccatgagtatgttaggcctttgcacaagcaacagctacatatgtctaggctgtaaaacaatatttgaaactgttattcatgtcccaataaaaggttcccttatgatgctctacttggagggagcgatgactactgtgtcataatagtgctatatattattttttcctaggtaacttatttgttcctcaagttagaaggccgaataatag

SEQ ID NO: 8516 - DNA, 2244 bp, Panax ginseng
gaagacaaagaggaagaagaaggaagagtaaatggagggtgtagatcacttggctgatgaaaggaggaaggctcagttcgatgtggagtctatgaaaatcgtttgggccggttcgcagcacgcttttgatgtctccgatcgcatgtccaagctcgttgctaatgatcctgcttttcagaaggatgaaaggactatgcttgctagaaaggagttgttcaaaaacactcttagaaaagcagcacatgcatggaagcgggtcaatgaacttaaactaacttatgaagaggcaactaagttaaggttttttgtggatgaaccttgctataccgatcttcattggggaatgtttgtacctgctataaaaggacaaggcaccgaagaacagcaagagaaatggttgccgcttgcccacaaaatgcaaatcattggctgctatgcacaaactgaacttggtcacggctccaatgtacaaggtcttgaaaccactgcaatatttgatccccaaacggatgagtttgttattcacagtcctacattgacgtccagcaaatggtggcctggtggtttgggtaaagtatccactcatgctgttgtttatgctcgtcttataactgatggtcaagaccatggggtacatggttttattgtccaattgcggagcttggaggatcactcacctcttccgggcataactgttggtgatatcggaatgaaatttggaaatggagcatacaacacaatggacaatggtgtgttaagatttgaccacgtgcgtatacctcgaaatcaaatgttgatgcgagttttgcaggtttcaagggaagggaaatgttcacactctgatgttcctcggcagctaatttatgggactatggtatatgttcggcaaaccattgttgctgatgcttcccttgctttatcaagggcagttactatcgccacaaggtatagttgtgtgcgtagacaatttggttcgcagaatgggggccctgagactcaggtgattgactataaaactcagcaaaataggctcttccctttgctggcttctgcctatgccttcagatttgttggtgaatggttacattggttgtacatggatgtgaccgaaagattgcaagccaatgacttctcaacactgccagaagctcatgcatgcactgctgggctcaagtctttgactacaactgccacttctgacgcaattgaagaatgtcgaaaattatgcggaggacatggctacctatgtagcagtggccttcctgaattatttgcagtttatgcccctgcctgtacgtatgaaggagacaacatggtgctgcttctacaggttgcaaggtttctagtgaagactgtatctctgctggggactggaaaacagccagtaggaacgacatcttatatggggcgagctgaacatctgatgcaatgtcattctaatgttgaaacagctgaagattggctaaagcctagtgcagttctggaggcatttgaagcaagggcatttagaatggttgttgcctgtgctcagaacttgagccagtttgcaaacccagaagaaggatttgcagaactgtcggctgatttagcagaggtagcagttgctcactgccaattaattgtagtttccaagttcattgataaactgaaacaagacattcctgggaagggggtaaaacaaatgttagaggtgctctgtaatgtatattcgctgtttcttcttcacaagtaccagggtgattttctcgctactggcagcatcacgaccaagcaggcttcactggcaactactcaattgagaaatttgtattcccaggtccggccaaatgcagttgcacttgttgattcattcaattacacggatcacttccttggttcaattcttggccgttatgatggaaatgtatatccaaagctttacgaggcagcatggaaggatccactgaatgattcggttgttcctgatggctaccatgagtatgttaggcctttgcacaagcaacagctacatatgtctaggctgtaaaacaatatttgaaactgttattcatgtcccaataaaaggttcccttatgatgctctacttggagggagcgatgactactgtgtcataatagtgctatattttattttttcctaggtaacttatttgttcctcaagttagaaggccgaataatagaggattgattgaaactgaatgtatcactggatggacaattcttggttatctaattcatgatttg

SEQ ID NO: 8517 - DNA, 2175 bp, Cyclamen graecum
tctgtctcactataaatagctacaacggatcgttgtttcctctctctacgtattcttcagttattgtgtgccatttgatctagagagagagatggaaggtgcgggcgtagatcacctagctgatgagaggaggaaggcgaatttcgacgtccagtcgatgaagatcgtctgggccggttccaaacgcaccctcgaagtctcggatcggatctccaagctcgtcgctgccgatcccgtgtttcgtaaagataacaggactacgcttggcagaaaggagttgttcaatgacaccctaagaaaagcagcttacgcatggaaaagaatcgcagagcttcgtctttctgaagaggaggcgggcatgatgagaaagtatgtagatcaagctgcatttactgatcttcactggggaatgtttatacccgctattaaaggacaaggaactgaggatcaacaaaagaaatggttgccattggcaaataagatgcaaattattggctgctatgcacaaactgagcttggccatggatccaatgtgcaaggtcttgagaccactgctacatttgatcccaaaatggatgagtttattattcatagtcctactctgacatcaagcaaatggtggcctggtggtttgggtaaggtgtctacacatgcagttgtatttgcccgtctaatactagagggccaggattatggagtgaatggtttcatagtgcaactacgaagcttggaagatcacttacctcttccaggtattactgttggtgatattggaacaaaatttgggaatggagcatataatactatggacaatggggtcttaagattcgaccgtgttcgcattccaagagatcagatgttgatgagggttgtgcaggttacccgtgaaggaaaatatgtgaagtctaatgctcctaggcagttactttatggtactatggtgtttgttagacaaacaattgtagctgatgcttctgttgctttatcgcgagcagtaactattgctacaaggtatagtgcagttcgtaggcaatttggatcacagaatggtggaccagagacacaggtcatcgattacaaaactcagcaaaacaggctctttcctttgctggcttctgcttatgctttcagatttgttggcgagtggttgaagtggttatatacagatgtcacccaaagattgcaagtcaatgatttttcaacgttgccggaggctcatgcttgcactgctggattgaaatctttgactactactgctactgctgatggtattgaagagtgccgtaaattatgtgggggccatggctatctttgtagcagtggtcttcctgaattgtttgctgtttatatccctgcctgtacgtatgaaggagataatgtggtgcttcttctacaggttgctaggcaccttatgaagactgttagggagctgggatctggcaagcaaccattgggcacagcagcttacatgggaagaatagagcaactcatgcagtgccattgcaatgttcagaaagctgaggactggttgatgcccgaagcagtattgaaggcatttgaggcaagggcagctagaatgtctgtggcatgtgctaaaaacttgagcacctatgaaaacccagaagaaggttttgatgaacttgcagctgatttggtggaagcggcagttgctcattgccaattgattgtggtgtccaagttcattgagaaactgcaacaggagattcccggaaagggtgtgaaacagcagctagaggtgctatgttatgtttatgctctccatctcgtccacaagtatcaaggcgatttcctctcgactggctccatcacccctaagcaagcttcctttgccaacgatcagctcagatctttgtactctgaggttcgtccaaatgcgattgcgcttgtggactccttcaattacactgatcactatctcagctcaattctcgggtgctacgatgggaatgtctatccgaagctatacgaagaggcttggaaagaccctctcaatgattctgttgtccccgagggttatcatcaatatattcggcctttgctgaagcaacagctgcgtacagccaaactctgaacagaaatatgccttctttgtcgtcagggagctcaaatacgttatgccaataaagctaaaattagctaccctatataaatagg

SEQ ID NO: 8518 - DNA, 2144 bp, Panax ginseng
gtctttgtatttgtattctgaatttaatttgaagacgaagaggaagaagaaggaagagtaaatggagggtgtagatcacttggctgatgaaaggaggaaggctcagttcgatgtggagtctatgaaatcgtttgggccggttcgcagcacgcttttgatgtctccgatcgcatgtccaagctcgttgctaatgatcctgcttttcagaaggatgaaaggactatgcttgctagaaaggagttgttcaaaaacactcttagaaaagcagcacatgcatggaagcgggtcaatgaacttaaactaacttatgaagaggcaactaagttaaggttttttgtggatgaaccttgctataccgatcttcattggggaatgtttgtacctgctataaaaggacaaggcaccgaagaacagcaagagaaatggttgccgcttgcccacaaaatgcaaatcattggctgctatgcacaaactgaacttggtcacggctccaatgtacaaggtcttgaaaccactgcaatatttgatcccaacggatgagtttgttattcacagtcctacattgacgtccagcaaatggtggcctggtgtttgggtaaagtatccactcatgctgttgtttatgctcgtcttataactgatggtcaagaccatggggtacatggttttattgtccaattgcggagcttggaggatcactcacctcttccgggtataactgttggtgatatcggaatgaaatttggaaatggagcatacaacacaatggacaatggtgtgttaagatttgaccacgtgcgtatacctcgaaatcaaatgttgatgcgagttttgcaggtttcaagggaagggaaatgtacacactctgatgttcctcggcagctaatttatgggactatggtatatgttcggcaaaccattgttgctgatgcttcccttgctttatcaagggcagttactatcgccacaaggtatagttgtgtgcgtagacaatttggttcgcagaatgggggccctgagactcaggtgattgactataaaactcaggcaaaataggctcttccctttgctggcttctgcctatgccttcagatttgttggcgaatggttacattggttgtacatggatgtgacggaaagattgcaagctgatgacttctcaacactgccagaagctcatgcatgcactgctgggctcaagtctttgactacaactgccacttctgatgcaattgaagaatgtcgaaaattatgcggaggacatggctacctatgtagcagtggccttcctgaattatttgcagtttatgcccctgcctgtacgtatgaaggagacaacatggtgctgcttctacaggttgcaaggtttctagtgaagactgcatctcagctggggactggaaaacagccagtaggaacgacatcttatatggggcgagctgaacatctgatgcaatgtcattctaatgttgaaacagctgaagattggctaaagcctagtgcagttctggaggcatttgaagcaagggcatttagaatggttgttgcctgtgctcagaacttgagccagtttgcaaacccagaagaaggatttgcagaactgtcggctgatttagcagaggtagcagttgctcactgccaattaattgtagtttccaagttcattgataaactgaaacaagacattcctggggagggggtaaaacaaatgttagaggtgctctgtaatgtatattcgctgtttcttcttcacaagtaccagggtgattttctcgctactggcagcatcacgaccaagcaggcttcactggcaaatactcaattgagaaatttgtattcccaggtccggccaaatgcagttgcgcttgttgattcattcaattacacggatcacttccttggttcaattcttggccgttatgatggaaatgtatatccaaagctttacgaggcagcatggaaggatccactgaatgattcggttgttcctgatggctaccatgagtacgttaggcctttgcacaagcaacagctacatatggctaggctgtaaaacaatatttgaaactgttattcatgtcccaataaaaggttcccttatgatgctctacttggagggagcgatgactactgtgtcataatag

SEQ ID NO: 8519 - DNA, 2369 bp, Ocimum basilicum
tgtgcgtgaatttttcacacacgcaataattaaaagcagatatcgacaactccaatcctaccatatcaactactactataaataagcacgcacattgggatgtacaaaccgagttctcgccctttctctcccctcgtataccccctctacacaagctcgaatatctaccgaaatccctctagctttgtggtggattagttagttagatttgtcagaaattgcagtggttttgctgttgatctgaacaaatatggcggaggttgactatttagctgatgagaggaagaaggcggagttcgatgtggattccatgaaaattgtgtgggctggctctcgtcacgacttcgaagtttcggatcgtatggccaagctcgtcgccaatgatcctgaatttcgaaaggataacagagctatgctgcctagaaaggaattgtttaaaaacactcttaggaaggcagcttatgcatggaaacgtattaatgaacttcgtctgacagaagaagaggcatctaagttgaggttttttgtagatgaaccggcttatactgatcttcattggggaatgtttgtaccagctataaaaggtcagggcactgatgaacaacagagaaagtggttgccattggcctataagatgcaaataattggatgctacgctcaaaccgaacttggtcatggctccaatgtgcaaggtctcgaaaccactgcaacatttgatgctcaaactgatgaatttgtgattcatagtcctacactgacctcaagtaaatggtggcctggaggactgggcaaagtatccacacatgctgtagtatatgctcgtctcattacggatggtaaagactatggcgttcatggtttcattgtccaactacggagcatagaagaccatagcccacttccaggaataatcgttggtgatattggaatgaaatttggaaatggggcatacaacaccatggacaatggcgtactgagattcaatcatgttcgtattccaagagatcagatgttgatgaaggtttcacaggtgacaaaagaaggaaagtttaagcaatctgacgtgccacggcagttagtttatgggactatggtgtatgttcggcaacagattgtggcagatgcttctcgtgctttagcaaaagctgtttgtattgctactaggtatagtgctgtacgtaggcagtttggatcacagaatggtggacctgagattcaggtcattgattacaggactcaacaaagcagactttttcctctgttggcttctgcgtatgcttttaaatttgttggtgaatggctgacctggttgtacaaggatgttactaaaagattgcaaaacagtgatttttcaacattgcctgaggctcatgcatgcactgcagggttgaagtcccttactacttctgtcactgccgatgggattgaagaatgtcggaagttatgcggaggccatggttacctccacagcagtgggcttccagaattatttgcagtttatgttccagcttgtacttatgaaggagacaacattgtgctgcttctacaggttgctaggtttctcatgaagactgtatctcagattggaagtggcaaaaagccagttgggacgatttcttatatgggaagagttgaacatttgttaaaatcacgctgcaatgtccaaagagctgaggattggctaaatcctggtcaagtagtggaagcttttgaggcgagagctgctagaatgtctgtttccagagctcaaaagctaagcacattttctgatcctgaaggagggtttgctgagctatcagcagagttagttgaggcagcagtggcacactgtcaactaattgtcgtctccaagtttcttgacaaattgcaacaagatattcctggtgaaggggtgaagcaacaactacaagcactatgtggcatatattacctctccctgctccacaagcaccagggcgatttcctcgcgaccaattacatcacccctaagcaggctgaacttgctaacgatcagctgcgggcgttgtatgccaaggttcgtccaaacgccgttgctctggttgattcgttcaactacacagaccatttcctgggctcaattctgggttgctatgacggtaatgtgtaccccaaactttatgaggctgcatggaaggagcctctgaatgagacagttgtacctgatggataccaggagtacatcaggccattgcttaagaaacagctccatggtgctaaattgtaggtatttataatgttgggaccggaataagagcatcgagttgcaactcactgtttaactctattttttagaataacaaatttgtcgagactcacttaagacttgatttatgaatccgatacatttt

SEQ ID NO: 8520 - DNA, 2598 bp, Trifolium pratense
caaaccatttatttggtgttgaaatttcagaactgcagaaaacagagtttgttagttcacacttcacagttccattctcaatcaaaagaatatggaaggcgttgatcatttagctttcgagaggaaaaaagcacaattcgatgtaaacgatatgaagattgtttgggctggttctcgtcaagaatttgaactttccgatcggatttctcgtcttgttgctagcgatccggtattccaaaaggataacagaaccgcgcttgatagaaaggagttatttaagaacactttgagaaaagcagctcatgcatggaaaaggatcatcgagcttcgtcttaatgaacaggaagcttctaagcttagatcctttgtggatcagcctggttttacggatcttcattggggaatgtttgtgcctgctatcaaaggacaaggaacggatgagcagcaggaaaagtggttgcctctggctaataatatgcaaataattggttgttatgcccaaaccgaacttggtcatggatccaatgttcaagggctagaaacaactgcaacatttgatccaaaaacagacgagttcattattcacagccccacattgacttccagcaaatggtggcctggtgggttgggtaaaatatccacgcatgctattgtttatgcccgtcttattactgatggtcaagaccatggagtgcacggtttcattgtccagctccggagcttggatgatcacttgcctcttcccggcataactgttggagatattggaatgaaatttggaaatgcagcatataactccatggataatggagttctacgttttgaccatgtacggattccaaggaatcaaatgttaatgagggtttcacaggttaccagagaaggaaaatttgtacattccggtgttccaagacagttaatttatggaactatggtatatgtgaggcaggcaattgtagctgatgcatcaattgcgttgtcacgagcagtttgtattgcgaccaggtatagtgctgttcgaagacagtttggatctcaaaagggaggtcctgaaacacaggtgattgattacaaaacacagcaggctagactcttcccattgctagcttctgcatacgctttcagatttgttagtgagtggctgaaatggctttacacggatgtgactcaaaaattacaagccaatgatttttcaacattgcccgaggcccatgcatgcactgcagggttgaaatccttgactacttccgcaactgctgatggaattgaagaatgccgtaaactttgtggcggtcatggttatctttgtagcagtggtctacctgagttgtttgcagtttatgttcctgcatgcacatatgaaggagacaatactgtcctacttttacaggtagcaaggtatcttatcaagactataactcagttgggttctggaaataaacctgttggtaccacggcttattttgctcgcgtggaacaattgatgcaatatcaatctgatgttaaaagagctgaggattggttgaagcctaatgtagtgattgaagcatttgaagctagggctgccaggatgtctgctgctgttgctcaaaatcttagcaagttcactgatcccgaagaaggttttcaagaactctcagctgatttagttgaggcagcagctgctcattgccagttaattgttgtctccaaatttatagagaagctgcagcaagatatacctggaaatggtgtaaaacagcaactagaagttctttgcagcgtttatgctttatttcttcttcataatcatctgggagattttctttccactggctgcatcactcaaaaacaaggatcacttgcaaatgagcagttgaggtccttgtattcacaggttcgtcctaatgcaattgcgcttgttgatgcgtttaattacactgatcacttgcttggttcggttcttgggcgctatgatggaaatgtgtaccctaagttgtatgaagaggcttggaaagatcctttgaacgattcagttgttcctgatggctttaaagatcatgttcaaccaatacttaggcaacaaatacgcaatgctagactctagattattttataattggggtagtggtactatttttattgaaaatagtcaataaagttgcatgaaatttggataaataaatgtagatgaacacataccactaccagttgaactttgatgataggtttatttccatggtttttgaaaaagaaagtgtatttccatggttaataatattcatgagaggaagtagcaattaggtgtatctggaatggaactagaacatcattatttagttatgcatacttgacgactcttgtttcatcgatcttgtttttgtggcaagtacatttcttgggccacaacacttgtttcaggcggtccatgtacccccgtgactgtgatagtgacaagtgttacctgatggcaggacaacattgtcggacggtccatgtgcccctatcgagcagtaatcatatgtaatcaaactgtgtccatcgtatgatttgctttgttaagtgtgaattctgtaattcgattcaacttgtaaattgatctttggccagtccggaaca

SEQ ID NO: 8521 - DNA, 2181 bp, Euphorbia peplus
cggaaaaaatgggagttgatcacttagctacggagaggagtaaagctcaatttgatgttgaggatatgaagatcgtatgggctggttcccgccatgccttggaagtctccgatcgtatggctcgtcttgtcgccaccgatccggcctttcgtaaggataacagacctatgctaggcaggaaagagttatttaagaacactctgaggaaagcagctcatgcatggaaacgtatcattgagcttcgccttactgaggaggaggctggtagattaaggttctatgtagatgaagcggcatttacggatcttcattggggaatgtttattccagcaattaaaggacagggcactgaagagcagcaaaagaagtggcttcctttggcacaaaagatgcaaataattggctgctatgcacaaactgaattaggtcatggctccaatgttcaagggcttgaaaccactgctacatttgatcaagagactgatgaatttgtcattcatagtcctactttgacttcaagcaaatggtggcccggtggattgggtaaagtttctacacatgctgttgtttatgcacgtcttatgattggtggtaaacaacgtggagtgcatggctttattgtccagctcaggagtttggatgatcacatgcctcttccaggcataactgttggtgatattggaatgaaatttggtaatggagcatataataccatggacaatggtgttttaagatttgataatgtgcgcatcccaagggatcaaatgttgcagagagttttgcaggttactagggaaggaaaatgtgtggaatctaatgttccacgccagttgatctatggcactatggtgtatgtgcgacagacaattgtagctgatgcttcctgtgctttatcacgggcagtttgtattgctacaaggtacagtgctgttcgcagacaattcggtgccgatgatggcggtattgaaacccaggtgattgattacaagacacagcaaaaccggctcttccctttgctggcttctgcatatgctttccgatttgtgggtgaatggttaaattggctttacacggatgtgacccagaggctgcaagccaacgacttctcaacattgcctgaagctcatgcatgtactgctgggttgaaatccttgacaacaactgccactgctgatgctattgaagagtgtaggaagctttgtggtggacatggttatctttgttccagtgggcttccagagttgtttgcagtttatgttccagcctgtacatacgaaggagacaatgttgtgctacttttacaggttgcgaggtttctcatgaagactgtttctcaactgggttctgggaagaagcctgttggaacaatatcatacatggcacgagttgaggatcttttgcagtgtcgttctagtgttacaaaggctgaagattggttaaagcctaatgttgtgttggaggcgtttgaagccaggtctgctaggatgtgtgttgcacgtgctcaaagccttagcaagttttcaaatcctgaacagggttttgctgagctatcggctaatctagttgaagcttcagtcgctcattgccaattgattgttgtttccaagttcattgagaaactacaacaaaatatacccggaaaaggggtgaaagagcagttgactaatctctgctacatctacgctttgaaccttgttcagaagcatttaggtgattttctctctaccgggtgcatcacacccaagcaagctacacttgcgaatgatcagctccgagctttgtacactcaggttcgcccaaatgcaattgcacttgtcgatgcattcaactacaccgatcactatctcggctccatcctcggatgttatgatggaaatgtctaccagaaactatatgatggagcatggaaggaccctctaaatgactcagttgtgcccgatggataccatgagtatgtccgtccaatgctgaagcaacagctacgcaatgcaagactataacaggtccctgaagttatgatacactacacaggttatgagtaataaattgaaggtaataaatcagcctaaaaattcactagcaaggtgaagattggatgttagttagtaaaaaactgttcaaagataagttatttttacgtgcttgttcataatatttataaaatcgatctgtttgctttac

SEQ ID NO: 8522 - DNA, 2234 bp, Flaveria ramosissima
tggagggagttgattacttgagtgatgagaggaacaaggcagaattcgatgttgaatctatgaagattgcttgggctggctctcgtcaagcttttgagctctctgatcgtatggcaaagctcgtagctaatgatcctgcctttgaaaagtttacaaggcctatgctgggtaggaaagagttgcttaagaatactcttagaaaagctgctcatggatggaagttgatcgttgatcttcgtctaacggaagaagaggccaaatggttgcgactatacatcgatgaacctgcttacactgatcttcattggggaatgttcatcccggctattgaaggacaaggcactgaagaacagaaaaagaaatggttgccattggctcaaaagatgcaaattattggctgttatgcacaaacagaacttggtcatggctccaatgtgcaaggtctggaaacgactgctacatttgatccccaaacggatgagtttattattcacagtcctactctaacatccagcaaatggtggcctggtggattgggtaaagtttcaacacatgctgtcgtttatgctcgtctcatagtaggtggtgaattccatggagttcatggctttattgtccaactaaggagcttggatgatcactcacctctttctggtgttactgttggtgatattgggttgaagtttggaaatggggcgtataacaccatggataatggtgttttaaggtttgatcatgtgcgtatccctagggaccaaatgttgatgagggtcacccaggttacaaaagaaggaaaaatcgtgcaatctgatgttcctcgacaacttatttatggaactatggtgtatgttaggcaaacaattgtggctgatgcttccaaagcattatcgcgtgcagtttgtattgctacaagatatagtgctgttcgtagacaatttggctcacgtaatggtgggcccgaaacccaggtgattgattataaaactcagcaaagcagactattccctttgctggcatctgcgtatgccttcagatttgtaggcgaatggttaaaatggttgtacatggatgttaagcaaagattagcagctaatgacttttcaacattgcctgaggcccatgcatgtactgcagggttaaagtccttgacaactactgcaacagctgatggaattgaagaatgtagaaaactatgtggtggtcatggctaccttgttagtagtgggcttcccgaactatttgcggtttacattcctgcttgtacgtatgaaggggacaatgttgttctactgctgcaggttgcgaggtttcttgtgaaaacagtctcagagcttggttacaaaaaaccagttgggactacagcttatatggggagagtagcatctctgatgcagaataattgtgctgttcaaactgctgagggatggctaaaccctggtgcaataatggaagcatttgagtcaagggctgctagaatggctgttcgatgtggtcgacaattagccaagtttgaaaatccagaagaaggttttgcagaactatcagctgatttggttgaggcatcagttgctcattgccaattgatcattgtgtccaaatttattgagaaattgcaacaagacatccccggaaagggagtgaagcaaacattagaggtgttgtgttacgtctatgcattgtttcttctccacaagcatcaaggtgatttcttggccaccgggtatcttacacccaaacaggcctcacttgctaatgatcaactcagaacattgtattctaaggtccgcccaaatgcaatagcacttgttgattcattcaactacactgatcactaccttggttcaattcttgggcgttatgatggaaatgtgtatccaaaactctatgaggctgcttggaaagatcctcttaatgactcagatgtagtcgatggcttccatgaatacgtccaaccacttctaaagcagaagctacgcacgtctaagctatagaacgcccatggctgcactgagtgacatattgcttgggcacatctcctttgtttcagtaagtgttcaactatggttttagttgttgttttaacactggatattaagttgaaggagcactatagagcttttacgtcttatatttatgctggtctgtgacattacatagtatgcaacatgcacgacaattgttgtgctttagttgttgattatgtgtcgaaagtgtgcattagaacattactattc

SEQ ID NO: 8523 - DNA, 2457 bp, Gossypium raimondii
tattatagtgaagcgcgtatctataaggtcattcctatctagtttcgttgttcctttttagctttctttttttcttttcgcattgtgttttttttctcattatttataaccaaatctgaaattacagaatacgaattctctagctttttttttttgaattttcaatttggatcgagaaaaaaaaatggaggcattggattaccacgcggaagaaaggcgcaaggcggagttcgatttggaagagatgaagatcgtttgggctggttctcgtcaaaactatgaaatctcggatcgaatggctcgtctcgtcgctagcgatccggtctttcgaaaggataacagaactatgctaagcaggaaggacttgtttaaagatactttgagaaaagctgctcatgcatggaagcggataattgagcttcgtctctctgaagaagaggcccatatgctaaggtcttatgtggatcagcctgctttcacagatcttcactggggaatgtttatacctgcaattaaaggacaaggaactgaggaacagcatgagaagtggttgccaatggcatataagatgcaaataattggatgctatgcacaaactgaacttggtcatggctccaatgtccaagggcttgagaccactgcaacatttgatcctcagactgatgaatttgtcattcatagtccaacattgacttcaagcaaatggtggcctggtggattgggtaaagtatccacacatgctgtggtctatgcacgtcttataacaggtgctcaagaccatggagtgcatggttttattgtccagctgcgtagtttggatgatcactcacctcttccaggcataacagtaggtgatattggaatgaaatttggaagtggggcatataacagcatggacaatggtcttctgagatttgatcatgtgcgcattccaaggaaccaaatgctaatgcgtgtttcacaggttacaagagaagggaaatttgtgcaatctgatgtgcctcgccagctggtttatggcactatggtctatgtccgacaaacaattgtatctgatgcttcttgtgctttagctagagcagtttgtattgcaacaaggtacagtgctgttcgtagacaatttggttcccagaatggcggtccagagacccaggtgattgactataaaactcagcaaagcagactctttcctttgcttgcttctgcctatgctttcagatttgttggtgagtggctgaaatggctatacactgatgtgacacaaagattgcaagccaatgatttctccacattacccgaggctcatgcatgtactgcagggttaaaatctatgactacttctgtaactgcagatgctattgaagaatgccggaaattatgtggtggtcatggttatctctctaacagtgggctccctgagttatttgcagtttatatacctacctgtacctatgaaggagacaatgttgtgctgctcttacaggttgcaagatttctcatgaaaaccgtttcccagctggggtcagggaagaagcctgttggaacaacagcttacatgggacgagcagaacacctcatgcagtgccgctgtgaagttgaaagggctgaagattggctaaagccaagtgtaatattggaggcatttgaagcgagggcttttaggatgtctattgcctgcgcaaaaaaccttagcaaattttcaaacccagaagacggtttttctgaactttcgcctgatttgcttgaggctgcaattgctcattgtcaattaattgttgtttccaagtacattgagaaactgcaacaagacataccagggaaaggagtgaaaagacagttggagattctgtgtaatgtatacgctttgcatcttttacacaaacatctcggtgatttcgtcacaaccagctgcattaccccgaagcaaggtgcactagcaaatgaacagctgagattgttgtactcccaggtccgtccaaatgccattacccttgtagatgcattcaattacaccgaccactaccttggctcggtcctcggttgctataatggaaacgtctatcaaaggctctatgaggaagcatggaaggatcctttgaacgatacagtcgtgccagatggttaccttgaatatgttcggccaatattgaagcaacatattcgcactgcaagactctaacaaataaccaaagcaccgtgccattttgaaccatatattaaggtcattaatgaataaagtgaagagatatctaccacctcaaaggtcaggtatcgctgctctagacttctagtatctccaatctcttggattatggcattagttatttacttaaaaattgtggtgtgataaatttaaggatatacttttagtaagctcatttatttattttgtgttcttgggatttaaaagcaaacttcaatttaatttataaacatttttttgaagtgcgatcatct

SEQ ID NO: 8524 - DNA, 2335 bp, Gossypium hirsutum
tttttattgaattttcaatttggatcgagaaaaaaatggaggcattggattaccacgccgaagaaaggcgaaaggcagagttcgatttggaagagatgaagatcgtttgggctggttctcgtcaaaactatgaaatctccgatcgaatggctcgtctcgtcgctagcgatccggtctttcgaaaggataacagaactatgctaagcaggaaggacttgtttaaagatactttgagaaaagctgctcatgcatggaagcggataattgagcttcgtctctctgaagaagaggcccatatgctaaggtcttatgtggatcagcctgctttcacagatcttcactggggaatgtttatacctgcaattaaaggacaaggaactgaggaacagcatgagaagtggttgccaatggcatataagatgcaaataattggatgctatgcacaaactgaacttggtcatggctccaatgtccaagggcttgagaccactgcaacatttgatcctcagactgatgaatttgtcattcatagtccaacattgacttcaagcaaatggtggcctggtggattgggtaaagtatccacacatgctgtggtctatgcacgtcttataacaggtgctcaagaccatggagtgcatggttttattgtccagctgcgtagtttggatgatcactcacctcttccaggcataacagtaggtgatattggaatgaaatttggaagtggggcatataacagcatggacaatggtcttctgagatttgatcatgtgcgcattccaaggaaccaaatgctaatgcgtgtttcacaggttacaagagaagggaaatttgtgcaatctgatgtgcctcgccagctggtttatggcactatggtctatgtccgacaaacaattgtatctgatgcttcttgtgctttagctagggcagtttgtattgcaacaaggtacagtgctgttcgtagacaatttggttcccagaatggcggtccagagacccaggtgattgactataaaactcagcaaagcagactctttcctttgcttgcttctgcctatgctttcagatttgttggtgagtggctgaaatggctatacgctgatgtgacacaaagattgcaagcgaatgatttctccacattacccgaggctcatgcatgtactgcagggttaaaatctatgactacttctgtaactgcagatgctattgaagaatgccggaaattatgtggtggtcatggttatctctctaacagtgggctccctgagttatttgcagtttatatacctacctgtacctatgaaggagacaatgttgtgctgctcttacaggttgcaagatttctcatgaaaaccgtttcccagctggggtcagggaagaagcctgttggaacaacagcttacatgggacgagcagaacacctcatgcagtgccgctgtgaagttgaaagggctgaagattggctaaagccaagtgtaatattggaggcatttgaagcgagggcttttaggatgtctattgcctgcgcaaaaaaccttagcaaattttcaaacccagaagacggtttttctgaactttcgcctgatttgcttgaggctgcaattgctcattgtcaattaattgttgtttccaagtacattgagaaactgcaacaagacataccagggaaaggagtgaaaagacagttggagattctctgtaatgtatatgctttgcatcttttacacaaacatctcggtgatttcgtcacaaccagctgcattaccccgaagcaaggtgcactagcaaatgaacagctgagattgttgtactcccaggtccgtccaaatgccattacccttgtagatgcattcaattacaccgaccactaccttggctcggtcctcggttgctataatggaaacgtctatcaaaggctctatgaggaagcatggaaggatcctttgaacgatacagtcgtgccagatggttacctcgaatatgttcggccaatattgaagcaacatattcgcactgcaagactctaacaaataaccaaagcaccgtgccattttgaaccatatattaaggtcattaacgaataaagtgaagagatatctaccacctcaaaggtcaggtatcgctgctctagacttctagtatctccaatctcttggattatggcattagttatttacttaaaaatcgtggtgtgataaatttaaggatatacttttagtaagctgatttatttattttgtattcttgggatttaaaaagcaaacttcaatttaatttataaacattttttagaagtgcgatcatctagctataatatataattcaagaaaaa

SEQ ID NO: 8525 - DNA, 2352 bp, Malus domestica
gaattaataattagacaccaaagcaaatcgtcccatgttttctcatatatagagtggattgttcacggacgctgacgcttcttctcatcggttcctcttacaaatcacaaaaccagaagcggaaggagagagagcggaaatctgagttttcgattgattctgtgaaaatggagggggtggatcatttggcgcaagaacggagcaaggcgcagttcgatgtcgaccagatgaaggtcatctgggccggctctcgccacaccttggaagtctccgatcgaattgctcgcctcgtcgctagcgatccggtctttagaaaggataacagaacattgctgagtaggaaggatttgtttaaaaacactctgcaaaaagcagctcatgcttggaaacggatcacagagctgcggctatccgaggaagaggcatactggttaaggcattatgtggatcaaccagcgtatacggatcttcactggggaatgttcgtgccagctattaaaggatcaggtactgaggagcagcaaaagaagtggttgccgctggcatacaaaatgcaaatcattggttgctatgctcagactgaacttggtcatggctccaatgttcaagggctggagaccactgcaactttcgatccaaagactgacgagtttgttattaatagtcctactctcacatcaagcaaatggtggcctggtggtttaggaaaggcttctacacatgctgttgtttatgcccgtcttatcactgatggtcaagaccatggagtgcatggtttcattgtccaacttcggagcttggatgatcacttaccacttccaggcataatagttggcgatattgggatgaaatttggaagtggggcatacaactccatggacaatggtgttcttagacttgatcatgtccgtataccaagggaacaaatgttgatgagggtctcacaggtcacaagagaaggaaaatacgtacaatccaatgttccacgacagctgctgtatggaactatggtttatgtgcggcaaacgattgtagctgatgcttcctctgctttatcacgggcagtatgtattgctactaggtatagtgccgttcgtcgacaatttggttcacaagatggtggccttgaaacacaggtcattgattacaagactcagcaaagtaggctcttccctttgctggcttctgcctatgcttttagatttgttggtgagtggttgaaatggctatacacagatgtgacagagaagttgcaagctaatgatttctcgacattgcccgaggctcatgcatgcactgcgggtctgaaatcattgaccacttctgcaactgctgatggcattgaagaatgccggaaattatgtggtggccatggttatctatctaacagtgggcttcctgaattatttgccgtttatgtaccagcatgtacatatgaaggagacaacattgttctacttctacaggttgcaaggtttcttatgaagactgttgctcagctaccatctggtaaaaaacctgttggaaccacaacttatatgggccgtgctcaacatttgatccaatgtcgttctagtgctcaaaaagcggaggattggttgaaccctagtgtgatacttgaggtatttgaagcaagggctataaggatgtcgattgcctgtgctcaagaccttagcaagttttcaaatcaagaagaaggctttgcagaactctcatctaatttagctgaggcagcagtagctcattgccaattaattgttgtttccaagttcattgataaagtccaacaagacataccggggaagggggtgaaaaaacagctggagatcctctgcaacatctatgctttatacactattcacaagcatttgggtgatttcctctccactggaagcctcacagcaaagcaagcttcacttgcaaatgatcaacttagatctctttattcccagctccgtcccaatgccattgccctcgttgatgcatttaatttcaccgaccactacctcggctcaattctaggccgctatgatggtaatgtgtacccgaatctctatgaggaggcttggaaagatcctcttaatgagtcagttgtgcccgatggctatcgggaatatgtccagcctctgctgaagaaccagctccgtaacgcaagactatgattaatagtgtgatgggggattttgtcgtcgccaataaaagcaccagcaggtggttgctgatcaacatcgaatactcgtagttatgtagcgtgaaacttttcttaagtaattgtaatgatttgttcctgaatatgggaaacaatgtaatcttaataactttatgaatgtggccaacagagtataaataaaa

SEQ ID NO: 8526 - DNA, 2303 bp, Momordica charantia
acgatttggcttgagatttgtcgcgtgttcgcaatttccaaagcattcttcggagcttttcttctttttcgatttgggattgtcgaaatccactctctctttcccagttaagcttcttttttgcatttttggagtgagatttcgaatttgtgtgtcgaacagatggagggtgtggatcatctttcccatgagaggagaaacgcccaattcgacgtcgatgagatgaagatcatttgggcgggttctcgtcatgcatttgaagtatctgatcgaatgtctcgattagttgctaatgatccggtctttcgaaaggacaatagagtccaattgggcaggaaggagctgtttaagaacactctcaggaaagcggcttatgcgtggaagcggattattgagcttaaactttctgaggaggaagctggtagattaaggttctttgtggatgagccagcatatacagatcttcactggggaatgttcgttccatttcttaaagggcaaggttctgatgagcagctacagaagtggatgccattggcgtataagatgcaaataatcggttgctatgctcaaactgaactcggtcacggttcaaatgttcaagggcttgagacaactgcaacatttgaccaacggacagatgaattcattatacatagtcctacacttacttcaagcaaatggtggcctgggggtctgggtaaggtttcgacacatgcagttgtattcgctcgtcttattaccgatggtcaagactatggagtgcatggtttcctagtccagataaggagcttggacgatcactcaattctaccaggcataaccattggagatattggtatgaaatttgggaatgcagcttacaatactatggataatggggtcatgcaatttgatcacgtgcgcatcccgcggaaccaaatgttgatgaggttttctcaggttacaagggaagggaaatatgtgcaatcagatgttccacgacaactagtttatggcactatggtattcgtgaggaagacgattgtagttgatgcttcaaatgccttatcacgtgcagtctgtattgctactaggtacagcgctgttcgtagacaatttggatcacagaatggtgatgtagaaacccaggtgattgattataaaacacagcaaagtaggctattccctttgctggcttctgcctatgctttcagatttgtcggtgaatggttacaatggttatatacggatgtaacccaaagactggcagccaatgatttctcaacactgcccgaggcgcatgcatgcactgccgggttgaagtcgataacaacagctgcaactgctgatggaattgaggagtgccggaagttatgtggtggccacggttacctttgtagcagtgggcttcctgagttgtttgcagtttatgtccctgcctgtacttatgaaggagacaatattgtgctacttttacaggttgcacgaattctcatgaagactgtggcccagttggcatctgggaagaagcccgtcgggacgatatcttacatgggacgagcacaacatctgttggaatgctctagcaatgtccagaaagctgaggactggttaaagcctagtgttgttctcgaggctttcgaagcacgggccactaggatgtctgtttcatgtgccaaaaaacttagcaagtttaccaatcaagaagaaggtttccaagaactttctcctagtttagttgaggctgcagttgcacattgccaattgattgttgtttccaaattcattgagaaacttcaaggagacatacctggaaagggagtgaaagatcaactccaaaaactttgcggtatatatgctttgtatacactacacaaacacttgggagattttctttccacttccaccatcactcccaaacaggcctcacttgctgatgatcttctcagatctctatattcccaggttcggcctaacgcaattgccttagtcgatgcgtttaactacaccgaccattacctcggctcaatccttggccgctatgatgggaatgtttacccaaatctctacgaggcagcatggaaggatcctctgaacgactccgccacaccggatggctaccatgaatatatcaaaccgttgcttaagcagcagctccgaaatgcaaggctatgaagaggggacgctgtgctgaattgttatgcccttgataattgtaataaaagcatggattgagattggtattttatactgctgtatggtttagcattattcttaatcgaattgttgatgatcaatttaaagtttctatcttctctttg

SEQ ID NO: 8527 - DNA, 2391 bp, Flaveria ramosissima
acaatttggatttcttcttcactgtctctgacgtctctctaatccccgtatattccattacttattttcttggatttaggctctaatttttgaagatcaaatggagggagttgattacttgagtgatgagaggaacaaggcagaactcgggataggtgaatctatgaagattgcttgggctggctctcgtcaagcttttgagctctctgatcgtatggcaaagctcgtagctaatgatcctgcctttgaaaagtttacaaggcctatgctgggtaggaaagagttgcttaagaatactcttagaaaagctgctcatggatggaagttgatcgttgatcttcgtctaacggaagaagaggccaaatggttgcgactatacatcgatgaacctgcttacaccgatcttcattggggaatgttcatcccagctattgaaggacaaggaactgaagaacagaaaaagaaatggttgccattggctcaaaagatgcaaattattggctgttatgcacaaacagaacttggtcatggctccaatgtgcaaggtctggaaacgactgctacatttgatccccaaacggatgagtttatcattcacagtcctactctaacatcaagcaaatggtggcctggtggattgggtaaagtttcaacacatgctgtcgtttatgctcgtctcatagtaggtggtggattccatggagttcatggctttattgtccagctaaggagcttggatgatcactcacctcttcctggtgttactgttggtgatattgggttgaagtttggaaatggggcgtataacaccatggataatggtgttttaaggtttgatcatgtgcgtatccctagggaccaaatgttgatgagggtcacccaggttacaaaagaaggaaaaatcgtgcaatctaatgttcctcgacaacttatttatggaactatggtgtatgttaggcaaacaattgtggctgatgcttccaaagcattatcacgtgcagtttgtattgctacaagatatagtgctgttcgtagacaatttggctcacgtaatggtgggcctgagacccaggtgattgattataaaactcagcaaagcagactattccctttgctggcatctgcatatgccttcagatttgtaggcgaatggttaaaatggttgtacatggatgttaagcaaagattagcagctaatgacttttcaacattgcctgaggctcatgcatgtactgcagggttaaaatccttgacaactactgcaacagctgatggaattgaagaatgtagaaaactatgtggtggtcatggctaccttgttagtagtgggcttcccgaactatttgcggtttacattcctgcttgtacgtatgaaggggacaatgttgttctactgctacaggttgcgaggtttcttgtgaaaacagtctcagagcttggttacaaaataccagttgggactacagcttatatggggagagtagcatctctgatgcagaataattgtgctgttcaaactgctgagggatggctaaaccctggtgcaataatggaagcatttgagtcaagggctgctagaatggctgttcggtgtggtcgacaattagccaagtttgataatccagaagaaggttttgcagaactatcagctgatttggttgaggcatcagttgctcactgtcagttgatcattgtgtccaaatttattgagaaattgcaacaagacatccccggaaagggagtgaaacaaacattagaggtgttgtgttatgtctatgcattgtttcttctccacaagcatcaaggtgatttcttggccaccgggtatcttacacccaaacaggcctcacttgctaatgatcaactcagaacattgtattctaaggtccgcccaaatgcaatagcacttgttgattcattcaactacactgatcactaccttggttcaattcttgggcgttatgatggaaatgtgtatccaaaactctatgaggctgcttggaaagatcctcttaatgactcagatgtagtcgatggcttccatgaatacgtccaaccaattctcaagcagaagctacgcacgtctaagctatagaacgcccatggctgcactaagtgacatattgcttgggcacatctcctttgtttcagtaagtgttcaactatggttttagttgttgttttaacactggatattaagttgaaggagcactatagagcttttacgtcttatatttatgctggtctgtgacgttacatagcatgcaacatgcacgacaatcgtcgtgctttagttgttgattatgtgtcgaaagtgtgcattagaacattactattctgagtgaaataaaactattaaataattgtctgtactaagtcagttgaatggta

SEQ ID NO: 8528 - DNA, 2370 bp, Flaveria ramosissima
aatcatctaacccttttggtctatcagaagacccacataatcaatgtcaacattcatcacgaactcacatctcaattttgtgatttccttctgttttctagggatttaggttttgatttgaagacgaaatggagggagttgattacttgagtgatgagaggaacaaggcggagttcgatgttgaatctatgaaaattgcttgggctggctctcgtgaagcttttgaactctccgatcgtatggccaagctcgtagctaatgatcctgcctttgaaaagtttacaaggcctatgctgggtaggaaagagttgcttaagaatactcttagaaaagctgctcatggatggaagctgatagttgatcttcgtctaactgaagaagaggccaaatggttgcggctatacatcgatgaacctgcttacactgatcttcattggggaatgttcatcccggctcttgaaggacaaggcaccgaagaacagaaaaagaaatggttgccattggctcaaaagatgcaaattattggctgttatgcacaaacagaacttggtcatggctccaatgtgcaaggtctggaaacgactgctacatttgatccccaaaaggatgagtttatcattcacagtcctactctaacatcaagcaaatggtggcctggtggattgggtaaaatttcaacacatgctgtcgtttatgctcgtctcatagtaggtggtgaattccatggagttcatggctttattgtccagctaaggagcttggatgatcactcacctcttcctggtgttactgttggtgatattgggttgaagtttggaaatggggcgtataacaccatggataatggtgttttaaggtttgatcatgtgcgtatccctagggaccaaatgttgatgagggtgacccaggttacaaaagaaggaaaaatcatgcaatctgatgttcctcgacaacttatttatggaactatggtgtatgttaggcaaacaattgtggctgatgcttccaaagcattatctcgtgcagtttgtattgctacaagatatagtgctgttcgtagacaatttggctcacgtaacggtgggcccgagacccaggtgattgattataaaactcagcaaagtagactattccctttgctggcatctgcttatgccttcagatttgtaggcgaatggttaaaatggttgtacatggatgttaagcaaagattagcagttaatgacttttcaacattgcctgaggcccatgcatgtactgcagggttaaagtccttgacaactactgcaacagctgatggaattgaggagtgtagaaaactgtgtggtggtcatggctaccttgttagtagtgggcttcccgaactatttgcggtttacattcctgcttgtacgtatgaaggggacaatgttgttctactgctacaggttgcgaggtttcttgtgaaaacagtctcagagcttggtcacaaaaaaccagttgggactacagcttatatggggagagtagcatctttgatgcagaataattgtgctgtacaaactgctgagggttggctaaaccctggtgcaataatggaagcattcgagtcgagggctgctagaatggctgttcaatgtggccgacaattagccaagtttgaaaatccagaagaaggttttgcagaactatcagctgatttggttgaggcatcagttgctcactgccaattgatcatcgtgtccaagtttattgagaaattgcagcaagacatccccggaaagggagtgaagccaacattagaggtgttgtgttacgtatatgcattgtttcttctccacaagcatcaaggtgatttcttggccaccgggtatcttacacccaaacaggcctcacttgccaatgatcaactcagaacattgtattctaaggtccgcccaaatgcaatagcgcttgttgattcattcaactacactgatcactaccttggttccattcttgggcgttatgatggaaatgtgtatccaaaactctatgaggctgcttggaaagatcctcttaatgattcagatgtagtagatggcttccatgaatacgtccaaccaattctcaagcagaagctacgcacgtctaagctatagaacgcccatggctgcactaagtgacatattacttgggcacatctcctttgtttcagtaagtgttcaactatggttttagttgttgttttaacactggatattaagtttaaggagcactatagagcttttacgccttatatgtatgctggcctgtgacgttacatagtatgcaacatgcccgacaatcgtcgtgctttcgttgttaattatgtgtcgaaagtgtgcattagaacattaccattctcgatta

SEQ ID NO: 8529 - DNA, 2002 bp, Solanum phureja
ttttgtattctgtttcatccttgagagagagagatggagagaatagattacttggctgatgagaggaagaaagctgagttcaatgttgatgagatgaaaattgtttgggctggttctcgccgtgcttttgaagtttcagattatatctccaagcttgttgctgatgatcctggcttcagtaaggaggaaaggaccatgcttcccaggaaagaactatttaagaacactctaaggaagtcagcatgctcatggaaacacatcattgatcttcagctttctgaagaagaagcagaaaggttaagatatttcgtcgatgagcctgcttttattgattctcatttgggagtgtttatacccgctataaaaggacagggcacgaaggaacaactgaaaaagtggttgccgttggcatacaagatgcaaattattggctgctatgctcaaactgaacttggacatgggtccaatgttcaaggccttgaaaccactgccacattcgatccccaaacagatgaatttgtcatgcatagtccaacactgacatcaagcaagtggtggcctggtggattgggtaaagtctctacccatgcgattgtgtatgctcgtcttataacagatggtatagatcatgggataaacggttttattgtccaactacggagcttggaggaccacaaacctcttccaggcattactgtcggagatattggaacaaaatttggaaacggggcatacaataccatggataatggggtactaagatttgatcacgtgcgtattccaagagatcaaatgctgatgagggttgcacaagttaccaaggacggaaaatatgtccaatctgatgttcctcgacaacttctctatgtgtccatggtatatactcgtcaagaacttgtaacatatgcttctggtgctttgtctcgggcagtgtgtattgcaacgagatatagtgctgttcgtagacaatttggttctcaaaatggtggacaagaaattcaggtgattgactacaaaactcaacaaagcaggctcttccccttgttagcttctgcatatgccttcagatttgttggtgagtggctgaaatggttttacactgatgtaactcaaagactgcaagcaaatgatttctcaacgctgcctgagttgcacgcgactacagcaggaataaagtctttgacaaccactgccactgctgatggaattgaagaatgccgaaagttgtgtggaggtcatggttatctttgtagcagtggacttccagaattatatgccgtttatgtccctgcctgtacatttgaaggagataacgtcgtgctactgcttcaggttgcaaggtttcttatgaaaactgtttcacagctgagctccggaaagaagccaacgggtaccataacttatatggggaaaattgaacacttgatgcaatgccattctgatgtggaacaagccaaggactggctgaaacctagtgcaatattggaagcatttgaatcaagggctgccaggatgtctgttgcctgtgctcagagtcttaccaagtttgataatccagaagaaggctttcaagaacttgcacctgatttagttgaagcagcacttgctcattctcagttgattgttgtctccaagtttatcgaaaagctgcaacaagacattccaggggaaggcgttaagcaacagctggaggtgctttgtagcatctatgcactcttcctacttcacaaacatcaaggagatttcctcgcgactggctacatcacctcaaagcaggggttatttgctaatgagcagctcagggccttgtatactcaggttcgtctcgttgaatttgttatctgtcattcctgtttaatttgttgtgccaaaactgtatgaggctgcgtggaaggatcctctcaacgaatcagatgtacccgatggcttcgatgaatatatcaggccactactcaagcagcaactgcagactgctagattgtgaatgaagaattgcagaaaa

SEQ ID NO: 8530 - DNA, 2226 bp, Centaurea maculosa
gaagacgaaatggagggagtggattacttgatcgatgagaggaagaaggcgcagttcgatgtggaagccatgaaagttgcttgggctggttctcgtgaagcttttgaactctctgatcgtatgggcaagctcgtcgctaatgatcctgcctttgagaagtttaccaggcctatgctcagtaggaaagagttgttcaagaatactcttagaaaggcggctcatggatggaagctgatcgttgatcttcgtctaactgaagaagaagccaaatggctgcgactttatatcgacgaacctgcttacaccgatcttcactggggaatgttcatcccagctatagaaggacaaggcaccgaggaacaaaaaaagaaatggttgccattagcacgaaagatgcaaattattggctgttatgcacaaacagaacttggtcatggctccaacgtgcaaggtcttgaaacaaccgcaacatttgatcctcaagcggatgagtttgttattcacagtccaactttaacatcgagcaaatggtggcctggtggattgggtaaagcatcaacacatgctctcgtttatgctcgcctcatagtaggtggtgaattccatggagttcatggctttattgtccaactaaggagcttggaggatcacttacctcttcccggaattactgttggtgatattgggctgaagtttggaaatggggcatataacaccatggataatggtgttttgagatttgatcatgtgcgtatcccaagggaccaaatgttgatgagggtggcacaggttacaaaggaaggaaagtttcggcaatctgatgttccccgacaactcctttatgggactatggtgtatgttaggcaaacaattgtgtctgatgcttccaaggcattatctcgtgcagtttgtatagctacaagatatagtgccgttcgtagacagtttggctcacgtaatggtggacccgagactcaggtgattgattacaaaactcagcaaagtagactcttccctttgctggcttctgcttatgccttcagatttgttggtgaatggttgaaatggttgtacacggatgtcaagcaaagattagaagctaacgacttctcaaccttgcctgaggcccatgcttgtactgcaggcttgaagtctttaacaacaaccgcaacagctgatggaattgaagaatgtcgaaaactgtgtggtggtcatgggtaccttgtcagtagtggacttcccgaactatttgcggtttacattcctgcttgtacgtatgaaggggacaatgttgtcctgttgctacaggttgcgagatttcttgtgaagacagtttcggaactcggatacaaacagccagttgggacaacagcttatatgggacgagtggcagctctgatgcagaacaattgcactgttcgaaccgttgaggattggctaaaccctggtgcaatagttgaagcatttgaggcacgggctgctagaatgtctgttgcctgtggtcggcagttagccaagtttgaaaatccagaagaaggttttgcagaattagcgtctgatttagttgaggcagcacttgctcactgccaattaattgttgtgaccaagtttgttgagaaattgcaacaagacattcccggaaagggagtgaaacaatcgttagagatattgtgctatgtctacgcattgtttcttcttcacaagcatcaaggtgaattcttggccaccgggtatcttacgcccaaacaggccgtacttgctaatgaacaactcagaaccttgtactctaaggtccgtccaaatgcaatagcgttggttgattcattcaactacaccgatcactatctgggttcaattcttgggcgttatgatgggaatgtgtatccaaaactctatgaggctgcttggcaagatcctctgaatgattcagatgtagctgacggcttccatcagtacgtgcaaccaattctcaagcaaaagctacactctgctaagctataagctacccgtggccaagtgtttaaaagatttcggttttagttggaagagtaagatagaagagcctttaggccttatattgatgccggtgtgtgcatgtgtgtgtgtttacctattttgcgacatttttcgtacttttaatcgttgttaaaaaacttgaaaacaagggtcttgcggatttgctcacaccaaaattatgtgggtttgattatcttttactatcgtgaa

SEQ ID NO: 8531 - DNA, 2345 bp, Flaveria ramosissima
ctctgacgtctctctaatccccgtatattccattttattcttggatttaggctttgattgaaaaacgaatggagggagttgattacttgagtgatgagaggaacaaggcagagttcgatgttgaatctatgaagattgcttgggctggctctcgtgaagcttttgagctctctgatcgtatggcaaagctcgtagctaatgatcctgcctttgaaaagtttacaaggcctatgctgggtaggaaagagttgctcaagaatactcttagaaaagctgctcatggatggaagttgatcgttgatcttcgtctaactgaagaagaggccaaatggttgcgactatacatcgatgaacctgcttacactgatcttcattggggaatgttcatcccggctattgaaggacaaggcactgaagaacagaaaaagaaatggttgccattggctcaaaagatgcaaattattggctgttatgcacaaacagaacttggtcatggctccaatgtgcaaggtctggaaacgactgctacatttgatccccaaaaggatgagtttatcattcacagtcctactctaacatcaagcaaatggtggcctggtggattgggtaaaatttcaacacatgctgtcgtttatgctcgtctcatagtaggtggtgaattccatggagttcatggctttattgtccaactaaggagcttggatgatcactcacctctttctggtgttactgttggtgatattgggttgaagtttggaaatggggcgtataacaccatggataatggtgttttaaggtttgatcatgtgcgtatccctagggaccaaatgttgatgagggtcacccaggttacaaaagaaggaaaaatcgtgcaatctgatgttcctcgacaacttatttatggaactatggtgtatgttaggcaaacaattgtggctgatgcttccaaagcattatcgcgtgcagtttgtattgctacaagatatagtgctgttcgtagacaatttggctcacgtaatggtgggcccgaaacccaggtgattgattataaaactcagcaaagcagactattccctttgctggcatctcgcgtatgccttcagatttgtaggcgaatggttaaaatggttgtacatggatgttaagcaaagattagcagctaatgacttttcaacattgcctgaggcccatgcatgtactgcagggttaaagtccttgacaactactgcacagctgatggaattgaagaatgtaaaaactatgtggtggtcatggctaccttgttagtagtgggcttcccgaactatttgcggtttacattcctgcttgtacgtatgaaggggacaatgttgttctactgctgcaggttgcgaggtttcttgtgaaaacagtctcagagcttggttacaaaaaacagttgggactacagcttatatgggaggagtagcatctctgatgcagaataattgtgctgttcaaactgctgagggatggctaaaccctggtgcaataatggaagcattcgagtcaagggctgctagaatggctgttcgatgtggtcgacaattagccaagtttgaaaataccagaagaaggttttgcagaactatcagctgatttggttgaggcatcagttgctcattgccaattgatcattgtgtccaaatttattgagaaattgcaacaagacatccccggaaagggagtgaagcaaacattagaggtgttgtgttacgtctatgcattgtttcttctccacaagcatcaaggtgatttcttggccaccgggtatcttacacccaaacaggcctcacttgctaatgatcaactcagaacattgtattctaaggtccgcccaaacgcaatagcacttgttgattcattcaactacactgatcactaccttggttcaattcttgggcgttatgatggaaatgtgtatccaaaactctatgaggctgcttggaaagatcctcttaatgactcagatgtagtcgatggcttccatgaatacgtccaaccaattctcaagcagaagctacgcacgtctaagctatagaacgcccatggctgcactaagtgacatattgcttgggcacatctcctttgtttcagtaagtgttcaactatggttttagttgttgttttaacactggatattaagttgaaggagcactatagagcttttacgtcttatatttatgctggtctgtgacgttacatagcatgcaacatgcacgacaatcgtcgtgctttagttgttgattatgtgtcgaaagtgtgcattagaacattactattctcgaagaaaaaaacagttaaaataaattgtctgtactaagtac

SEQ ID NO: 8532 - DNA, 2519 bp, Cichorium intybus
cgttaggaattaggatggagtcggcattgtatcgtcatcaatgcaataaatgaaatgagaaaaagggaagataaatacgtcgattgtgtttgtcttgggattcgcaactgcgagttgtaccaaggatttctctggaacccgcatatcctccttctcgtcttggcgatcatcacctcgttttagacatttcggttttgcttcaaagaggaaatggagggagtggattacttgagtgatgagagggaaaaggcgcagttcgatgtgaaagccatgaaagttgcttgggctggttctcgtgaaactcttgaagtctctgatcgtatggccaagctcgtcgctaatgatcctgcctttgagaagtttaccaggcctatgcttggtaggaaagagttgttcaaggatacgcttaaaaaagctgcttatgcatggaagttgatcattgatcttcgtctatcagaagaagaggccaaatggttgcgactttatattgatgaacctgctttcactgatcttcactggggaatgttcatcccagccatagaaggacaaggcaccgaggaacaaaagcagaaatggttgccattggcccaaaagatgcaaattattggctgttatgcacaaacagaacttggtcatggctccaacgtgcaaggtcttgaaacaactgcaacatttgatccccaaacggacgagtttgtccttcacagtcctactttaacttcaagcaaatggtggcctggtggattgggtaaagtgtcaacacatgctgtcgtttatgctcgcctcatagtaggtggtcaattccatggagttcatggctttatcgtccaactaaggagcttggaggatcactcgccgctacgtggcattactgttggtgatatcgggctcaagtttggaaatggggcatataacactatggacaatggtgttttgagattcagtcatgtgcgtataccaaggaaccaaatgttgatgagggtattacaggttacaaaggatggaaagatcatgcagtctgatgttccccgacaactcatatatgggactatggtgtatgttaggcaaacaattgtggcagatgcttctaaagcattatctcgtgctgtttgtatcgccacaagatatagtgctgttcgtagacagtttggctcacgtgatggtggacctgaaacacaggtgattgattataaaactcagcaaagtagattattccctttgcttgcttctgcgtatgccttcagatttgtgggggagtggttgaaatggttgtacatggatgtgaagcaaagattagcagccaatgacttctcaacattgcctgaggcccatgcgtgtactgcaggcttgaagtccttaacaactactgcaacagctgatggaattgaagaatgtagaaaactatgtggtgggcatgggtaccttgttagtagtgggcttcctgaactatttgctgtttacatccctgcttgtacatacgagggggacaatgttgtcctgctgctacaggttgcgaggtttcttgtaaaaacagtgtcagagctgggacacaaaaagccagttgggacaacagcttatatgggacgagcagcagctctgatgcagagtaattgtggcattcaatccgctggggagtggctaaaccccgatgcgattgtggaagcatttgaggccagggctgctagaatggctgtcagctgtgctcaacggttggccaagtttgaaaatccagaagaaggttttgcagaactagcagctgatctagtggaggcatcagttgctcactgccaattaattgttgtgtccaagttcattgagaagttgcagcaagacatccctgggaagggagtgagagagtcgttagaggtgctgtgttatgtatatgcattatttcttcttcacaaacatcagggtgatttcctggcaactggttatcttacccccaaacagtcggcacttgctaacgatcaactaagaactttgtactccaaggtgcgtccaaatgcaatagctttggttgattcattcagctacacagatcactacttgggttcgattctcgggcgttatgatgggaacgtctatccaaaactctacgaggctgcttggaaagatcctctcaatgactccgatgttgctgatggcttccatcaatatgtccagccaatactcaaacagatgctgcactctgctaagctatagttatcataagccttcagtctttagcccttgttataatattcacagactcatattattgcaaaatgtgcgtcttggttgttgagatatggtattgtgagtttaaaaacttagattcaccatgcttttactattcttcctgaaatttaatgatatctattctggaaagtggaaagtcggttgcatgtcattaatttatgttaatttatgtataaagccaaatttgatttcttttttggcttacaatgaatagtgcaacaccaaagttggtgtcttcttattcgtcaaaaccattaatttggtgtttttgtggtgtggtt

SEQ ID NO: 8533 - DNA, 2530 bp, Cichorium intybus
cgttaggaattaggatggagtcggcattgtatcgtcatcaatgcaataaatgaaatgagaaaaagggaagataaatacgtcgattgtgtttgtcttgggattcgcaactgcgagttgtaccaaggatttctctggaacccgcatatcctccttctcgtcttggcgatcatcacctcgttttagacatttcggttttgcttcaaagaggaaatggagggagtggattacttgagtgatgagagggaaaaggcgcagttcgatgtgaaagccatgaaagttgcttgggctggttctcgtgaaactcttgaagtctctgatcgtatggccaagctcgtcgctaatgatcctgcctttgagaagtttaccaggcctatgcttggtaggaaagagttgttcaaggatacgcttaaaaaagctgcttatgcatggaagttgatcattgatcttcgtctatcagaagaagaggccaaatggttgcgactttatattgatgaacctgctttcactgatcttcactggggaatgttcatcccagccatagaaggacaaggcaccgaggaacaaaagcagaaatggttgccattggcccaaaagatgcaaattattggctgttatgcacaaacagaacttggtcatggctccaacgtgcaaggtcttgaaacaactgcaacatttgatccccaaacggacgagtttgtccttcacagtcctactttaacttcaagcaaatggtggcctggtggattgggtaaagtgtcaacacatgctgtcgtttatgctcgtctcatagtaggtggtcaattccatggagttcatggctttatcgtccaactaaggagcttggaggatcactcgccgctacgtggcattactgttggtgatatcgggctcaagtttggaaatggggcatataacactatggacaatggtgttttgagattcagtcatgtgcgtataccaaggaaccaaatgttgatgagggtattacaggttacaaaggatggaaagatcatgcagtctgatgttccccgacaactcatatatgggactatggtgtatgttaggcaaacaattgtggcagatgcttctaaagcattatctcgtgctgtttgtatcgccacaagatatagtgctgttcgtagacagtttggctcacgtgatggtggacctgaaacacaggtgattgattataaaactcagcaaagtagattattccctttgcttgcttctgcgtatgccttcagatttgtgggggagtggttgaaatggttgtacatggatgtcaagcaaagattagcagccaatgacttctcaacattgcctgaggcccatgcgtgtactgcaggcttgaagtccttaacaactactgcaacagctgatggaattgaagaatgtagaaaactatgtggtgggcatgggtaccttgttagtagtgggcttcctgaactatttgctgtttacatccctgcttgtacatacgagggggacaatgttgtcctgctgctacaggttgcgaggtttcttgtaaaaacagtgtcagagctgggacacaaaaagccagttgggacaacagcttatatgggacgagcagcagctctgatgcagagtaattgtggcattcaatccgctggggagtggctaaaccccgatgcgattgtggaagcatttgaggccagggctgctagaatggccgtcagctgtgctcaacggttggccaagtttgaaaatccagaagaaggttttgcagaactagcagctgatctagtggaggcatcagttgctcactgccaattaattgttgtgtccaagttcattgagaagttgcagcaagacatccctgggaagggagtgagagagtcgttagaggtgctgtgttatgtatatgcattatttcttcttcacaaacatcagggtgatttcctggcaactggttatcttacccccaaacagtcggcacttgctaacgatcaactaagaactttgtactccaaggtgcgtccaaatgcaatagctttggttgattcattcagctacacagatcactacttgggttcgattctcgggcgttatgatgggaatgtctatccaaaactctacgaggctgcttggaaagatcctctcaatgactccgatgttgctgatggcttccatcaatatgtccagccaatactcaaacagatgctgcactctgctaagctatagttatcataagccttcagtctttagcccttgttataatattcacagactcatattattgcaaaatgtgcgactaatactatccttggttgttaagatatggtattgtgagtttaaaaacttagattcaccatgcttttactattcttcgtgaaatttaatgatatctattctggaaagtggaaagtcggttgcatgtcattaatttatgttaatttatgtataaagccaaatttgatttcttttttggcttacaatgaatagtgcaacaccaaagttggtgtcttcttattcgtcaaaaccattaatttggtgtttttgtggtgtggtt

SEQ ID NO: 8534 - DNA, 2402 bp, Cichorium intybus
ggagtcggcattgtatcgtcatcaatgcaataaatgaaatgagaaaaagggaagataaatacgtcgattgtgtttgtcttggaattcgcaattgcgagttgtaccaacccgcatatcctccttctcgtcttggcgatcatcacctcgttttagacatttcggttttgcttcaaagaggaaatggagggagtggattacttgagtgatgagaggaaaaaggcgcagttcgatgtgaaagccatgaaagttgcttgggctggttctcgtgaaactcttgaagtctctgatcgtatggccaagctcgtcgctaatgatcctgcgtttgagaagtttaccaggcctatgcttggtaggaaagagttgttcaaggatacgcttaaaaaagctgcttatgcatggaagttgatcattgatcttcgtctatcagaagaagaggccaaatggttgcgactttatattgatgaacctgctttcactgatcttcactggggaatgttcatcccagccatagaaggacaaggcaccgaggaacaaaagcagaaatggttgccattggcccaaaagatgcaaattattggctgttatgcacaaacagaacttggtcatggctccaacgtgcaaggtcttgaaacaactgcaacatttgatccccaaacggatgagtttgtccttcacagtcctactttaacttcaagcaaatggtggcctggtggattgggtaaagtgtcaacacatgctgtcgtttatgctcgcctcatagtaggtggtcaattccatggagttcatggctttatcgtccaactaaggagcttggaggatcactcgccgcttcgtggcattacagttggtgatatcgggctcaagtttggaaatggggcatataacactatggacaatggtgttttgagattcagtcatgtgcgtataccaaggaaccaaatgttgatgagggtattacaggttacaaaggatggaaagatcatgcagtctgatgttccccgacaactcatatatgggactatggtgtatgttaggcaaacaattgtggcagatgcttctaaagcattatctcgtgctgtttgtatcgccacaagatatagtgctgttcgtagacagtttggctcacgtgatggtggacctgaaacacaggtgattgattataaaactcagcaaagtagattattccctttgcttgcttctgcgtatgccttcagatttgtgggggagtggttgaaatggttgtacatggatgtgaaggaaagattagcagccaatgacttctcaacattgcctgaggcccatgcgtgtactgcaggcttgaagtccttgacaactactgcaacagctgatggaattgaagaatgtagaaaactatgtggtggccatgggtaccttgttagtagtgggcttcctgaactatttgctgtttacatccctgcttgtacatacgagggggacaatgttgtcctgctgctacaggttgcgaggtttcttgtaaaaacagtgtcggagttgggacacaaaaagccagttgggacaacagcttatatgggacgagcagcagctctgatgcagagtaattgtggcattcaatccgctggggagtggctaaaccccgatgcgattgtggaagcatttgaggccagggctgctagaatggctgtcagctgtgctcaacggttggccaagtttgaaaatccagaagaaggttttgcagaactagcagctgatctagtggaggcatcagttgctcactgccaattaattgttgtgtccaagttcattgagaagttgcagcaagacatccctgggaagggagtgagagagtcgttagaggtgctgtgttatgtatatgcattatttcttcttcacaaacatcagggtgatttcctggccaccggttatcttacccccaaacagtcagcacttgctaacgatcaactcagaactttgtactccaaggtgcgtccaaatgcaatagctttggttgattcattcagctacacagatcactacttgggttcgattctcgggcgttatgatggcaacgtgtatccaaaactctacgaggctgcatggaaagatcctctcaatgactcggatgttgctgatggcttccatcaatatgtccagccaatactcaaacagaagctgcactctgctaagctataaaattactcaaactcttatcataagccttcagtctttagcccttgttataatattcacagagtcatattattgcaaaatgtgcgactaatgctatccttggttgttatgatatggtattgtgagtttaaaaacttagattcaccatgcatcaacattatgttttactattcttcgtgaaatttaatgatatctattctggaaagtggaaagtcggttgcatgtcattaatt

SEQ ID NO: 8535 - DNA, 2298 bp, Cichorium intybus
ggaattcgcaattgcgagttgtaccaacccgcatctcctccttctcgtcttggcgatcatcacctcgttttagacatttcggttttgcttcaaagaggaaatggagggagtggattacttgagtgatgagaggaaaaaggcgcagttcgatgtgaaagccatgaaagttgcttgggctggttctcgtgaaactcttgaagtctctgatcgtatggccaagctcgtcgctaatgatcctgcgtttgagaagtttaccaggcctatgcttggtaggaaagagttgttcaaggatacgcttaaaaaagctgcttatgcatggaagttgatcattgatcttcgtctatcagaagaagaggccaaatggttgcgactttatattgatgaacctgctttcactgatcttcactggggaatgttcatcccagccatagaaggacaaggcaccgaggaacaaaagcagaaatggttgccattggcccaaaagatgcaaattattggctgttatgcacaaacagaacttggtcatggctccaacgtgcaaggtcttgaaacaactgcaacatttgatccccaaacggatgagtttgtccttcacagtcctactttaacttcaagcaaatggtggcctggtggattgggtaaagtgtcaacacatgctgtcgtttatgctcgcctcatagtaggtggtcaattccatggagttcatggctttatcgtccaactaaggagcttggaggatcactcgccgcttcgtggcattacagttggtgatatcgggctcaagtttggaaatggggcatataacactatggacaatggtgttttgagattcagtcatgtgcgtataccaaggaaccaaatgttgatgagggtattacaggttacaaaggatggaaagatcatgcagtctgatgttccccggcaactcatatatgggactatggtgtatgttaggcaaacaattgtggcagatgcttctaaagcattatctcgtgctgtttgtattgccacaagatatagttgtgttcgtagacagtttggctcacgtgatggtggacctgaaacacaggtgattgattataaaactcagcaaagtagattattccctttgcttgcttctgcgtatgccttcagatttgtgggggagtggttgaaatggttgtacatggatgtgaagcaaagattagcagccaatgacttctcaacattgcctgaggcccatgcgtgtactgcaggcttgaagtccttaacaactactgcaacagctgatggaattgaagaatgtagaaaactatgtggtggccatggctaccttgttagtagtgggcttcctgaactatttgctgtttacatccctgcttgtacatatgagggggacaatgttgtcctgctgctacaggttgcgaggtttcttgtaaaaacagtgtcggagttgggacacaaaaagccagttgggacaacagcttatatgggacgagcagcagctctgatgcagaataattgtggcattcaatccgctggggagtggctaaaccccgatgcgattgtggaagcatttgaggccagggctgctagaatggctgtcagctgtgctcaacggttggccaagtttgaaaatccagaagaaggttttgcagaactagcagctgatctagtggaggcatcagttgctcactgccaattaattgttgtgtccaagttcattgagaagttgcagcaagacatccctgggaagggagtgagagagtcgttagaggtgctgtgttatgtatatgcattatttcttcttcacaaacatcagggtgatttcctggccaccggttatcttacccccaaacagtcggcacttgctaacgatcaactcagaactttgtactccaaggtgcgtccaaatgcaatagctttggttgattcattcagctacacagatcactacttgggttcgattctcgggcgttatgatggcaacgtgtatccaaaactctacgaggctgcatggaaagatcctctcaatgactcggatgttgctgatggcttccatcaatatgtccagccaatactcaaacagaagctgcactctgctaagctataaaattactcaaactcttatcataagccttcagtctttagcccttgttataatattcacagagtcatattattgcaaaatgtgcgactaatgctatccttggttgttatgatatggtattgtgagtttaaaaacttagattcaccatgcatcaacattatgttttactattcttcgtgaaatttaatgatatctattctggaaagtgc

SEQ ID NO: 8536 - DNA, 2359 bp, Cirsium arvense
aaaacaaacacgtgagaatcatggagccggtatttgtatcgtcatcaatgcaatatatatcgagtaagaaataaagccaatataaacacgtctgttattgttgtcttgggaattacaatcacgattgctctctgatatccgcatatccctctttctttctctcttgggatttcaattttgatttgaagaagaaatggagggagtagattacttgatcgatgagagaaagaaggcgcagttcgatgtggaagccatgaaagttgcttgggctggttctcgtgaaactcttgaagtttctaatcgtatggccaagctcgtcgctgatgatccggtctttgagaagtttaccaggcctatgctcggtaggaaagagttgttcaagaatactcttagaaaggctgctcatggatggaagctgatcgttgatcttcgtctaactgaagaagaggccaaatggttgcgactttatatcgacgaacctgcttacactgatcttcactggggaatgtttatcccagctatagaagggcaaggcaccgaggaacaaaaaaagaaatggttgccattggcccaaaagatgaaaataattggctgttatgcacaaacagaacttggtcatggctccaacgtgcaaggtcttgaaacaaccgcaacatttgatccccaagcggatgagtttgttattcacagtcctactttaacatcaagcaaatggtggcctggtggattgggtaaagcatcaacacatgctctcgtttatgctcgcctcatagtaggtggtgaattccatggagttcatggctttattgtccaactaaggagcttggaggatcactcacctcttcctggtattacggttggtgatattgggctgaagtttggaaatggggcatataacaccatggataatggtgttttaagatttgatcatgtgcgtatcccaaggaaccaaatgatgatgagggtgtcacaggttacaaaggaaggaaaatacatgcaatctgatgttcctcgacaactcatttatgggactatggtgtatgttaggcaaacaattgtggctgatgcttccaaagctttatctcgtgcagtttgtattgctacaagatatagtgctgttcgtagacagtttggctcacgtaatggtgggcctgagacgcaggtgattgattataaaactcagcaaagtagactcttccctttgctggcttctgcttatgcctttagatttgttggtgaatggttgaaatggttgtacacggatgtgaagcaaagattagaagctaacgacttctcaacattgcccgaggcccatgcatgtactgcaggcttgaaatcgttgacaactaccgcaacagctgatggaattgaagaatgtcgaaaactatgtggtggtcatggctaccttgtcagtagtgggcttcccgaactatttgcggtttacattcctgcttgtacgtatgaaggggacaatgttgtcctgttgctacaggttgcgaggtttcttgtgaagacagtctcggagctgggatacaaaaagccagttgggacaacggcttacatggggcgagtggcaactctgatgcagaataattgtgctgttaaaaccgctgaggactggctaaaccctggtgcgatagttgaagcatttgaagcaagggctgctagaatggctgttgccgttggccaacagttagccaagtttgaaaatccagaagaaggttttgcagaactagcatctgatttagttgaggcatcagttgctcactgccaattaattgttgtttccaagtttatcgagaaattacaacaagatattcctggaaagggagtgaaacaatcgttagagatattatgctatgtgtacgcattgtttcttcttcacaagcatcaaggtgatttcttggccatcgggtatcttacgcccaaacaggctttacttgctaacgatcaactcagaaccttgtactctaaggttcgtccaaatgcaatagcgttggttgattcattcaactacaccgatcactatctgggttcaattcttgggcgttatgatgggaatgtatatccgaaactctatgaagctgcttggcaagatcctctgaacgattcagatgtagctgacggcttccatcagtacgttcaaccaattctcaagcagaagctacactccgctaagctataaaaacacccgtggctgcgctaagtgttcaaaagattccggcattttagatatcgcttttactattttgtttgaagtggaaagagtaagatagtctctacctattttccgacacttttcgtgctttttaattgttgtcgagaaagtggaaaacgatggtcttatggatttgctcat

SEQ ID NO: 8537 - DNA, 2593 bp, Echinacea purpurea
catgttgttgcattgggattgacaatttaggatttgttacgtctctgaaatcctcgtatattccattttcgccttgggtttgctttgaagaacgtaatggaaggagttgattacttgagttatgaaaggaagaaggcgcagttcgatgtggaagccatgaaagtagcttgggctggttctcgtgaagcttttcaactctctgatcgtatggccaagctcgtagctaatgatccggcctttgaaaagttcacaaggcctatgatgggtaggaaagagttgctcaagaatactcttaggaaagctgctcatggatggaagctgattgttgatcttcgtctaactgaagaagaggccaaatggttgcgactttatattgatgaacctgcttacactgatcttcactggggaatgtttatcccggctatcgaaggacaaggcacagaagaacagaaaaagaaatggttgccattggctcaaaagatgcaaattattggctgttatgcacaaaccgaacttggtcatggatccaatgtgcaaggtctagaaacaactgcaacatttgatccacaaacggatgagtttgtcattcacagtccaactctaacatcaagcaaatggtggcctggtggattgggtaaagtgtcaacacatgctgtcgtttatgctcgcctcatagtaggtggtgaattccatggggttcatggatttatcgtccaactaaggagcttggatgatcactcacctcttcctggcattactgttggtgatatcggtatgaaatttggaaatggggcctataacaccatggataatggtgttttaaggtttgatcacgtgcataccccaaggaaccaaatgttgatgagggtaacccaggttacaaaggaaggaaaagtaatgcaatccaatgttcctcgacaactcatatatggaactatggtgtatgttaggcaaacaattgtggctgatgcttccaaagcattatctcgtgcggtttgtattgctacaagatatagcgctgttcgtagacaatttggctcacgcaacggtggacccgagacccaggtgattgattataaaactcagcaaagtagactcttccctttgctggcatcggcttatgccttcagatttgtgggcgagtggttaaaatggttgtacacagatgttaaggaaagattagcagctaatgacttctcaacattgccagaggcccatgcatgtaccgcagggttaaagtccttaacaacttcagtgacagctgatggaattgaagaatgtagaaaactatgtggtggtcatggataccttgttagtagtgggcttccagaactatttgcagtttacattcctgcttgtacatatgaaggggacaatgttgttctactgctacaggttgcaaggtttcttgtgaaaacagtgtcggaacttggttacaaaaagccagttgggacaacagcttatatggggagagtggcatctctgatgcagaatagttgtgctgtacaaactgctgaggattggctaaaccatggtgcaataattgaagcatttgagtcaagggctgctagaatggcggttcgttgtggtcgacatttggccaagtttgaaaatccggaagaaggttttgccgaactatcagctgatttggtcgaggccgcagttgctcactgccaattaattgttgtgtccaagtttaatgagaaattgcaacaagacatccctggacagggagtgaaagaaatgctagaggtgttgtgttacgtctatgcattgtttcttcttcacaagcatcaaggtgatttcttggccaccggctatcttacacccaaacaggcctcgcttgctaatgatcaactcaggacgttgtattccaaggttcgcccaaatgcaatcgtgctagttgattcattcaactacactgaccactacctgggttcgattcttgggcgctatgatggaaatgtgtatccaaaactctacgaggctgcttggaaagatcctcttaatgattcagatgtagttgacggcttccatgattatgtacaaccaattctcaagcagaagatacgcactgctaagctataaagcgcggaaccaatcctcataatgattcagatgtggttgttggcttcctccatttcagcaagtgttcaaaaatggttacaattttcagtattgtttggtgttttaacactggatatattaagttggaagagaaccatagaacctttaggcctatatatatattttggtggtatcagctgttacatagttttcaaaatgtgtgacaatcgctgcgcttttgttgttggttatgtgtcataaaatgtgcgccttactattattgactaaaagaagtttaatgattcctctattctataaaatttcttgtaagataagattttggtttggcttactaatgtaatcatgtgcgttggaatttattgatatgggagttgatgtctttgttttattgggtatttaaggattttcttttttcgattatctattgttgtaacatatacgcacatgcacccacttgttccagttggtcaaatgcgaaacttgttgaaatgaaatggttttaatg

SEQ ID NO: 8538 - DNA, 2240 bp, Solanum lycopersicum
ttttgtattctatttcatccctgagagagagagatggagggtatagattacttggctgaagaaaggaagaaagctgagttcaatgttgatgagatgaaaattgtttgggcaggttctcgccgtgcttttgaagtttcagattatatctccaagcttgttgctgatgatcctggtttcagtaaggaggaaagaaccatgctttctaggaaagaactatttaaagacactctaaggaagtcagcatactcatggaaacacatcattgatcttcagctttctgaagaagaagcagagaagttaagatatttcgtcgatgagcctgcttttattgattctcatttgggagtgtttatacccgctataaaaggacagggcaacaaggaacaactgaaaaagtggttgccgttggcatacaagatgcaaattattggctgctatgctcaaactgaacttggacatgggtccaatgttcaaggccttgaaaccactgccacattcgatccccaaacagatgaatttgtcattcatagtccaacactgacatcaagcaagtggtggcctggtggattaggtaaagtctctacccatgcgattgtgtatgctcgtcttataacagatggtaaagatcatgggattaacggttttattgtccaactacggagcttggaggatcacaaacctcttccaggcattactgtcggagatattggaacaaaatttggaaacggagcatacaataccatggataatggggtgctaagatttgatcacttgcatattccaagagatcaaatgctgatgagggttgcacaagttactaaggatggaaaatatgtccaatctgatgttcctcgacaacttctctatgtgtccatggtacatgttcgtcaagcacttgtaacatatgcttctggtgctttgtctcgggctgtttgtattgcaacgagatatagtgctgttcgtagacaatttggttctcaaaatggtggacaagaaattcaggtgatagactacaaaacacagcaaagcaggctcttccccttgttagcttcagcatatgccttcagatttgttggtgagtggctgaaatggttttgcactgatgtaactcaaagactaaaagcaaatgatttctcaacgttgcctgagttgcacgcgactacagctggaataaagtctttgacaaccactgccactgctgatggaattgaagaatgccgaaagttgtgtggaggtcatggttatctttgtagcagtggacttccagaattatatgccgtttctgtccctgcctgtacatttgaaggagataacgtcgtgctactacttcaggttgcaaggtttcttctgaagactctttcacagctgagctccggaaagaagccaacgggtaccatagcttatatggggaaaattgaacagttgatgcaatgccattctgatgtggaacaagccaaggactggctcaaacctagtgcaatattggaagcatttgaagcaagggctgccaggatgtctgtttcttgtgctcagagtcttagcaagtttgattatccagaagaaggctttcaagaacttgcaactgatttagttgaagctgcagttgctcactgtcagttgattgttgtctccaaatttatcgaaaagctgcaacaagacattccaggggaaggtgttaagcaacaactggtggtgctttgtagcatctatgcactcttcctacttcacaaacatcaaggagacttcctcgcgacgggctacatcacctcaaagcaggggttatttgctaatgagcagctcagggccttgtatactcaggtttgtctcattggatttgttatctgtgtttgctgttcatttgtgtacccgaaactgtatgaggctgcgtggaaggatcctctcaacgaatcggatatacccgatggcttccatgaatatatcaggccactactcgagcaacaattgcagactgctagattgtgaatgaagaactgcagaaaatgggagaaggcgtagatttccccttgaacttgtcccgaaaagtcaattacacgcttaaactatttacaactattataaagtcgtcataattaattgtttaagcgtgtaactgacatgctctttccctatagtaatatgacaataaactaaaggtttttgaaatacaatatcttgtattgtgctgtgctgtgctgtgctgcagtagatattatttgaataagattatggaactctggtca

SEQ ID NO: 8539 - DNA, 2085 bp, Catharanthus roseus
gtctcggatcggatttctaagctcgtcgctaatgatcctgcctttgcaaaggatgagagaactatgatgcccagaaaggagctgttcaagaacactctcagaaaggcagcttatgcatggaagaaaatcaacgaacttcgtctctctgaggaagaggcgtctaaacttcggttttatgtggatgaacctgcttttactgatcttcattggggaatgtttgtgcctttcatcaaaggacagggcactgatgaacagcagcaaaaatggttgtctttggcctataagatgcaaataataggatgttatgcacaaactgaactaggtcatggctctaatgtgcaaggccttgaaaccacagcaacatttgatcctcagacagatgaatttgtaattcatagtcctacactgacttcaagcaaatggtggcctggtggtttgggtaaagtatccacacatgcagtcgtctttgcccgtctaataactgatggcaaagagtatggggttcatggttttattgtccaactacggagcttggaggatcatcagcctcttccaggtgtaactgttggtgatattggaatgaaatttggtaatggagcatacaacaccatggacaatggagtactaagattcgatcacgtgcgtattccaagagatcatatgttgatgaggttttcacaagttacaagggatggaaaatataaacagtcagatgttcctcgccagctggtttatggaacaatggtttatgtccgtcaaacaattgtgcaagatgcatcatctgccttgtcacgggctgtttgtattgcgacaaggtatagtgctgttcgccgacaatttggttctcaaaatggtggtccagaaacccaggtgattgactataaaactcaacaaagtaggctctttcccctgctggcttctgcttatgcctttagatttgctggtgaatggcttaaatggttatacacggatgtgacacaaagacttcaagcaaatgacttctctacattgcccgaggctcatgcatgcactgcagggttgaagtccttgactacttctgctactgctgatgctattgaagaatgcagaaaattatgtggtggccatggctatctctgtaccagtgggcttccagaattgtttgcagtttatgtccctgcttgcacatatgaaggagacaacattgtaatgctgctacaggtggcaaggtttctaatgaagacagtttcacagctggcgtttgggaaacagctaacgggaacaattgcttacatgggaagacttgaacatttgatggagtgtcgctgcagtgtgcaaaaggccgaggattggttgaatcccagtgcagtgttggaggtatttgaggcaagagccgctaggatgtctgtttccggtgcccaaaggttgagcaactttactaatccagaagaaggctttgctgaactatcagctgatttggttgaggcagccgttgctcattgtcaattaattgtcgtctcaaagttcatcgagaaacttcaacaggacattcctggacagggcgttaaggaacagctaaaagcactatgcggcatttattacctataccttcttcacaagcaccagggtgactttcttgccaccagctgcatcaccccaaagcaagcttcactagctaatgatctcctcaggacattgtattcacaggttcgtcctaatgctgttgcgctcgttgatgcattcaactacaccgatcactaccttggttcgatcctcgggtgctacgatggaaatgtgtatgcaaaactatatgatgctgcatggaaggatcctttgaatgaatctgttgtgcctgatggctatcaagaattcattaggcctctgcttaagagacaacttggtaatgctaagctctgaagactatatacttataatagaaggactttttgaagatagagagatgaacttaggaggggagaatttggtgttaaatttttattaaccacattcatgtgctgtggaattacaatattgaaattattggcaattctttttctttttcattaataaatttcaataaagttgaacttttgggttaaaaaaaaa

SEQ ID NO: 8540 - DNA, 989 bp, Solanum tuberosum
gcagaggacgagacagaacgcagaaaaaaacaacatcgaccaagaagatagacggatagagagagtcgaaaatggcgatttccgtggcttctctcgcctcatcttttgcttctctttcattttcttctcagatttctcaaaaaccctatgctgtatcccttgctcattcaaagcaattctctttctctctcacttccaaaatccctaggctcgttgtgtcagcttccgttgccgaagcaccggagacggaggaattggaaacgagagagaaccttttgaagctcgtaaaaagtagacttcctggtggtttcgctgcacagcctatttttggaactggtagacgtaaaagtgcaagtgctcgtgttgtccttcaggaaggttctggaaaaatcatcatcaattatcgtgatgctaaggaatatcttcaaggaaatccattgtggattcaatatgtcaaaactcctctggccactttaggatatgaggctagttatgacattttcgtcaaggtggaaggcggtggtctttctgggcaggctcaagcaatttcccttggcattgctcgtgcactcctaaaggttagtgagagccatagaaaaccattgagggtggagggtctgctaactagagatgccagagttgtggagcggaagaaagttggtctcaagaaggctcgcaagcgtccacaattttccaagcgttgaggttggtacttactcactgtggcagcatttggtagaaagatttggtggtttattgactcagattggggggaaaagagcatatcaatgatctgatttgactgtttaagatgaggaaatgtttcagatttatcatcactcaattgcttcttgtaaattttgtattagtccctactcagaattacaatttgttctgttgaaggtattttttgagtttagtttcttgttcaattcacatggtaaacgtacactgcgacagtttgatataattctggagatttttgtgcc

SEQ ID NO: 8541 - DNA, 925 bp, Solanum phureja
aaacatcgaccaagaagatagagagagtcgaaaatggcgatttccgtggcttctctcgcctcatcttttgcttctctttcattttcttctcagatttctcaaaaaccctatgctgtatcccttgctcattcgaagcaattctctttctctctcacttccaaaatccctaggctcgttgtgtcagcttccgttgccgaagcaccggagacgaaggaattggaaacgagagagaaccttttgaagcttgtgaaaagtagacttcctggtggtttcgctgcacagcctatttttggaactggtagacgtaaaagtgcaagtgctcgtgttgtccttcaggaaggttctggaaaaatcatcatcaattatcgtgatgctaaggaatatcttcaaggaaatccattgtggattcaatatgtgaaaactccactggccactttaggatatgaggctagttatgacattttcgtcaaggtggaaggcggtggtctttctgggcaggctcaagcaatttcccttggcattgctcgtgcactcctaaaggttagtgagagccatagaaaaccattgagggtggagggtctgctaactagagatgccagagttgtggagcggaagaaagttggtctcaagaaggctcgcaagcgtccacaattttccaagcgttgaggttggtacttactcactgtggcagcatttgatagaaagatttggtggtttattgactcagattgggggaaaaagagcatatcaatgatctgatttgactgtttaagatgaggaaatgtttcagatttatcatcactcaattgcttcttgtaaattttgtattagtccctactcagaattacaatttgttctgttgaaggtgtttcttgagtttagtttcttgttcaatgtttaatataattctggagatttttgtgcc

SEQ ID NO: 8542 - DNA, 669 bp, Nicotiana benthamiana
ctcttcgagaggaaatcgaaaatggcgatttctctcacttctctcacctcatcctttgcttctctctccttctcctcacaaatatctcaaaaaccctatgccgtatctctcgcacatttaaagccattccctttatctctcaattccaaaatccctacactcgtagtatcagcttccgtcgcagaagcaccagcggcgccagagttagaaacgcgagaggaacttctgaagcttgtgaaaagtagacttccaggcggttttgcggcacagcctatttttggaactggtagacgtaaaagcgccagtgctcgtgttgtccttcaggaaggttctggaaaaataatcatcaattatcgtgatgctaaggaatatcttcaaggaaatccgctgtggattcaatatgttaaaactcctctggccactttaggatatgaggctagctatgatatttttgtcaaggtggaaggcggtggtctttctgggcaggctcaagcaatctcccttggcattgctcgtgcactcctaaaggtcagtgagagtcatagaaaaccattgagggaagagggcctgctaactagagatgccagagttgtggagcggaagaaagttggtctcaagaaggctcgcaagcgtccacaattttccaagcgttgaggttatactccaaat

SEQ ID NO: 8543 - DNA, 1271 bp, Nicotiana benthamiana
ccaatctgctttacattatccgctgctcttgcttcccttcaaaattccacccttcactctcagagaggaaatcgaaaatggcgatttctctcacttctctcacctcatcctttgcttctctctccttctcctcacaaatttctaaaaaaccctatgccatatctctcgcacattcaaagcaattccctttatctctcacttccaaaatccctacactcgtagtatcagcttccgtcgccgaagcaccagcggcgccggagttagaaacgcgagaggaacttctgaagcttgtgaaaagtagacttcccggcggttttgctgcacagcctattttcggaactggtagacgtaaaagcgccagtgctcgtgttgtcattcaggaaggttctggaaaaatcatcattaattatcgtgatgccaaggaatatcttcaaggaaatccgctgtggattcaatatgttaaaactcctctggccactttaggatacgaggctagctatgatatttttgtcaaggtggaaggcggcggtctttctgggcaggctcaagcaatctcccttggcattgctcgtgcactcctaaaggtcagtgagagtcatagaaaaccattgagggaagagggcctgctaactagagatgccagagttgtggagcggaagaaagttggtctcaagaaggctcgcaagcgtccacaattttccaagcgttgaggttatactccaaataaaatatcagttcgaaaacctgtgcgcttttccactgaagcacacaggtgcaagagcttctaatggaatttacttacgttttctttgctatccctttctaggttgggaacttcttatttacccttgtttcattttgtagaaaggtatggaagtcatcatataccattgctttattaatacgtaacggattgatcagcatgaaattcacaaccatattatggattcctcaatgcactttttcccccttttgtgagtaaaagaatgatgtaaaccatgatttgtgtttgtaattctttctgcttttggttttcagtttaggtggttttgttaacgcagattggggaaataccatatcaatgatctgttcgtttgttgaagattggaagcgtttccgatccattactcaaatgcttcttgtaaattttgtatcagtctcgactcagaagtacaattgaatcttctgaagttgttattgagtttataagtctagattcacattgtaaacattcaccgagacagtttaatataatttgaagatttagttac

SEQ ID NO: 8544 - DNA, 987 bp, Nicotiana tabacum
ccgatcggctttacattatccactgcttcgcttcaaaattcgacccttcactcttaacccgagagaaagtcgaaaatggcgatttctctcgcttctctcacctcatcctttgcttctctctccttctcctcacaaatttctcaaaaaccctatgccatatctttcgcaaattcaaagccattccctttatctctcacttccaaaattcctacactcgtagtgtcagcttccgtcgccgaagcaccggcgccgccggaattggaaacgcgagaggaacttctgaagcttgtgaaaagtagacttcccggcggttttgctgcacagcctattttcggaactggcagacgtaaaagcgctagtgctcgtgttgtccttcaggaaggttctggaaaaatcatcatcaattatcgtgatgccaaggaatatcttcaaggaaatccgttgtggattcaatatgttaaaactcctctggccactttaggatatgaggctagctatgatatttttgtcaaggtggaaggcggtggtctttctgggcaggctcaagcaatctcccttggcattgctcgtgcactcctaaagatcagtgagagtcatagaaaaccattgagggaagagggcctgctaactagagatgccagagttgtggagcggaagaaagttggtctcaagaaggctcgcaagcgtccacaattctccaagcgttgaggttgggaacttcttatttaccatcgttgcatttggtagaaagattaggtggttttgttaatgcagattgaggaaataccatatcaatgatctggttcgacagttggagatcggaaatgtttccgatccattactcaaatgcttcttgtaaactttgtatcagtcttgactcagaattacaattgaatctgttgaagttgttattgagtttgtaagtctagattcacattgtaaacattcaccgagagagtttaatataatttgaagattttgttacgc

SEQ ID NO: 8545 - DNA, 897 bp, Solanum melongena
actcttcaccggaatacagagagaaaatggcgatttccgtcgcttctctcacttcatccttttcctctctttcattttcttctcaaatttctcaaaaaccctatgccttatccctcacacattcaaagaaaatctctttttctctcactcccaaagtcccgacgctcgtcgtctcagcttcagtagcggaagcaccggcgccggaggattttgaaacgagagaagaccttttgaagctcgtgaaaagtagacttcccggcggtttcgctgcacagcctattttcggaactggtagacgtaaaagcgctattgctcgtgttgtccttcaggaaggttctggaaaaatcataatcaattaccgtgatgctaaggaatatcttcaaggaaatccattgtggattcaatatgtcaaaactccactggccactttaggatatgaggctagctatgatatttttgtcaaggtggaaggaggtggtctttctgggcaagctcaagcgatttcccttggcattgctcgtgcactcctaaaggttagtgagaaccatagaaaaccattgagggaagagggtccgctaaccagagattcaagagttgtggagcggaagaaagctggtctcaagaaggctcgcaagcgtccacaattttccaagcgttgaggtcggtacttgctcactgtggcggcatttggcagaaagatttggtgttttttggactcagattggggaagagcgtatcgatttgatttgatcgtttaagatcaggaaaatggttcatatttatcattcaaatgctgcttgtaaattttgtatcagtccggactcagaattacaatttgttctattgaaggcattgtgtggagtttagtttcttgtaactggcctaagtttcaattcg

SEQ ID NO: 8546 - DNA, 981 bp, Capsicum annuum
ctttactcatcatttcctttacattatccactttcactcttcaccaaagagatagagagaatcgaaaatggcggtttcggtagcttctcttacttcatccttcgcttcactttccttcacttctcaaatttctcaaaaaccctacgccttatccctctcacattcgaagcaattccccttctctctcacttccaaaacccctaaactcatcgtatcagcttccgtcgccgaagcaccttcggcaacggaggaactggaaacgagggaggatcttttaaagctagtgaaaagtagactacctggaggtttcgctgcacaaccattttttggaactggtagacgtaaaagtgctagtgctcgtgttgttgttcaggaaggttctggaatgattgttattaattatcgtgatgctaaggaatatcttcaaggaaatccattgtggattcaatatgttaaaactccaatggccactttaggatatgaagctagctatgacatttttgtcaaggtggaaggtggtggtctttctgggcaggctcaagcaatctcccttggcattgctcgtgcactcctaaaggtcagtgagagccatagaaaaccactgagggacgagggtctactaactagagatgccagagttgtggagcggaagaaagctggtctcaagaaggctcgcaagcgtccacaattttccaagcgttgaggttggtacttactcactgtggcagcaattggtagaaagatttgttggtttattgaccctgattggggaaagagcgtatcgatgatctcatagactgttgaagatcaggaaatgtttcagatttatcactcaaatgattcttgtaaattttgtatcactcctgactgagaattacaatttctgttgaagttattttttgagttcagtttcttgtaactggtctaagtttcaattcacatggtaaacgtacattcgacggtttaatataattctggaga

SEQ ID NO: 8547 - DNA, 686 bp, Petunia hybrida
tgactctctctcgtctccaaaatggcgatttccttaacttctctcacttcatcctttgcttcactttccttctcttctcaaatttctcaaaaaccttacatttattgttcaaagccattgtcattatctgtcagttcaaaattacctaaaatctcagctaccgtagccgccgaagaagcagcagcagtagtggaatcagaatcaagagaagaactgttgaaattagtgaaaagtagactgccaggtggatttgcagcacagcctatatttggaacgggtagacgtaaaagtgctagtgctcgtgttgttcttcaagaaggttctggcaaaattatcatcaattatcgtgatgctaaggattatcttcaaggaaatccgttgtggattcaatatgttaaaactcctctagccactttaggatatgaggctagctatgatatttttgtcaaggtcgaaggcggtggtctttctgggcaggctcaagcaatctctcttggcattgctcgcgcactcctaaaggttagcgagagccatagaaaaccattgagggaagagggtctgttaactagagatgccagagttgtggagcggaagaaagttggtctcaagaaggctcgcaagcgtccacaattttccaagcgctgaggatgggaacttcttattcgctgtggctgcatttggtagga

SEQ ID NO: 8548 - DNA, 1495 bp, Solanum tuberosum
gcccatacatgtgaattaatagactcgaaacccatcgtgtgtaacactccaagattcaatctttagatctatacgcttcttttatttttatatatatacttaatcttgttttcttgccaaactactgtttctgccactcaaacatggagtcttgcatctaccatcagctcaaatcccagcctgtatggcttcttttgcttctttctttaggtttcttgaaagtcttgtgcttttcagtcatctttctcaaatgggtctatgtcaatttcctcagacctgctaagaatcttaagaaatatgggtcatgggcacttgttactggacctacagatggtattgggaaggggtttgcttttgaattagctcgaaaagggcttaatttagttcttgtgggtcgtaaccctgataaacttaaggatgtttctgaatcgattaatgctaaatatggacagacccagatcaaaacagtggtcgttgatttctctggtgatttggatgaaggggttaagaagattaaggagacaattgaaggattagatattggggttttgattaacaacgttggggtttcgtatccttatgctagatttttccatgaagtggatgataagctgttggcagatttgattaaagttaatgtggaagggactacaaaggttactcaagctgttttgcctggtatgattcagaggaaaagaggagcaattgttaatattggttctggtgcggctattgttatcccctctgatcccctgtatgctgtttatgccgctactaaagcatacattgaccagttctccagatgcctctatgtagagtacaagaagagtggaattgatgtgcaatgccaggtgccgttgtatgtggcaacaaaaatggcgtcaatcaaaagatcttcattttttgttccctcgactgatggttatgctcggtctgccctgcgatggattggtcatgagccaaggtgcacaccttactggccccattctcttctgtggggtttgctatattcatcaccagaatcgatggttgatgcttggcgtctgaagttctgcattggaattcgaaggagagggcagctgaaggattccaggaagaatgaatagaaagcatctcctttacctcattccatatcttaaagtctgattagtagacaactactttctgtctctatttccaattgggtaatgcaacaagaagcttgatttcgttcttactcattaaacaaggcctagtgttatttttgcatttttagttgtatgctgattgaatcaagagcagtctaaaagatattcgaactctcaattctacactgtctagccaaaagaaccatttccagggcaagtgaatcagaagatactatttgtatttattcttttgagcttgatgttgcagaatgaattttcagtatggtgtttatttcagtatccttacatgctctggatttgctaatttgaatattaccataactagatcaaaaaaaaaaaaaaaaaaa

SEQ ID NO: 8549 - DNA, 1381 bp, Solanum phureja
aaccaataacggtccattctcccagctgtgccgaatgcccatacatgtgaattaatagactcgaaacccatcgtgtgtaacactccaagattcaatctttagatctatacgcttctttttatatatactttataatcttgttttcttgccaaactactgtttctgccattcaaacatggagtcttgcatctaccatcagctcaaatcccagcctgtatggcttcttttgcttctttctttaggtttcttgaaagtcttgtgcttttcagtcatctttctcaaatgggtctatgtcaatttcctcagacctgctaagaatcttaagaaatatgggtcatgggcacttgttactggacctacagatggtattgggaagggctttgcttttgaattagctcgaaaagggcttaatttggttcttgtgggtcgtaaccctgataaacttaaggatgtttctgaatcgattaatgctaaatatggacagacccagatcaaaacagtggtcgttgatttctctggtgatttggatgaaggggttaagaagattaaggagacaattgaaggattagatattggggttttgattaacaacgttggggtttcgtatccttatgctagatttttccatgaagtggatgataagctgttggctgatttgattaaagttaatgtggaagggactacaaaggttactcaagctgttttgcctggtatgattcagaggaaaagaggagcaattgttaatattggttctggtgcggctattgttatccccgctgatcctctgtatgctgtttatgccgctactaaagcatacattgatcagttctccagatgcctctatgtagagtacaagaagagtggaattgatgtgcaatgccaggtgccgttgtatgtggcaacaaaaatggcgtcaatcaaaagatcttcattttttgttccctcgactgatggttatgctcgggctgccctgcgatggattggtcatgagccaaggtgcacaccttactggccccattctcttctgtggggtttgctatattcatcaccagaatcaatggttgatgcttggcgtctgaagttctgcattggaattcgaaggagagggcagctgaaggattccaggaagaacgaatagaaagcattgcctttacctcattcgatatcttaaattctgctaagtagacaattactttctgtctctatttccaattgggtaatgcaacaagaagcttgattttgttcttactcattaaacaaggcctagtgttatttttgcatttttagttgtatgctgattgaatcaagagcagtctaaaagatattggaactctcaattctacactgtctagccaaaagaaccatttccagggcaagtgaa

SEQ ID NO: 8550 - DNA, 1418 bp, Solanum melongena
atggactttggataaacaatacgcattttaggcggccttttaaatgcccaactacggctgcataaccatattcaatttcccctgccgtccatatgcattaatacaaagattcaaactttagatctatacttcttttttattatataaataaactcatttctctttgttttcttgcaagctactgattctgttccactcaaaaatggagtcttgcatctaccatcagctcaaatctcagcctttatggcttcttttgcttctttccttaggttctctcaaagtcttgtgctattcactcatctttctcaaatgggtatatgtcaatttcctcagacctgcaaagaatctcaagaaatatgggtcatgggcacttgttactggacctacagatggtattggaaagggatttgcttttcagttagctcgaaaagggcttaatttggttcttgtgggtcgtagccctgataaactcaaggacgtttctgaatcgattaaggctaaatatggacagacccagatcaaaacagtggtcgttgatttcaccggcgacttggatgaaggggtaaagaagattaaggagacaattgaaggattagatgtgggggttttgattaacaatgttgggatttcgtatccttatgctagatttttccatgaggtggatgataagctgttcgctgatttgataaaagttaatgtggaagggactacaaaggttactcaagctgttttgcctggtatgattcagaggaaaagaggagcaattgttaatattggttctggttccgccattgtcatcccctcggatcccctctattctgtttatgccgctacaaaagcatacattgatcagttctccagatgcctctatgtggaatacaagaagaatggaattgatgtgcagtgccaggtgccattgtatgtggcgacaaaaatggcttcgatcaagagatcttcattttttgttccctcgactgatggttatgctcaggctgccctgcgatggattggttatgagccaagatgcacaccttactggccccattctcttctgtggggtttgctatattcattgccagaatcgattgttgatgcttggcgtctgaagttctgtagtggaattcgaaggagagggcagctgaaggactccaggaagaatgaatagaaaacatctcctttacctcagtccatatcttatgtctgattagttgaattctcatcttgtttctgtttctgtttccaattggataatgctattttacttcatactcattaaacaaggcctagtgtccctttttgcccttttagttgtaagccgatcgaatcaagagcagtctaaaagaaattccaactctcaattctataccgtgtagccaaaagaaccatttccaggggtgaatcacaatgtttctgttcgt

SEQ ID NO: 8551 - DNA, 1461 bp, Nicotiana tabacum
ggtgcccaaccacgtgcaatagtagattgtgctaatattaaaccccatcttcgtacgtaacgctcaaaaatccaatctttagatctatatttagctgcacaaatcttgtactgtttctgttccacttgcacatcacacaatggaaacttgcatctatcatcagctcaaatctcagcctttttggcttctttttcttccttctttaggttctttaaaaatcttatgcttttcaatcatctttctcaaatgggtctatgttaatttccttagacctggcaaaaatctcaagaaatatgggtcatgggcacttgttactgggcccactgatggtataggaaaaggctttgcttttcaattagctagaaaaggacttaatttagttcttgtgggtcgtaatcctgataaattgaaagacgtttctgattcaattaaggctaagtatggacaaatccagattaaatcagtggttgttgatttttctggtgatttggatgaaggggttgagaagattaaggagacaattgaagggttagatgttggtgttttgattaataatgttggggtttcgtatccttatgctagattttttcatgaagtggatgataagttattggctgatttgattaaagttaatgtggaagggactactaaggttactcaagctgttttgcctggtatgttgaagaggaaaaaaggtgctattgttaatattggttctggtgctgcaattgttatcccctctgctcccctttatgctgtttatgctgctactaaagcatacgttgatcagttctctagatgcctgtatgtagagtacaagaagagtgggattgatgtgcaatgtcaggtgccgttgtatgtggcaacaaaaatggcgtcgatcaaaagatcttcattttttgttccctcgactgatggttatgctcgggctggcctgcgatggataggttatgagccaaggtgtacgccttactggccccattctcttctgtggggtttgatatattcattgccagagtcgattgttgatgcttggcgcctgaagttttgcatgggaattcggaagagggggcagatgaaagactccaggaagaaggaatagaaagcacctttctcacctcatcccttatctttaagtctgattagctgaattcctatcttcttccttctgttcctgtatccaattgagtaatgctaattctgataatgcaacaagaaggttgggtttgttcttactaaacaagcctgatgtcattcttgtgtgttcttagctgtaggctgtttgaatcaagagtagtccaaaagaaccatttttccaggacaagtaaatcagaatgattctgtttgtatttgttctttgagatttgatgttgcagaatgaaatttaagtttgatgtttacttatatggaccaatgaagtaccctatgatttaagagaaactttcagcggccgcatgaggg

SEQ ID NO: 8552 - DNA, 1411 bp, Nicotiana benthamiana
tctatatttagctgcacaaatcttgtgctgtttctgttccatttcacacatcacaaaatatggagacttgcatctatcatcagctcaaatctcagcccatatggcttctttttcttctttctttaggttctttaaaatttttatgttttttgctcgtttttctcaaatgggtctatgttaatttccttagacctggtaaaaatctcaagaaatatgggtcatgggcacttgttacaggacccactgacggtataggaaaaggctttgcttttcaattagctaaaaaaggacttaatttagttcttgtgggtcgtaatcctgataaattgaaggatgtttctgattcaattaaggctaagtatggacaagtccagattaaatcagtggttgttgatttttctgatgatttagatgaaggggttaagaagattaaggagacaattgaagggttagatgttggtgttttgattaataatgttggggtttcgtatccttatgctagattttttcatgaagtggatgacaaattattggctgatttgattaaagttaatgtagaagggactactaaggttactcatgctgttttacctggtatgttgaagaggaaaaaaggtgctattgttaatattggttctggtgctgcaattgttattccctctgatcccctttatgctgtttatgctgctactaaagcatacgttgatcaattctcaagatgcctgtatgtagagtacaagaagagtggaattgatgtgcaatgtcaggtgccactgtatgttgcaacaaagatggcgtcaatcaaaagatcttcattttttgttccctcaactgatggttatgctcgggctggtctgcgatggataggttatgagccaaggtgtacgccttactggccccattctcttctgtggggtttgatatattcattaccagagtcgattgttgatgcttggcgtctgaagttctgcatgggaattcgcaagagggggcagatgaaagactccaggaagaaggaataggaagccccttcctcacctcatccattatcttaagtctgattagctgaattcctatgctcttctttctgttcctgtttccaatagggtaatgctaagtctgataatgctacaagaattttggttttgttcttatttaaacaagcctgatctcattcttgtgcgttcttagctgtacgttgtttgaatcaagagtagtccaaaagaaattcgagttctcagatctctattatgtctcgccaaaagaaccattttccagggcaagtatatcagaatgattctgtttgtatttgttctttgagtttgataaatttaaacttggtgtttacttatatgaaccaatgaattaccctatgttttaatacatagcagataattctttgttttgaata

SEQ ID NO: 8553 - DNA, 1459 bp, Capsicum annuum
tccattcccattccccatgtgcaattataattaattccccataatattcacaacccatcggacgtaacgccccaaaagatcaaatctttaagatctatacgttatattttgctgtatatattaatacatttctctagcgagacctattgtttgtttgtttgttttccactcacacatggaatcttgcatctaccatcagctcaaatctcagccaatatggcttgttttgcttctctctttaggtatcttgaaagtcttgagcttttcagtcatactgctcagatgggtctatgttaatttccttagacctgccaagaatctcaagaaatatgggtcatgggcacttgttaccgcacctactgacggtattggaaaggcttttgctttccaattagctagaaaggggcttaatttaatacttgtgggtcgtaatcctgataaacttaaggatgtctgtgattcaattaaggttaaatatgggaaagtcgagattaagacagtggtggttgatttctctggtgatttggatgaaggggttaagaagattaaggagataattgaaggattagatattggggttttgattaataacgttggggtttcgtatccttatgctagattttttcatgaagtggatgataaattgttggctgatttgattaaagttaatgtggaaggaactactaaggttactcaagctgttttacctggtatggttcagaggaaaagaggtgctattgttaatattggttctggtgctgctaatgttatccctgctgatccactttacgctgtttatgccgctaccaaagcatacattgatcagttctccagatgcctctatgtagagtacaataagagcggaattgatgtacaatgccaggtgccattgtatgtggcgacaaaaatggcgtcaatcagaaggtcttcattttttgttccctcaactgatggttatgctcgggctgcgctacgatggattggtcatgaccctaggtgcactccttactggccccattctcttctgtggggtttgctatattcattgccagagtcagctgttgatgcttggcgtctgaagttcaacatgggaattcggaagaggggccaactgaaggacaacagaaagaaggagtaggaagcatctgctttttacctcattccgtctgattagttgatttctcattttcttctatttctgtttccaattgggtaatgctagttctggtaattaaacaagaagctttatttcattctacttattaaacaaggcccagtgttcttgttgcattttaagctgtaggctgcttgaatcaagagcagtctaaaagaaattcgaactctcagttctacacactgtcttgtcaaaagaaccatattccaggacaagtaaatcagaatgattctgtttgtatttgttctttgagtttgatgttgcagaatgaatattcaatacggt

SEQ ID NO: 8554 - DNA, 1321 bp, Ipomoea nil
caaccctctcatatattcaaagctaaacccaccattttcaactgctctctgaagctataaacagctcagaagtcagagctgctccaaacctccattcttaaccgtgtagaaagctctgagtttgctcagttgccgtgtactctttcacttcgaccatggaggcctgtgtctatgaacagctcaaatctcagccgccatggcttctcgtgctactagctctcggattcttgaagcttctcgccttgtctgtaaccgttctcaaatgggtccacgtcaatttcctccgcccggggaagaatctcaagaaatacgggtcatgggcgctggtgacggggccgaccgacggtatcggaaaagggtttgcgtttcagttagctcggaaagggctgaatttagttcttgtggggcggaacccggagaagctgaaagatgtttccgattcgataaaggccaagtacgggcagacccaaatcaagagtgtggtggtggatttctccggcgatttggacgacggcgttcggagaatccgggaggcgattgaggggatagatgtcggagttttgattaacaacgtcggcgtttcttatccgtacgcgaggttttttcatgaggtggatgataagcttttggctgatctgattaaagtcaatgtggaagggactactaaggttactcaggcggttttaccggggatgattcagaggaagaaaggagctatcgtcaatattggctccggcgccgccattgttatcccttcagatcccctttattctgtctatgccgccactaaagcatacattgatcaattttcaagatgcctttatgtggagtacaagaaaagtgggattgatgtgcaatgtcaggtacccttatatgttgcaacgaaaatggcatcaatccggagatcttcgttctttgttccatcaactgatggttatgctcgggctgccttgcgttggataggttatgaacctaggtgcacgccatattggccccattcgcttctatggggcttgctctattcattgcccgagtcagcagttgatgcttggcgtctgaagttttgcctcggaatcagaaagcgagggcagctcaaggactcgaggaagaccgaataggagccactagtcttgcccatcccattgtttcgctgttattttcagtttcatttatactatgaatgatttccatgttatctgaaactgcaatttgaggtggtaggacttcctttgttatagctttatttgccttatgtacccttcttcttcctctaaataatttctaagtttggctgatgactttagtgcctttgtaaggggat

SEQ ID NO: 8555 - DNA, 1383 bp, Petunia hybrida
tcttgagatctatttagctgtctttatatatactttcttgcacaattctattgtttctgttatacactcaaaaagatggaaacttgcatctaccatcagctcaaaactcaacctttatggcttctttttctactttctttaggttctttaaagctcttatcttttgcattcatagtcctcaaatgggtgtatgttaatttccttagacctggtaaaaatctcaagaaatatggatcatgggcacttgttacaggacccactgatggtattggaaaagcttttgcttttcagttagctaaaaagggtcttaatttgattcttgttggtaggaatcctgataaattaaatgatgttagtgcttcaattatggctaaatttgcaaaaacccaaatcaagaatgtggttgttgatttttctggtgatttagatgaaggggttgttaagattaaggaagcaattgaaggattagatgttggtgttttgattaataatgttggtgttagttatccttatgctagattttttcatgaagtggatgaaaaattattagctgatttaattaaagttaatgttgaagggactagtaaagttactcaagctgttttacctggtatggttaaaaggaaaaaaggtgctattgttaatattggttctggtgctgctattgttattccttctgatcctctttatgctgtttatgctgctactaaagcatacattgatcagttctctagatgcctctatgtagagtacaagaagagtgggattgacgtgcaatgtcaggtgccgttgtatgtggcaacaaaaatggcgtcgattaaaagatcttcattttttgttccctcgactgatggctatgctcgggctggcttgcgatggataggttatgagccaaggtgcacaccttactggccccattctcttctgtggggtttgctatcttccttaccagagtcaattattgacgcatggcgtctgaagttctgcatcggaattcggaaaagaggacagttgaaggactccaggaagaaggaatagaaagcaccttcttgacatcatgccatatcttaatttctctgtcgctctattgttccacttgatgtgtgctcaggttttataggtaactgaaagataaatttagtcagtagactttagtttacatttcatcttttcgggactcaactttattgcaagagaaatttccccttgttggggctgtccctttcctttatgttcctttatttgtgcacatccaatgtggtcagtgcgttcaatatgactattgaaagaattctgattaattcggtcgatagacttcagttcctacattttacatttcatcttttcagggcttcgactttatctcaagagaaattttccctt

SEQ ID NO: 8556 - DNA, 1296 bp, Tabernaemontana elegans
agaatccctcatccgttctagtgctgactaaaacaatttccagatcccctcacctctctcggctctcactcactgttgtttcctccgccttgtaaaccaaatggagtcttgtttatttcatcaagttcaagaattgaaatctcaacctctgtggttactactattgctcgccgtaggttctttgaagttacttctttcgttactatctgtactcaaatgggtttatgttaacttccttagacctcccaagaatctcaagaaatacgggtcatgggcacttgtaactggaccaacggatggcattggcaagggctttgctttccagctagcacgtaaagggctcaatttagttcttgtgggtcggaaccctgataaactcaaggatgtttccgattcaatcaaggaaaaaaatggtcaaacccagatcaaaacggtggtggttgacttttctggtgacttagacgaaggcgttcagaagattaaagacactattgaaggattggatgttggtattttgattaacaacgtgggagtttcttatccctatgctaggtttttccacgaggtggatgagaaattattggctgatttgattaaagttaatgtggaagggactactaaggttactcaagctgtgttgcctggaatgatcaagagaaaaaaaggggctattgttaatattggttctggtgctgccatagtcatcccttcagatcctctctatgcagtctatgctgccaccaaagcatatattgaccagttctctagatgcctgtatgttgaatacaagaagagtgggatcgatgtgcagtgccaggtaccattatatgtggcgactaagatggcatcaatcagaaggtcatccttctttgttccatcaaccgatggctatgctcgggctggtctgcgctggattggctatgaaccacgttgcacaccatactggccacattcggttttgtgggctttagcatattcattgcctgagtcgattgttgatgcttggcgtctgggtttctgccttaagattcggaagagaggacaggttaaagattccagaaagaaggaatagaaagcatgtttcctttcccccttgtctttttatctcttattctctccatcctgtccgagaatgttgctaagatatgtagccaatttccagctaaaatttctaggcccacttctggtgtttgatactaccttgctcccattgaagggcattgtagcttgcaaaagaccgagtcgtgataactcacaagttcagattacttttcctatctgtagaatcttcatgaa

SEQ ID NO: 8557 - DNA, 1500 bp, Amsonia hubrichtii
cctcctttccttttatggcttctttttctacgttagtgtactgactactgagtactgatcccatctaaacaaatttcagatcccattgcttgtcttgcctctagcttagcatcggttcctccgctctgattacacaatggagtcttcttgtctgcttcatcaagttcaacaattgaaatctcaacctctgtggctacttctgttattagctttagggtctttgaaagtgcttcttttgttactatctgtactcaaatgggtttatgttaacttcctcagacctcccaagaatctcaagaaatatgggtcatgggcacttgtaactggaccaactgatggtattggcaagagctttgctttccaactagcacgtaaagggctccatttagttctggtgggtcggaaccctgataaactcaaggatgtttccgactcaatcaagactaagtatggccagacccagatcaaaaccgtggtggttgacttttctggtgacttaaacgaaggtgttcagagaattaaagataccattgaaggattggatgttggtgttttgattaacaacgttggggtttcttatccctatgctaggtttttccacgaggtggatgagaaattgttggctgatctgattaaagttaatgtggaagggactaccaaggttactcaagctgtgttgcctggaatgctccagagaaaaagaggggctattgttaatattggctctggtgctgccatagtcatcccttcagatcctctctatgcagtctatgctgccaccaaagcatatattgatcagttctctagatgcctctatgttgaatacaagaagagtgggatcgatgtgcagtgtcaggtaccattatatgtggcaactaagatggcatcaatcagaaagtcctccttcttggttccatcaacagatggctatgctcgggctggtctgcgctgggttggctatgaaccacgttgcacaccatactggccccattcggttttgtgggctttggtgcattctttgcctgagtggattgttgattcttggcgtctgggtttctgccttaagattcggaagagaggacagctcaaggactcaaggaagaaggaatagaaagcatggttctttccctgtcacgtggttttatctctttttctcttcaccctccgaagatgttcctaagatgtgtagccaatttccagctagaatttctagatggtctacttccgagtttgagtactaccttgccctgactgaacggcatttagaatgcaaaggaacctgagttctgagaacttatgaagttcaaattactcttcctactgctagaatcttcatgattggcttttcagattgtaattttgtttgtgtgtttagttaatggtactactggatattatttgtccttttcctttgtaatggattattaagtacacgagaaaacactaaatcaggtgttcaggaaatcttctataggtcaatatctattaagaatacaagga

SEQ ID NO: 8558 - DNA, 1068 bp, Vinca minor
tgtactactgactaccaaattttcagatcccataacatcatacattgttttctccgatctggactacatttttgtggactaaaaatggagtcttgtccgtttcatcaagttcttgaactgaaatctcagcctctatggatacttctgttactgggcttaggttctttgaaatcccttattttgttagtgtctttactgaaatgggtttatgttaatttcctcagacctgccaagaatctcaagaaatatgggtcatgggcagttgttaccggaccaactgatggaattggaaaggcttttgctttccaattagctcgtaaagggctcaatttagttcttgtgggtcggaatcctgataaactcaaggatgtttctgagtcaatcaaggataaatatggccagacccaaatcaagactgtggttgtggacttttctggggaattgaatgaaggaattcagagaattaaagaaaccattgaaggacttgaagttgggattttgattaacaatgttggggtttcttatccttatgcaaggtttttccatgaagttgatgagaaattgttggctgatttgattaaggttaatgtcgaaggtactactaaggttacccaagctgtgttgcctggaatggtacagaggaaaagaggggctattgttaatattggttctggtgctgccattgttatcccttcagatcctctctatgcagtctatgccgccaccaaagcatatattgaccagttttctagatgcctctatgttgaatacaagaagagcgggatcgatgtgcagtgtcaggtaccattatatgtggcaactaagatggcgtcaatcaaaaggtcatccttctttgttccatcaacagatggctatgctcgtgctggtctgcgctggattggctatgaaccacgttgcacaccctactggccccattccgttatgtgggctttggcatcttctttgcctgagtcgattattgatacttggagactcggtttttgcctcaagattcgaaagagaggacagcttaaggatgccagaaagcaggaatagaaatcagttctt

SEQ ID NO: 8559 - DNA, 1165 bp, Actinidia deliciosa
aaacgctctgcgtcatggagctctgttctgtcatggagccgctcaaatctcagcctctttggcttcttctccttctgggtctcggttctttatcattactcaagtgttctttcgcttttctcaaatgggtctacgtccatttcctcagacccgccaagaatctgaagaaatacgggtcgtgggcacttgttaccggacccaccgatggaatcggtaagggtttcgccttccaattagctcgtaaagggcttaatctggttctcgtgggtcgaaaccctgagaagctcaaggatgtttcggactcgatccgggccaaattcaggcaaacccagatcaagaccgtggtggttgatttctctggcgatttaaacgaaggggtcaatcggattcgcgaaacgattgaaggtttagatgtggggattttgattaacaacgttggggtttcgtatccctacgccaggttttttcacgaagtggatgacaaattgttgggggatttgattaaagtcaatgttgaagggactacgaaggttacacaagcagtgttgcctggaatgatcaagagaaagaagggtgcgattgtcaatattggttctggtgctgccattgtgatcccttctgatccgctttacgcagtttatgcggccaccaaagcatacattgatcaattctcaaggtgcctttatgtggagtacaagaagagtgggatcgatgtgcagtgtcaggtgcccttgtacgtggcaacaaagatggcatcaatcagaaggtcctcgttcttcgttccatcaaccgattgttatgctcgggctggtttgcgttgggtaggctatgaaccacgttgcactccttactggccccattcccttctgtgggccttggcatgcttgttgcccgaatccattatcgatgcttggcgtctccggttctgcctcgcaattcgaaagaagggacaactcaaagactcgaggaagaaggaatagacatcattcttctctccatttatttttttctgtgaggatgtgaagagagaactttgcaatccataatgcttctatttacgttgccttcatgtactttttacgaggctgagagaggagtctggatgatttatggtagaattttaagaacttgttcaatctagctgattgttttctaaaaaaaaaaa

SEQ ID NO: 8560 - DNA, 1042 bp, Manihot esculenta
aaatggagctttattttctcgataagctcaagggtcaaccttcctggattcttgtgctattcactgtgggttctttatcagttctgaaatgcttcttcgctttccttaattgggtttatgtcaatttccttagacccgctaagaatctgaagaagtatggatcatgggctcttgtaaccggacctactgacggtattgggaaagggttcgcttttcaattggctcgaaagggtctcaatctggttttggttggtcgaaatcctgataagctcaaggatgtttcggattctattcagtccaaatatggtaaggtccaaatcaagaacgttgttgttgatttcagtggggatatcgacgagggtgttaagaaaattcaggagacaattgaaggattggatgttggtgtcttgattaataacgttggggtttcatatccatatgcgagatttttccatgaagtggatgatgacttgttgaagaacttgattaaggtgaacgtagaaggcactaccaaagttacacaagctgttttgcctgggatgttgaagaggaagaaaggtgctatagttaatatcggttctggtgcagcaattgtcattccttctgatcctctttatgctgtttatgcggccaccaaagcgtacatagatcaattctcaaggtgcctttatgttgaatacaagaaaagtgggatcgatgtgcagtgtcaggttccactatatgtggcaacaaagatggcatccattaggagatcttccttcttcgttccgtcaacagatggttatgcccgggcaggtctgcgttggataggctatgaacctcgttgcacaccgtactggcctcattctcttctttggggtttgctatgtgcattgccagaatccattgttgatggatggcgactccgctattgccttgggattcgaaagaaagggcagctgaaggattctaggaagaaggaataaacagtactcctttgtattaatggagtcagcctagctggtcattatatgttgttcactttgtggttttgaacacatgg

SEQ ID NO: 8561 - DNA, 1283 bp, Olea europaea
tttttgttgcatttgtctttgagtactgtttcattcttctagaaattaactcccatcaaattcttagatccgtcacccatggcggagtgtatattggaacagctcaaatcccagcccacatggcttcttccgctactggtactcgggtttttatcgctattcaaatgctcattcaccatcctgaattgggtctacgtgaattttctccgacccggaaagaatctcaagaaatacggatcttgggctctggtcaccgggcctactgacggcataggcaaagcctttgcttttcagttggcccggaaagggctgaacctggttcttgtgggtcggaacccggataagctccgggaagtttcggactcaatcaagtccaaacacggatccacccagatcaagactgtggtagttgatttttcgtgtgatttgaatgatggagtaggaagaattaaagagacaattgaaggactggatattgggattttaattaacaatgctgggatttcttatccttatgcaaggtttttccatgaattagatgaaaaattgttaaatgatttgattaaggttaatgttgagagcactacgaaggttactcaagctgttttacctgggatgctggagaggaaaaagggggctatcgttaatatagggtccggtgctgccatggttatcccttctgatcccctttatgctgtttatgctgccaccaaagcatatattgatcagttctcaagatgcctctatgtggagtacaagaaaagcgggattgacgtgcagtgtcaggtccccttgtacgtggcaacaaaaatggcatccataaaacgttcctccttcttcgtaccatcgacagatggctatgctcgggctgcccttcgttggataggctacgaaccacgatgcacaccgtactggcctcactctcttctctggggtttgctatattcgttgccagagtctgttgtcgatgcttggcgtctgaagttctgccttgggattaggaagaggggacaactcaaggactcgaggaagaaggaatagatttcctgtcataatctcccagtatgtgttactttttccaagggtctgttttgttcaggacgatgtttgagatatgggaaatttgaggattagagtcgaaactcgttgaaagtttcatcttttagtgctttaatgtattctgtcttgttatgagatcgtacttgagttcagcagtgtcaatattcttgtaactttagttctgaacttgcctttttctcctaaaattattgtttacaagtcgt

SEQ ID NO: 8562 - DNA, 1527 bp, Gossypium hirsutum
ctacttcaccgactactttattttttcatttatagataatcagtccttcccttttcctctttttgattcccatctgtttctgcctaaccgaactgctaaagattccccttttcgttatcgtgcgctctatttatatccccttaggtctctttctttggtattcacctaagtttcaagtttctcctcttaggtaatccatggaagcctgcttcttcgatactctcaaggctcaatctttctgggttattttccttttcactttgggttctttatcactcttgaagttctcatttgtttttctaaaatgggtctggatcaattttcttagacctggtaagaatctaaaaaaatatggctcctggggtcttgttactggaccaactgatggtatcggcaaaggatttgcctttcagctggctaggaaagggcttaatcttgtcttggtgggccgtaatcctgataaactcaaagacgtttccgattcaatcttggccaagtatgccaagattcggatcaagacagttgttgtggacttcactggcgatcttgatgaaggcgtgaagaagataaaagaaactattgaaggactggatgtgggggttttgattaacaatgttgggatttcatatccttatgccaggttcttccacgaggttgatgaggagctgttgatgaatttgattaaggttaatgttgaaggtaccacaaaggtaactcaagctgttttgcctgggatggtgaagagaaagagaggcgcaattgtgaacattgggtctggtgctgccattgtcatcccttctgatccactctatgctgtttatgctgctactaaggcgtatattgatcaattctctaggtgcctttatgttgaatacaagaacagtgggattgatgttcaatgtcaggttccattatatgtggcaacaaaaatggcatcaatcaaaagatcgtctttctttgttccatcaacagacggatatgctcgtgcagcaatgcggtggataggctatgaacctcgttgcacgccctactggccccattccatcctctggggcttggcttattcactgccagagagtgtggttgatgcatggcgtttgcgcttttgtcttggcattcgaaagagggggcaactcaaagattctaggaagaaggaatgaaaacagattgttgagtctgctgtattttgtgttcatggagttgagtgttttggttggatgaatgagctccagaaccgtccaaccccccaaatattgtaatcgcttcataaatttgttttcaagcattgcaattgcattgtgacacttccattatgtagggaaggataaggatgaaagcatacaaatgtatgaatcgtctgcctgcatgatttgcttttacgagtttaaagtatacaaaaatttgtaatgcaatactaatatttctagctaagcaaaaatgttcaaatgattaaagtttgatctagctaagcaaaaattgctcaagctgtcgattgaaatatagataaatgggtaccttaaaacccaa

SEQ ID NO: 8563 - DNA, 1539 bp, Gossypium raimondii
ccactgtgattttattctcctgtaaataccaatgcccctcaacagtcaaactcctaagtagttaatgaaggtggttttcatctcatctacttcacccactatatttttttcatttatagataatcaatccttccctttttctctttttgattcccatctgtttccgcctaaccgaactgctaaaaagattccccttttcgttatcgagcgctctacttatatccccttacatctctttctttggtattcacacaagtttcaagtttctcctctacgtaatccatggaagcctgcttcttcgatactctcaaggctcaacctttctgggttattttccttttcactttgggttctttatcactcttgaagttctcatttgtttttctgaaatgggtctggatcaattttcttagacctggtaagaatctcaaaaaatatggctcctggggtcttgttactggaccaactgatggtatcggcaaaggatttgcctttcagctggctaggaaagggcttaatcttgtcttggtgggccgtaatcctgataaactcaaagacgtttccgattcaatcttggccaagtatgccaagattcagatcaagacagttgttgtggacttcactggcgatcttgatgaaggcgtgaagaagataaaagaaactattgaaggactggatgtgggggttttgattaacaatgttgggatttcatatccttatgccaggttcttccacgaggttgatgaggagctgttgatgaatttgattaaggttaatgttgaaggtaccacaaaggtaactcaagctgttttgcctgggatggtgaagagaaagaaaggcgcaattgtgaacattgggtctggtgctgccattgtcatcccttctgatccactctatgctgtttatgctgctactaaggcgtatattgatcaattctctaggtgcctttatgttgaatacaagaacattgggattgatgttcagtgtcaggttccattatatgtggcaacaaaaatggcatcaatcaaaagatcgtctttctttgttccatcaacagacggatatgctcgtgcagcaatgcggtggataggctatgaacctcgttgcacgccctactggccccattccatcctttggggcttggcttattcactgccagagagtgtggttgatgcatggcgtttgcgcttttgtcttggcattcgaaagagggggcaactcaaagattctaggaagaaggaatgaaaacagattgttgagtctgttgtattttacgttcatggagttgagtgttttggttggatgaatgagctccagaaccgtccaaccccccaaatattgtaatcgcttcataaatttgttttcaagcattgcaattgcattgtgacacttccattatgtagggaaggataaggatgaaagcaaacaaatgtatgaatcgtctgcctgcatgatttgcttttacgagtttaaagtatacaaaaatttgtaatgcaatactaatatttctagctaagcaaaaatgttcaaatgattaaa

SEQ ID NO: 8564 - DNA, 1640 bp, Hevea brasiliensis
acaatgcaatttactcgaaagaaggaagcagaggtcctgtcctcttgttctggtatggctgttcatcaatagttgttaaatgcggtggttttcagctcatctactttgccaccctctgcccatttcaaatcttaataaatctctcactctaaactgtttctgcctaaccctacttcttctctgcttcacttcgccctctgtttttctttgttagctaccgtttgtgtagtcaattctcacccattcccaccaaactcaaaatccaatataggaacagggatactctcttttttgtctatattattctttcttgagcaaaacccacttcccagatctctctcttttcatttttgatcgaagaaaacagttgctctccaaaatggagctttgttttgtagataagctcaaagaacagccttactggcttcttgtgttattcactatgggttctttatcagttttgaaattcttcttcgctttcctcaaatgggtttacgtcaatttcctcaggccggccaagaatctgaagaaatatggatcatgggctctcgtaaccggacctactgacggtattggcaaaggtttcgcttttcaattggctcgaaagggtatcaatctggtattggttggtcgaaatcccgataagctcaaagatgtttcggattctattcagtccaaatatggcaaggtccaaatcaagaccgttgttgttgatttcagcggcgatatcaatgagggtgttaagaaaattcaggagactattgaaggattggatgttggtgtcttgattaataacgttggggtttcatatccctacgcgaggtttttccatgaggtggatgaggagttgttgaagaacttgatcaaagtaaacgttgaaggcactactaaagttacacaagctgttttacctggtatgttgaagaggaagaagggtgctatagttaatatgggttctggcgcagcagttgtcattccttctgatcctctctatgcggtttatgctgccaccaaagcgtatatagatcagttctccaggtgcctttatgttgaatacaagaaaagtgggatcgatgtgcagtgtcaggttcctctctatgtggcaacaaagatggcatcaattaggagatcttccttcttcattccatcaacagatggctatgcccgggcaggtttgcgatggataggccatgaacctcgttgcacaccttactggccccattctcttctttggggcttgttatatgcattgcctgaatccattattgatgcatggcgactccgcttttgccttgggattcgaaagaaaggacaacagaaggattctaggaagaaggagtaaacagtactctcttgtattaatcgagtcagggtagctagccatggttggctgttcagtttgtggattgaactcttggaatttaatcttttctgtcatctttcctacattttcttttgcattttagtactaagaacaaccttttaccttttgcatgtactcttatggagaagttgcaaaacattaacatgcctatattatcttgaacttcggttcttgggggccttggttttctcaagacatggttcaaatggtgtgaaattgaagagttcaatcaatctttataacgaaatactgttgg

SEQ ID NO: 8565 - DNA, 1522 bp, Tropaeolum majus
cggccgggggtttgcagctcatcgacttcacccaccttcataatcttctaaaaaaccattctttcctccatcattttccgtatataattcaaattcaatgcgcccattcgccatctgtctctgctaaacccattctccattctcatttaaagccattctctgtttacctcgttagttccgcctcctctcactctaaaaacttcaatataggatagagataccatagtctccagaacccactttggatatcctcatctgggttctctttcagatctgttcgttttttttttttaaatttccggatccttcaaaatcttcaacaatggaggtctgtttgttagagactctcaagtcgcagcctatttgggttattgctcttttctctttaggttcactttcggttttgaagttttctctatcgattctcaaatgggtttacgtcagtttcctcagacctggcaaaaaccttaagaaatacgggtcgtgggctctggttaccggacctacggatggtatagggaagagcttcgcgtttcagttagccaggaaggggattaatctggttttggtgggacggaatccggataaattgaaggatgtatcggattcgatcgtggctaaatacgggaaaaccctaattaaaaccgtcgtggtggatttctctggagatctcgatgaaggtgtgaacaagatcaaggaaacgatcgagggattggatattggggttttgattaacaacgttggtatctcgtatccttacgctaggtttttccatgaagtggatgagaaattgttgaagaatctcatcaaggttaatgttgaaggtactactaaggtcactcaagctgtcttgcctggtatgttggaaaggaaaaaaggggctattgtcaatattggatctggtgctgccattgttataccttctgatcctctttatgctgtttatgctgcaacaaaagcgtatattgatcagttttcaaggtgtctatatgttgaatacaagaagagtgggattgatgtgcagtgtcaggttccgttgtacgtagcaaccaagatggcatcgatccgacgatcgtccttcttcgttccatcaacagatagctatgcaaaggctggtctccgttggatagggtacgagcctcgttgcacgccttactggcctcactcactcctctggggattggcatctttattgcctgagagcgcgattgacgcctggcgtcttcccttttgtatgaaaatccgaaagaggggacagctcaaggatgctaggaaagacgagtaggttgtaggttgtatttctagggagaagaaaaagaaaaaacttgtttgccctcgtgtttgtagctcgtttttatcgtttggattacgatttacgtttgttaaattgtgtttttcactgttttgtttgcttcgggtcactccactttgaaatctttaatccctagtcgataggaagctttgatacttgagtttggtattgtctgaacaaacttatatcgatacgaatttaaattttaat

SEQ ID NO: 8566 - DNA, 1447 bp, Olea europaea
cgtcgtaattcatggcggagtgcatattagagcagctcaaatcccagcccacatggctgcttccgcttctaacactcggtgttttatcacttttcaaatgtttattctccattctgaaatgggtctacgtgaatttcctccggcccgggaagaatctcaagaaatacggatcttgggctctggtcactggcgctactgacggaataggcaaagcctttgcttttcagttggcccggaaagggctgaacctgattcttgtgggtcggaacccggataagctccgggaagtttcggactcgatcaagtccaaacacgggtcaacacaaatcaagacagtggtggttgatttttcgggtgatttgaatgatggtgtaggaagaattaaagagacaattgaaggactggatgttggggttttgattaataatgctgggatttcttatccttatgcgaggtttttccatgaggtggatgaaaatttgttgaatgatttgattaaggttaatgttgagggtactacaaaggttactcatgctgttttacctgggatgttgaataggaaaaagggggctattgttaatatagggtcaggtgctgccactgttataccttctgatcctctttatgatgtttatgctgcctccaaagcatatattgatcagttctcgagatgtctctatgtggagtacaagaaaagcgggattgatgtgcagtgtcaggttcccttgtatgtggcaacaaaaatggcatccatcaaacgttcatccttcttcgtaccatctacagatggttatgctcgggctgctcttcgttggataggctatgaaccacgctgcacgccgtactggccccactctcttctctggggtttgctgtattccttgccagagtcaattgtcgatgcttggcgtctgaagttctgccttggaattaggaagagaggacaactcaaggactcgaggaagaaggaatagaagctttgtcatctctcagtgtgtgtgaccttctgcaaggatttattcattcgaggatgatgcctgagacatgggaaattcgagggattgaattcgaaactggaaaaagtttaatcattttactgatttaatgtacttgtcttgttacgaaatcatatatgagttggggggcaaaaattgcatttttcttttaaacttgtttaagcatgcgagttttccttttgttgtacgtcctcgaggcaattgaggattatttgatttggggaaaaaatgaaaatccaggcctgggcctggctccgaccggaacataatatggtcattgacattggccatagactagcatggactggacctgtctggattacatgccgtcctggttagcaggctgactctagcatgctgcaagtgggcaattttgttcaggttatactcctgatgccctttcaggagaggtggactggcggaatcagcct

SEQ ID NO: 8567 - DNA, 1285 bp, Manihot esculenta
acgcttggtcttctacaaaaatggagcattgttttgtagataagctcaaggatcagccttcctggcttcttgtgctattcactatcggttctttatcacttctgaaattcttcttcgctttcctcaaatgggtttacgttaatttcctcagacctgctaaaaatctgaagaaatatggatcatgggctctcgtaactggacctactgatggtattggcaaaggttttgcttttcaattggctcgaaagggtatgaatctggttttggttggtcgaaatcctgataagctcaaggacgtttcggattctattcagtccaaatatggcaaggtccaaatcaagtccgttgttgttgatttcagtggcgatattgatgagggtattaggaaaattcaggagactattgaaggattggatgttggtgtcttgattaataacgttggagtttcatatccctacgccagatttttccacgaggtggacgaagagttattgaagaacttgattaaggtaaatgtagaaggcactactaaagttacaaaagctgttttgcctgggatgctgaagaggaagaagggtgctatagttaatattggttctggtgcagccattgtcattccttctgatcctctctatgcggtttatgctgccaccaaagcgtatatagatcagttctccagatgcctttatgttgaatacaagaaaagtgggattgatgttcagtgtcaggttcccctctatgtggcaacaaagatggcatcaatcaggagatcttccttcttcgtcccatcaacagatggctatgctcgggcaggtttacgttggatagggtatgagcctcgttgcacaccttactggccccattctcttctctggggtttgttatatgcattgccggaatccattatcgatgcgtggcgactccacttttgccttgggatacgaaagagaggacaacagaaggattctaggaagaaggagtaaacattacactctttttattagttcagtcagggtgttggattgaactcatagaatttaatcttctgtgtcattttcttacattttcttttgcattttactattaaaaaccactttcttccttttgggtgtacacttgctgagaagttggagaaaattaacatgcctttattgtcttgaatttaagttcttgggggccttggaattctcaagacatcgttcaattggtgtgagattgaaaagttgagtctttgtaacaaaatgctgttggaacaacctgaaatccatgcattttccatgtctcc

SEQ ID NO: 8568 - DNA, 1590 bp, Prunus mume
gtagtcctttttctcgccccgggaacagagttagttaaatgtggtggttttccgctcatctacttcatccaactcttctttctatcaatttcagacgcttctataaattaaattccatcctttaattcacgccactccctcccctcttcttctatttctgagccaaacccaacctttgggttcactattttcgtttcagattccaagcaaaacctttctaaaagaacatgggtttttgtctcctggagcacctcaagactcagcctttctggctcgttgtgcttttcactctgggttctctctctgttctcagattctctttagctttcctccaatgggtctatgtcaatttcctcagacctgctaagaatctcaaaaagtatggatcttgggctctcgtcactggacccactgacggcattggcaaagccttcgcctttcaattggctcgtaaagggctcaatctggtattggtcggtcgcaacccagaaaagctcaaggacgtctcagattcaatcctggccaaatacggcaaaacccagatcaagaccgtcgtggttgatttcactggtgaccttgacaatggtgttaagcgcattcgtgagaccattgaaggattggatgtgggtcttttggttaacaacgctgggatatcgtacccgtacgctaggttttttcatgaagtggatgaggaactgttgaagaacttgataaaggtcaatgttgaaggcactacaaaagttactcaagctgttttgccagggatgcttcagaggaagagaggcgctatcgtcaatattgggtctggggctgcgattgtgatcccctcagatcctctctatgctgtttacgcagctacaaaagcgtatattgatcagttctctaggtgcctctatgttgaatacaagaaaagtgggattgacgttcagtgtcaggttccattgtatgtggcaacaaagatggcatctatcaggagatcttccttctttgtaccatcaactgatggttatgcccgggcagctctgcgctggatagggtatgaacctcgttgcactccttactggccccatacgcttctttgggccgtggcatcctcattgccagagtctgttgttgacgcgtggcgcctgagattttgcctggctattcgaaagaggggacaactcaaagattcccagaagcaagaatagatgaccgaacattcttatgttattctgtttgggccgcttggtagggaatgctgtttggtgcaacggattaggactttctgaaagctgatcgtatgcttagacttcagtttatgtttaatgttttaaaattccatggtctttgttaattaatgatcaactgcttcttctttttttatatattaaagttccttgcaaaaaaagcaaatagatagatgtttgtctgttcgccctatttattcttgttgattccttgagctgcagtcgttgaaatagccacatagtttgtgctttatgggctctttgttgttgtaaacttgtaacttgaaatggggttgcgtttctaaagatccattaattcaaaacgactgaggagaacaaaaaatgcagtaacataatttaa

SEQ ID NO: 8569 - DNA, 1382 bp, Gossypium hirsutum
tactttatttttttcatttatagataatcaatccttccctttttctctttttgattcccatctgtttccgcctaaccgaactgctaaaaagattccccttttcgttatcgagcgctctatttatatccccttacatctctttctttggtattcacacaagtttcaagtttcaagttcctcctctacgtaatccatggaagcctgcttcttcgacactctcaaggctcaacctttctgggttattgtccttttcactttgggttctttatcactcttgaagttctcatttgtttttctgaaatgggtctggatcaattttcttagacctggtaagaatctcaaaaaatatggctcctggggtcttgttactggaccaactgatggtatcggcaaaggatttgcctttcagctggctaggaaagggctaaatcttgtcttggtgggccgtaatcctgataaactcaaagacgtttccgattcaatcttggccaagtatgccaagattcagatcaagacagttgttgtggacttcactggcgatcttgatgaaggcgtgaagaagataaaagaaactattgaaggactggatgtgggggttttgattaacaatgttgggatttcatatccttatgccaggtacttccacgaggttgatgaggagctgttgatgaatttgattaaggtgaatgttgaagggaccacaaaggtaactcaagctgttttgcctgggatggtgaagagaaagaaaggcgcaattgtgaacattgggtctggtgctgccattgtcatcccttctgatccactctatgctgtttatgctgctactaaggcgtatattgatcaattctctaggtgcctttatgttgaatacaagaacattgggattgatgttcagtgtcaggttccattatatgtggcaacaaaaatggcatcaatcaaaagatcgtctttctttgttccatcaacagacggatatgctcgtgcagcaatgcagtggataggctatgaacctcgttgcacgccctattggccccattccatcctttggggcttggcttattcactgccagagagtgtggttgatgcatggcgtttgcgcttttgtcttggcattcgaaagagggggcaactcaaagattctaggaagaaggaatgaaaacagattgttgagtctgttgtattttacgttcttggagttgagtgttttggttggatctgttaggatcgttccgattaagcaacgaacaagtaaaaatagtagaagaaattgagaagttgaacataaaaatttaacgtggaaaaacctctccaaagaggataaaaactacgggcaaatatgattttactataatgacaaaagaatgaagagtacaaaagatgga

SEQ ID NO: 8570 - DNA, 1223 bp, Gossypium hirsutum
ccctttttctctttttgattcccatctgtttccgcctaaccgaactgctaaaaagattccccttttcgttatcgagcgctctacttatatccccttacatctctttctttggtattcacacaagtttcaagtttctcctctacgtaatccatggaagcctgcttcttcgatactctcaaggctcaacctttctgggttattgtccttttcactttgggttctttatcactcttgaagttctcatttgtttttctgaaatgggtctggatcaattttcttagacctggtaagaatctcaaaaaatatggctcctggggtcttgttactggaccaactgatggtatcggcaaaggatttgcctttcagctggctaggaaagggctaaatcttgtcttggtgggccgtaatcctgataaactcaaagacgtttccgattcaatcttggccaagtatgccaagattcagatcaagacagttgttgtggacttcactggcgatcttgatgaaggcgtgaagaagataaaagaaactattgaaggactggatgtgggggttttgattaacaatgttgggatttcatatccttatgccaggtacttccacgaggttgatgaggagctgttgatgaatttgattaaggtgaatgttgaaggtaccacaaaggtaactcaagctgttttgcctgggatggtgaagagaaagaaaggcgcaattgtgaacattgggtctggtgctgccattgtcatcccttctgatccactctatgctgtttatgctgctactaaggcgtatattgatcaattctctaggtgcctttatgttgaatacaagaacattgggattgatgttcagtgtcaggttccattatatgtggcaacaaaaatggcatcaatcaaaagatcgtctttctttgttccatcaacagacggatatgctcgtgcagcaatgcagtggataggctatgaacctcgttgcacgccctattggccccattccatcctttggggcttggcttattcactgccagagagtgtggttgatgcatggcgtttgcgcttttgtcttggcattcgaaagagggggcaactcaaagattctaggaagaaggaatgaaaacagattgttgagtctgttgtattttacgttcttggagttgagtgttttggttggatctgttaggatcgttccgattaagcaacgaacaagtaaaatagtagaagaaa

SEQ ID NO: 8571 - DNA, 1480 bp, Gossypium raimondii
aggcccctcaacagtcaaactcctaagtagttaatgaaggtggttttcagctcatctacttcacccactattttattttttcatttatagataatcaatccttccctttttctctttaatcccatctgtttctgcctaaccgaactgctaaagattccccttttcgttatcgtgcgctctatttatatcccttagatctctttctttggtactcacacaagtttcaagtttctcctctacgtaatccatggaagcctgcttcttcgatactctcaaggctcaacctttctgggttattttccttttcactttgggttctttatcactcttgaagttttcatttgtttttctgaaatgggtctggatcaattttcttagacctggtaagaatctcaaaaaatatggttcctggggtcttgttactggaccaactgatggtatcggcaaaggatttgcctttcagctggctaggaaaggccttaatcttgtcttggtgggccgtaatcctgataaactgaaagacgtttccgattcaatcttggccaagtatgccaagattcagatcaagacagttgttgtggacttcactggcgatcttgatgaaggcgtgaagaagataaaagaaactgttgaaggactggatgtgggggttttgattaacaatgttgggatttcatatccttatgccaggtacttccacgaggttgatgaggagctgttggtgaatttgattaaggttaatgttgaaggtaccacaaaggtaactcaagctgttttgcctgggatggtgaagagaaagaaaggcgcaattgtgaacattgggtctggtgctgccattgtcatcccttctgatccactttatgctgtttatgctgctactaaggcgtatattgatcaattctctaggtgcctttatgttgaatacaagaacagtgggattgatgttcagtgtcaggttccattgtatgtggcaacaaaaatggcatcaatcaaaagatcatctttctttgttccatcaacagacggatatgctcgtgcagcaatgcggtggataggctatgaacctcgttgcacgccctactggccccattccatcctctggggcttggcttattcactgccagagagtgtggttgatgcatggcgtttgcgcttttgtcttggcattcgaaagagggggcaaatgaaagattctaggaagaaggaatgaaaacacattgttgagtctgttctattttctgttcatggagttcaatattttacttggatgaatgagatccacaaccctttataaatttgttttcaagcattgcaattgcattgtgacacttccattatgtattaggatgcttagggaaggataaggatgaaagtatacaaatatatgaacccttttcctgcatgatttacttttacaagtttaaagtgtatgtcatcgcgtttatacaaaagatatcaaagtatgtcaggtcttaaacat

SEQ ID NO: 8572 - DNA, 1289 bp, Sarracenia psittacina
tacggggactttcaagcaatcgactaaatcttcttctggttttctatttaatccgccatacctaaagcttcttaaccatggagctctgtttcatggagcagctcaaagctcaaccactttgggttcttcttctgctaggtctcggttctttatcagtattgagattttctctggctttcctcaattgggtctatgtgaatttcctcagaccttccaagaatctaaagaaatatgggtcttgggcgctcgttacgggaccaaccgacggcattggtaagggttttgctttccaattagctcgtaaagggctgaatctggttctcgtcggtcgaaatcccgacaagctcaaggaagtttccgattcgattggagctaagttcggacaaatcaagatcaagacagtggtggttgatttctccggcgatttgacagacgggttcaccggattcgcgaggttattgatgatctggacatcggaattctggttaataatgtcggaatttcctatccctacgcgaggtttttccacgaggtggacgagaaattgttggccgatttgatcaaaatcaacgttgaggggacgacaaaggtcacacaagcggttttgcctgggatgcttaagagaaagagaggcgcaatcgttaatatcggttcgggcgcggccattgttatcccttctgatcctctctatgccgtttatgcggccaccaaagcatacattgatcaattctcgaggtgcctttatgtggagtacaagaagagcgggatcgatgtgcagtgtcaggtgcccttgtacgtggcaacaaagatggcatcaatcagaaggtcctccttctttgttccatcaacagatggttatgcccgggctgctatccgctggataggctatgaaccacgctgcactccttactggccgcatactcttctttgggcgttggcaaactcgttgcccgagtcggctgttgatgcttggcgtctaaggttctgccttgcaattcgaaagaaggggcaattcaaagactcgaggaagaaggaatagagaccaagataccacatttttcttctctttctgttaatttatctaaatcttttttttttcttattaatcttttgctcggacgatatgtggatatggactattatgataggccatttgggaggtttatttgattctaccagaaagtgaaccttttcaaccattgttcttgggtttatgttgtcctaagtcttaatgtactttctactttcgaccaagttgggtttgaaatttggatgaattcatggcagga

SEQ ID NO: 8573 - DNA, 1191 bp, Camellia sinensis
ctcagagaactcaaacactctgcatcatggagatctgttccatggcgcgactcaaatctcaacccctctgcctccttctactagtagctctcggttctttatcacttctgaagtgttctttagcttttctcaaatgggtctacgttaatttcctcagacctcccaagaatctgaagaaatacgggtcctgggcactcgttacgggacccaccgacggtattggcaagggtttcgccttcgaattggctcgtaaaggtctgaatttgattctcgttggtcgaaaccccgagaaactcaaggaggtttcggagtcgatcggagccaaattcgggaaaacccagatcaagactgtggttgttgatttctctggagatttgaacgaaggggttaatcggattcgtgaaaccattgaaggtctggatgttggagttctgatcaataatgttggagtttcgtatccttatgcgaggtttttccatgaggtggacgagcaattgttggctgatttgattaaaatcaatgttgaagggactactaaagttacacaagcggttttgcctgggatgattaagaggaagagaggtgcgattgttaatattggttctggtgccgccattgttatcccttctgatccactttatgctgtatatgcagccaccaaagcatacactgatcaattctcaaggtgcctttatgtggagtacaagaagaatggtatcgatgtgcagcgtcagtgccctgtacgtggcaacgaagatggcctcgatcagaaggtcctccttctttgttccatcgacagatggttatgctaaggctgcaatgcgctggataggctatgaaccacgttgcactccttactggccccatactgttctgtgggcgctggcccactctttgcctgagtccgttgtcgatgcttggcgtctaaggttctgcctcgcaatccgaaagaagggacaactcaaagactctaggaagaaggaatagacaagcattcttctctctttctgtttatctacttccctttttattatttgatatctgtctcagaatcagaagttgcgaagatttggactagtaggataggctgtttgggaggttaatttgattccaaaacgtagacttttttgtgccataatgcttcaatttatatcgtttcatgtgctctgcccaaaaataaaaacatgtcgg

SEQ ID NO: 8574 - DNA, 1538 bp, Theobroma cacao
atgggtgtcatcgtaagtagttatttaaggtggttttcagctcatctacttcacccacctcttcctcttctttgttccttctccaaaatccgatccttcatttccttcatttgatcccgttcctgcccctatctgtttctgcctaccacatcccctctgtttttttttgttcttctctttgtcacagtcgaagccatacccaactctatcaaccccaaacgaactaaaaggtttgctaaagattttctctttttgttcactctatttatctccttagatctctcctcttttttgatatatccacaaaaatttcgactttttcctctgcataagccatggcaacctgtttcttcgatactctcaaggctcaacctttctgggttcttgttcttttcactttgggttctttatcactcttgaaatcttcatttgtttttctcaaatgggtctgggtcaattttcttagacctggtaagaatctcaagaaatatggttcctggggtcttgtgacaggaccaactgatggtataggcaaaggttttgcctttcagttagctaggaaagggcttaatcttgtcttggtgggtcgtaatcctgacaaactcaaagatgtttctgattcaatcttggctaagtatggaaagattcagatcaagacagttgttgttgacttcactggtgattttgatgagggtgtaaagaagatcaaagaagctattgaaggattggatgttggtattttaattaataatgttgggatttcgtatccttatgcaaggttcttccatgaggttgacgaggagctgttgaggaatttaattaaggttaatgttgaaggtactactaaggttactcaggctgttttgccggggatggtgaagagaaagagaggtgcaattgtgaatattggttctggtgctgctattgtcatcccttctgatccactttatgctgtttatgctgctactaaagcgtatattgatcaattctcaaagtgcctttatgttgaatataaaaatagtgggattgatgtccagtgtcaggttccattgtatgtggctaccaagatggcgtcgatcaaaagatcctctttctttgttccatcaacagatggttatgctcgggcggcaatgcgctggataggctacgaacctcgttgcacaccctactggccccattccatcctctggagcttggcttcttcactgccagagagtgtggttgatgcatggcgttttcacttttgtctcggcattcgaaagagggggcaactgaaagattctaggaagaaggaatagaaaagcacttggaattgtattagtttctgttcatggagttgaaaggtggctaggatgagctttcaactcgtattacctatggaattgtactagttctggtattctcttatttatttttgaaaatctaattattactctcttgataaatttgttttcaagcatggcatcttaaccatcccattacgtatcaagatgcttttgtaggttaaggatgaaatgaaaatagagaactctgaacct

SEQ ID NO: 8575 - DNA, 1388 bp, Gossypium hirsutum
tgaaggtggttttcagctcatctacttcacccactattttatttttttcatttatagataatcaatccttccctttttctctttttgaatcccatctgtttctgcctaaccgaactgctaaagattccccttttcgttatcgtgcgctctatttatatcccttagatctctttctttggtactcacacaagtttcaagtttctcctctacgtaatccatggaagcctgcttcttcgatactttcaaggctcaacctttctgggttattttccttttcactttgggttctttatcactcttgaagttttcatttgtttttctgaaatgggtctggatcaattttcttagacctggtaagaatctcaaaaaatatggttcctggggtcttgttactggaccaactgatggtatcggcaaaggatttgcctttcagctggctaggaaaggccttaatcttgtcttggtgggccgtaatcctgataaactgaaagacgtttccgattcaatcttggccaagtatgccaagattcagatcaggacagttgttgtggacttcactggcgatcttgatgaaggcgtgaagaagataaaagaaactattgaaggactggatgtgggggttttgattaacaatgttgggatttcatatccttatgccaggtacttccacgaggttgatgaggagctgttggtgaatttgattaaggttaatgttgaaggtaccacaaaggtaactcaagctgttttgcctgggatggtgaagagaaagaaaggcgcaattgtgaacattgggtctggtgctgccattgtcatcccttctgatccactttatgctgtttatgctgctactaaggcgtatattgatcaattctctaggtgcctttatgttgaatacaagaacagtgggattgatgttcagtgtcaggttccattgtatgtggcaacaaaaatggcatcaatcaaaagatcatctttctttgttccatcaacagacggatatgctcgtgcagcaatgcggtggataggctatgaacctcgttgcacgccctactggccccattccatcctctggggcttggcttattcactgccagagagtgtggttgatgcatggcgtttgcgcttctgtcttggcattcggaagagggggcaaatgaaagattctaggaagaaggaatgaaaacacattgttgagtctgttctattttctgttcatggagttcaatattttgcttggatgaatgagatccacaaccctttataaatttgttttcaagcattgcaattgcattgtgacacttccattatgtattaggatgcttagggaaggacaaggatgaaagtatacaaatatatgaacccttttcctgcatgatttgcttttacaa

SEQ ID NO: 8576 - DNA, 1335 bp, Prunus persica
cttctatttctgagccaaacccaacctttgggttctccattttcgtttcagattccaagcaaaaccttgctaaacgaacatgggtttttgtctactggagcacctcaagactcagcctttctggctcgttgtgcttttcactctgggttctctctctgttctcagattctctttagctttcctccaatgggtctatgtcaatttcctcagacctgctaagaatctcaaaaagtatggatcatgggcactcgtcactggacccactgacggcattggcaaagccttcgcctttcaattggctcgtaaagggctcaatctggtcttgatgggtcgcaacccagaaaagctcaaggacgtctcagattcaatcctggccaaatacggcaaaacccagatcaagaccgtcgtggttgatttcactggtgaccttgacgatggtgttaagcgcattcgtgagaccattgaaggattggatgtgggtcttttggttaacaacgttgggatatcgtacccgtacgctaggttctttcatgaagtggatgaggaactgttgaagaacttgataaaggtcaatgttgaaggcactacaaaagttactcaagctgttttgccagggatgcttcagaggaagagaggcgctatcgtcaatattgggtctggtgctgcgattgtgatcccctcagatcctctctatgctgtttacgcagctacaaaagcgtatattgatcagttctctaggtgtctctatgttgaatacaagcaaagtgggattgacgttcagtgtcaggttccattgtatgtggcaacaaagatggcatctatcaggagatcttccttctttgtaccatcaactgatggttatgcccgggcagctctgcgctggatagggtatgaacctcgttgcactccttactggccccatacgcttctttgggccttggcatcctcattgccagagtctgttgttgacgcatggcgcctgcgattttgcctggctattcgaaagaggggacaactcaaagattcccagaagcaagaatagatgatagaacattcttatgttattctgtttgggccgccgcttggtagggaatgctgtttggtgcaacggattaggacttctaaaagctgatcgtatgcttagacttcagtttatgtttaatgttttaaaattccatggtctttgttaattaatgatcaactgcctctcttattttttttttttaaagttccttgcaaaaaaagcaaatagatagatgtttgtctgtttgccctatttattcttgttgattccttgagctgcagtcgttgaaatagccacatagtttgtgcttt

SEQ ID NO: 8577 - DNA, 1385 bp, Cucurbita pepo
aacccagacttcaagacccacattctcccaataccaagatggagctcagttgtgttgagcagcttaaatcccagcccctctgggtttgcttgctattcgcgttcggatctctctcggctttgaaattcttagtaatcgttctcaaatgggtctatgtcaatttcctcagacccccaaagaatctcaagaaatacggttcttgggcgctcgtcacaggacccactgatggaatcggtaagggtttcgcctttcagctggctcgcaaggggctcaatctcattttggtgggtcggaaccctgagaaactcaaggacgtttccgattcaatcgtcgctaaatacggcagcatccaaataaagaacgttgtcgtcgatttctccggcgatctttcagaagggatgaagagaatcagcgaagcgattgaagggttggatgttggggttttgattaacaacgttggggtttcgtatccgtacggaaggttttttcacgaagtggatgaggagcttctcaataacttaatcaaggtcaatgtggaaggcactaccaaggtgactcaagctgttctgcctggaatgttgaagaggaagagaggcgccattgttaatattggttccggtgctgccattgtcattccttcagatcccctatatgctgtctatgccgccaccaaagcgtacattgaccaattctcgaggtgcctgtatgtggagtacaagaagagtggaatcgatgtgcaatgtcaggtcccgctgtatgttgctacgaaaatggcgtctattcgacgatcatccttcttcgttcctttgacgaatggatatgcagcagcagctctccgctggattgggtatgagcctcggtgcacaccgtattggccccatcaacttatatggggtttggtgtacttgttgccagagtctgttgttgatgcttggcgcctgaagttttgtcttggcatcagaaagagaggacaactcaaagactcgaggaaaaaggaagagtaggaagattcaagatatgtagtgttgttctaattcttcgccttcattgaattctggaaccacagacctgctagattttaatgttttgagttttgttcttcttttcgatgacctttctttcaatatatttcttagaaagctaatggtgaaaagactttggtaatgatgtgctcccttttgttctcgttctttgttggatgaaagtcccacctcgactaattttgggaatgatcataggtttatatgtaagagatacatatctattagtttgaggcctttcgggaaagctcaaaataaagccacgggagcttatgatcaaagtggacaatatcatatcattgtggagtttaatcttgaatttatgatagtagtgttcttatggaa

SEQ ID NO: 8578 - DNA, 1429 bp, Cucumis melo
aaaagctgaaacgcaaaacccccgaatgaaagtgttcagatttttaattagccggtttgctcatctacttcagcaacccatcatccgtttccataaatgtaacccatactccatttcttcttcttcttcttcctaatctccctttccatctcctcacaaatcttccttttaatcccacatttctactcccaaattcccccaatccaaatatgcagctcggttgtatcgaacaacttaaatctcaacccatctgggttttatttcttttagcattgggatctctctcagctctcaaattcatactaatcattctcaaatggatctatgttaatttcctccgaccctcaaagaatctcaagaaatacggttcatgggcactcgtcactggacccactgatggtatcggtaagagtttcgcttttcagttggctcgtaaagggctcaatctcgttttggtgggtcggaaccctgagaaactcaaagatgtttctgattctattgttgctaagtacggtagcatccagattaagagcgttgtcgttgatttctccggtgatctttcagaaggtattaagagaatcactgaagcgattgaaggtttggatgttggggttttgattaataacgttggggtttcatatccgtatggaaggttttttcatgaagtggatgaggagcttctgaataacttaattaaggtcaatgttgaaggcaccactaaggtgactcatgctgttttgcctggaatgttgaagaggaagagaggtgccattgttaatattggttctggtgctgctattgttattccttcagatcccctgtatactgtttatgctgctaccaaagcgtacatcgatcaattctcgagatgcttgtatgtggagtacaagaagagtggaattgatgtgcaatgtcaggttccgctatatgttgctaccaaaatggcgtcaattcgaagatcatccttcttcgttccctcaaccaatggatatgcagcagcagctctacgctggatcggttacgagccgcgctgcacaccgtattggccccatcaacttttatggggtttggtgtccttgttgccggagtctgttgtcgatggttggcgcctgaacttttgtcttggcatcagaaagagaggacaactgaaagattccaggaaaaaagagtaggaagattaaagatacgtagttctaatttgcagagaagaataacatttctccttagtgtcagctacttttcgaaatttggaacacaagcgtctagatttgtatgttttcagtttgattgttctttgaccaatatatatttttttccattttatatcagccttttttcatatttttctcttgagaagggaagaatgctaagcaattatgtgctcaattttccattttagatcagccttttcttcatgttatgtgctaaa

SEQ ID NO: 8579 - DNA, 1488 bp, Vaccinium corymbosum
tctacttcttttttcttcctatcacttcactcattcctgtcctattaaatctcgatcaaaaatactcctcacacaagaattcgacgaaatcgtctctgggttatcttattcaatcactttgaaccaaaacccatttctcagatctcacattctgcatcatggagctctgttctatggagcagctgaaatcccaaccctactggcttctcctcctcctgaccctcggttctatctcgctcctcaaattaaccctctcctttctcgactgggtcttcgtcaatttcctcagacccccaaagaacctcaagaaatacggctcatgggcactcgtaaccggacccacagacggcataggcaagggtttcgccttccaattagcacgcaaaggcctcaacctgatcttagtcggtcgtaaccctagtaaactagccgaggtttcggattcgatccgagccaaatacgggcagacccagatcaagaccgtggtggttgacttctctggtgatttgaacgaaggggttgataggattagggaagagattgaagggctggatgttggggttttggttaataatgtgggtgtgtcgtatccttatgcgaggttttttcatgaggtggatgagaagttgttgaaggatttgattcagattaatgttgaagggactactaaggttaccaaagtagttttggatgggatggttaagaggaagagaggtgcgattgtgaatatcgggtcgggtgcggctgttgtcattccttctgatcctctttatgctgtttatgcagccactaaagcgtacattgatcagttctcaaggtgcctctatgtggagtacaaaaacagtgggatcgatgtgcagtgtcaggtgcccttgtatgtggcaacaaagatggcatcaatcaaacgatcctcattcttcgtaccgtcgacagacggttatgctcgagctgccatgcgctggataggctacgaaccacgctgcactccttactggccccactctcttctgtgggggttggcaaactccttgccggagtccattattgatgcttggcgtcttaggttctgccttgcaattcgaaagaggggtcagctgaaagactcaaggaagaaggagtagatacaccattcttctctttcatgttatcttcttgtactctcatttaatctttttattcagccaagccagggcggattcggatatcaattggaggttagtttgccatgtgactccactagaatttgaattatcttctacttattatgctgtcttcatgtattttgtagtttgtaccgagttccattcaatcaagctgcttgcttttctcatgtgttgctctcttcttttgcaattacaagtttccgggttcttttagtgcagtattgaaacattcaagttgaagaaattaggtgcaactgcaagaattctagatcatatagctctacaaaattcttggtgaagtaatagaaacattcgagttagaaag

SEQ ID NO: 8580 - DNA, 1236 bp, Orobanche aegyptiaca
atggcggactgcatctttcaccagctcaaatcacagcctacgtggctcatcctcctcacatccctcggttccttatccctcctcagactctccttctcgatcctcaaatggatctacgtcaatttcctccgacccggcaaaaacctcaagaaatacgggtcgtgggctttaatcacgggccccaccgacggcatcggcaaagccttcgcttttcagctcgcggggaaagggctcaacctaatcctagtcgggcgaaacccggataagctcaaggaggtctcggaatccatcaaatccaagtacgggtcgacccggatcacgaatgtggtcgttgatttttccggggatttagacgacggcgtttcgaggataaaggatgctatcgaagggttggatgtaggggttttgattaacaatgtcggcttgtcttatccgtatgcaagattcttccatgaagtggatgacaaattgttgagtgatttgattagggttaatgttgagggtacaacgaaggttacccgggtcgttttaccgggtatggttagaaggaagaaaggggctattgtgaatattgggtcgggtgctgctattgttattccatctgatccactttattcagtttatgctgctaccaaagcgtatgttgaccagttctcaagatgcctctatgtggaatataagaagagcgggatcgatgtacagtgtcaggtaccattgtacgttgcgacaaagatggcatcaatcaaaaggtcatccttctttgttccatcaacggatggttatgctcgtgcagcgttaaggtggataggttacgaaccccgttgcacgccttattggccccacacactcctctgggccttggctaattcattaccggagtcggttgttgatgcttggcgtctcaagttctgccttggaattaggaagagaggacaacttaaggactcgaggaagaacgaatagaaaatcgataatagtctttccccctgcggctcctattctgttcttcttttgacctattttagtgagaatgtttatttgtgatatgttagtaattttgtgaaattatatttgaaagactagtggaattcttcttatatgtgaagaaaatcgggtatttcacttggttctgtgggaactactggtgtgatgtcgagcgggttattgttcagtcgggttatcctttctgattagagagccataaacgaatcgaatattcgtgaacaaaagctcgtt

SEQ ID NO: 8581 - DNA, 1226 bp, Sarracenia psittacina
aaccatggagctctgtttcatggagcagctcaaagctcaaccactttgggttcttcttctgcttggtctcggttctctatcagtattgagattttctctggctttcttcaattgggtctatgtgaatttcctcagaccttccaagaatctaaagaaatatgggtcttgggcgctcgttacgggaccaaccgacggcattggtaagggttttgctttccaattagctcgtaaagggctgaatctggttctcgtcggtcgaaatcccgacaagctcaaggaagtttccgattcgattggagctaagttcggacaaatcaagatcaagacagtggtggttgatttctccggcgatttgacagacggggttcaccggattggcgaggctattgatgatctggacatcggaattctggttaataatgtcggaatttcctatccctacgcgaggtttttccacgaggtggacgagaaattgttggccgatttgatcaaaatcaacgttgaggggacgacaaaggtcacacaagccgttttgcctgggatgcttaagagaaagagaggcgcaatcgttaatatcggttcgggcgcggccattgttatcccttctgatcctctctatgccgtttatgcggccaccaaagcatacattgatcaattctcgaggtgcctttatgtggagtacaagaagagcgggatcgatgtgcagtgtcaggtgcccttgtacgtggcaacaaagatggcgtcaatcagaaggtcctccttctttgttccatcaacagatggttatgcccgggctgctatccgctggataggctatgaaccacgctgcactccttactggccacatactcttctttgggcgttggcaaactcgttgcccgagtcggctattgatgcttggcgtctaaggttctgccttgcaattcgaaagaaggggcaattcaaagactcgaggaagaaggaatagagaccaagaaaccacaattttattctctctgttaatttacctaaatcctttttttcttattaatcttttgctcggacgatatgtggatgtggactattacgattggccatttgggaggtttatttgattccaccagaaagtgaactttttcaaccattgttctttggtttatgctgtcttaagtcttaatgtactctctactttcaatcaagttagttgaaatttggatgaattcatggcaggatcttagaacttttgg

SEQ ID NO: 8582 - DNA, 1229 bp, Momordica charantia
tgggttcctataaatcccgcatttctcgaccccaaaatcttccaaccaaagctcttccaagatggagcttgaattagtcgagcagcttagatctcagccactctgggtttgcttactctttgcactgggttctctctcggctctcaaattctctttaatttttctgaaatggatctatgtcaatttcctcagacccccgaagaacctcaagaaatacgggtcctgggcgctcgtcactggtcccactgacggaatcggtaagggtttcgcgttccaattggcccgcaaagggctcaatctgattttggtgggccgaaaccctgacaagctcaaggacgtctcggattcaatcgtcgcgaagtacggcagcgtccagatcaagaacgtcgtcgtcgatttctccggcgaccttgccgaaggcattaagaggatcggcgaagccgtcgaagggttggatgtgggggttttgattaacaacgtgggggtttcgtatccgtatgggaggtattttcacgaggtggatgaggagcttctggaaaacctaatcaaggtcaatgtcgagggcaccaccaaggtgactcaagctgttttgcctggaatgctcaagaggaagagaggcgccatagttaatattggttctggcgctgccattgtcattccctcggatccactctacgccgtctacgccgccactaaagcgtacattgaccaattctcgaggtgcctgtatgttgagtacaagaagagtggaattgatgtgcaatgtcaggtcccgttatatgttgctacaaagatggcgtctattcgaagatcatcctttttcgttccttcaacaaatggatatgcagcagcagctctccgctggattgggtatgagcctcgctgcacaccttattggccccatcaacttctttggggtttgcgtactcgttcccggagtctgttgttgattcttggcgcctgaagttttgccttggtatcagaaagagaggacaactcaaagactctaagaaagagtaggaagatttgtagttctaatttctggagaaaaaagaacctttctccttagtgtcagctactttgttgaggattgaaacactagcatgatagattgaatgtttggagtttcattctcctttgatgatctttcgatatatttcttcaatttaaggttagccttttcaattttctttttgagaaaggaaaataacaaacgactttacttatcg

SEQ ID NO: 8583 - DNA, 1420 bp, Gossypium hirsutum
ctgtgatttattctcctgtaaataccaatgcccctcaacagtcaaattcctaagtagttaatgaaggtggttttcagctcatctacttcacccactacttattttttcatttatagataatcaatccttccctttttctctttttgattcccatctgtttccgcctaaccgaactgctaaaaagattcccctttcgttatcgagcgctctatttatatccccttacatctctttctttggtattcacacaagtttcaagtttcaagtttctcctctacgtaatccatggaagcctgcttcttcgatactctcaaggctcaacctttctgggttattttccttttcactttgggttctttatcactctttaagttttcatttgtttttctgaaatgggtctggatcaattttcttagacctggtaagaatctcaaaaaatatggctcctggggtcttattactggaccaacggatggtatcggcaaaggatttgcctttcagctggctaggaaagggcttaatcttgtcttggtgggccgtaatcctgataaactcaaagacgtttccgattcaatcttggccaagtatgccaagattcagatcaagacagttgttgtggacttcactggcgatcttgatgaaggcgtgaagaagataaaagaaactattgaaggactggatgtgggggttttgattaacaatgttgggatttcatatccttatgccaggttcttccacgaggttgatgaggagctgttgatgaatttgattaaggttaatgttgaaggtaccacaaaggtaactcaagctgttttgcctgggatggtgaagagaaagaaaggcgcaattgtgaacattgggtctggtgctgccattgtcatcccttctgatccactttatgctgtttatgctgctacaaaggcgtatattgatcaattctctaggtgcctttatgttgaatacaagaaccgtgggattgatgttcagtgtcaggttccattatatgtggcaacaaaaatggcatcaatcaaaagatcgtctttctttgttccatcaacagacggatatgctcgtgcagcaatgcagtggataggctatgaacctcattgcacaccctactggccccattccatcctttggggcttagcttattcactgccagagagtgtggttgatgcatggcgtttgcgcttttgtcttggcattcgaaagagggggcaaatgaaagattctaggaagaaggaatgaaaacacattgttgagtctgttctattttctgttcatggagttcaatattttacttggatgaatgagatccacaaccctttataattttttttccaggcattgcaattgcattgtgacacttacattatgtattaggatgcttagggaaggataaggatgaaagtatacaaat

SEQ ID NO: 8584 - DNA, 1377 bp, Malus domestica
ctaccagtttcagacgcttccataaatttagtcccaccgttcactccctgctaaccccttcttcctcacgccactccctcctctctccccactctaattccaaaaacccaaatctcagaattcaagaattcagatccacagcaagaaacagacatgggttcctgcttactcgagcacctcaaggctcagcctttctgggttcttgtgctcttcactctcggctctttctctctcctcaaactctctctctctttcctccaatgggtctacgtcaatttccttagacctgccaagaatctcaaaaagtacggatcttgggcactcgtcaccggacccaccgatggcattggcaaggccttcgccttccaactggctcggaaggggctcaatctgatcttggtaggtcggaatccggacaaactcaaggacgtctcggacgccgtcctggccaagtacggcaaaacccagatcaagaccgtcgtggtcgacttcaccggcgacctcgacgacggcgtcaggcgcattcgggagacgattgaagggttggatgtgggacttttgattaacaacgttgggatttcgtacccgtatgctcggttctttcatgaggtggattcggagctgctgaggaacttgattaaggttaatgtcgaaggtactacgaaggttactcaggctgttttgccggggatggtgcagaggaagagaggtgctattgtgaacattggttcgggtgctgcgattgtgatcccctcggatcctctgtatgctgtttatgcagctacaaaagcgtatattgatcagttctctaggtgcctgtacgttgaatacaagaaaagtgggattgacgtgcagtgccaggttccattgtacgtggcaacaaagatggcatctatcaggaggtcttccttctttgtaccatcaactgacggttatgcccgggcagctctgcgctggataggctatgagcctcgttgcactccttactggccgcacacacttctttggggtttggcatgctcattgccggagtctgttgttgacgcatggcgtctgagattttgcctgaggattcggaagagaggacagcagaaagattcttccctgaagcaggcatagatgaccgaacgctactgttacgttattcagatgcgttgttgggtaggtcatgccagtttggtttagcggattaggacttcggaaatctgattgtatgcttggacttcattttctgttgtatgttttgaaattccatggtcgttgttgattggtgatcactgttttctttcttgttaatgccttgaactgctctctagtgaaatagccacattgtttgaagatctattacttcaagggaaatttaacgaaaggctctca

SEQ ID NO: 8585 - DNA, 1712 bp, Cannabis sativa
ttaattaattaattaaccgacccctgcaccgttggcagaggaaaacaaaagatctgtttttcttgaagttgtgccatgattcagtcatcaccattcaccatcactgtttttagttaaatgtggtggttttccgctcatctacttcacccaactctccttataatctctttacttcttcatcttcctcgcccctgttcctcttgctaactccgtctcctcttccttcttcaaatctcaaccccactctaccccatctaacaatcattcgttttccttctccttgctcaatatttatcacagacagccttattcagatccaaaacacgtaaaaaaatggagcttggctttgttgaaaatctaaaggctcagcctttatgggttttgctgcttttttctgttggttctctctcggttctgaaattcttaatcgcttttatcaaatgggttttcgtcaattttctcagacctgccaagaatttgaaaaagtatggttcttgggcagtcgttactggacccactgacggtattgggaaaggttttgcttttcaattggctcgtaaagggcttaacttggtcttggtgggtcgaaatccagataagctcaaggaagtttctgattcgattcaagccaaatttggtaataagacccagataaagactgttgttgttgatttcagtggtgatcttgatgagggtgttcagaggattagggagacgattgaaggtttggatgttgggattttaatcaacaatgttggagtatcttacccttatgctaggttcttccatgaagtagatgaacagcttttgaagaatttaattaaggtcaatgttgaaggcaccacaaaggtcactcaagctgttcttcctggaatggttcagagaaaacgaggtgctattgtcaatattggctctggtgctgccattgttattccttctgatcctctttatgctgtttatgctgccacaaaagcatatattgatcagttctcaaggtgtctctatgttgagtacaggaacattggcatcgatgttcagtgtcaggttccattgtatgtggcaacaaagatggcatcaatcaagagatcttccttctttgttccatcaactgatggctatgctcgagcagccatgcgttggataggttatgaacctcgctgcacgccttactggcctcattcccttctatgggctttggcaaatgcattgccagaatgcatcatcgatgcatggcgtctgcggttttgtcttgcgattcgaaagaggggacaactcaaagattccaggaaaactgactaagaaaattacaacacctttacattggtgtagttggagaactgagaaatgagctttataatagatagataatgtgattagaatgtttcttttgaaaaaggttgtttagaaaagcagtttgttttgttggttaaacttaagaacaatgattgtgtaatgctggttatttaatatatgatactttactttattgtttaacttagattattagattattgcccctacaacaaattattatctacactttcttcatattatgttttgaagatttcaccaaacaccaacttccggagatattgggcaatgctctttttctcctcatcttttcattgaaacatatatttctatttccaatcatcctaattccacgtaggtctatgttattatgacacttaaaaattatataatttatctgg

SEQ ID NO: 8586 - DNA, 1525 bp, Nicotiana benthamiana
gaatagattgtgctactaatattaaacccccatcttcctacgtaacgctcaaaaatccaatctttagatctatatttagctgcacaaatcttgtactgtttctgttccacttcacacaatggagacttgtatctatcatcagctcaaatctcagcctacatggcttctttttcttctttctttaggttctttaaaactcttgtgtttttctctcattattctcaaatgggtctatgttaatttccttagacctggtaaaaatctcaagaaatatgggtcatgggcacttgttactggacccactgacggtataggaaaaggctttgcttttcaattagctaaaaaaggacttaatttagttcttgtgggtcgtaatcctacactgcacatatcaactgaaataggaaaaggctttgcttttcaattagctaaaaaaggacttaatttagttcttgtgggtcgtaatcctgataaattgaaggatgtttctgattcaattaaggctaaatatggacaaatccagattaaatcagtggttgttgatttttctggtgatttagatgaaggggttaagaagattaaggaaacaattgaagggttagatgttggtgttttgattaataatgttggggtttcgtatccttatgctagattttttcatgaagtggatgataaattgttggctgatttggttaaagttaatgtagaagggactactaaggttactcatgctgttttacctggtatgttgaagaggaaaaaaggtgctattgttaatattggttctggtgctgcaattgttattccctctgatcccctttatgctgtttatgctgctactaaagcatacgttgatcagttctctagatgcctgtatgtagagtacaagaagagtggaattgatgtgcaatgtcaggtgccgttgtatgtggcaacaaaaatggcgtcgatcaaaagatcttcatttattgttccctcgactgatggttatgctcgggctggcctgcgatggataggttatgagccaaggtgtacgccttactggccccattctcttctgtggggtttgatatattcattgccagagtcgattgttgatgcttggcgtctgaagttctgcatgggaattcggaaaagggggcagatgaaagactccaggaagaaggaatagaaagcaccttcctcacctgataagtctgaatagccgaattcctatcgtattctttctgttcctgttttcaatggggtaatgctaaatctgataatgtaacaagatggttggttttgttcttattgagcaagcctgatgtcattcttgttgcattcttagcagtaggctgtttgaatcaagagtaatccaaaagaaatcgagttctcagatctctattatgtctagccaaaagaaccattttcggacaagtaaatcagaatgattctgtttgtatttgttcgttgagtttgtttgcggcgaaatttaagcttggtgtttccttatatgaaccatttaattaccgtatgttttaat

SEQ ID NO: 8587 - DNA, 1293 bp, Rosmarinus officinalis
gtgcatatttatttacttcacactataataaccataaatcatagtattatatataaatcctatttcaaaactccatctcactcgctcacttcctcagaatcatcgccatgacggactgcatcttcgagcagctcaaatctcagcccacatggctcctcctcctcatctccctcggcaccttctctctcctcaaactctccctctccatcctcaaatgggcctacgtcaatttcctccgcccgggcaaaaacctcaagaaatacgggtcgtgggccgtaatcacgggtcccaccgacggcatcggcaaatccttcgctttccagctggcgcgaaaagggctcaacttggtcctagttggccggagccccactaagctcgaggaggtctcgggcgccattaaatccaaatccgggtcgacccagatcaagacggtggtggtggacttctccggcgacttggacgacggcgtttcgaggattaaggaggcgatcgagggtttggatgtgggcttgctgattaacaatgttggggtttcgtatccgtacgcgcggttctttcacgaggtggacgagaagctgttgaacgatttgattaaggttaatgtggtgggaacgacgaaggttacgcaggctgtgttgcccgggatggtggagaggaagaagggggcgattgtgaatattgggtccggcgccgccattgttattccttctgatccgctttactctgtttatgctgctactaaagcgtacatcgatcagttctcaagatgcctttacgtggagtacaagaagagtggaattgatgtacagtgccaggtaccactgtacgttgccacgaagatggcatcaattagaaggtcatccttcttcgttccatcagcagacggttatgctcgtgcagctctgcgttggataggctatgaacctcgttgcactccttactggccccacaccctcctctgggccgtggcgaattctttgcccgagtcagccattgatgcatggcgtctcaagttctgccttgccattagaaagcgaggacagctcaaggattcgaggaagaaggagtagaagccattcttttccacactcatcaactaagaatgttgtctgagacatattttatatttgtgtaactttcttcgtttagaactttgatgtattttctcaattttcttgaaaactttttatcatgtagtattgcttatggaggtgttcgtgcacattacatgtattgataaaatgaagaatgggatgaagctgatgaataaaaaattgtggatggagtagcaac

SEQ ID NO: 8588 - DNA, 1380 bp, Gossypium hirsutum
ctcacacaagtttcaagtttctcctctacgtaatccatggaagcctgcttcttcgatactctcaaggctcaacctttctgggttattttccttttcactttgggttctttatcactctttaagttttcatttgtttttctgaaatgggtctggatcaattttcttagacctggtaagaatctcaaaaaatatggctcctggggtcttattactggaccaactgatggtatcggcaaaggatttgcctttcagctggctaggaaagggcttaatcttgtcttggtgggccgtaatcctgataaactcaaagacgtttccgattcaatcttggccaagaatgccaagattcagatcaagacagttgttgtggacttcactggcgatcttgatgaaggcgtgaagaagataaaagaaactattgaaggactggatgtgggggttttgattaacaatgttgggatttcatatccttatgccaggttcttccacgaggttgatgaggagctgttgatgaatttgattaaggttaatgttgaaggtaccacaaaggtaactcaagctgttttgcctgggatggtgaagagaaagaaaggcgcaattgtgaacattgggtctggtgctgccattgtcatcccttctgatccactttatgctgtttatgctgctacaaaggcgtatattgatcaattctctaggtgcctttatgttgaatacaagaaccgtgggattgatgttcagtgtcaggttccattatatgtggcaacaaaaatggcatcaatcaaaagatcgtctttctttgttccatcaacagacggatatgctcgtgcagcaatgcagtggataggctatgaacctcattgcacaccctactggccccattccatcctttggggcttagcttattcactgccagagagtgtggttgatgcatggcgtttgcgcttttgtcttggcattcgaaagagggggcaaatgaaagattctaggaagaaggaatgaaaacacattgttgagtctgttctattttctgttcatggagttcaatattttacttggatgaatgagatccacaaccctttataatttttttttcaggcattgcaattgcattgtgacacttacattatgtattaggatgcttagggaaggataaggatgaaagtatacaaatatatgaacccttttcctgcatgatttacttttacaagtttaaagtgtatgtcatcgcgtttatacaaaagatatcaaagtatgtcaggtcttaaacatgcaaccttagttggtaaagttgatttcaatctcaaaggacaacctacacacccccaaaagaaagcaatcataaaatgaaataataatatgattacaattcgactagaaaaa

SEQ ID NO: 8589 - DNA, 1676 bp, Panax ginseng
aagcagtggtatcaacgcagagtacatgggggggacgcacaatagatgggtctcgccaattttagctcatccacttcagtgccggttcaaccaactgaaaccacttttaacacccaactgcttcttcccaacaatacccataaaatctccatttcaattaccccactcacatcacatgcttccttattagattttcatatttaacttccatacaaaaaccttttcccatagatccatctatctccttccacacacagacaacttcactcgcactgtatagaagaaatggagctctgttcgatcgatcagctcaaatctcaacctttatgggttcttctacttacgggtctcggttctttgtatgtattcagatttttattctccattctcagatgggtctatgttaatttcctcagacccccaaagaatctcaagaaatacgggtcctgggcactggtaactggaccaactgatggtattggtaaggcttttgccttccaattggcgcgtaagggactaaatcttgttcttgtgggtcggaaccctgagaagcttaacgctgtttcgaaggcaatccgggctaaattcggacagacccagatctcgacggttgtggttgatttctctggtgatttatcagaaggaattcaaagaattcgagcaacgattgagggtttagatattggggttttgatcaataatgtggggatttcgtacccatatgcaaggtttttccatgaagtggatgccaagttgctggcagatctgattcaagtcaatgttgaagggaccacaaaggttactcaagcagtgttgcctggaatgttgaagagaaagaggggggcaattgttaatattggttccggtgcggctattatcatcccttctgatcctctttactctgtttatgcggctgcaaaagcatatgttgatcagttctcaagatgcctctatgtggagtacaagaacagcggtattgatgtgcaatgtcaggttcccttgtatgtggcgacaaagatggcatcaatcaaaagatcttccttcttcgttccatcaactgatggttatgctcaggctgccttacgctggataggctatgagccacgatgcacaccttactggccccactctatcttgtgggctttgctgtacttattacctgagtctgctgttgatgcatggcgactgcgcttctgccttgcaattcgaaagaggggtcaactcaaagacagcaggaaaaaggagtaaaagctctctatctctctcccggtccactcgctttcctcgcctcaccttctcaaatgtctcacacatgttattgggtatacagtctgggaagtagttttaatatatgagaatgtaaaccatcatggattaagtatttctactgaatgttcttattaagtagcataggtatttagactatgctaatatttggacatctgttgctaaaagtagtagctacattgtcacctaatatgttgtgttatgctttatttatgttaggagcaagcttattgttatttgggttgaagtccggtcctcctcgagaaaagctggcacgcattcttgtgatatcttgatcttggtctacatggtcagtcagtaatttagtcctgcttatcatctccatgaatccccgtaatccaggtacccctaaaatgaacaaaaagatg

SEQ ID NO: 8590 - DNA, 1771 bp, Panax ginseng
attagattttcatatttaacttccatacaaaaaaccttttcccatagatctatctatctctttccacacacagacaacttcactcgcactgtatagaagaaatggagctctgttcgatcgatcagctcaaatctcaacctttatgggttcttctacttacgggtctcggttctttgtatgtattcagattcttattctccattctcagatgggtctatgttaatttcctcagacccccaaagaatctcaagaaatacgggtcctgggcactggtaactggaccaactgatggtattggtaaggcttttgccttccaattggcgcgtaagggactcaatcttgttcttgtgggtcggaaccctgagaagcttaacgctgtttcggaggcaatccgggctaaattcggacagacccagatctcgacggttgtggttgatttctctggtgatttatcagaaggaattcaaagaattcgtgcaacgattgagggtttagatattggggttttgataaataatgtggggatttcgtacccatatgcaaggtttttccatgaagtggatgccaagttgctggcagatctgattcaagtcaatgttgaagggaccacaaaggttactcaagcagtgttgcctggaatgttgaagagaaagaggggggcaattgttaatattggttccggtgcggctattatcatcccttctgatcctctttactctgtttatgcggctgcaaaagcatatgttgatcagttctcaagatgcctctatgtggagtacaagaacagcggtattgatgtgcaatgtcaggttcccttgtatgtggcgacaaagatggcatcaatcaaaagatcttccttcttcgttccatcaactgatggttatgctcaggctgccttacgctggataggctatgagccacgatgcacaccttactggccccactctatcttgtgggctttgctgtacttattacctgagtctgttgttgatgcatggcgcctgcgcttctgccttgcaattcgaaagaggggtcaactcaaagacaccaggaaaaaggagtaaaagctctctatctctctcccggtccactccctttcctcgcctcaccttctcaaatgtctcacacatgtgttattgggtatacagtctgggaagtagttttaatatatgagaatgtaaaccatcatggattaagtatttctactgaatgttcttattaagtagcataggtatttagactatgctaatatttggacatctgttgctaaaagtagtagctacattgtcacctaatatgttgtgttatgctttgttcatgttaggagcaagcttattgttatttgggttgaagtccggtcctcctcgagaaaacctggcacacattcttgtgatatcttgatcttggtctacatggtcagtcagtaatttagtcctgcttatcatctccatgaatccccgtaatccaggttcccctaaaatgaacaaaaagatgggtgtaacagaggagtacaaattaacaatatgctagattatgatggattgaatgttttacttttatgtgaaggattaaatttttttgatgattataattatttccatggttagtatacataaggtttttgcttcatggttttcagtcagctaaaactgtatgtttgattttaggaagagaagctgctaatataaatcattatgacatgtcaatttattttggtcatcgataaacgatctaaaattagttttaagaaattggctaactaggcagcttt

SEQ ID NO: 8591 - DNA, 1386 bp, Mimulus guttatus
ccacatgctataaatctagattaacttcataaatgaatgtgtgcgcaataaatcaacttacaaaaattaaaaaacaattctcatttgttttggttgtgtatcaaaaaattaatattttacagagctataaaaataaaatacgacgacgttttcaccactcggaagtgtataatataaaaaccccgtttgcacatcttagattcatcaaaacatggcggagtgcatctaccaccagctcaaatctcagcccacatggattctcatcctcctctcactcggctccatatccctcctcaaactctcattttcgatcattatttgggtctacgtcaatttcatccgacccggaaagaatctcaagaaatacgggtcatgggctttaatcaccggccccaccgacggcatcggaaaagccttcgcttttcagctggcaaggaaaggcctcaacttagtcctagttggaagaaacccggacaaactgaaggaggtctctgaatcaatcaagtccaaatccgggtcgacccagatcaaaaatgtggtggtggacttctccggtgacctagacgacggcgtttcgaggattaaggaagcaattgaaggtctggatgttgggcttttgattaataacgtcggcgtgtcgtatccttatgcgagattcttccatgaagtggacgaaaagctgttgtctgatctgattaaggttaatatcgagggtaccacaaaagtcactcaggctgttttgccggccatggtgaaaaggaaaaagggggctattgttaatattggttctggtgctgctattgttattccttctgatccactttactctgtttatgctgctaccaaagcgtatgttgatcagttctcaagatgcctgtatgtggagtacaagaatagtgggattgatgtgcaatgtcaggtacctttgtacgttgctacgaaaatggcatcaatcaaaaggtcgtctttctttgttccgtcaacagacggttacgctcgtgcagcactgcgttggattgggtatgaaccacgttgcactccgtactggccacattctattttgtgggctttggctaattctttgcctgagtcggccattgatgcttggcgtctcaagttctgcttagctattagaaagagaggacagctcaaggactccaagaaaatcgaatagaagtattcgtatgcctcttccattcaatttatgtactcatgattcatctttcctgttttcgttcaagagtttgtgtgagacgattaattatatgtaagactgatacatctctcgtgttagaactatgattctatttcttttgtcggacaagtgcgtttgtgttgtaatgaacgagttgaaatttctcattaacacgtttattttcgtgttca

SEQ ID NO: 8592 - DNA, 1172 bp, Trifolium pratense
tggattgttgtataatgagtaagctcaaaactcaacctttctggttcattcttctcttctccctcggtctcttcacaattctcagattcactctcattcttctcaactgggtctatgtcaattttctcagacaacccaaaaatctcaaaaagtatggatcttgggcactcgttacaggacccactgacggcattggaaaaagcttcgcttttgaacttgctcgcaaaggtttaaacctaatccttgttggtcgaaaccccgacaaactcaaagacgtttcagattctgttaaatccaagttcggaaaaaccgaggttaaaactgttgtggttgattttgccggtgatcttgatgaaggtgtgaatagaattcgtgaaacgattgaagggttggatattggggttttgattaataacgtgggaatttcttacccttatgcgaggttttttcatgaagttgatgaagagcttttgaagaatttgatacatgttaatgttgttggaactactaaggttacacaagctgttttacctgggatgttgaagaggaaaaaaggagcaattgttaatattggttctggtgctgctattgttattccttctgatccactttatgctgtttatgctgccacaaaagcgtacatagatcaattttctagatgtctctatgttgaatacaagaagagtgggattgatgtgcagtgtcaggttccattatatgtggcaacaaagatggcatcgataaagagatcttcattcttcgttccatcaacagatggctatgctaaagcaggtgtgaaatggatcggatatgaacctcgctgcacaccatactggccacatacccttctttgggcagtggcttgctcgttgcctgagtctatagttgatgcttggcgcctacggttttgtatcggtattagaaagaggggtcagctcaaagattcaaggaagcaagaataaaatgatgcttgtttgtttgcattgtgtaggcgtagatgttgtcgctgataactgcacaccgccgctagtagattatgtttccaagttgttttgggtttctagttccactcttactgttgttggtcttaattagtatcaattgtgttgcctattctttttcatgctacaattctgtttatgtttctgttctttaatgttctacttctatag

SEQ ID NO: 8593 - DNA, 1223 bp, Euphorbia peplus
ccaaaacccacttctaagatccccctttacccatctcaaaatctaatcaatggagctctgttttctcaatcacctcaaagaccagccaatttggcttctcgctttcttctctctcggctctctttcaatcaccaagttcatcttcatctccctcaactgggtctacgtcaatttcctcagacccggtaagaatctcaagaaatacggatcttgggctctcgtcaccggacctactgatggtatcggtaagggctttgcttttcaattagcgaaaaagggtcttaatctcatcctagtagctcgaaatcctgataagttaaaggaggtttctgattcgattctcgctaaatacggaaaaacccagatcaaatctgttattgttgacttcagtggtgatttagatgatggggttaagaggattaaggaaagtattgaagggttagatgttggggttttgattaataatgtcggggtttcgtatccttatgctagattctttcatgaagttgatgaagatttgttgaggaatttgattaaagttaatgttgaaggaactactaaggttacacaggctgttttgcctgggatgttgagtaggaaaaaaggggctattgttaatatcgggtccggtgctgccattgttattccttctgatcctctttatgctgtttacgctgctaccaaagcgtatattgatcagttctccagatgtctttatgttgagtacaagaaaagtgggattgatgtgcagtgtcaggttcccctttatgtggcaacaaagatggcatcaatcaagagatcatcctttttcgtgccatccacggatggctatgctcgggcaggcttacactggatagggtacgagccgcgttgcactccttactggccgcattcccttctttggggtttgctaaccattttgcctgaatctgctatcgacaaatggcggctcgggttttgccttaacattcggaagaaaggacagcagaaagactccaggacgaagaaggaatagcgctattgcttttggagaatgatcagattaatgatgaattgtttgaaaggtagattgagcttaggatatttatcaacattgttgtatactttctttcaatttcatttactgttttgatgatatggattattattattttaagattatgaagcacctctgttccctaatagttcaactgtctttgtatttttaaatgaacacgttatgt

SEQ ID NO: 8594 - DNA, 1218 bp, Tripterygium wilfordii
ctcctctgtttcttcttcgttttctccgtctcctatccactcaaattcaattccaaccttctaaaccaaactcaaatcacacgttatattagcttctctaattttctgaacaataccatttcttagatccacttctcccccaaagaaccacagataccacgtactctgccactaatggggccctgtttcttcgacacgctaaaggcgcagccaagttgggttcttttgctgttcagtttgggatccttttcgattttgaaattctctctcgcggttctcaaatgggtctacgttagttttctcaggcccgcgaagaatcttaagaaatacgggtcatgggctctggttacgggtccgactgacggtattgggaagagtttcgcgttcgagttgggtcgtaaagggcttaacctggtgttggtgggtcggaatccgggtaagctgaaggatgtatcggattcaatcaaggctaaatacggtaagactgaaatcaagaatgttgttgttgatttcagtggggatcttgacgagggtgtgaaaaggattggagaagctattggcggattggatattggggttttgattaacaatgtcgggatttcgtacccgtacgcgaggttctttcacgaagtggatgaggagcttctgaagaatctgattaaagtcaatgtcgaagggactacgaaggttacgcagactattttgccagggatgttgaagaggaagaaaggggcaatcgtgaacatcgggtcgggtgcggccatcgtgattccgtccgatcctctttacgccgtttatgctgccacaaaagcgtatattgatcaattctctaggtccctttatgttgagtataaggatagagggatcgatgtgcagtgtcaggttcctttgtatgtggcaactaagatggcatcaatcaggagatcgtcgttcttcgtgccatcaacagatggttatgctcgagcagcaatgcgctggataggatacgatccccgctgcaccccatactggcctcattcccttctctggggtttggctcactcattgccagagtttgttatcgatgcatggcgtctaaggttttgccttggaatccgaaagagagggcagcttaaagattcaaggaagacggagtagacaacagtattctgtaattgtagtatttagtgtgtttgtggactcaatatttaggatgcaaaaatcttttacttggaactc

SEQ ID NO: 8595 - DNA, 1586 bp, Ricinus communis
gctctaaccatgagtagttaaatgcggtggttttcagctcatctacttctccacctttttttggcccttctctatcttcattcatatctttaataaatccaatctctcttgctcttaacaatctgtgctaacccctactattgaaaatctcctttcttttcttttcttttttcttttcttttcctctcgatagctccgccttgcctgttcttagtcaaatctcacccatttccaccaaattcataactcttttcactgtctctgtgttgggttcttgtatttaatcctcttggctaaaacccacttttcaaagtcctcccgttctctttcagatccacgaggacgtatcacattaaaaaatggagctctgttttgtcgataagctaaagtctcagcctttatggtttcttgtgctgttttctttaggttctttatcacttttgagatgtttcttcactattctcaattgggtttatgttaatttccttaggcctgctaagaatctgaagaaatatggatcttgggctcttgtaacgggacctactgatggtattggtaaaggttttgcttttcaattggctagaaaaggtttgaatttggtgttagtcgctagaaatcctgataagcttaaagatgtttctgattctattctgtctaaatatgggaaagtgcaaatcaagactgttgttgtagattttagtggtgatattgacgagggtgttaagagaattaaggatactgttgaaggattagatgttggtgttttgattaataatgttggggtttcatatccttatgcaaggtttttccatgaagttgatgaggaactgttaaagaatttgattaaagtcaatgtagaaggtactacaaaagttacgcatgctgttttgcctgggatgttgaagaggaaaaaaggtgctattattaatattggttctggtgctgcaattgttattccttctgatcctctttatgcagtttatgccgccactaaagcgtatatagatcagttctccagatgcctttatgttgaatacaagaaaagtgggatcgatgtgcagtgtcaggtcccgctctatgtggcaacgaagatggcatcaataaggagatcatccttctttgttccatctacagatgattatgcccgggcagggctgcgttgggtaggttacgaacctcgctgcacaccttactggccgcattcccttatttggggtttgatatctatagtgccagaatttgctgtggatgcttggcggtacaagtttaaccttggaatccgaaagagaggacaacaaaaagatgctaggaaaaaggagtaaactgtactctgttgtatgaactgagttattggtgtttgatcgcagtaggctaaatcttttggtggattgaactcttaggttgccaatgcctggtactagtacttaaatttaataacttcaatcacctttgttgggagatcattagcatttttagtcgtatgaactacgtttttcagctatttgctttgcatgcaagaaagaacttgcagaacacgtaaaattgatgatacattatttaaagaacccctttaatgctgaaaattt

SEQ ID NO: 8596 - DNA, 1382 bp, Cucumis sativus
tctcaactaaaagctggaaacgcaaaacccccgattgaaagtggtgagatttttaattggccggtttgctcatctacttcagcaacccatcatccctttccataaatgtaacccaacctccattttcttctccttcatcttcctttccatttcctcacagaccttccttttaatctcacatttctactcccgaatttcccccaatccaaatatgcagctcagttgtgttgaacatcttaaatctcagcccatctgggttttctttcttttagcattgggttctctctcagctctcaaattcatactaatcattctcaattggatctatgtcaatttcctccgaccctcaaagaatctcaagaaatacggttcatgggcactcgtcactggacccactgatggtatcggaaagagtttcgcttttcaattggctcgtaaagggctaaatctcgttttggtgggtcggaaccctgagaaactcaaagatgtttctgattctattgttgctaagtacggtagtatccagattaagagcgttgtcgttgatttctccggtgatctttcagaggggattaagagaatcactgaagcgattgaaggtttggatgttggggttttgattaataacgttggggtttcgtatccgtatggaaggttttttcatgaagtggatgaggagcttctgaataacttaattaaggtcaatgttgaaggcaccactaaggtgactcatgctgttttgcctggaatgttgaagaggaagagaggtgccattgttaatattggttctggtgctgccattgttattccttcagatcccctgtatactgtttatgctgccaccaaatcgtacatcgatcaattctcgagatgcttgtatgtggagtacaagaagagtggaattgatgtgcaatgtcaggttccgctatatgttgctaccaaaatggcgtcaattcgaagatcatccttcttcgttccctcaaccaatggatatgcagcagcaggtctacgctggatcggttacgaaccgcgctgcacaccgtattggccccaccaacttttatggggtttggtgtccttgttgccggagtccgttgtcgatggttggcgcctgaacttttgtcttggcatcagaaagagaggacagctgaaagactccaggaaaaaagagtaggaaaattaaagatacgtagttccaatttgcagagaagaataacatttctccttagtgtcagctacttttttgaaatttggaacaacacaagcgtctagatttgtatgttttcagtttgattgttctttgatgacgttccaatatattttttttcattttatatcagccttttttcatattttctcttgagaatggaagaatgctgggc

SEQ ID NO: 8597 - DNA, 1248 bp, Panax ginseng
catatttaacttccatacaaaaaaccttttcccatagatctatctatctctttccacacacagacaacttcactcgcactgtatagaagaaatggagctctgttcgatcgatcagctcaaatctcaacctttatgggttcttctacttacgggtctcggttctttgtatgtattcagattcttattctccattctcagatgggtctatgttaatttcctcagacccccaaagaatctcaagaaatacgggtcctgggcactggtaactggaccaactgatggtattggtaaggcttttgccttccaattggcgcgtaagggactaaatcttgttcttgtgggtcggaaccctgagaagcttaacgctgtttcgaaggcaatccgggctaaattcggacagacccagatctcgacggttgtggttgatttctctggtgatttatcagaaggaattcaaagaattcgagcaacgattgagggtttagatattggggttttgatcaataatgtggggatttcgtacccatatgcaaggtttttccatgaagtggatgccaagttgctggcagatctgattcaagtcaatgttgaagggaccacaaaggttactcaagcagtgttgcctggaatgttgaagagaaagaggggggcaattgttaatattggttccggtgcggctattatcatcccttctgatcctctttactctgtttatgcggctgcaaaagcatatgttgatcagttctcaagatgcctctatgtggagtacaagaacagcggtattgatgtgcaatgtcaggttcccttgtatgtggcgacaaagatggcatcaatcaaaagatcttccttcttcgttccatcaactgatggttatgctcaggctgccttacgctggataggctatgagccacgatgcacaccttactggccccactctatcttgtgggctttgctgtacttattacccgagtctgctgttgatgcatggcgcctgcgcttctgccttgcaattcgaaagaagggtcaactcaaagacaccaggaaaaaggagtaaaagctctctatctctctcccggttcactccctttcctcgcctcaccttctcaaatgtctcacacatgtgttattgggtatacagtctgggaagtagttttaatatatgagaatgtaaaccatcatggattaagtatttctactgaatgttcttattaagtggcataggtatttagactatgctaatatttggac

SEQ ID NO: 8598 - DNA, 1593 bp, Populus trichocarpa
aatattgttaacggaaattaaaaaaaaaaaaaaagactttaatattcttattataaatgttattcagactaaactgtcttggctgtcgccgtatagtagttaaatgcggtggttttcagatcatctacctcaccgctccatggccacatctctatccttctctatctctccatcaaatttcattaaatagtccactgtccttctaactgctttctcctaaccctatatctcccatttgattttcctcactctccctgtcctgtgctttccttgtaatcttcacgttctacactattaatattagcagaagcttagcttttcccttcttcatagcattttttaagtcttcatcaagacccgcttctcagatccaaaacaaaaactaaaagatgagtctctgtttcgttgacgaactcaagtctcagccttcatggcttcttgtgctcttcactctgggttctctttcatttctgaagttccttttcgcttctctcaaatgggtctacgttagtttcctcagacctgccaagaatctcaagaaatacggatcatgggctctcgttactggacccactgacggtattggcaaaggattcgctttccaattggctcgaaagggtctcaatttaatcttggtgggcagaaatcccgataaactcaaagatgtgtcgacttcaattcaatccaaatacagtaatgtccaaatcaagaacgttgttgttgatttcagtggcgatattgacgagggtgttcaaaagattaaggagactgttgaaggtctggatgttggtatcttgattaataatgtcggggtttcttatccttatgccaggttctttcatgaggttgacgaggagctgttgaagcatttgattagagtgaatgttgaaggtactactaaagttacacaagctgttctgcctgggatgttgaagaggaagaagggtgctattgttaatattggttctggagctgccattgtaatcccttctgatcctctttatgctgtttatgctgctactaaagcgtacatcgatcaattctcaaggtgcctttatgttgaatacaagaaaagtgggattgatgtgcagtgtcaggttcccctttacgttgcaacaaagatggcatcaataaagagatcttccttttgggttccttcatcagacagttatgcccgggcaggtctgcgtgctataggctatgaacctcgctgcacaccttactggccccattcccttctttggggtttgatacaattgttgccagaatcagctgttgattcctggcgactaggtttttgccttaggattcgaaagagaggacagcttaaagattctagaaagaatgaatgaacggtttagccagggagtttggtctgtggattaaacttttaggatgctgattgtgttcttgtaattgaccttctccaaaacgttcctgtcattttcgttttcatgttgccttttggttattatgaacggaggaccattggtatgccttgataatttcactagttaataaaagcatgaatgattaaagcatataaaattcctagttggttttctccctttttcatttataacgaagatctct

SEQ ID NO: 8599 - DNA, 1545 bp, Trifolium pratense
aagagaaaatatattagtacatgcaatgagatgcataagcataagtattgaattccatggtgtcctcccaactgtccaacctccctacttaattctgttgatttttcagctcatctaccttaccagttaagtactaccatactattcattcccacactactctcttaccataaatccaatactcttcttctctcttttttcataaacaaaaaaccactctctctgttttctctcttcacatttcatatcaaaaaaacatggattcctgctgtataatcagtaagctcaaaactcaacctttctggttcctagttttcttctccctcggtctcttcacaattctcagattcactctcattcttctcaactgggtctatgtcaattttctcagacaacccaaaaatctcaaaaagtatggatcttgggcactcgttactggacccaccgacggcattggaaaaagcttcgcttttgaactcgctcgtaaaggtttgaacctaatccttgtcggtcgcaaccccgacaaactcaaagacgtttcagattctgttaaagctaagttcggaaaaaccgaggttaaaactgttgttgttgattttgccggtgatcttgatgagggtgtgaatagaattcgtgaaacgattgaagggttggatattggggttttgattaataacgtgggaatttcttacccttatgcgaggttttttcatgaagttgatgaagagcttttgaagaatttgattcaggttaatgttgttggaactactaaggttactcaagctgttttacctggaatgataaggagaaaaaaaggagcaattgttaatattggttctggtgctgctattgttattccttctgatccactttatgctgtttatgctgccacaaaagcgtacatagatcaattttctagatgtctctatgttgaatacaagaacaaagggattgatgtgcagtgtcaggttccattatatgttgcaacaaagatggcatcaatccggagatcttcgttttttgttccgtcaacagatggttatgccaaagcaggtgtgaaatggatcggatatgaacctcgttgcacaccatactggccccatacccttctttgggccgtggcttgctcgttgcctgagtctatagttgatgcttggcgcctacgattttgtatcggtattagaaagaggggtcagctcaaagagtcaaggaagcaagaataaaacgatacttgtttgtttgtttgtattatgtaggcgtagatgttgttgctgataactgcacactgctgctagtagatcatgtttcgaagttgtttcatgtgtttctagttttacttttactgttgtcggtcttaatgagtatcaaattgtgttgcctattcttttttcatgccacaattccgtttgtgtttctgttctttaatgttctacttctatagtttctgttgttttttataccttttctcccatttcgaggctcgagctttaagagcaagcaagcaattagggtctcaaaattgcgaaaattggtcaaaatacattt

SEQ ID NO: 8600 - DNA, 1097 bp, Gossypium hirsutum
tcccatctgttgctgcctaacggaactgctaaagattccccttttcgttttcgtgcgctctatttatatcccttagatctctttctttggtattcacacaagtttcaagtttcaagtttctcctctacgtaatccatggaagcctgcttcttcgacactctcaaggctcaacctttctgggttattgtccttttcactttgggttctttatcactcttgaagttctcatttgtttttctgaaatgggtctggatcaattttcttagacctggtaagaatctcaaaaaatatggctcctggggtcttgttactggaccaactgatggtatcggcaaaggatttgcctttcagctggctaggaaagggctaaatcttgtcttggtgggccgtaatcctgataaactcaaagacgtttccgattcaatcttggccaagtatgccaagattcagatcaagacagttgttgtggacttcactggcgatcttgatgaaggcgtgaagaagataaaagaaactattgaaggactggatgtgggggttttgattaacaatgttgggatttcatatccttatgccaggtacttccacgaggttgatgaggagctgttgatgaatttgattaaggtgaatgttgaaggtaccacaaaggtaactcaagctgttttgcctgggatggtgaagagaaagaaaggcgcaattgtgaacattgggtctggtgctgccattgtcatcccttctgatccactctatgctgtttatgctgctactaaggcgtatattgatcaattctctaggtgcctttatgttgaatacaagaacattgggattgatgttcagtgtcaggttccattatatgtggcaacaaaaatggcatcaatcaaaagatcgtctttctttgttccatcaacagacggatatgctcgtgcagcaatgcagtggataggctatgaacctcgttgcacgccctattggccccattccatcctttggggcttggcttattcactgccagagagtgtggttgatgcatggcgtttgcgctttgtcttggcattcgaaagagggggcaacttcaaagattctaggaagaagggaat

SEQ ID NO: 8601 - DNA, 2153 bp, Panax ginseng
ctatactttagcctatctcgattgcctcgcccaagtaattagttttaagttgggacgcacaatagatgggtctcgccaattttagctcatctacttcagtgccggttcaaccaacggaaaccacttttaacacccaactgcttcttcccaacaatacccataaaatctccatttcaattaccccactcacatcacatgcttccttattagattttcatatttaacttccatacaaaaaccttttcccatagatccatctatctccttccacacacagacaacttcactcgcactgtatagaagaaatggagctctgttcgatcgatcagctcaaatctcaatctttatgggttcttctacttacgggtctcggttctttgtatgtattcagattcttattctccattctcagatgggtctatgttaatttcctcagacccccaaagaatctcaagaaatacgggtcctgggcactggtaactggaccaactgatggtattggtaaggcttttgccttccaattggcgcgtaagggactcaatcttgttcttgtgggtcggaaccctgagaagcttaacgctgtttcggaggcaatccgggctaaattcggacagacccagatctcgacggttgtggttgatttctctggtgatttatcagaaggaattcaaagaattcgtgcaacgattgagggtttagatattggggttttgatcaataatgtggggatttcgtacccatatgcaaggtttttccatgaagtggatgccaagttgctggcagatctgattcaagtcaatgttgaagggaccacaaaggttactcaagcagtgttgcctggaatgttgaagagaaagaggggggcaatcgttaatattggttccggtgcggctattatcatcccttctgatcctctttactctgtttatgcggctgcaaaagcatatgttgatcagttctcaagatgcctctatgtggagtacaagaacagcggtattgatgtgcaatgtcaggttcccttgtatgtggcgacaaagatggcatcaatcaaaagatcttccttcttcgttccatcaactgatggttatgctcaggctgccttacgctggataggctatgagccacgatgcacaccttactggccccactctatcttgtgggctttgctgtacttattacccgagtctgctgttgatgcatggcgcctgcgcttctgccttgcaattcaaaagaagggtcaactcaaagacaccaggaaaaaggagtaaaagctctctatctctctcccggtccactccctttactcaactcaccttctcaaatgtctcacacgtgttattgggtatacagtctgagaagtagttttaatatatgagaatgtaaacgatcatggattaagtatttctattgaatgttcttattaagtagcataggtatttagactatgctaatatttggacaatggatgctaaaagtagtagctacattgtcacctaaaagtagtagttacatctgtagctaaaagtagtagcaaacagaaattaagtagtttctgccataaaccgtatgtcttagcttgctatagaatgccttggcttgatatcctcaatggatgggtgatttagataagacaaagcttttcatgggtggtccttcatactcaatcccatctggtaattgaaactgcagtagattgtattagtttcacattagacattttggggggtcattagagaaatctgattgggtattgtgatggcatactacaatgttaatacatagtatatataacttgagaaagcaacatggcaaaataaagcactattagatatgattacattagttcatagagtatattttgctttatcaatatgtggtacaagctatatccaaatttcggataagcaatttacccatatgattgcatataattccattgttgtgtaatctaggtagagtttattcagtacttgattgacattgcaaaacaattctgcattatgcacttggataatacattggcctactttactaatctttagactaaaatctacagcgtgatttcagtacaatttcattcttatttaatatctcattatgtccttgattaaacatgacaactttcttcaggtttatcatcatcgtctactagc

SEQ ID NO: 8602 - DNA, 1118 bp, Gossypium hirsutum
aacctttctgggttatttccttttcactttgggttctttatctactctttaagtttctatttgttttctgaaatgggtctggatcaattttcttagacctggtaagaatctcaaaaaatatggctcctggggtcttattactggaccaactgatggtatcggcaaaggatttgcctttcagctggctaggaaagggcttaatcttgtcttggtgggccgtaatcctgataaactcaaagacgtttccgattcaatcttggccaagtatgccaagattcagatcaagacagttgttgtggacttcactggcgatcttgatgaaggcgtgaagaagataaaagaaactattgaaggactggatgtgggggttttgattaacaatgttgggatttcatatccttatgccaggttcttccacgaggttgatgaggagctgttgatgaatttgattaaggttaatgttgaaggtaccacaaaggtaactcaagctgttttgcctgggatggtgaagagaaagaaaggcgcaattgtgaacattgggtctggtgctgccattgtcatcccttctgatccactctatgctgtttatgctgctactaaggcgtatattgatcaattctctaggtgcctttatgttgaatacaagaacattgggattgatgttcagtgtcaggttccattatatgtggcaacaaaaatggcatcaatcaaaagatcgtctttctttgttccatcaacagacggatatgctcgtgcagcaatgcagtggataggctatgaacctcgttgcacgccctattggccccattccatcctttggggcttggcttattcactgccagagagtgtggttgatgcatggcgtttgcgcttttgtcttggcattcgaaagagggggcaactcaaagattctaggaagaaggaatgaaaacagattgttgagtctgttgtattttacgttcatggagttgagtgttttggttggatgtgttaggatcgtcccgattaagcaacgaacaagtaaaaatagtagaagaaattgaagaagttgaacataacaaatttaacgtaggaaaaacctctaccaaagaggaataaaaaccacgggacaaatatag

SEQ ID NO: 8603 - DNA, 1128 bp, Vinca minor
tctcagcctctatggctacttctatttactcttcttaggttctttgtaaatcccttttcttattagtatctttactgaaatgggtttatgttaattcctcagaccacccaagaatctcaagaaatatgggtcatgggcagtggttactggaccaactgatggaattggaaaggcatttgctttccaattagctcgtaaagggctgaatttagttcttgtgggtaggaatcctgataaactcaaggatgtttctgattcaatcaaggctaaatatttccaaacccagatcaagactgtggttgtagacttttctggggaattaaatgaaggtgttgaaagaattaaagaaaccattgatggattagaagttgggattttgattaataatgttggggtttcttatccttatgctagatatgtccatgaagttgatgagaaattgttggctgatttgattaaagtgaatgttgaagggactagtaaggttactcaagctgtgttgcctggaatggttgagaggaaaaaaggggctattgttaatattggttctggtgctgccattgtcatcccttcagatcctctctatgccgtttatgccgccacgaaagcatatattgatcagttctctagatgcctctatgttgaatacaagaagaacgggatcgatgtgcagtgtcaggtaccattatatgtggcaactaagatggcgtcaatcaaaaggtcatccttctttgttccatcaacggatggctatgctcgggctggtttgcgctggattggctatgaaccgcgttgcacaccatactggctccattccgtcatgtgggctctggcatcttctttgcctgagtcgattgttgatacttggagacttggtttttgccttaagattcgaaagagaggacagcttaaggatgccagaaagcaggaatagaaatcagttcttcccctttctcgtcatcatttcatctcgtttcctccccttccctccgatgctgccccagtatgatgcagacaatctataactaagatttctagacggtctagctctcatatttgagtaccaagtatattgatgtcttgagaactcaggaattcatgttacttttcccatctgtagaatcttca

SEQ ID NO: 8604 - DNA, 1454 bp, Fagus grandifolia
ttttatcgtctgagtcgctgattttgttgttaattgcggtggttttccgctcatctacttcaaccaactctttcctctctcttgcgctttcataaattgaatgcttgctactctctctacctgtaccatcccatactctgcatttagcattcgtcacgaaccaactaaatcttgtcctgtcccccattctctcgctaaatccgtcccctcttcaatcaattcccaactaacttcatcaatttcaaatcctttgaatctcttctgggtcactgtgattaatctctcactacaaaacccatttcttagatctcatatcattccctctcagatccaaaccaacacaaaaaacattcaaccatggagacctgtttcctgaacaagctcaagactcagcctttatgggttctcgtgctgttcactttgggttctctctctgctctgagactttctctcactttcctcaactgggtctacgttaattttctcagaccacccaggaatctcaaaaagcactacggctcttgggcactcgttactggacccactgacggtattggcaaaggtttcgcttttcaattggctcgtgcggggcttaatcttgtcttggtgggtcggaatccagagaagctcaaggatgtctcggatttgattcaaaccaagtacggtaaaacccagatcaagaacgttgttgtggattttgccggtgatctttctgagggtattaataggattagcgacgccattgaaggtttggatgttggggttttgatcaacaacgttggaatctcgtacccttatgccaggtttttccacgaagtggatgaggagctcttgaagaatttgattcaggtcaatattgaaggtactacaaaagttactcaggctgttttgcctgggatgctcaagaggaagagaggtgcaatcgtcaatattggctctggagctgccattgtcattccttctgatcctctttatgctgtttatgctgccaccaaagcgtatattgatcaattctcgaggtgtctctatgttgaatacaagaaaagtgggatcgatgtccagtgtcaggttccactctatgtggcaacaaagatggcatcaatcaagaggtcctccttctttgttccatcaacagatggatatgcccgagcagctttgcgtcacataggctttgagccccgttgcacgccttactggccccacaccctcctctgggctttggcctactccttgccagagtccggtgttgatgcctggcgcctgaggttttgcctcggcattcgaaagaggggacaactcaaggactctaggaagaaggaataaggcagcatcttgctctaaaggaaattggtggattaaaattaagaatgctgattgtatgattggagttcacatttcaatttcattagcatgatgaaagtttggtttcatcattcactgttgttcatttttct

SEQ ID NO: 8605 - DNA, 1014 bp, Castanea mollissima
ctcaagactcaacctttctgggttctagtgcttttcactttaggttctctctcggctctaaaactttctctcactttcctcaactgggtctacgtcaattttctcagaccacccaaaaatctcaaaaagcactacggctcatgggcactcgtaactggacccactgatggtattggcaaaggtttcgcctttcaattggctcgggcggggcttaatcttgtcttggtgggtcggaatccagagaagctcaaagatgtctcggattcgattcaagccaagtacagcaaaacccagatcaagaatgttgttgtggatttctctggtgatttgtctgaggggattaagaggattagtgaaactattgagggtttagatgttggggttttggtcaacaacgttggggtatcgtacccttatgccaggttttttcatgaagtggatgaggagcttttgaagaatttgattcaaataaatgttgttggcactactaaggttactcaggctgttttgcctgggatgctcaagaggaagagaggtgcaattgtcaatattggctctggagctgccattgtgattccttctgatcctctttatgctgtttacgcagccactaaagcgtatattgatcaattctcgaggtgtctctatgttgaatacaagaaaagtggaatcgatgttcagtgtcaggttccgctatatgtggcaaccaagatggcatcaatcaagaggtcctccttccttgttccatcaacagatggatatgcccgagcagctttgcgtcacataggctacgagcctcgttgcacaccttactggccacacaccctcctctgggctttggcctactccttgccagagtttgttgtcgatgcatggcggctgaggttttgccttggaattcgaaagaggggacaactcaaggactcaaggaagaaggaataagccagcgtcttgctctaacttttatcagggatggcttcttagtcaagtacattggtggattaaaattaagaa

SEQ ID NO: 8606 - DNA, 1148 bp, Rosmarinus officinalis
atatataaatcctatttcaaaactccatctcactcgctcacttcctcagaatcatcgccatgacggactgcatcttcgagcagctcaaatctcagcccacatggctcctcctcctcatctccctcggcaccttctctctcctcaaactctccctctccatcctcaaatgggcctacgtcaatttcctccgcccgggcaaaaacctcaagaaatacgggtcgtgggccgtaatcacgggtcccaccgacggcatcggcaaatccttcgctttccagctggcgcgaaaagggctcaacttggtcctagttggccggagccccactaagctcgaggaggtctcgggcgccattaaatccaaatccgggtcgacccagatcaagacggtggtggtggacttctccggcgacttggacgacggcgtttcgaggattaaggaggcgatcgagggtttggatgtgggcttgctgattaacaatgttggggtttcgtatccgtacgcgcggttctttcacgaggtggacgagaagctgttgaacgatttgattaaggttaatgtggtgggaacgacgaaggttacgcaggctgtgttgcccgggatggtggagaggaagaagggggcgattgtgaatattgggtccggcgccgccattgttattccttctgatccgctttactctgtttatgctgctactaaagcgtacatcgatcagttctcaagatgcctctatgtggagtacaaaaagagtggaattgacgtacagtgtcaggtaccactgtatattgccacgaagatggcatcaatcagaaggtcgtccttcttcgttccatcagcagacggttacgctcatgcagctctgcgtaggataggctatgaaccccgttgcacgccatactggccacacaccctcctctgggccgtggcgaattctttgcctgagtcagccattgatgcgtggcgcctcaagttctgcctcgccattagaaagcgaggacaactcaaggattcgaggaaggaggagtagaagccattcttttgtttgagacatatttgttatttatgtaactttctttgtttacaactttgatgtattttctcaattttcttgaattattattattatattttatcatgtactattgcatatgga

SEQ ID NO: 8607 - DNA, 1570 bp, Citrus clementina
aatacgatgtgttaagaggacttgcggaaattagatgtgtgtcagcgttagtagttaattgcggtagttttcagctcatctacttcacccactaaattttgaaaacccccctcacatccgccatccgtcgctgcctacaactctgctctctttgtatcaccctcctccttttccttcactgaatccgttttcagtcaacaactctaccaacgattagcgattataatactttctaaattttggtttcttatatttctgggtcacgctatatatctcttctcgacattacccacttcttagatccgtgtttttttcttttcttttcctttcttctctcttcattcaaaaaattaaaaatataacaaaatggagtcttgctttcttaatactctcaagactcaacctttatggcttcttgctttgttcactattggttctctttcagttttgaagcttgctttcgtcattctcaactgggtttatgttaatttcctcagacctgctaagaatttgagaaagtacggctcttgggctctggtgaccggaccaaccgatggaattggcaaaagttttgcttttcagttggctaagactggtcttaatctggttctggttggtcgtaatcctgataaattgaaagatgtttcggattctattcaagctaagtatgccaaaacccagatcaagagcgttgttgttgatttcagcggtgatcttgatgagggagttgagaggattaaagaggctattgagggattggatgttggagttttgattaacaatgttgggatttcttatccttatgcgaggttctttcatgaagttgatcaagtgttgttgaagaatttgattaaggttaatgtggaaggtacgacgaaggttacccaagctgttttgcctgggatgttgaagaggaaaaaaggtgctattgtgaatattggctcaggtgctgccattgtgatcccatcggatcctctttattctgtttatgctgccactaaagcgtatattgatcaattctcaaggtctctctatgttgaatatcggaaaagcggaattgatgtgcagtgtcaggttccattatatgtagcaactaagatggcatcgatcaagagatcttcattctttgttccatcaaccgatgtttatgctcgggcagctgtgcgctggatagggtatgaaccttgttgcacaccctactggcctcattccttcatctggggtgtgctgtccatattgccagagaaacttatcgatgcaggccgtcttcagttttccattgggattagaaagaggggacaactcaaagatgcaaggaaaaaggaatagataactttattttgatgttatttggttgggaaggttggctaggataagcagtctggttggcagaattgaacttttcaaagctcaagttgcgcacttgcggtttctctctctcgtgatttctttttaaacttacgtgtgcgttaattgtcacatgttttatgtttctttccctgtaatttaatcgataacttttttcaaatggagctaattatagctttgtcgtctttttggcgctgcttga

SEQ ID NO: 8608 - DNA, 1302 bp, Euonymus alatus
gataccaaaatctaaatcacgctcatttatatcagcttctctacttctcttaacattacccacttcttagatccacttcttccctcgtagatccgtggatgctaatggagccctgtttattcaacactctcaagtcgcagccaagttgggttcttttgcttttcactttgggatccttttcgattttgaaattctctctcgcggttttcaattgggtatacgttagtttcctcagacctgggaagaatcttaagaaatacgggtcgtgggctctggttacgggtccgaccgacggtattgggaagagtttcgcgtttgagttgggtcgtaaagggcttaacctggtcttggtgggtcggaatccggataaattgaaagatgtctcggattcaatcaaggctaaatacgctaagattgaaatcaagaatgttgttgttgatttcagtggcgatcttgacgagggtgtgaaaaggattggagaagcaattgacggattggatgttggagttttgattaacaatgttgggatttcgtacccgtacgcaaggttctttcacgaagtggatgagcagcttctgaggaatttgattaaagtcaatgttgaagggactacgaaggttacgcaggctgttttgcctgggatgttgaagaggaagaaaggtgcaatcgtcaatatcgggtcgggtgcggccatcgttattccgtcggatcctctttacgccatttatgctgctacaaaagcgtatatcgatcaattctctagatgcctttatgttgagtacaaggacagagggatcgatgtgcagtgtcaggttcctttgtatgtggcaactaagatggcatcaatcaggagatcgtccttcttcgtgccatcaacagatggttatgctcgagcagcaatgcgctggataggatacgatccccgctgcaccccatactggcctcattcccttctctggtgtttggctcagtcattgccagagtttgttatcgatgcatggcgtctaaggttttgccttggaatcagaaagagagggcagcttaaagattcaaggaaggaggagtagacagtattctgtaattgtagcatttagtatttatctactcttgttctttcacattacctttatgcatctaagcttagtggtttgtctcaatcgtcaggcatcttttttatatgtattttttgttttgcaactgaaattgttcttgaccaattaagggaatgacccttgtgacttcgaatgcttttttccttttagttccaaataagattcaatggaaaaggaaaaattttgattt

SEQ ID NO: 8609 - DNA, 1291 bp, Euonymus alatus
gcggggactctcttacacgcattaaattcaacacacatacacgcacttctctgtttcttcttcgttttctcctcttattcactccaattcaattccagaaattcaaatcacacgttacattagctttctccagtcctctggaccaaacccaattcttagatcgacttctccccagagaaccgcagataccaatactctgccactaatggagccctgttttttcgacactctcaaggcgcagccaagttgggttcttttgctgttcagtttgggatccttttcgattttgaaattatccctagcggtagtcaaatgggtctacgttagttttctcaggccagcgaaggatcttaagaaatacgggtcgtgggctctggtcactggtccgactgacggcattgggaagagtttcgcgttcgagttgggtcgtaaagggcttaacctggtcttggtgggtcggaatcaagataagctgaaggatgtatcggattcaatcaaggctaaatatgctcagattgaaatcaagaatgttgttgttgatttcagtggggatcttgacgagggtgtgaaaaggattgtagaagcgattgacggattggatgttggggttctgattaacaatgttgggatttcgtacccgtacgcaaggttccttcacgaagtagatgaggagcttctgaggagtctaattaaagtcaatgtcgaagggacaacgaaggttacacaggctattttgcctgggatgttgaggaggaagaaaggggcaatcgtgaacataggatcgggcgcagccatcgtgattccttccgatcctctttatgccgtttatgctgccacaaaagcgtatattgatcaattctctaggtgcctttatgttgagtacaaggatagagggatcgatgtgcagtgtcaggtccctttgtatgtggcaactaagatggcgtcaatcaggagatcttccttcttcgtgccatcaacagatggttatgctagagcagcaatgcgctggataggatacgatccccgctgtaccccttactggcctcattcccttctctggggattggctcactcactgccagagtttgttatcgatgcatggcgtctaaggttttgccttggaatccgaaagagagggcagcttaaagattcaaggaaaacagagtagacagtattctgtaattgtagtattgagtgtgtctggactcaatgttaggatgctaaaatcttctacttggaactcttgttctttcaaattaccttttaatgcatctaagcttagtggcttgta

SEQ ID NO: 8610 - DNA, 1345 bp, Panax ginseng
agatccatctatctccttccacacacagacaacttcactcgcactgtatagaagaaatggagctctgttcgatcgatcagctcaaatctcaatctttatgggttcttctacttacgggtctcggttctttgtatgtattcagattcttattctccattctcagatgggtctatgttaatttcctcagacccccaaagaatctcaagaaatacgggtcctgggcactggtaactggaccaactgatggtattggtaaggcttttgccttccaattggcgcgtaagggactaaatcttgttcttgtgggtcggaaccctgagaagcttaacgctgtttcgaaggcaatccgggctaaattcggacagacccagatctcgacggttgtggttgatttctctggtgatttatcagaaggaattcaaagaattcgagcaacgattgagggtttagatattggggttttgatcaataatgtggggatttcgtacccatatgcaaggtttttccatgaagtggatgccaagttgctggcagatctgattcaagtcaatgttgaagggaccacaaaggttactcaagcagtgttgcctggaatgttgaagagaaagaggggggcaatcgttaatattggttccggtgcggctattatcatcccttctgatcctctttactctgtttatgcggctgcaaaagcatatgttgatcagttctcaagatgcctctatgtggagtacaagaacagcggtattgatgtgcaatgtcaggttcccttgtatgtggcgacaaagatggcgtcaatcaaaagatcttccttcttcgttccatcaactgatggttatgctcaggctgccttacgctggataggctatgagccacgatgcacaccttactggccccactctatcttgtgggctttgctgtacttattacccgagtctgctgttgatgcatggcgcctgcgcttctgccttgcaattcaaaagaagggtcaactcaaagacaccaggaaaaaggagtaaaagctctctctctctctcccggttcactccctttcctcacctcaccttctcaaatgtctcacacatatgttattgggtatactgtctgggaagtagttttaatatatgagaatgtaaaccatcatggattaagtatttctactgaatgttcttattaagtggcataggtatttagactatgctaatatttggacatctgttgctaaaagtagtagctacattgtcacctaatatgttgtgttagctttgttcatgttaggagcacgcttattgttatttgggttgaagtccggtcctcctcgagaaaagctggcacgcattcttgt

SEQ ID NO: 8611 - DNA, 1569 bp, Citrus sinensis
aatacgatgtgcgaagaggacttgcggaagttagatgtgtgtcagcgttagtagttaattgcggtagttttcagctcatctgcttcacccactaaattttgaataccccctcacatccgccatccgtcgctgcctacaactctgctctcttcgtatcaccctcctccttttccttcactgaatccgttttcagtcaacaactctaccaacgattagcgattataatactttctaaattttggtttcttatatttctgggtcacgctatatatctcttctcgacattacccacttcttagatccgtgtttttttcttttctttttctttcttctctcttcattcaaaaaattaaaaatataacaaaatggagtcttgctttcttaatactctcaagactcaacctttatggcttcttgctttgttcactattggttctctttcagttttgaggcttgctttcgtcattctcaactgggtttatgttaattttcttagacctgctaagaatttgagaaagtacggctcttgggctctggtgaccggaccaaccgatggaattggcaaaagttttgcttttcagttggctaagactggtctgaatctggttctggttggtcgtaatcctgataaattgaaagatgtttcggattctattcaagctaagtatgccaaaacccagatcaagagcgttgttgttgatttcagcggtgatcttgatgagggagttgagaggattaaagaggctattgagggattggatgttggagttttgattaacaatgttgggatttcttatccttatgcgaggttctttcatgaagttgatcaagtgttgttgaagaatttgattaaggttaatgtggaaggtacgacgaaggttacccaagctgttttgcctgggatgttgaagaggaaaaaaggtgctattgtgaatattggctcaggtgctgccattgtgatcccatcggatcctctttattctgtttatgctgccactaaagcgtatattgatcaattctcaaggtctctctatgttgaatatcggaaaagcggaattgatgtgcagtgtcaggttccattatatgtagcaactaagatggcatcgatcaagagatcttcattctttgttccatcaaccgatgtttatgctcgggcagccatgcgctggatagggtatgaaccttgttgcacaccctactggcctcattccttcatctggggtgtgctgtccatattgccagagaaacttatcgatgcaggccgtcttcagttttccattgggattagaaagaggggacaactcaaagatgcaaggaaaaaggaatagataactttattttgatgttatttggttgggaaggttggctaggataagcagtctggttggcagaattgaacttttcaaagctcaagttgcgcacttgcggtttctctctctcgtgatttctttttaaacttacgtgtgcgttaattgtcacatgttttatgtttctttccctgtaatttaatcgataacttttttcaaatagagctaattatagctttgtcgtctttttggcgctgcttga

SEQ ID NO: 8612 - DNA, 1805 bp, Populus trichocarpa
acctttcgctttctccatcaaatcttagttaattcccgcgttcttctgtctgttctcgcctaacttatcttccgccactcgatttttcctctcacgcgcgcgcgcgcactctgttttcctcgttagctccgcttttaaatccaaaaattctgcagtgttaacattaacagaagcttccttacctttctttccccttctttctttatagcattcttttatttaagtcttcatcaaatcccacgtctcggatccaaaagcataactaaagaatgggtctccgtttcattgaccagctcaaagatcagcctttctggcttcttctgctcttcactttgggttctctttcacttctgaaattcctttccgctactctcaaatgggtctacgttagtttcctcagacctgccaagaatctcaagaaatatgggtcatgggctctcgttactgggcccactgacggtattggcaagggattcgctttccaattggctcgaaagggtctcaatctagtcttggtgggcaggaatcctgataaactcaaagacgtgtcaagttctattcaatccagatacagtaatgttcaaatcaagaacgttgttgttgatttcagtggcgatattgacgagggtgttcaaaagatcaaggagactattgaaggattggatgttggtgtcttgattaataatgttggggtttcttatccttgtgcgaggttctttcatgaggttgatgaggggttgttgaagaatttgattaaagtgaacgtggaaggcactaccaaagttacgcaagctgttttgcatgggatgttgaagaagaagaaaggtgctattgttaatattggttctggtgctgccattgttattccttctgatcctctttatgctgtttatgctgctactaaagcgtacattgatcaattctcaagatgcctttatgttgaatacaagaaaagtgggattgatgtgcagtgtcaggttccgctttacgtggcaacaaagatggcatcaataaggagatcttccttttgggttccatcatcagatggttatgcccgggcaggtctgcgtgctataggctatgaacctcgctgcacaccttactggccccattcccttctctggggtttgatacaattgttgccagaatcaattgttgatttctggagactaagtttttgccttgcgattcgaaagaagggacaccttaaagattccaggaagatggaatgaacagtataaactcaactttggttagcttgggaatttggtctgtggattaaactttcaggatgctgattgtgtacttatcatttgaagtcacaaaaataaaaataaacacgccacgttgttgattaatttacagttataattaattagatatatgaaattaaattactatgattattcattttctttctatttcaatgttaattattgctacttatcccccattaagtaacctgcactttgtctgcatgttaaatttattaattttaatatgcttttaaatatagaaaagttcacatgctgcgttagactgtttatcctttaaaaattctcataatcaagaaatccctggagggagttcgtctactgaagatgtttagggatagaatgtggaagttaacccctagggtttcagcaaagaacctgatgcagcacctgttcctgtccagggagtaacaatttcagagtcttgagctgtctctgtgaaggaaaaacgtatgtcgatcctgtccaagaagatgaaagcccctctttactaggtgatcaggctgatggactcgaagaggaaagagactc

SEQ ID NO: 8613 - DNA, 1262 bp, Tripterygium wilfordii
cgttttctcccgtctcttcttcagtcaaattcaatcccacccatcgataccaaacccaaatcacactcatttatatcagcttctctactcatctaaacaaaacccatttcttagatccacttcttccctcgtagatccgtggatacgacgcactctgccactaatggagccctgtttcttcaacactatcaaatcgcagccaagttgggttctttttccattcactttgggatgcttttcgattttgaaattctctctcgcggttctcagatgggtatacgttagttttctcagacctggaaagaatcttaagaaatacgggtcgtgggctctggtcacgggtccgaccgacggtattgggaagagtttcgcgtttgagttgggtcgtaaagggcttaacctggtcttggtgggtcggaatccggataaattgaaagatgtctcggattcaatcaaggctaaatacggtaagattgaaaccaagaatgttgttgtcgatttcagtggggatcttgacgagggtgtgaaaaggattggagaagcaattgacggattggatgttggggttttgattaacaatgttgggatttcgtatccgtacgcgaggttcttccatgaagtggatgagcagcttctgaggaatttgattaaagtcaatgttgaagggactacgaaggttacgcaggctcttttgcctgggatgttgaagaggaagaaaggcgcaatcgtgaatatcgggtcgggtgcggccatcgtgattccttcggatcctctttacgccgtttatgctgctacaaaagcgtatattgatcaattctctaggtccctttatgttgagtacaaggatagagggatcgatgtgcagtgtcaggttcctttgtatgtggcaacaaagatggcatcaatcaagagatcgtccttcttcgtgccatcaacagatggttatgctcgagcagcaatgcgctggataggatacgatccccgctgcactccatactggcctcattccctcctctggggtttggcacattcattgccagagtttgttatcgatgcatggcgtctaaggttttgccttggaatcagaaagagagggcagcttaaagattcaaggaagaaggagtagacagtattctgtaactgcagtatttagtatttatatgcccttgttctgtcaaattaccttttatgcatctaagcttagtggtttgtcttaatcgtcaggcatcgttcttatatttattttaattttgcaacttaaa

SEQ ID NO: 8614 - DNA, 1016 bp, Vicia sativa
cttcatcttccctcaacatggtttgctgcataatcagtaaactcaaatccgaacctctctggttcctccttctcttctcactcggtctctttaccattctcagattcactctaacattcctcaactgggtctatgtcaattttctcagacaacccaaaaacctcaaaaagtacggatcttgggccctcgtcacaggacccacagacggcattggaaaaagcttcgcctttgagctcgctcgcaaaggcttgaacctaatcctcgtcggccgcaaccccgacaaactcaaagacgtttcagattctatccaagccaagtttggaaaaaccgaggttaaaaccgttgtcgtcgatttcacaggtgatctcgacgagggtgtgaacagaatccgtgaaacgattgaggggttggaagtcggagtgttggtaaacaacgtgggaatttcttacccttatgcgagattcttccatgaattagacgaggagcttctgaagaatttgattaaggttaatgttgttggaactactaaggttacacatgctgttttacctgggatgttgaagaggaagaagggggctattgttaatattggttctggtgctgctattgttattccttctgatccactttatgcggtttatgctgccactaaagcgtatattgatcaattttctagatgtctatatgttgaatacaagaagagtgggattgatgtgcagtgtcaggttccattatatgtggcaacaaagatggcatcaatcaagagatcttccttctttgttccatcaacagacggatatgcgagagcaggtgtgaaatggatcggatacgaacctcgttgcacaccgtattggccacatactcttctttgggctgtggcatgttcgttgccggagtatgtagtcgatacttggcgcctcgggttttgtatgggtattagaaagagggggcagctcaaagactcgaggaagcaggaataagaaaaggatgcttgtttgtttgtgtactctgtaggg

SEQ ID NO: 8615 - DNA, 1405 bp, Citrullus lanatus
taactctggagttgtcgcctaaaagctgaaacgcataaccctccattggaagtggtaacatttttaatgaggcggttagctcatccactttagcgacctgtcatccgtttccataaatgaaaaaacctttcgatctttttcttcatcttcacaaatttcccttttgtttctttaaatcccaagacttttattcccaaattctcccaattcaaaaatggagctgaccaattgtgtccagcagcttaaatctcagcccctctgggtttgcttcctattcgcattgggttctctctctgctctgaaattcttagcaatcattctcaaatggatctatgtcaatttcctccgtcccccaaagaatctcaagaaatacggttcatgggcactcgtcactggacccactgatggaatcggtaagagtttcgcttttcaattggctcgcaaaggcctcaatctcgttttggtgggtcggaaccctgagaaactcaaggacgtttcggatgcaatcgttgctaaatacggtagcgtccagataaagagcgtcgtcgttgatttctccggcgatctttcagaagggattaagagaatcaccgaagcaattgaagggttggatgttggggttttgattaacaacgttggggtttcgtatccgtatggaaggttttttcacgaagtggatgaggagcttctgaataacttaatcaaggtcaatgttgaaggcactaccaaggtgactcatgctgttttgcctggaatgttgaagaggaagagaggcgctattgttaatattggttctggtgctgccattgttattccctcagatcccctgtatactgtctatgctgccaccaaagcgtacattgaccaattctcgaggtgcttgtatgtggagtacaagaagagtggaattgatgtgcagtgccaggtcccactatatgttgctaccaagatggcgtctattcgaagatcatccttcttcgttccctcaacaaatggatacgcagcagcagctctccgctggattgggtacgagcctcgctgcacaccgtattggccccatcaacttatatggggtttggtgtacttgttgccagagtctgttgtcgatgcttggcgcctgaagttttgtcttggcatcagaaagagaggacaactgaaagactccaggaagaaagagtaggaagattaaagatatatagttctaatttgcgtagtagaataacttttctccttagtgtgtcagctactttgttgaaatttggaacacaagcatgctagatttgaatgttttcagttctattgttctttgatggccttccaatatatttttaacattttagatcagcctttttcatatttttttcttgggaagggaaaaagactagggaatggtgtgctccatttt

SEQ ID NO: 8616 - DNA, 1988 bp, Quercus alba
atgggggacacataaaaatgaaacatatgatgatggattcatacaagaacacctctagcacaagtaactagtcatgtacaaattatgataaaaaattgtgtttttctggcattactcttacacttcgttttcccaacataaaatggtgccaactagtccagcaaaaatacagtggcagctccacgttctctcatgtgcgtcgttttttgattgtttaattacggtggttttccgctcatctacttcacccaactatttcctctctttctgactctgttgcctgcataaattgaatgcctcttggtctgctaactgtcctatcttaattcctatatatccaaccatctgttagcattaaacacgaccaatttggccatttcctcttactctctcaaacccgtcctgccctcctaaatcaacccccagctaaccttgtcaatctcaaacctactctttctccctctccttacaaaaccccatttggccatttctcagatccaaaccaaacccaaaaaaaaaacacacacacacacacacactctgttccaatcatgcatacctgtgttctagacaagctcaagactcaacctttctgggttcctgtgcttgtcactttaggttctctctcggctctaaaactttctctcactttcctcaactgggtctacgtcaattttctcagaccacccaaaaatctcaaaaagcactacggctcatgggcactcgtaactggacccactgatggtattggcaaaggtttcgcctttcaattggctcgggcggggcttaatcttgtcttggtgggtcggaatccagagaagctcacagatgtctcggattctattcgagccaagtacggcaaaacccagatcaagaatgttgttgtggacttttctggtgatttatctgaggggattaagaggattagtgaagctattgaaggtgtagatgttggggttttggtcaacaacgttggggtatcgtacccttatgccaggtttttccatgaagtggatgaggagcttttgaagaatttgattcaaatcaatgttgttggtactactaaggttactcaggctgttttgcctgggatgctcaagaggaagagaggtgcaattgtcaacattggctctggagctgccattgtgattccttctgatcctctttatgctgtttatgcagccactaaagcgtatattgatcaattctcgaggtgtctctatgttgaatacaagaaaagtggaatcgatgttcagtgtcaggttccactatatgtggcaacaaagatggcatcaatcaagaggtcctccttccttgttccatcaacagatggatatgcccgagcagctttgcgtcacataggctacgagcctcgttgcacaccttactggccacacaccctcctctgggctttggcctactccttgccggagtttgttgttgatgcatggcggctgaggttttgccttggtattcgaaagaggggacaactcaaggactcaaggaagaaggaataagccagcgtcttgctctaacctttatcagggatgggttcttagtcaagtacattggtggattaaaattaagaatgctaattgtatggttggagttcaccttgcaatttcattagcattatgagagtttggtttcatgatagactgttcttcatttttcctcgactcttaaagtttgattttatgaatgttataaatgtggtccccaaagggtggttttagtttccttcaatttatttcttcatgtcaacccttggttctagtttggcgctacatttattaggttagttgaatatgttggcagagttggttactaagggcacgtttggtagattgtaatagacactgtaatataatagctattactgtagcataactattcggttgtttggttatgtttttattacaataaatagttattccttatgaatagctattcttcaaaatgaggaataactattctttatcaaaagt

SEQ ID NO: 8617 - DNA, 1451 bp, Phaseolus vulgaris
agaattccagaacttctatctttctcatcattcacaccttccacctcccaaaatggaatgctgcataatctccaggctcagggtccaacccatatggttcgtgctgctctttcttgtcggattcttaacgattctgaaactagctttcgttcttgtcaaatgggtctacgtcaatttcctcagacctcccaaaaaccttagaaagtacggatcttgggctgtcgtcactggacccaccgacggcattggaaagagcttcgctttcgagctggcgcgtaaagggctcaacctcgtacttgtgggtcggaaccccgacaagctcaaggacgtgtcggattcgatcgccgccaagttcgggaaaactgaggtgaggactgtggtggtcgatttctcgggggatctggacgagggtgtggcgaagattggggaagcagttgaagggttggacgttggagtgctggttaacaatgtgggagtttcgtacccttacgccaggttcttccatgaagtggacgaggggcttctcaacaacctcattcaggttaacgttgtgggaaccaccaaggtcacgcaggctgttctgccggggatgctgaagagaaagagaggggcgattgttaacattggttctggtgctgctattgtgattccttctgatcccctttatgctgtttatgccgccaccaaagcgtacatcgatcagttttccagatgtctctatgttgaatacaagaagagtggaattgatgttcagtgtcaggttccgttatatgtggcaaccaagatggcatcaatcagaaaatcttcattctttgttccatcaacagatggctatgccagagctggtgtgcgatggatcggctacgagcctcgatgcacgccatactggccacatacccttctctgggctgtggcctgctcattgcctgaatttgttgttgatgcttggcgcctgtggttctgcttgggtattagaaagaggggacaacgcaaagattccacaaagaaggaatagatacagaagaatgcttggttctgctgtttaggcaatagatgctgctactcatctcatacatatatgcagattgttagcagattaaggactccaagtatctcatatgttcctaaatttcatcttaatgttgttagttgttcttagtatcagttgtgtggtctataaattcttttaactcccatgtttgggtgtttctgttcacgtttcagtacttttgttgaactcatatgatgtgtattgtgttcaatgcctttctcttactgtgagcttttggaaagtttctgtgtttgaagccaagaactaaggatgtatttggaaaaacattgagttaaaaccagtgtttttctcaatccatcagagcattgtagtttcttggttttgtgtttgggaatgaatagagcattggtgataaactaattgcaattttagctgaaaa

SEQ ID NO: 8618 - DNA, 1970 bp, Eucalyptus grandis
cgagacgataggcacaaaagtcacatttggacaatgaatgcccatcgtcattgctgcgattgatgggccggtgagaagagcctcccttgcctcatccctctttgcatctcagcttcttcagcggtcggattttacagccatcccaatccatacggaatcaacaagtcgaaaggaaaaaaaaatttaaaaaaaatcaacacctggtcatacggaatcgcacatgattcgacggccctgacaattggcaaaggtgagatttactcgttgcatgtgcatcgatggagggctctccctgtcgcccagcgtcattgttgatcagacgtgcaaggagtcttgattgcatcggttcgcagcccatctacttcacccaacttctcactctctcttgtctctctctctcggcattcaattcaatcgctccccatccgtctccaacacccccgactccgtcctcggttgcctaaccctaacaccttcctctgttttctcgccctcgtcctccctccgtccaaccttaaccaacatcaccaaaaaagttaaagaatcctccgcagtccgcctataattccccctccagacgaaacccacatcttagttttctccattagcccctagatccgctccctcgtgctctgaagcttcgccgaaatggagctctgtttcttggataagctcaagaaccagccttcatgggtcatcttcctcttcgccctcggttcaatctcgattctcaagttctcgctcgctgttctcaagtgggtctacgtcagtttcctcaggcccgccaagaatctgaagaagtacggctcgtgggcgctcatcaccgggcccaccgacggcattggcaagggattcgctttccagattgcccggaagggcattaatctggtcctcgtcggccggaaccccgataagctgaaggatgtctccgacgcgatcctggccaagtacgggaaggtgcagatcaagacggtggtcgtcgatttcgccggggacatcgacgcgggcgtccggaggatcagcgagacgatcgaggggttggacgtgggggtgctgatcaacaatgtcggcgtgtcatatccgtacgcgaggttcttccatgagttggacgatgagctgctgaaaaacttgattaaggtcaatgtggaagggaccaccaaggtcacccatgctgttttggctgggatgatcaagaggaagaagggagctattgtcaatattggatcgggggctgcgattgtgatcccctcggatccactctactctgtttatgctgccacgaaggcgtacatcgatcagttctccaggtgtctctacgttgaatataagaagagcggcatcgatgtgcagtgtcaggttccactgtacgtggccactaagatggcgtcgatcaagcggtcttctttctttgtgccatcgccagaaggctatgctcgggcagctctggggtcgattggctacgaacctcgatgcaccccctactggccccattccctcctctggggcgttgctagcttgttaccggagtcggcgatcgattcctggcggctgggattttgcctcggcattaggaagagggggcagctcaaggactcgaggaagaacgagtagtgtgcgtaaatccctcggctctatggctcgcgtgcgggtcatgcacagagctttgtgcttgttctgtctgcgagattttcgtctttccaaaagtgtatgatcttcgaaatccatggctttcgatgtttgttttgtgttagcacgctttggtgggatgaattgttcttgactctttcgtcttatgatttgcatcgctctctctccctcgactagcaaagaacaaaagacgaaaacattttgtgaggaaaatgttgttaactgtatctccatttagtgtattgaacatctcgaatttcatatttatataagtcatttgaaattcgagagaaatttttttcataatccgacaaatgcttatt

SEQ ID NO: 8619 - DNA, 2536 bp, Petroselinum crispum
atcataccttaatttttgtgatacgtcgatgatcccaaagtaagtttgacaagaccattaatcaaggacaacgttagcgtggtgaaatgcacttaaacagcaaaattttagctcatctactttaaacaaacacttctgttacatttcaaatctagcactacttgtagtagtattcaatttcaacacccaaccgtttctttattaattgttcacagttgagcagcttcacatattgagcatctacacacacctctattaaaaccccatttcacagattcatttttcatgtcttcttgtcctatggatcaactaaagtctcaacctttatgggttcttgctcttttatctttaagttctttatatatactcaagttcttgttttgtgttcttaaatgggtctatgtttatttcatcagacctgccaagaatctcaagaaatatggttcttgggctttggttactggcccaactgatggcattggtaaagcttttgcctttcaattggctagaaaaggactaaatcttgttcttgtgggtcgaaaccctgataagcttaatgatgtttcgactgcgattcgagctaagtttgggggaattgagattaagactgtggttgtggatttttctggggatttgttagaaggggttaagagaattgaggaggtgattgagggtttagatgttggggttttgattaataatgtggggatttcgtatccatatgcgaggttttttcatgaagtggatgagaaattgttggctgatatgattaagattaatgttgaagggactactagggtgactcaggctgtgttgcctggaatgcttaagaggaagaggggagcaattgttaatattggatccggtgctgccattgtcattccttcggatcctctttactctctttatgcggctgctaaagcatatgttgatcagttctcaagatgcctctatgtggagtacaagaagagtggtattgatgtgcaatgtcaggtacccctgtacgtggcgacaaaaatggcatcaattcgaagatcttctttctttgtaccatcaactgatggatatgcccgggctgccttaccatggattggctatgaaccacggtgcacgccctactggccccactctatcttgtgggctttggcaaactctttgcctgatgctgttattgacgcttggcgtctgaatttctgccttgcaatccgcaagaagggacaatctaaagactcaaggaagaaggaatgaacaggtctacatccgacttcagttcacaccttttcttacttcagtttcccaacattaattcaggatttattactgggatgtacattttaaaacagttgtttcggtatgagaaaatgtactctgcatcaagtacttgaacttctagcatgagttctcattgagttgcatttgttttcaaaatatgatgatagtgtaacgctggacacatgttgccaatagttgtcatatattctttaatttgaatttaacgacgagcactttcactttcatgaaattgctttcagttctcgctgtaggaatggcaaaagttaaatttaagcttccgtttgaatatcatcataatactaacaaaaattaagaccattactccaaatctatacaagtaatcactctccagcctacaacgtgaatggtaaaaacaagaaagtacactctagcttaatataaaatatgaaaaaagatcatcactttaaatctatacaaatccccaacagtatacaaaaagatatcaaagagaagcaattacaactatctatatgattacatacatatcttacagctatttagtagaaagggaagtgtttcgagaggaaagtataattcgatttcgctttcttcattcttgtttgcggaaatggttgaacattaacatgtaatatcacatttaacttggacatctttctggcatatctcaccggacatctttatcggacatctttatcgacagcaagttgagtctctacatcagcggcaggtgtcttacgcctggaatacttcaggctaaatatcctactaaatgtactttttgaccttggcagagtttcaggatcagcattgtgtttgctgccatcagttttccgagcatgatcacaagacatagttttaagagcactatcaaatcgacgcttatatgttgggaaccttgatatggacttgcttattccttgaagtctcagtgctaatgcattaagttctgccttctttatctccgattcaggtggggatcccatcgttgaaattttcaatttctccggactacctataaataacactagtctccccaagtacagatcttcggtctcggataggttctgggctttgatctgatccttcatgacgaggagtggatttaaaaaccaatcgaaaaaagtctctgttggtctgtttgtgcttgttatctcagtaatattgtctgctagtagcaaaccaacactatccgcttttgcagatcgcagaaggcactgcaggaggctgtaagcagctaaaccactacatacagacctttttt

SEQ ID NO: 8620 - DNA, 1183 bp, Platanus occidentalis
agcttttgtatcgcagatcgagagtgacccctcatcctcatttcggattacagatggagcactgttttatggagcagctcaaagctcaacccacttgggttcgtgtccttctggttctgggttttctctttgtgtcgaaattcgcctttgctattctcaaatgggtttacgttaactttctcagacctggtaagaatctcaagaaatatgggtcctgggcgctagtgacgggaccgactgacggtattggaaaaggtttcgcctttcagttggctcggaaaggcctgaatctgatcctcgtgggccggaatcctgataagttgaaggaggtttcgaatgcgattcaggcgaaatttgggaaaacccagatcaagaatgttgttgttgatttctccggtgacctttcggagggaatccagcggattcaggaagcgattgaagggttggacgttggagttctaataaataacgtaggaatttcctacccgtatgcgaggttctttcatgaagtggatgcagagctattgaatgatttaattaaaatcaatgttgaaggcactacaaaggttacgcaggctgttctcacggggatgcttcagaggaagaaaggtgcaattgtcaatatcggctcgggcgctgccattgtgataccttcagaacctctttatgctgtttatgctgccacaaaagcgtacattgatcagttctcaaggtgcctatatgtggagtacaagaagagtggaatcgatgtgcagtgtcaggtaccattgtatgtggcgactaagatggcatcaatcaggagatcttccttccttgtaccatcaacagatggttatgctcgggctgccatgcgctggataggctatgaaccacgttgcactccgtactggccgcattctctgttatggggtttagcaagcttgttgccagaatatatcattgatacatggcgtctggggtactgccttaagattcgcaagaagggacaacttaaggactcaaggaagaaggaatgaacggtctctgttttgtcgtggttggtttgggagaggtgggctagttttggctgtctgttagtgaatctaggttcgcaagactgtaatatttaaactctaattggatctcctttgttactggttaaactgatctcttcttctaaattttccttcatgtcagttcatac

SEQ ID NO: 8621 - DNA, 1668 bp, Vigna unguiculata
gtcacattgtatagtgtgcaaaacaatgttggggtttgaatattcaatgaatgccaccgtactgcgccaactttctacttaattctggtggttttccgctcatctacctcacccacacttccctttcaccacctgtctctcacactcaccgtcatcatcataataaattcgatgctcttattgttcttctcataagcccaaaaacttctcctgagccataccatcatcatcatctttctcatcattcacaccatcaaaattcctaaaatggaatgctgtataatctccaggctaagggttcaacccctatggttcgcgctgctctttcttgtcggattattcacgattctgaaactggctttcgttgttgtcagatgggtctacgtcaatttcctcagacctcccaaaaacctcagaaagtacggatcttgggctctcgtcactggacccactgacggcattggaaagagcttcgctttcgagctcgcgcgcaaaggcctcaacctcgtactcgtcggtcggaaccccgacaagctcaaagacgtgtcggattcgatcgtcgccaagttcgggaaaaccgaggtcaagaccgtggtggtcgatttctcaggggatctggacgagggtgtggccaaaattggggaagcgattgaggggttggacgttggagtgctggttaacaatgtgggagtttcgtacccttacgccaggttcttccatgaagtcgacgaggggcttctcaataaccttattaaggttaacgttgtgggaaccaccaaggtcacgcaggctgttctgccggggatgctgaagagaaagagaggagcgattgttaacattggttctggtgccgctattgtcattccttccgatcccctttatgctgtttatgccgccaccaaagcgtacatcgatcagttttccagatgtctctatgttgaatacaagaagagtggaattgacgttcagtgtcaggttcctttatatgtggcaaccaagatggcatcaataaggaaatcttcattctttgttccatcaacagatggctatgccaaagctggtgtgcgatggattggttatgaacctcgatgcacaccatattggccacacacccttctctgggcagttgcatgttcattacctgaatttgttgttgatgcttggcgactgtggttctgtttgggtattcgaaagaggggacaacgcaaagagtccacgaagaaggaatagagatttacagaagaatgcttggttctgctgtttaggcaaacatagatgctactcatctcatacatatatgcagattttagcagattaaggatattcccaagtatctgttatgttcctcaatttcatgttaatgttgtttagtatcagttgttgtgtggtctataaattctttttactcctctgttttggttgtttctgttcacattttcagtactttgttgaactgatatgatgtgtattggcatatcgcttaacccggttttctctgctgtcattccttgcttttctcttactgtgagattttagaaaatctgtgtttgaagccaacagatgaaggtgtatttggaaaaacaccgagttggggtaactgtttttcttaatccatcagctttgttagtttcgcggttgtgtatgggaatgaataaaccattggtgatg

SEQ ID NO: 8622 - DNA, 1084 bp, Triphysaria pusilla
tctatcaccagctgaaatctcagcccacatggctcctcctcctcatctccataggttccttctccctcctcaaactctcactctcgatcctcaaatgggtctacctcaatttcctccgacccggcaaaaacctcaaaaaatacgggtcatgggctttaatcaccggcccgaccgacggcatcggcaaagccttcgcctttcagctcgccagaaaaggtctcaacttaatcctagtcgggcgaaacccggataagctcaacgaggtctcagaatccatcaaatccaaatacgggtcaacccagatcaagaatgtggtggttgacttttctggggacctagacgacggcgttttgaaggtgaaggatgctattgaagggttggatgttgggattttgattaacaatgttggaatgtcgtatccttatgccagattttttcatgaagttgatgataaattgttgagtgatttgattagggttaatgttgagggtaccacgaaagtgacccgggccgttttacccggaatggtcgaaaggcgaaaaggggctattgtgaatattgggtctggtgctgctattgttattccatctgatccactttactctgtttatgctgccacaaaagcgtacattgaccagttctcgagatgcctatacgtcgaatacaagaatatcgggattgatgtgcagtgccaggtaccgttgtatgttgcgacaaagatggcatcgataaaaaggtcgtcgttttttgttccatcgacggatggttatgctcgtgcggctctgaggtggataggatacgagcctcgttgtacaccttactggccccacacgattttgtgggccctggcaaatgctttaccggagtcgattgtggatgcttggcgtcttagattttgcctaaagattaggaagagaggacagttcaaggacacgaggaagaaggattagaatcgaaaccatatgtgttcggttcaaaggctaaacgtactttttcttgtttctacctttgttgtatttgcttattcaatgtatttcgacattaaaacatatttgtatccgaattctgaatatcgagttccggt

SEQ ID NO: 8623 - DNA, 1118 bp, Vinca minor
ttaggttctttgaaatcccttttcttattagtatctttactgaaatgggtttatgttaatttcctcagacctgccaagaatctcaagaaatatgggtcatgggcattagttacaggaccaactgatggaattggaaaggcatttgctttccaattagctagaatagggctgaatttagttcttgtgggtaggaatcctgataaactcaaggatgtttctgattcaattaaggctaaatatggccagactcagatcaagactgttgttgttgacttttctggggaattaaatgaaggaattgagagaattaaagaaattattgatggattagaagttgggattttgattaataatgttggggtttcttatccttatgctagatttttccatgaagttgatgagaaattgttggctgatttgattaaagttaatgttgaaggaactactaaggttactcaagcagtgttgccaggaatggttcagaggaaaagaggggctatcgttaatattggttctggtgctgccattgtcatcccttcagatcctctgtatgctgtctatgccgcctcgaaagcatatattgaccagttctctagatgcctctatgttgaatacaagaacagcgggatcgatgtgcagtgccaggtaccattatacgtagcaactaagatggcgtcaatcaaaaggtcatccttctttgttccatcaacagatggctatgctcgggctggtctgcgctggattggctatgaaccgcgttgcacaccgtactggccccattccgttatgtgggctttggcatcttctttacccgagtcaattgttgatacttggagactcggtttctgccttaagattcgaaagagaggacagcttaaggacgccagaaagcaggaatagaaatcagtttctttccccttaccatcatttcatctcgtttcctctccatccccttcgatgatgtcccaatctaatgtagccattagacaactaaaatttctagttttgatgtttgagtactatcttgctgccattgaatgtcattttagcttgcaaaagaaccaagtcttgagaactctggaattcatattactttttcgtatatctgtaaaatcttc

SEQ ID NO: 8624 - DNA, 1714 bp, Cicer arietinum
attagttattagtattaatgaattgaattgaatgccacaatgtcccaacggtccaacctccctacttaattctgttgattttcctgctcatctaccttacctgttatttgttactaccatacccacactactctctctctctctctctctccttaacttcagccatgctcttctctctatcttcataaacctctctctctctctctctctctattaccaaacaacccttaatcataccaatatggattgctgtataatcagtaagctcaagactcaacctttctggttcattatcctcttcgccctcggtctcctcaccattctcagattcactctaacatttctcaattggctctatgtcaattttctcagaccctctaaagatctcaaaaaatacggatcttgggcactcgttactggacccaccgatggcattggaaaaagtttcgcctttcaacttgctagcaaaggcttgaacctaatcctcgttggacgaaaccccgacaagctcaaagacgtttcggattcaattcaagccaagttcggaaatactcaagttaaaacaattgtagttgatttcgcaggtgatctcgacgagggtgttcagcgaattcgagaaacgattgaagggttggatattggggttttgattaacaacgtgggaatttcgtacccttatgccaaattcttccatgaagtggacgaagagcttttgaagaatcttattaaggttaatgttgttggaactactaaggttactcaagctgttttgcctgggatgttgaagaggaagaaaggagcaattgttaacattggttctggagctgctattgttattccttctgatccactttatgctgtttatgctgccacaaaagcgtatattgatcagttttcaagatctctctatgttgaatacaagaagagtgggattgatgtacagtgtcaggttccattatatgtggccacaaaaatggcatcaatcaagaaatcttcattctttgtcccatcaacggacggctatgcaaaagcaggtgtgagatggataggatatgaacctcgttgcacgccatactggcctcatacccttctttgggccgtggcatactcgttgcctgagttcatagttgatgcttggcgtctgcagttttgtattggtattagaaagaggggactgctgaaagattcaaggaagaaggattgaaaggatgtttgattgtttgtaatgtgtaggcatagatgttgctgataactgcaggctgctgcaagtagattaagattccaagttgtttgttatgtttctagttttactcttaattaatgttgctggtcttaatgagtatcagttatgtgtccctactcttttttcttctcacattccgtttgtgtttctgttctctgttaattgataactggtattctaaattgtgagcatttctgttccattatctcatgttctcccatccacagccattaaccacgttgctgagagcctcagacaacattctcaccccccatcgatcacacaacctccgtgtttagcaaaccatcactcagtttttctcatctcgcttcaccgcattgtttcgtttaattgatattggacaatattctttaaaatataaatgattgacaatttctttgactatagaatttttcaaggacaatcctagttcaacatattgaattttatgaatggacaaataaatcgccg
